United States Patent 8,952,217 (PROCESS FOR DECREASING VERBASCOSE IN A PLANT BY EXPRESSION OF A CHLOROPLAST-TARGETED FIMD PROTEIN) - sequence listing, part 13

SEQ ID NO: 69761 - protein, 434 aa, Nitrobacter hamburgensis X14; identical to SEQ ID NO: 14110

SEQ ID NO: 69762 - DNA, 1308 bp, Paracoccus denitrificans PD1222; identical to SEQ ID NO: 14111
  CDS (1)..(1308): transl_table=11

SEQ ID NO: 69763 - protein, 435 aa, Paracoccus denitrificans PD1222; identical to SEQ ID NO: 14112

SEQ ID NO: 69764 - DNA, 1230 bp, Pseudomonas fluorescens; identical to SEQ ID NO: 14113
  CDS (1)..(1230): transl_table=11

SEQ ID NO: 69765 - protein, 409 aa, Pseudomonas fluorescens; identical to SEQ ID NO: 14114

SEQ ID NO: 69766 - DNA, 1215 bp, Pseudomonas fluorescens; identical to SEQ ID NO: 14115
  CDS (1)..(1215): transl_table=11

SEQ ID NO: 69767 - protein, 404 aa, Pseudomonas fluorescens; identical to SEQ ID NO: 14116

SEQ ID NO: 69768 - DNA, 1443 bp, Staphylococcus haemolyticus; identical to SEQ ID NO: 14117
  CDS (1)..(1443): transl_table=11

SEQ ID NO: 69769 - protein, 480 aa, Staphylococcus haemolyticus; identical to SEQ ID NO: 14118

SEQ ID NO: 69770 - DNA, 1245 bp, Leishmania major; identical to SEQ ID NO: 14119
  CDS (1)..(1245)

SEQ ID NO: 69771 - protein, 414 aa, Leishmania major; identical to SEQ ID NO: 14120

SEQ ID NO: 69772 - DNA, 1380 bp, Gibberella moniliformis; identical to SEQ ID NO: 14121
  CDS (1)..(1380)

SEQ ID NO: 69773 - protein, 459 aa, Gibberella moniliformis; identical to SEQ ID NO: 14122

SEQ ID NO: 69774 - DNA, 1233 bp, Schizosaccharomyces pombe; identical to SEQ ID NO: 14123
  CDS (1)..(1233)

SEQ ID NO: 69775 - protein, 410 aa, Schizosaccharomyces pombe; identical to SEQ ID NO: 14124

SEQ ID NO: 69776 - DNA, 1290 bp, Saccharomyces cerevisiae; identical to SEQ ID NO: 14125
  CDS (1)..(1290)

SEQ ID NO: 69777 - protein, 429 aa, Saccharomyces cerevisiae; identical to SEQ ID NO: 14126

SEQ ID NO: 69778 - DNA, 1200 bp, Pseudomonas aeruginosa; identical to SEQ ID NO: 14127
  CDS (1)..(1200): transl_table=11

SEQ ID NO: 69779 - protein, 399 aa, Pseudomonas aeruginosa; identical to SEQ ID NO: 14128

SEQ ID NO: 69780 - DNA, 1197 bp, Pseudomonas aeruginosa; identical to SEQ ID NO: 14129
  CDS (1)..(1197): transl_table=11

SEQ ID NO: 69781 - protein, 398 aa, Pseudomonas aeruginosa; identical to SEQ ID NO: 14130

SEQ ID NO: 69782 - DNA, 1224 bp, Acinetobacter sp; identical to SEQ ID NO: 14131
  CDS (1)..(1224): transl_table=11

SEQ ID NO: 69783 - protein, 407 aa, Acinetobacter sp; identical to SEQ ID NO: 14132

SEQ ID NO: 69784 - DNA, 1218 bp, Bordetella pertussis; identical to SEQ ID NO: 14133
  CDS (1)..(1218): transl_table=11

SEQ ID NO: 69785 - protein, 405 aa, Bordetella pertussis; identical to SEQ ID NO: 14134

SEQ ID NO: 69786 - DNA, 1305 bp, Brucella melitensis; identical to SEQ ID NO: 14135
  CDS (1)..(1305): transl_table=11

SEQ ID NO: 69787 - protein, 434 aa, Brucella melitensis; identical to SEQ ID NO: 14136

SEQ ID NO: 69788 - DNA, 1305 bp, Brucella suis; identical to SEQ ID NO: 14137
  CDS (1)..(1305)

SEQ ID NO: 69789 - protein, 434 aa, Brucella suis; identical to SEQ ID NO: 14138

SEQ ID NO: 69790 - DNA, 1200 bp, Buchnera aphidicola; identical to SEQ ID NO: 14139
  CDS (1)..(1200): transl_table=11

SEQ ID NO: 69791 - protein, 399 aa, Buchnera aphidicola; identical to SEQ ID NO: 14140

SEQ ID NO: 69792 - DNA, 1197 bp, Buchnera aphidicola; identical to SEQ ID NO: 14141
  CDS (1)..(1197): transl_table=11

SEQ ID NO: 69793 - protein, 398 aa, Buchnera aphidicola; identical to SEQ ID NO: 14142

SEQ ID NO: 69794 - DNA, 1200 bp, Burkholderia mallei; identical to SEQ ID NO: 14143
  CDS (1)..(1200): transl_table=11

SEQ ID NO: 69795 - protein, 399 aa, Burkholderia mallei; identical to SEQ ID NO: 14144

SEQ ID NO: 69796 - DNA, 1209 bp, Chromobacterium violaceum; identical to SEQ ID NO: 14145
  CDS (1)..(1209): transl_table=11

SEQ ID NO: 69797 - protein, 402 aa, Chromobacterium violaceum; identical to SEQ ID NO: 14146

SEQ ID NO: 69798 - DNA, 1206 bp, Erwinia carotovora; identical to SEQ ID NO: 14147
  CDS (1)..(1206): transl_table=11

SEQ ID NO: 69799 - protein, 401 aa, Erwinia carotovora; identical to SEQ ID NO: 14148

SEQ ID NO: 69800 - DNA, 1215 bp, Methanosarcina acetivorans; identical to SEQ ID NO: 14149
  CDS (1)..(1215): transl_table=11

SEQ ID NO: 69801 - protein, 404 aa, Methanosarcina acetivorans; identical to SEQ ID NO: 14150

SEQ ID NO: 69802 - DNA, 1209 bp, Neisseria gonorrhoeae; identical to SEQ ID NO: 14151
  CDS (1)..(1209)

SEQ ID NO: 69803 - protein, 402 aa, Neisseria gonorrhoeae; identical to SEQ ID NO: 14152

SEQ ID NO: 69804 - DNA, 1209 bp, Neisseria meningitidis; identical to SEQ ID NO: 14153
  CDS (1)..(1209)

SEQ ID NO: 69805 - protein, 402 aa, Neisseria meningitidis; identical to SEQ ID NO: 14154

SEQ ID NO: 69806 - DNA, 1209 bp, Neisseria meningitidis; identical to SEQ ID NO: 14155
  CDS (1)..(1209): transl_table=11

SEQ ID NO: 69807 - protein, 402 aa, Neisseria meningitidis; identical to SEQ ID NO: 14156

SEQ ID NO: 69808 - DNA, 1215 bp, Photorhabdus luminescens; identical to SEQ ID NO: 14157
  CDS (1)..(1215): transl_table=11

SEQ ID NO: 69809 - protein, 404 aa, Photorhabdus luminescens; identical to SEQ ID NO: 14158

SEQ ID NO: 69810 - DNA, 1218 bp, Photobacterium profundum; identical to SEQ ID NO: 14159
  CDS (1)..(1218): transl_table=11

SEQ ID NO: 69811 - protein, 405 aa, Photobacterium profundum; identical to SEQ ID NO: 14160

SEQ ID NO: 69812 - DNA, 1170 bp, Ralstonia solanacearum; identical to SEQ ID NO: 14161
  CDS (1)..(1170)

SEQ ID NO: 69813 - protein, 389 aa, Ralstonia solanacearum; identical to SEQ ID NO: 14162

SEQ ID NO: 69814 - DNA, 1305 bp, Rhizobium loti; identical to SEQ ID NO: 14163
  CDS (1)..(1305): transl_table=11

SEQ ID NO: 69815 - protein, 434 aa, Rhizobium loti; identical to SEQ ID NO: 14164

SEQ ID NO: 69816 - DNA, 1305 bp, Rhizobium meliloti; identical to SEQ ID NO: 14165
  CDS (1)..(1305): transl_table=11

SEQ ID NO: 69817 - protein, 434 aa, Rhizobium meliloti; identical to SEQ ID NO: 14166

SEQ ID NO: 69818 - DNA, 1203 bp, Salmonella choleraesuis; identical to SEQ ID NO: 14167
  CDS (1)..(1203)

SEQ ID NO: 69819 - protein, 400 aa, Salmonella choleraesuis; identical to SEQ ID NO: 14168

SEQ ID NO: 69820 - DNA, 1203 bp, Salmonella paratyphi; identical to SEQ ID NO: 14169
  CDS (1)..(1203): transl_table=11

SEQ ID NO: 69821 - protein, 400 aa, Salmonella paratyphi; identical to SEQ ID NO: 14170

SEQ ID NO: 69822 - DNA, 1308 bp, Vibrio cholerae; identical to SEQ ID NO: 14171
  CDS (1)..(1308): transl_table=11

SEQ ID NO: 69823 - protein, 435 aa, Vibrio cholerae; identical to SEQ ID NO: 14172

SEQ ID NO: 69824 - DNA, 1311 bp, Vibrio parahaemolyticus; identical to SEQ ID NO: 14173
  CDS (1)..(1311): transl_table=11

SEQ ID NO: 69825 - protein, 436 aa, Vibrio parahaemolyticus; identical to SEQ ID NO: 14174

SEQ ID NO: 69826 - DNA, 1314 bp, Vibrio vulnificus; identical to SEQ ID NO: 14175
  CDS (1)..(1314): transl_table=11

SEQ ID NO: 69827 - protein, 437 aa, Vibrio vulnificus; identical to SEQ ID NO: 14176

SEQ ID NO: 69828 - DNA, 1314 bp, Vibrio vulnificus; identical to SEQ ID NO: 14177
  CDS (1)..(1314): transl_table=11

SEQ ID NO: 69829 - protein, 437 aa, Vibrio vulnificus; identical to SEQ ID NO: 14178

SEQ ID NO: 69830 - DNA, 1179 bp, Xanthomonas axonopodis; identical to SEQ ID NO: 14179
  CDS (1)..(1179): transl_table=11

SEQ ID NO: 69831 - protein, 392 aa, Xanthomonas axonopodis; identical to SEQ ID NO: 14180

SEQ ID NO: 69832 - DNA, 1197 bp, Xanthomonas campestris; identical to SEQ ID NO: 14181
  CDS (1)..(1197): transl_table=11

SEQ ID NO: 69833 - protein, 398 aa, Xanthomonas campestris; identical to SEQ ID NO: 14182

SEQ ID NO: 69834 - DNA, 1185 bp, Xylella fastidiosa; identical to SEQ ID NO: 14183
  CDS (1)..(1185): transl_table=11

SEQ ID NO: 69835 - protein, 394 aa, Xylella fastidiosa; identical to SEQ ID NO: 14184

SEQ ID NO: 69836 - DNA, 1185 bp, Xylella fastidiosa; identical to SEQ ID NO: 14185
  CDS (1)..(1185): transl_table=11

SEQ ID NO: 69837 - protein, 394 aa, Xylella fastidiosa; identical to SEQ ID NO: 14186

SEQ ID NO: 69838 - DNA, 24 bp, Artificial sequence
  (1)..(24): primer
atgacacaattcgcttctcctgtt

SEQ ID NO: 69839 - DNA, 26 bp, Artificial sequence
  (1)..(26): primer
ttaactggcttttttaatatgcggaa

SEQ ID NO: 69840 - protein, 581 aa, Artificial sequence; identical to SEQ ID NO: 14189
  Variant (3)..(3): xaa in position 3 is any amino acid
  Variant (20)..(22): xaa in position 20 to 22 is any amino acid
  Variant (23)..(24): xaa in position 23 to 24 is any or no amino acid
  Variant (27)..(29): xaa in position 27 to 29 is any amino acid
  Variant (31)..(31): xaa in position 31 is any amino acid
  Variant (33)..(33): xaa in position 33 is any amino acid
  Variant (35)..(36): xaa in position 35 to 36 is any amino acid
  Variant (38)..(42): xaa in position 38 to 42 is any amino acid
  Variant (43)..(53): xaa in position 43 to 53 is any or no amino acid
  Variant (56)..(57): xaa in position 56 to 57 is any amino acid
  Variant (60)..(60): xaa in position 60 is any amino acid
  Variant (62)..(63): xaa in position 62 to 63 is any amino acid
  Variant (68)..(68): xaa in position 68 is any amino acid
  Variant (72)..(72): xaa in position 72 is any amino acid
  Variant (75)..(76): xaa in position 75 to 76 is any amino acid
  Variant (78)..(78): xaa in position 78 is any amino acid
  Variant (80)..(88): xaa in position 80 to 88 is any or no amino acid
  Variant (95)..(96): xaa in position 95 to 96 is any amino acid
  Variant (100)..(103): xaa in position 100 to 103 is any amino acid
  Variant (105)..(105): xaa in position 105 is any amino acid
  Variant (107)..(109): xaa in position 107 to 109 is any amino acid
  Variant (110)..(126): xaa in position 110 to 126 is any or no amino acid
  Variant (128)..(128): xaa in position 128 is any or no amino acid
  Variant (130)..(130): xaa in position 130 is any or no amino acid
  Variant (132)..(132): xaa in position 132 is any or no amino acid
  Variant (134)..(134): xaa in position 134 is any or no amino acid
  Variant (136)..(137): xaa in position 136 to 137 is any amino acid
  Variant (138)..(138): xaa in position 138 is any or no amino acid
  Variant (153)..(154): xaa in position 153 to 154 is any amino acid
  Variant (156)..(156): xaa in position 156 is any amino acid
  Variant (158)..(161): xaa in position 158 to 161 is any amino acid
  Variant (162)..(162): xaa in position 162 is any or no amino acid
  Variant (164)..(172): xaa in position 164 to 172 is any amino acid
  Variant (174)..(176): xaa in position 174 to 176 is any amino acid
  Variant (178)..(183): xaa in position 178 to 183 is any amino acid
  Variant (184)..(198): xaa in position 184 to 198 is any or no amino acid
  Variant (208)..(208): xaa in position 208 is any amino acid
  Variant (210)..(212): xaa in position 210 to 212 is any amino acid
  Variant (214)..(215): xaa in position 214 to 215 is any amino acid
  Variant (218)..(218): xaa in position 218 is any amino acid
  Variant (221)..(222): xaa in position 221 to 222 is any amino acid
  Variant (224)..(224): xaa in position 224 is any amino acid
  Variant (225)..(236): xaa in position 225 to 236 is any or no amino acid
  Variant (238)..(238): xaa in position 238 is any or no amino acid
  Variant (244)..(245): xaa in position 244 to 245 is any amino acid
  Variant (250)..(250): xaa in position 250 is any amino acid
  Variant (252)..(252): xaa in position 252 is any amino acid
  Variant (263)..(263): xaa in position 263 is any amino acid
  Variant (265)..(266): xaa in position 265 to 266 is any amino acid
  Variant (269)..(270): xaa in position 269 to 270 is any amino acid
  Variant (271)..(288): xaa in position 271 to 288 is any or no amino acid
  Variant (290)..(291): xaa in position 290 to 291 is any amino acid
  Variant (294)..(295): xaa in position 294 to 295 is any amino acid
  Variant (298)..(299): xaa in position 298 to 299 is any amino acid
  Variant (302)..(303): xaa in position 302 to 303 is any amino acid
  Variant (305)..(305): xaa in position 305 is any amino acid
  Variant (306)..(316): xaa in position 306 to 316 is any or no amino acid
  Variant (318)..(318): xaa in position 318 is any amino acid
  Variant (326)..(329): xaa in position 326 to 329 is any amino acid
  Variant (334)..(334): xaa in position 334 is any amino acid
  Variant (337)..(337): xaa in position 337 is any amino acid
  Variant (338)..(391): xaa in position 338 to 391 is any or no amino acid
  Variant (394)..(394): xaa in position 394 is any amino acid
  Variant (397)..(397): xaa in position 397 is any amino acid
  Variant (401)..(401): xaa in position 401 is any amino acid
  Variant (407)..(408): xaa in position 407 to 408 is any amino acid
  Variant (416)..(416): xaa in position 416 is any amino acid
  Variant (418)..(418): xaa in position 418 is any amino acid
  Variant (419)..(427): xaa in position 419 to 427 is any or no amino acid
  Variant (430)..(430): xaa in position 430 is any amino acid
  Variant (433)..(442): xaa in position 433 to 442 is any or no amino acid
  Variant (453)..(453): xaa in position 453 is any amino acid
  Variant (455)..(455): xaa in position 455 is any amino acid
  Variant (457)..(457): xaa in position 457 is any amino acid
  Variant (459)..(459): xaa in position 459 is any amino acid
  Variant (461)..(466): xaa in position 461 to 466 is any amino acid
  Variant (468)..(474): xaa in position 468 to 474 is any or no amino acid
  Variant (484)..(484): xaa in position 484 is any amino acid
  Variant (489)..(491): xaa in position 489 to 491 is any amino acid
  Variant (492)..(531): xaa in position 492 to 531 is any or no amino acid
  Variant (541)..(542): xaa in position 541 to 542 is any amino acid
  Variant (545)..(545): xaa in position 545 is any amino acid
  Variant (553)..(553): xaa in position 553 is any amino acid
  Variant (557)..(557): xaa in position 557 is any amino acid
  Variant (559)..(560): xaa in position 559 to 560 is any amino acid
  Variant (561)..(575): xaa in position 561 to 575 is any or no amino acid
  Variant (578)..(579): xaa in position 578 to 579 is any amino acid

SEQ ID NO: 69841 - protein, 10 aa, Artificial sequence
  Variant (2)..(2): xaa in position 2 is any amino acid
  Variant (3)..(3): xaa in position 3 is Asn or Thr
  Variant (5)..(5): xaa in position 5 is any amino acid
  Variant (7)..(7): xaa in position 7 is any amino acid
  Variant (8)..(8): xaa in position 8 is Phe, Ile, Leu or Val
  Variant (9)..(9): xaa in position 9 is any amino acid
LXXDXYXXXM

SEQ ID NO: 69842 - protein, 25 aa, Artificial sequence
  Variant (2)..(4): xaa in position 2 to 4 is any or no amino acid
  Variant (8)..(10): xaa in position 8 to 10 is any amino acid
  Variant (11)..(11): xaa in position 11 is Ala or Gly
  Variant (12)..(14): xaa in position 12 to 14 is any amino acid
  Variant (15)..(15): xaa in position 15 is Ala, Asp, Glu, Gly, Asn, Gln or Ser
  Variant (16)..(19): xaa in position 16 to 19 is any amino acid
  Variant (22)..(22): xaa in position 22 is any amino acid
  Variant (25)..(25): xaa in position 25 is Ala, Glu, Gln or Ser
GXXXTSNXXXXXXXXXXXXGTXAHX

SEQ ID NO: 69843 - DNA, 819 bp, Escherichia coli; identical to SEQ ID NO: 46342
  CDS (1)..(819)

SEQ ID NO: 69844 - protein, 272 aa, Escherichia coli; identical to SEQ ID NO: 46343

SEQ ID NO: 69845 - DNA, 774 bp, Thermoplasma volcanium GSS1; identical to SEQ ID NO: 46344
  CDS (1)..(774): transl_table=11

SEQ ID NO: 69846 - protein, 257 aa, Thermoplasma volcanium GSS1; identical to SEQ ID NO: 46345

SEQ ID NO: 69847 - DNA, 870 bp, Vibrio cholerae O1 biovar eltor str. N16961; identical to SEQ ID NO: 46346
  CDS (1)..(870): transl_table=11

SEQ ID NO: 69848 - protein, 289 aa, Vibrio cholerae O1 biovar eltor str. N16961; identical to SEQ ID NO: 46347

SEQ ID NO: 69849 - DNA, 867 bp, Pseudomonas aeruginosa PAO1; identical to SEQ ID NO: 46348
  CDS (1)..(867): transl_table=11

SEQ ID NO: 69850 - protein, 288 aa, Pseudomonas aeruginosa PAO1; identical to SEQ ID NO: 46349

SEQ ID NO: 69851 - DNA, 798 bp, Deinococcus radiodurans R1; identical to SEQ ID NO: 46350
  CDS (1)..(798): transl_table=11

SEQ ID NO: 69852 - protein, 265 aa, Deinococcus radiodurans R1; identical to SEQ ID NO: 46351

SEQ ID NO: 69853 - DNA, 723 bp, Thermoplasma acidophilum DSM 1728; identical to SEQ ID NO: 46352
  CDS (1)..(723): transl_table=11

SEQ ID NO: 69854 - protein, 240 aa, Thermoplasma acidophilum DSM 1728; identical to SEQ ID NO: 46353

SEQ ID NO: 69855 - DNA, 843 bp, Listeria monocytogenes EGD-e; identical to SEQ ID NO: 46354
  CDS (1)..(843): transl_table=11

SEQ ID NO: 69856 - protein, 280 aa, Listeria monocytogenes EGD-e; identical to SEQ ID NO: 46355

SEQ ID NO: 69857 - DNA, 846 bp, Listeria innocua Clip11262; identical to SEQ ID NO: 46356
  CDS (1)..(846): transl_table=11

SEQ ID NO: 69858 - protein, 281 aa, Listeria innocua Clip11262; identical to SEQ ID NO: 46357

SEQ ID NO: 69859 - DNA, 855 bp, Nostoc sp. PCC 7120; identical to SEQ ID NO: 46358
  CDS (1)..(855): transl_table=11

SEQ ID NO: 69860 - protein, 284 aa, Nostoc sp. PCC 7120; identical to SEQ ID NO: 46359

SEQ ID NO: 69861 - DNA, 771 bp, Agrobacterium tumefaciens str. C58; identical to SEQ ID NO: 46360
  CDS (1)..(771): transl_table=11

SEQ ID NO: 69862 - protein, 256 aa, Agrobacterium tumefaciens str. C58; identical to SEQ ID NO: 46361

SEQ ID NO: 69863 - DNA, 741 bp, Thermoanaerobacter tengcongensis MB4; identical to SEQ ID NO: 46362
  CDS (1)..(741): transl_table=11

SEQ ID NO: 69864 - protein, 246 aa, Thermoanaerobacter tengcongensis MB4; identical to SEQ ID NO: 46363

SEQ ID NO: 69865 - DNA, 768 bp, Streptomyces coelicolor A3(2); identical to SEQ ID NO: 46364
  CDS (1)..(768): transl_table=11

SEQ ID NO: 69866 - protein, 255 aa, Streptomyces coelicolor A3(2); identical to SEQ ID NO: 46365

SEQ ID NO: 69867 - DNA, 771 bp, Xanthomonas axonopodis pv. citri str. 306; identical to SEQ ID NO: 46366
  CDS (1)..(771): transl_table=11

SEQ ID NO: 69868 - protein, 256 aa, Xanthomonas axonopodis pv. citri str. 306; identical to SEQ ID NO: 46367

SEQ ID NO: 69869 - DNA, 909 bp, Xanthomonas axonopodis pv. citri str. 306; identical to SEQ ID NO: 46368
  CDS (1)..(909): transl_table=11

SEQ ID NO: 69870 - protein, 302 aa, Xanthomonas axonopodis pv. citri str. 306; identical to SEQ ID NO: 46369

SEQ ID NO: 69871 - DNA, 816 bp, Yersinia pestis KIM; identical to SEQ ID NO: 46370
  CDS (1)..(816): transl_table=11

SEQ ID NO: 69872 - protein, 271 aa, Yersinia pestis KIM; identical to SEQ ID NO: 46371

SEQ ID NO: 69873 - DNA, 870 bp, Pseudomonas putida KT2440; identical to SEQ ID NO: 46372
  CDS (1)..(870): transl_table=11

SEQ ID NO: 69874 - protein, 289 aa, Pseudomonas putida KT2440; identical to SEQ ID NO: 46373

SEQ ID NO: 69875 - DNA, 882 bp, Vibrio vulnificus CMCP6; identical to SEQ ID NO: 46374
  CDS (1)..(882): transl_table=11

SEQ ID NO: 69876 - protein, 293 aa, Vibrio vulnificus CMCP6; identical to SEQ ID NO: 46375

SEQ ID NO: 69877 - DNA, 765 bp, Bradyrhizobium japonicum USDA 110; identical to SEQ ID NO: 46376
  CDS (1)..(765): transl_table=11

SEQ ID NO: 69878 - protein, 254 aa, Bradyrhizobium japonicum USDA 110; identical to SEQ ID NO: 46377

SEQ ID NO: 69879 - DNA, 738 bp, Shewanella oneidensis MR-1; identical to SEQ ID NO: 46378
  CDS (1)..(738): transl_table=11

SEQ ID NO: 69880 - protein, 245 aa, Shewanella oneidensis MR-1; identical to SEQ ID NO: 46379

SEQ ID NO: 69881 - DNA, 843 bp, Lactobacillus plantarum WCFS1; identical to SEQ ID NO: 46380
  CDS (1)..(843): transl_table=11

SEQ ID NO: 69882 - protein, 280 aa, Lactobacillus plantarum WCFS1; identical to SEQ ID NO: 46381

SEQ ID NO: 69883 - DNA, 870 bp, Pseudomonas syringae pv. tomato str. DC3000; identical to SEQ ID NO: 46382
  CDS (1)..(870): transl_table=11

SEQ ID NO: 69884 - protein, 289 aa, Pseudomonas syringae pv. tomato str. DC3000; identical to SEQ ID NO: 46383

SEQ ID NO: 69885 - DNA, 870 bp, Vibrio parahaemolyticus RIMD 2210633; identical to SEQ ID NO: 46384
  CDS (1)..(870): transl_table=11

SEQ ID NO: 69886 - protein, 289 aa, Vibrio parahaemolyticus RIMD 2210633; identical to SEQ ID NO: 46385

SEQ ID NO: 69887 - DNA, 834 bp, Enterococcus faecalis V583; identical to SEQ ID NO: 46386
  CDS (1)..(834): transl_table=11

SEQ ID NO: 69888 - protein, 277 aa, Enterococcus faecalis V583; identical to SEQ ID NO: 46387

SEQ ID NO: 69889 - DNA, 765 bp, Streptomyces avermitilis MA-4680; identical to SEQ ID NO: 46388
  CDS (1)..(765): transl_table=11

SEQ ID NO: 69890 - protein, 254 aa, Streptomyces avermitilis MA-4680; identical to SEQ ID NO: 46389

SEQ ID NO: 69891 - DNA, 924 bp, Rhodopirellula baltica SH 1; identical to SEQ ID NO: 46390
  CDS (1)..(924): transl_table=11

SEQ ID NO: 69892 - protein, 307 aa, Rhodopirellula baltica SH 1; identical to SEQ ID NO: 46391

SEQ ID NO: 69893 - DNA, 876 bp, Gloeobacter violaceus PCC 7421; identical to SEQ ID NO: 46392
  CDS (1)..(876): transl_table=11

SEQ ID NO: 69894 - protein, 291 aa, Gloeobacter violaceus PCC 7421; identical to SEQ ID NO: 46393

SEQ ID NO: 69895 - DNA, 882 bp, Vibrio vulnificus YJ016; identical to SEQ ID NO: 46394
  CDS (1)..(882): transl_table=11

SEQ ID NO: 69896 - protein, 293 aa, Vibrio vulnificus YJ016; identical to SEQ ID NO: 46395

SEQ ID NO: 69897 - DNA, 726 bp, Mycobacterium avium subsp. paratuberculosis K-10; identical to SEQ ID NO: 46396
  CDS (1)..(726): transl_table=11

SEQ ID NO: 69898 - protein, 241 aa, Mycobacterium avium subsp. paratuberculosis K-10; identical to SEQ ID NO: 46397

SEQ ID NO: 69899 - DNA, 843 bp, Listeria monocytogenes str. 4b F2365; identical to SEQ ID NO: 46398
  CDS (1)..(843): transl_table=11

SEQ ID NO: 69900 - protein, 280 aa, Listeria monocytogenes str. 4b F2365; identical to SEQ ID NO: 46399

SEQ ID NO: 69901 - DNA, 816 bp, Yersinia pseudotuberculosis IP 32953; identical to SEQ ID NO: 46400
  CDS (1)..(816): transl_table=11

SEQ ID NO: 69902 - protein, 271 aa, Yersinia pseudotuberculosis IP 32953; identical to SEQ ID NO: 46401

SEQ ID NO: 69903 - DNA, 840 bp, Nocardia farcinica IFM 10152; identical to SEQ ID NO: 46402
  CDS (1)..(840): transl_table=11

SEQ ID NO: 69904 - protein, 279 aa, Nocardia farcinica IFM 10152; identical to SEQ ID NO: 46403

SEQ ID NO: 69905 - DNA, 906 bp, Nocardia farcinica IFM 10152; identical to SEQ ID NO: 46404
  CDS (1)..(906): transl_table=11

SEQ ID NO: 69906 - protein, 301 aa, Nocardia farcinica IFM 10152; identical to SEQ ID NO: 46405

SEQ ID NO: 69907 - DNA, 891 bp, Photobacterium profundum SS9; identical to SEQ ID NO: 46406
  CDS (1)..(891): transl_table=11

SEQ ID NO: 69908 - protein, 296 aa, Photobacterium profundum SS9; identical to SEQ ID NO: 46407

SEQ ID NO: 69909 - DNA, 819 bp, Salmonella enterica subsp. enterica serovar Paratyphi A str. ATCC; identical to SEQ ID NO: 46408
  CDS (1)..(819): transl_table=11

SEQ ID NO: 69910 - protein, 272 aa, Salmonella enterica subsp. enterica serovar Paratyphi A str. ATCC; identical to SEQ ID NO: 46409

SEQ ID NO: 69911 - DNA, 873 bp, Synechococcus elongatus PCC 6301; identical to SEQ ID NO: 46410
  CDS (1)..(873): transl_table=11

SEQ ID NO: 69912 - protein, 290 aa, Synechococcus elongatus PCC 6301; identical to SEQ ID NO: 46411

SEQ ID NO: 69913 - DNA, 852 bp, Bacillus clausii KSM-K16; identical to SEQ ID NO: 46412
  CDS (1)..(852): transl_table=11

SEQ ID NO: 69914 - protein, 283 aa, Bacillus clausii KSM-K16; identical to SEQ ID NO: 46413

SEQ ID NO: 69915 - DNA, 852 bp, Xanthomonas oryzae pv. oryzae KACC10331; identical to SEQ ID NO: 46414
  CDS (1)..(852): transl_table=11

SEQ ID NO: 69916 - protein, 283 aa, Xanthomonas oryzae pv. oryzae KACC10331; identical to SEQ ID NO: 46415

SEQ ID NO: 69917 - DNA, 864 bp, Pseudomonas syringae pv. syringae B728a; identical to SEQ ID NO: 46416
  CDS (1)..(864): transl_table=11

SEQ ID NO: 69918 - protein, 287 aa, Pseudomonas syringae pv. syringae B728a; identical to SEQ ID NO: 46417

SEQ ID NO: 69919 - DNA, 735 bp, Pseudomonas syringae pv. syringae B728a; identical to SEQ ID NO: 46418
  CDS (1)..(735): transl_table=11

SEQ ID NO: 69920 - protein, 244 aa, Pseudomonas syringae pv. syringae B728a; identical to SEQ ID NO: 46419

SEQ ID NO: 69921 - DNA, 792 bp, Xanthomonas campestris pv. campestris str. 8004; identical to SEQ ID NO: 46420
  CDS (1)..(792): transl_table=11

SEQ ID NO: 69922 - protein, 263 aa, Xanthomonas campestris pv. campestris str. 8004; identical to SEQ ID NO: 46421

SEQ ID NO: 69923 - DNA, 900 bp, Xanthomonas campestris pv. campestris str. 8004; identical to SEQ ID NO: 46422
  CDS (1)..(900): transl_table=11

SEQ ID NO: 69924 - protein, 299 aa, Xanthomonas campestris pv. campestris str. 8004; identical to SEQ ID NO: 46423

SEQ ID NO: 69925 - DNA, 858 bp, Pseudomonas fluorescens Pf-5; identical to SEQ ID NO: 46424
  CDS (1)..(858): transl_table=11

SEQ ID NO: 69926 - protein, 285 aa, Pseudomonas fluorescens Pf-5; identical to SEQ ID NO: 46425

SEQ ID NO: 69927 - DNA, 864 bp, Pseudomonas syringae pv. phaseolicola 1448A; identical to SEQ ID NO: 46426
  CDS (1)..(864): transl_table=11

SEQ ID NO: 69928 - protein, 287 aa, Pseudomonas syringae pv. phaseolicola 1448A; identical to SEQ ID NO: 46427

SEQ ID NO: 69929 - DNA, 930 bp, Ralstonia eutropha JMP134; identical to SEQ ID NO: 46428
  CDS (1)..(930): transl_table=11

SEQ ID NO: 69930 - protein, 309 aa, Ralstonia eutropha JMP134; identical to SEQ ID NO: 46429

SEQ ID NO: 69931 - DNA, 915 bp, Nostoc punctiforme PCC 73102; identical to SEQ ID NO: 46430
  CDS (1)..(915)

SEQ ID NO: 69932 - protein, 304 aa, Nostoc punctiforme PCC 73102; identical to SEQ ID NO: 46431

SEQ ID NO: 69933 - DNA, 729 bp, Nostoc punctiforme PCC 73102; identical to SEQ ID NO: 46432
  CDS (1)..(729)

SEQ ID NO: 69934 - protein, 242 aa, Nostoc punctiforme PCC 73102; identical to SEQ ID NO: 46433

SEQ ID NO: 69935 - DNA, 789 bp, Pseudomonas aeruginosa UCBPP-PA14; identical to SEQ ID NO: 46434
  CDS (1)..(789)

SEQ ID NO: 69936 - protein, 262 aa, Pseudomonas aeruginosa UCBPP-PA14; identical to SEQ ID NO: 46435

SEQ ID NO: 69937 - DNA, 861 bp, Pseudomonas fluorescens PfO-1; identical to SEQ ID NO: 46436
  CDS (1)..(861)

SEQ ID NO: 69938 - protein, 286 aa, Pseudomonas fluorescens PfO-1; identical to SEQ ID NO: 46437

SEQ ID NO: 69939 - DNA, 882 bp, Cytophaga hutchinsonii; identical to SEQ ID NO: 46438
  CDS (1)..(882)

SEQ ID NO: 69940 - protein, 293 aa, Cytophaga hutchinsonii; identical to SEQ ID NO: 46439

SEQ ID NO: 69941 - DNA, 849 bp, Pediococcus pentosaceus ATCC 25745; identical to SEQ ID NO: 46440
  CDS (1)..(849)

SEQ ID NO: 69942 - protein, 282 aa, Pediococcus pentosaceus ATCC 25745; identical to SEQ ID NO: 46441

SEQ ID NO: 69943 - DNA, 939 bp, Pseudomonas aeruginosa UCBPP-PA14; identical to SEQ ID NO: 46442
  CDS (1)..(939)

SEQ ID NO: 69944 - protein, 312 aa, Pseudomonas aeruginosa UCBPP-PA14; identical to SEQ ID NO: 46443

SEQ ID NO: 69945 - DNA, 855 bp, Azotobacter vinelandii AvOP; identical to SEQ ID NO: 46444
  CDS (1)..(855): transl_table=11

SEQ ID NO: 69946 - protein, 284 aa, Azotobacter vinelandii AvOP; identical to SEQ ID NO: 46445

SEQ ID NO: 69947 - DNA, 870 bp, Chromohalobacter salexigens DSM 3043; identical to SEQ ID NO: 46446
  CDS (1)..(870): transl_table=11

SEQ ID NO: 69948 - protein, 289 aa, Chromohalobacter salexigens DSM 3043; identical to SEQ ID NO: 46447

SEQ ID NO: 69949 - DNA, 852 bp, Frankia sp. CcI3; identical to SEQ ID NO: 46448
  CDS (1)..(852): transl_table=11

SEQ ID NO: 69950 - protein, 283 aa, Frankia sp. CcI3; identical to SEQ ID NO: 46449

SEQ ID NO: 69951 - DNA, 852 bp, Frankia sp. EAN1pec; identical to SEQ ID NO: 46450
  CDS (1)..(852): transl_table=11

SEQ ID NO: 69952 - protein, 283 aa, Frankia sp. EAN1pec; identical to SEQ ID NO: 46451

SEQ ID NO: 69953 - DNA, 954 bp, Shewanella baltica OS155; identical to SEQ ID NO: 46452
  CDS (1)..(954): transl_table=11

SEQ ID NO: 69954 - protein, 317 aa, Shewanella baltica OS155; identical to SEQ ID NO: 46453

SEQ ID NO: 69955 - DNA, 942 bp, Shewanella amazonensis SB2B; identical to SEQ ID NO: 46454
  CDS (1)..(942): transl_table=11

SEQ ID NO: 69956 - protein, 313 aa, Shewanella amazonensis SB2B; identical to SEQ ID NO: 46455

SEQ ID NO: 69957 - DNA, 729 bp, Rubrobacter xylanophilus DSM 9941; identical to SEQ ID NO: 46456
  CDS (1)..(729): transl_table=11

SEQ ID NO: 69958 - protein, 242 aa, Rubrobacter xylanophilus DSM 9941; identical to SEQ ID NO: 46457

SEQ ID NO: 69959 - DNA, 906 bp, Shewanella frigidimarina NCIMB 400; identical to SEQ ID NO: 46458
  CDS (1)..(906): transl_table=11

SEQ ID NO: 69960 - protein, 301 aa, Shewanella frigidimarina NCIMB 400; identical to SEQ ID NO: 46459

SEQ ID NO: 69961 - DNA, 849 bp, Pseudoalteromonas haloplanktis TAC125; identical to SEQ ID NO: 46460
  CDS (1)..(849): transl_table=11

SEQ ID NO: 69962 - protein, 282 aa, Pseudoalteromonas haloplanktis TAC125; identical to SEQ ID NO: 46461

SEQ ID NO: 69963 - DNA, 726 bp, uncultured Acidobacteria bacterium; identical to SEQ ID NO: 46462
  CDS (1)..(726)

SEQ ID NO: 69964 - protein, 241 aa, uncultured Acidobacteria bacterium; identical to SEQ ID NO: 46463

SEQ ID NO: 69965 - DNA, 24 bp, Artificial sequence
  (1)..(24): primer
atgatttacatcggtctaccgcaa

SEQ ID NO: 69966 - DNA, 27 bp, Artificial sequence
  (1)..(27): primer
ttagaaaagagaagattgctgtggaat

SEQ ID NO: 69967 - protein, 325 aa, Artificial sequence; identical to SEQ ID NO: 46466
  Variant (3)..(5): xaa in position 3 to 5 is any amino acid
  Variant (7)..(18): xaa in position 7 to 18 is any amino acid
  Variant (19)..(36): xaa in position 19 to 36 is any or no amino acid
  Variant (38)..(39): xaa in position 38 to 39 is any amino acid
  Variant (42)..(46): xaa in position 42 to 46 is any amino acid
  Variant (49)..(49): xaa in position 49 is any amino acid
  Variant (55)..(64): xaa in position 55 to 64 is any amino acid
  Variant (65)..(65): xaa in position 65 is any or no amino acid
  Variant (67)..(73): xaa in position 67 to 73 is any amino acid
  Variant (75)..(75): xaa in position 75 is any amino acid
  Variant (77)..(78): xaa in position 77 to 78 is any amino acid
  Variant (80)..(83): xaa in position 80 to 83 is any amino acid
  Variant (87)..(89): xaa in position 87 to 89 is any amino acid
  Variant (91)..(99): xaa in position 91 to 99 is any amino acid
  Variant (100)..(106): xaa in position 100 to 106 is any or no amino acid
  Variant (108)..(113): xaa in position 108 to 113 is any amino acid
  Variant (115)..(116): xaa in position 115 to 116 is any amino acid
  Variant (117)..(122): xaa in position 117 to 122 is any or no amino acid
  Variant (125)..(129): xaa in position 125 to 129 is any amino acid
  Variant (133)..(155): xaa in position 133 to 155 is any amino acid
  Variant (156)..(161): xaa in position 156 to 161 is any or no amino acid
  Variant (164)..(164): xaa in position 164 is any amino acid
  Variant (166)..(168): xaa in position 166 to 168 is any amino acid
  Variant (171)..(175): xaa in position 171 to 175 is any amino acid
  Variant (176)..(182): xaa in position 176 to 182 is any or no amino acid
  Variant (184)..(193): xaa in position 184 to 193 is any amino acid
  Variant (195)..(209): xaa in position 195 to 209 is any amino acid
  Variant (210)..(233): xaa in position 210 to 233 is any or no amino acid
  Variant (236)..(237): xaa in position 236 to 237 is any amino acid
  Variant (239)..(254): xaa in position 239 to 254 is any amino acid
  Variant (255)..(273): xaa in position 255 to 273 is any or no amino acid
  Variant (275)..(282): xaa in position 275 to 282 is any amino acid
  Variant (283)..(302): xaa in position 283 to 302 is any or no amino acid
  Variant (304)..(313): xaa in position 304 to 313 is any amino acid
  Variant (315)..(317): xaa in position 315 to 317 is any amino acid
  Variant (319)..(324): xaa in position 319 to 324 is any amino acid

SEQ ID NO: 69968 - protein, 18 aa, Artificial sequence
  Variant (2)..(4): xaa in position 2 to 4 is any amino acid
  Variant (5)..(5): xaa in position 5 is Ala, Cys, Gly, Ser, Thr or Val
  Variant (6)..(10): xaa in position 6 to 10 is any amino acid
  Variant (13)..(13): xaa in position 13 is Gly, Ile, Leu or Val
  Variant (14)..(14): xaa in position 14 is Asp or Asn
  Variant (15)..(15): xaa in position 15 is any amino acid
  Variant (16)..(16): xaa in position 16 is Ala, Pro, Ser or Thr
LXXXXXXXXXVEXXXXFY

SEQ ID NO: 69969 - protein, 25 aa, Artificial sequence
  Variant (2)..(8): xaa in position 2 to 8 is any amino acid
  Variant (10)..(10): xaa in position 10 is any amino acid
  Variant (11)..(11): xaa in position 11 is Phe or Val
  Variant (12)..(13): xaa in position 12 to 13 is any amino acid
  Variant (15)..(18): xaa in position 15 to 18 is any amino acid
  Variant (19)..(19): xaa in position 19 is Phe, Ile, Leu or Val
  Variant (20)..(20): xaa in position 20 is Ser or Thr
  Variant (22)..(24): xaa in position 22 to 24 is any amino acid
WXXXXXXXFXXXXKXXXXXXHXXXL

SEQ ID NO: 69970 - protein, 13 aa, Artificial sequence
  Variant (2)..(9): xaa in position 2 to 9 is any amino acid
  Variant (10)..(10): xaa in position 10 is any or no amino acid
  Variant (12)..(12): xaa in position 12 is Phe or Leu
  Variant (13)..(13): xaa in position 13 is Pro or Ser
LXXXXXXXXXQXX

SEQ ID NO: 69971 - protein, 17 aa, Artificial sequence
  Variant (2)..(2): xaa in position 2 is any amino acid
  Variant (4)..(14): xaa in position 4 to 14 is any amino acid
  Variant (15)..(16): xaa in position 15 to 16 is any or no amino acid
EXRXXXXXXXXXXXXXL

SEQ ID NO: 69972 - DNA, 1119 bp, Escherichia coli
  CDS (1)..(1119)
atgggaaaaagcatagtcgttgtttctgcggtcaattttaccactggcggtccatttaccattttgaaaaaatttttggcagcaactaataataaagaaaatgtcagttttatcgcattagtccattctgctaaagagttaaaagaaagttatccatgggttaaattcattgagtttcctgaggttaaagggtcgtggctaaaacgtttgcactttgaatatgtagtttgtaaaaaactttcaaaagagctgaatgctacgcattggatttgtctgcatgatattacggccaatgtcgtcactaaaaaaagatatgtgtattgtcataaccctgcacctttttataaaggaattttattccgtgaaattcttatggagcctagctttttcttatttaaaatgctatacgggctgatatataaaataaacattaaaaaaaatactgcagtgtttgttcaacaattctggatgaaagaaaaatttatcaagaaatattctataaataacatcattgtcagtcggccagaaattaaattatctgataaaagccaacttactgatgatgattctcaatttaagaataacccttctgagttgacaatattttaccctgctgttccacgagtatttaaaaattacgagcttattattagtgcagcaaggaaattgaaagaacaatccaatattaaatttctgcttactatcagtggtacagaaaatgcgtatgcaaaatatattatcagtcttgcagaaggactggataatgttcatttcctcgggtacttggataaagaaaaaatcgatcattgttataatatttcagatatagtttgttttccctctaggttagaaacatggggattgccgttgtctgaagctaaagagcgaggtaagtgggtattagcatcagatttcccatttactagagaaactcttggtagttatgaaaagaaagctttttttgattctaataacgatgacatgttagttaaacttattattgacttcaaaaaaggtaacctcaaaaaagatatctctgatgcaaatttcatttatcgtaatgaaaatgtattagttgggtttgatgaactagttaattttattactgaagaacattga

SEQ ID NO: 69973 - protein, 372 aa, Escherichia coli
MGKSIVVVSAVNFTTGGPFTILKKFLAATNNKENVSFIALVHSAKELKESYPWVKFIEFPEVKGSWLKRLHFEYVVCKKLSKELNATHWICLHDITANVVTKKRYVYCHNPAPFYKGILFREILMEPSFFLFKMLYGLIYKINIKKNTAVFVQQFWMKEKFIKKYSINNIIVSRPEIKLSDKSQLTDDDSQFKNNPSELTIFYPAVPRVFKNYELIISAARKLKEQSNIKFLLTISGTENAYAKYIISLAEGLDNVHFLGYLDKEKIDHCYNISDIVCFPSRLETWGLPLSEAKERGKWVLASDFPFTRETLGSYEKKAFFDSNNDDMLVKLIIDFKKGNLKKDISDANFIYRNENVLVGFDELVNFITEEH

SEQ ID NO: 69974 - DNA, 1017 bp, Rickettsia prowazekii str. Madrid E
  CDS (1)..(1017): transl_table=11
atggatcaggaaaagtcgaaaatagtccaaagctttatattttatagtcctggtattcactcaggtggtggactagttttattaaaagagattttaaacgttaaagattttgttaataattgtaagtatatttatctagatgaaagagtaagaagtaaattaaatttctctcatttctttaaaaatattatttttataaaatcacgattattaggagaatggaaattaagaaaaaattgtgaaatgagtgatactgttttatgctttcatggattaccaccattatttcctataaaaagtaaggtaattgtatttttacaaaatagacttttattagaaccgttgaaaaataatcactactcaattttaatattaataaaaaagatttggttacgtttaggtttaaaatttaataatataagatatatagtacaaactgagtctatgctaagaattgctaaagagtttttagatcaagatattgatattgcagtactacctttttcacctaaaactattcaaaaaaatttaaatcatactaaaaaatatgattttttttatcctgcaagtggtgaggctcataaaaatcattttaatttacttaaagcatggaaaattttagctggtataggtataaaaccttctcttgctttaactataaatactgaattataccctgagcttttagagcaaatacaaacataccaattagatatagttaatttaggcgaaatatcttataacgaagtattagacttatatacacaagtttcagtagtaatttatccatcaaaatcagaatcactcggtttacctttaattgaggctacagtatataaaatacctattattgcatcagaacttgattatgttagggatgtatcaaaccctatagagacatttgatccaaattctcccatctcaattgtaagagcagtaagaagatttctaaataataatgagagtttaatagtgctaaattcagcagcagaatttttagaggttatttgtaaataa

SEQ ID NO: 69975 - protein, 338 aa, Rickettsia prowazekii str. Madrid E
MDQEKSKIVQSFIFYSPGIHSGGGLVLLKEILNVKDFVNNCKYIYLDERVRSKLNFSHFFKNIIFIKSRLLGEWKLRKNCEMSDTVLCFHGLPPLFPIKSKVIVFLQNRLLLEPLKNNHYSILILIKKIWLRLGLKFNNIRYIVQTESMLRIAKEFLDQDIDIAVLPFSPKTIQKNLNHTKKYDFFYPASGEAHKNHFNLLKAWKILAGIGIKPSLALTINTELYPELLEQIQTYQLDIVNLGEISYNEVLDLYTQVSVVIYPSKSESLGLPLIEATVYKIPIIASELDYVRDVSNPIETFDPNSPISIVRAVRRFLNNNESLIVLNSAAEFLEVICK

SEQ ID NO: 69976 - DNA, 1113 bp, Clostridium acetobutylicum ATCC 824
  CDS (1)..(1113): transl_table=11
atgacacaaaatttaagagtaataattgatgcgcgtatggttaataagcatctacatgggattgctcgatatacttatgaaataataaaacatatgtcatatgaagataatgtggagatgatactgctcgtgaatgatttagaagaagcaagtaaaatctttggtcaatttaataacataaaatttaaaaggatgagatctaagtttttatctatttttgaacaaattgaattgcctatgattgttaataagtataaaaatatggctatatttcattcgccttcttttgttgcaagcccgtttataaagtgtaagatgattatgacaatacatgatttgaatcatctaaaatttcctcaatattatacaccttttcataagtattattacaaatacatagtaaagaaatgtgcgttgaaaagtaaaaaaatattaactgtttctgaattttctaaggaggaaatttttaagtggataaagtgtgatagggataaaattaaagtcacgtataatggaattgatcctaaatttcatgtgataagtgatgcagagaaattaaaaaaaataaaagaaaaatataagttgccagatagatttattttatatatcggtaacttaaagccacataaaaatgttgaaacattagtaaaagctatgagatttattgacggcaaagttaaattggtaattaacggaacaataaataaatctataagtgagattttagacaaatttaatttgctcgagaaagttaaatttataggttatgttaatgaggatgaattaccactactgtataatttggctagcgtttttgtgtttccatcattatatgaaggatttgggctaccaccattagaggctgctgtgtgtggatgtaaagttattatctctgatatatcgtcattgagtgaaattatgagtgattatggagttaaggtgaatcctctagattcaaaaggaatggcaagagagattaaaaaaatattagaaaatagtagtatagatatttgtaataaagaaaaagaaacttttgttcaaaaatatagttggaataaaactagtagtaagacattagaaatttacaaagaaataaataaagaatttttgtga

SEQ ID NO: 69977 - protein, 370 aa, Clostridium acetobutylicum ATCC 824
MTQNLRVIIDARMVNKHLHGIARYTYEIIKHMSYEDNVEMILLVNDLEEASKIFGQFNNIKFKRMRSKFLSIFEQIELPMIVNKYKNMAIFHSPSFVASPFIKCKMIMTIHDLNHLKFPQYYTPFHKYYYKYIVKKCALKSKKILTVSEFSKEEIFKWIKCDRDKIKVTYNGIDPKFHVISDAEKLKKIKEKYKLPDRFILYIGNLKPHKNVETLVKAMRFIDGKVKLVINGTINKSISEILDKFNLLEKVKFIGYVNEDELPLLYNLASVFVFPSLYEGFGLPPLEAAVCGCKVIISDISSLSEIMSDYGVKVNPLDSKGMAREIKKILENSSIDICNKEKETFVQKYSWNKTSSKTLEIYKEINKEFL

SEQ ID NO: 69978 - DNA, 1056 bp, Methanosarcina acetivorans C2A
  CDS (1)..(1056): transl_table=11
atggaaatagattatataaacggcctgaaaacagatgagatattcgggatgtcaaaatatcaaagtgagattcataagaggttagaaaatgtaaaattaaatcggatagaatatcctaatatatcaaaagtaactggaattaataaaattgtagaatattctgtatatccatttattgtaaaaaaaaaagtaattaagaataatattaagcatgtgacccgtcaagatctagcatttctcctagtattgatgaaattaaaaagaaccatcgttacttgccacgacatcataccgatatcatattataagacccagagccctgtttggaaacttaatggaaaaggattaaggaaagcagaaaaaataataactgtatcagaattctccaaaaaggaaattggtaaatatataaaatatccggaagaaaatattgagatcatacatcccgcagtggatcataatttgtactatcgaaatagaaacaaaatgattttaaaaaaatatgggataaaggataacgagaaagtaattctctatgttggagccgaagagccgagaaaaaacgttcaatttataataaactcattcagcaacttaaagaaaagaattccagaagtaaaattattaaaagttgggatgccaaattatcctggagtaagaagaaaactcattcaacaaatagagtctttaaacctgcagaaagacattatctttgcagggtatgtatcggaactcgcattggcagaaatatacaatgctgtagacttgttcgtatttccatctttgtatgagggattcggaatacctcctttagaagcaatggcttgcggaacccccgtcataacctcaaacacatcctcactacctgaagttgtgggagatgctgcaattcagataaacccttatgatgttgagaaatttgctgaagagatgtatgaagtactgaccaatgagagactcaaagaagaaatgatcagaaaaggactggaaaggtcgaaaatgtttagctgggagaattcagcaaaaaaaacattgaaagtttacagagaaatgtaa

SEQ ID NO: 69979 - protein, 351 aa, Methanosarcina acetivorans C2A
MEIDYINGLKTDEIFGMSKYQSEIHKRLENVKLNRIEYPNISKVTGINKIVEYSVYPFIVKKKVIKNNIKHVTRQDLAFLLVLMKLKRTIVTCHDIIPISYYKTQSPVWKLNGKGLRKAEKIITVSEFSKKEIGKYIKYPEENIEIIHPAVDHNLYYRNRNKMILKKYGIKDNEKVILYVGAEEPRKNVQFIINSFSNLKKRIPEVKLLKVGMPNYPGVRRKLIQQIESLNLQKDIIFAGYVSELALAEIYNAVDLFVFPSLYEGFGIPPLEAMACGTPVITSNTSSLPEVVGDAAIQINPYDVEKFAEEMYEVLTNERLKEEMIRKGLERSKMFSWENSAKKTLKVYREM

SEQ ID NO: 69980 - DNA, 1122 bp, Bacteroides thetaiotaomicron VPI-5482
  CDS (1)..(1122): transl_table=11
atgggaaacaatgcaaaactcatagtcgtgtctgctgtcggattgcgtcagggaggtactttgactattctgaaagagtgcctgcaatatctttctacctgtgtacgtgaggggcatgtacgtgtgatagccattgtacacgacagaaggctcgcggagttcaacggcattgagtatattgaattgccggatgtcatcaaaagttggactcgccggttatggtgcgaatatataaccatgcaccgcatttctcaacgattacccgggattgatttatggctttcactgcatgacaccacccctcgtgtgatagccaaacgacaggcggtctattgccagacttcttttcctttttataagcggacgtggcgtgatttttatttcaactataagatagccctattttcactgttcacccgttatgcttacaggattaatgttcaccgtaatcagtatatgatagtacagcagtcatggctaagggagggacttagcaggatgttaggcgtgggcaaagagaaatttatcgtagcaccgccccgacgtatggcagtcaaagtggaaacggagagcgtgaatttgccttgtttcacattcctatatgcttccgcaccggactgtcacaagaatttcgaggtattatgtcaggccgccaggcttttggagaaggaaaaaggaaaaggctgttttaaagtggtggtcacgctgtccggaaaagaaaaccgttatacccgctggctttataaaaactggcacgatgtgaactcaatcgagtttgccggatatatgaataaggaaaagttatatggttactatcaggccgcacattgtttggtacatgcttccaaagtagaaacctggggcttgccgatttccgaattcggtgaaacgggcaaacccatgttacttgcagatcttccttatgctcatgctacagcttcgggctttcatgccgtaggctacttcaatgaacacaaaccggaagaattgaaaagacttatgaaagaaatgctggagggggatcataggtctctatcatcccaaccttcgactgccataaagggactctatgtgtgttcatggcgggaactgtttgaaaaattactgcctgcttccatttga

SEQ ID NO: 69981 - protein, 373 aa, Bacteroides thetaiotaomicron VPI-5482
MGNNAKLIVVSAVGLRQGGTLTILKECLQYLSTCVREGHVRVIAIVHDRRLAEFNGIEYIELPDVIKSWTRRLWCEYITMHRISQRLPGIDLWLSLHDTTPRVIAKRQAVYCQTSFPFYKRTWRDFYFNYKIALFSLFTRYAYRINVHRNQYMIVQQSWLREGLSRMLGVGKEKFIVAPPRRMAVKVETESVNLPCFTFLYASAPDCHKNFEVLCQAARLLEKEKGKGCFKVVVTLSGKENRYTRWLYKNWHDVNSIEFAGYMNKEKLYGYYQAAHCLVHASKVETWGLPISEFGETGKPMLLADLPYAHATASGFHAVGYFNEHKPEELKRLMKEMLEGDHRSLSSQPSTAIKGLYVCSWRELFEKLLPASI

SEQ ID NO: 69982 - DNA, 1113 bp, Bacteroides thetaiotaomicron VPI-5482
  CDS (1)..(1113): transl_table=11
atgagtagcaagcgaaagacgattgttgtctcagcggttagtttacgtaagggaggtacattaacgatattgcaagattgcttatgttatctttctgctttggcagccgacggcaattatcgggttattgcattggtacataaaagagaattggctgactatccgcacattgaatatattgaaatgccggacgttatcaaagggtggggacgacgtttgtggtgtgaatatgtgacaatgtataaattgtcacaaaaaataatgcctgtatatttatggctgtctcttcatgatgcgactccaagggtggtggctgaacgtcgggttgtctattgccagacttctttccctttttataaatggagttggagggattttctgtttgactataagattgttctatttgctttatttacccgttggatttatcggatcaatgtgcatcggaatacttacctgattgtacaacaggaatggttacgttccggattgagccggatgttgggggtaaaaaaagaaaagttcatagtagctcctccggaacgtaaagagaatgatgtgattgcagaaatagtagaactttcctgttttacattcttttatgctgccacaccagattgccataagaattttgagctgctatgcgacgctgcttctctgttggaacaagagcttggaaaaggaaggttcaaagtggtcttgactattagcggacaagaaaataaatatgcacagtggttatataaaaagttcggttcggtaagttcgatagagttcgcaggattcatgagcagagaaaaactttttggttattatcatgcagttgattgccttgtgtttccgtcaaaggtggaaacatggggattacccgtatctgaatttatggcaacgggtaagccgatgcttctagccgaccttccgtatgctcacgagactgccgctggaagtatgcaaactgcattttttaaattgtcggacccggttcaattaatgaatctgatgaaacggttatgtgaagatgactttacttttctaacgagtatcggtacttctgataaacgtttctcattcgcttcatcctggcgggaattattcgattctatattaaattaa

SEQ ID NO: 69983 - protein, 370 aa, Bacteroides thetaiotaomicron VPI-5482
MSSKRKTIVVSAVSLRKGGTLTILQDCLCYLSALAADGNYRVIALVHKRELADYPHIEYIEMPDVIKGWGRRLWCEYVTMYKLSQKIMPVYLWLSLHDATPRVVAERRVVYCQTSFPFYKWSWRDFLFDYKIVLFALFTRWIYRINVHRNTYLIVQQEWLRSGLSRMLGVKKEKFIVAPPERKENDVIAEIVELSCFTFFYAATPDCHKNFELLCDAASLLEQELGKGRFKVVLTISGQENKYAQWLYKKFGSVSSIEFAGFMSREKLFGYYHAVDCLVFPSKVETWGLPVSEFMATGKPMLLADLPYAHETAAGSMQTAFFKLSDPVQLMNLMKRLCEDDFTFLTSIGTSDKRFSFASSWRELFDSILN

SEQ ID NO: 69984 - DNA, 1014 bp, Staphylococcus haemolyticus JCSC1435
  CDS (1)..(1014): transl_table=11
ttggattatgtaggaaaagttggaggagctagttcgatttcaagacaattttatgaagatgttaaaaatgatgagaataatcaatggatttttttaacaaataaagagtatgtatcacaaaaaagtaatattaaaagaattttagtaaacaatgcaaataaaactttcttacatagattttattttgaaacttttaaaatacctaatattataaataatattaagccagatctagttttatcattacaaaatcttggagttaaacctaagcaaaatcaaattttatatattcatcaagcgctcccatttcaaaataagttatgggagttaagtaataatcctataagcttggttaaaatgctattaatgaaatacaaattgattaaagatataaaaaaatctaatcacataattgtgcaaaccaattatatgaaaaaattaattgaaaaatataataacaatataattgttaacttgccaaattttaattttgccagcccgcaaacacataaagatacaaaagactttttatatcccacaaatgcacaaaaatataaaggtttaaattatatcgttgatttcgctagaatattgaaaaaaaataaacaaaatgtgtatataaatttaactttgataggtaatgaaaataaatatattgaaaatataagaaaaattattaataaagagcaattagctataagattcattggaagacaaaatagtgatgaaatgaatgaactttataaactaaataatttactttttacctcccaagtagaaagtttgggcttacctttaattgaagcagctcattacggatgtaaaatatttgcatatgaaactgatgttactaaagaagtgcttaaaaattataaattcaaagtttttttcaataaatcaaatattgaaagtaaatataaagaatttttaagtttccctccaactactataggggaaaatataaatggtttaaacataaatggaattttgcgaacaaatcacataatcaaatag

SEQ ID NO: 69985 - protein, 337 aa, Staphylococcus haemolyticus JCSC1435
MDYVGKVGGASSISRQFYEDVKNDENNQWIFLTNKEYVSQKSNIKRILVNNANKTFLHRFYFETFKIPNIINNIKPDLVLSLQNLGVKPKQNQILYIHQALPFQNKLWELSNNPISLVKMLLMKYKLIKDIKKSNHIIVQTNYMKKLIEKYNNNIIVNLPNFNFASPQTHKDTKDFLYPTNAQKYKGLNYIVDFARILKKNKQNVYINLTLIGNENKYIENIRKIINKEQLAIRFIGRQNSDEMNELYKLNNLLFTSQVESLGLPLIEAAHYGCKIFAYETDVTKEVLKNYKFKVFFNKSNIESKYKEFLSFPPTTIGENINGLNINGILRTNHIIK

SEQ ID NO: 69986 - DNA, 1155 bp, Candidatus Pelagibacter ubique HTCC1062
  CDS (1)..(1155): transl_table=11
atgtcttcagaattaaaagtactgcaagtaattcctaaacttggatatgggggtgcagaaacaggctgttacgatcttgcacactatttaccagaaaataattgtggttcttatatagtaactagtggaggagagttattaaaatttattgataaaaaaaaagtaaaagtaataaaacttcccgtccatagtaaaaatccatttttaatgctctttaattcaatagctttgatttttattattttactaaataatatatctattgttcatgcaagaagtcgtgctccagcttggtcttgtttgtttgcaacaaaaattacaagaagaaagtttgttacaacttttcatggtacttataattttaaaaactcaattaaaaaattctataattcagtaatggttagatcagatttaataatagcaggatcaaattttattttttcacatattaatcaaaattatccaaaatttttagatttaaaaaaaaaattcttagtaatttttaggggaattaatgtcgattattttgaattatcaacaattttagacagtgaagaaaacagacttatttcagattgggaagttgatagaaataaaaaaacgatcctaatgccaggtcggttaactgcttggaaaggtcaggagacatttattgaggcattaaatcttgttaataaagaactgggctatgagtcttttaatgcagttattttgggtagcgatcaagaaagagacatttataccaaaaaaattaaaagattggctgagcaatataggctaactagtcagttaaaatttatagaacattgtaaaaatatgccgttagcctacaaaatatcagacattgttgtttcagcctcagtagaacctgaagcttttggaagggtagcagttgaagcccaatcaatggaaaaaccaataattgcaagtgatattgggggatctaatgaaactattatcgataacgtgacaggttttttatttcagtctggcaatgcagaagctttgagtaaaaaaataatagaagtcttacaattagacgaatctagattgaaatctattggtatagaaggtagaaaaaatataattaaaaaatttaatgttgaaaaaatgtgtttttctacatattcagaatacaaaaaattattgaattaa

SEQ ID NO: 69987 - protein, 384 aa, Candidatus Pelagibacter ubique HTCC1062
MSSELKVLQVIPKLGYGGAETGCYDLAHYLPENNCGSYIVTSGGELLKFIDKKKVKVIKLPVHSKNPFLMLFNSIALIFIILLNNISIVHARSRAPAWSCLFATKITRRKFVTTFHGTYNFKNSIKKFYNSVMVRSDLIIAGSNFIFSHINQNYPKFLDLKKKFLVIFRGINVDYFELSTILDSEENRLISDWEVDRNKKTILMPGRLTAWKGQETFIEALNLVNKELGYESFNAVILGSDQERDIYTKKIKRLAEQYRLTSQLKFIEHCKNMPLAYKISDIVVSASVEPEAFGRVAVEAQSMEKPIIASDIGGSNETIIDNVTGFLFQSGNAEALSKKIIEVLQLDESRLKSIGIEGRKNIIKKFNVEKMCFSTYSEYKKLLN

SEQ ID NO: 69988 - DNA, 1134 bp, Candidatus Pelagibacter ubique HTCC1062
  CDS (1)..(1134): transl_table=11
atgattaaaattctttattttttagaccatccaattcaatatcaaaatccatttttagacagaatatcactttcttcaaaaattaatttaaacgttatttatctatcagacttttctctaaaaccttatttcgacgaaggtttgaataaaactattaaattcgatgatattgaaaactttagtcacaaacatcaatttatatttaaagataaaaataaaagtaaaataaaatttttaattaggctcactaagatattgtttaaagaaaaacctaagtatttttgggtacatggatattctaatttttactcaatgtcatcaataattattgctcgtttgttaagtatcaaagttttgttaagaggtgaaagtagtaatttttttaaaaacaatttaaaatctaaaattagtatttttttattttttaaaataattgatccactaattacaaactatctagcaattggtaaaaaaaataaagaattctatcttaataatacaaaaaaaaatattcttaaacttccttacattgttggaaatttatctaaaaaaaaaataataaaaaaagaggatttaatgaatttaagaaaaaaaattcaaattaaacaaaactcttttataatattttataatgcaaaaatcatagatagaaaaaatccagagttattaattaagtcttttttaaaaatagagaaagcttgcaaaatcccagtgactttaattattgcgggagatggtaatattaaagatagattaattaatagatataaaaactttagaaatataaaatttgttggctttataaatcagaacttgttatgtcaattttatgctttatcagatttatttgttttgccatctaaatatgatgcttggggacttgtagtaaatgaagcaatgagtttttcaaaacctgttataacctcaaggaatgttatttcatcatacgatcttgtaaaacaaaacgtaaatggagttgcttttaataataaatttcatttagaacaatccataattaatattattaacaataaagatataagatataggtattcaaaaaactcaaagataattataaaaaattggagtatagaaacagctaataaatacttccataaaatatttgtaaaataa

SEQ ID NO: 69989 - protein, 377 aa, Candidatus Pelagibacter ubique HTCC1062
MIKILYFLDHPIQYQNPFLDRISLSSKINLNVIYLSDFSLKPYFDEGLNKTIKFDDIENFSHKHQFIFKDKNKSKIKFLIRLTKILFKEKPKYFWVHGYSNFYSMSSIIIARLLSIKVLLRGESSNFFKNNLKSKISIFLFFKIIDPLITNYLAIGKKNKEFYLNNTKKNILKLPYIVGNLSKKKIIKKEDLMNLRKKIQIKQNSFIIFYNAKIIDRKNPELLIKSFLKIEKACKIPVTLIIAGDGNIKDRLINRYKNFRNIKFVGFINQNLLCQFYALSDLFVLPSKYDAWGLVVNEAMSFSKPVITSRNVISSYDLVKQNVNGVAFNNKFHLEQSIINIINNKDIRYRYSKNSKIIIKNWSIETANKYFHKIFVK

SEQ ID NO: 69990 - DNA, 1134 bp, Rhodoferax ferrireducens DSM 15236
  CDS (1)..(1134): transl_table=11
ttggaaaggaatataggcatgccacgtatcgttgtttccgcagtaaatttcactgagggcgggccgctcacggtgctgcgtgagtgcctcgcatccgcggcggctgtgctccccgctgagttcgagatcatagccatagtaaatcgtgctgatctgatcaatgaaccgcgggttcgtttgatttcaattccgagttcaaagaaatcctggtttcataggctttactgggaatggtgcgggttcagtcgtatttcccacgaactaaagcccacgttgtggctatcgctgcacgacatcacgccgcgcgtgtcagctgctcgccaagcagtgtattgtcataatccttcgcccttttatcgcatcggtctacgtgaggctttgatggagccaacgttcctcatgttcaaccagttctacgctttgctgtaccgactcttcatccgtcgcaaccactgcgttatcgtgcagcaagactggcttcgcgccgagtttataaaacggatggggcagctccctgtggtcgtcgctcacccctcctttcgggctgccgagcgtcccagcgctccgaagcgtggaccggcattcgtctttatctatccagctctgccacgggtatttaagaacatcgagactttgtgcaaagcggcacagctattggtttcccggggggtcggcggcttcgaggtacggctgactcttgacggcagcgaaaatcgatacgctcgctggcttcgaaatcggtttggcgatacggcgcacgtccgatttataggccgacagactaaagatgagatggacgcccactatggtgaggcctccgcagtcgtgtttccgagcaagctggagacttgggggttgcccattaccgaaggcaaggcacaacggcggccgcttctcgtggccgatctcccatatgcacgggaaaccgttgggacctacgatctcgtgagctttttcccggccgaatcttctgaggcgcttgctgatctcatgcagtcgatgatcgagcaaacgtggcgaccgaccggcaacgaccatcctgaccccgcggctccgtttgcacccaattgggctagcctgtggggcatcctcattagcgggctgccgtctgcagcacagaactccggtgattga

SEQ ID NO: 69991 - protein, 377 aa, Rhodoferax ferrireducens DSM 15236
MERNIGMPRIVVSAVNFTEGGPLTVLRECLASAAAVLPAEFEIIAIVNRADLINEPRVRLISIPSSKKSWFHRLYWEWCGFSRISHELKPTLWLSLHDITPRVSAARQAVYCHNPSPFYRIGLREALMEPTFLMFNQFYALLYRLFIRRNHCVIVQQDWLRAEFIKRMGQLPVVVAHPSFRAAERPSAPKRGPAFVFIYPALPRVFKNIETLCKAAQLLVSRGVGGFEVRLTLDGSENRYARWLRNRFGDTAHVRFIGRQTKDEMDAHYGEASAVVFPSKLETWGLPITEGKAQRRPLLVADLPYARETVGTYDLVSFFPAESSEALADLMQSMIEQTWRPTGNDHPDPAAPFAPNWASLWGILISGLPSAAQNSGD

SEQ ID NO: 69992 - DNA, 1080 bp, Lactobacillus rhamnosus
  CDS (1)..(1080): transl_table=11
atgcattatgtcatcgtcgattttgtagtaaggcaaaattctggagggatattatcaatattacaagatgtcaataaatttgcgcttgaacatacagaagaccgttttacgtttatagttgggacagatggtctgatcactacttcgccaaacataaaggttattttgcgccctgatttgcagcgtaactacataaaaagaatttttttcgatttctggagaggtgctggtgtcattaattctttaaaaccggatgtggttatttctctacagaataccgccgttcttggagttaatgctcctgaaatgttatatgtgcaccaacctctcccgttcgaaacaaattataaatttagcttctttaaaagctcggagaggaaaatggctttttaccaaagtttagtgggcagtgttatcaaattgaacttaaggagttttcataagggggcaatcacggtacaaactcactggatgttggaagaagtacagaagtacgctaaaacaccaatttttgtaacgcgaccatctattgataaaaatgatttcaaaggtcagattttaggaagtaaaggaagcaatttcttttttccgagtactgcaatggtttataagaaccatcgaaatctagttgacgcctatgaaatgctttctgacgaagtaaggcgtgaacatcacttaatatttacgatctctagaaaggaatacggtcgtttgtacgggcaagtacctgatgattcgaatattaagtttctaggaaggattcctcgggctaaggtaatcgaaattttaaatcatagtatattagtctttccttcaaaaattgaaactctcgggttaccgcttattgaagcaatgatattgcaaagacagattgttgctgcaaatatcagcccggtcactgaagtaactagtgagtacgattcgattagttactttgatcctgatgatgtgaagtctatttacaactctctattggccggaataagaatgaatccttctaggagaagctttaaagagacaaatgacaatggttggcaggcattcttttctaatgtagaggcattgaatcatgcaaaatag

SEQ ID NO: 69993 - protein, 359 aa, Lactobacillus rhamnosus
MHYVIVDFVVRQNSGGILSILQDVNKFALEHTEDRFTFIVGTDGLITTSPNIKVILRPDLQRNYIKRIFFDFWRGAGVINSLKPDVVISLQNTAVLGVNAPEMLYVHQPLPFETNYKFSFFKSSERKMAFYQSLVGSVIKLNLRSFHKGAITVQTHWMLEEVQKYAKTPIFVTRPSIDKNDFKGQILGSKGSNFFFPSTAMVYKNHRNLVDAYEMLSDEVRREHHLIFTISRKEYGRLYGQVPDDSNIKFLGRIPRAKVIEILNHSILVFPSKIETLGLPLIEAMILQRQIVAANISPVTEVTSEYDSISYFDPDDVKSIYNSLLAGIRMNPSRRSFKETNDNGWQAFFSNVEALNHAK

SEQ ID NO: 69994 - DNA, 1080 bp, Lactobacillus rhamnosus
  CDS (1)..(1080): transl_table=11
atgcattatgtcatcgtcgattttgtagtaaggcaaaattctggagggatattatcaatattacaagatgtcaataaatttgcgcttgaacatacagaagaccgttttacgtttatagttgggacagatggtctgatcaatacttcgccaaacataaaggttattttgcgacctgatttgcagcgtaactacataaaaagaatttttttcgatttctggagaggtgctggtgtcattaattctttgaaaccggatgtggttatttctctacagaataccgccgttcttggagttaatgctcctgaaatgttatatgtgcaccaacctcttccgttcgaaacaaattataaatttagcttctttaaaaactcggagaggaaaatggctttttaccaaagtttagtgggtagtgttatcaaatcgaacttaaggagttttcataagggggcaatcacggtacaaactcactggatgttggaagaagtacagaagtacgctaaaacaccaatttttgtaacgcgaccatctattgataaaaatgatttcagaggtcagattttaggaagtaaaggaagcaatttcttttttccgagtactgcaatgatttataagaaccatcgaaatctagttgacgcctatgaaatgctttctaacgaagtaaggcatgaacatcacttaatatttacgatctctagaaaggaatacggtcgtttgtacgggcaagtacctgatgattcgaatattaagtttctcggaagaattcctcgggctaaggtaatcgaaattttaaatcatagtatattagtctttccttcaaaaattgaaactctcgggttaccgcttattgaagcgatgatattgcaaagacagattgttgctgcaaatatcagcccggtcactgaagtaactagtgagtacgattcgattagttacttcgatcctgatgatgtgaagtctatttacaactctctattggccggaataagaatgaatccttctaggagaggctttaaagagacaaatgacaatggttggcaggcattcttttctaatgtagaggcattgaatcatgcaaaatag

SEQ ID NO: 69995 - protein, 359 aa, Lactobacillus rhamnosus
MHYVIVDFVVRQNSGGILSILQDVNKFALEHTEDRFTFIVGTDGLINTSPNIKVILRPDLQRNYIKRIFFDFWRGAGVINSLKPDVVISLQNTAVLGVNAPEMLYVHQPLPFETNYKFSFFKNSERKMAFYQSLVGSVIKSNLRSFHKGAITVQTHWMLEEVQKYAKTPIFVTRPSIDKNDFRGQILGSKGSNFFFPSTAMIYKNHRNLVDAYEMLSNEVRHEHHLIFTISRKEYGRLYGQVPDDSNIKFLGRIPRAKVIEILNHSILVFPSKIETLGLPLIEAMILQRQIVAANISPVTEVTSEYDSISYFDPDDVKSIYNSLLAGIRMNPSRRGFKETNDNGWQAFFSNVEALNHAK

SEQ ID NO: 69996 - DNA, 1080 bp, Lactobacillus rhamnosus
  CDS (1)..(1080): transl_table=11
atgcattatgtcatcgtcgattttgtagtaaggcaaaattctggagggatattatcaatattacaagatgtcaataaatttgcgcttgaacatacagaagaccgttttacgtttatagttgggacagatggtctgatcaatacttcgccaaacataaaggttattttgcgacctgatttgcagcgtaactacataaaaagaatttttttcgatttctggagaggtgctggtgtcattaattctttgaaaccggatgtggttatttctctacagaataccgccgttcttggagttaatgctcctgaaatgttatatgtgcaccaacctcttccgttcgaaacaaattataaatttagcttctttaaaaactcggagaggaaaatggctttttaccaaagtttagtgggtagtgttatcaaattgaacttaaggagttttcataagggggcaatcacggtacaaactcactggatgttggaagaagtacagaagtacgctaaaacaccaatttttgtaacgcgaccatctattgataaaaatgatttcagaggtcagattttaggaagtaaaggaagcaatttcttttttccgagtactgcaatgatttataagaaccatcgaaatctagttgacgcctatgaaatgctttctaacgaagtaaggcatgaacatcacttaatatttacgatctctagaaaggaatacggtcgtttgtacgggcaagtacctgatgattcgaatattaagtttctcggaagaattcctcgggctaaggtaatcgaaattttaaatcatagtatattagtctttccttcaaaaattgaaactctcgggttaccgcttattgaagcgatgatattgcaaagacagattgttgctgcaaatatcagcccggtcactgaagtaactagtgagtacgattcgattagttacttcgatcctgatgatgtgaagtctatttacaactctctattggccggaataagaatgaatccttctaggagaggctttaaagagacaaatgacaatggttggcaggcattcttttctaatgtagaggcattgaatcatgcaaaatag

SEQ ID NO: 69997 - protein, 359 aa, Lactobacillus rhamnosus
MHYVIVDFVVRQNSGGILSILQDVNKFALEHTEDRFTFIVGTDGLINTSPNIKVILRPDLQRNYIKRIFFDFWRGAGVINSLKPDVVISLQNTAVLGVNAPEMLYVHQPLPFETNYKFSFFKNSERKMAFYQSLVGSVIKLNLRSFHKGAITVQTHWMLEEVQKYAKTPIFVTRPSIDKNDFRGQILGSKGSNFFFPSTAMIYKNHRNLVDAYEMLSNEVRHEHHLIFTISRKEYGRLYGQVPDDSNIKFLGRIPRAKVIEILNHSILVFPSKIETLGLPLIEAMILQRQIVAANISPVTEVTSEYDSISYFDPDDVKSIYNSLLAGIRMNPSRRGFKETNDNGWQAFFSNVEALNHAK

SEQ ID NO: 69998 - DNA, 1104 bp, Escherichia coli
  CDS (1)..(1104): transl_table=11
atgtttgatctgtccaaaaattatattattgtaagtgcgacggcgctggcttccggaggtgcattaactatattaaagcaatttataaaacatgcatcacaaaattcaaatgactatattatgtttgtatctgcgggattggagttgccggtctgtgataacatcatttacatagaaaacacaccaaaaggatggttgaaaagaatatattgggattggttcggttgtcggaagtttatctcggaacataagattaacgttaagaaagtaatttctctacaaaattccagtttgaatgttccttacgaacagattatttacttgcaccagccaattccttttagtaaagttgattcttttttaaaaaatatcacatccgataacgtaaagctttttttatataaaaagttttattcctattttatatttaaatatgtgaatgccaatacaaccatcgtagtgcaaacgaattggatgaaaaaaggagtgctggagcaatgtgataaaattagtaccgaaagggtccttgttataaaacctgatatcaaagcatttaataatactaattttgatgtagatatggatgtatctgcaaaaacactcttatatccagcgacaccacttacctataaaaatcatttggtcattctgaaggcgttggttattttaaagaaaaagtattttatagatgatctgaaattccaagtgacttttgaaaagaataggtacaaaaattttgataagtttgtgcaattaaataacttaagcaaaaacgttgattatctcggcgttctttcatactcgaacttgcaaaaaaaatatatggcggcatctttaatcgtttttcctagctatatcgaatcatatgggttaccactcatcgaagctgctagtttaggaaaaaaaatcattagtagtgatcttccttatgcccgggatgttttaaaggattatagcggcgtagattttgtaatttacaataatgaagatggctgggctaaggcgttgtttaatgttttaaatggcaattcgaagctcaattttaggccttatgaaaaagatagtcgttcatcttggccacagttcttctctattttgaaataa

SEQ ID NO: 69999 - protein, 367 aa, Escherichia coli
MFDLSKNYIIVSATALASGGALTILKQFIKHASQNSNDYIMFVSAGLELPVCDNIIYIENTPKGWLKRIYWDWFGCRKFISEHKINVKKVISLQNSSLNVPYEQIIYLHQPIPFSKVDSFLKNITSDNVKLFLYKKFYSYFIFKYVNANTTIVVQTNWMKKGVLEQCDKISTERVLVIKPDIKAFNNTNFDVDMDVSAKTLLYPATPLTYKNHLVILKALVILKKKYFIDDLKFQVTFEKNRYKNFDKFVQLNNLSKNVDYLGVLSYSNLQKKYMAASLIVFPSYIESYGLPLIEAASLGKKIISSDLPYARDVLKDYSGVDFVIYNNEDGWAKALFNVLNGNSKLNFRPYEKDSRSSWPQFFSILK

SEQ ID NO: 70000 - DNA, 1080 bp, Escherichia coli
  CDS (1)..(1080): transl_table=11
atgaaaattattatatatgcgacagcagcagttgatggtggcgctctttcgcttttaaatgatttgctggaatatgcgaatgatgatattgataatgaatatactgtttgcgttaatgaaaaattaaataacgaagtgtctgtttacaataatttgacatttttatttgttgatactaaagcttggcataaaagggtttattttgactttatagggtttaaaaaaaactttgataataaagattattgcttggtaataaatttgcaaaatataccagttcggacacaattaaaacaaatattgtacttgcatcagcctttgcctttttcggatattaagttaaatattttggagaagcgtaatagaaaattgatattctataaatacttatatggattaataataaaatttaattcatgttttattgatcattgcttagtgcaaactgagtggatgagaaaagctgttattgataaactaaacctgtctgagaaaaaaataagtataattagaccagtaatagatattgatttgaacaaaattttaaaaaatgaaaatgaaaatgaaaatacattcatctatcccgcagcatcttatagttataaaaatcatataatattggttgaatcattaaatatgattggtgtggattttttgtttcagaataagataactgttatatttacattagatcgtgatgaaaattcgaagttgtttgatcggataaaaaaatataatcttcaagagattattaaatttacaggaaatatcccaagatatgatgttttaaattacatttataatgctaaagccttactgtttccatcaagactagaaacatttggtataccattgatagaagctgtaaaatttaattctaacataattgtaagtgatctaccttatgcgcacgacgtattggatggttatgaaaatgtcaaatactgtaatcctgattctccagaggattggtctgaagcaatcaaatttgctatcaatctaaaagagaataaattaaatcagggctttgaattaaattcagggtggagagagttgagttcgattatttcaactctttaa

SEQ ID NO: 70001 - protein, 359 aa, Escherichia coli
MKIIIYATAAVDGGALSLLNDLLEYANDDIDNEYTVCVNEKLNNEVSVYNNLTFLFVDTKAWHKRVYFDFIGFKKNFDNKDYCLVINLQNIPVRTQLKQILYLHQPLPFSDIKLNILEKRNRKLIFYKYLYGLIIKFNSCFIDHCLVQTEWMRKAVIDKLNLSEKKISIIRPVIDIDLNKILKNENENENTFIYPAASYSYKNHIILVESLNMIGVDFLFQNKITVIFTLDRDENSKLFDRIKKYNLQEIIKFTGNIPRYDVLNYIYNAKALLFPSRLETFGIPLIEAVKFNSNIIVSDLPYAHDVLDGYENVKYCNPDSPEDWSEAIKFAINLKENKLNQGFELNSGWRELSSIISTL

SEQ ID NO: 70002 - DNA, 1035 bp, Shigella boydii
  CDS (1)..(1035): transl_table=11
gtgtcaaatttaaaaaaatataagtttataatttttattcctgatagcattaatttgcctaaagcagttaatatcagatatatccctgtgcctaaaaaaaattggctatctaggatatattgggatagttatggcttaagaaaatatattcgagtaaatcggcttcaatatcaggcggtcatttctcttcagaatacatctgtaaatgtagaaggaaaacagataatatatcttcaccaatctataccatttatagattttgatattccactgacaagtttatttaatttaaaattatggctatacaagcgattttattcttattttatatttttatttgttaacaagaatacttcttttattgtccaagccaaatggctgaaagagctcctttctgataagtatcatatcgatgcaaaaaaaatatctatcataaagcccaaagcaagatatgttcctctagcaactaactctattcataatgtagccaacttatctaagcaattctgtaatattatttatccagcaacaccaatattttataaaaatcattgtgttattattgatgctcttaggattttaagagaacagcgcaatattgataacttatgttttaatgtcaccttttcaaaaggtgagtatgctaagtttgacgatttggttaggcgttataacttgggtaagaatattcgctatttgggatatttgacccgagatgaattatatcaacattatgataatagcgcttttatggtctaccccagttatgtggaaacctgtgggcttccgttgctggaggctgcttctaagcagttgccaataatcgctagtgatctgccttatgcatgtgaaatgcttgaggcttatactggcgtcgtttatgttaagttcaatgtctctaccgaatgggctcgagaaattgatacgatggcccgagctggtgaaactcgaattattccgccgttattaaaagcggagaatgattctgattggaataagttagataatattattgaaggaaaagatgatgtttaa

SEQ ID NO: 70003 - protein, 344 aa, Shigella boydii
MSNLKKYKFIIFIPDSINLPKAVNIRYIPVPKKNWLSRIYWDSYGLRKYIRVNRLQYQAVISLQNTSVNVEGKQIIYLHQSIPFIDFDIPLTSLFNLKLWLYKRFYSYFIFLFVNKNTSFIVQAKWLKELLSDKYHIDAKKISIIKPKARYVPLATNSIHNVANLSKQFCNIIYPATPIFYKNHCVIIDALRILREQRNIDNLCFNVTFSKGEYAKFDDLVRRYNLGKNIRYLGYLTRDELYQHYDNSAFMVYPSYVETCGLPLLEAASKQLPIIASDLPYACEMLEAYTGVVYVKFNVSTEWAREIDTMARAGETRIIPPLLKAENDSDWNKLDNIIEGKDDV

SEQ ID NO: 70004 - DNA, 25 bp, Artificial sequence
  (1)..(25): primer
atgggaaaaagcatagtcgttgttt

SEQ ID NO: 70005 - DNA, 28 bp, Artificial sequence
  (1)..(28): primer
ttaatgttcttcagtaataaaattaact

SEQ ID NO: 70006 - protein, 294 aa, Artificial sequence
  Variant (3)..(173): xaa in position 3 to 173 is any amino acid
  Variant (174)..(205): xaa in position 174 to 205 is any or no amino acid
  Variant (208)..(250): xaa in position 208 to 250 is any amino acid
  Variant (251)..(259): xaa in position 251 to 259 is any or no amino acid
  Variant (261)..(278): xaa in position 261 to 278 is any amino acid
  Variant (279)..(279): xaa in position 279 is any or no amino acid
  Variant (282)..(283): xaa in position 282 to 283 is any amino acid
  Variant (284)..(284): xaa in position 284 is any or no amino acid
  Variant (286)..(287): xaa in position 286 to 287 is any amino acid
  Variant (291)..(292): xaa in position 291 to 292 is any amino acid
GGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKNXXXXXXXXXXXXXXXXXXXXXXXXXXXXXXXXXXXXXXXXXXXXXXXXXXXXGXXXXXXXXXXXXXXXXXXXPSXXXEXXGLPXXEA

SEQ ID NO: 70007 - protein, 12 aa, Artificial sequence
  Variant (2)..(3): xaa in position 2 to 3 is any or no amino acid
  Variant (5)..(5): xaa in position 5 is Gly, Ser or Thr
  Variant (6)..(6): xaa in position 6 is any amino acid
  Variant (8)..(8): xaa in position 8 is Ile or Leu
  Variant (10)..(10): xaa in position 10 is Ile, Leu or Pro
  Variant (11)..(11): xaa in position 11 is any amino acid
SXXEXXGXPXXE

SEQ ID NO: 70008 - DNA, 1185 bp, Saccharomyces cerevisiae; identical to SEQ ID NO: 19013
  CDS (1)..(1185)

SEQ ID NO: 70009 - protein, 394 aa, Saccharomyces cerevisiae; identical to SEQ ID NO: 19014

SEQ ID NO: 70010 - DNA, 1362 bp, Saccharomyces cerevisiae; identical to SEQ ID NO: 19015
  CDS (1)..(1362)

SEQ ID NO: 70011 - protein, 453 aa, Saccharomyces cerevisiae; identical to SEQ ID NO: 19016

SEQ ID NO: 70012 - DNA, 1338 bp, Saccharomyces cerevisiae; identical to SEQ ID NO: 19017
  CDS (1)..(1338)

SEQ ID NO: 70013 - protein, 445 aa, Saccharomyces cerevisiae; identical to SEQ ID NO: 19018

SEQ ID NO: 70014 - DNA, 1287 bp, Schizosaccharomyces pombe; identical to SEQ ID NO: 19019
  CDS (1)..(1287)

SEQ ID NO: 70015 - protein, 428 aa, Schizosaccharomyces pombe; identical to SEQ ID NO: 19020

SEQ ID NO: 70016 - DNA, 1621 bp, Arabidopsis thaliana; identical to SEQ ID NO: 19021
  CDS (86)..(1342)

SEQ ID NO: 70017 - protein, 418 aa, Arabidopsis thaliana; identical to SEQ ID NO: 19022

SEQ ID NO: 70018 - DNA, 1068 bp, Caenorhabditis elegans; identical to SEQ ID NO: 19023
  CDS (1)..(1068)

SEQ ID NO: 70019 - protein, 355 aa, Caenorhabditis elegans; identical to SEQ ID NO: 19024

SEQ ID NO: 70020 - DNA, 1152 bp, Oryza sativa; identical to SEQ ID NO: 19025
  CDS (1)..(1152)

SEQ ID NO: 70021 - protein, 383 aa, Oryza sativa; identical to SEQ ID NO: 19026

SEQ ID NO: 70022 - DNA, 1485 bp, Debaryomyces hansenii CBS767; identical to SEQ ID NO: 19027
  CDS (1)..(1485)

SEQ ID NO: 70023 - protein, 494 aa, Debaryomyces hansenii CBS767; identical to SEQ ID NO: 19028

SEQ ID NO: 70024 - DNA, 1329 bp, Debaryomyces hansenii CBS767; identical to SEQ ID NO: 19029
  CDS (1)..(1329)

SEQ ID NO: 70025 - protein, 442 aa, Debaryomyces hansenii CBS767; identical to SEQ ID NO: 19030

SEQ ID NO: 70026 - DNA, 1413 bp, Debaryomyces hansenii CBS767; identical to SEQ ID NO: 19031
  CDS (1)..(1413)

SEQ ID NO: 70027 - protein, 470 aa, Debaryomyces hansenii CBS767; identical to SEQ ID NO: 19032

SEQ ID NO: 70028 - DNA, 1404 bp, Debaryomyces hansenii CBS767; identical to SEQ ID NO: 19033
  CDS (1)..(1404)

SEQ ID NO: 70029 - protein, 467 aa, Debaryomyces hansenii CBS767; identical to SEQ ID NO: 19034

SEQ ID NO: 70030 - DNA, 1260 bp, Yarrowia lipolytica CLIB99; identical to SEQ ID NO: 19035
  CDS (1)..(1260)

SEQ ID NO: 70031 - protein, 419 aa, Yarrowia lipolytica CLIB99; identical to SEQ ID NO: 19036

SEQ ID NO: 70032 - DNA, 1470 bp, Yarrowia lipolytica CLIB99; identical to SEQ ID NO: 19037
  CDS (1)..(1470)

SEQ ID NO: 70033 - protein, 489 aa, Yarrowia lipolytica CLIB99; identical to SEQ ID NO: 19038

SEQ ID NO: 70034 - DNA, 1230 bp, Kluyveromyces lactis NRRL Y; identical to SEQ ID NO: 19039
  CDS (1)..(1230)

SEQ ID NO: 70035 - protein, 409 aa, Kluyveromyces lactis NRRL Y; identical to SEQ ID NO: 19040

SEQ ID NO: 70036 - DNA, 1086 bp, Xenopus laevis; identical to SEQ ID NO: 19041
  CDS (1)..(1086)

SEQ ID NO: 70037 - protein, 361 aa, Xenopus laevis; identical to SEQ ID NO: 19042

SEQ ID NO: 70038 - DNA, 1161 bp, Candida glabrata CBS138; identical to SEQ ID NO: 19043
  CDS (1)..(1161)

SEQ ID NO: 70039 - protein, 386 aa, Candida glabrata CBS138; identical to SEQ ID NO: 19044

SEQ ID NO: 70040 - DNA, 1356 bp, Candida glabrata CBS138; identical to SEQ ID NO: 19045
  CDS (1)..(1356)

SEQ ID NO: 70041 - protein, 451 aa, Candida glabrata CBS138; identical to SEQ ID NO: 19046

SEQ ID NO: 70042 - DNA, 1272 bp, Candida glabrata CBS138; identical to SEQ ID NO: 19047
  CDS (1)..(1272)

SEQ ID NO: 70043 - protein, 423 aa, Candida glabrata CBS138; identical to SEQ ID NO: 19048

SEQ ID NO: 70044 - DNA, 1155 bp, Ashbya gossypii; identical to SEQ ID NO: 19049
  CDS (1)..(1155)

SEQ ID NO: 70045 - protein, 384 aa, Ashbya gossypii; identical to SEQ ID NO: 19050

SEQ ID NO: 70046 - DNA, 1602 bp, Neurospora crassa; identical to SEQ ID NO: 19051
  CDS (1)..(1602)

SEQ ID NO: 70047 - protein, 533 aa, Neurospora crassa; identical to SEQ ID NO: 19052

SEQ ID NO: 70048 - DNA, 1080 bp, Caenorhabditis elegans; identical to SEQ ID NO: 19053
  CDS (1)..(1080)

SEQ ID NO: 70049 - protein, 359 aa, Caenorhabditis elegans; identical to SEQ ID NO: 19054

SEQ ID NO: 70050 - DNA, 1029 bp, Mus musculus; identical to SEQ ID NO: 19055
  CDS (1)..(1029)

SEQ ID NO: 70051 - protein, 342 aa, Mus musculus; identical to SEQ ID NO: 19056

SEQ ID NO: 70052 - DNA, 1029 bp, Homo sapiens; identical to SEQ ID NO: 19057
  CDS (1)..(1029)

SEQ ID NO: 70053 - protein, 342 aa, Homo sapiens; identical to SEQ ID NO: 19058

SEQ ID NO: 70054 - DNA, 1328 bp, Homo sapiens; identical to SEQ ID NO: 19059
  CDS (7)..(1056)

SEQ ID NO: 70055 - protein, 349 aa, Homo sapiens; identical to SEQ ID NO: 19060

SEQ ID NO: 70056 - DNA, 25 bp, Artificial sequence
  (1)..(25): primer
atgtggacaaacactttcaaatggt

SEQ ID NO: 70057 - DNA, 25 bp, Artificial sequence
  (1)..(25): primer
ttactttgacaggaacgagactaaa

SEQ ID NO: 70058 - protein, 474 aa, Artificial sequence; identical to SEQ ID NO: 19063
  Variant (9)..(12): xaa in position 9 to 12 is any amino acid
  Variant (14)..(19): xaa in position 14 to 19 is any amino acid
  Variant (21)..(29): xaa in position 21 to 29 is any amino acid
  Variant (30)..(35): xaa in position 30 to 35 is any or no amino acid
  Variant (38)..(38): xaa in position 38 is any amino acid
  Variant (40)..(40): xaa in position 40 is any amino acid
  Variant (42)..(42): xaa in position 42 is any amino acid
  Variant (44)..(55): xaa in position 44 to 55 is any amino acid
  Variant (56)..(108): xaa in position 56 to 108 is any or no amino acid
  Variant (110)..(111): xaa in position 110 to 111 is any amino acid
  Variant (114)..(115): xaa in position 114 to 115 is any amino acid
  Variant (118)..(118): xaa in position 118 is any amino acid
  Variant (121)..(124): xaa in position 121 to 124 is any amino acid
  Variant (126)..(129): xaa in position 126 to 129 is any amino acid
  Variant (130)..(134): xaa in position 130 to 134 is any or no amino acid
  Variant (140)..(140): xaa in position 140 is any amino acid
  Variant (145)..(147): xaa in position 145 to 147 is any amino acid
  Variant (149)..(149): xaa in position 149 is any amino acid
  Variant (153)..(164): xaa in position 153 to 164 is any or no amino acid
  Variant (166)..(167): xaa in position 166 to 167 is any amino acid
  Variant (169)..(170): xaa in position 169 to 170 is any amino acid
  Variant (172)..(172): xaa in position 172 is any amino acid
  Variant (174)..(175): xaa in position 174 to 175 is any amino acid
  Variant (177)..(177): xaa in position 177 is any amino acid
  Variant (179)..(205): xaa in position 179 to 205 is any amino acid
  Variant (206)..(279): xaa in position 206 to 279 is any or no amino acid
  Variant (282)..(283): xaa in position 282 to 283 is any amino acid
  Variant (286)..(286): xaa in position 286 is any amino acid
  Variant (287)..(287): xaa in position 287 is any or no amino acid
  Variant (289)..(290): xaa in position 289 to 290 is any amino acid
  Variant (292)..(324): xaa in position 292 to 324 is any amino acid
  Variant (325)..(354): xaa in position 325 to 354 is any or no amino acid
  Variant (356)..(362): xaa in position 356 to 362 is any amino acid
  Variant (364)..(364): xaa in position 364 is any amino acid
  Variant (367)..(379): xaa in position 367 to 379 is any amino acid
  Variant (380)..(405): xaa in position 380 to 405 is any or no amino acid
  Variant (409)..(411): xaa in position 409 to 411 is any amino acid
  Variant (414)..(417): xaa in position 414 to 417 is any amino acid
  Variant (419)..(427): xaa in position 419 to 427 is any amino acid
  Variant (428)..(454): xaa in position 428 to 454 is any or no amino acid
  Variant (456)..(457): xaa in position 456 to 457 is any or no amino acid
  Variant (461)..(461): xaa in position 461 is any amino acid
  Variant (464)..(464): xaa in position 464 is any amino acid
  Variant (467)..(469): xaa in position 467 to 469 is any amino acid
  Variant (471)..(473): xaa in position 471 to 473 is any amino acid

SEQ ID NO: 70059 - protein, 9 aa, Artificial sequence
  Variant (2)..(2): xaa in position 2 is any or no amino acid
  Variant (4)..(4): xaa in position 4 is any or no amino acid
  Variant (6)..(6): xaa in position 6 is any amino acid
  Variant (8)..(8): xaa in position 8 is any amino acid
DXLXGXGXS

SEQ ID NO: 70060 - protein, 26 aa, Artificial sequence
  Variant (3)..(3): xaa in position 3 is Phe or Tyr
  Variant (4)..(4): xaa in position 4 is any amino acid
  Variant (5)..(5): xaa in position 5 is Ala, Ser or Thr
  Variant (6)..(7): xaa in position 6 to 7 is any amino acid
  Variant (9)..(9): xaa in position 9 is any amino acid
  Variant (10)..(10): xaa in position 10 is Phe, Ile, Leu, Met or Val
  Variant (11)..(11): xaa in position 11 is any amino acid
  Variant (12)..(12): xaa in position 12 is His or Tyr
  Variant (13)..(13): xaa in position 13 is Asn or Pro
  Variant (14)..(18): xaa in position 14 to 18 is any amino acid
  Variant (19)..(19): xaa in position 19 is Ala or Leu
  Variant (20)..(23): xaa in position 20 to 23 is any amino acid
  Variant (24)..(24): xaa in position 24 is Pro, Gln or Ser
  Variant (25)..(25): xaa in position 25 is any amino acid
  Variant (26)..(26): xaa in position 26 is Ala, Gly or Ile
GGXXXXXYXXXXXXXXXXXXXXXXXX

SEQ ID NO: 70061 - protein, 12 aa, Artificial sequence
  Variant (3)..(3): xaa in position 3 is Ala, Asp, Glu, Gln or Ser
  Variant (4)..(4): xaa in position 4 is any amino acid
  Variant (5)..(5): xaa in position 5 is Asp, Ser or Thr
  Variant (6)..(6): xaa in position 6 is any amino acid
  Variant (7)..(7): xaa in position 7 is Ile, Met or Val
  Variant (8)..(8): xaa in position 8 is Asp or Asn
  Variant (9)..(10): xaa in position 9 to 10 is any amino acid
  Variant (11)..(11): xaa in position 11 is Ala, Gly, Ser or Thr
  Variant (12)..(12): xaa in position 12 is Ala or Gly
YGXXXXXXXXXX

SEQ ID NO: 70062 - protein, 13 aa, Artificial sequence
  Variant (2)..(2): xaa in position 2 is any or no amino acid
  Variant (4)..(4): xaa in position 4 is any amino acid
  Variant (5)..(5): xaa in position 5 is Ile, Leu or Val
  Variant (6)..(6): xaa in position 6 is Phe or Tyr
  Variant (7)..(7): xaa in position 7 is any amino acid
  Variant (9)..(9): xaa in position 9 is Asp, Asn or Gln
  Variant (10)..(12): xaa in position 10 to 12 is any amino acid
GXHXXXXDXXXXF

SEQ ID NO: 70063 - DNA, 327 bp, Saccharomyces cerevisiae
  CDS (1)..(327)
atggatggatcttacctcactcaccgatattgcgcgctcaagcggccctatactgcacacctattacttcttgatttttcaaaggacgaagttacaaaaaatgtttggaggtggaaaggtacggatgttaaacttcataaaatgggtagaaaaagcatcgttgctgcagtgtacaatcaagctcacccgagccatccacctctctaccatctcggtaacttgaatggtgacaaatatgtcgcctcacctcctagtcgaatgaaggcagtcagcctatcttttgcgtttactttcttatattattattttccgcttcctactaattag

SEQ ID NO: 70064 - protein, 108 aa, Saccharomyces cerevisiae
MDGSYLTHRYCALKRPYTAHLLLLDFSKDEVTKNVWRWKGTDVKLHKMGRKSIVAAVYNQAHPSHPPLYHLGNLNGDKYVASPPSRMKAVSLSFAFTFLYYYFPLPTN

SEQ ID NO: 70065 - DNA, 24 bp, Artificial sequence
  (1)..(24): primer
atggatggatcttacctcactcac

SEQ ID NO: 70066 - DNA, 26 bp, Artificial sequence
  (1)..(26): primer
ctaattagtaggaagcggaaaataat

SEQ ID NO: 70067 - DNA, 1704 bp, Brassica napus
  CDS (58)..(1470)
gtcgacgatttcgtcctaagttctcttatcacatcgtagatacccccgcatgtgaaaatggagagggtaaacgctagattagccgttctctctgcgcacttggaggtgtcagatcccatgccggcggcgataaagccatggtgcacatcaagtgctggtgcaccgcatggatccctaatgggaaacttgacgatcgttgatgagcgtacggggaagaagtatcaggtcccagtctctgaggatggtaccgttaaatccattgatctcaagaagataacgacagggaaagatgacaagggacttaaattatacgatccaggttacttgaacacggctcctgttcgatcttccatttcttacatcgacggagatgaaggcatcctacgttatcgtggatacccaattgaagagttggctgagaattgtacttttcttgaggttgcttacctcctcatttatgggaacctgccttcacaacgccagctagctgatttggagtttgaggtttctcagcattcagctgttccacaagggcttctagatattatccagtccatgcctcaagatgcacatccatcgggtgcttttgtcagtgcggctgcaatgagtgcactttccctcttttatcctgatgcaaatccttctcatatgggccaagatatttacaagtcaaaacaagttcgtgataaacagatatttcgtattcttggacaggcacctacgattgcagcaaatgcttttctgaggacgtcaggcaagcctcctgttcttccttcaagcaacttttcttatgcagagaacgtactctatatgctggattcaatgggcgataagtcttacaaacctaatcctcggctagctcgagtgttggacatcatcttcatactgcatgccgaacatgaaatgaactgctctactgctgctgctcggcatcttgcttcgagtggtgttgatgtgtacgctgctatttccggagctgttggagccctttatggcccacttcatggtggtgcaactgatgctgtgtctaagatgttatcagagattggaactgttgaaaacattccagacttcttccaatgcgtgaagaacaagaagaggaggttgtcaggttttggacaccgtgtttacaaaaattacgaccctcgagcaaaagtggttaaaaaactggcgtatgaagtgttctcaattgttggaaaggatccgctgattgaggtagcagttgctctagagaaggcggcactctctgatgaatattttgttaagaggaagctttaccccaatgttgatttctactctggattagtctttagggcaatgggaatcccgccacaattcattgcagttccacgtatggctggatacttggcacactggcttgagtcgttagataatcctgacactaagatcatgagaccccaacaggtctatactggagtgtggctaaggcattatgctccggtgaattgatttggattctgatcacattggtcactaaaatgggcaatagaccagacaaagaacttgcatatgtgttgtattatgtatttgtacacgttctgtaatacataaaacagaattatgatgtcgtgaatatattaatatcttttgcaaaatgaaataaaaaatattaacatattataagtgacatatataagttgtgaatgtaataaaaaagtttcttgtaccaaaaaaaaaaaaaaa

SEQ ID NO: 70068 - protein, 470 aa, Brassica napus
MERVNARLAVLSAHLEVSDPMPAAIKPWCTSSAGAPHGSLMGNLTIVDERTGKKYQVPVSEDGTVKSIDLKKITTGKDDKGLKLYDPGYLNTAPVRSSISYIDGDEGILRYRGYPIEELAENCTFLEVAYLLIYGNLPSQRQLADLEFEVSQHSAVPQGLLDIIQSMPQDAHPSGAFVSAAAMSALSLFYPDANPSHMGQDIYKSKQVRDKQIFRILGQAPTIAANAFLRTSGKPPVLPSSNFSYAENVLYMLDSMGDKSYKPNPRLARVLDIIFILHAEHEMNCSTAAARHLASSGVDVYAAISGAVGALYGPLHGGATDAVSKMLSEIGTVENIPDFFQCVKNKKRRLSGFGHRVYKNYDPRAKVVKKLAYEVFSIVGKDPLIEVAVALEKAALSDEYFVKRKLYPNVDFYSGLVFRAMGIPPQFIAVPRMAGYLAHWLESLDNPDTKIMRPQQVYTGVWLRHYAPVN

SEQ ID NO: 70069 - DNA, 1752 bp, Brassica napus
  CDS (21)..(1547)
gtcgacgatttcgtgtgaaaatggagatttctgcgagaagattggccgttctcactgcgcacttggcggtatctgatcccgtcggatcgatccaggtgttgccgccggcgatcgagccgtggtgcacatcgagtgctttaccaccgcatggatcgctcaagggaagcttgacgatcgtcgatgagcgcacggggaggaagtatcaggtcccggtatcagaggacggtaccgttaaagccgttgatctcaagaagataacgacgacggggaaggatgacaaggggcttaagttgtacgatccaggttacttgaacacggctcctgttaggtcttcgatctcttacatcgatggagatgaagggatcttacgttatcgtgggtacccaatagaagagttggctgagagcagcactttcattgaggtttcttacctcctcatgtatgggaatctgccttctcaaagtcagctagctgattgggagttcaccattcctcagcattctgctgtcccacaaggagttttggaaatcatacagtccatgcctcatgatgcacacccaatgggggttcttgtgagtgcaatgagtgcactttccatctttcatcctgatgccaaccctgctcttaggggccaagatatttacaagtcgaaacaaattcgtggtaaacagattgttcgtattcttggaaaggctccaacagttgcggcggctgcttatttgaggatggcaggcaggcctcctgttcttccttctggcaacctttcttatgctgagaatttcctctatatgctggattcaatgggcaatacgtcttacaagcctaatcctcgtctggctcgggtgctagacatcctcttcatactgcatgctgaacatgaaatgaactgctccactgctgctgctcggcatcttgcctctagtggtgttgacgtgtacaccgctgttgcgggagctgttggagcgctatacggtcctcttcatggcggtgcgaacgaggctgtccttaagatgttagcagagattgggagtgttgaaaacattccagagttcatcgaaggggtgaagagcagaaagaggaagatgtctggttttggacatcgtgtttacaaaaactacgacccgagagcaaaagtcattaagaaactggcggatgaagtgttctccatcgttggaagggatcctctgatcgaggtagcagttgctctagagaagacggcactctctgatgaatattttgtgaagagaaagctttatccaaatgtggatttctactctggattaatctatagggcaatgggattcccaccagaattcttcacagtcctgtttgcagtcccgcgtatggctgggtatttgtcacactggcgggagtctttggatgatcctgacactaagatcatgagaccccaacaggcctacactggggtgtggctaaggcattacgagccggtgagagaaagaacgttgtcaagtgattcggataagttgggtcaagtttcgatttcgaatgcatcaagaaggcgtttatctggatctgcactttagtctcaagctctcaatctttactacataccaataaaacaattgggtgacacctctgggcaaacgagaggggctcttctcaacaatctctgttgttttctttctcttctcttattatttgttattcaacatgcaccctcaataatccacttcctattggttgtctggtattttatatgatgattttaaacataaaaaaaaaaaaaaa

SEQ ID NO: 70070 - protein, 508 aa, Brassica napus
MEISARRLAVLTAHLAVSDPVGSIQVLPPAIEPWCTSSALPPHGSLKGSLTIVDERTGRKYQVPVSEDGTVKAVDLKKITTTGKDDKGLKLYDPGYLNTAPVRSSISYIDGDEGILRYRGYPIEELAESSTFIEVSYLLMYGNLPSQSQLADWEFTIPQHSAVPQGVLEIIQSMPHDAHPMGVLVSAMSALSIFHPDANPALRGQDIYKSKQIRGKQIVRILGKAPTVAAAAYLRMAGRPPVLPSGNLSYAENFLYMLDSMGNTSYKPNPRLARVLDILFILHAEHEMNCSTAAARHLASSGVDVYTAVAGAVGALYGPLHGGANEAVLKMLAEIGSVENIPEFIEGVKSRKRKMSGFGHRVYKNYDPRAKVIKKLADEVFSIVGRDPLIEVAVALEKTALSDEYFVKRKLYPNVDFYSGLIYRAMGFPPEFFTVLFAVPRMAGYLSHWRESLDDPDTKIMRPQQAYTGVWLRHYEPVRERTLSSDSDKLGQVSISNASRRRLSGSAL

SEQ ID NO: 70071 - DNA, 816 bp, Brassica napus
  CDS (8)..(697)
cccaaccatgtctccatggaaccctccaacccctcgtctcctcctcaaaaacgtctcctgcatgagaaacgcccagcagatcctccgacacgtcaacgtatccctccacgacggcggcgcgctcgtcctaaccggaaccaacggatccggcaaatcaaccttcctgagaatgctcgccgggttctcaaagccctccgcgggagaaatcctctggaacggccacgacatcacgcaatcaggggtcttccagcagtacaaactccagctcaactggatctctctgaaagacgcaatcaaggagaggttcacggtcctcgacaacgtccagtggttcgagctcctcgagaacaagatcgggaaagcgcagccggcgctggagctgatggggctagggaggctggtgaaggagaagtcgaggatgctgtcgatgggccagaggaagaggctgcagctcgcgaggctgttggcgattgataggcccatttggcttttggatgagccctccgttgcgttggatgatgaaggggttaggttgcttgagtatgttatcggggagcataggaagaaaggtgggattgtgattgttgcgactcatcttccgattgagattgaagatgctatgatcttgaggctccctcctaggtttcctaggaagatgactttgattgatatgcttgatcgtgctgacatttcttagccttagatgctatgggattgttttttgttttgtgttgttttttgttttttttgtttgtacttgtgtaatggaatcaaataatggatttgggacgagttaaacgtaaaaaaaaaaaaaaa

SEQ ID NO: 70072 - protein, 229 aa, Brassica napus
MSPWNPPTPRLLLKNVSCMRNAQQILRHVNVSLHDGGALVLTGTNGSGKSTFLRMLAGFSKPSAGEILWNGHDITQSGVFQQYKLQLNWISLKDAIKERFTVLDNVQWFELLENKIGKAQPALELMGLGRLVKEKSRMLSMGQRKRLQLARLLAIDRPIWLLDEPSVALDDEGVRLLEYVIGEHRKKGGIVIVATHLPIEIEDAMILRLPPRFPRKMTLIDMLDRADIS

SEQ ID NO: 70073 - DNA, 1211 bp, Glycine max
  CDS (111)..(893)
gaattcccgggtcgacatttcgtggcaggctgtttctggtttcaacttgttatgatggtgtcatcttctccattctcattctcattctctgtcgctcacggctagcaatcatgtcttctcgcttagatgagtgcttgttggaggtggatgggtacggtgatggcgatggaaaggcgaaacccaaattcctgataaggaatctcagcagagtttcggaggatggggttcccatcctcaaaggcataaatcttgagatcccagagggtgtgatcgtgggagtgataggccccagtggtagcggcaagtcaacgttcttgagggcccttaaccgcctctgggagccaccctccgcctccgtcttcctcgacgcccaagacatctgccatctcgatgtcctctctctccgccgtaacgttgccatgctctttcagctcccggccctctttgaaggcagcgttgcggacaatgtgaggtacggaccacaactcagagggaaaaagctaagcgatgatgaggtgcgcaagttgcttctaatggccgacctggatgcttctttcatggataagtccggggctgaactctctgtcggtcaagctcaaagagttgcacttgctaggactttagctaattcaccccaggttttgttgctggatgagccaactagtgccttagatccaatatcgacagaaaacatagaggatgccctggtgaagctgaacaagaatcagggcatgacagtcatcatggtctctcatagcatcaagcaaatccaaaggatcgctcacatagtgtgcctgcttgttgatggtgaaattgttgaagttctcaaccctcataatctctctcaggccaaccatcccatggctaagaggtttcttcaactcagttcttaaagccaagataaatctacttgcacctgctcgtttatcggccacatatatatgttcacctctcctcgattcatatctttcaatcaattatcttccacatatgttgctttaatttcaagacgtgcaggttgatgacatatatatgattttatgatagtggaggtttagttaccaatatgatattgcaaaatgctactatagaataggaatttcgtttttcaccaaaacaaaactattgtccacagttttttctatttgcaatacaaccaattggatgtaagcgtactctttggtacaagtttcgtgaaaaaaaaaaaaaaa

SEQ ID NO: 70074 - protein, 260 aa, Glycine max
MSSRLDECLLEVDGYGDGDGKAKPKFLIRNLSRVSEDGVPILKGINLEIPEGVIVGVIGPSGSGKSTFLRALNRLWEPPSASVFLDAQDICHLDVLSLRRNVAMLFQLPALFEGSVADNVRYGPQLRGKKLSDDEVRKLLLMADLDASFMDKSGAELSVGQAQRVALARTLANSPQVLLLDEPTSALDPISTENIEDALVKLNKNQGMTVIMVSHSIKQIQRIAHIVCLLVDGEIVEVLNPHNLSQANHPMAKRFLQLSS

SEQ ID NO: 70075 - DNA, 1996 bp, Glycine max
  CDS (506)..(1768)
ttgcttcacgttcccaaaagaaaaagtttaagagtattactacaataaaactaggaacttgttaagattcagaaaacattttttagttttcaattttggtttatacaattattaattttttttatttaattcaaaggtttctgaagataaaaaataaaaatacaaaaccaaacatgtcccaagtgtttctaatgttcttgtctttttgtttaggtgtactttgaatattttttggtgtactcatgttcttgtctatttcactgtttgtatcaatgtggaatgttagtaacacattctataacatattattatttcttaaaatttatctgaaactacaaaatcataaccgagactcattcaatatagagtgaaacctacaaaattcttaataagttttagtcattaataatgtgttttgctagcatttttctgatttcaaataatttaatcttagaagttagaacatcctaggaatctaacttggtttgtgtagaattagaacattatgctgttgattaagtgccaatggaatgattttctctgtctttggattctgcagcaactatctctaaaagggtttgctggagacacagccaaggctcatgcaaagacaagtatgatagcaggagagggagtgagcaacatcagaacagttgcagcattcaatgctcagaacaagatgttatcggtgttctgccacgagctccgagtgcctcagagccagagcctgcgccggagcctgacatccggcttcttgttcggtctctctcagcttgccctctatgcctccgaggctctcattctatggtatggtgcacatttggtcagcaaaggtgtttcaaccttctcaaaggtcatcaaggtgtttgtggtcctagtgatcactgcgaattcggtggctgaaaccgtgagccttgcaccggagattattcgcggtggcgaagctgttggttcagtgttctcaatcctcgatcgatcaacaagaattgaccctgatgatcctgatgctgatccggttgaatcgcttcgcggggaaattgagctcagacatgttgattttgcatacccttctaggcctgatgtgatggtgttcaaggattttaaccttaggatccgtgcaggccagagtcaggctcttgtgggggcaagtggttcggggaagagttctgttattgcattgattgagagattctatgaccttattgctggaaaagtgatggtggatggaaaggacattaggaagttgaacttgaagtctttgaggcttaaaattgggttggtgcagcaagagccagcactttttgcagcaagcattttcgagaacattgcatatgggaaagaaggtgcaaccgaggctgaggtgattgaggccgcgcgtgctgcgaacgtgcacggatttgtgagtggtttgcctgaaggttacaagacaccggttggcgagagaggcgtgcaactctctggagggcaaaagcaaaggattgccattgcaagagccgtgcttaaggaccccacaattcttctactagatgaggccacaagtgcacttgatgctgagtccgagtgtgtgctacaagaggccttggagaggctaatgaggggtcgcaccacggtgctcgtggctcatcgtttgtcaaccattagaggggttgattgcattggtgtggttcaagatgggcgcattgtggagcaaggtagccattctgaacttgtcagcaggcatgagggggcatattctagactcttgcagctacaacatcatcacatatgagaatatgagagaaagagattattgttttttttgtatttgataaatatgaccttgtgggggtgataattatgtttgggtcccattaacctcatgctttggtttttctttttttctttcttttagatgtagatatgtgggatatgaggtttgtagcttgagttcaaagtgatctatttccaatggggtatcaattattatatttaatcacatgtcaaaaaaaaaaaaaaa

SEQ ID NO: 70076 - protein, 420 aa, Glycine max
MLLIKCQWNDFLCLWILQQLSLKGFAGDTAKAHAKTSMIAGEGVSNIRTVAAFNAQNKMLSVFCHELRVPQSQSLRRSLTSGFLFGLSQLALYASEALILWYGAHLVSKGVSTFSKVIKVFVVLVITANSVAETVSLAPEIIRGGEAVGSVFSILDRSTRIDPDDPDADPVESLRGEIELRHVDFAYPSRPDVMVFKDFNLRIRAGQSQALVGASGSGKSSVIALIERFYDLIAGKVMVDGKDIRKLNLKSLRLKIGLVQQEPALFAASIFENIAYGKEGATEAEVIEAARAANVHGFVSGLPEGYKTPVGERGVQLSGGQKQRIAIARAVLKDPTILLLDEATSALDAESECVLQEALERLMRGRTTVLVAHRLSTIRGVDCIGVVQDGRIVEQGSHSELVSRHEGAYSRLLQLQHHHI

SEQ ID NO: 70077 - DNA, 1970 bp, Hordeum vulgare
  CDS (63)..(1694)
gccccaccagtcctcctcgcttccacgctcctagggtttagccgccgccgcgcctcccgagcatgtcggcgccgccctttctcaagtcccctgccaccgccgccttcctcgcctccccacgcgtgactgctgctccgagagccgccgtgctcggcgccaccgcgcagccgccacggcgcctacgctgctctgcagccgttggagccggagccagggatttcggggtgatgagtgctcccctgggctgggcggcgaggtcggtggaggagctggagcaagcgacggacctggacagtttctgtatgatggcgctatcacctctggacggccggtacatcagatttatcaaggacttgatgcccttcttcagcgagttcggtctcatcagataccgcgtcttagtcgaggtcaaatggttgctgaagctttcacaaattcctgaggtcaaggaggtgccaccgtttagccaggaggctcagctctttctggatgcagttatccaagattttagcatcaatgatgctaaagaagtgaaacaaattgagaaaataactaaccatgacgtgaaggctgttgagtactatctgaagcagaaatgcagctcaaatccagaggttgcaaaggttttggaattcttccattttggatgtacttctgaagatatcaacaacctgtcacatgcattagctctaaaagagggggtaaacacaattatgttccctgtgatgatcgatgtatgcagtgcaatatgttccttggcaacagaaaatgcacacgtccctttgttgtctaaaactcacggacagccagcatcaccaacaactctggtaaaagagatggcaaattttgcagccagattatctgatatcgggaagagtttttctgaggtcaagatactagggaaatttgctggcgctgttggaaattacaatgctgatgtagttgcatatccggaaattgactggcctaagatgacagaagagtttgtcagatccttaggtttggagttcaatccttacgttactcagattgaacctcatgactatatctcaaagctcttcaatctatttgtccagttcaacattgtcttgactgactttgacagagacatgtggtcttacatatcagcaggctacttcaagcagatagcaaaggctggtgaagttggatcctccaccatgcctcacaaaatcaatcccatcaactttgaaaatagtgaaggcaattttagtgtgtcgaatggtcttttatgtactttaagtatgaagctaccaatatcaaggttgcagcgtgatctcacagattcaactgttttgagaaacttgggtgttggattagggcattcactcttggcttacaaagcaacaatgcagggaatcaagaagctagaggtgaacaaagtccgtttggatgaagacttggagcaaacatgggaagtccttgcagagccaatacagactgtgatgcgaaggtatgggatccccgaaccctatgagaaactgaaggaaatgactagaggccaggctgtgaccaaagacagcatacgccagttcattgaaggtcttgacctaccggaggatgcccggtcaagtcttttgaagttaacaccacactcttacactggagaggcagagaatctggctgcaaatatttggaatgtggttgacctgaaatctggatttaagatcaagtgagcttctatcctggcccactattttttttgatgaggacagcgacaataacatgggggaatatctcatactccctctatacctaaataattgtagttggagaaaactagattagttctcgtcaactatatttatttaggtatggagaagtagtagcttagcgttcaaagattgtcacgctaatttatctggttctcgttgaaaaagcttgtggtgcatgtagcatgcggccttcggaattgttccattactattcgttctgccaaaaaaaaaaaaaaa

SEQ ID NO: 70078 - protein, 543 aa, Hordeum vulgare
MSAPPFLKSPATAAFLASPRVTAAPRAAVLGATAQPPRRLRCSAAVGAGARDFGVMSAPLGWAARSVEELEQATDLDSFCMMALSPLDGRYIRFIKDLMPFFSEFGLIRYRVLVEVKWLLKLSQIPEVKEVPPFSQEAQLFLDAVIQDFSINDAKEVKQIEKITNHDVKAVEYYLKQKCSSNPEVAKVLEFFHFGCTSEDINNLSHALALKEGVNTIMFPVMIDVCSAICSLATENAHVPLLSKTHGQPASPTTLVKEMANFAARLSDIGKSFSEVKILGKFAGAVGNYNADVVAYPEIDWPKMTEEFVRSLGLEFNPYVTQIEPHDYISKLFNLFVQFNIVLTDFDRDMWSYISAGYFKQIAKAGEVGSSTMPHKINPINFENSEGNFSVSNGLLCTLSMKLPISRLQRDLTDSTVLRNLGVGLGHSLLAYKATMQGIKKLEVNKVRLDEDLEQTWEVLAEPIQTVMRRYGIPEPYEKLKEMTRGQAVTKDSIRQFIEGLDLPEDARSSLLKLTPHSYTGEAENLAANIWNVVDLKSGFKIK

SEQ ID NO: 70079 - DNA, 1348 bp, Helianthus annuus
  CDS (36)..(1139)
gtcgacgatttcgtcggccactctttccgattccgatggctctgcatatcgccaaacgcctcctccgcacccgcgccaccacccctaccgtcgcacttttctcagccgttgatcggagcttttcctccacctcttccgatctgatccgcgccactctcttccccggtgacggcatcggtcccgagatcgccgaatctgttaaacaggtattcaatgctgcagaggttccaattgaatgggaagaacattttgtggggacagaagttgacccgaggacccaaagctatctcacatgggaaagtctagagtcagtaagaagaaataaagtgggcttaaaaggcccaatggctacgccaatcggaaaaggacatcgttccttaaaccttacgttgaggaaagaactgaatctgtacgcaaatgtcagaccatgttacagcttacctggttacaagactcgatatgacgatgttaatcttgttaccatccgtgaaaacactgaaggagagtacagtggtcttgaacatcaggtggtgcggggagttgtcgaaagtctcaaaatcatcactcgacaggcaagtctgagggtcgctgaatacgctttttattacgctaaaacacatggtagggagagagtatctgcagtacacaaagctaacatcatgcagaaaaccgatggtctctttttgaagtgctgtcgtgaagttgctgagaagtacccggagattaagtacgaggaagttgtcatcgacaattgctgtatgatgcttgtgaagaatccaacgctgtttgatgttttagtaatgcccaatctttatggtgacatcatcagtgatctgtgtgctggattaattggaggactgggtttaacaccaagcttaaacattggagagggtggtattgctcttgctgaggccgttcatggttcagctcctgatattgctggaaagaatttggcaaacccgaccgctttattactaagtgccgtatcaatgcttcaccatttggacctgaatgaaaaagccgataaaatccaagatgcggttttgaagacaatcgcagaaggcaagtaccgaactggcgatctaggtggccaatcaacaacctcggaatttacaaaagcgatcatcgatcatctttgagcattaaagatggtgcaaattgcatataaagtttgattccatttttcttacactaattttccattcatgtactatttggagttgtggagaggggaattagaccacaacaagattttttggttttgttatttgagtaaggatataaagataactgctcaaaagccaggttatgcagttgacatatgcttttctagaaaaaaaaaaaaaaa

SEQ ID NO: 70080 - protein, 367 aa, Helianthus annuus
MALHIAKRLLRTRATTPTVALFSAVDRSFSSTSSDLIRATLFPGDGIGPEIAESVKQVFNAAEVPIEWEEHFVGTEVDPRTQSYLTWESLESVRRNKVGLKGPMATPIGKGHRSLNLTLRKELNLYANVRPCYSLPGYKTRYDDVNLVTIRENTEGEYSGLEHQVVRGVVESLKIITRQASLRVAEYAFYYAKTHGRERVSAVHKANIMQKTDGLFLKCCREVAEKYPEIKYEEVVIDNCCMMLVKNPTLFDVLVMPNLYGDIISDLCAGLIGGLGLTPSLNIGEGGIALAEAVHGSAPDIAGKNLANPTALLLSAVSMLHHLDLNEKADKIQDAVLKTIAEGKYRTGDLGGQSTTSEFTKAIIDHL

SEQ ID NO: 70081 - DNA, 1426 bp, Brassica napus
  CDS (73)..(1173)
gtcgacgatttcgtgcaaaatatctccgactcgaatagtttcgtcgctgcgtccctttggtgctttgaagagatgaccatggcggcagcaaccttcgcgaaacgcctgatcggaagccgatctagctcaaccacagccacttccgtcgccagagctttctgctcgtccaccactccaatcaccgcaaccatgttccccggagacgggatcggtcccgagatcgccgaatccgtcaaacaggtgttcacgacggcgggagtgccgattaactgggaagagcactacgtcagcgccgagatcgatccgagaacgcagagcttcttgacctgggagagtctcgaatccgtgcgtaggaacaaagtcggtttgaaaggtccgatggcgactccgatcgggaaaggccaccgttccttgaatctgactcttaggaaagagctgaatctgtacgctaacgttaggccttgctatagtcttcctggttacaagactcgttacgatgatgtgaatctaattactattagggagaatactgagggagagtacagtgggcttgaacatcaggttgttagaggtgtggtggagagtcttaagatcattacgcgtcaggcgagtttgagagttgctgagtatgcttttcactatgctaagactcatgggagagagagagtttccgctattcataaagctaatattatgcagaaaactgatggtcttttcctcaagtgttgtcgtgaggttgctgagaagtatcctgagattacttacgaagaggttgttattgacaactgctgtatgatgcttgtgaaaaacccagcactgtttgatgtattggtgatgccaaacctgtacggtgacattattagtgacttgtgtgctggattggttggaggactaggattgactccaagttgtaatattggggaagatggtgtagctcttgctgaagccgttcacggttctgcacctgatatcgctggaaagaacttggcgaacccaacagcgttgctactgagtggagtgatgatgttgcgtcacctgaagctgaacgaacaagcagaacagatccacagcgcaatcatcaacaccatagctgagggcaaatacagaactgcagatcttggaggtagttcgaccaccacggacttcacaaaagcaatctgtgatcatctctgaacaatcgtaaaaaaatctcaattctttaacgaatctttcctttgaggcttgagcgtttattagcctctgagattcttcttgttttcctcgttttacgataagaataaaacaggcaattgcttttgaagttacattgtttcttctgcctctaaaacgtcttttaaaaaacttagattcatagcacagaaacagctgtgttgttctgtaatcaatcagaagagttttgtttttcttgctgaaaaaaaaaaaaaaa

SEQ ID NO: 70082 - protein, 366 aa, Brassica napus
MTMAAATFAKRLIGSRSSSTTATSVARAFCSSTTPITATMFPGDGIGPEIAESVKQVFTTAGVPINWEEHYVSAEIDPRTQSFLTWESLESVRRNKVGLKGPMATPIGKGHRSLNLTLRKELNLYANVRPCYSLPGYKTRYDDVNLITIRENTEGEYSGLEHQVVRGVVESLKIITRQASLRVAEYAFHYAKTHGRERVSAIHKANIMQKTDGLFLKCCREVAEKYPEITYEEVVIDNCCMMLVKNPALFDVLVMPNLYGDIISDLCAGLVGGLGLTPSCNIGEDGVALAEAVHGSAPDIAGKNLANPTALLLSGVMMLRHLKLNEQAEQIHSAIINTIAEGKYRTADLGGSSTTTDFTKAICDHL

SEQ ID NO: 70083 - DNA, 1389 bp, Brassica napus
  CDS (59)..(1150)
gtcgacgatttcgtatcatcttcccttccgatcaaactttgtcagattcaacgaaatcatgtctcgccgatcaccaactctcctgaaaaacctcgccaattcaagaacccagacccgatccgtaacctacatgcccagacccggcgacggagcgccacgcgccgtgactctaatcccgggcgacgggatcggccctctcgtgaccaacgccgtggagcaggtgatggaagcgatgcacgcgccgatctacttcgagaagtacgacgtccagggggagatgagccgcgtgccggcggaggtgatggagtcgatacggaagaacaaggtgtgcttgaaaggcgggctcaagacccccgtgggcggcggcgtgagctcgctgaacgtgcagctgaggaaggagcttgacctctttgcgtcgctggtcaactgcttcaacttgcccgggttgcccacgaggcatgagaatgttgatatcgttgtgattagggagaatactgaaggggagtatgcggggcttgagcatgaggttgttcctggcgttgttgagagtcttaaggtgatcacgaagttctgttcggagcgtatagctaagtatgcttttgagtatgcttacctgaacaacaggaagaaagtgacggcggtgcacaaggctaacatcatgaagcttgctgatggtttgttcttggagtcttgtcgtgaggttgctaaaaagtatccagggatcacatacaatgagattattgtcgataactgctgcatgcaacttgtagccaagccagagcagtttgacgtcatggtaacacccaatctctatggtaatttagttgcaaacactgccgctggtattgctggaggcaccggagtcatgcctggaggaaacgttggggctgaccatgcggtgtttgagcaaggtgcatcagcaggaaatgtcgggaaagactcgatagtaaggaaaaacaaagcaaacccagtggcgttgcttctctcatcagccatgatgcttagacatcttcagtttccttcatttgctgaccggctcgaaacagcagtgaagagagtgatctctgaagggaagtgccggactaaagatcttggtggacaaagcactactcaagaggtcgttgacgcagtcattgcaaagctggagtgacttgtgacaaaaacacttaatccctctctctccctctttctctgcataaatcatcaagtttctgctacagattttctgttgacaaaaaatatatgggtatgatccacggtggctggttttgtacctcttgagtttcatacaattcttttagacgtaaaatcgtcgaaaacttccaatcagattttgctattcccaaatagttcatgctgaatgaaagcttggtcaaaaaaaaaaaaaaa

SEQ ID NO: 70084 - protein, 363 aa, Brassica napus
MSRRSPTLLKNLANSRTQTRSVTYMPRPGDGAPRAVTLIPGDGIGPLVTNAVEQVMEAMHAPIYFEKYDVQGEMSRVPAEVMESIRKNKVCLKGGLKTPVGGGVSSLNVQLRKELDLFASLVNCFNLPGLPTRHENVDIVVIRENTEGEYAGLEHEVVPGVVESLKVITKFCSERIAKYAFEYAYLNNRKKVTAVHKANIMKLADGLFLESCREVAKKYPGITYNEIIVDNCCMQLVAKPEQFDVMVTPNLYGNLVANTAAGIAGGTGVMPGGNVGADHAVFEQGASAGNVGKDSIVRKNKANPVALLLSSAMMLRHLQFPSFADRLETAVKRVISEGKCRTKDLGGQSTTQEVVDAVIAKLE

SEQ ID NO: 70085 - DNA, 1288 bp, Glycine max
  CDS (25)..(1119)
gtcgacgatttcgtcaacagcgcaatggcacgaagatccctccctctcctaaagcacctcctcctctcgcggcggatcccggcccgatccgtgacgtacatgcaccggccgggcgacgggtctcctcggcctgtgacgctgatccctggcgacgggatcgggccgatggtgacgggcgcggtggagcaggtcatggaggccatgcatgcgcccgtctactttgagaagttcgaggtccacggccacatgaaggccgtgccgccggaggtcctcgattcgattcggaagaacaaggtctgtctcaagggtggactcgtcacccccatgggtggtggcgtcagttccctcaatgttcagcttcggaaggagcttgatctctatgcttctcttgttaattgtttcaacctccctggccttcccacgcgccatgataatgttgatattgttgtcatcagggagaacaccgaaggcgagtactccggcctcgaacacgaggtcgttcccggcgttgttgaaagccttaaggtaataacaaagttttgttcagagcgaattgctaaatatgcattcgagtatgcttacctgaataacagaaagaaggtgactgccgtgcacaaagcaaatattatgaagcttgctgatggtttattcttggaatcttgtcgagaggttgctacaaagtaccctggaatcaagtataacgaaattattgtggataactgctgtatgcagcttgtttcaaagcctgaacagtttgatgtcatggtgaccccaaatctttatggaaatctagttgcaaacactgcagcaggcattgctggaggcactggagtcatgccaggaggtaatgttggggctgagcacgctgtgtttgagcaaggtgcatcagcgggaaatgtcggtagtgataaaataagggaacaaaagaaagccaatccagtggcgcttcttctctcgtcagctatgatgcttaggcatctccagtttcctgcatttgctgaccgtttggaaactgctgtggaaaaagtcatcctggagggcaaatgccgaacaaaggatcttggagggacaagcaccacccaagaggttgtggatgcagtgatagatgctttagattgagtaatttttgttgctgatttcccaaacgaagtcagtctcgttcctttctaaccaattttgccaacattgttttgcacccatcaaatgcaaaatagtaatttttcgtcctgaataaagtttatggaacacagaaagtgataattgtttccctcctaaaaaaaaaaaaaaa

SEQ ID NO: 70086 - protein, 364 aa, Glycine max
MARRSLPLLKHLLLSRRIPARSVTYMHRPGDGSPRPVTLIPGDGIGPMVTGAVEQVMEAMHAPVYFEKFEVHGHMKAVPPEVLDSIRKNKVCLKGGLVTPMGGGVSSLNVQLRKELDLYASLVNCFNLPGLPTRHDNVDIVVIRENTEGEYSGLEHEVVPGVVESLKVITKFCSERIAKYAFEYAYLNNRKKVTAVHKANIMKLADGLFLESCREVATKYPGIKYNEIIVDNCCMQLVSKPEQFDVMVTPNLYGNLVANTAAGIAGGTGVMPGGNVGAEHAVFEQGASAGNVGSDKIREQKKANPVALLLSSAMMLRHLQFPAFADRLETAVEKVILEGKCRTKDLGGTSTTQEVVDAVIDALD

SEQ ID NO: 70087 - DNA, 1457 bp, Brassica napus
  CDS (63)..(1169)
gtcgacgatttcgtactgaagaagacgaatctgattccgatcaaaaaaacttgcagaacaagatgtctcgccgccaatctctctccctactgaagaatctcggtagattaacaaccgggtcccaaacccagacccgatccgtgacttacatgcccagacccggtgacgggaagccacgacccgtgacgttgatccccggagacggagtaggtcctctggtgacaaacgcggtggagcaagtgatggaggcgatgcacgctcccgtctacttcgagcccttcgacgttcacggagacatgaagagtttgccggaggggttgctggagtcgatcaagaagaacaaggtttgtctgaaaggagggctcaagactcccgtcggtggaggtgtgagctcgctgaatgttaacttgaggaaggagcttgatctctttgcttctttggtcaactgtttcaatttgcctgggttagagtctcggcatgagaacgttgatatagtggtgattagggagaatactgaaggtgagtatgcagggcttgagcatgaagttgttcctggtgttgttgagagccttaaggtgattacaaagttttgttccgagcgtattgcaaagtatgcgttcgagtacgcctacttgaacaacaggaagaaagttacggcagtgcacaaggccaacatcatgaaactcgctgatggtttgttcctggaatcttgtcaagaggttgctaagaagtatccaagcatcgcctacaatgagatcattgttgataactgctgtatgcaacttgtagctagaccagagcaatttgacgtcatggtgacacccaatctctatggtaatctagttgcaaacactgctgctggtattgctggaggcactggagtcatgcctggaggaaatgttggagcggagtatgcagtgtttgagcaaggagcatcagcagggaacgtggggaaggacacgacggaagagcagaagaatgcaaaccctgtggcgttgctgctctcatcagccatgatgcttaggcatcttcagttcccttcttttgctgataggcttgaaaccgcggtgaagcgtgtcatcgctgaaggaaaatgcaggactgaagatcttggcggaaagagtacaactcaagaggtcgttgatgccgtcatttcaaaattggattgagtcattcatcactcctcgagataggtggtatacatgattcacaccacgctggtctacagatgtgtacctctatttttcccacatttttttcaagataactcggaagtgggttccgtaacttccactcaaaagatactagttgatatatttttaattgggttgtcgtcaaattgcggttttgctctcccaagaagaaaggaaaggatacatacttgtatgatccttttgttattcatgtactttctgaataaatgagacttttgttaacttcttaaaaaaaaaaaaaaa

SEQ ID NO: 70088 - protein, 368 aa, Brassica napus
MSRRQSLSLLKNLGRLTTGSQTQTRSVTYMPRPGDGKPRPVTLIPGDGVGPLVTNAVEQVMEAMHAPVYFEPFDVHGDMKSLPEGLLESIKKNKVCLKGGLKTPVGGGVSSLNVNLRKELDLFASLVNCFNLPGLESRHENVDIVVIRENTEGEYAGLEHEVVPGVVESLKVITKFCSERIAKYAFEYAYLNNRKKVTAVHKANIMKLADGLFLESCQEVAKKYPSIAYNEIIVDNCCMQLVARPEQFDVMVTPNLYGNLVANTAAGIAGGTGVMPGGNVGAEYAVFEQGASAGNVGKDTTEEQKNANPVALLLSSAMMLRHLQFPSFADRLETAVKRVIAEGKCRTEDLGGKSTTQEVVDAVISKLD

SEQ ID NO: 70089 - DNA, 1364 bp, Linum usitatissimum
  CDS (61)..(1152)
gtcgacgatttcgtgcaaaaaggtcgaaaacgcaaattccacaaacacctctccgcaatcatggcgttccagcacctcatgaggcgcgctctcagaagccgccccgaccacatcctctccacttcctccgccactaggcctttctcctccgctcccattacggcaactctcttccccggcgacggtatcggccccgagatcgccgagtccgttaagcaggtgttcagggaagctgaggtaccaatacaatgggaagaacattatgttggtactgaaatagatcctagaacccagagctttctgacatgggaaagtttggagtcagtaagaagaaaccgagtgggtctgaaagggccaatggctaccccaatcggcaaaggccatcgttcattgaaccttactctcaggaaagaacttaatttgtatgccaatgtcaggccttgctacagccttcctggttacaaaaccaaatacgatgatgtgaatctcatcaccattcgtgaaaacactgaaggagaatacagtgggcttgagcaccaagtggtgagaggtgtggttgaaagtctcaagatcattactcgtcaggccagtttgagggtggccgaatatgctttctactatgcaaaggctcatggaagagagagagtgtctgccatacataaagctactatcatgcagaaaaccgatggtcttttcctcaagtgctgtcgtgaggttgctgaaaagtatcctgagattacttacgaggaggttgtcattgacaactgttgcatgatgcttgtgaaaaatccagctctttttgatgtactggttatgcctaacctctacggtgacatcatcagtgatctttgtgctggtttgattggtggtctcgggttgacaccaagctgcaatattggagaagggggaattgctcttgctgaggctgtccatggctccgcccctgacattgctgggaagaacttggctaacccaactgctctgctactgagtggtgtgtccatgctgcggcatctagaactccacgataaggcagaaaggattcagaaggccgttctgggcaccattgcggaaggcaagtaccgaacggcagatcttggtggtagctctacgacatctgattttactaaagccatctgcgaccacctttgaaggtttcccctcctgagggacaaaggaaagtttattttttttgcatcaatttgacaaacatagttttgatgtaagttctttcttcttcttcttcggcctgagtcctgagcccttgttattttccagaagagtaataaaaaaaactcatgaccattatggttacacgtcaactactttgaagttgtttcttcatcaccaaaaaaaaaaaaaaa

SEQ ID NO: 70090 - protein, 363 aa, Linum usitatissimum
MAFQHLMRRALRSRPDHILSTSSATRPFSSAPITATLFPGDGIGPEIAESVKQVFREAEVPIQWEEHYVGTEIDPRTQSFLTWESLESVRRNRVGLKGPMATPIGKGHRSLNLTLRKELNLYANVRPCYSLPGYKTKYDDVNLITIRENTEGEYSGLEHQVVRGVVESLKIITRQASLRVAEYAFYYAKAHGRERVSAIHKATIMQKTDGLFLKCCREVAEKYPEITYEEVVIDNCCMMLVKNPALFDVLVMPNLYGDIISDLCAGLIGGLGLTPSCNIGEGGIALAEAVHGSAPDIAGKNLANPTALLLSGVSMLRHLELHDKAERIQKAVLGTIAEGKYRTADLGGSSTTSDFTKAICDHL

SEQ ID NO: 70091 - DNA, 2120 bp, Zea mays
  CDS (76)..(1572)
tcgctgtcgacgatttcgtccatttcccagccgccgcggcgccacgcagacctagcagagaaacacccacccgagatggcgatggctctgcgccgccttgcgggcgtgtccggatcgccgtcggcctcctctgccgcggccacggtgctactccggtcggcgctgacccgcccgatctccaccggcttccgcgaggagcgcgacaccttcggtcccatccaagtccccaacgacaagctgtggggcgcgcagacgcagagatcgctgcagaactttgacattggcggggagcgtgagaggatgcccgttcccatcatccgtgcctttggcgtgctaaaaaagtgcgccgctaaggtgaatatggactatggccttgatccaacaatagggaaggccataatacaggcagctgaggaggtcgcagagggaaagttggatgatcacttcccacttgttatctggcaaactggcagtggcacacaaagcaacatgaatgccaatgaggtaattgcaaatagggcatctgagatccttggacacaagcgcggtgagaagtttgtgcacccaaatgaccatgtgaataggtcacaatcttcaaatgatacatttcccactgtaatgcatatagcgacggccgttgagatacattcgaggtttatcccaagtttgcaacagttgcatgattcacttcattcgaaaactattgagtttaaagacataattaaaattggacgtacacatacccaagatgccaccccattgactcttggccaagaattcagtggctacactacacaggtcaaatatggaattgaccgcattaattgtacattacctcggatgtaccagcttgctcaaggtggaactgcagttggaactggcttgaacaccaagaaaggatttgatgccaaaatagctgctgcagtggctgaggaaacaaacctaccctttgtgacagcagagaacaagtttgaagctttggcagcacatgacgcttttgttgagagcagtggtgccgtaaatacaatttctgcatctcttatgaagatagcaaacgacatacgtttgctaggaagtggtcctcggtgtggtcttggtgaactaatcctaccagaaaatgagcctgggagcagcattatgcctgggaaagttaatccaacccagtgtgaggctctgacaatggtttgtgcacaggttatgggtaatcatgttggtgttacaattggtggtgccaatgggcattttgaactgaatgtttttaagccaatgatcgcagccggattacttcgatcattgaggttgttaggggatgcatccgtgtcctttgagaaaaattgtgtcaggggaattcaagcaaaccacaagagaatttcacaacttttgcatgagtctctgatgttagtgacatctttgaaccctaaaattggctatgacaatgctgcagctgttgctaagaaagcccacaaagaaggaaccacgttgaaggaagctgcattagaccttggagtattaacggagcaagaattccatgagcttgtcgtcccggagaaaatgattggtccttctgattgataaccccatgttcactatgtttctttgaagcattcaggttgccacatccgcgagttctggtggccctgtgtttccaagttaatgattctagcgcacccataaataaagcaaataatttttcatatggtcattaggtcctcaccgtaccgcactagagaaatgatttttgcatggcggatggtatctgagaaaacagttgtattcttgttcaaatagggagcagtgcactttgattcatgaggcgccttccattatcttggcatcagtcaaccttttcttgccaagtagctagtgctatgcaacaagtgacatggcaaccatgtatagaaattatttgcatgggtttgtgttcttgccaggtagctaatgttatgtaataagtgacaaggaaacaatgccatgaattatttgcattgggttttgacgagtgaaatagaaatatacgccctgttttagttttaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 70092 - protein, 498 aa, Zea mays
MAMALRRLAGVSGSPSASSAAATVLLRSALTRPISTGFREERDTFGPIQVPNDKLWGAQTQRSLQNFDIGGERERMPVPIIRAFGVLKKCAAKVNMDYGLDPTIGKAIIQAAEEVAEGKLDDHFPLVIWQTGSGTQSNMNANEVIANRASEILGHKRGEKFVHPNDHVNRSQSSNDTFPTVMHIATAVEIHSRFIPSLQQLHDSLHSKTIEFKDIIKIGRTHTQDATPLTLGQEFSGYTTQVKYGIDRINCTLPRMYQLAQGGTAVGTGLNTKKGFDAKIAAAVAEETNLPFVTAENKFEALAAHDAFVESSGAVNTISASLMKIANDIRLLGSGPRCGLGELILPENEPGSSIMPGKVNPTQCEALTMVCAQVMGNHVGVTIGGANGHFELNVFKPMIAAGLLRSLRLLGDASVSFEKNCVRGIQANHKRISQLLHESLMLVTSLNPKIGYDNAAAVAKKAHKEGTTLKEAALDLGVLTEQEFHELVVPEKMIGPSD

SEQ ID NO: 70093 - DNA, 1726 bp, Brassica napus
  CDS (76)..(1554)
ataatttgccattttgtttgccctatcttctgcaactctccaccatctcgtctcccaaggcagaagaagaaccccatggcgatttacgtcgcatcacggcggctttccgccagaacaaccgcggcggcgctgcgttacgccactgctctgagatcttattcgacctcgttcagggaggagagggacaccttcggcccgatccaagttccttccgataagttgtggggagcccagacgcagagatcgctgcagaacttcgagatcggcggcgagcgcgagcgaatgcccgagccaatcgtccgcgcttttggcgtcttgaagaagtgcgctgccaaggttaacatggagtatggacttgatccaactattgggaaagcgattatggaagctgctcaggaagttgctgagggcaaactcaatgatcatttcccccttgttgtttggcaaactggtagtggcactcagagtaacatgaatgctaatgaggtcattgctaacagagcagctgagattcttggtcgcaaacgtggtgaaaaatgtgtccaccctaatgaccatgtcaacagatctcagtcttctaacgacactttccctaccgtcatgcacattgcagctgcaaccgagattaattcaaggctcatccctagtctgaaaactttgcataccactctcgactctaagtccttcgagtttaaagatattgtgaaaattggaagaactcacactcaagatgctactcctttgactctaggacaagaatttggtggctatgctactcaggttaagtatggacttaatcgagtcacatgcactctaccccgcctctatcagcttgcacaaggtggaactgcggttgggacaggattaaacaccaagaaagggtttgatgtaaagatagctgctgcagtagccgaagaaacaaacctgccgtttgtcactgcagaaaacaagtttgaagctctggctgcacatgatgcttgtgttgaaaccagtgggtcacttaacacaatcgccacatcgttgatgaagattgccaatgatatacgttttcttggaagtggtccaagatgtggtcttggtgaacttgttctgcctgaaaatgagccaggaagcagcatcatgcctgggaaggtaaatcctacacagtgtgaggccttgactatggtttgtgctcaggtaatgggcaaccatgtagctgtgacagttggtgagtcaaatggtcatttcgaactgaatgtatttaagccggtgattgcaagcgctctcttgcattccgtgaggttaatagcagatgcttcagcttcgtttgagaaaaactgtgtaaggggtattgaggccaacagagaaaggatctcaaagcttttgcacgagtctcttatgcttgtgacatcattgaatccgaaaatcggatatgacaatgctgcagcagttgccaagaaagctcacaaagaaggatcgacactgaaggaagcggctctgaagttaggtgttcttacttctgaagagtttgatacccttgttgttcccgagaagatgatcggtccctccgattgatgttgagccaaaagcttcattttgccatgttttattcttgataaagaggttgtaatgacaaataagcaaatccccagactcaaattttgcatttggaaggattcaattctttatgtatcacacagttacttttatgttgaataaaagagcaactatgcaaaaaaaaaaaaaa

SEQ ID NO: 70094 - protein, 492 aa, Brassica napus
MAIYVASRRLSARTTAAALRYATALRSYSTSFREERDTFGPIQVPSDKLWGAQTQRSLQNFEIGGERERMPEPIVRAFGVLKKCAAKVNMEYGLDPTIGKAIMEAAQEVAEGKLNDHFPLVVWQTGSGTQSNMNANEVIANRAAEILGRKRGEKCVHPNDHVNRSQSSNDTFPTVMHIAAATEINSRLIPSLKTLHTTLDSKSFEFKDIVKIGRTHTQDATPLTLGQEFGGYATQVKYGLNRVTCTLPRLYQLAQGGTAVGTGLNTKKGFDVKIAAAVAEETNLPFVTAENKFEALAAHDACVETSGSLNTIATSLMKIANDIRFLGSGPRCGLGELVLPENEPGSSIMPGKVNPTQCEALTMVCAQVMGNHVAVTVGESNGHFELNVFKPVIASALLHSVRLIADASASFEKNCVRGIEANRERISKLLHESLMLVTSLNPKIGYDNAAAVAKKAHKEGSTLKEAALKLGVLTSEEFDTLVVPEKMIGPSD

SEQ ID NO: 70095 - DNA, 1764 bp, Glycine max
  CDS (34)..(1521)
gttattctccggtggctccttccttccttcgccatggcgttctacgtgctctcgcgtcgtttatcagctggatccaactcaacgacgctcctcgccctgcgttttgcttcctcttccagatccttctcctcttccttcagggaagaaagagatacctttggacccattcaagttccctccgacaaattatggggagcacaaactcaaagatcgttgcagaacttcgacatcggtgggccccgcgaacgcatgcccgaacccatcattcgcgcttttggcgtcttgaagaaatgcgctgctaaggtgaacatggagtatggtcttgatcccatcgtgggagaagcaataatgcaagcggcacaagaagtagccgagggaaaactaaacgaacattttcctctcgttgtatggcaaactggcagtggcactcaaagtaacatgaatgctaacgaggttattgcaaaccgagcagcagagattcttggccataagcgcggtgggaagttcgtgcacccaaatgaccatgtcaatagatcgcagtcttctaatgatacattcccaaccgtaatgcacattgcagccacaatggaaataaactcaagactaattcccagcttgaaaaccttacacggtacactaaactcaaagtcaattgaattcaaagatattgtcaagattggacgcactcatactcaagatgcaacacctttgactcttgggcaagagtttagtgggtatactacacaagtgaagtacggtattgatcgagtaattggcactttgccgcacctgtatcagcttgcccagggtggtacagctgtagggactggattgaatacaaagaaggggtttgatgccaagatagcagcagcagtagctgaggaaacaaatctgccttttgttacggcagaaaataagtttgaggccttggctgcccatgatgcttttgttgaaactagtggagcacttaacactattgcggcttctttgatgaagattgctaatgatatacggttgttaggaagtggtccacgctgcggtcttggtgaactcattcttcctgaaaacgaaccaggaagtagtatcatgcctgggaaggttaaccctacccagtgtgaggctttgacaatggtgtgtgcccaggtcattggaaaccatgttgcagttacagtgggtggatcaaatggtcattttgagcttaatgtgttcaagccaatgactgccagttgtctcctgcattcgctgagactgcttggagattcatctgcttcctttgaaaagaattgtgtgagaggcattcaagctaatagggaaagaatttcaaaattactgcatgagtcactgatgctcgtcacatccttaaacccaaaaattggttatgacaaggcagcagcagttgccaagacagcccacaaagaggggtgtactcttaaggaagctgcattgaaactcggagtgctcagctctgaagattttgacaagcttgtggtacctgagaaaatgcttggaccgtctgattgactaactcgcaatgtttttgttctaataattccttgtttcatcatatcggctacatttgaggtagtatttttttagctacacccgttgattggtttgagaaatggcaacccaatgaacaataatttggcttcctcagttgatattcgcgagggaagagttcttccaaatttgtaacgagacaatgtattgcagaaatttactgagccaaataaagggaaattttttattcaaaaaaaaaaaaaa

SEQ ID NO: 70096 - protein, 495 aa, Glycine max
MAFYVLSRRLSAGSNSTTLLALRFASSSRSFSSSFREERDTFGPIQVPSDKLWGAQTQRSLQNFDIGGPRERMPEPIIRAFGVLKKCAAKVNMEYGLDPIVGEAIMQAAQEVAEGKLNEHFPLVVWQTGSGTQSNMNANEVIANRAAEILGHKRGGKFVHPNDHVNRSQSSNDTFPTVMHIAATMEINSRLIPSLKTLHGTLNSKSIEFKDIVKIGRTHTQDATPLTLGQEFSGYTTQVKYGIDRVIGTLPHLYQLAQGGTAVGTGLNTKKGFDAKIAAAVAEETNLPFVTAENKFEALAAHDAFVETSGALNTIAASLMKIANDIRLLGSGPRCGLGELILPENEPGSSIMPGKVNPTQCEALTMVCAQVIGNHVAVTVGGSNGHFELNVFKPMTASCLLHSLRLLGDSSASFEKNCVRGIQANRERISKLLHESLMLVTSLNPKIGYDKAAAVAKTAHKEGCTLKEAALKLGVLSSEDFDKLVVPEKMLGPSD

SEQ ID NO: 70097 - DNA, 1860 bp, Glycine max
  CDS (135)..(1622)
gctgaacaaaaatactagactattcatttggggtccaacttggaagaagactgcggaatcgcgtatcctgattggtcagacaagtgttatgctccggtgactccttccttcgccacccccactcaaattcaaccatggcgttgtacgtgctctcgcgtcgtttatcagctggatccaactcaaccacgctcctcgccttgcgttttgtttcctctaccagatcctactcctcttccttcagggaagaaagagatacctttggagccattcaagttccctccgagaaattatggggagcacaaactcaaagatcgttgcagaacttcgatatcggtgggccccgcgaacgcatgcccgaacccatcattcgcgcctttggcgtcttgaagaaatgcgctgctaaggtgaacatggagtatggtcttgatcccgccgttggaaaagcgattatgcaagcggcacaagaagtggccgagggaaaactaaacgaccattttcctctcgttgtatggcaaactggcagtggcactcaaagtaacatgaatgctaacgaggttattgcaaaccgagcagcagagattctttggcataagcggggtgggaagttagtgcacccaaatgaccatgtcaatagatcacagtcttcaaatgatacattcccaactgtaatgcacattgcagccgcaatggaaataaactcaagactaattcccagcctgaaaaccttacatggtacactaaactcaaagtcaattgaattcaaagatattgtcaagattggacgcactcatactcaagatgcaacacctttgactcttggacaagagtttagtgggtatactacacaagtgaagtatggtattgatagagtaattggcactttgccgcacatgtatcagcttgcccagggtgggacagctgtagggactggattgaatacaaagaaggggtttgatgccaaaatagcagcagcagtagctgaggaaaccaatctgccttttgttacggcagaaaataagtttgaggccttggctgcccatgatgcttttgttgaaactagtggagcccttaacactattgcggcttctttgatgaagattgctaatgacatacggttgttaggaagtggtccacgctgcggtcttggtgaactcattcttcctgaaaacgaaccagggagcagtatcatgcctgggaaggttaaccctacccagtgtgaggctttgacaatggtgtgtgcccaggtcataggaaaccatgttgcagttacagtgggtggatcaaatggtcattttgagcttaatgtgttcaagccaatgattgccagttgtctcctgcattcactgagactgcttggagattcatctgcttcctttgaaaagaattgcgtgagaggcattcaagctaacagggaaagaatttcaaaattactgcatgagtcactaatgcttgtcacatccttaaacccgaaaattggttatgacaaggcagcagcagttgccaagacagcccacaaagaggggtgtactcttaaggaagctgcattgaaactcggagtgctcagctctgaagattttgacaagcttgtggtacctgagaaaatgcttggaccatctgattgactggctcgtaatgttttgttctaattattccttgttttatcatcggctacattgaggtagtattttttagccacacccgttgataggtttgagaaatggcaatccaatgaacaataatttggcttcctcagttgatattcgcgagggaagagctcttccaaatttgtaatgagacaatgtattgcagaaatttactgacccaaataaagggaaaatttgtattcaaaaaaaaaaaaaa

SEQ ID NO: 70098 - protein, 495 aa, Glycine max
MALYVLSRRLSAGSNSTTLLALRFVSSTRSYSSSFREERDTFGAIQVPSEKLWGAQTQRSLQNFDIGGPRERMPEPIIRAFGVLKKCAAKVNMEYGLDPAVGKAIMQAAQEVAEGKLNDHFPLVVWQTGSGTQSNMNANEVIANRAAEILWHKRGGKLVHPNDHVNRSQSSNDTFPTVMHIAAAMEINSRLIPSLKTLHGTLNSKSIEFKDIVKIGRTHTQDATPLTLGQEFSGYTTQVKYGIDRVIGTLPHMYQLAQGGTAVGTGLNTKKGFDAKIAAAVAEETNLPFVTAENKFEALAAHDAFVETSGALNTIAASLMKIANDIRLLGSGPRCGLGELILPENEPGSSIMPGKVNPTQCEALTMVCAQVIGNHVAVTVGGSNGHFELNVFKPMIASCLLHSLRLLGDSSASFEKNCVRGIQANRERISKLLHESLMLVTSLNPKIGYDKAAAVAKTAHKEGCTLKEAALKLGVLSSEDFDKLVVPEKMLGPSD

SEQ ID NO: 70099 - DNA, 1479 bp, Zea mays
  CDS (1)..(1479)
atggatccatacaagcaccgcccgtctagtgggagcaactccagcttctggaccaccaactccggcgcccccgtctggaacaacaactctgccctcaccgtcggacagcgaggtccaatcctccttgaggattatcatctaatcgaaaagcttgctcagttcgacagagaacgtatccctgaacgtgttgtgcatgcacggggagccagtgccaagggtttctttgaggtcactcatgatgtctctcaccttacatgtgctgattttctccgtgctcctggggtccagacacctgttattgtccgtttctctacagttgtgcatgagcgtggaagccctgagaccttgagggatccacgtggttttgctgtcaagttctacaccagagagggtaactttgacctcgtgggtaacaacatgcctgtgtttttcatacgagatgggatgaaattccctgacatggtccacgctttcaagccgaatccaaagaccaatttgcaggagaactggagaatagtagatttcttctctcaccacccagagagcctacacatgttcaccttcctctttgacgatgttggcatcccactcaactacaggcacatggagggctttggtgtcaatacctacaccttgatcaacagggatggaaagcctcaccttgtgaaattccattggaagcctacttgtggtgtgaaatgcttgctcgacaatgaagctgtgactgttggaggcacctgccacagccatgcgacgaaggatctatatgattccatcgcagctgggaattaccctgaatggaagctctacatccagactattgatcttgaccatgaggataagtttgactttgacccgctcgatgtcaccaagacctggcctgaggatatcatcccgctgcagcccgttggacggatggtcctgaacaagaacgtcgacaacttctttgcagagaatgaacagattgctttctgcccagcgattattgttcctggaattcactattctgatgataagctgctccagacgagaatcttctcctatgctgatacccagaggcaccgccttggtccaaactatctgatgcttcctgtgaatgcaccaaaatgtgcccaccacaataaccaccatgatgggttcatgaacttcatgcacagggacgaagaggtgaactacttcccttcgaggtttgatcccgcccgtcacgcggagaaggtccccattcctccccgtgttctaacaggctgtcgtgagaagtgcatcattcagaaggagaacaacttcaagcaggctggcgagagatatcgttccttcgaccctgcaaggcaagaccggttcatccagcgatgggttgacgcactgacagaccctcgcgtgacccatgaacaccgtaccatttggatctcctactggtcccagtgcgacgccgctcttggccagaagctgccttctaggctgaacctgaagccgagcatgtaa

SEQ ID NO: 70100 - protein, 492 aa, Zea mays
MDPYKHRPSSGSNSSFWTTNSGAPVWNNNSALTVGQRGPILLEDYHLIEKLAQFDRERIPERVVHARGASAKGFFEVTHDVSHLTCADFLRAPGVQTPVIVRFSTVVHERGSPETLRDPRGFAVKFYTREGNFDLVGNNMPVFFIRDGMKFPDMVHAFKPNPKTNLQENWRIVDFFSHHPESLHMFTFLFDDVGIPLNYRHMEGFGVNTYTLINRDGKPHLVKFHWKPTCGVKCLLDNEAVTVGGTCHSHATKDLYDSIAAGNYPEWKLYIQTIDLDHEDKFDFDPLDVTKTWPEDIIPLQPVGRMVLNKNVDNFFAENEQIAFCPAIIVPGIHYSDDKLLQTRIFSYADTQRHRLGPNYLMLPVNAPKCAHHNNHHDGFMNFMHRDEEVNYFPSRFDPARHAEKVPIPPRVLTGCREKCIIQKENNFKQAGERYRSFDPARQDRFIQRWVDALTDPRVTHEHRTIWISYWSQCDAALGQKLPSRLNLKPSM

SEQ ID NO: 70101 - DNA, 1482 bp, Zea mays
  CDS (1)..(1482)
atggacccgtacaagcaccgcccgtcgagcgccttcaacgccccgtactggaccaccaactccggcgcccccgtgtggaacaacgacagctccctcaccgtcggcgcacgaggtcccatcctgctggaggactaccacctggtggagaagctagccaacttcgaccgcgagcgcatcccggagcgcgtggtgcacgcgcgtggcgccagcgccaagggcttcttcgaggtgacccacgacatcacccacctgacgtgcgccgacttcctgcgcgcgcccggggtgcagacgcccgtcatcgtccgcttctccacggtgatccacgagcgcgggagccccgagacgctgcgcgacccgcgcgggttcgccgtcaagttctacacccgggagggcaactgggacctggtgggcaacaacttccccgtcttcttcatccgcgacggcatcaagttcccggacatggtgcacgcgctcaagcccaacccgcggacgcacatccaggacaactggcgcatcctcgacttcttctcgcaccacccggagagcctgcacatgttctccttcctcttcgacgacgtcggcatccccgccgactaccgccacatggacggatccggggtgcacacgtacacgctcgtcagccgcgccggcaccgtcacctacgtcaagttccactggcgccccacctgcggcgtgcgctcgctgatggacgacgaggccgtcgccgttggcggcgccaaccacagccacgccaccaaggacctcacggacgccatcgcggcggggaacttccccgagtggacgctctacatccagaccatggaccccgagatggaagaccgcctcgacgacctggacccgctggacgtgaccaagacgtggcccgaggacgcgttcccgctgcagcccgtgggccgcctggtgctcaaccgcaacatcgacaacttcttcgcggagaacgagcagctggccttctgcccgggcctcatcgtccctggtatctactactccgacgacaagctgctgcagaccaggatcttctcctactccgacacgcagcgccaccgcctcggccccaactacctgctgctaccggccaacgcgcccaagtgcgcacaccacaacaaccactacgacggatccatgaacttcatgcaccgccacgaggaggtcgactacttcccctccaggtacgacgccgtcaggaacgcgccgaggtacccgatcccgaccgcccacatcgccggccgccgagagaagactgtgattagcaaggagaacaacttcaagcagcccggggagaggtaccgcgcgatggacccagcaaggcaagagcggttcataaccagatgggtcgacgcgctctccgacccccgcctcacccacgagatcaggaccatctggctctccaactggtctcaggccgacaggtctctgggccagaagctcgcgagccgcctcagcgccaagccgagcatgtaa

SEQ ID NO: 70102 - protein, 493 aa, Zea mays
MDPYKHRPSSAFNAPYWTTNSGAPVWNNDSSLTVGARGPILLEDYHLVEKLANFDRERIPERVVHARGASAKGFFEVTHDITHLTCADFLRAPGVQTPVIVRFSTVIHERGSPETLRDPRGFAVKFYTREGNWDLVGNNFPVFFIRDGIKFPDMVHALKPNPRTHIQDNWRILDFFSHHPESLHMFSFLFDDVGIPADYRHMDGSGVHTYTLVSRAGTVTYVKFHWRPTCGVRSLMDDEAVAVGGANHSHATKDLTDAIAAGNFPEWTLYIQTMDPEMEDRLDDLDPLDVTKTWPEDAFPLQPVGRLVLNRNIDNFFAENEQLAFCPGLIVPGIYYSDDKLLQTRIFSYSDTQRHRLGPNYLLLPANAPKCAHHNNHYDGSMNFMHRHEEVDYFPSRYDAVRNAPRYPIPTAHIAGRREKTVISKENNFKQPGERYRAMDPARQERFITRWVDALSDPRLTHEIRTIWLSNWSQADRSLGQKLASRLSAKPSM

SEQ ID NO: 70103 - DNA, 1485 bp, Zea mays
  CDS (1)..(1485)
atggatcctaccaagttccgtccgtccagcagccacgacacgacggtgacgacgacgaacgcgggcgctcctgtgtggaacgacaacgaggcgctgactgtggggcctcgcggtcccatcctgctggaggactaccacctgatcgagaaggtggcgcacttcgcgcgcgagcgcatcccggagcgcgtggtgcacgcgcgcggggcctccgccaagggcttcttcgagtgcacccacgacgtgacgtcgctgacgtgcgccgacttcctgcgcgcgcccggcgtgcggacgcccgtgatcgtgcgcttctcgacggtgatccacgagcgggggtccccggagacgatccgcgacccgcgcgggttcgccgtgaagttctacacccgcgagggcaactgggacctgctgggcaacaacttccccgtcttcttcatccgcgacggcatcaagttccccgacgtgatccacgcgttcaagcccaacccgcggtcgcacgtgcaggagtactggcgggtgttcgacttcctgtcgcacctccccgagagcctgcacaccttcttcttcctcttcgacgacgtgggcgtgccgtccgactaccgccacatggaagggttcggcgtgaacacgtacacgttcgtgagcgcggcggggaaggcgcagtacgtcaagttccactggaagccgacgtgcggcgtgcggtgcatcctgacggacgaggaggcggcgctggtcgggggacggaaccacagccacgcgacgcaggacctgtacgactccatcgcggcggggagcttcccggagtggacgctgtacgtgcaggtgatggacccggacacggaggagcagtacgacttcgacccgctggacgacaccaagacgtggccggaggacctgctgccgctccgccccgtggggaggctggtgctggacaggaacgtggacaacttcttcaacgagaacgagcagctggcgttcggcccggggctggtggtgccagggatctactactcggacgacaagatgctgcagtgccgggtgttcgcctacgccgacacgcagcgctacaggctggggcccaactacctgatgctgcccgtcaacgcgccgcgctgcgcgcaccacaacaaccactacgacggcgccatgaacttcatgcaccgcgacgaggaggtggactactacccgtccaggcacgcgccgctgcggcaggcggcgccgcccacgccactgccgcccaggccggtcgcggggaggagggagaaggcaaccatacgcaagcccaacgacttcaagcagccaggggagaggtaccgctcctgggacgccgaccgacaggaccgattcgtgaggcgattcgccgactcgctcggacacccaaaggtcagccaggagctcaggtccatctggatagacctcctcgccaagtgcgacgcgtcgctggggatgaagattgccacccggctcaacatgaagccaaacatgtga

SEQ ID NO: 70104 - protein, 494 aa, Zea mays
MDPTKFRPSSSHDTTVTTTNAGAPVWNDNEALTVGPRGPILLEDYHLIEKVAHFARERIPERVVHARGASAKGFFECTHDVTSLTCADFLRAPGVRTPVIVRFSTVIHERGSPETIRDPRGFAVKFYTREGNWDLLGNNFPVFFIRDGIKFPDVIHAFKPNPRSHVQEYWRVFDFLSHLPESLHTFFFLFDDVGVPSDYRHMEGFGVNTYTFVSAAGKAQYVKFHWKPTCGVRCILTDEEAALVGGRNHSHATQDLYDSIAAGSFPEWTLYVQVMDPDTEEQYDFDPLDDTKTWPEDLLPLRPVGRLVLDRNVDNFFNENEQLAFGPGLVVPGIYYSDDKMLQCRVFAYADTQRYRLGPNYLMLPVNAPRCAHHNNHYDGAMNFMHRDEEVDYYPSRHAPLRQAAPPTPLPPRPVAGRREKATIRKPNDFKQPGERYRSWDADRQDRFVRRFADSLGHPKVSQELRSIWIDLLAKCDASLGMKIATRLNMKPNM

SEQ ID NO: 70105 - DNA, 1485 bp, Zea mays
  CDS (1)..(1485)
atggatcctaccaagttccgtccgtccagcagccacgacacgacggtgacgacgacgaacgcgggcgctcctgtgtggaacgacaacgaggcgctgactgtggggcctcgcggtcccatcctgctggaggactaccacctgatcgagaaggtggcgcacttcgcgcgcgagcgcatcccggagcgcgtggtgcacgcgcgcggggcctccgccaagggcttcttcgagtgcacccacgacgtgacgtcgctgacgtgcgccgacttcctgcgcgcgcccggcgtgcggacgcccgtgatcgtgcgcttctcgacggtgatccacgagcgggggtccccggagacgatccgcgacccgcgcgggttcgccgtgaagttctacacccgcgagggcaactgggacctgctgggcaacaacttccccgtcttcttcatccgcgacggcatcaagttccccgacgtgatccacgcgttcaagcccaacccgcggtcgcacgtgcaggagtactggcgggtgttcgacttcctgtcgcacctccccgagagcctgcacaccttcttcttcctcttcgacgacgtgggcgtgccgtccgactaccgccacatggaagggttcggcgtgaacacgtacacgttcgtgagcgcggcggggaaggcgcagtacgtcaagttccactggaagccgacgtgcggcgtgcggtgcatcctgacggacgaggaggcggcgctggtcgggggacggaaccacagccacgcgacgcaggacctgtacgactccatcgcggcggggagcttcccggagtggacgctgtacgtgcaggtgatggagccggacacggaggagcagtacgacttcgacccgctggacgacaccaagacgtggccggaggacctgctgccgctccgccccgtggggaggctggtgctggacaggaacgtggacaacttcttcaacgagaacgagcagctggcgttcggcccggggctggtggtgccagggatctactactcggacgacaagatgctgcagtgccgggtgttcgcctacgccgacacgcagcgctacaggctgggtcccaactacctgatgctgcccgtcaacgcgccgcgctgcgcgcaccacaacaaccactacgacggcgccatgaacttcatgcaccgggacgaggaggtggactactacccgtccaggcacgcgccgctgcggcaggcggcgccgcccacgccactgccgcccaggccggtcgcggggaggagggagaaggcaaccatacgcaagcccaacgacttcaagcagccaggggagaggtaccgctcctgggacgccgaccgacaggaccgattcgtgaggcgattcgccgactcgctcggacacccaaaggtcagccaggagctcaggtccatctggatagacctcctcgccaagtgcgacgcgtcgctggggatgaagattgccacccggctcaacatgaaggcaaacatgtga

SEQ ID NO: 70106 - protein, 494 aa, Zea mays
MDPTKFRPSSSHDTTVTTTNAGAPVWNDNEALTVGPRGPILLEDYHLIEKVAHFARERIPERVVHARGASAKGFFECTHDVTSLTCADFLRAPGVRTPVIVRFSTVIHERGSPETIRDPRGFAVKFYTREGNWDLLGNNFPVFFIRDGIKFPDVIHAFKPNPRSHVQEYWRVFDFLSHLPESLHTFFFLFDDVGVPSDYRHMEGFGVNTYTFVSAAGKAQYVKFHWKPTCGVRCILTDEEAALVGGRNHSHATQDLYDSIAAGSFPEWTLYVQVMEPDTEEQYDFDPLDDTKTWPEDLLPLRPVGRLVLDRNVDNFFNENEQLAFGPGLVVPGIYYSDDKMLQCRVFAYADTQRYRLGPNYLMLPVNAPRCAHHNNHYDGAMNFMHRDEEVDYYPSRHAPLRQAAPPTPLPPRPVAGRREKATIRKPNDFKQPGERYRSWDADRQDRFVRRFADSLGHPKVSQELRSIWIDLLAKCDASLGMKIATRLNMKANM

SEQ ID NO: 70107 - DNA, 1211 bp, Glycine max; identical to SEQ ID NO: 70073
  CDS (111)..(893)

SEQ ID NO: 70108 - protein, 260 aa, Glycine max; identical to SEQ ID NO: 70074

SEQ ID NO: 70109 - DNA, 1996 bp, Glycine max; identical to SEQ ID NO: 70075
  CDS (506)..(1768)

SEQ ID NO: 70110 - protein, 420 aa, Glycine max; identical to SEQ ID NO: 70076

SEQ ID NO: 70111 - DNA, 1508 bp, Hordeum vulgare
  CDS (45)..(1391)
cccacctctactgagaggaagcagcagcagtggcagcggcagcaatggcagcagcagccgctctccagtgctgccctctactgagctcaccgctggcatcatccgtctcgccgccttcctccgtaagaacaccggcagttagcaggacaggggaggccaggaggaggaggaggctgcagcgatgccgctgttcccagtctgccgaggggcgatcaccgggtagctcgccgccgcagctggagcgcctcttctccaatgtcaacaaggcaaccatgaagcacgagccagggagtatcactggttccatcttccttgtggccgggacaacggtcggggcaggtatccttgcgatccccgccgtcacacaagaagctggattcttggcctcagcagtcacatgcattttctgctgggcatatatggttataacagggctgttagttgctgaagtaaacgtcaatacaatgtgtgagctaggatctggaggtgtctccctggtttcgatggctaagcgcactctagggacagttggagtaagaacagcctgcttttcatatttgtttatacattatgcacttcttgttgcgtatgtggcacgatcttcagagatcttaacaaactcattgggcattccattatgggagagtgccaccctattttcgctggcttttgggggtctatgctacttcggaagtcagagagtcattggtgccgtgaatggctttttggtgttcagtatcataacatccttcacagctcttgtggtggtggcaagtggaaatatacagtggagttctcttcttgaaacgaattttgctgctgctccccaaagtataccaataattgctctttcattcgtatatcagaatgtagttcctgtcctgtgtacaaatttggaaggagacctgtcaaaagtaagaaaggccattgtattaggtactgccataccccttgctctgtttctcatatgggatgctgtcatcctggggacaatcccggggtttgcagaaagtggggctgttactgatccgttacaacaacttaggtcaagcaatggtacagtggggcctatcgttgaggcattctcatttctggcaataggcacatcatacattggatttgttctaggactctcagacttcatcgcggactatccagagatatttttcaaggcattggactttgcaggaacttatggagttctagtactctttggagttttccctgcagctatgtcttggtcagagagatactcaaatgacttggaagctcctatatcccctatagtcccaggaggaaaattaaccctctcatttgttatggggggtgccttgcttgtaatattttcggagattttcaaggacataatgcagctgcaaggactacattgacaattacaacgtgcaaagttcaactactgatgcttctgcagattttggtccaatgtattaacacacccaaaataaactaatccagtatttctagcttttcttaaaaaaaaaaaaaaa

SEQ ID NO: 70112 - protein, 448 aa, Hordeum vulgare
MAAAAALQCCPLLSSPLASSVSPPSSVRTPAVSRTGEARRRRRLQRCRCSQSAEGRSPGSSPPQLERLFSNVNKATMKHEPGSITGSIFLVAGTTVGAGILAIPAVTQEAGFLASAVTCIFCWAYMVITGLLVAEVNVNTMCELGSGGVSLVSMAKRTLGTVGVRTACFSYLFIHYALLVAYVARSSEILTNSLGIPLWESATLFSLAFGGLCYFGSQRVIGAVNGFLVFSIITSFTALVVVASGNIQWSSLLETNFAAAPQSIPIIALSFVYQNVVPVLCTNLEGDLSKVRKAIVLGTAIPLALFLIWDAVILGTIPGFAESGAVTDPLQQLRSSNGTVGPIVEAFSFLAIGTSYIGFVLGLSDFIADYPEIFFKALDFAGTYGVLVLFGVFPAAMSWSERYSNDLEAPISPIVPGGKLTLSFVMGGALLVIFSEIFKDIMQLQGLH

SEQ ID NO: 70113 - DNA, 1574 bp, Linum usitatissimum
  CDS (96)..(1547)
ctcgccttctcgtttctccgtcctccagtcttctcccgccgccgtttctgttttggacttcaattcttcgatcgacagctacgttgccggacaggatgccggaggaaaccgactccatcgactatgccatggagaaggcctctggtcctcacttctccggccttcgcatcgacagcctcctttcttcccctcctgcttcttccacttcatctcctgctcatcgttcttctcctaccgctgctggttctgttttcgctgacgccaatgctctcaggcagcccttcgtcattggggtttctggaggtaccgcttcggggaagactacggtgtgtgacatgatcattcagcagctccacgatcaccgtgttgtgcttgtcaatcaggattcattctatcgtggattgacgcctcaagaactagaacgcgttcacgaatacaacttcgatcatccagatgcatttgacactgaccagcttttggactgcgttgaaacacttaagcgtgggcttccttatcaagtccctatatatgacttcaagacccatcagcgttgttcagatagctttaggcaggtgaatgcttctgatgttattatattagagggtatattggttttccatgatcaacgtgttcgcaagcttatgaatatgaagatctttgttgatacagatcccgatgtgaggcttgctcgcagaattcggcgtgacactgttgagaggggtagagatataaactctgttcttgagcagtatgctaaatttgtgaagcctgcttttgatgatttcgtacttccttcgaaaaagtatgccgatgtgatcatacctcgtggaggtgataatcatgttgccattgatttgatagttcagcatatccagacgaagcttggtctacatgacctctgcaaaatatatccaaatgtgtatgttattcaaacaacttttcagattagaggcatgcataccttgattcgagacagggaaatttcaaagcatgattttgttttttactcggatagacttattcggctggttgttgaacatggccttggtcatttgccattcacggagaagcaagttgttacccctaccgggtcagtttatactggcgttgacttctgcaaaaaattatgcggagtttctatcgtacgaagtggagaaagcatggaaaatgcattgcgtgcatgttgcaaagggataaaaattggtaaaattttaatccacagggatggcgacaacggaaagcagcttatatatgagaagcttccaaacgacatttccgaaaggcacgtcctgcttctagatcctgttcttgccactggtaactcggccaaccaagcaatcgatctactcatacagaaaggagttccagaatcccatattatattcttaaacctaatctctgcacccgaaggcatccactgcgtctgcaagagttttccatctcttaaaatcgtgacttctgaaatcgatatagcaataaacgacgaatttcgggttgtacctgggctgggagagttcggtgatcggtactttgggactgatgattgattgaagcaactaactgaggattttctg

SEQ ID NO: 70114 - protein, 483 aa, Linum usitatissimum
MPEETDSIDYAMEKASGPHFSGLRIDSLLSSPPASSTSSPAHRSSPTAAGSVFADANALRQPFVIGVSGGTASGKTTVCDMIIQQLHDHRVVLVNQDSFYRGLTPQELERVHEYNFDHPDAFDTDQLLDCVETLKRGLPYQVPIYDFKTHQRCSDSFRQVNASDVIILEGILVFHDQRVRKLMNMKIFVDTDPDVRLARRIRRDTVERGRDINSVLEQYAKFVKPAFDDFVLPSKKYADVIIPRGGDNHVAIDLIVQHIQTKLGLHDLCKIYPNVYVIQTTFQIRGMHTLIRDREISKHDFVFYSDRLIRLVVEHGLGHLPFTEKQVVTPTGSVYTGVDFCKKLCGVSIVRSGESMENALRACCKGIKIGKILIHRDGDNGKQLIYEKLPNDISERHVLLLDPVLATGNSANQAIDLLIQKGVPESHIIFLNLISAPEGIHCVCKSFPSLKIVTSEIDIAINDEFRVVPGLGEFGDRYFGTDD

SEQ ID NO: 70115 - DNA, 1640 bp, Brassica napus
  CDS (45)..(1496)
gttttcttctccgcagacctaatcggaatttcgccgcgaatccaatgcctgaagactctacgtcgattgactacgtcatggagaaggcatcggggcctcacttctccggtcttcgcctcgacggccttctctcttctccgtccaaatccaccaactcttccccttctcccttccgttccggcgttccatctttctcccagatttccgatcccgccgcgcctaatcagcctttcgtcatcggagttactggtggtacagcttctggtaagaccacggtgtgtgacatgattatccagcagcttcatgatcatcgcattgttctagttaaccaggattccttttaccgtggtctgacatctgaagaactggagcgtgcgcaagaatacaacttcgatcatcctgatgcatttgacactgaacagcttttgcattgcatcgatacactcaagagtgggcaaccctatcaaattccaatttacgacttcaagacccatcaacgtaaatcagatgcttttcgccaggtcaatgcttgcgatgtcataattttggaagggattctagtttttcatgactcacgagttcgggatctgatgaatatgaagatcttcgttgacacagatgctgatgtgaggcttgctcgcagaatcagacgtgacactgttgagaggggtagggatgttgattctgtccttgaacagtatgcaaagtttgtgaagcctgcgtttgatgattttgtgctgccttcaaagaaatatgccgatgtgatcattcctcgaggaggtgacaatcacgttgcagttgatttgattgtgcaacatatccacacaaaacttgggcaacatgatctctgcaaaatctacccaaatctttttgttatccaatcgacatttcagataagaggcatgcatacacttattcgagagaaggacatatcaaaacatgactttgtgttttactcagatcgactcattcgtctggttgtagagcatggtcttggccatttgccattcactgagaaacaagtagttactccaacaggatctgtgtatagcggtgttgatttctgcaagaaactttgtggggtctcaatcattcgaagtggtgaaagcatggaaaacgcgttacgtgcatgttgtaaagggatcaaaatagggaagattcttattcatcgtgaaggcgacaacggaatgcagcttatatatgagaagcttccaagtgatatctccgagcgccatgtcctgcttctagatcccgttttaggcacaggtaactgtgcaagtcaggcgatagagctactcatacgtaaaggagtccctgaatctcacataatattcctcaatcttatctcggctccggaaggaatccactgcatctgcaaacggtttccgctgttgaagattgtgacatcggaaatagatcagtgtctgaatgaagactttcgggttataccaggcttgggtgaatatggcgatcgctactttggtactgacgagtaaaactagttactaatctctggtttcaaaatccggtgtaatggttgttgtgtctttgtctgcggaagcataaaattgcgacaatgttatcaaaacatgaaccataaagggaaatattgtttgtttttttttaaaaaaaaaaaaaaa

SEQ ID NO: 70116 - protein, 483 aa, Brassica napus
MPEDSTSIDYVMEKASGPHFSGLRLDGLLSSPSKSTNSSPSPFRSGVPSFSQISDPAAPNQPFVIGVTGGTASGKTTVCDMIIQQLHDHRIVLVNQDSFYRGLTSEELERAQEYNFDHPDAFDTEQLLHCIDTLKSGQPYQIPIYDFKTHQRKSDAFRQVNACDVIILEGILVFHDSRVRDLMNMKIFVDTDADVRLARRIRRDTVERGRDVDSVLEQYAKFVKPAFDDFVLPSKKYADVIIPRGGDNHVAVDLIVQHIHTKLGQHDLCKIYPNLFVIQSTFQIRGMHTLIREKDISKHDFVFYSDRLIRLVVEHGLGHLPFTEKQVVTPTGSVYSGVDFCKKLCGVSIIRSGESMENALRACCKGIKIGKILIHREGDNGMQLIYEKLPSDISERHVLLLDPVLGTGNCASQAIELLIRKGVPESHIIFLNLISAPEGIHCICKRFPLLKIVTSEIDQCLNEDFRVIPGLGEYGDRYFGTDE

SEQ ID NO: 70117 - DNA, 2318 bp, Glycine max
  CDS (128)..(2110)
gaattcccgggtcgacttcgctgtcgacgatttcgtcttgacttgaactcaggcatctctattcctcttaatattatattattattattccaagagcacatgacttgaacatctttggcttcccctaatggcacaagatactgtttctggagttgactcgcctcggggacgtctattacgagatcaggttcaagtggttaaaaaaaaggattctgatcgctatgaaattgttcctatccaagattctttgtcatttgagaaaggattcttcatatttatccgtgcatgccagttgttggctcaaaagaatgatggaatcatattagtaggagttgcaggtccatctggagcagggaaaactgttttcaccgagaaggtcctcaattttatgccaagcatagctgtcataacaatggacaattataatgattctagtagaattattgatggaaacttcgatgaccctcggttgacagattatgataccctgctcgaaaatatacagggtcttaaagcagggaagcctgttcaagttccaatatacgatttcaagtctagttctcgcataggttacaggactgttgaagtccctggctctcgtattgtaatcatagaaggcatctatgccttaagtgaaaaattacgacctttgcttgatcttcgtgtttctgtcactggtggagttcattttgatcttgtcaagcgtgttttgcgggacattcatcgtgccggtcaagagcctgaagaaataattcatcaaatctctgaaacggtgtatcctatgtataaagcttttatcgagccagatctccaaacagcccatttaaaaattattaacaagtttaatccattctctggatttcagaatcccacctacatattgaagtcagcaagaactgtgacagttgatcaaataaaggcagttattgctgcagagcatactgaaactaaagaggaaacatatgacatatttcttctaccccctggggaagaccccgaagcttgtcaatcatatttgagaatgagaaaccgtgatggaaagtacaatctcatgtttgaggaatgggtgacagatagtccattcataatatcacctagaattacttttgaagtcagcgtgcgccttcttggagggctgatggccttgggatacacaattgcagctattctgaaaagaagcagccatgtctttcatgatgataaagtgaccataaaaactgattggctagaacaacttaatcgcacatatgttcaggtgcaagggaaagacagaaactattgcaaattttttgcagagaaactggggttggatggttcctatgttcctcgcacttacattgaacaaattcagctagaaaagcttgtaaacgatgtgatggcattgccagatgatcttaagacaaaactcagcatagatgatgacttggtttcaagccccaaagaagccctttccagagcttctgcagataggagaatgaagtatcttaatcgcggtatttcacaatcctattcaactcaaagggacaagattctacctaagctgactaaacttgctataaataacagaagatttgatggaagagcactagaatcccctgcaccaattgctaaccaaggagtcatcactcaactttctgatcaaatttcaacattaaatgaaagaatggatgaattcacctcccgtattgaagagctgaattcaaagttcgctatcagaaaagattcagcaggcagtcaacaaaacttggctttacaggctgaggcctgcaatggctcaggccccacttccttctttgtaactggacgaggcaatggttcattgactggatcattgctacctaattcatcatcatcttctcagttggctaaagagtctcccctgatggaagaggtattagtgattgcacgaggacaacgtcaaatcatgcatcaactagacactctgagcaatcttttgcatgaatactttggagaaaggtcacgcctgggaagaccagaccatacaggaagaatgcgtgaagctgaatccgtcgccgtccccctgcttctgactctggccattggtgctgttggtgtgcttttgttcagaggtttgacatcccaaaaataatgtgcatatattttgtttcttgtaaaattgtcattaccatttaggagagaagcctcataagtatatctaatgcataaagggtttatgaaaacaattgccaatctgtgaggggctgcctcacattaagtggtagtagtagtggacgacgaccttaataggtatattttggcattcacttaagctgtaatatacgacacgcagcggccgc

SEQ ID NO: 70118 - protein, 660 aa, Glycine max
MAQDTVSGVDSPRGRLLRDQVQVVKKKDSDRYEIVPIQDSLSFEKGFFIFIRACQLLAQKNDGIILVGVAGPSGAGKTVFTEKVLNFMPSIAVITMDNYNDSSRIIDGNFDDPRLTDYDTLLENIQGLKAGKPVQVPIYDFKSSSRIGYRTVEVPGSRIVIIEGIYALSEKLRPLLDLRVSVTGGVHFDLVKRVLRDIHRAGQEPEEIIHQISETVYPMYKAFIEPDLQTAHLKIINKFNPFSGFQNPTYILKSARTVTVDQIKAVIAAEHTETKEETYDIFLLPPGEDPEACQSYLRMRNRDGKYNLMFEEWVTDSPFIISPRITFEVSVRLLGGLMALGYTIAAILKRSSHVFHDDKVTIKTDWLEQLNRTYVQVQGKDRNYCKFFAEKLGLDGSYVPRTYIEQIQLEKLVNDVMALPDDLKTKLSIDDDLVSSPKEALSRASADRRMKYLNRGISQSYSTQRDKILPKLTKLAINNRRFDGRALESPAPIANQGVITQLSDQISTLNERMDEFTSRIEELNSKFAIRKDSAGSQQNLALQAEACNGSGPTSFFVTGRGNGSLTGSLLPNSSSSSQLAKESPLMEEVLVIARGQRQIMHQLDTLSNLLHEYFGERSRLGRPDHTGRMREAESVAVPLLLTLAIGAVGVLLFRGLTSQK

SEQ ID NO: 70119 - DNA, 1771 bp, Glycine max
  CDS (278)..(1501)
gaattcccgggtcgacttcgctgtcgacgatttcgtccaaaacaaggggtagtcacagaaacacataaacaagaagacacccaccaatattttgctttctcttttcttttcctgcttataactgccttttgttttggtttttaattccacctcatattttatatgtgttccaaacttcttcttggaatgtcccttccttaatacccctcaaagaaaagccaccttaacatctcttctctgaaaattctctttagagagatagagagaggaagaaagaatggcagcttgcactgtctactcaacacaatctctgagcacaaattgctccatctcaaccccatcaaagacgcaactcagttttttccaccaaaagcaggtagttttctggaggaacagcaagaagggcagctgcagcagcagaagaagctatgtgataacatgtgcagcaggtgactcacagacagtggtgattggcctggctgcagactcagggtgtgggaagagcaccttcatgaggaggctgaccagtgtgtttggaggagcagcagagccaccaaagggtggcaaccctgactccaacactctcatcagtgacaccaccactgtcatatgcttggatgattaccactctttggacagaactggaagaaaggagaagggtgtcactgcccttgaccctagagccaatgattttgatctcatgtatgaacaagttaaagctcttaaggatggaattgctgttgaaaaaccaatctacaaccatgtcactggtctcttggatccccctgagctcattaaaccccccaaaatcttagtcattgaaggtttgcacccaatgtttgattcccgtgtcagagatctcttggactttagcatctacctagacattagcaatgaggtcaaattcgcttggaaaattcagagagacatggcagagcgtggacacagtcttgaaagcatcaaggctagcattgaagcaaggaagcctgattttgaagcatatattgatccacaaaagcaatacgcagatgcagtgatagaagtgttgccaacgcaactcattccagatgacaacgagggtaagattttgagagtgagattgatacagaaagagggggttaagtactttagcccggtttacttgtttgatgatggctctaccatttcatggataccatgtggaagaaagcttacatgctcctaccctggcatcaaattcttctatggacctgagacttactacggaaatgaggtgtcagttgtagaaatggatggacaatttgacagactagatgaactaatatacgttgagagccacctaagcaacctctctacaaagttctatggagaggttactcaacagatgttgaagcatgctgattttcccggcagcaacaatggaacaggtctcttccaaaccatagttggtttgaagataagagatctatatgagcagctaatagccagcaaggctgagactccagtagctgcaaaagcttaggaattgaacctgccataatatatatacatatatcgatcgagcaacgcagccaaattgagttctctcatcatcaaaatcatcattttctttcttctttcatgttttccacaattccactctatttcatgttattttgtcaattgttattaggctgttctgcatgataattaatgaaaaaaacactatgtatgtatgtacttacccgagaagaaaaagcgaggctgagattcagttatgttgatacaagattgagacaaaaaaaaaaaaaaa

SEQ ID NO: 70120 - protein, 407 aa, Glycine max
MAACTVYSTQSLSTNCSISTPSKTQLSFFHQKQVVFWRNSKKGSCSSRRSYVITCAAGDSQTVVIGLAADSGCGKSTFMRRLTSVFGGAAEPPKGGNPDSNTLISDTTTVICLDDYHSLDRTGRKEKGVTALDPRANDFDLMYEQVKALKDGIAVEKPIYNHVTGLLDPPELIKPPKILVIEGLHPMFDSRVRDLLDFSIYLDISNEVKFAWKIQRDMAERGHSLESIKASIEARKPDFEAYIDPQKQYADAVIEVLPTQLIPDDNEGKILRVRLIQKEGVKYFSPVYLFDDGSTISWIPCGRKLTCSYPGIKFFYGPETYYGNEVSVVEMDGQFDRLDELIYVESHLSNLSTKFYGEVTQQMLKHADFPGSNNGTGLFQTIVGLKIRDLYEQLIASKAETPVAAKA

SEQ ID NO: 70121 - DNA, 2096 bp, Triticum aestivum
  CDS (110)..(1852)
gaattcccgggtcgacttcgctgtcgacgatttcgtgagcgcggactgtttccctccccacttccccagtcacgaggcctagggttcgtaggtgggtccacttgcttacatggcctctatggttgccgccgcgcgcctcgccggcggggtctcgcggctgtcggctcagggttctactgcccggggccttccgcccggcagccttcgacttcccccgccgcgccggcgtctgcgcagcagcgtccggtgctgcgtggttcgccatcccggcggcggcggcggcgtggacgcgggggaggagttcgtcgggttcttccgggaggcgtggccgtacatacggggccatcgtgggagcaccttcgtggtcgttatatccagcgaggttgtgtcggggccacacttggaccgcattttgcaggatatttcactacttcatggtcttggcattaactttgttcttgttccgggaacacatgtccagattgataaactattgtcagaaagaggaaggaaggctaagtatgttggtcagtaccgagttaccgattctgattcactagaagctgcgatggaggcagctggcagaataaggttaacaatagaagcaaagctctctcctggccctccaatgttaaacctccgtagacatggtgttattggtcattggcatggtcttgtggataatgttgcaagtggcaatttccttggtgctaagagaagaggggtagttcatggtgttgattacggatttactggtgaagttaagaaaatagatgttgcacggataaaagaaaggcttgatagtgatagcattgttgttgtgagcaatatgggatactcgagctcaggagaagttctaaattgcaacacttacgaagtagccaccgcatgtgccttagccatagaggcggataaacttatctgcgttgtggacggtcagatatttgatgagaatggacgagtcattcatttcatgtctctggaggaagctgatatgttgatcagaaagcgtgctaagcaaagtgatattgctgcaaattatgtcaaggttgttgatgaggaggaccatgaaccatctttgaacggaaaggggcatcttaatgggtacgctgcttcttttcaaaacggtttgggttttaacaatggaaatggtatttgttctggtgagcaagggtttgctattggtggtgaagagcgattaagcaggtcaaatggctatctttctgagttggctgcagctgcttatgtatgccatgctggtgttcaaagagtgcatatcatagatggtacagttgatggatcactgctattagagttgtttacaagagatggtgctgggacaatgattgcgagggatgtttatgaaggaacaagaatggcgacggaggaagatcttcctggcataagaaaacttatctacccactagaggaatctggtgttttagtgcgaagaacagataaagagcttcttgaagcgttgtattcattctatgttgttgaaagagatggttcagtaattgcatgtgctgctctctttccatttcccgaggacaaatctggtgaagttgctgcaattgctgtatctgaagaatgccgaggaagaggtatgggggataagttgcttgattacattgagaaggaggcattatcccttggtcttggcaaattgttcttgcttactacacggacagccgattggtttgtgcgacgtggcttctcagagtgttcgattgaatctattcctgagcagagaagaaaacgcatcaatctgtcacgtggatcaaaatattatataaagcagctccagccaaagcatgctggtgtccctgtcaacaattttgctggcagatgatagggcttccaagaatttttgtgagagtgagacgagatatctgcactggttacatcaaggcttttatatatgttattagttgtaatttcagatagaaatataactgcagcctgtgatagcggcttaaattttttctcttttacttatggatgtaaaaaaggcactttgtgacacaacagaaaacaaatatcagaggaatttctatacagaaaccatctgcaagcagtataaaaaaaaaaaaaaa

SEQ ID NO: 70122 - protein, 580 aa, Triticum aestivum
MASMVAAARLAGGVSRLSAQGSTARGLPPGSLRLPPPRRRLRSSVRCCVVRHPGGGGGVDAGEEFVGFFREAWPYIRGHRGSTFVVVISSEVVSGPHLDRILQDISLLHGLGINFVLVPGTHVQIDKLLSERGRKAKYVGQYRVTDSDSLEAAMEAAGRIRLTIEAKLSPGPPMLNLRRHGVIGHWHGLVDNVASGNFLGAKRRGVVHGVDYGFTGEVKKIDVARIKERLDSDSIVVVSNMGYSSSGEVLNCNTYEVATACALAIEADKLICVVDGQIFDENGRVIHFMSLEEADMLIRKRAKQSDIAANYVKVVDEEDHEPSLNGKGHLNGYAASFQNGLGFNNGNGICSGEQGFAIGGEERLSRSNGYLSELAAAAYVCHAGVQRVHIIDGTVDGSLLLELFTRDGAGTMIARDVYEGTRMATEEDLPGIRKLIYPLEESGVLVRRTDKELLEALYSFYVVERDGSVIACAALFPFPEDKSGEVAAIAVSEECRGRGMGDKLLDYIEKEALSLGLGKLFLLTTRTADWFVRRGFSECSIESIPEQRRKRINLSRGSKYYIKQLQPKHAGVPVNNFAGR

SEQ ID NO: 70123 - DNA, 1956 bp, Brassica napus
  CDS (98)..(1870)
tgggtcccacttaccgccgccgtctcccgccggtttaaattcattttctatggaatcttaattgatttcttctaaaacgaagcagtgcaagtaaaaaatgatggagcagggagctttgttgcgttctgcgtcttttcaattacgccgaacgaggaacgatctttcgtctttcaagccggaaaataagttaaaccctggtcaaatccggtttaggtttaaaccggttggttccgtggcggcgaaatgcaatacgtacaacagctacgcggcgagtggaggcggcgacgcgggggctgagcatccagtggacgacaaagagttcgtgcgctggttccgtgaagcttggccttatctgtgggcccacggtggctgcactttcgtcgttgtcatctccggcgatatactcgccggcccttactgtgatcccattttaaaggacatagcgtttctccatcatcttgggataagattcgttctagttccaggaacacaagtgcaaatcgaccagcttctgtctgaaagaggacgcgaggctacatatgtgggacgttacagagtaacagacgcagcatcgttgcaagccgccacggaagctgcgggagctatctcagtgatgcttgaggctaaactatctcctggaccttccatttgcaatatccgtaggcatggtgatagtagtcgtttgcatgatataggtgtcagggttgataccggcaacttctttgcagcgaaaaggagaggcgttgttgatggtgttgattttggagcgactggtgaagtgaagaagatagatgttgaccggatttgtgagaggcttgacggtggttctgtagtcttgttgaggaacttgggtcactctagctccggagaagtcttaaattgcaatacctatgaggttgctacagcttgtgcattagctataggagcagataagcttatttgcataatggacggtccaattcttgatgagagtggacatcttattcgtttcttgacactccaagaagcagatacgttagtgagaaaacgtgtacagcaaagcgacattgctgctaactatgtaaaggctgttggtgatggaagcatggcttatcaagaacctcctggtaacgggagagcagcgttttggggaaacgggaaccacactccgatctttcaaaacggtgttggatttgacattgggagtgggttagggtctggtgagcaaggctttgctattggtggtgaggagagactaagccgccaaaacggttatctttccgaactggctgctgctgcttttgtctgcaggggtggagttaaaagagttcatttgttggatggtactataactggagttctattgttggagcttttcaaaagagatggaatggggactatggtcgctagtgatgtatacgaaggaacacgagacgccaaagtaaatgatcttgcaggaatcagacgtatcatcaaacctttggaggaagctgggatcttggtccgcagaaccgacgaggagttactccaagctttggactccttcgtggtagtcgaaagggaaggtcaaatcatcgcttgtgcagctctgttcccattcttccaagacaaatgcggagaagtcgcagccatcgcggttgcatcagactgccgcggtcaaggccaaggcgataaactactagattacatggagaagaaagcatcctctctcgggttagacacgctgtttctcctcacaacgcgagcagcagactggttcgtgagacgcgggttccaagaatgctcaatcgaggtcataccagagaccagaaggcaaagaatcaacctctcaagaaaatcaaagtactacatgaagaagctactacctgataagagtggcatctcaatataacacaaacagcaatcattattgtaaaaattaaaaaacattttgcaatcaagcttttatttctattattcaagaaaaaaaaaaaaaaa

SEQ ID NO: 70124 - protein, 590 aa, Brassica napus
MMEQGALLRSASFQLRRTRNDLSSFKPENKLNPGQIRFRFKPVGSVAAKCNTYNSYAASGGGDAGAEHPVDDKEFVRWFREAWPYLWAHGGCTFVVVISGDILAGPYCDPILKDIAFLHHLGIRFVLVPGTQVQIDQLLSERGREATYVGRYRVTDAASLQAATEAAGAISVMLEAKLSPGPSICNIRRHGDSSRLHDIGVRVDTGNFFAAKRRGVVDGVDFGATGEVKKIDVDRICERLDGGSVVLLRNLGHSSSGEVLNCNTYEVATACALAIGADKLICIMDGPILDESGHLIRFLTLQEADTLVRKRVQQSDIAANYVKAVGDGSMAYQEPPGNGRAAFWGNGNHTPIFQNGVGFDIGSGLGSGEQGFAIGGEERLSRQNGYLSELAAAAFVCRGGVKRVHLLDGTITGVLLLELFKRDGMGTMVASDVYEGTRDAKVNDLAGIRRIIKPLEEAGILVRRTDEELLQALDSFVVVEREGQIIACAALFPFFQDKCGEVAAIAVASDCRGQGQGDKLLDYMEKKASSLGLDTLFLLTTRAADWFVRRGFQECSIEVIPETRRQRINLSRKSKYYMKKLLPDKSGISI

SEQ ID NO: 70125 - DNA, 1417 bp, Brassica napus
  CDS (151)..(1176)
gaattcccgggtcgacagtaactattggttcattactgtttgcctgcgacatacaccgctgaagattttaactaatttgtaactaaacctgagagactctctcgcttcagtattatctccgccgcctactccggtaggagtcactcagatatggccaccgtcacatccaaaacgccgcctaaatccttctccttctccatttccaatcctctcaaacccctaacccccaaatctccatccctccgctttccacctcgcaacaatcatcaccaccaccgtttatccgtaaacgccgccgtatcaccaccgccttcagacacaccttcgccggattatagattcgagatcctctccgagtccctacccttcatccaaaaattccgaggcaaaaccatcgtcgtcaaatacggcggcgcggccatgacttcgccggagctaaaagcctccgtcgtcaccgacctcgtcctcctcgcgtgcgtcggtctccgccccatcctcgtccacggcggaggtcccgacatcaaccgctacctcaaacagcttaacatcccggccgagttccgcgacggactccgcgtcaccgacgccacgacgatggagatcgtctcgatggttctcgtcggaaaagtgaacaagaatctcgtttctttaataaacgccgccggagccaccgctgttgggctgtccggacacgacggtcgtcttatcaccgcgcggcctgttcctaactcggatcagttaggttttgtcggagaagtcgcgagggttgatccgagcgtgttgcgtcccttagtagaatccggttacattccggtgattgcctctgtggctgcggatgaagctggtcaggcttataacatcaatgcggatacggtggcgggggagctcgcggcggcgcttggagctgagaagctgattctgttgactgatgtggcggggatcttggaggatagagaggatgtggggagcttggtgaaggagattgatataaagggagtgaagaggatgattgatgatgggaaagttggtggtgggatgattcctaaggtgaagtgctgtataaggtcacttgctcagggagtgaagacggcgagtattatcgatgggaggaggcagcattctttgcttcatgagatcatgtctgatgaaggagctggaactatgattactggatgaaatgtgatgttataggtgatccatggttttgtatttgagaatgccaatgcctgtgtgtaggcaagatacattcatgatcgctgcttatgagtcttagaaagacaatttttttggcagctcttgtggtttgcatttgcaacttcgttgtttctgatttctaatgattatcattggtcttgaaaagttataaatttttgaagacaataagctgttctaaggaaaaaataaaaaaaaaaaaaaa

SEQ ID NO: 70126 - protein, 341 aa, Brassica napus
MATVTSKTPPKSFSFSISNPLKPLTPKSPSLRFPPRNNHHHHRLSVNAAVSPPPSDTPSPDYRFEILSESLPFIQKFRGKTIVVKYGGAAMTSPELKASVVTDLVLLACVGLRPILVHGGGPDINRYLKQLNIPAEFRDGLRVTDATTMEIVSMVLVGKVNKNLVSLINAAGATAVGLSGHDGRLITARPVPNSDQLGFVGEVARVDPSVLRPLVESGYIPVIASVAADEAGQAYNINADTVAGELAAALGAEKLILLTDVAGILEDREDVGSLVKEIDIKGVKRMIDDGKVGGGMIPKVKCCIRSLAQGVKTASIIDGRRQHSLLHEIMSDEGAGTMITG

SEQ ID NO: 70127 - DNA, 2132 bp, Glycine max
  CDS (116)..(1924)
gaattcccgggtcgacttcgctgtcgacgatttcgtggcaaacaaatttctgggcgtggcggctaaagtttgtgagtggtctctgccaccaaccccgcactgtgtgggatcttcaatggcaccttccttatgtctatcccttccaaacacttccaccttctctgatttcaacaagctacactgtttctgtttccacccaaaaaaaccgaaccggcaatttatgtctggttgggtcccagaagctcggcccgtggcggcccatttgggttaccgaaagaagcttaatgcgttgagccaagatggagagagctaccacgggacgatggaggataagcaattcgtgcgttcgtttcgcgaggcctggccttacttgtgggcctatcgtggtagcacctttgttatcattatttccggtgaaattgtttctggtcctttcttggatcccattctcaaggatatagctttccttaatcacctaggtatccgctttgttcttgttccggggacacatgtgcagatagacaagcttctgaatgagagagggtgccagcctaagtatgttggtagatataggataactgatgatgaatctctggaagctgcgatggaagcagctggaggcataagattgatgatagaagcaaaactttctcctggaccttctatatgcaatattcgtcgacatggtgacaatagtcgatggcacgaagttggtgtcagtgttgccagtggtaactttcttgcagccaagagaagagaggtggtcaatggaattgattttgggtcaactggggaagttaaaaaagtagacgtatctcgcatgcgtgagagacttgatggtggttgtgtagttatattaaccaacttgggctactccagctctggagaagtattaaattgcaacacttatgaagttgccacagcttgtgccttggctataggggcagacaaattaatatgccttatagatggtccaatacttgatgagagtggacgcttaattcgtttcttgccacttcaagaagcagacatgctaattcgtaaacgggctgagcaaagtgaagcagctgctaactatgtgaaagctgttgacgaagaaggtttcaactctcttgagtataacaattttaatggagcagtcaaatcaccacctattggacgttttacagaatggcataatgcaaccttccataatggtgttggttttgagagtggaaatggcttagggtctggtgagcaaggttttgctattggaggtcaagaacggctaagtcgaatgaatggttacctgtcagaattggctgctgcagcttttgtttgcagaggtggtgttcaaagagttcacttgctggatggaactattagtggagttttgttgttggaattgtttaaaagagatgggatgggaacgatggtggctagtgacctttatgaaggcactcggacagcaggggtaaaagatatttctggaataaaacaacttattcagcctttggaggcatctggcatattggttaagcggactgatgaagagctgttaaaaacattggattcgttcattgttgtggaaagagaaggtcacataattgcttgtgctgccctttttcctcactttgaggagaagtgcggagaggttgcttgtattgcagtatctcctgattgccgtggccaaggacagggtgacaaattgcttgattatatggagaagaaagcatcatctcttggattgaatatgcttttccttcttacaacacgtacagcagattggtttgtaaggcgtggattttcggaatgttcaattgattatcttcctgaaaagaaaaggagaatgatcaatctttcccgcaattctaagtattatatgaagaagcttctgccaaatattagtggaattactgttggtgtaaaatctgcttcaagttagtactattttatgttgtttccacctaccaggaatggagggtgattggaagcaatattatgaggcacttctatagataattacttcgtaacagtatggcctctagaattattactatctctggcaggtcttccacgtgtaagcattaagtttctaactttctactgttaatatattgttagtatttaatttccgcaaaaaaaaaaaaaaa

SEQ ID NO: 70128 - protein, 602 aa, Glycine max
MAPSLCLSLPNTSTFSDFNKLHCFCFHPKKPNRQFMSGWVPEARPVAAHLGYRKKLNALSQDGESYHGTMEDKQFVRSFREAWPYLWAYRGSTFVIIISGEIVSGPFLDPILKDIAFLNHLGIRFVLVPGTHVQIDKLLNERGCQPKYVGRYRITDDESLEAAMEAAGGIRLMIEAKLSPGPSICNIRRHGDNSRWHEVGVSVASGNFLAAKRREVVNGIDFGSTGEVKKVDVSRMRERLDGGCVVILTNLGYSSSGEVLNCNTYEVATACALAIGADKLICLIDGPILDESGRLIRFLPLQEADMLIRKRAEQSEAAANYVKAVDEEGFNSLEYNNFNGAVKSPPIGRFTEWHNATFHNGVGFESGNGLGSGEQGFAIGGQERLSRMNGYLSELAAAAFVCRGGVQRVHLLDGTISGVLLLELFKRDGMGTMVASDLYEGTRTAGVKDISGIKQLIQPLEASGILVKRTDEELLKTLDSFIVVEREGHIIACAALFPHFEEKCGEVACIAVSPDCRGQGQGDKLLDYMEKKASSLGLNMLFLLTTRTADWFVRRGFSECSIDYLPEKKRRMINLSRNSKYYMKKLLPNISGITVGVKSASS

SEQ ID NO: 70129 - DNA, 1210 bp, Helianthus annuus
  CDS (57)..(953)
gtcgacgatttcgtttgcccgatagtaaatcggactcggtaaagtttgatgcaaggatgctctctttcctgccgaaaacgatatttgagaagcatgaggagtacctttacttgaggctggtgaaagacatcatttctaatggcgctttaaagggtgaccgtactgggactggtactttatcaaaatttggttgtcagatgcggttcaatctgagaaagtctttcccgcttcttacaacaaagaaagtgttttggcgtggagttgtggaagaacttttgtggttcatcagtgggtcaacaagtgccaaggttttacaagataagggcattcatatatgggatggtaacgcatccagaaactacctagacagtattgggttggtggatagagaagaaggtgacttgggaccagtatacgggtttcagtggagacactttggtgcaagctataccaacatgcatgctgactacactggccaaggattcgatcaactgctagacgttatcaacaaaataaaaaacaatcctgacgatcgtcgaataattatttcagcgtggaacccttctgatcttaagcagatggcgcttccaccttgtcacatgtttgcacagttttatgtaaatcaaggagagttatcgtgtcaaatgtatcaacgatctgccgatatgggtttgggcgttccttttaacatagcgtcatacgccttattaacatgcatgatcgcccatgtttgtgatcttgttccgggtgattttgttcacgttcttggtgatgcgcatgtctatagcaatcatgtccgacctctgcaggaccagcttcagaagctgcctagaccttttcctattttgaagatcaatcctgagaagaaggatatagatgcttttgtggcgaatgattttaaactcataggctatgatccccaccagaaaatagaaatgaaaatggcagtatagagttatcatctatcttcaggtattcgtaaggacaaatatgaaccgttgttccctgtttacatcataatttatatctttatcttatggttttgcatagctacattcctatttaaacttgtcggtttactagaggactagaggtgcgtattattccgagctttatggcacttttagtagggcaaaataactattcgtattgcgcttttagttcatgctttatttgacatttcataattcatgctaaaaaaaaaaaaaaa

SEQ ID NO: 70130 - protein, 298 aa, Helianthus annuus
MLSFLPKTIFEKHEEYLYLRLVKDIISNGALKGDRTGTGTLSKFGCQMRFNLRKSFPLLTTKKVFWRGVVEELLWFISGSTSAKVLQDKGIHIWDGNASRNYLDSIGLVDREEGDLGPVYGFQWRHFGASYTNMHADYTGQGFDQLLDVINKIKNNPDDRRIIISAWNPSDLKQMALPPCHMFAQFYVNQGELSCQMYQRSADMGLGVPFNIASYALLTCMIAHVCDLVPGDFVHVLGDAHVYSNHVRPLQDQLQKLPRPFPILKINPEKKDIDAFVANDFKLIGYDPHQKIEMKMAV

SEQ ID NO: 70131 - DNA, 1138 bp, Brassica napus
  CDS (7)..(1005)
taagaaatggaagcaaagaagaggcatgaatatgctgcggatttatcttccataaagaaagctcatgaacgtatcaagccgtacatacacaaaactccagtgctaacatctgaatccttgaattcaatctctggaagaagcttgttctttaagtgcgagtgctttcagaaaggtggagctttcaagtttcgtggagcatgcaatgctgtcttgtctcttgatgctgaacaagcagccaaaggggttgtaacacacagcagtggaaaccatgctgctgcgttgtctttggctgcgaagatgcaggggatccctgcgtatatcgttgtaccaaaaggtgctccgaagtgcaaagtagataatgtgatccggtatggtggtaaggttatatggagtgaagcaacaatgtcttctcgagaggaagtagcttccagagttttgcacgaaacaggttctgttctcatccacccatataatgatggacgcatcataagtggtcagggtactgttgcgttggaactgttggagcaaatccaagagattgacactataattgtgccgataagcggggggggtttgatctctggtgtggcgctggctgctaagtcaattaagccgagcatccggattatagcagctgaaccaaaaggagctgatgatgcggctcagtctaaggttgctggtagaatcatcactttacctgtggctaataccatagcggatggccttcgtgcttctctaggagacttaacatggcctgtagtgagagatatggtagatggtgttgtagttgtggaggatggggaaataattgaagccatgagaatgtgctatgagatgctgaaagtctctgtggaaccaagtggtgccattggcctagcagcagttttatcaactagtttccgtagcaatccttgttggaaagattgtaaaaacatagggattgtactcccaggaggtaatgtcgatttgggtgttctgtgggattcacttaagagttcagagtaattaaacatcttggttactgcatttgtttcactattgatgtcgatgtgagaattgtctgtagaattttgaacaaaaggattcatgttcttgcaagaaactccaaattagtacagagtccaaaaaaaaaaaaaaa

SEQ ID NO: 70132 - protein, 332 aa, Brassica napus
MEAKKRHEYAADLSSIKKAHERIKPYIHKTPVLTSESLNSISGRSLFFKCECFQKGGAFKFRGACNAVLSLDAEQAAKGVVTHSSGNHAAALSLAAKMQGIPAYIVVPKGAPKCKVDNVIRYGGKVIWSEATMSSREEVASRVLHETGSVLIHPYNDGRIISGQGTVALELLEQIQEIDTIIVPISGGGLISGVALAAKSIKPSIRIIAAEPKGADDAAQSKVAGRIITLPVANTIADGLRASLGDLTWPVVRDMVDGVVVVEDGEIIEAMRMCYEMLKVSVEPSGAIGLAAVLSTSFRSNPCWKDCKNIGIVLPGGNVDLGVLWDSLKSSE

SEQ ID NO: 70133 - DNA, 1111 bp, Brassica napus
  CDS (29)..(928)
gtcttgctccgccgtcaggggaaagaatatggaagcagccactgctgttcagaggtttcactactcaccatcatcatggattgattggagaaattttgaagggaagcctcgtggttctctacgttactctcagcgaatcaaagagaataaaaggcttagagttattgctttatctcacttgcaacctgacaaaagaagagatcttcgacaactatcagtttcggacaagaactcctcagcattgttggaaactggagatcttcttcattctccatttgatgaagaactggttttgaagagaaaagctgaagaggtcaaaccgtatttgaatggacgatctatgtatcttgttggaatgatgggttccgggaagacgacagtaggaaagatcatggcaaaagcacttggctatacactctttgattgtgacacaatgatcgaggaggcgatgaatagaacttctgtagctgagatatttgagcatttcggtgagagtgtcttcagagagaaagagacagagacactaaagaagctctctttgatgtaccaccaagttgttgtgtcaacaggtggaggtgcggttataagacccattaactggaagtatatgcataaaggtattagcatttggcttgatgttcccctagaagccttagcgcaaaggattgctgctgtaggaacaaactcaagaccattgttacatgatgatgagtcaggaggagacccatacacagtggctttcaaccgtctttcaacgatttgggaaacacgtggtgaagcatacactaacgcaagcgcgagagtctccttggagaatattacatcaaagcacgggtatagaaacgtctcagaccttacaccaactgaaatcgccgttgaggcctttgagcaagttcagtgctttctcaacaaaggagacaagtattgatagacccggtggcctatagttcaagcgcttgagcttgtttgtgcctagttttgactgttactacggtatatataattgaataatactgtttgtttgattactttgtcatattatctatccactggaccccaaaaaaagggaaataagtcatttgatttttttttatttaaaaaaaaaaaaaaa

SEQ ID NO: 70134 - protein, 299 aa, Brassica napus
MEAATAVQRFHYSPSSWIDWRNFEGKPRGSLRYSQRIKENKRLRVIALSHLQPDKRRDLRQLSVSDKNSSALLETGDLLHSPFDEELVLKRKAEEVKPYLNGRSMYLVGMMGSGKTTVGKIMAKALGYTLFDCDTMIEEAMNRTSVAEIFEHFGESVFREKETETLKKLSLMYHQVVVSTGGGAVIRPINWKYMHKGISIWLDVPLEALAQRIAAVGTNSRPLLHDDESGGDPYTVAFNRLSTIWETRGEAYTNASARVSLENITSKHGYRNVSDLTPTEIAVEAFEQVQCFLNKGDKY

SEQ ID NO: 70135 - DNA, 1975 bp, Triticum aestivum
  CDS (88)..(1887)
gcgttcccacggccaccagccactacgcctgctccgcggttccatcagcgcctagctccaaaaggtcgtcattgagaggctgcaccaatgggttccattcctacttattgttcttatcaaacaaacagtgttggttcactgaaactgtcacctcacatccaattccagcaatcttgtaacaatggagttatgtttgtatccatgcggaataagacacagctggccaaaagaagagccacaaattatggaactcatcctaattctagtaggactcctgcacctatcgtatgttcaactggaatgcccataattttcgttgccactgaagtgcacccatggtgcaaaactggaggccttggtgatgtcgtaggaggattgcccccagctctggctgcaatggggcaccgggttatgacgatagctcctcgctatgatcagtacaaggatacatgggatacaaatgttcttgttgaggtaattgttggtgacagaacagaaacagtgcgcttttttcactgctacaaaaggggagttgatcgtgtttttgttgatcatcctatgtttcttgagaaggtatggggcaaaactggatcaaaattgtacgggcctaccactggaacagacttccgagataaccagttacggttctgccttttgtgccttgctgcattggaggctccgagggttcttaatctcaataattctgaatacttctctggaccatatggagaaaatgttgtcttcgttgcaaatgactggcacactgcagttttgccatgctatttgaagagcatgtataagcaaaatggaatttatgagaatgccaaggttgctttctgcattcacaatatcgcctatcagggcagatttcccagagcggacttcgaacttcttaatttacctgaaagtttcatgccgtcatttgattttgttgatgggcatgttaagccagtagtagggagaaagattaactggatgaaggcagggatcactgagtgtgacgtggtccttacagttagtccacattatgtcaaagaactcacttctggcccagagaaaggtgttgagttggatggcgtccttcgtgcaaagcctcttgaaactggaattgtaaatggaatggatgttgttgattggaatccagcaacagataagtacatcagtgtcaaatacaatgcaacaacggtggcagaagcaagagctctcaataaagaaatactgcaagctgaagttggattgcctgtggactctagcatacctgttatagttttcattggacgtcttgaagaacagaaagggtcagacatactaattgcagccataccggagtttctcgaggagaatgttcagataattgttctcggcacagggaagaagaaaatggaggaggaactgatgctgctagaagcgaagtacccacagaatgccagaggcatagcaaaattcaatgtcccattggcgcacatgatgttcgccggggctgatttcatcattgttccaagtaggtttgagccatgtggcctcatccaattgcaagggatgagatatggagtgattcccatctgttcatccaccggaggacttgttgacacggtgagggagggtgtcaccggattccacatgggttcgttcaatgtcgagtttgaaaccgtcgatccagcagatgtcgcggcagtcgcttcgaatgtcacacgagctctgaaacagtacaaaacaccgtcgttccacgcaatggttcggaattgcatggcgcaggacctatcttggaagggaccggcaaagaagtgggaggaggcacttcttggcctaggagtcgagggaagtcagctgggcatcgagggcgaggagatcgctccacttgcgaaacagaatgtggccactccctgaaatctccaaatattagggagagtgttctaagattcgacaaaataatgaggttgctaaagatgaagctgtattcaaaaaaaaaaaaaaa

SEQ ID NO: 70136 - protein, 599 aa, Triticum aestivum
MGSIPTYCSYQTNSVGSLKLSPHIQFQQSCNNGVMFVSMRNKTQLAKRRATNYGTHPNSSRTPAPIVCSTGMPIIFVATEVHPWCKTGGLGDVVGGLPPALAAMGHRVMTIAPRYDQYKDTWDTNVLVEVIVGDRTETVRFFHCYKRGVDRVFVDHPMFLEKVWGKTGSKLYGPTTGTDFRDNQLRFCLLCLAALEAPRVLNLNNSEYFSGPYGENVVFVANDWHTAVLPCYLKSMYKQNGIYENAKVAFCIHNIAYQGRFPRADFELLNLPESFMPSFDFVDGHVKPVVGRKINWMKAGITECDVVLTVSPHYVKELTSGPEKGVELDGVLRAKPLETGIVNGMDVVDWNPATDKYISVKYNATTVAEARALNKEILQAEVGLPVDSSIPVIVFIGRLEEQKGSDILIAAIPEFLEENVQIIVLGTGKKKMEEELMLLEAKYPQNARGIAKFNVPLAHMMFAGADFIIVPSRFEPCGLIQLQGMRYGVIPICSSTGGLVDTVREGVTGFHMGSFNVEFETVDPADVAAVASNVTRALKQYKTPSFHAMVRNCMAQDLSWKGPAKKWEEALLGLGVEGSQLGIEGEEIAPLAKQNVATP

SEQ ID NO: 70137 - DNA, 1492 bp, Triticum aestivum
  CDS (43)..(1197)
agaatctgcacaggcagcaaaccagtaggcaactctccagcaatggctgccgctgcatcgtcgccctcccctccggcggtcatcacctgccgagcggcggtggcatgggggccggggcaggcgctggtgatggaggacgtggaggtcgccccgccggggccactggagatccgcgtcaaggtcgtctccacctccatctgccgcagcgacgtcacccagtggcagtccacggcgcagcccgatctgttccccagaattttcgggcacgaagcatccggggtggtcgagagcgtcggggaaggagtgaccgagttccaagtgggagaccacgcgctcaccgtcttcatcggggaatgcatgagctgcaagcactgcgtgtcggggaaaagcaacatgtgccagacgctcggtctggagaggaagggcgtcatgcacagcgaccagaccacccgcttctccatcggcgggaagcccgtgtaccattactgcgccgtgtcgagcttcagcgagtacgcggttgtccactcgggctgcgcggtcaaggtcagccccaccatgcccatggacaggatatgcctgctcagctgcggcgcgtccgcaggccttggtgcggcttggaatgttgctgatgtatccaaggggtcaagtgtagttatatttggtctgggaactgtaggactttcggtagctcaaggtgctaagctacggggagcttccaagattattggagtagataccaatcctgctaagcaagaaaaggggaaggcttttggtgttacagattttattaatcctgccgaattgaatgaacctgttcagcaggtagtaaaacggcttactgatggaggggctgattactcttttgaatgtgtgggtgataccggagtagtctcgactgcattgcaatcatgttctgatggatggggactgactgtaactcttggtgtaccaaaagcaaaaccagaagtttctgctcattatggattgcttctctctggaagaacactgaaggggtctttgtttggaggatggagacccaaaactgatatacctttgttagtggagaagtacgcaaacaaggaaatccaagttgatggccttgtcacacatgatatgccattcagtgacatcaacaaagcgcttgaactgatgctacaaaacaggtgtttgcgatgcgtgattcacatgccaaagtgacaggattgatttatacatcagtgccatcatacctgtacaattttggtggttttctcatcagtaatttttcacttgatctgctcctggctcgagttttcatgacaccaacatattgaagctccagtgtgattctctattggtgtctcaccttagagttatggtgttatagttgttgaggagattacaaatcatactgatattcccttggaattcctcatatgtccgacctcaagaattattcgtgtaatctaacttgttaaaaattgatctgttagtgattaaaaaaaaaaaaaaa

SEQ ID NO: 70138 - protein, 384 aa, Triticum aestivum
MAAAASSPSPPAVITCRAAVAWGPGQALVMEDVEVAPPGPLEIRVKVVSTSICRSDVTQWQSTAQPDLFPRIFGHEASGVVESVGEGVTEFQVGDHALTVFIGECMSCKHCVSGKSNMCQTLGLERKGVMHSDQTTRFSIGGKPVYHYCAVSSFSEYAVVHSGCAVKVSPTMPMDRICLLSCGASAGLGAAWNVADVSKGSSVVIFGLGTVGLSVAQGAKLRGASKIIGVDTNPAKQEKGKAFGVTDFINPAELNEPVQQVVKRLTDGGADYSFECVGDTGVVSTALQSCSDGWGLTVTLGVPKAKPEVSAHYGLLLSGRTLKGSLFGGWRPKTDIPLLVEKYANKEIQVDGLVTHDMPFSDINKALELMLQNRCLRCVIHMPK

SEQ ID NO: 70139 - DNA, 1254 bp, Zea mays
  CDS (1)..(1254)
atggccatgtccgcttcctcctcctcgcgcgccctcctccgccggatcggcggcgcgctcctccgccgctccttctcctcctcatccgccgccgccgccgcagggtaccacgtcgcgggcgggcccagctacatgcgcggcgccgtcttctgggagcccggccgcccgctcacgctcgaggagttccgcatgccgcggcccaaggccggcgagctcctcatcaagaccaaagcctgcggggtctgtcactccgatctccatgtcctcaaaggcgagctccctttctccacgccctgtgtcgtgggccatgagatcactggagaggtggttgaccatggcacgcacactcctgttgagatcatcaacaggttcccagtcggaagtcacgtcgtcggcgccttcataatgccatgtgggaactgcttctactgcgttaagggccaagaagatctgtgtgagtctttcttcgcgtataatcgtgccaaggggacactctatgatggcgagacacggctgtttctaaggggcaatgggaaaccggtgtacatgtatagtatgggagggcttgcagagtattgtgttgtcccagccaatgcgctagcagttctccctgactcactgccatacacagaatcagcaattttaggatgtgcagtgtttaccgcgtatggtgccctgaggcatgctgctgaaatgcggcctggtgattcagtagctgtgatcggagttggaggggttgggtcaagctgtttacagatagcaaaagcctttggagcttcccaagtcattgcagtggatgtccttgatgagaagcttcagaacgctacaacacttggagcaacccacactgtaaatgcagcaaaagatgatgcagttgaaaggataaaggaaattactgatggtaggggtgtagatgtggctatagaggcacttggtaaggcgttaacattttcccagtgcgccaagagcgtgcgtgatggaggcaaagctgttatgatcgggcttgctgcaacgaacgtaatgggagaggttgatataacccgtcttgtccgacgacaggtgaaaatcattggctcatatggcgcaagggctaggcaagaccttcctcagatagtgaagctcgcggagagtggtgccttcaatctccaaaacaccatatcaaggaaatgcaaatttgaggaggcgaatggcgcctatgaggatctcaatcagggcaagatcgtaggacgagctgtggttgagatcatggagtga

SEQ ID NO: 70140 - protein, 417 aa, Zea mays
MAMSASSSSRALLRRIGGALLRRSFSSSSAAAAAGYHVAGGPSYMRGAVFWEPGRPLTLEEFRMPRPKAGELLIKTKACGVCHSDLHVLKGELPFSTPCVVGHEITGEVVDHGTHTPVEIINRFPVGSHVVGAFIMPCGNCFYCVKGQEDLCESFFAYNRAKGTLYDGETRLFLRGNGKPVYMYSMGGLAEYCVVPANALAVLPDSLPYTESAILGCAVFTAYGALRHAAEMRPGDSVAVIGVGGVGSSCLQIAKAFGASQVIAVDVLDEKLQNATTLGATHTVNAAKDDAVERIKEITDGRGVDVAIEALGKALTFSQCAKSVRDGGKAVMIGLAATNVMGEVDITRLVRRQVKIIGSYGARARQDLPQIVKLAESGAFNLQNTISRKCKFEEANGAYEDLNQGKIVGRAVVEIME

SEQ ID NO: 70141 - DNA, 1511 bp, Brassica napus
  CDS (147)..(1382)
gcggccgctgcgtgtgggtctctctctctccaaaagagaagagcctcgtccgtcactcattgtgggtctcgtcttacagacacccaaagagggaagaagaagaagaagcaaatcattacacatttttttttgtgtttcacaaagagatggagagagcaaccatttccccgagcctgagtcaaaactacttactttgtccttcaccacgcgcctttaccacgcgcctccactccttctccactactcggaacctatctccgtcatcttgctcctcctccatcaagcttcagcattcttcttccaatggcggaacctcccttactcgttgcaacgccgtcctctccaattcgtcttccagtgcggaggtagcagacatagattgggacaacatagggttcggtcttaagccgactgattacatgtacgtcatgaaatgcaacctcgatggggagttctcaaagggtgaattgcaactttttgggaacattgaagtcagcccatctgctggtgttctcaactatggacagggactgttcgaaggaatgaaagcttacagaaagcaagacggtaagaacatcctcctctttcgtcctgaagagaatgcaaatcgtatgagaagtggcgccgagaggatgtgtatgcctgctcctaccattgaccagtttgtcaaagctgtcaaagcaaccgtattagcaaacaaacgttgggttccacctgcagggaaaggttctttgtatattagaccgttgctaatgggaactggagctgttcttggtcttgcccctgctccagaatatactttccttgtctatgtttctcctgttggaaactacttcaaggaaggtgtggcaccaatcaatttgattgtggaaagtgaatttcaccgtgcaacacctggtggtaccggtggtgttaagaccatcggcaactacgctgcagtactgaaagcacagtcgattgcgaaatctaaaggatattccgacgttttgtaccttgattgcgttcacaaacgataccttgaagaggtctcctcttgcaatatcttcattgtcaaggacaatgtgatctctactcctgatataaaaggaacaatcttaccagggattacgcggaaaagtataatcgacgtggctcgtacccaaggttttaaggtggaggaacggaatgtgacagttgacgagttactagaagctgacgaggttttctgcacaggaaccgccgtggttgtctctccagttggaagcattacgcacaaaggcaaaagagtatcttatggagaaggtagctttggacccgtctcggagaaactctacaccgttctgacaagcttgcagatgggtctgagcgaggacaacatgaactggactctgaatctgagttagaaaaactctacaccagtgttttcggttttatttttcatcctcgtatgagtctctcattcttattcgtaaaactacaagttggattgttttaaaaacttggttcgatctcaaaagtcgacccgggaattc

SEQ ID NO: 70142 - protein, 411 aa, Brassica napus
MERATISPSLSQNYLLCPSPRAFTTRLHSFSTTRNLSPSSCSSSIKLQHSSSNGGTSLTRCNAVLSNSSSSAEVADIDWDNIGFGLKPTDYMYVMKCNLDGEFSKGELQLFGNIEVSPSAGVLNYGQGLFEGMKAYRKQDGKNILLFRPEENANRMRSGAERMCMPAPTIDQFVKAVKATVLANKRWVPPAGKGSLYIRPLLMGTGAVLGLAPAPEYTFLVYVSPVGNYFKEGVAPINLIVESEFHRATPGGTGGVKTIGNYAAVLKAQSIAKSKGYSDVLYLDCVHKRYLEEVSSCNIFIVKDNVISTPDIKGTILPGITRKSIIDVARTQGFKVEERNVTVDELLEADEVFCTGTAVVVSPVGSITHKGKRVSYGEGSFGPVSEKLYTVLTSLQMGLSEDNMNWTLNLS

SEQ ID NO: 70143 - DNA, 1332 bp, Brassica napus
  CDS (87)..(1250)
tataacctctgaaaatagaatcgtacaataacatttcatcttaagtgtttcagtttggtgcacaacaagctcatacaacatttgtcatggctcttcgctgcttatctcaatcttcatcaacaactttctcttatctctctaagatctgtggatttcgtatgcatgggactaaggcagcagtttctgttgtagaagaacatgtctcgaagatggtggggacaggacgtgaggatgaagagtatgctgatgtggattgggacaacctcggattcagtcttgtacggacagattacatgttcgccaccagaagttgcagagaaggaaacttcgaacaaggttgccttagccgttacggcaacatcgagctcaaccctgctgctggaattctcaactacggccagggattaatcgaggggatgaaagcttacagaggagaagatggtagggttcttctatttcgtccagagttaaatgccgtgcgtatgaagaaaggagcagagagaatgtgtatgcattctccttctgttcaacagtttattgaaggtgttaagcaaaccgttcttgcaaacagacgctgggttcctcctcctggaaaaggctccttgtatctcagaccattgttgtttggaagtggagcaagcttgggtttgtctgcagcatcagagtttacgtttcttgtgtttggttctcctgttcaaaactattttaaagaaggtacatcagcactgaatctctacgttgaggaggtgattccacgcgcgtatcttggaggaagtggtggcgttaagtccatttctaattacggtccagtgcttgaagtcatgagaagagcgaaagcgagagggttttcggatgttttgtatctggatgcagaaactaagaagaatatggaggaagtttctgcttctaatatattccttgtgaaggggaatacaatagtgactccagctacaaacgggacgattctcggagggatcacacgaaagagcgtaatcgaaattgctattgatcttggttacaaggtggaagaacgagtagttccggtagaagaactgaaggaagcagaagaagttttctgcactggaactgccaccggagttgcttctgttgggagcatcacgtttcagaacaccaggactgagtacaaagttggagatgggcttgtaacgcagcaacttcgatctattcttgtcggaatacaaactggttctatccaagacactaagaattgggtgttggagatagattaatttcagagaaaaataaatcaattgttatgttgcactctttgatgtatcaaaagatttggaactctcgaaaaaaaaaaaaaaa

SEQ ID NO: 70144 - protein, 387 aa, Brassica napus
MALRCLSQSSSTTFSYLSKICGFRMHGTKAAVSVVEEHVSKMVGTGREDEEYADVDWDNLGFSLVRTDYMFATRSCREGNFEQGCLSRYGNIELNPAAGILNYGQGLIEGMKAYRGEDGRVLLFRPELNAVRMKKGAERMCMHSPSVQQFIEGVKQTVLANRRWVPPPGKGSLYLRPLLFGSGASLGLSAASEFTFLVFGSPVQNYFKEGTSALNLYVEEVIPRAYLGGSGGVKSISNYGPVLEVMRRAKARGFSDVLYLDAETKKNMEEVSASNIFLVKGNTIVTPATNGTILGGITRKSVIEIAIDLGYKVEERVVPVEELKEAEEVFCTGTATGVASVGSITFQNTRTEYKVGDGLVTQQLRSILVGIQTGSIQDTKNWVLEID

SEQ ID NO: 70145 - DNA, 1827 bp, Glycine max
  CDS (321)..(1559)
gaattcccgggtcgacatgagctttttagacatgacaagggcatcttgcaaactttttctgcatgattctctgttcttgctattgattgtaatctgagtcatgttgcttgttaggagctttgagtagtagccaatggatatggcagtttcttgtttgtctccagtcagaacccatactttaatgcctgcaatccttagagactcaatggattcaggcacaccttgttgcagcttatcttaaatggaagatgcacctaatatggcaaaactgttctctacggctgttcttgtgggtgttgttggattggaatcggagagaaatggagagcagcgccgtctacggaagcattcgaccaagttacccgatctgcccctctcgacgttcttcctctcttctctctcaccaatctcccttcctattcgagccttctctttctctcaagcttcgcaagcagtttcctctcatttcgcagaattttctggaagccgcttctcctctcaggccttctgccactttgtcttctgattcctaccgtgagacgattgaattagctgatatagaatgggacaaccttggttttgggcttcaacccacggattatatgtattccatgaaatgcacacgaggtggaaccttctccaaaggtgaactgcagcgttttggtaacattgaattgaacccctcagcaggagttttaaactatggtcagggattatttgagggtttgaaagcgtatcggaaacaagatgggagtatactcctcttccgtccggaagaaaatggtttgcggatgcagataggtgcagagaggatgtgcatgccatcgcctactgttgagcagtttgtggaagctgtaaaggagacagttttagcaaacaaacgttgggttccccctgcaggtaaaggttccctgtatattagacctttgctaatgggaagtggaccggtacttggtcttgcacctgctccagagtacacctttctaatatacgtttcacctgttgggaactacttcaaggaaggtttggccccaatcaatttgattgtggaaaatgaattacatcgtgcaactcctggtggcactggaggtgtgaagaccattggaaactatgctgcagttctgaaggcacagtctgaagcaaaagctaaaggctactctgatgttttataccttgactgtgtgcacaaaagatatttggaggaggtttcttcatgcaacatttttgttgttaagggtaacgttatttcaactccagctattaaagggacaatcctacctggcattactcgcaaaagtataattgatgttgctcgaagccaagggttccaggttgaggagcgattagtgtcagtggatgaattgctagatgctgacgaggtcttctgcacgggaacagctgtggttgtatcacctgttggcagtattacttatcttgacaagagggtagcatatggggatggtattggcgtggttgcacagcaactttatactgtctttaccagattacagatgggtcttacggaggatgagatgaattggactgttgagctgagataagcgcaccatgaatagtttgcagttcatgttttgctggaacacatgttcttttaaaatttccgagctctagaagttgcttttaaaattttgctatcatatgattagatgctgtagatagtattatggtgtgtttattgctattgaatgactatagcaagtacatacggttgcctcttgctatctggagaaatcgttgctagtggattagtaaaccttttcattggttgaaaaatagaattctggtagatgcggtaaaaaaaaaaaaaaa

SEQ ID NO: 70146 - protein, 412 aa, Glycine max
MESSAVYGSIRPSYPICPSRRSSSLLSHQSPFLFEPSLSLKLRKQFPLISQNFLEAASPLRPSATLSSDSYRETIELADIEWDNLGFGLQPTDYMYSMKCTRGGTFSKGELQRFGNIELNPSAGVLNYGQGLFEGLKAYRKQDGSILLFRPEENGLRMQIGAERMCMPSPTVEQFVEAVKETVLANKRWVPPAGKGSLYIRPLLMGSGPVLGLAPAPEYTFLIYVSPVGNYFKEGLAPINLIVENELHRATPGGTGGVKTIGNYAAVLKAQSEAKAKGYSDVLYLDCVHKRYLEEVSSCNIFVVKGNVISTPAIKGTILPGITRKSIIDVARSQGFQVEERLVSVDELLDADEVFCTGTAVVVSPVGSITYLDKRVAYGDGIGVVAQQLYTVFTRLQMGLTEDEMNWTVELR

SEQ ID NO: 70147 - DNA, 1860 bp, Glycine max; identical to SEQ ID NO: 70097
  CDS (135)..(1622)

SEQ ID NO: 70148 - protein, 495 aa, Glycine max; identical to SEQ ID NO: 70098

SEQ ID NO: 70149 - DNA, 1726 bp, Brassica napus; identical to SEQ ID NO: 70093
  CDS (76)..(1554)

SEQ ID NO: 70150 - protein, 492 aa, Brassica napus; identical to SEQ ID NO: 70094

SEQ ID NO: 70151 - DNA, 2002 bp, Triticum aestivum
  CDS (128)..(1711)
cgaacattcctctttctctcccttgcttggggaagaagaagaagaagaagaagaagagagggcgagcgcccccgcctcccgacgccgtcgcccctcgccgccgatctgatctcaggagccagcgaagatgcattccaccaatctgctcctcgaggagcccatccggatggtctccatcctcgagccatccaagccgaacttcttcccggcgatgacgaagattgtggggacgctgggtccgaagtcccggtccgttgaggccatctccgcctgtctaaaggccggcatgtctgtggcccgtttcgatttctcgtggggggatgccgcgtaccaccaggagacactcgagaacctcaagctcgccatcaaggccaccaagaagctatgtgctgttatgctcgacactgttggccctgagttgcaagtggtgaacaagagtgaagtcacaatctcgcttgaagagaacgagtctgttgttctcacccctcaccagggccaggaggcctcttccaagttgctccctatcaacttcgctggactcgccaaggctgtgaagcccggagccacaatattcgttgggcaatatttgttcacgggcagtgagactacatcagtttggctggaggtttctgaagttcaaggggatgacgtggtttgcgtgatcaagaactcagctaccctggctgggtcactcttcacattgcactgctcccagatccatatcgacatgcccacgctgtctgatgaggataaagatgttatgaaaaaatggggtgctccaaacaagattgacttcctctctctttcttatacaaggcatgcagaagatgtgcggcaagcacgggagttcctctctaagttaggtgatcttagccaaactctgatttttgccaaaattgagaatgtggagggcttgaaccattttgatgagatcctggaggaagcggatggtatcattctgtcaagagggaaccttggaattgatcttccacctgaaaaggtgttcttatttcagaagtctgctctgcacaagtgcaacatggctggaaagcctgctgttgttactcgtgttgtggacagtatgacggacaacctaaggcctactcgtgcggaggcaactgatgtggcaaatgcggtgctggacggtagtgatgccattctccttggtgctgagactctccgtgggttgtatccagtcgagactatttcaacagtgggcagaatttgtgctgaggctgagaaggtcttcaaccaagatttgtatttcaagcgaaccgtgaaatatgtgggagaacccatgacccacttggagtctattgcttcctctgcagtgcgggctgctattaaagttaaggcttcggtcatcatttgcttcacttcatctggacgggctgcaaggctaattgccaagtacaggcccaccatgcctgtcctgtccgttgtcattcctcgtctgaaaacaaatcaattgaagtggagcttcacaggtgcatttgaggcaagacaatcactcatagttagaggcctctttcccatgcttgctgatccacgtcatccggctgattctactagcactacaaatgaatcagtgttgaaggttgctcttgaccacggcaaagcatctggtgtgatcaagtcgcatgaccgtgtcgtcgtgtgccagaaagtgggagattcctctgtcgtgaagatcattgagctagacgactaggcaaaattagcctttgctcagggcttgccagatttttgactaggccaaaacgttgcttggtggctatgtataattctatctatagttttgcaaaacgagcagtttttcctatggtgtcatcataggatccgcggttatcattctgaaacctacgctagttattatggatatgtcctcagattttactgcagtgtagcgagtaaatgatctgatggaataatgatatcaaaactttgtgacccttattgttgtcgctaagcctatgttcccatttgcaaaaaaaaaaaaaaa

SEQ ID NO: 70152 - protein, 527 aa, Triticum aestivum
MHSTNLLLEEPIRMVSILEPSKPNFFPAMTKIVGTLGPKSRSVEAISACLKAGMSVARFDFSWGDAAYHQETLENLKLAIKATKKLCAVMLDTVGPELQVVNKSEVTISLEENESVVLTPHQGQEASSKLLPINFAGLAKAVKPGATIFVGQYLFTGSETTSVWLEVSEVQGDDVVCVIKNSATLAGSLFTLHCSQIHIDMPTLSDEDKDVMKKWGAPNKIDFLSLSYTRHAEDVRQAREFLSKLGDLSQTLIFAKIENVEGLNHFDEILEEADGIILSRGNLGIDLPPEKVFLFQKSALHKCNMAGKPAVVTRVVDSMTDNLRPTRAEATDVANAVLDGSDAILLGAETLRGLYPVETISTVGRICAEAEKVFNQDLYFKRTVKYVGEPMTHLESIASSAVRAAIKVKASVIICFTSSGRAARLIAKYRPTMPVLSVVIPRLKTNQLKWSFTGAFEARQSLIVRGLFPMLADPRHPADSTSTTNESVLKVALDHGKASGVIKSHDRVVVCQKVGDSSVVKIIELDD

SEQ ID NO: 70153 - DNA, 1883 bp, Brassica napus
  CDS (119)..(1651)
caacccgaaaaaacaagaggttgttcttgttccgacacgacaacacatccagtatcggagctaataagagggaagaaagaagaaatagttgactgtgtttaagggtttctgttgaaaaatgtcgaacatagacattgaagggatattgaaggagctacctaacgatgggaggatcccaaaaaccaagatcgtttgcactctaggaccagcttctcgcactgttcctatgatcgaaaagcttctcagagccggtatgaacgtcgctcgcttcaacttctcacatggcagccatgagtatcaccaaggcacactcgacaacctccgcaccgctatgcagaacacaggcattctcgccgccgtcatgcttgacacaaagggacctgagattcgtactggtttcttgaaagatgggaaccctatacaactcaaggaaggccaagagatcactatcaccactgactacgaaactttaggagatgagacgacgatctccatgagctataagaagcttcccttagatgtgaagcccggaaacaccatactctgtgcagatggaagcataagtctagctgtcttgtcatgtgatccagagtctggaactgttaggtgcaggtgcgaaaacacggcgatgcttggcgagagaaagaacgtgaatctccccggtgtcgttgttgatctccccactctgacagacaaggatattgaagatattatgggttggggtgttcctaacagcatcgatatgattgcgctttcttttgtccgtaaaggctcagatcttgttaatgtcaggagggttcttggttctcatgctaaaagcattatgctgatgtcaaaggttgagaaccaggaaggagtggtgaactttgatgagatactgcgcgaaacagatgcattcatggtcgctcgtggtgatctcgggatggagattcccatagagaagatcttcttagctcagaagctgatgatctacaagtgcaaccttgcaggcaaaccagtggtgacagccactcagatgcttgagtcaatgatcaagtcaccaaggccaacacgtgctgaagccacggacgttgccaacgccgtccttgacggcacagactgcgtgatgctcagcggagagagcgcagcaggagcttatccggagatagccgtgaaagtcatggccaagatctgcattgaagcggagagctctcttgactacaacacgatctttaaagagaggatcagagcaactccggttccaatgagcccgttagagagtcttgcatcgtcagctgtgagggctgcgaacaaagcgcatgcgaagctcatcattgtgttgactcgtggaggctcaacagctaagcttgtagctaagtacagaccctctgttccgattctttcggtggttgtaccagttatgaccacggattcctttgactggacttgtagtgacgagtcgcctgcaaggcatagtttgatatacagaggtttgatccctatgttggctgaaggatctgcaaaggcgacagatagtgagtccacagaggttatcattgaatccgctttgaagtcagctgtgcagagaggactgtgcaaccatggtgatgctgttgtggcgctgcaccgtattggagtcgcctcggttattaagatctgtgtggttaagtaaagaaataaagaatagctcttggctccttatgattgttggcaatcgtaactgagttgacttcgttacttgaaataaagatgtactgttggagacatctctctctctctctctctctctctctctctctgtcttttcagttttcaagattatgaatcttaaatctgctttgtatgaatcactatgtataacactgtttctcttcataagctttgcttacaaaaaaaaaaaaaaa

SEQ ID NO: 70154 - protein, 510 aa, Brassica napus
MSNIDIEGILKELPNDGRIPKTKIVCTLGPASRTVPMIEKLLRAGMNVARFNFSHGSHEYHQGTLDNLRTAMQNTGILAAVMLDTKGPEIRTGFLKDGNPIQLKEGQEITITTDYETLGDETTISMSYKKLPLDVKPGNTILCADGSISLAVLSCDPESGTVRCRCENTAMLGERKNVNLPGVVVDLPTLTDKDIEDIMGWGVPNSIDMIALSFVRKGSDLVNVRRVLGSHAKSIMLMSKVENQEGVVNFDEILRETDAFMVARGDLGMEIPIEKIFLAQKLMIYKCNLAGKPVVTATQMLESMIKSPRPTRAEATDVANAVLDGTDCVMLSGESAAGAYPEIAVKVMAKICIEAESSLDYNTIFKERIRATPVPMSPLESLASSAVRAANKAHAKLIIVLTRGGSTAKLVAKYRPSVPILSVVVPVMTTDSFDWTCSDESPARHSLIYRGLIPMLAEGSAKATDSESTEVIIESALKSAVQRGLCNHGDAVVALHRIGVASVIKICVVK

SEQ ID NO: 70155 - DNA, 1983 bp, Brassica napus
  CDS (100)..(1815)
atccccctctctctctctctcttaaatatcagttttaacagaaaacctcattctcattctctctcctctgcttgacctctgttcttcaagttgtacgacatggcggcgacaggtcaaatctcgacgagaatgacggtggatcgcactctgtcctcctccaggaacgctggactttccctttcaccatcaccccagagaacgctaatcggcgtcgccggtaggtctggtatcgctcaccgtcaactgtctctctccgtcagagcgattaacaccaatgaagatagccggaaagtcaaggtttatgcagagaacggcgctttcgatttgggagtgatggatccttcagtggagccatataaatttgcggagccaagaacaagtcataatgattcgaggaggaaaaccaagattgtgtgtaccattggaccttcctctagctctcgtgaaatgatttggaaactcgcggaagcaggaatgaatgtggctcgtttgaatatgtctcatggagatcatgcttctcatcagattactattgatcttgttaaagaatacaactctctctttgttgacaaagccattgctatcatgttggatacaaagggtcctgaggttcgaagtggggatgtacctcagccgatcttccttgaagagggtcaagagtttaattttaccatcaagagaggtgtctcaatgaaagacaccgtcagtgtcaactatgatgattttgttaacgatgtcgaagttggagacatacttttggtcgatggtggaatgatgtcactagctgttaagtccaagacgagcgatttggtgaaatgtgtagttattgacggtggagagcttcaatctagacgtcacttgaatgttcgaggaaagagtgctactcttccttccataacagacaaagattgggaagacatcaaatttggagtggacaaccaagttgatttctatgctgtctcttttgttaaggatgctaaagttgtccatgagttgaaaaactacctcaaaagctgcagtgcggatatctctgtgattgtgaaaattgaaagcgcagattctataaagaatcttccttccattatatctgcttgtgatggggcaatggttgctcgtggagatcttggagctgaacttcccattgaggaggttcccttgttacaggaggagataatcacaaggtgtaggaacattcataaaccagtgattgtcgccacaaacatgctagagagtatgattaatcatccaacacctacaagagctgaagtatctgacattgcaattgcagtgcgcgaaggagcagatgcaatcatgctttctggtgaaaccgcacacggaaagtttcctctgaaagctgttaacgtgatgcataccgtggctttgagaactgaggctagtctacctgttagaacctcagcaatccggaccactgcttacaagggtcgcatgggccaaatgtttgctttccatgcttctataatggcgaatacactgaacacaccgatcattgtgttcacaagaactggatccatggcagtgcttctgagtcactaccgcccgtcctcaacaattttcgccttcacaaaccagaggagaataatgcaaaggctggctctttaccaaggtgtcatgcctatatacatggagttttctgatgatgcagaagatacatatgcccgttccttgaaactcctacaggacgagaatatgcttaaggaaggacaacatgtaactcttgtccaaagtggtgcgcaacccatttggcgtgaagaatcaacacatctcatacaagtccgtaagattaagataggttgatgtttttcactactcgagcttctatatccctgactttatttttcttacacgatttgatccaatattgttttatgtcactcacagtgaaaccatatatatttgttttaagttcttgaaccacatgactgtaaaaacaaaacagtcttttcgatgaaaaaaaaaaaaaaa

SEQ ID NO: 70156 - protein, 571 aa, Brassica napus
MAATGQISTRMTVDRTLSSSRNAGLSLSPSPQRTLIGVAGRSGIAHRQLSLSVRAINTNEDSRKVKVYAENGAFDLGVMDPSVEPYKFAEPRTSHNDSRRKTKIVCTIGPSSSSREMIWKLAEAGMNVARLNMSHGDHASHQITIDLVKEYNSLFVDKAIAIMLDTKGPEVRSGDVPQPIFLEEGQEFNFTIKRGVSMKDTVSVNYDDFVNDVEVGDILLVDGGMMSLAVKSKTSDLVKCVVIDGGELQSRRHLNVRGKSATLPSITDKDWEDIKFGVDNQVDFYAVSFVKDAKVVHELKNYLKSCSADISVIVKIESADSIKNLPSIISACDGAMVARGDLGAELPIEEVPLLQEEIITRCRNIHKPVIVATNMLESMINHPTPTRAEVSDIAIAVREGADAIMLSGETAHGKFPLKAVNVMHTVALRTEASLPVRTSAIRTTAYKGRMGQMFAFHASIMANTLNTPIIVFTRTGSMAVLLSHYRPSSTIFAFTNQRRIMQRLALYQGVMPIYMEFSDDAEDTYARSLKLLQDENMLKEGQHVTLVQSGAQPIWREESTHLIQVRKIKIG

SEQ ID NO: 70157 - DNA, 1930 bp, Brassica napus
  CDS (109)..(1692)
cggtcaaatcccattcgcataaaaagcatctcctctccgatcgaattctctcactctgttcgccgccgaagatctgagatctctcctctctcctctctcacctcaaagatgcattcgagtcatctccttctcgaggaaccgatcaggatggcatcaatcctcgagccatccaaatctagcttcttcccagcattgactaagatcgtcgggactctcggtcccaaatcccgatccgtcgagactctctccggttgcctcaaatccgggatgtccgtggctcgatttgatttctcttggggagatgctgagtatcaccaggagacgctggataatctgaaaattgctgtgaagagcactaagaagctttgtgctgttatgcttgatactgtgggacctgagctgcaagttatcaacaagtctgggaaagctattactcttaaagccgatggacttgttactttgacacccagtcaagatcgagaagcgtcttctgaagtccttccgattaactttaatgggcttgccaaggcagtgaagaagggagacactatctttgttgggcaatacctattcactggtagtgaaacaacttcagtttggctcgaggttgatgaagttaaaggagatgatgtcatttgcctgtcaaggaatgctgctactcttgctggttctctcttcactctgcacgcctctcaagttcacatcgatctgccaactcttacggagaaagataaggaggttataagcacatggggagttcagaataaaatcgattttctctctttgtcttattgtcgtcatgcggaggatgttcgccagacccgcgaaatgcttaagaagttgggtgacctctctcaaacacaaatatttgccaagattgagaatgtagagggacttaaccactttgatgagattctacaagaagctgatggaattattctttctcgtgggaatttgggtattgatctacccccggaaaaggtgtttttgtttcaaaaggcggctctttacaagtgcaacatggctggaaaaccagccgttcttacccgtgtcgttgatagtatgactgacaacttgcgaccaactcgtgcagaggcaacagatgttgctaatgctgttctagatggaagtgatgcaattcttcttggtgctgagacccttcgcggtttataccctgttgagacaatatccactgtcggtagaatctgtgctgaggcagaaaaggttttcaatcaggacttgtacttcaagaagactgtcaagtatgtaggagaaccgatgtctcacttggaatccattgcttcttcagctgtacgggcagcaatcaaggttaaggcatctgtcattatatgcttcacctcttctggaagagcagcaaggttaattgccaaatacaggccaacaatgcccgttatttctgttgtcattccccgggttaagacaaatcagctgaaatggagctttagtggagcctttgaggcgaggcagtcacttattgtcagaggccttttccccatgctcgctgatcctcgtcacccagcggaatcaacaagtgcgacgaacgagtcagtcctcaaggttgcactagaccatggaaagcaagcaggagtgatcaaatcgcatgacagagtagtggtgtgtcagaaagttggtgatgcttctgtggtgaagatcatcgagctagaggattaacacaaaaatggaagaagaaaacaattgctatatttttcttacttcgagactgtgccggagtgagtatatttttatctacgggacttttggtttttgagatttgatgtctctaaatgattcccttctttttcctttcggtatacatttgggttgccttcagatttaaagccatgtttaaagagtatacaatgtctagcaaattattcaataaactgtaacatccaaaaaaaaaaaaaaa

SEQ ID NO: 70158 - protein, 527 aa, Brassica napus
MHSSHLLLEEPIRMASILEPSKSSFFPALTKIVGTLGPKSRSVETLSGCLKSGMSVARFDFSWGDAEYHQETLDNLKIAVKSTKKLCAVMLDTVGPELQVINKSGKAITLKADGLVTLTPSQDREASSEVLPINFNGLAKAVKKGDTIFVGQYLFTGSETTSVWLEVDEVKGDDVICLSRNAATLAGSLFTLHASQVHIDLPTLTEKDKEVISTWGVQNKIDFLSLSYCRHAEDVRQTREMLKKLGDLSQTQIFAKIENVEGLNHFDEILQEADGIILSRGNLGIDLPPEKVFLFQKAALYKCNMAGKPAVLTRVVDSMTDNLRPTRAEATDVANAVLDGSDAILLGAETLRGLYPVETISTVGRICAEAEKVFNQDLYFKKTVKYVGEPMSHLESIASSAVRAAIKVKASVIICFTSSGRAARLIAKYRPTMPVISVVIPRVKTNQLKWSFSGAFEARQSLIVRGLFPMLADPRHPAESTSATNESVLKVALDHGKQAGVIKSHDRVVVCQKVGDASVVKIIELED

SEQ ID NO: 70159 - DNA, 1903 bp, Brassica napus
  CDS (122)..(1618)
ttccctagtccccaaggcccaagccagatctctctctctctctctataaatctctctcggtctctactaccatctctgatccaacctatttccccattgaactcgctgttttcttccaaagatggcgatgatagagcaaaggccgaagacgaagatcgtgtgtaccgttggtcccgcttccagatccgttgagatggtcgagaagcttctcagggctggcatgaacgtcgctaggtttaacttctctcacggatctcatgagtaccaccaggagactctcgataatctccgtcaagctatgctcaacactggtatcctctgcgccgtcatgctcgataccaagggtccagagatccgaaccggattcttgaaagatgggaaaccaatccagttgaaacaaggccaagagatcaccatctccactgactacgacttgcagggagacgaggaaacaatctgcatgagctacaagaagttggctgaggatgtgaacccagggatggttatcctctgtgctgacggtacaatctcgttactggtcctctcctgtgacacagagaacggcacagtccgttgccgctgcgagaactctgccatgcttggtgagaggaagaacgttaatctcccaggtgttgttgtggacctcccaactctaactgagaaagacaaagaagacatcatgaagtggggagtcccgaatcagatcgatatgatcactttgtcttttgtcagaaaaggttcggacttggttcaggtcaggaaactgttaggagatcatgccaagaacattcttctcatgtcaaaggttgagaaccaagaaggtgtggcgaacttcgatgacattcttgtcaactccgacgcgtttatgattgcaagaggagatctcggcatggagatcccaatcgagaagatcttcctagctcagaaagtgatgatctacaaatgcaacatccagggaaaaccagtggtcacagcgactcagatgctcgagtccatgatcaaatcccctcgacccacaagagctgaagccactgacgtagcaaacgcagtcctcgacggcaccgactgtgtcatgctcagcggagaaaccgcagctggagcttaccctgagctagctgtacgcacgatggccaagatctgcgttgaagccgagagcacgcttgactacggagacgtcttcaagaggatcatgcagtactctccggttccaatgtccccgctggagtcactggcctcctctgcagtcagaacagctaactcggctagagccacgctcatcatggtcctaaccaggggaggaagcacggcgaggcttgtggctaaatacagaccagggatgcctattttgtcagtcgttgttcccgagatgaaaacagacttctttgactggtcttgcagcgacgaatcgccggcgaggcacagtctcatcttccgtgggttgattccggtgctgtacgcagggtctgctagagcctcgcatgatgagtccacagaagaagctattgagtttgcgactcagcatgggaaagagaagcagctgtgtaagactggagactctgttgttgctctgctccgagttggtaatgcttctctaatcaagatcttgaccgtcaagtgatgattgatgattcacgatctttaaaaaggagtcccgtttttggcgtttggcggttgggggaaacgcaactataatcggtttttgttatgaattttttttattcaagattgtgattacatatcttgagataggaaactcaagttctctttcttgctaattacaactactgtggtgaccagtgaatccacttacggctctcttttgttttggattattggttgtatggaactaatcaatcatacacgtatctattatcatgattttcttctgaaaaaaaaaaaaaaa

SEQ ID NO: 70160 - protein, 498 aa, Brassica napus
MAMIEQRPKTKIVCTVGPASRSVEMVEKLLRAGMNVARFNFSHGSHEYHQETLDNLRQAMLNTGILCAVMLDTKGPEIRTGFLKDGKPIQLKQGQEITISTDYDLQGDEETICMSYKKLAEDVNPGMVILCADGTISLLVLSCDTENGTVRCRCENSAMLGERKNVNLPGVVVDLPTLTEKDKEDIMKWGVPNQIDMITLSFVRKGSDLVQVRKLLGDHAKNILLMSKVENQEGVANFDDILVNSDAFMIARGDLGMEIPIEKIFLAQKVMIYKCNIQGKPVVTATQMLESMIKSPRPTRAEATDVANAVLDGTDCVMLSGETAAGAYPELAVRTMAKICVEAESTLDYGDVFKRIMQYSPVPMSPLESLASSAVRTANSARATLIMVLTRGGSTARLVAKYRPGMPILSVVVPEMKTDFFDWSCSDESPARHSLIFRGLIPVLYAGSARASHDESTEEAIEFATQHGKEKQLCKTGDSVVALLRVGNASLIKILTVK

SEQ ID NO: 70161 - DNA, 2063 bp, Glycine max
  CDS (192)..(1700)
ttgcataataacaagagtcgcatcgcatcacaaatcttttttgtctctctctacttttttgctttctttcttcttctgtttatcgcatcgcgtattggttggtcgaaaaacaaagagtgtgtgttgtgtggtttggtttggtttttcacttttcttcatctttttgcgagaagacacacacacagagagagatggctacgacgaggattgaggcagagaagaagccgaagacgaagatcgtgtgcactctgggccccgcatcacggtcggtcccaatgatcgagaagcttctgcgagcaggcatgaacgtggcgcgcttcaacttctcccatgggtcccacgagtaccaccaggaaaccctcgacaacctccgcgccgccatggagaacaccggtattctctgcgccgtcatgctcgacaccaaggggcctgagattcgaactggttttctcaaggacggtaagcctatccaactgatacaaggtaatgaaataaccatttccactgactatgacctaaagggagatgagaagacgatttgtatgagctacaaaaagctgcctgaggatgtgaagcccgggatggtcatactctgtgcggatggcaccatatcatttacagttttatcatgtgacaaacaagcaggcttggttcaatgccgatgtgagaactctgccactcttggcgagaggaagaatgttaatttgcctggagtgatagtggatctcccaactttgacagacaaggacaaggaagatatcttggcctggggaattccgaataaaattgacatgattgctctttcttttgttcgaaaaggttctgacctggtggaagtcaggaaagttctgggaaaacatgctaagaacattatgctcatgtctaaggttgaaaaccaagaaggggttgcaaattttgatgaaatccttgcaaattcagatgcatttatggtggcacgtggtgaccttggaatggaaattccaatagagaagatatttctcgcacagaaagtgatgatttacaagtgcaacatccaaggaaaaccagttgtcactgcaacccagatgttggagtcaatgatcaaatctcccaggccaaccagggccgaagctactgatgttgccaatgcagttctggatggcacagactgtgtgatgcttagtggtgaaaccgctgctggagcctatccagaccttgctgttcaaacaatggctaaaatatgcattgaagcagagagcacccttgactatggtgatgtgttcaaaaggattatggagcactcaccggtacccatgagcccattagagagtctagcttcttctgctgttagaacagccaactcggctagagcggctcttatcttggttttaactagaggagggagtactgcaaaattggtggcgaaatacaggccagggatgccaattctttccgtggttgttcccgagctcaagactgatagctttgattgggcatgcagtgatgaggcccctgcgagacatagccttatattccgcgggttggttcccgtgttgagtgcagcttctgctagagcttctcatgctgaaacaacagaagaagcaatagaattcgccatgcaacatgccaagtccaagggtctctgccacaacggggattcagtggtggcactgcatcgtgtgggcactgcatctatcatcaagatcttgactgtgaaatgatcacccccattacaaggaattcttctgctgtttatggcaaattttttggatggtgcaaaagaggtctcgatatacctcttcatatctacattggatgcaaacttcaattaaaagcatttattaggatcggttacctgtttttcacatatcatatattactttttttttttttttttgttacatttgccttatcattgtggcgagtagccacttgttttcatttgttaagattttgtacgaggcttttggtgaaccaaaaaactagccacttctggattttgaattttgcggtctaaagttgttttaacttttaattgagcagtcagcagtgtatgttttttgagaccgacacgcagcggccgc

SEQ ID NO: 70162 - protein, 502 aa, Glycine max
MATTRIEAEKKPKTKIVCTLGPASRSVPMIEKLLRAGMNVARFNFSHGSHEYHQETLDNLRAAMENTGILCAVMLDTKGPEIRTGFLKDGKPIQLIQGNEITISTDYDLKGDEKTICMSYKKLPEDVKPGMVILCADGTISFTVLSCDKQAGLVQCRCENSATLGERKNVNLPGVIVDLPTLTDKDKEDILAWGIPNKIDMIALSFVRKGSDLVEVRKVLGKHAKNIMLMSKVENQEGVANFDEILANSDAFMVARGDLGMEIPIEKIFLAQKVMIYKCNIQGKPVVTATQMLESMIKSPRPTRAEATDVANAVLDGTDCVMLSGETAAGAYPDLAVQTMAKICIEAESTLDYGDVFKRIMEHSPVPMSPLESLASSAVRTANSARAALILVLTRGGSTAKLVAKYRPGMPILSVVVPELKTDSFDWACSDEAPARHSLIFRGLVPVLSAASARASHAETTEEAIEFAMQHAKSKGLCHNGDSVVALHRVGTASIIKILTVK

SEQ ID NO: 70163 - DNA, 1976 bp, Glycine max
  CDS (116)..(1696)
cgtacaacactttctatatttatcgtccattctctctcactccataattgcttcttgctttggtcgatccattcggtgatcactgaccagtggtttggtgttgttgatagagaaaatgcattccagccctttgcttcttgaggaacccattaggatggcatccatccttgagccatccaagcctactttttttccggctatgacgaaaattgttggcacacttggtccaaagtcacgatcagttgatataatttcccattgccttgatgcaggaatgtctgtggcaaggtttgacttttcatggggtgatccagaataccatcaagagacattggaaaatttgagagttgctatcaaaagtaccaagaaactctgtgcggttatgctagatactgtgggtccagaattacagattgagaataagactgatcacccaatcacccttgaagcagacacattagttgtcttaactccagatcaaaataaagaagctagttcaaatctcttaccattaaattttaccgggctatcaaaggctgtgaagaagggtgatactatttttattggaaaatacttgtttactggaagtgaaacagcttctgtatggctggaggtcagtgaggtggaaggtgaggatgtcacctgtctggtaaaaaacactgccacactctctggatcattgtttactgtacatgtctctcagattcacatcgatcttcctactcttgctgataaagataaggaggtaataagcacatggggtgttcaaaacaatattgacttcctttcattatatacccggcacgttgaagatattcgtcatgcacgtgaatttctctctaaattgggtgacctgaagcagacacatatttatgcaaagattgaaaatatagagggaatgaaacattttgatgaaatattgagagaagcagatggtatcatcctcgctcgtggaaatttagggatagaactcccacctgagaaggttttcttattccaaaaggctgctatttacaagtgtaacatggttggaaagccagttgttgttacacgtgttgtggactctatgactgataatctaagacctactcgtgctgaagcaacagatgttgccaatgcagtgttggatggaagtgacgcaattctccttggagcagagaccctgcggggacaataccctgtagagaccatttctatagttggaaaaatatgtgctgaggcagagaaagttcataatcaagatttgtattttaagaaggctgtaaaatatgtgggagagccaatgagccatttggaatcaattgcttcctctgcggttcgggcagctatcaaggttaaggcctctgttattatttgcttcacttcatctggaagagctgcaagattgattgctaagtacagaccaaccatgcctgtgatatctgttgtcattcctcaattgaagacaaatcaactccgatggacgttcaccggtgcttttgaggctaggcaatctcttattgtgagaggtctttttcctatgctggcagatccacgacacccagctgagtccagaagtggaacaaatgaatcaattttgaaggttgctttagaccatggcaaggcttttggcatcataaagccacatgaccgagttgttgtctgccagaaagtagctgactcgtcagttgtgaagattcttgagctcgaagattgaatgattacaacttatgcgttatttgatgcataataataaagattcttgggcttgtgtttgataatcggagcgatatccagttttgaaatcaagcatggtgtgctgatctttcggctacttatgttgtttaatagtaaaccatccgaattcgaaaacgaaattgattatcttctaatgaattttatgctgaaaagaaaagtatgaattataagacaacttgtaaacactgagtgtgccagataaacttgtgagattattttagcttaaaaaaaaaaaaaaa

SEQ ID NO: 70164 - protein, 526 aa, Glycine max
MHSSPLLLEEPIRMASILEPSKPTFFPAMTKIVGTLGPKSRSVDIISHCLDAGMSVARFDFSWGDPEYHQETLENLRVAIKSTKKLCAVMLDTVGPELQIENKTDHPITLEADTLVVLTPDQNKEASSNLLPLNFTGLSKAVKKGDTIFIGKYLFTGSETASVWLEVSEVEGEDVTCLVKNTATLSGSLFTVHVSQIHIDLPTLADKDKEVISTWGVQNNIDFLSLYTRHVEDIRHAREFLSKLGDLKQTHIYAKIENIEGMKHFDEILREADGIILARGNLGIELPPEKVFLFQKAAIYKCNMVGKPVVVTRVVDSMTDNLRPTRAEATDVANAVLDGSDAILLGAETLRGQYPVETISIVGKICAEAEKVHNQDLYFKKAVKYVGEPMSHLESIASSAVRAAIKVKASVIICFTSSGRAARLIAKYRPTMPVISVVIPQLKTNQLRWTFTGAFEARQSLIVRGLFPMLADPRHPAESRSGTNESILKVALDHGKAFGIIKPHDRVVVCQKVADSSVVKILELED

SEQ ID NO: 70165 - DNA, 1965 bp, Glycine max
  CDS (127)..(1764)
ctgaccaccagaagaatgggacctggttggttgaaagtggagcgaagaaaactaacggagacttgtttggaagctagtctctggtgagagtgaaggcgcaccatcttcaccttgaagtcaacgatcatggcaaccattaacctttcttccgctactacgtctctcttccaatccaaacaccgaacgaaacgcattccacgcctccctacaatcgccagaataacaaaccacatcgaaggaactcatcttaactcccccaacggctctcccatccttggcaacgcaaacaattcccttgaggttccctccaataactatatctcgctacactcttcagacgtgcgtaggaaaactaagatcgtgtgcacgataggtccttctacgagctcacgtgatatgatatggaacctggctcaagctggaatgaacgtggcgcgtttgaacatgtcgcatggggaccacgcctcgcacctccaaaccattgatttggtgaaagaatacaattctcagtttcaagataaggttgtagccatcatgctcgacaccaagggtcctgaagttagaagtggggatgtagctcaacctattttacttaaagagggacaagaattctgtttcaccactatgagaggggttagcacacatgacacggttagcgtgaactacgatggctttgtgaatgatgtggagttcggagatgtgttgctggttgatggaggaatgatgtctcttgctgttaagtcaaagacaaaagacttggttaaatgtgaagttattgatggtggtgaactgaaatctaggcgtcatttaaatgtccgtggaaaaagtgcaacacttccttccataactgacaaggactgggaagatatcaagtttggggtggacaatcaagtagacttctttgctgtctcatttgtcaaggatgctagagtggtgcacgagttaaaacactacctcaaaagtcataatgccgatatacacgtgattgtaaaaattgaaagtgcagattccataccaaatctccattcgatactttctgcttcagatggggccatggtcgctcgtggggatcttggagctgaacttccaatagaggaagttcctttattgcaggaagacatcattcgaagatgtcaaattatgcaaaagcctgttattgtggcaacaaatatgcttgaaagcatgattaatcatcccacaccaacaagggcagaagtttcagacatcgcaattgcagtaagacaaggtgctgatgctatcatgctttcaggagaaactgcacatggaaaatttccattgaaagctgttaaagttatgcacacggtggctcttaggaatgaatccagtgttcaaagtggtgtttcttatccgagtcaactgagttcccatgaaagtcatatgggagaaatgtttgctttccatgcgacaacaatgtctaacactcttaatactcctattattgttttcaccagaacaggatccatggcaattcttttgagccattataggccttactcaacaatctttgcattcacaaatgaagcaagaattaagcagaggttggcgctttatcatggggttatgtccatatacatgcaattttcaaatgatgtagaagagaccttctctagagccctcaagctactattgagtaagagtcatttacacgagggacaacatgtcacacttgttcaaagtggagcacaaccaatctggcgtgaggaatccactcaccacatacaagttcgcaaggttcatggataaaattctatgaaggatctttgttcctcataagtgtacagtttttttccccactatcttgtaactattcatagtaatggctattcactatcttgtaactattcatagttatgactattatgcacttgaaacaccaaagttggatagtaaaggaattttcataatgcaaatagtgatttattgataaggaaaaaaaaaaaaaaa

SEQ ID NO: 70166 - protein, 545 aa, Glycine max
MATINLSSATTSLFQSKHRTKRIPRLPTIARITNHIEGTHLNSPNGSPILGNANNSLEVPSNNYISLHSSDVRRKTKIVCTIGPSTSSRDMIWNLAQAGMNVARLNMSHGDHASHLQTIDLVKEYNSQFQDKVVAIMLDTKGPEVRSGDVAQPILLKEGQEFCFTTMRGVSTHDTVSVNYDGFVNDVEFGDVLLVDGGMMSLAVKSKTKDLVKCEVIDGGELKSRRHLNVRGKSATLPSITDKDWEDIKFGVDNQVDFFAVSFVKDARVVHELKHYLKSHNADIHVIVKIESADSIPNLHSILSASDGAMVARGDLGAELPIEEVPLLQEDIIRRCQIMQKPVIVATNMLESMINHPTPTRAEVSDIAIAVRQGADAIMLSGETAHGKFPLKAVKVMHTVALRNESSVQSGVSYPSQLSSHESHMGEMFAFHATTMSNTLNTPIIVFTRTGSMAILLSHYRPYSTIFAFTNEARIKQRLALYHGVMSIYMQFSNDVEETFSRALKLLLSKSHLHEGQHVTLVQSGAQPIWREESTHHIQVRKVHG

SEQ ID NO: 70167 - DNA, 1825 bp, Helianthus annuus
  CDS (128)..(1624)
ataacaaaccaacccacccatttttattctcatttcacacatcaccgccgcccaatattcaatacattctcatcattttcaattctgtttctcaatttgattccattattccttcacaatcacactgatggatcaccagatgaagaggccgaagacgaagatcgtctgcacgttaggacctgcatctagatcagttccaatggtggagaagctcttaaaagcaggtatgaacgttgctcgcttcaatttctctcacggatcctatgaatatcatcaggaaacgcttgataatctccgcactgctatggataacaccggtatactctgtgcggttatgctcgacaccaagggtccagagattcgaaccgggtttttaaaagatggcaagccagttcagcttaaacagggtcaagaaatcacaatctctatcgattacaccatcaaaggcgatgaaaacatgatctgcatgagctacaagaagctagctcacgatgttaaaccacaaagtgtgattctctgtgcagacggcaccatttcgtttactgttctgtcttgtgacattgaaaacgggctagttcgttgtcgttgtgagaacactgcggttcttggtgaacgaaaaaacgttaatctacctggtgtgattgtggatctaccaacgctgactgagaaagacaaagaagatatcatgaaatggggtgttcctaataagattgatatgattgctttgtcgtttgtccgaaagggttcagaccttgtggaggttcgtaagctgttgggagtacatgctaaaaacattctgcttatgtctaaggttgaaaatcaagaaggggttgccaactttgatgatatcctagcgaactcagacgcgtttatggtggcgcgtggtgatctcgggatggaaattccgattgagaaaatatttctagctcagaaagtaatgatatacaagtgcaacctacaaggaaagccggttgtaaccgccactcaaatgctggagtcaatgatcaagtctccaaggcccactcgagccgaagccacagacgttgctaacgcggtcctcgatggaaccgactgcgtcatgcttagtggagaaaccgcagccggggcttacccagagctcgcagttcaaaccatggctaaaatctgcatggaagccgaaagcacaatagactataaagacgttttcaaaaggatcactgccaatgcaccggtccccatgagcccacttgaaagcttagcctcttctgcggttcgaaccgcgatctcatcaaaagcgagtctgatattggttctaaccagaggtggaagcactgcgaaactagtggctaagtaccgccccgggatgcctatactgtctgttgtggttccagaaatcaagaccgattcttttgactggtcttgtagtgatgagtcaccggctagacatagtctaatctttaggggtttggtcccggttttgattgcggggtctgctagagcttctcatgatgagtccactgaagaagctattgaatttgctttgcaacatgctaaagataaaggactatgcaagaatggtgattcggttgtggctctacatcgtgttggaaccgcgtctataatcaagatcgtgacagttaagtgattcttatgctatattgatattgtcgatttttgccctttcgatggcacacattgttacactggtaaactaaagttgattttggtatcgatgaactggatttgttatgagaaactacgtaacgagtaatgcatttttgtcgcgagtttgaataattgacattacttcgtgttttttggaaaaaaaaagaaaaaaaaaaaaaaa

SEQ ID NO: 70168 - protein, 498 aa, Helianthus annuus
MDHQMKRPKTKIVCTLGPASRSVPMVEKLLKAGMNVARFNFSHGSYEYHQETLDNLRTAMDNTGILCAVMLDTKGPEIRTGFLKDGKPVQLKQGQEITISIDYTIKGDENMICMSYKKLAHDVKPQSVILCADGTISFTVLSCDIENGLVRCRCENTAVLGERKNVNLPGVIVDLPTLTEKDKEDIMKWGVPNKIDMIALSFVRKGSDLVEVRKLLGVHAKNILLMSKVENQEGVANFDDILANSDAFMVARGDLGMEIPIEKIFLAQKVMIYKCNLQGKPVVTATQMLESMIKSPRPTRAEATDVANAVLDGTDCVMLSGETAAGAYPELAVQTMAKICMEAESTIDYKDVFKRITANAPVPMSPLESLASSAVRTAISSKASLILVLTRGGSTAKLVAKYRPGMPILSVVVPEIKTDSFDWSCSDESPARHSLIFRGLVPVLIAGSARASHDESTEEAIEFALQHAKDKGLCKNGDSVVALHRVGTASIIKIVTVK

SEQ ID NO: 70169 - DNA, 1575 bp, Glycine max
  CDS (38)..(1354)
ggaaaccggaggcagaaaactgaaaagcagagaaacgatggcctttgaatcggtgacgcagtcagcacctcctccgagatcaagaggaagaatcaccttgctcgaaaaccccaaaacacccttcgcccttgctcttctctttgccgacgccgtcctcgtctctctcataatcgccttcgtcccctatacgaagatagattgggacgcttacatgtcacaggttaccgggtttctcggtggagaacgagattaccgcaacctcaagggtgacactggtcctctcgtctaccctgctggctttctctacatttactctgctttccagtatcttaccgaaggacaagtttaccctgctcagattttgttcggagtgttgtatatcgttaacttggcaatcgttctcgccgtctatgtcaaaactgatgtggttccgtggtgggcactttgcttgctttctctgtcgaaaagagtgcattctatcttcgtgcttcgtttatttaatgactgtgtggccatgacactttttcatgctgcattgctcttactcgtgcaccgtaggtggaatcttgggttgattttgtttagtggagctgtttcggtgaagatgaatgtgcttctttatgctcctcctttgctgcttctcatgctgaaggctatggacatcagtggcgtgttattggcattatctggtgcagcactggttcagatattactgggacttcctttcctggtttcatacccagttacatacatatcaagagccttcaaccttggccgtgtcttcatccatttctggtctgttaacttcaaattcatccctgaaccagtatttgtgtccaagggatttgcaatctttttgttggctgctcacctcatatcacttgcttcatttgcgcattatagctggtgcaaacatgaaggagggctttgcaacttcctgcattccagatatgtctttatgagaatgaagtttgcacttttcttctcttcctctttttctaaggtcggcaagagcagttcatcatccctcaagatccttaataaagaacatattgtgacaactatgtttgttgggaacttcattggcattgtatgtgctcggtcgttgcattatcagttctatttgtggtacttctatagcttgccctacttgttgtggagaacgaattaccctacattgctgcgtttgattttgttcgtgggagtggagctgtgctggaatatctatccttcgaacagcctttcttcagcgttacttctttgtcttcacacaattattctctggggtttgtggtctgctccacctgagtatccttatgaagaaaataaaccatcctctcacaaaaacaaatagaagttcaaatttcaaaggttgctctcctattttgtggaggaaaaaggatgacttggacaaatgagttttgattttccccttatcactcctttccctttgatgtagatgtttgtgatgtatcttggagcaagcctaaggacttggatgtaaaacagaatataggagcgacaattctttagatattttgatttttttttttcacttccaaaaaaaaaaaaaaa

SEQ ID NO: 70170 - protein, 438 aa, Glycine max
MAFESVTQSAPPPRSRGRITLLENPKTPFALALLFADAVLVSLIIAFVPYTKIDWDAYMSQVTGFLGGERDYRNLKGDTGPLVYPAGFLYIYSAFQYLTEGQVYPAQILFGVLYIVNLAIVLAVYVKTDVVPWWALCLLSLSKRVHSIFVLRLFNDCVAMTLFHAALLLLVHRRWNLGLILFSGAVSVKMNVLLYAPPLLLLMLKAMDISGVLLALSGAALVQILLGLPFLVSYPVTYISRAFNLGRVFIHFWSVNFKFIPEPVFVSKGFAIFLLAAHLISLASFAHYSWCKHEGGLCNFLHSRYVFMRMKFALFFSSSFSKVGKSSSSSLKILNKEHIVTTMFVGNFIGIVCARSLHYQFYLWYFYSLPYLLWRTNYPTLLRLILFVGVELCWNIYPSNSLSSALLLCLHTIILWGLWSAPPEYPYEENKPSSHKNK

SEQ ID NO: 70171 - DNA, 1437 bp, Brassica napus
  CDS (54)..(1259)
tcgtcctctctcttagcatcagtcaactcattgtttacatctgttcatctactatggcgacgaagagaagcgttggaacgttgaaggaagctgatctgaagggaaagagcgtgttcgtgagggttgatctcaacgttcctttggatgataactctaacatcactgatgacaccaggattcgtgccgctgttcctaccgttaagtacttgatggaaaacggatctagagttgttctctgcagtcacttgggtcgtccaaaaggtgttacccctaaattcagcttaaagcctcttgtgccgaggttgtctgagcttcttgggattgaggttgtaatggcaaatgactctattggtgaggaagtccagaaactagtcgcaggactacctgaaggaggtgttctgctattggagaatgtgaggttctacaaggaagaagagaagaacgaccctgaatttgccaagaagctcgctgcccttgctgatgtctatgtcaacgatgctttcggaactgctcacagagcccatgcttccactgagggagttgccaaatacttgaagccttctgtcgctggtttcctcatgcagaaggaacttgattacctcgtcggagctgtggtaaaccccaagaatccttttgccgccattgttggaggttcaaaggtttcgacgaagattggtgtcattgagtcgctcctgtccaccgttgacatccttcttcttggtggaggtatgatttatactttctacaaggcacaaggacactctgtcggatcttctcttttggaagaggacaagcttgacttggccaggtcgctcatggagaaggccaaagccaaaggtgtctctcttttactcccaaccgatgtggttattgctgacaaattcgctcctgatgctaacagcaagatagtgccggccacggcaatcccagatggctggatgggactagatattggtccagactccatcaagacattcagcgaagcgctggacacaaccaagaccatcatctggaatggtcccatgggtgtttttgaatttgaaaagtttgcagctggaactgaggctgtagcaaagcagctggcggagctgagcggaaagggagtgaccacaatcataggaggaggtgactctgtcgctgccgttgaaaaggttggtttggctgacaagatgagtcacatctctacaggaggcggtgcaagtttggagcttctagagggaaagccactcccaggagtcctcgctctcgacgacgcttgagaatattttaagttcctgtccatgttatttattatacatcgtgtaccaagtcgtctggttttcttgtagccagagcaagccattaatattgtcagcttgagagttctctacggctttcttttagtttggagcctatttaataataaagagatgaaactctgagtaaaaaaaaaaaaaa

SEQ ID NO: 70172 - protein, 401 aa, Brassica napus
MATKRSVGTLKEADLKGKSVFVRVDLNVPLDDNSNITDDTRIRAAVPTVKYLMENGSRVVLCSHLGRPKGVTPKFSLKPLVPRLSELLGIEVVMANDSIGEEVQKLVAGLPEGGVLLLENVRFYKEEEKNDPEFAKKLAALADVYVNDAFGTAHRAHASTEGVAKYLKPSVAGFLMQKELDYLVGAVVNPKNPFAAIVGGSKVSTKIGVIESLLSTVDILLLGGGMIYTFYKAQGHSVGSSLLEEDKLDLARSLMEKAKAKGVSLLLPTDVVIADKFAPDANSKIVPATAIPDGWMGLDIGPDSIKTFSEALDTTKTIIWNGPMGVFEFEKFAAGTEAVAKQLAELSGKGVTTIIGGGDSVAAVEKVGLADKMSHISTGGGASLELLEGKPLPGVLALDDA

SEQ ID NO: 70173 - DNA, 1432 bp, Brassica napus
  CDS (39)..(1244)
ttacatccactcattgttttcttttttgctcatctactatggcgacgaagagaagcgttggaactttgaaggaagcggatctgaagggaaagagcgtgttcgtgagggttgatctcaacgttcctttggatgataactctaacatcaccgacgacactaggattcgtgccgctgttcccaccatcaagtacttgatgggtaacggatctagggttgttctctgcagtcacttgggccgcccaaaaggtgttacccctaaattcagcttgaagcctcttgtgccgagattgtctgagcttcttggtgttgaggttgtgatggcaaatgactctattggtgaggaagtccagaaactggttgcaggactacctgaaggtggagttcttctcttggagaacgtgaggttctacaaggaagaagagaagaacgaccctgagtttgccaagaagcttgctgcccttgctgatgtctacgtcaacgatgctttcggaactgctcacagagctcatgcttctaccgagggagttgccaaatacttgaagccttccgttgccggtttcctcatgcagaaggagcttgattaccttgtcggagctgtggcaaaccccaagaagccttttgctgccattgtcggaggctcaaaggtttcgacaaagattggtgtcattgagtcgctcttgtccaccgttgacatcctcttgctcggtggaggtatgattttcactttctacaaggcgcaaggacattcggttggatcttcccttgtggaagaggacaagcttgacttggccaagtcactcatggagaaggcgaaagccaaaggtgtctctctgttgctcccaaccgatgtggttattgctgataagttcgctcccgatgctaacagcaagatagtgccagccacggcaatcccagatggctggatgggactcgatgttgggccagactctatcaagacattcagcgaggctctggacacaacccagaccatcatctggaatggtcccatgggtgtttttgaattcgaaaagtttgcagctggaactgaggccgtagcaaagcagctagcggagctgagcggaaagggagtgaccacaatcataggaggaggtgactctgtggctgccgtggagaaggttggtttggctgacaagatgagtcacatctctaccgggggaggtgcaagtttggagcttctagagggaaagccacttccaggagtcctagctcttgacgacgcgtgaatttcatctctcttgtgatatgtgatatgtgatatgtattacaagtcttatgcttttcttatgaccagattagcaaagcccttgtacttgtccgcttgagattttctttctacggctctttttcgagttttttgcttggagcctttttaataaaagaaagagattaaactctgaaaaaaaaaaaaaaa

SEQ ID NO: 70174 - protein, 401 aa, Brassica napus
MATKRSVGTLKEADLKGKSVFVRVDLNVPLDDNSNITDDTRIRAAVPTIKYLMGNGSRVVLCSHLGRPKGVTPKFSLKPLVPRLSELLGVEVVMANDSIGEEVQKLVAGLPEGGVLLLENVRFYKEEEKNDPEFAKKLAALADVYVNDAFGTAHRAHASTEGVAKYLKPSVAGFLMQKELDYLVGAVANPKKPFAAIVGGSKVSTKIGVIESLLSTVDILLLGGGMIFTFYKAQGHSVGSSLVEEDKLDLAKSLMEKAKAKGVSLLLPTDVVIADKFAPDANSKIVPATAIPDGWMGLDVGPDSIKTFSEALDTTQTIIWNGPMGVFEFEKFAAGTEAVAKQLAELSGKGVTTIIGGGDSVAAVEKVGLADKMSHISTGGGASLELLEGKPLPGVLALDDA

SEQ ID NO: 70175 - DNA, 1641 bp, Glycine max
  CDS (194)..(1399)
ccccaaacagggctaatcccaaaaaaaggccacaaccctctcacacgtgtcgttcacacgagtgccacccacctctctctataaatctttctagaaagttccctcactccctgaacctgatcgatctctttaccagttgccacactacaccgagattccccctaaacccgtttgcgttgttgtttgcgaagaaatggcgactaagaggagcgtgggaacgttgaaggagggtgatttgaaagggaagagggtgttcgtgagggtcgatctgaacgtgcctttggatgacaaccttaacatcaccgatgacactagagtccgtgctgctgttcccaccatcaagtacttaactggtcatggagccaaagtgatcctttctagccacttgggacgtcctaaaggtgtaacacctaaatacagtttgaagcctcttgtgccaaggctgtctcaacttctcggaattgaggttacgatggcaaatgactctattggggaggaagttgagaagttggttgcacaacttccagaaggtggtgttttgcttctagagaatgtgaggttctataaggaggaagagaagaatgaccctgagtttgcaaagaagttggcttctcttgctgatctctacgtgaatgatgctttcggcactgcccacagagctcatgcttctacagaaggagtggccaaatacttgaagccctctgttgcaggattccttatgcagaaggaacttgactatctagttggagctgtgtcaaaccccaagagaccatttgctgctatcgttggtgggtcaaaggtgtcttccaagattggagttattgagtccttgttggagaaagttaacgttctcttgcttggtggaggaatgatctttaccttttacaaggctcagggttattcagttggttcatctcttgtggaggaagacaagcttagccttgcaactacacttctcgaaaaggccaaggctaaaggggtttctttgttgcttccaactgatgtggtcatagcagacaagtttgctgctgatgctaacagcaagactgtgccagcatcaagcatcccagacgggtggatgggattagatattggtcccgattccatcaagacatttggtgaagcattggataagacccagaccgtcatttggaatggaccaatgggtgtttttgagtttgataagtttgccacaggaacagaggccatagccaagaaactggcagagctgagtgggaagggagtaacgaccatcattggaggaggtgactctgttgccgctgtggagaaggttggtcttgcagacaagatgagccacatctccactggtggtggtgccagcttagagcttcttgaggggaagcaactccctggtgtccttgcccttgatgatgcttgagtaaacatcactagttcctctgtaatttgtgctttatattattattatggttggatttcagccaacagtggattgaggtacaatgagagagctcttgttgctcctgtagaggcttaatataggttaggtttcgaaataagagggttttgtggcatccttggtgttgcattgagctttgatctaattgttcttgaacaatgttcatttcaaaaggagttttactttgttaaaaaaaaaaaaaa

SEQ ID NO: 70176 - protein, 401 aa, Glycine max
MATKRSVGTLKEGDLKGKRVFVRVDLNVPLDDNLNITDDTRVRAAVPTIKYLTGHGAKVILSSHLGRPKGVTPKYSLKPLVPRLSQLLGIEVTMANDSIGEEVEKLVAQLPEGGVLLLENVRFYKEEEKNDPEFAKKLASLADLYVNDAFGTAHRAHASTEGVAKYLKPSVAGFLMQKELDYLVGAVSNPKRPFAAIVGGSKVSSKIGVIESLLEKVNVLLLGGGMIFTFYKAQGYSVGSSLVEEDKLSLATTLLEKAKAKGVSLLLPTDVVIADKFAADANSKTVPASSIPDGWMGLDIGPDSIKTFGEALDKTQTVIWNGPMGVFEFDKFATGTEAIAKKLAELSGKGVTTIIGGGDSVAAVEKVGLADKMSHISTGGGASLELLEGKQLPGVLALDDA

SEQ ID NO: 70177 - DNA, 1838 bp, Glycine max
  CDS (167)..(1618)
cgataagagaaatccaaaatcctctcaccacacccaatcgttcccgcgttgtcctccacgtcctcatcctttcatcacctctctcttccaccaaacaataaaaacctccaaacccactccagttaactccatacactctctctctctctctctctctctctctacaatggcctcagccgcagcccccacaactttctctctcctccactccaccaccccggcctcctcctcctccgccacctccgcctccccctcgcgcgtgcagctctcctcctccctccgctcgcgcccgctcgcgcgccgccttggcttcgccgcggcggacccgctgctcgcggcgaatgtcgcagcgcgcgtcgcggcggtgagaggaggaaagggcgcgaggggggtggtgtcgatggcgaagaagagcgtgggggagctgagcgcggcggacctgaaggggaagaaggtcttcgtcagggccgacctcaacgtcccgctcgacgacaaccagaacatcaccgacgacaccagaattcgcgccgccattcccaccatcaaacacctaatccaaaacggcgccaaagttattctctccagccacttggggaggccgaagggtgtcactcccaaatacagcttggcacctcttgtgccccggctttctgagctcattggtatccaggttgtcaaggctgaagacagtattggtccagaagtagaaaagttggtggcttctcttccagatggaggtgttcttcttctagaaaatgtgaggttttacaaggaggaagaaaagaatgatcccgagcatgcaaaaaagcttgcctctctggcagatctgtttgtgaatgatgcatttggtactgctcacagggcacatgcatcaacagagggtgttactaaatacctgaagccatctgttgctggttttcttttgcaaaaggaacttgattaccttgttggggcggtatcaagccccaaaaggccatttgctgccattgttggtggttccaaggtctcatctaaaattggagtgattgagtcacttttggaaaaagttgacattcttcttcttggtggaggaatgatcttcacattttacaaggcacaaggtctttcagtgggttcatcccttgtagaagaagataagttggatcttgctacatcactacttgcaaaagccaaggaaaagggggtgtctctcttgttaccaagtgatgtggtgattgcagacaaatttgcccccgatgcaaacagcaaggtcgtgccagcatctgccatccctgatggctggatgggattggatattggtccagattctgttaaatcattcagtgaagcattggatactacccaaaccatcatatggaatggaccaatgggagtgtttgagtttgacaagtttgctgttggtacagaggctattgcaaagaagctggctgatctcagtggaaagggggtgaccacaattatcggaggaggagattctgttgcagctgtggagaaagtaggagttgctagtgtcatgagccacatatctactggtggtggtgccagtttggagttattggaaggcaaagagcttccaggagtccttgctctcgatgaagccgtcccagttgccgtgtaagacaattttcagcttggaaaatttttccatcctcagatttcggtgttgtcaatcttgtaaaagagcatatgttgtaggacccttcggagtctgttagtgtaaattttatcatgcttgagttattattggcttcacacataaattgcgtgtaactgtaaaccctggctgagagccataaattcgaataaatcttttagttgctgccaaaaaaaaaaaaaaa

SEQ ID NO: 70178 - protein, 483 aa, Glycine max
MASAAAPTTFSLLHSTTPASSSSATSASPSRVQLSSSLRSRPLARRLGFAAADPLLAANVAARVAAVRGGKGARGVVSMAKKSVGELSAADLKGKKVFVRADLNVPLDDNQNITDDTRIRAAIPTIKHLIQNGAKVILSSHLGRPKGVTPKYSLAPLVPRLSELIGIQVVKAEDSIGPEVEKLVASLPDGGVLLLENVRFYKEEEKNDPEHAKKLASLADLFVNDAFGTAHRAHASTEGVTKYLKPSVAGFLLQKELDYLVGAVSSPKRPFAAIVGGSKVSSKIGVIESLLEKVDILLLGGGMIFTFYKAQGLSVGSSLVEEDKLDLATSLLAKAKEKGVSLLLPSDVVIADKFAPDANSKVVPASAIPDGWMGLDIGPDSVKSFSEALDTTQTIIWNGPMGVFEFDKFAVGTEAIAKKLADLSGKGVTTIIGGGDSVAAVEKVGVASVMSHISTGGGASLELLEGKELPGVLALDEAVPVAV

SEQ ID NO: 70179 - DNA, 1322 bp, Hordeum vulgare
  CDS (14)..(1051)
tagagcggacgagatgaggatgtcgctgctgagatccgcgtcgcagcacctgcgccgccaccgctgcgactactcctcctcctcctccgccaccgcctcgccggagcggaaggtggccatcctcggcgcggcgggcggcatcggccagccgctggcgctgctcatgaagctcaacccgctcgtctcctccctctccctctacgacatcgccgccacgcccggcgtcgccgccgacgtctcccacatcaacacccgcgccctcgtcaaggggttcgtcggggacgaccagctcggggaggcgctggagggcgccgacctcgtcatcatccccgccggggtgccccggaagcccggcatgaccagggacgacctcttcaagatcaacgccgggatcgtcaagggcctctgcaccgccatcgccaggcactgccccaacgctctcgtcaatatgatcagcaaccctgtcaactcgacagtcccgattgcggcagaggtgtttaagaaggctggtacttatgatgagaagaagctgtttggtgtgaccactcttgatgttgttcgtgctaaaacattctacgctggaaaggcaaacgtgccagttactggggtgaatgttcctgttgttggtggccatgctggtatcactatcctgccactgttctcacaggctactcctgcaagtaatgcattgtcccatgaggaccttgtggccctcacgaagaggacacaggatggtgggacggaagttgttgaagcaaaagctggaaagggctcagcaacattgtcgatggcatatgctggtgcagttttcggagacgcatgcttgaaggggctcaatggagttcctgacatcatagagtgctcttttgtccaatcaactgtaacagagttgccattctttgcctccaaggtaaggctgggcaagagcggagtggaggaagtgcttgggctgggcgagctatcggccttggagaaggaggggctggaaagcctcaagggcgagctgctgtcttccatcgagaagggtgtcaagtttgcgcaggagagctaggcggcgacctgcccagcctataatggttcacacttgaactcatgcaatttttgttcgaccgcttccgttgccccccaatccggttatgccgtggggcatcgaggcatcgtcgtgctccacaataaaatgtactactggctttgatgtcgccagactgaactaaacctgtagtgccagaaacagcggacaccggtgcctatgtgtttgtagcattcgtacccgagatcacgaagggaaaccgaagattctatctgggaaaaaaaaaaaaaaa

SEQ ID NO: 70180 - protein, 345 aa, Hordeum vulgare
MRMSLLRSASQHLRRHRCDYSSSSSATASPERKVAILGAAGGIGQPLALLMKLNPLVSSLSLYDIAATPGVAADVSHINTRALVKGFVGDDQLGEALEGADLVIIPAGVPRKPGMTRDDLFKINAGIVKGLCTAIARHCPNALVNMISNPVNSTVPIAAEVFKKAGTYDEKKLFGVTTLDVVRAKTFYAGKANVPVTGVNVPVVGGHAGITILPLFSQATPASNALSHEDLVALTKRTQDGGTEVVEAKAGKGSATLSMAYAGAVFGDACLKGLNGVPDIIECSFVQSTVTELPFFASKVRLGKSGVEEVLGLGELSALEKEGLESLKGELLSSIEKGVKFAQES

SEQ ID NO: 70181 - DNA, 1222 bp, Brassica napus
  CDS (45)..(1070)
gcttcaccacaaacactaaaaagacatctcttctctcctgcaaaatgttcagatccgcgcttgtccgatcctccgcctcggcgaagcagtcgcttctccgccgcagcttctcttccggatccgtccccgagcgtaaagtcgccatcttgggagccgccggtggaatcggtcagcctctggctctcctcatgaaactcaatcccctcgtctcaagcctctccctttacgatatcgccaacacacccggagtcgccgctgacgtcggtcacatcaacaccagatctcaggtggttgggtacatgggagatgataacttggcgaaagctcttgaaggagctgacctcgttatcattccagctggtgtccccaggaagcctggtatgacccgtgatgatcttttcaacatcaatgctggcattgtcaagaacctttgctctgccatcgccaagtactgccctcatgcacttgttaatatgattagcaacccggtcaactctactgttccgattgcagcagagattttcaagaaggctggtatgtacgatgaaaagaagctgtttggtgttaccactcttgacgttgttagggccaagactttctatgctggaaaggctaatgtccctgttgcagaagttaatgttccggtgattggtggtcatgctggggttacaatcctcccactcttctctcaggccactccccaagctaacttgtcaggtgacgtgctcactgccctcaccaagcgtactcaagatggaggtacagaagttgtggaggctaaagcagggaaaggttcagctacattgtcaatggcgtatgctggagcactattcgctgacgcatgcttgaagggactcaatggtgttccagatgtagtcgaatgctcatacgtgcagtccacaatcactgagcttcctttctttgcctcaaaggtgaggttggggaagaacggtgttgaggaggttcttgatttggggccactctctgactttgagaaggaaggcttggaagcattgaaaccggaactcaagtcttccattgagaagggagttaagtttgccaaccaatgagttaaaccggtttgactcggttatgtttctttccaattttccggctagagctggccttccataaaatccatgattgagtcttacttttttattttcaaacaatgtattttgcgggtaataaatgacactctcacaaacaaaaaaaaaaaaaa

SEQ ID NO: 70182 - protein, 341 aa, Brassica napus
MFRSALVRSSASAKQSLLRRSFSSGSVPERKVAILGAAGGIGQPLALLMKLNPLVSSLSLYDIANTPGVAADVGHINTRSQVVGYMGDDNLAKALEGADLVIIPAGVPRKPGMTRDDLFNINAGIVKNLCSAIAKYCPHALVNMISNPVNSTVPIAAEIFKKAGMYDEKKLFGVTTLDVVRAKTFYAGKANVPVAEVNVPVIGGHAGVTILPLFSQATPQANLSGDVLTALTKRTQDGGTEVVEAKAGKGSATLSMAYAGALFADACLKGLNGVPDVVECSYVQSTITELPFFASKVRLGKNGVEEVLDLGPLSDFEKEGLEALKPELKSSIEKGVKFANQ

SEQ ID NO: 70183 - DNA, 1319 bp, Brassica napus
  CDS (104)..(1126)
gtgagcttcaccacataagcataaaaaagagcatctccttagatttgcttccttctctcctccagattcctctcgagcgtaaaccctagcttccctctccaaaatgttcagatccgtcgtcgtccgttcctcttcatcggcgaagcaatcgcttctccaccgcagcttctcctcctccgtccccgagcgcaaagtcgccatcctcggggccgccggtggaatcgggcagcctctcgctctcctcatgaagctcaaccccctcgtctcaagcctctccctcttcgatatcgcaaacacccctggagtcgccgctgatgtcggtcacatcaacaccagatctgaggtggttggatacatgggagatgatgaattggcgaaagctcttgcaggagctgacctcgttatcatccctgctggtgtccccaggaagcctggcatgactcgtgatgatcttttcaacatcaacgctggtattgtcaagaacctttgctctgccatcgccaagtactgccctcatgcacttgttaacatgatcagcaacccagtgaactccactgttccaattgcagctgagatattcaagaaggctggtatgtacgatgagaagaagttgtttggtgtcaccactcttgacgttgttagggccaagactttctacgctggaaaggctaatgtccctgttgctgaagttaatgttccggtgattggtggtcatgctggggttacaattctcccactcttctctcaggccactcctcaggccaacttgtctaatgatgtactcaccgctctcaccaagcgtacccaagatggaggtaccgaagtcgtggaggctaaagcaggaaaaggttcagctacattgtcaatggcctatgctggagcactatttgctgatgcatgcttgaaaggactcaacggagttccagacgttgtggaatgttcatacgtgcagtccaccatcactgagcttcctttctttgcctcaaaggtgaggttggggaagaacggtgtggaggaggttcttgatttggggccactctcagactttgagaaacaagggttggaagcactgaagccagaactcaagtcttccatcgagaagggtgttaagtttgcaaaccaatgagttaaatcgatttgagtcgggttatttttccaattttccggttatattatcgcccttcattgggttgcatcaataaaattcatgtgttgaggctttttgggttctttcccaaagcacagagataaaaaaaactgtaacatgtaaggtttctttcttatataacaatgtttttttctgtcaaaaaaaaaaaaaa

SEQ ID NO: 70184 - protein, 340 aa, Brassica napus
MFRSVVVRSSSSAKQSLLHRSFSSSVPERKVAILGAAGGIGQPLALLMKLNPLVSSLSLFDIANTPGVAADVGHINTRSEVVGYMGDDELAKALAGADLVIIPAGVPRKPGMTRDDLFNINAGIVKNLCSAIAKYCPHALVNMISNPVNSTVPIAAEIFKKAGMYDEKKLFGVTTLDVVRAKTFYAGKANVPVAEVNVPVIGGHAGVTILPLFSQATPQANLSNDVLTALTKRTQDGGTEVVEAKAGKGSATLSMAYAGALFADACLKGLNGVPDVVECSYVQSTITELPFFASKVRLGKNGVEEVLDLGPLSDFEKQGLEALKPELKSSIEKGVKFANQ

SEQ ID NO: 70185 - DNA, 1320 bp, Brassica napus
  CDS (61)..(1092)
agaatcgcatcttagcttttgcttccttctcgagagtaaaccctagatcccatctccaagatgttcagatccgttatcgtccgttcttcttcatcggcgaagcaatcgcttctccgccgcagcttctcctcctcctcctcctccgtgcccgagcgcaaagtcgccatcctcggcgccgccggtggaatcgggcagcctctcgctctcctcatgaagctcaaccccctcgtctctagcctctcactcttcgatatcgctaacacccctggagtcgccgccgatgtcggtcacatcaacaccagatctgaggtggttggatacatgggagatgatgaattggcgaaagctcttgaaggagctgacctcgttatcattcctgctggtgttcccaggaagcctggtatgacccgtgatgatcttttcaacatcaatgctggtattgtcaagaacctctgctctgccatcgccaagtactgccctcatgcacttgttaacatgatcagcaaccctgtgaactctactgttccaattgcagctgagatcttcaagaaggctggtatgtacgatgagaagaagttgtttggtgtcaccactcttgacgttgttagggccaagactttctacgctggaaaggctaatgttcctgttgcagaagttaacgttcctgtcattggtggtcatgctggggttacaattctcccactcttctctcaggccactcctcaagccaacttgtcgagtgacgtactcaccgctctcaccaagcgtacccaagatggaggtaccgaagtcgtggaggcaaaggcaggaaaaggttcagctactttgtcaatggcctatgctggagcactattcgctgatgcatgcttgaaaggactcaacggagttccagatgttgtggaatgctcatacgtgcagtccaccatcactgagcttcctttctttgcctcaaaggtgaggttggggaagaacggtgtggaggaggttcttgatttggggccactctcagacttcgagaaagaagggttggaagcactgaagccagaactcaagtcttccatcgagaagggtgttaagtttgccaaccaatgagttaaatcgagttgagtcggttatttttccaattttccggttatattctcgccctacattgggttgcatcaataaaattcatgtgttgaggctttttgggctctttcccaaagcacagagataaaaactgtaacatgttagcatgtaaggtttctttcttttgtaacaatgatatttctgtcataatcatcagatcaaaagtctgcttgattccaaaaaaaaaaaaaa

SEQ ID NO: 70186 - protein, 343 aa, Brassica napus
MFRSVIVRSSSSAKQSLLRRSFSSSSSSVPERKVAILGAAGGIGQPLALLMKLNPLVSSLSLFDIANTPGVAADVGHINTRSEVVGYMGDDELAKALEGADLVIIPAGVPRKPGMTRDDLFNINAGIVKNLCSAIAKYCPHALVNMISNPVNSTVPIAAEIFKKAGMYDEKKLFGVTTLDVVRAKTFYAGKANVPVAEVNVPVIGGHAGVTILPLFSQATPQANLSSDVLTALTKRTQDGGTEVVEAKAGKGSATLSMAYAGALFADACLKGLNGVPDVVECSYVQSTITELPFFASKVRLGKNGVEEVLDLGPLSDFEKEGLEALKPELKSSIEKGVKFANQ

SEQ ID NO: 70187 - DNA, 1522 bp, Brassica napus
  CDS (89)..(1285)
ctctctctcactcactcaaaccctcgaaagcctgcgaagaaaactcttgaagcgtctctatctctctcgtcttgagctttcctcaaagatggcagcaacatcagcagcttcttcgatttcaattggatcaaacctttccagagccaccagctcctcctcaagggcacaagctgttaactttaactactctctccctcgtttcaccgctctgagatcatccactctcctctctggaccagaatcctcatctttcgccaagtctctccgcggttccgtaatgaaatcccaatcaaccgacacgaagccgtacggattgaacatcaacgcatcgtacaaagtggcggtcctcggtgctgccggagggatcggtcagcctctgtcacttctcatcaaaatgtctcctctcgtctccaccctccacctctacgatatcgccaacgtcaagggagtcgccgctgatttgagccactgcaacactccctctcaggttcgtgatttcaccggaccggctgagctggctgattgtttgaaagatgtcaacgtcgttgtcatccctgctggtgtgccgagaaagcccggtatgacccgtgacgatctcttcaacatcaacgccggtatagtgaagacgcttgttgaggctgtcgctgataactgtcctaacgcgttcatccacatcatcagcaaccctgttaactccaccgtccccattgctgctgaggtgttgaagaagaaaggtgtctatgatcccaagaagctctttggtgtcaccactttggatgttgtgagggctaacacctttgtttctcagaaaaagaacttgaagctcatcgatgtcgatgttcccgtcatcggtggccacgctggaatcaccattctgcctcttctatccaagaccaagccttctgtcagcttcactgacgaagagatcgagaaactcactctgaggattcagaacgctggaaccgaggttgtggatgctaaggcgggtgctggctcggctactttgtcgatggcctatgccgcagcgagatttgtggagtcgtctcttcgtgctcttgacggagatggagatgtttacgagtgctcgttcgtggactccactctcactgatcttcctttctttgcatcacggatcaagattgggaggaacggagttgaagctgtgattgagtctgacctccaagggctgactgagtacgagcagaaggcactagaagctcttaagccagaactgaaagctagcatcgaaaagggtgttgcattcgcaaacaaacctgctaactaagatctttgatctcatctgagagaaacatgcttctacattcgagaggataacagtttccttctgatcattttgagttttgttttgttttatttttgttgcatcggcgagacattttctggttgtagaataaagaatgtattagcttcttcggttctgaagatgttggatacacgacattgaatcagattttatgatgaatcacaccaaatatcatcttggttttaaaaaaaaaaaaaa

SEQ ID NO: 70188 - protein, 398 aa, Brassica napus
MAATSAASSISIGSNLSRATSSSSRAQAVNFNYSLPRFTALRSSTLLSGPESSSFAKSLRGSVMKSQSTDTKPYGLNINASYKVAVLGAAGGIGQPLSLLIKMSPLVSTLHLYDIANVKGVAADLSHCNTPSQVRDFTGPAELADCLKDVNVVVIPAGVPRKPGMTRDDLFNINAGIVKTLVEAVADNCPNAFIHIISNPVNSTVPIAAEVLKKKGVYDPKKLFGVTTLDVVRANTFVSQKKNLKLIDVDVPVIGGHAGITILPLLSKTKPSVSFTDEEIEKLTLRIQNAGTEVVDAKAGAGSATLSMAYAAARFVESSLRALDGDGDVYECSFVDSTLTDLPFFASRIKIGRNGVEAVIESDLQGLTEYEQKALEALKPELKASIEKGVAFANKPAN

SEQ ID NO: 70189 - DNA, 1459 bp, Brassica napus
  CDS (178)..(1239)
gaattcccgggtcgacttcgctgtcacgatttcgtgacgccacgcttcccaatacatataaccatttctgacgtcatcttctatctctaatcaatatataaacctgccgattcctcttcatcacattctcaaacttttaatcgaagcaaaataaaaaaaagaagaagaagcagagctatggatgcaaaccagcgtatcgctagaatctctgctcatctcaaccctcccaatctcgatcagattggttccgggtcgggtcttgaaggggtgggttgccgggcgaaaggcgggtctccaggattcaaagtggcgatactgggagcagcgggagggatagggcagcctctggcgatgttaatgaagatgaatccgttggtgtcgcttcttcatctctacgacgttgctaatgctcctggtgtcaccgctgatattagtcacatggacactagtgccatcgttcgtggatttctcggtcagtcgcaattagaggaagcacttacgggtatggatctagtgatcataccagctggtgttccgaggaagccagggatgaccagggatgatcttttcaaaatcaacgctggcatcgtgaggacactctctgaagctatagccaagtgctgtcccaaagcgattgtgaatatcatcagtaatcctgtgaactctaccgtgccaatcgcagctgaggttttcaagaaagctggcacttttgatccaaagaaactcatgggagtcaccatgcttgatgttgttagagctaatacttttgtggcggaagtaatgagtcttgatcctcgagaagttgatgttccagtcgttggaggacacgcaggagttacaatcttgcctctgctttctcaggtgaaacctccttgctctttcactcaaaatgagattgaatatctcacagaccgtatccaaaatggtggcactgaagttgtcgaggcaaaagctggtgcaggttctgcaacactatccatggcttacgcagcagtgaagtttgcagatgcttgcctcaagggtctacgtggcgatgcaaacatcgtcgagtgtgcatttgtggcatctcatgtgactgagcttcccttcttcgcatcaaaggtgcgtctaggaagatgtggggtcgatgaagtgtacggtctcggaccattgaatgaatacgagaggatgggactggagaaggcaaagaaagagcttgaagggagtattgcgaaaggtgttacctttgtgaagaagtaaagaccgttgacaaacacttagttttatctttcgaatagtgatttgtttggaataagaacaatgcctcgcaataaaagctcatgcgagtagtctgattttgaagattcaataaactgcagtcactctgttcttagatacaagaaggtttatgagtttatattcttatcttcttggtatgtttcttcaaatatgtgtttttcttacttaaaaaaaaaaaaaa

SEQ ID NO: 70190 - protein, 353 aa, Brassica napus
MDANQRIARISAHLNPPNLDQIGSGSGLEGVGCRAKGGSPGFKVAILGAAGGIGQPLAMLMKMNPLVSLLHLYDVANAPGVTADISHMDTSAIVRGFLGQSQLEEALTGMDLVIIPAGVPRKPGMTRDDLFKINAGIVRTLSEAIAKCCPKAIVNIISNPVNSTVPIAAEVFKKAGTFDPKKLMGVTMLDVVRANTFVAEVMSLDPREVDVPVVGGHAGVTILPLLSQVKPPCSFTQNEIEYLTDRIQNGGTEVVEAKAGAGSATLSMAYAAVKFADACLKGLRGDANIVECAFVASHVTELPFFASKVRLGRCGVDEVYGLGPLNEYERMGLEKAKKELEGSIAKGVTFVKK

SEQ ID NO: 70191 - DNA, 1297 bp, Glycine max
  CDS (56)..(1093)
cgttttttctcaaaaagttgcaagagttaaagcaaaaaccaaagtgagagagaaaatgatgaagccatcgatgctcagatctcttcactctgccgccacccgcggcgcctcccacctctcccgccgtggctacgcctccgagccggtgccggagcgcaaggtggccgttctaggtgccgccggcgggatcgggcaacccctctcccttctcatgaagctcaaccccctcgtttccagcctctccctctacgatatcgccggaactcccggtgtcgccgccgatgtcagccacatcaacaccggatctgaggtagtggggtaccaaggtgacgaagagctcggaaaagctttggagggtgcagatgttgttataattcctgctggtgtgcccagaaagcctggaatgactcgtgatgatctttttaacatcaatgctggcattgttaagacactgtgtactgctattgctaagtactgccctcatgcccttgttaacatgataagcaatcctgtgaactccactgttcctattgctgctgaagttttcaagaaggcaggaacgtatgatgagaagagattgtttggtgttaccacccttgatgttgttagggcaaaaactttctatgctgggaaagccaatgttccagttgctggtgttaatgtacctgttgtgggtggccatgcaggcattactattctgccattattttctcaagccacaccaaaagccaatcttgatgatgatgtcattaaggctcttacaaagaggacacaagatggaggaacagaagttgtagaagctaaggctggaaagggttctgcaactttgtcaatggcctatgctggtgccctatttgctgatgcttgccttaagggcctcaatggagtcccagatgttgtggagtgctcattcgtgcaatccactgttactgaacttccctactttgcttccaaggtgaggcttgggaagaatggagtggaggaagttctgggcttaggacctctctcagattttgagcaacaaggcctcgaaagccttaagcctgaactcaaatcatcaattgagaagggaatcaaatttgccaaccagtaattgaacatgttatcacatacgtgtctggtaggctaatgttaatgttattccttcaagaaccaaatcaaattttgcaatctcagaaccattgttgtattgttgccggcagtggtgtggcgactttgttgttttatttagagtaggtatacgccatgatttaataatttaagtctgagagctttttgttgcgaaaaaaaaaaaaaa

SEQ ID NO: 70192 - protein, 345 aa, Glycine max
MMKPSMLRSLHSAATRGASHLSRRGYASEPVPERKVAVLGAAGGIGQPLSLLMKLNPLVSSLSLYDIAGTPGVAADVSHINTGSEVVGYQGDEELGKALEGADVVIIPAGVPRKPGMTRDDLFNINAGIVKTLCTAIAKYCPHALVNMISNPVNSTVPIAAEVFKKAGTYDEKRLFGVTTLDVVRAKTFYAGKANVPVAGVNVPVVGGHAGITILPLFSQATPKANLDDDVIKALTKRTQDGGTEVVEAKAGKGSATLSMAYAGALFADACLKGLNGVPDVVECSFVQSTVTELPYFASKVRLGKNGVEEVLGLGPLSDFEQQGLESLKPELKSSIEKGIKFANQ

SEQ ID NO: 70193 - DNA, 1279 bp, Brassica napus
  CDS (43)..(1119)
aaaactgtttgccagcttcaaacaaagaaagagaacacaataatggagtttcgtggagatgccacccagagaattgctatgatatcagctcatcttcaaccttctttcacttctcagatggaggggaagaacactgtgatgggaagagaaaactgcagagggaaaggagggaaagcaggattcaaagtagcaatacttggagctgcaggtgggataggacaatcactatcgttgctaatgaagatgaaccctctcgtctctttacttcatctctacgatgttgtcaatgctcccggagtcactgctgacgtcagccatatggacactggagctgttgttagaggattcttgggagccaagcaacttgcggatgccctaacgggtatggatcttgtgatcataccagctggtgtgccgaggaaaccagggatgacacgcgatgatctcttcaaaatcaatgctgggattgttaagacgctatgtgagggagtagcgaaatgctgtcctaatgctatagtcaacttgattagtaaccctgtgaactccactgtggccattgccgctgaggttttcaagaaagctggaacttatgatcctaagaagctccttggagttactacactcgatgttgctcgtgccaacacatttgtggctgaagttcttggacttgatccaagagaagtcgatgtaccagtagttggaggacacgctggagttacaatattgccactattgtcacaggttaaaccacctagtagttttacaccttcagaaacagagtaccttacgaacaggattcaaaacggtgggactgaagtagtggaggcgaaagctggagctggatcagcaacactttcaatggcatatgctgcagccaagtttgcggatgcttgccttcgcgggttaagaggagatgcgaatgtcgttgagtgctcctttgttgcttcacaggtgaccgagttacctttctttgcaacgaaagtgcgtcttggacgtacaggagcagaggaagtgtttcagcttggacccttgaacgaatacgaaagggttggtctggagaaagcaaaagaggagttagcaggaagtattcagaaaggtgtcgacttcatcaggaaatgataactgagaataaatcatatgatcatgtactagtcactcatcatgcatgtgtccttgtgcttcttcttcttcaactttgtaaatttcctttcataagctgtgcaactcttgtggcctctctccttagacgttacatgtacttctataaaaaaaaaaaaaa

SEQ ID NO: 70194 - protein, 358 aa, Brassica napus
MEFRGDATQRIAMISAHLQPSFTSQMEGKNTVMGRENCRGKGGKAGFKVAILGAAGGIGQSLSLLMKMNPLVSLLHLYDVVNAPGVTADVSHMDTGAVVRGFLGAKQLADALTGMDLVIIPAGVPRKPGMTRDDLFKINAGIVKTLCEGVAKCCPNAIVNLISNPVNSTVAIAAEVFKKAGTYDPKKLLGVTTLDVARANTFVAEVLGLDPREVDVPVVGGHAGVTILPLLSQVKPPSSFTPSETEYLTNRIQNGGTEVVEAKAGAGSATLSMAYAAAKFADACLRGLRGDANVVECSFVASQVTELPFFATKVRLGRTGAEEVFQLGPLNEYERVGLEKAKEELAGSIQKGVDFIRK

SEQ ID NO: 70195 - DNA, 1744 bp, Triticum aestivum
  CDS (126)..(1310)
gaattcccgggtcgacgccgccaccgccgttccccttcttccccggcctccgggacatcctgctgctgcctccaccccgtcccagtctccggccactgggtctccttccttccttcgagttggacatggcatcatctgctaccatcagttcagttggcgctcaggctgctctggtttcaaagccaaggaatcatggcatcggtggcttaaaggcgtcctcatcaattaacttcgaattgggatcctcgttcctgggcaagaccgggtctcttcgggcatctgttaccacaagggttgtgcccaaggcgaagtctggggctcggatactaccggaggcatcttacaaagtggcggtacttggtgctgctgggggcatcggccaaccattgggcctgctgatcaagatgtctcctctggtctcggagctgcgactgtacgatattgcaaatgtcaagggagtcgctgctgatctcagccactgcaacacaccttctcaggtcatggacttcactggcccagcggaattagccagctgcttgaaaggtgtggatgttgttgtcatccccgccggggtccctagaaagcctgggatgactcgtgatgatcttttcaacatcaatgcgggcatcgtcaagtcacttatcgaggctgttgcagacaattgccctgatgcctttatccatattatcagcaacccagtcaactccacagtgccgattgctgctgagattctgaaacagaagggtgtctacaatcccaagaagctttttggggtttccaccctagatgttgtccgagctaacacattcgtagctcagaagaagggcctcaagctcattgatgttgatgtcccagttgttggtggtcatgctggaattacaatcctgcctttgttgtcaaagacgaggccatctgtcaccttcacggatgaggaaactgaacagctgacgaagaggatacagaacgctgggacagaggtggtggaggcgaaagcgggtgctggatctgctaccctgtccatggcttatgctgctgccagatttgttgagtcttcactccgtgcactggctggtgatccagatgtttatgagtgcacgtatgttcagtctgagttaactgagctgccattctttgcgtccagagttaagattggcaagaatggtgttgagtccatcatttctttggacctggagggaataactgagtacgaggccaatgcactcgaggcattgaagcctgagctgaaggccagcatcgagaagggcatcgagtttgcgcacaaacagcagggagccgccgcatctgtttgaagtgaggagaacggcgattccatacgaagagaaggcaaaatgattctccttgtcttctagttttgcagcctagagtattgacatgtagcagtatgccttggagcatctatatatttctcaattgttggtcagtttattacgattccagtttacatgagggcgtgaagccccaaacttgcaccctgttctggggccttgttttgtttgacacataaattttggtcctgttccacctgctgttcttgtagcttctggagttcaactgtggactaataaagaacatctttgatcattaccaaggcacgccatctagatctgcctctacttgtggtaacatattgtatggtgtcataagttatcaattgctgttgtaagatgagccagtgggatgaataataccttgtgcaagattttcgtacaaaaaaaaaaaaaaa

SEQ ID NO: 70196 - protein, 394 aa, Triticum aestivum
MASSATISSVGAQAALVSKPRNHGIGGLKASSSINFELGSSFLGKTGSLRASVTTRVVPKAKSGARILPEASYKVAVLGAAGGIGQPLGLLIKMSPLVSELRLYDIANVKGVAADLSHCNTPSQVMDFTGPAELASCLKGVDVVVIPAGVPRKPGMTRDDLFNINAGIVKSLIEAVADNCPDAFIHIISNPVNSTVPIAAEILKQKGVYNPKKLFGVSTLDVVRANTFVAQKKGLKLIDVDVPVVGGHAGITILPLLSKTRPSVTFTDEETEQLTKRIQNAGTEVVEAKAGAGSATLSMAYAAARFVESSLRALAGDPDVYECTYVQSELTELPFFASRVKIGKNGVESIISLDLEGITEYEANALEALKPELKASIEKGIEFAHKQQGAAASV

SEQ ID NO: 70197 - DNA, 1448 bp, Zea mays
  CDS (204)..(1388)
tttcgtatagcaccgaaggcgaggagggggggccaaggacgagcgccttttcgtgcccgctggccattgccgctgctcacgagcctcccgcctcttgctgccctgccctctgcggctctgccccaacgagccccaggagagccagccagccagttaaaggagccgtcaaaagcccccgccgaggagagcacgcaaggtcagacatggcgtcaaccgttaccttcagcccagttagcacccaagctgggttgatccataagccaaggaaccttggagccacaagctacgctggcttaaaggtgccgagctttggctctgagtcatcattcttgggtaggaacgcatcccttcgggcggctgttactacaaggattgtgcccaaggcaaagtctggatctcagatatcgccacaggcatcttacaaggtggcgctgctcggtgctgctggtggcatcggtcaacccttgggcctattgattaagatgtctcccctggtgtccgagctgcatctgtatgatattgctaatgtcaagggagtcgctgcagatctcagccactgcaacacgcccgctcaggtacttgacttcactgggccctcagagttagccagctgcttgaaaggcgtggatgttgttgtcatccctgccggggtcccaaggaagccgggcatgactcgtgatgacctttttaacatcaacgcgagcatcgtcaagtcacttgttgaggctgtcgcggacaattgccccgaggcgttcatccatatcatcagcaacccggtgaattccaccgtgccaatcgcagcagaggttttgaagcagaagggcgtctacaatcccaagaagctttttggggttaccaccctggatgttgtcagggctaacacatttgtggcgcagaagaagaaccttaatctcatcgatgttgatgtcccagttgttggtggccatgctgggatcacaattctgccgttgctatcaaagaccaggccgtccgtcaccttcacagatgaggaagctgaggagctgacaaagaggatacagaatgccgggacagaggtggtggaggcaaaggctggtgctgggtctgctaccctgtccatggcctacgctgctgccagattcgtcgagtcgtctctccgcgccctggccggcgaccccgatgtttacgagtgcacatttattcagtccgaggcaaccgatctgccattcttcgcatcaagagtcaagctcggcaagagtggtgtcgaatccatcgtttctgccgacctcgagggagtgaccgagtgcgaggccaaggcgcttgacgcgcttaaggccgagttgaagggaagcattgagaagggtgtcgccttcgccagcaaacagcaggaggctgctgcatctgtttgaagtgtccacaagagaataaagggacaatggtcttgaatggctttttaaaaaaaaaaaaaa

SEQ ID NO: 70198 - protein, 394 aa, Zea mays
MASTVTFSPVSTQAGLIHKPRNLGATSYAGLKVPSFGSESSFLGRNASLRAAVTTRIVPKAKSGSQISPQASYKVALLGAAGGIGQPLGLLIKMSPLVSELHLYDIANVKGVAADLSHCNTPAQVLDFTGPSELASCLKGVDVVVIPAGVPRKPGMTRDDLFNINASIVKSLVEAVADNCPEAFIHIISNPVNSTVPIAAEVLKQKGVYNPKKLFGVTTLDVVRANTFVAQKKNLNLIDVDVPVVGGHAGITILPLLSKTRPSVTFTDEEAEELTKRIQNAGTEVVEAKAGAGSATLSMAYAAARFVESSLRALAGDPDVYECTFIQSEATDLPFFASRVKLGKSGVESIVSADLEGVTECEAKALDALKAELKGSIEKGVAFASKQQEAAASV

SEQ ID NO: 70199 - DNA, 1358 bp, Glycine max
  CDS (68)..(1138)
cttcaacacactacttctcactctccctctctaatagtaatagtaatatacataagtaacataaccaatggaagcgcgtgcaggagccaatcagcgtattgcaagaatctctgctcatcttcagcctccaaatttccaggaagggagtgatgttcttcttaagagtgctgagtgcagagcaaagggtggggcacctggattcaaagttgcaattttgggggctgctgggggaattggtcaacccctttctttgctgatgaagatgaacccattggtttcagttcttcatctttatgatgttgtcaacacccctggtgtcactgctgatgttagccacatggacactggtgctgtggttcgtggctttctggggcagcaacaacttgagagtgcactcactggcatggacttggtaatcatacctgctggggtaccaaggaaacctgggatgacaagagatgatttatttaaaataaatgctggaattgtgaggaccctttgtgaaggaattgccaagagctgccccaatgcaattgtcaacttgattagtaatccagtgaattccacagttgctattgctgcagaggttttcaagaaagccggtacatatgatccaaagcgactactgggtgttacgacccttgatgttgtgagggcaaatacttttgtggcagaggtacttggagttgatccaagagaggttgatgttccagtggttggaggtcatgctggtgtcacaattttgcctcttttgtcacaggttaagcctcgcagtagcttcactgcagaagaaactgaatacctgacaaatcgcatccaaaatagtggaactgaagttgttgaggcaaaagctgggacaggttctgcaacactatcaatggcatatgcagctgccaagtttgctggtgcatgcctccgtggcttaaaaggagaagctggggtagtggagtgtgcttttgttgattctcaggttacggaacttcccttctttgcaaccaaggtacgtctaggtcgtgctggagcagaagaggtttatcaactgggtcccctgaatgagtatgaaaggattggattggaaaaggcaaagagagagttagcaggaagcatccagaagggtgtagagttcatcagaaaataaatgtgataaagaaaaactagtttttgtctcttatatataaggaccatgtgtaatgcttctctttgttcatagatttttttcttcttcttaagaatagtactctaaatttttggtgtcatccgtaattgctgatgataacggatttgacatcagtggaactgcttaataatctcagaaagatactaaaatatcagccttttgtactgaaaaaaaaaaaaaa

SEQ ID NO: 70200 - protein, 356 aa, Glycine max
MEARAGANQRIARISAHLQPPNFQEGSDVLLKSAECRAKGGAPGFKVAILGAAGGIGQPLSLLMKMNPLVSVLHLYDVVNTPGVTADVSHMDTGAVVRGFLGQQQLESALTGMDLVIIPAGVPRKPGMTRDDLFKINAGIVRTLCEGIAKSCPNAIVNLISNPVNSTVAIAAEVFKKAGTYDPKRLLGVTTLDVVRANTFVAEVLGVDPREVDVPVVGGHAGVTILPLLSQVKPRSSFTAEETEYLTNRIQNSGTEVVEAKAGTGSATLSMAYAAAKFAGACLRGLKGEAGVVECAFVDSQVTELPFFATKVRLGRAGAEEVYQLGPLNEYERIGLEKAKRELAGSIQKGVEFIRK

SEQ ID NO: 70201 - DNA, 1858 bp, Glycine max
  CDS (317)..(1546)
cagatctgtgtaaacgctattctcttccatttccatttctcaattgtctttctgtattccattatcgatgttgcaattttcattcaaaattacactctcattaactaattttagaacatgtatgcaagttgttttcagctctttctgtgttgtatgctatggcatcttaattggttcgattgaataatctgttaggtctaccctagcaaaacaaaccttatactttcttatttccttggtgctttttgtagctttcagataggtttctgtgtgttaatcgaatagacctgaattatttattgtatcacaggttgtgatggcagcagcaccagcagctaccttcgctattggaaccaccggttccctcggccaaagaggaagctcgcttcctcaatcaaagtcctttgggttgaaattcaactctctgaatcatttgaagagcttctgtggcctcaaggccatgtcatccgtgagatgtgagtcggaatcctccttcttcggtaacaaaaccggtgctgctctacgggcgtcttttgcatccaaagctcaaaaggaaaacaaccacaactcgcagcctcaggcttcgtacaaagttgcggttcttggtgctgctggagggataggtcagccgctctcgcttctcatcaagatgtcgcctttagtttccaacctgcatctctatgatattgcgaatgtcaagggagttgctgctgatatcagtcactgcaacacaccctcacaggtcagggatttcactggagcttctgagttgccgaattgtttgaaggatgtgaatgttgttgtcatacccgccggtgttccaaggaagcctggcatgactcgtgacgaccttttcaacatcaatgctggcattgtcagggacttggtttctgctgttgcggattactgccctgatgcttttgttcaaattatcagtaaccctgtgaactctaccgtgcctattgccgcagaagttttgaaacagaagggtgtgtatgatcctaagaagctctttggggttaccacactggatgttgtgcgggcaaacacgtttgttgctcagaggaagaacctgaagctgattgacgttgatgtcccagttgttggtggccatgccgggattaccattcttcctctgttgtcaaagacaagaccctcggcgagtttcactgatgaagaaattgatgagttgactgtcaggattcaaagcgctggaactgaagttgttgtagcaaaggcaggcacagggtctgctaccttgtcgatggcatatgctgctgctagatttgttgaatcgtctcttcgcgcacttgatggagatggggatgtgtatgagtgctcatttgtggaatcaaacttgactgaccttccattctttgcttcaagggtgaaacttggtaggacaggagttgaggctttaattccatctgacctccaagggttgactggctatgagcagaaggctttggaagcacttaagcctgaactcaaggccagcatagagaaggggattgcttttgctcagaagcaaactgttgctgcttaaatttccttgtcagcaggtggtttcttgggttatggatttatttgagcataaatactacttagaggacttaggttgcagatttgttgtagcatctttactgcttccagaacttaggattcagactttctatgtatcaattctacttccagttttgttagtagaacgggaggacgcttccatttctgttctctaaaccgagcttaggttttggtcagaaatcttcaaagatgtaagcattataatgtagaattgaaaaaaaatgtaaacgttgctttttgaataatatggccattagaccaaaaaaaaaaaaaa

SEQ ID NO: 70202 - protein, 409 aa, Glycine max
MAAAPAATFAIGTTGSLGQRGSSLPQSKSFGLKFNSLNHLKSFCGLKAMSSVRCESESSFFGNKTGAALRASFASKAQKENNHNSQPQASYKVAVLGAAGGIGQPLSLLIKMSPLVSNLHLYDIANVKGVAADISHCNTPSQVRDFTGASELPNCLKDVNVVVIPAGVPRKPGMTRDDLFNINAGIVRDLVSAVADYCPDAFVQIISNPVNSTVPIAAEVLKQKGVYDPKKLFGVTTLDVVRANTFVAQRKNLKLIDVDVPVVGGHAGITILPLLSKTRPSASFTDEEIDELTVRIQSAGTEVVVAKAGTGSATLSMAYAAARFVESSLRALDGDGDVYECSFVESNLTDLPFFASRVKLGRTGVEALIPSDLQGLTGYEQKALEALKPELKASIEKGIAFAQKQTVAA

SEQ ID NO: 70203 - DNA, 1545 bp, Triticum aestivum
  CDS (160)..(1236)
cgaacggacggaaagacaacttttgcatccggcccctccgctttaccccttttctcccgccctcgcaaccacctccgctgtcctccccggagtctcttcttctcttccctctcccgtcgcctcccgagtctccggcgaccacgcggaaccgacgcggccatggagcaaggcgccgactccgcggcggccaggcggatggccagggtcgcctcccacctccgcccgcccacctcgcaggaggaggaggtggccatcttgaagggctctaattgccgtgcaaaaggtgcagcaccagggttcaaggttgcagtcctgggtgcatctggtgggatcggccagcccctctcgctgcttatgaagatgaaccctcttgtttcggtgctccatttgtatgatgttgtcaacacacctggtgttacagctgacattagccatatgaacaccggtgctgtggtgcgtggcttcttgggtcagccacaattggaaagtgctcttactggaatggatcttgtcatcattcctgctggcattcctcggaaacctgggatgacaagggatgatttgttcaacatcaatgctggaattgttcggactctttgcgggggaattgcaaaatgctgcccaaatgcgattgtgaatgtgatcagtaaccctgtaaattccactgttccgattgctgctgaagtatttaaaaaagctggaacatatgatcctaagcgcctattgggggtgacaacacttgatgtagtgagagccaatacctttgtgggagaggttcttggacttgaccccagagatgtcaatgttcctgttgttggtgggcatgcaggagttacaatattaccactcctttcacaggtgaatcctccctgttcgtttacctcagaagaaattagttatctcacttcccgcatacagaatggtgggacagaagtagttgaggcgaaagcaggagcgggatccgcgactctttccatggcctacgcagcagccaggttcgcggacgcgtgcctgagagggctgcgcggcgacgccgggatagtggagtgctcctacatagcctctcaggtgacggagctggccttcttcgcgtccaaggtgcggctgggccgggccggcgtcgaggaggtcctgccgctcggcccgctgaacgagtttgagagggccgggctggagaaggccaagggcgagctcgccgagagcatccgcaagggcgtcgccttcgccaacaagtgagatgaaagatgggaagaaaatacagcacacagctcctccgtatctttcgccggatggaatgctccgaggcccagcatagaaatctgagacgcattttgcttcctgcctgtcagcaacggtccgcctgggagcaacggtcgccgtgtgatgtgacgtaaatctccctgtcatataacagtaataataatgatgataaattgtactgtatttataccggtatatacgatgcggacaacccgatgtttacggctgtactgtattatacactcgatgaataaaatacgacattagagtaaaaaaaaaaaaaaa

SEQ ID NO: 70204 - protein, 358 aa, Triticum aestivum
MEQGADSAAARRMARVASHLRPPTSQEEEVAILKGSNCRAKGAAPGFKVAVLGASGGIGQPLSLLMKMNPLVSVLHLYDVVNTPGVTADISHMNTGAVVRGFLGQPQLESALTGMDLVIIPAGIPRKPGMTRDDLFNINAGIVRTLCGGIAKCCPNAIVNVISNPVNSTVPIAAEVFKKAGTYDPKRLLGVTTLDVVRANTFVGEVLGLDPRDVNVPVVGGHAGVTILPLLSQVNPPCSFTSEEISYLTSRIQNGGTEVVEAKAGAGSATLSMAYAAARFADACLRGLRGDAGIVECSYIASQVTELAFFASKVRLGRAGVEEVLPLGPLNEFERAGLEKAKGELAESIRKGVAFANK

SEQ ID NO: 70205 - DNA, 1335 bp, Hordeum vulgare
  CDS (38)..(1114)
cgagtctccggcgaccacacacgccaccgcgacggccatggagcaaggcgccgactcaccggcggcgaggcggatggcgagggtcgcgtcccacctccgcccgcccacctcgcagatggaggaggtggccatcttgaagggctctaattgccgtgcgaaaggtgcggcgccagggttcaaggtcgctgtcctgggtgcatctggtgggattggccagccactctcgctgcttatgaagatgaaccctcttgtttcggtgctccatttatacgatgttgtcaacacacctggtgtcacagctgacattagccacatgaacactggtgctgtggtgcgtggctttttgggtcagccacaattggagagtgctcttactggaatggatcttgtgatcattcctgctggcattcctcggaaacctgggatgacaagggatgatttgttcaacatcaatgctgggatcgttcggactctttgcgagggaattgcaaaatgctgcccaaatgcgattgtgaacgtgatcagtaaccctgtaaattccacagttccgattgctgctgaagtatttaaaaaagctggaacatatgatcctaagcgcctattgggggtgacaactcttgatgtagtgagagccaatacctttgtgggagaggttcttggacttgatcccagagatgtcaatgttcctgttgttggcgggcatgcaggagttacgatattaccactcctttcacaggtgaatcctccctgttcgtttacctcagaagaaattagttatctcacttctcgcatacagaatggtgggacagaagtagttgaggcgaaagcgggggcaggatccgcaactctttccatggcctacgcagcagccaaattcgcggacgcctgcctgagagggctgcgcggcgacgccgggatagtcgagtgctcgtacatagcctctcaggtgacggagctgcccttcttcgcgtccaaggtgcggctgggccgggccggcgtcgaggaggtcctgccgctcggcccgctcaacgagtttgagagggccgggctggagaaggcccagggcgagctggccgagagcatccgcaagggcgtcgcgttcgccaacaagtgatgaagagaaggatctaaaaaaaaaaaagtgatgaagagaagtgtattcagctgcgtattcttggcccccccagcatagaaatctgagatgccttttgcttccgtctgctcctgcctgggagcaacggtcgccgtgtgatgtgatatccctgtatatcgtataataacaataacaataataatgaagtgtactgtattttatactgcaaaaaaaaaaaaaaa

SEQ ID NO: 70206 - protein, 358 aa, Hordeum vulgare
MEQGADSPAARRMARVASHLRPPTSQMEEVAILKGSNCRAKGAAPGFKVAVLGASGGIGQPLSLLMKMNPLVSVLHLYDVVNTPGVTADISHMNTGAVVRGFLGQPQLESALTGMDLVIIPAGIPRKPGMTRDDLFNINAGIVRTLCEGIAKCCPNAIVNVISNPVNSTVPIAAEVFKKAGTYDPKRLLGVTTLDVVRANTFVGEVLGLDPRDVNVPVVGGHAGVTILPLLSQVNPPCSFTSEEISYLTSRIQNGGTEVVEAKAGAGSATLSMAYAAAKFADACLRGLRGDAGIVECSYIASQVTELPFFASKVRLGRAGVEEVLPLGPLNEFERAGLEKAQGELAESIRKGVAFANK

SEQ ID NO: 70207 - DNA, 2229 bp, Triticum aestivum
  CDS (347)..(1876)
gccatgcccaacctcctcccaccattgccatgcccacccgcccgcacactttcccatttcagtcgcggctccgtggcagggccgtgcttcaaatgccggtctccgctcgcttcattattcgcctgagcatgcagtaattcctccgggtcggcaccgggttcctgaaatttcgctccacttctagaattatattggcccgacgccgcctcaaggttggatttttagagtcaaacatcggaatcttggccgacacggactgggtttctttgagcaaaatcgcttgcctgctacccacccgctgagctagagattggattcgcgggggcgtttcggtggggggccgagcatgacgatcgatttgtccaccatgcccgggagctcctcctcccgtctcctggacgccgccgcggcgaggaaggacatgaacttcttcaaaaaccgctacgtgcttgggctcaccggcgtcgccggaatcggcgggttcctctttggatacgacacaggtgttatatctggagcgcttctgtatattcgggacgaatttccagctgtcaaagacaatctattcttgcaggagacaattgttagcatggcattacttggagccatgcttggagcagctgggggcggttggataaatgatgcctacggtcgtaaaaagtccactcttcttgctgacctgatgttcgcacttggttcactggttatgtgtgctgctggcggtccttacattctgatacttggaaggctctttgttggattgggtgtgggaatagcatcagtcactgccccagtttacatcgctgaagctgctccttcagaaatcaggggaggtttggtgtcaactaatgtcctcatgattactggcggccaattcttctcctacttggtcaatcttggctttaccgaggttcctgggacatggcgctggatgctcggagtagctgctgtgccagcaatcatacagtttgtgctgatgctttttctgccagaatctccccgctggctttaccggaaggatgagaaagcaaaagctattgctgtcctggagcagatatatgactctggtcgtctggaggaagaggttgagctgcttgcgtcggcttccatgcatgaattccagtctaactgtactgggagctatttggacatattcaggttgaaggaattaaggctagctttttttgctggagctggtcttcaggcctttcagcaatttactggcatcaacaccgtcatgtactacagccccacgatcgtccagatggctgggttcacttccaacaggctggccctgctactttccctcatcgttgccgccatgaatgcgagtggaaccatcgtcggaatctacctcatcgaccgttgtggccgccgccgcctggcccttacaagcctagccggggtcgtgctctcccttgtcatcctcgccacggccttcatactgcagtcatcctccagcctctgcgggagcctgttcagcggctcctgccaaggcgtgctggggtggttcgcggtcggagggctcgctctgtacatcgccttcttctctccgggcatggggccggtgccatgggccgtgaactcggagatctaccccgaggcctaccgcggcatgtgcggcggcatgtcggccaccgtcaactggatctccaacctgatcgtggcgcagacgttcctctcgatcgtggggtgggtcggcaccggcccaacattcataatcatcgccgggatagccgtgatggccttgatcttcgtcgccctctacgtgccggagaccaagggcctgagcttcgaggaggtggacctcctgtggaaagagcgggcctggggaagccagggcagccacgagagcctcctgggtgctgcgccgtaagaggtaagaccaccacctgctggctctggtcctgcacggcggtgcatcggcggcgcccttttagtatggttctgcggctgcgccccgccgcgcctggctggctcgcggcggtcgctggcttctagctaggacgggagtcttagaaagaactggatggacaatatcatacacgaatcacgaacctgtatatcaatggcggtgtgttatgttgtcgtcgcgtgttcaagtcgaatattgttgagtcaaagcgaccgtatgactgagacgcagcaatattgtttctgcattgccggcatgagtgcaccaagaaccaaagagcaagagctccgttggcggtgaaaaaaaaaaaaaaa

SEQ ID NO: 70208 - protein, 509 aa, Triticum aestivum
MTIDLSTMPGSSSSRLLDAAAARKDMNFFKNRYVLGLTGVAGIGGFLFGYDTGVISGALLYIRDEFPAVKDNLFLQETIVSMALLGAMLGAAGGGWINDAYGRKKSTLLADLMFALGSLVMCAAGGPYILILGRLFVGLGVGIASVTAPVYIAEAAPSEIRGGLVSTNVLMITGGQFFSYLVNLGFTEVPGTWRWMLGVAAVPAIIQFVLMLFLPESPRWLYRKDEKAKAIAVLEQIYDSGRLEEEVELLASASMHEFQSNCTGSYLDIFRLKELRLAFFAGAGLQAFQQFTGINTVMYYSPTIVQMAGFTSNRLALLLSLIVAAMNASGTIVGIYLIDRCGRRRLALTSLAGVVLSLVILATAFILQSSSSLCGSLFSGSCQGVLGWFAVGGLALYIAFFSPGMGPVPWAVNSEIYPEAYRGMCGGMSATVNWISNLIVAQTFLSIVGWVGTGPTFIIIAGIAVMALIFVALYVPETKGLSFEEVDLLWKERAWGSQGSHESLLGAAP

SEQ ID NO: 70209 - DNA, 1748 bp, Brassica napus
  CDS (95)..(1729)
atcatctcaatctctccgcggagtctcccaagtttctctggtagcttcctactcgaagttcgctttggtttataaaagctaagattaaaaaaaaatgcaatcgtcaacgtacgcagctgttaaaggaaacgctgcgtttgcgtttcagagacgtagcttctctaacctcgtcagcagatcggcgactactaccggaattcgcttctccaccggctcttacttcgcacaactccactcttccgcctcgaaagccatgggagcgaagcttgctcgcgctgagaacgggattcacagtctctcctcggtcaaagctcgatcggttagagcacaagcctcctctggtggtggtgacgaagaagaagcaatacctctgagatctgaaggaaaaatctcagggacggttttacccttcgttggtgttgcttgtcttggtgctatcttgtttggttatcatctcggggttgttaacggtgctcttgagtaccttgctaaggatcttggtatcgctgataatgctgttttgcaagggtggattgttagcgcgttgcttgctggtgcaacggtcggttctttcaccggaggtgcattagctgacaaatttggaagaactagaacttttcaattggatgctatcccgcttgctattggagctttcttatgtgcaacagctcagagtgtgcagactatgattgtgggacgtctgctcgcaggggttggaatcggaatctcatcagccattgtaccactttacatctccgagatatcaccaactgaaattcgcggtgcactcggatctgtgaaccagttgttcatatgtattggaatactcgcagccttgatagctggattaccccttgcagcaaaccctctatggtggaggacgatgtttggtgttgcagttatcccttccgttctattagccataggaatggggttttctccagaaagcccaaggtggctcgttcagcaaggaaaacttactcaagcggaaaaggctatcaaaactctgtatggtaaagaaaaagtggttgaactagtgcgtgacttatcaaactctggccaaggtacttctgagccagaggcaggatggtttgatctattcagcagccgctactggaaagttgtaagcgttggtgcggcgctcttcttgtttcagcagttagctgggataaatgcagttgtgtactactctacatctgtgttccgcagcgccggaatccaatctgatgttgcagccagtgctcttgttggagcatcaaacgtgtttggaactgctgttgcttcgtctttgatggacaaaatgggaaggaaaagtcttctacttactagctttggtggaatggcgttgtctatgctgttgctctcgttgtccttcacatggaaggctcttgctgcatattctggcactcttgctgttgttggaactgttctatatgtcctgtcattttcgcttggtgctggcccagtaccggctcttttgcttccagagatattcgcatccaggatcagagcaaaagccgtcgctctttctctcggcatgcactggatctcaaactttgtgattggactctacttcttgagcgttgtgactaaattcggaatcagcagtgtctacttgggattcgcaggagtgtgtgtccttgcagtcatgtacattgcaggaaacgtggtggagactaaaggacggtcactcgaggaaatagagcttgctcttacatccggagcttaaaaccaaaaaaaaaaaaaaa

SEQ ID NO: 70210 - protein, 544 aa, Brassica napus
MQSSTYAAVKGNAAFAFQRRSFSNLVSRSATTTGIRFSTGSYFAQLHSSASKAMGAKLARAENGIHSLSSVKARSVRAQASSGGGDEEEAIPLRSEGKISGTVLPFVGVACLGAILFGYHLGVVNGALEYLAKDLGIADNAVLQGWIVSALLAGATVGSFTGGALADKFGRTRTFQLDAIPLAIGAFLCATAQSVQTMIVGRLLAGVGIGISSAIVPLYISEISPTEIRGALGSVNQLFICIGILAALIAGLPLAANPLWWRTMFGVAVIPSVLLAIGMGFSPESPRWLVQQGKLTQAEKAIKTLYGKEKVVELVRDLSNSGQGTSEPEAGWFDLFSSRYWKVVSVGAALFLFQQLAGINAVVYYSTSVFRSAGIQSDVAASALVGASNVFGTAVASSLMDKMGRKSLLLTSFGGMALSMLLLSLSFTWKALAAYSGTLAVVGTVLYVLSFSLGAGPVPALLLPEIFASRIRAKAVALSLGMHWISNFVIGLYFLSVVTKFGISSVYLGFAGVCVLAVMYIAGNVVETKGRSLEEIELALTSGA

SEQ ID NO: 70211 - DNA, 1949 bp, Glycine max
  CDS (141)..(1799)
gggagcatcacttttcaacatttacaaacagataactctcttttaatacttgataatctgatcctgctccatactacgatgattccacgcacatttaatacttgatattcatacactgtttctttgttccgctgcctcgcatggcatcaactactctcttcagcttcagactctctttgaacccactgcaccatcaacagacaacgaggccaaaatctctgctctcctctcctcgcaccaatccacgcctcgtttcttccattaacaatcatttggccctcacacgtgtcacatacccgcttctccaatctcactctgctcctaagcgcagattccatgtgtattctgatggggaaagctccgagtcgcttgtttctgacgctacataccaagaggaattttcttggtcttctgtaattcttccgtttctgttccctgcgttgggtggcttattatttggctatgatattggagccacctctggcgctacaatttcactgcagtcacctgagcttagcggtatatcatggtttaaactttctgctattcagcttggactagtggttagtggttccctatatggggctcttcttggctcgcttgttgcatttgccatagctgatttccttgggaggaagaaacaactcattactgcagcactgttgtatttgtttggtggtgtgattactgcctatgcaccagaacttggtgttctcttagcaggaaggctgctttatggacttggtataggtttggccatgcatggggctcctttatatattgcggagacttgtccatcacaaatccgtgggactttagtatcattaaaagaactcttcattgtcctggggattctgctgggttattttgtgggaagctttctgattgagaccgttgggggatggcggttcatgtatggatttagtgctccagttgctgtattaatggggcttggaatgttgactctccccaattctccacggtggttgcttctcagagcagtgcaaggaaaaggttcttttcaagatttgaaggaaaaggccattttttccctgagcaaattaaggggccgaccacctggtgacaaagaatccgagagacaagtagaagaaacccttgtctcattgaagtctgcctatgcagataaggaatcggaggggaatttcttagaggtgtttcagggtccgaatctgaaagctttcataattggtgggggactagtcttatttcaacagataacaggtcaaccaagtgttctgtactatgcaggtccaattcttcagagtgctggattttctgctgcatccgatgctacaaaagtttcggttgttattggcctattcaagttgctaatgacttggattgctgtcctaaaagttgatgatttggggagaagacctctgctgattggaggtgtcagtggcattgccctttctctagttctcctttctgcttattataaatttcttggaggtttcccacttgttgctgttggagctttacttctttatgttggttgctaccagatatcatttgggccgataagttggctaatggtatcagaggtcttcccacttcgcactagaggaaaggggattagtctggctgttcttaccaacttcgcttcaaatgctgttgtcacctttgcattctccccgctaaaggagtttctaggagcagaaaatctttttctcctttttggggctattgctattctatcacttttgttcattatcttttctgtcccagagacaaaaggcttgagtttagaagatatagaatccaaaatcttgaagtgacaacttaatccagcaccttttgatgtgaatgctgtatattttggttgagtctgtcaccttgtgtatatatctcctgtgtggaatttgattgtcatggttacgtttgcagtataaacattggaatttttaatctctaaaaaaaaaaaaaaa

SEQ ID NO: 70212 - protein, 552 aa, Glycine max
MASTTLFSFRLSLNPLHHQQTTRPKSLLSSPRTNPRLVSSINNHLALTRVTYPLLQSHSAPKRRFHVYSDGESSESLVSDATYQEEFSWSSVILPFLFPALGGLLFGYDIGATSGATISLQSPELSGISWFKLSAIQLGLVVSGSLYGALLGSLVAFAIADFLGRKKQLITAALLYLFGGVITAYAPELGVLLAGRLLYGLGIGLAMHGAPLYIAETCPSQIRGTLVSLKELFIVLGILLGYFVGSFLIETVGGWRFMYGFSAPVAVLMGLGMLTLPNSPRWLLLRAVQGKGSFQDLKEKAIFSLSKLRGRPPGDKESERQVEETLVSLKSAYADKESEGNFLEVFQGPNLKAFIIGGGLVLFQQITGQPSVLYYAGPILQSAGFSAASDATKVSVVIGLFKLLMTWIAVLKVDDLGRRPLLIGGVSGIALSLVLLSAYYKFLGGFPLVAVGALLLYVGCYQISFGPISWLMVSEVFPLRTRGKGISLAVLTNFASNAVVTFAFSPLKEFLGAENLFLLFGAIAILSLLFIIFSVPETKGLSLEDIESKILK

SEQ ID NO: 70213 - DNA, 2143 bp, Glycine max
  CDS (268)..(1719)
gcgttcctttcttccttccttctttttcccccctacaaacaaaaacaaagcaacattcccttttctatctgtttccttcgcgaaccagcaacaacccccggcgcacgatagcgccatcgctttcgttacgcggttggtaaccgtctctctttcatcaccgtttttatttccattcacaaaaccaacaacctctctgtgatttttcttcacttttctctctcggaacaaaacggaggatccgtcatagtattggtcaaatattggctaatgtgggtgggacattcatctatgtacaagcgcactccttcgagagataattcaaacatggaggacatggaagaaaactcagacatcggcctggacaagggaacatcaaatccttcattgatgctttctttaccgcatgtacttgtggcgaccatttcttcattcctttttggataccatctgggggttgttaatgaaccacttgagagcatttctgtggatcttggcttccgtggaaatacattggcagaaggtctggtggtgagcatatgccttggtggtgccttgattggatgtctactaagtggttggattgctgatggggtggggcgtcgtagggctttccagttgtgtgctctgccaatgataattggtgcttctatgagtgcagcaacaaacaacttgtttggcatgcttgtaggaaggttgtttgttgggactggcttgggcctgggccctcctgttgcctctctgtatgtgacagaggtttctcctgcttttgtgcggggcacctttggagctttcatccagattgcaacatgccttggtctaatgggagctttatttattggaatccctgtcaaagaaatttctggatggtggcgggtttgtttttgggtatctaccattccagctgctatacttgccgcagctatggtcttctgcgcagagagtccgcattggttatacaagcaaggaagaactgctgaagcagaagctgagtttgagagacttctgggtgtatcagaagcaaaatttgcaatgtcggagttatccaaggtagatagaagtgatgatactgatactgtaaagctgtcggaattgcttcatggtcgtcattctaaagttgtttttattggatcaaccctatttgctttacaacagctatctggtataaatgctgggttttatttctcttcaactgtttttaaaagtgctggagtcccatcagacattgcaaatgtctgcataggaatcgctaatttggcaggatctatcgtttcaatgggtttgatggataagcttggaaggaaggttctacttttctggagtttctttggcatggcaatagcaatgatccttcaagccacaggagcaacttcacttgtatcaaacgtgggagctcagtacttttctgttggtggcatgttactgtttgtcttaacatttgctctgggggctggtccagttccaggtctccttctaccagaaatctttcctagtcgaataagagccaaagccatggcagtctgtatgtcagtgcattgggtgataaatttctttgttggactactgttcttgcgtttgctggagaaacttggtccacagctgctttactccatgtttgctaccttttgcatcatggcagtaacttttgtaaaaagaaatgtggtggaaaccaaagggaagtcacttcatgaaattgagatcgcacttcttcctcaagactagatctctattcatttgattgctctaattttgcatagtttttcggctgagcagattgtgtttcgtctattttggttgaccttaacattacaaggggaagctcaggaactatgcattgttttgctgcaacattagtacgaagaggcttaggtattatggctagctgtgatgtagtaggtggtactattagcggcttacaacacgagaccctttctgttgttactcgcggcttgtgattctatgatttggcatccacgtaaagggagacataattcatcaggggggatctatgcatcccataatattccataaatgtactactttatgtaatattatatatgtttctgtacgtgacattatttttaatcgcttcaattttgtcccattttggatacgaagtagtctagcatgtaaaaaaaaaaaaaaa

SEQ ID NO: 70214 - protein, 483 aa, Glycine max
MWVGHSSMYKRTPSRDNSNMEDMEENSDIGLDKGTSNPSLMLSLPHVLVATISSFLFGYHLGVVNEPLESISVDLGFRGNTLAEGLVVSICLGGALIGCLLSGWIADGVGRRRAFQLCALPMIIGASMSAATNNLFGMLVGRLFVGTGLGLGPPVASLYVTEVSPAFVRGTFGAFIQIATCLGLMGALFIGIPVKEISGWWRVCFWVSTIPAAILAAAMVFCAESPHWLYKQGRTAEAEAEFERLLGVSEAKFAMSELSKVDRSDDTDTVKLSELLHGRHSKVVFIGSTLFALQQLSGINAGFYFSSTVFKSAGVPSDIANVCIGIANLAGSIVSMGLMDKLGRKVLLFWSFFGMAIAMILQATGATSLVSNVGAQYFSVGGMLLFVLTFALGAGPVPGLLLPEIFPSRIRAKAMAVCMSVHWVINFFVGLLFLRLLEKLGPQLLYSMFATFCIMAVTFVKRNVVETKGKSLHEIEIALLPQD

SEQ ID NO: 70215 - DNA, 2655 bp, Triticum aestivum
  CDS (102)..(2336)
ggggcctgccgcttcttgggcttctccatctcatctccttggttggttctctactagagaggcgcagctgcagggatccttggtggagaggagggaagaagatgtcgggtgctgcactggtcgcgattgcggcttccattggcaatctgctgcaggggtgggacaatgccaccatcgctggtgctgttctgtacatcaagaaggaattccagctcgaaaataatccgactgtggaggggctcatcgtggccatgtcgctcatcggtgcaaccatcatcaccacattctccgggccagtatcagactgggttggccggcgccctatgctcattctctcttcgcttctctacttcctcagcggcttaatcatgctatggtcacccaatgtctatgtgctgctcctggcacgccttgtcgatggctttggtatcggcttggctgtcacactggtgcctttgtacatctcagagacggctccttcggagatcaggggaaggctcaacacgcttccacagttcagtgggtcaggagggatgttcttgtcatactgcatggtgttcgggatgtcactcttgccatcacctgattggagaattatgctcggggttctctcagttccgtcgttgtttttcttcgtcttgacggtattttacctgccagaatctccgagatggcttgtcagcaagggccgaatggcagaggcaaagaaggtgctgcaaagattacggggaagggaggatgtctcaggagaaatggcccttcttgttgaaggtttggaggttggaggagacacctccattgaggagtacataataggaccagctaatgacccagctgatgatcatgttgttgatggcgataatgaccaaataacactatatgggcctgaagagggccaatcatggattgctcgaccttccaagggacccagcatgcttggaagtgtgctttctcttgcatctcgtcatggtagcatggtgaaccagagtgtgccccttatggatcctctagtcacgcttttcggaagtgttcatgagaacatgcctcaagttggaggaagcatgcggagcacattgtttcctaactttggcagcatgctcagtgtggcagatcagcacccaaaaactgagcactgggatgaggagaacgttcatagggacgatgaagaatatgcatctgatgctggaggcgactacgaagataatgtccatagcccgctgctgtcacgacagaccacaaacacggatgggaaggaccatggtcaccatggaagcactttgggcatgagaaggagaagtctcttggaagagggtggggaggcagtcagcagcactggtattggtggggggtggcaactcacatggaaatggtcggagcgacaaggcgaggatggcaagaaggaaggaggcttcaaaagaatctacttgcaccaagagggggtggccgactcaagaaggggctctgttgtttcacttcctggtgggggtgatgccacgcaagggggcagtgggtttatacacgcagctgctttggtaagccactcggctctttactccaaggatcttatggaagagcgtatggcggctggtccagccatgattcatccattggaggcagctcccaaaggttcaatctggaaagatctgtttgaacctggtgtgaggcgtgcattgttcgtcggcgttggaattcagatgcttcagcagtttgctggaataaatggagttctctactatactcctcaaattctggagcaagctggtgtggcggttcttctttccaatcttggcctcagttcagcatcagcatccatcttgatcagttctctcaccaccttactcatgctcccaagcattggtgtagccatgagacttatggatatatctggaagaaggtttctgctactaggcacaattcccatcttgatagcatccctaattgttttggttgtgtccaatgttatcaacttgagtacggtgccccacgctgtgctctccacagttagcgtcattgtctacttctgctgctttgtcatgggctttggcccgatccccaacattctatgtgcagagattttccccaccagagcccgtggtgtctgcatcgctatttgcgccctcacattctggatttgtgacattattgttacctacagcctgcctgtgatgctgaatgctattggtctagcaggtgtctttggtatatatgcagtcgtttgctgcatcgcctttgtgttcgtctacctaaaggtcccagagacaaagggcatgcccctcgaggtcatcaccgagttctttgcggttggggcgaagcaagcgcagaccaccattgcctgattcatcatggagctttgttttcagtttgcacactgcgctgaaaattgcaaattggacgggtcctcgtgaggaacggaaaaacttttgagttgtaaatgagatagctacccaaagagttcatcacgaggaacggaagctgtaaaagtaggaggatttcatgcccccatttcatcgtctattcttgcttattagtactgtactgtaatcgtcattagttgctgtagggatgttcaacttgctaatctgattctgaactactatgctgatgtccgaaataaagaaaaagcatgttttttttaaaaaaaaaaaaagcggccgc

SEQ ID NO: 70216 - protein, 744 aa, Triticum aestivum
MSGAALVAIAASIGNLLQGWDNATIAGAVLYIKKEFQLENNPTVEGLIVAMSLIGATIITTFSGPVSDWVGRRPMLILSSLLYFLSGLIMLWSPNVYVLLLARLVDGFGIGLAVTLVPLYISETAPSEIRGRLNTLPQFSGSGGMFLSYCMVFGMSLLPSPDWRIMLGVLSVPSLFFFVLTVFYLPESPRWLVSKGRMAEAKKVLQRLRGREDVSGEMALLVEGLEVGGDTSIEEYIIGPANDPADDHVVDGDNDQITLYGPEEGQSWIARPSKGPSMLGSVLSLASRHGSMVNQSVPLMDPLVTLFGSVHENMPQVGGSMRSTLFPNFGSMLSVADQHPKTEHWDEENVHRDDEEYASDAGGDYEDNVHSPLLSRQTTNTDGKDHGHHGSTLGMRRRSLLEEGGEAVSSTGIGGGWQLTWKWSERQGEDGKKEGGFKRIYLHQEGVADSRRGSVVSLPGGGDATQGGSGFIHAAALVSHSALYSKDLMEERMAAGPAMIHPLEAAPKGSIWKDLFEPGVRRALFVGVGIQMLQQFAGINGVLYYTPQILEQAGVAVLLSNLGLSSASASILISSLTTLLMLPSIGVAMRLMDISGRRFLLLGTIPILIASLIVLVVSNVINLSTVPHAVLSTVSVIVYFCCFVMGFGPIPNILCAEIFPTRARGVCIAICALTFWICDIIVTYSLPVMLNAIGLAGVFGIYAVVCCIAFVFVYLKVPETKGMPLEVITEFFAVGAKQAQTTIA

SEQ ID NO: 70217 - DNA, 1374 bp, Glycine max
  CDS (118)..(1200)
actttcactcgaagaaccttgaagcgagtctgggccacagcaaccagcgacaacaactcaatcagctagggttgctttgcttgctatcttgttggaggattttctgttcaagagaagatggtaactagaattgtggatcttcgttcagacacagttacaaagccaactgaagcaatgagagctgctatggcaagtgctgaagttgatgacgatgttctaggctatgatccaactgcttttcgcttagaaacagagatggcaaagacaatgggcaaagaagctgctctttttgttccatctggcactatggggaaccttgtatctgtacttgttcattgtgatgtcaggggaagtgaggttattcttggagacaattgccatatcaacatttttgagaatggaggcattgcaaccattgggggagtgcatccaagacaagtgaaaaataacgatgatggaaccatagacattgatttgattgaggctgctataagggacccaatgggggagctattctatccaaccaccaagcttatttgcttggaaaacactcatgcaaactctggtggcagatgcctctcagttgaatatacagacagagttggagagttagctaagaagcatggactgaagcttcacattgatggggcccgtatttttaacgcatcagttgcacttggtgttccagtggataggcttgtccaggcggctgattcagtttccgtttgcctatctaaaggtataggtgctccagttggatctgttattgttggttccaagaattttattgccaaggctagacgactccggaaaaccttaggaggtggaatgagacagattggcctcctttgtgccgctgcacttgttgccttgcaggaaaatgttgggaagctggaaagtgatcacaagaaagctagacttttggctgatggattaaaagaagttaaaggactgagagtggatgctggttctgtggagaccaatatggtatttattgacattgaagagggtacaaagactagggcagaaaagatatgcaagtacatggaagaacgtggtatccttgtgatgcaagagagttcatcaagaatgagagttgttctccaccaccaaatatcagcaagtgatgtgcaatatgcattgtcgtgctttcagcaagctctagctgtcaagggagtacaaaatgaaatgggcaactagtggaagaatttgaatatggcacgttgctgccatattagtcattaaaaaggaattccgtgttccatttgcctttgctcatttgattttcttaaatgtaccctaaagaacatgcaaagatttacatctttgatgttgttccctgttatgaattatgttgactaaaaaaaaaaaaaa

SEQ ID NO: 70218 - protein, 360 aa, Glycine max
MVTRIVDLRSDTVTKPTEAMRAAMASAEVDDDVLGYDPTAFRLETEMAKTMGKEAALFVPSGTMGNLVSVLVHCDVRGSEVILGDNCHINIFENGGIATIGGVHPRQVKNNDDGTIDIDLIEAAIRDPMGELFYPTTKLICLENTHANSGGRCLSVEYTDRVGELAKKHGLKLHIDGARIFNASVALGVPVDRLVQAADSVSVCLSKGIGAPVGSVIVGSKNFIAKARRLRKTLGGGMRQIGLLCAAALVALQENVGKLESDHKKARLLADGLKEVKGLRVDAGSVETNMVFIDIEEGTKTRAEKICKYMEERGILVMQESSSRMRVVLHHQISASDVQYALSCFQQALAVKGVQNEMGN

SEQ ID NO: 70219 - DNA, 1848 bp, Zea mays
  CDS (384)..(1637)
cccaccgccgcccctccctcgagttcccccgaacgccgcccctcaggttcccgggacgccgcccctcagttttcctggacgccgaccctccctcgaggttctccgtgtagatccgccacctctcccttgcacgaactcgcgcccctccgtcgaggtcccctggacgccgcgcccacccctagcgcctatcttgccaaacaccatcaaaactccagaggagttgccccaccagggagttttggagcagagcagctctaggtggagcagagctatgccaaacacgcttgtcccaaacaggacctgagacgaaccctttggcctcggctctcgtcttgtgagtgtgtaatctcggatcgggaaactcgactgcggggtcggagaagatggcggcggcgggagaagttgccggcgcttcgtcggggacgaggacgaagcggcttaagattgccgtcatccacccggatctcggaatcggtggtgctgagagattgattgtcgatgcggcttgtcagcttgctgcccacgatcatgatgttcatgtcttcacatcacatcatgataaaaaacgttgctttgaggagactctttctggtttgtttccggttactgtacatggggatttcctgcctcgccatgtgttctaccgctttcatgctgtttgtgcttatcttcgctgcatttttgttgcgctctgtgtgctactcagatggcccttctttgatgtcatattggtagaccaggtttctgttgtgattccactacttaaactaatggcatcatcgaagataatattttactgtcatttccctgatctgttacttgcacaacatactactatgcttcggaggttatatcgcaagccaattgacatgattgaggaaagcactactggtatggctgatttgattcttgtcaatagcaagttcactgcagcaacttttgcaaggaccttttctggtttacatgctagaggaatcgagcctggtgttctttatccagctgtctctgttgagcagtttcacgaaccccatgcttataagttgaatttcctatcaatcaaccggtttgagaggaaaaagaatcttgatcttgccatttcagcatttgctttgctccgttctgctgcttggactctacctggtgatgctctacaagaagcaacattaacagtggcaggtggctatgataagcgtctcaaggaaaatgttgaataccttgaggaactcaaaagactcgcattgacggaaggggtttctggacaggttaattttgttacatcttgctcaacatctgaaagaaacgagcttctctccaactgcctctgcgttttatacactccaaaggatgaacatttcggtattgtacctcttgaagccatggccgcccataagccggtaattgcctgcaatagtggtggcccagtggaaacagttgtgaatgaagtaacagggtttctgtgtgatccctctcccgcagaattctccaaagccatgctgaaacttgtgaatgatcatgatcttgctgtcagattgggtgaacaagcacgtgaccatgtggtgcaaaaattctcgaccaagacatttggtgatctcctcaacagctacgtcttgaacatctaccatgagaggatggaatgatctataatattgggtcagccatgccatatgaaaacaatttgttcaatacaaggttttttttgcacctttacgtctaatctgattttgatggacacacataatgacaatgacattccattgaatccctttggcatactgtagtcactctatgatctgtatattgttttcaattataacatcaaatttggcttggtccaaaaaaaaaaaaaaa

SEQ ID NO: 70220 - protein, 417 aa, Zea mays
MAAAGEVAGASSGTRTKRLKIAVIHPDLGIGGAERLIVDAACQLAAHDHDVHVFTSHHDKKRCFEETLSGLFPVTVHGDFLPRHVFYRFHAVCAYLRCIFVALCVLLRWPFFDVILVDQVSVVIPLLKLMASSKIIFYCHFPDLLLAQHTTMLRRLYRKPIDMIEESTTGMADLILVNSKFTAATFARTFSGLHARGIEPGVLYPAVSVEQFHEPHAYKLNFLSINRFERKKNLDLAISAFALLRSAAWTLPGDALQEATLTVAGGYDKRLKENVEYLEELKRLALTEGVSGQVNFVTSCSTSERNELLSNCLCVLYTPKDEHFGIVPLEAMAAHKPVIACNSGGPVETVVNEVTGFLCDPSPAEFSKAMLKLVNDHDLAVRLGEQARDHVVQKFSTKTFGDLLNSYVLNIYHERME

SEQ ID NO: 70221 - DNA, 1411 bp, Helianthus annuus
  CDS (58)..(1266)
ccaactcaactcaacaagcgtaaagtgtaaatcccctttcttctgtgtgcaagagcaatggagaagaaaaacgggtcgaagaagatgaacatcgccatcattcatcctgatctcggaatcggaggagccgaaaggttaatagttgatgcggcagttgaactagcatctcatggtcataatgttcacattttcacatctcaccatgatagaaatcgctgttttgaggagacacttgcaggttcatttgcagttacagtatacggatctttccttccaagacacatcttttaccgttttcatgcggtttgtgcatacatacgttgcatattcgttgctctatgtgtgttgttcaagtggccatcttttgatgttgtgcttgctgatcaagtctcagtcgtcattccaatattaaagcttaaaaattcttctaaggttgtattctattgtcatttccctgatttgttacttgcaaagcacacgactattgttaggagaatatatcgggcgcccataaactatttggaacaattaacaacagggatggtagatttaattctagttaacagcaaatttacagcatccacttttgctgcaacatttaagcgtcttgattctcaagggataaaaccagctgtgctgtaccctgcagtaaatgtggatcagttcagtcaaccgaatggttataggttgaattttctttcaatcaatcgttttgaaaagaaaaagaatattgacttggcaatatcagcatttgcaatgcttgggtctcctgacgtgacattgacgattgcaggtggatttgatcagcgattgagagaaaatgttgattacttggagcaattaaaagtcttggcagaaattaaaggtgtgtctaagcaagtcaaattcatcacatcttgtccaacttccgaaagaaacgctcttctgtctgagtgcttatgcgttatatatacaccaaaggatgaacattttggtatagttccacttgaggcaatggcggcccacaaacccgtgatagcatgcaatagtggtggcccggtggagagcgtgaaagatggagagacagggttcctgtgtgacccgtcaccacaaagcttctcattggccatggccaagttcttgaaggacccctcgttggcagaaaatatgggctcgaaagcccgagcccatgttgctacatcattctctaccaaaacttttggcatccagttgaatcaatatatcatggatgtagtggaacaacacaaacatacaaaagcagattaaagaaagataatgttaggaggtattgatcttccagttgacctttttcgtcccgttgtggcataactttaggagcttcttgacccatttgatttgtatgtttccatacatttgttcataagattactgttggaaaaaaaaaaaaaaa

SEQ ID NO: 70222 - protein, 402 aa, Helianthus annuus
MEKKNGSKKMNIAIIHPDLGIGGAERLIVDAAVELASHGHNVHIFTSHHDRNRCFEETLAGSFAVTVYGSFLPRHIFYRFHAVCAYIRCIFVALCVLFKWPSFDVVLADQVSVVIPILKLKNSSKVVFYCHFPDLLLAKHTTIVRRIYRAPINYLEQLTTGMVDLILVNSKFTASTFAATFKRLDSQGIKPAVLYPAVNVDQFSQPNGYRLNFLSINRFEKKKNIDLAISAFAMLGSPDVTLTIAGGFDQRLRENVDYLEQLKVLAEIKGVSKQVKFITSCPTSERNALLSECLCVIYTPKDEHFGIVPLEAMAAHKPVIACNSGGPVESVKDGETGFLCDPSPQSFSLAMAKFLKDPSLAENMGSKARAHVATSFSTKTFGIQLNQYIMDVVEQHKHTKAD

SEQ ID NO: 70223 - DNA, 1727 bp, Zea mays
  CDS (125)..(1573)
gaattcccgggtcgacttcgctgtcgacgatttcgtaggtggccggacggtggtggcatcgccaattcaactccgcatctgaatcggcactcggcagcgcgccagctccatagtgtaggaggagatggcgctcacaagaatcggtcttgctggccttgcggtcatggggcagaaccttgccctcaacattgcagagaaagggttccccatctctgtgtacaacaggacaacctccaaggtggacgagaccgtgcagcgtgccaaggcagaaggaaaccttcccgtctacggcttccatgaccccgcgtcctttgtgaagtccattcagaagccacgggtggtgatcatgctcgtcaaggccggcgcgccagttgaccagaccatcgcgacgctcgcagctcacttggagcagggcgactgcatcatcgatggggggaacgagtggtacgagaacacggagaggagggagaaggccatggaggagcgcggcctcctgtatcttggcatgggtgtctctggaggagaggagggtgcccgcaacggcccgtccttgatgcccggaggctcgttcgaggcttacaagtacgtcgaagacattgtcctcaaggtggctgctcaggtccctgacagtggcccgtgtgtcacgtacattggcaaaggtggatcgggcaactttgtcaagatggttcacaacggaatcgagtatggcgatatgcagctgatttccgaggcatacgacgttctcaagtcggtcggtaagctcaccaacagtgagctgcaccaggtgttctccgagtggaacaagggcgagctcctgagcttcttgatcgagatcacggccgacatctttggcatcaaggacgagcatggcgatggctacctggtggacaaggtccttgacaagaccgggatgaaagggacagggaagtggacggtgcagcaggccgccgagctgtcggtggccgctcctacgatcgaggcgtccttggactcgaggttcctgagcgggctgaaggacgagcgggtggaggcctccaagatcttccagggtgactactactccaccggctcgccggtggacaaggcgcagctggtggaggacgtgaggcaggccctgtacgcgtccaagatctgcagctacgcgcagggcatgaacatcatcaaggccaagagcgcggagaaaggctgggggctcaacctcggcgagctggccaggatctggaagggcgggtgcatcatccgcgccatcttcctggaccgcatcaagaaggcctacgacaggaacccgggcctcgccagcctgctcgtagaccccgagttcgcgcaggagatcatggacaggcaggcggcgtggcgcagggtggtgtgcctcgccatcaacaacggcgtcagcaccccgggaatgtccgctagcctggcctacttcgactcctaccgcagggacaggctgcctaccaacctggtgcaggcccagagggactacttcggggctcacacctacgagagggtcgacatgcctggctctttccacaccgagtggttcaagattgcgcgcaacatctccaacaactgatgagctgctcaacggatggcatgcccggtgttgactactccagtcggtaatgagatttcctgcaggaacttgtctattgatctttgtaagttaattatttatatgaataaaataagagcagacatgcttgtgtttgggcaaaaaaaaaaaaaaa

SEQ ID NO: 70224 - protein, 482 aa, Zea mays
MALTRIGLAGLAVMGQNLALNIAEKGFPISVYNRTTSKVDETVQRAKAEGNLPVYGFHDPASFVKSIQKPRVVIMLVKAGAPVDQTIATLAAHLEQGDCIIDGGNEWYENTERREKAMEERGLLYLGMGVSGGEEGARNGPSLMPGGSFEAYKYVEDIVLKVAAQVPDSGPCVTYIGKGGSGNFVKMVHNGIEYGDMQLISEAYDVLKSVGKLTNSELHQVFSEWNKGELLSFLIEITADIFGIKDEHGDGYLVDKVLDKTGMKGTGKWTVQQAAELSVAAPTIEASLDSRFLSGLKDERVEASKIFQGDYYSTGSPVDKAQLVEDVRQALYASKICSYAQGMNIIKAKSAEKGWGLNLGELARIWKGGCIIRAIFLDRIKKAYDRNPGLASLLVDPEFAQEIMDRQAAWRRVVCLAINNGVSTPGMSASLAYFDSYRRDRLPTNLVQAQRDYFGAHTYERVDMPGSFHTEWFKIARNISNN

SEQ ID NO: 70225 - DNA, 1924 bp, Glycine max
  CDS (216)..(1676)
gaattcccgggtcgactttcaattttctactgcgaacaataataataataataataataatttttcgttattgataatctttctcaccttttattgttatcattattatataatatatatatagcttctaccctcgctcgcatcttttcatccgtgctctgtgattccagaccttaatttttctctcattcgcttcaaatttcaggaaatcaattatggctcaaccctcaacaagaataggccttgctggactggctgttatgggccaaaatctagcactcaatattgctgagaaaggctttcccatttctgtttataaccgaaccacttccaaggttgatgagactgtagaacgagcaaaacaggaaggaaatcttccagtttatggctaccatgaccccgaagcttttgttcattccattcaaaagcctagggtgataataatgcttgttaaggctggggcacctgttgaccagaccattaagaccctatctgcatacatggaaaaaggtgactgcataattgatggtggtaacgaatggtacgagaacaccgaaagaagagagaaatcggtggctgaattgggtctgctctaccttgggatgggagtttctggtggtgaggaaggtgctcgtaatggtccctctttgatgcctggtggttcgtttgaggctttcaaatacatagaagatattcttctcaaggtggcagctcaagtccctgacagtggtccttgcgtgacttatattggtaaaggtggctctggtaattttgtgaaaatgatccacaatggcatcgaatatggtgacatgcagctgattgcagaggcctatgatgtgctgaagtcagttggaaagttgtcaaatgaggaactacaaagtgtcttctcagaatggaacaagggagaacttctgagtttcctgattgaaatcactgcagatatatttggaattaaggatgataagggagatggatatcttgttgacaaggtcctagacaagactggcatgaagggcactggtaagtggactgttcagcaagctgctgaattatcaattgctgctcccactattgaagcatcattggatgcaaggttcctgagtggtttgaaggaggaaagagttgaagctgcaaaggtctttaaatcaggtggcattggtgatatcgtgactgatcaacctgtagacaagaaaaaattggttgatgatgttaggaaggctctttatgcagccaaaatctgtagttatgcacagggaatgaatttgatccgtgcaaagagtattgaaaagggttgggatttgaagttgggtgaactggcccggatttggaaaggtggttgcatcattagagcaatattcttagacagaatcaagcaagcgtatgatagaaaccctaatctggcaaaccttcttgtggatccagagtttgcaaaggaaataatcgatcgccaatctgcctggaggagagttgtttgccttgctatcaattctggtatcagcactccaggtatgtctgctagtcttgcttattttgacacttacagaagggaaaggttgccagctaatttggtgcaagctcaacgagactactttggtgctcatacatatgaaagggttgacatagaggggtcttaccatactgagtggttcaagcttgccaaacagtctagaatttagattactgtatttgaaccaatcaggattttcctaataaatgtaatgttttctgctcagactgtatgctgagttgagtttacatagccacaacgtggtgaagttttatttatattatttccaactgaattgcttgatagtttgttttccaactatgttgtatctttgctgatcatgctttgtgcttgatacaaaattgtcccagctcatggtgcctttttaattttcacattttgaaaaaaaaaaaaaaa

SEQ ID NO: 70226 - protein, 486 aa, Glycine max
MAQPSTRIGLAGLAVMGQNLALNIAEKGFPISVYNRTTSKVDETVERAKQEGNLPVYGYHDPEAFVHSIQKPRVIIMLVKAGAPVDQTIKTLSAYMEKGDCIIDGGNEWYENTERREKSVAELGLLYLGMGVSGGEEGARNGPSLMPGGSFEAFKYIEDILLKVAAQVPDSGPCVTYIGKGGSGNFVKMIHNGIEYGDMQLIAEAYDVLKSVGKLSNEELQSVFSEWNKGELLSFLIEITADIFGIKDDKGDGYLVDKVLDKTGMKGTGKWTVQQAAELSIAAPTIEASLDARFLSGLKEERVEAAKVFKSGGIGDIVTDQPVDKKKLVDDVRKALYAAKICSYAQGMNLIRAKSIEKGWDLKLGELARIWKGGCIIRAIFLDRIKQAYDRNPNLANLLVDPEFAKEIIDRQSAWRRVVCLAINSGISTPGMSASLAYFDTYRRERLPANLVQAQRDYFGAHTYERVDIEGSYHTEWFKLAKQSRI

SEQ ID NO: 70227 - DNA, 1791 bp, Linum usitatissimum
  CDS (67)..(1524)
cgcgttcatccttccatctccgcacaacttctaattgtcatctcggtcgattcacaaggaaaagccatggctgcgaaaccaagaatcggacttgctggtttggctgttatgggtcagaacctcgctctcaacatcgcagagaaaggattccccatttccgtctacaatcggtctacctccaaggttgatgagactgtcgagagagcaaagagagagggtgatctcccagttcttggattccatgatcctgaatctttcgtccagtcgatccagaagcctcgtgtgataatcatgctagttaaggccggggctcccgtcgatgccaccatccagactctttctgcctacatggagaaaggtgactgcattatcgacggtgggaacgagtggtatgaaaacactgagaggaggcaaaaggcgatgctagagaagggtttactatatctcggaatgggagtttcgggtggcgaggaaggtgcacgaaacggtccctcgatgatgcctggaggatccctggaggtgtacaagtacattgaagacattcttctgaaagtggcagctcaagttcccgacagtggcccgtgtgtaacatacatcggagaaggtggatccggtaactttgttaagatggtccacaatggaatcgaatacggtgatatgcagctgattgccgaagcttatgatgtgctgaagtcggtgggaaagctttccaacgaggagttgcataacgtttttacggaatggaacaagggcgagctactgagcttcctaattgaaataactgctgatatttttggaattaaagatgataagggagagggatatttggttgataaggtcctggacaaaaccggtatgaagggtactggtaaatggacggtgcagcaagctgcagatctttctgtggcagctcccacaattgctgcttcgttggatgccaggtttcttagtggtctgaaggaggaaagggttcaagctgccgaggtgttcaagtctggtggtttctcggatattctcactgaccaagttgtggacaaggagacgttgattgatgatgtgaggaaagcactttatgcatccaagatttgcagttatgcacagggaatgaacctgattcgcgccaagagtatcgagaaaggatggggattggtgttgggagagttggctaggatttggaaaggaggctgcattatcagagcagtgttcctggacaggatcaagcaggcctatgaccgtaaccctgaactgtctaaccttctcgtggatcccgagtttgcaaaggaaatcatcgagcgccagtctgcatggcgcagggttgtgtctcttgcggtcaactccggtattagtactcccggtatgtcgtccagccttgcctatttcgacacctacaggagaggaaggttgcctgctaatcttgtgcaagctcaaagggattactttggtgctcatacttatgaaagaactgatatggaaggagctttccataccgagtggttcaagattgctcggcaatcaaagtactagacaatctcctggtttctttctaagcataataactcgggttcgagggatctgcgcccgaacttgagacctgcattgtggagcagattttatctttatggattgtagtttggcaggggttctaactgcttgcgtttgtactgttttttttacaatttctccttactatttggatgagatatttcattttccgtatggtatttgctcaaagtttgatgttggactgagttattcaaccatattgcttctctttcgaaaaaaaaaaaaaaa

SEQ ID NO: 70228 - protein, 485 aa, Linum usitatissimum
MAAKPRIGLAGLAVMGQNLALNIAEKGFPISVYNRSTSKVDETVERAKREGDLPVLGFHDPESFVQSIQKPRVIIMLVKAGAPVDATIQTLSAYMEKGDCIIDGGNEWYENTERRQKAMLEKGLLYLGMGVSGGEEGARNGPSMMPGGSLEVYKYIEDILLKVAAQVPDSGPCVTYIGEGGSGNFVKMVHNGIEYGDMQLIAEAYDVLKSVGKLSNEELHNVFTEWNKGELLSFLIEITADIFGIKDDKGEGYLVDKVLDKTGMKGTGKWTVQQAADLSVAAPTIAASLDARFLSGLKEERVQAAEVFKSGGFSDILTDQVVDKETLIDDVRKALYASKICSYAQGMNLIRAKSIEKGWGLVLGELARIWKGGCIIRAVFLDRIKQAYDRNPELSNLLVDPEFAKEIIERQSAWRRVVSLAVNSGISTPGMSSSLAYFDTYRRGRLPANLVQAQRDYFGAHTYERTDMEGAFHTEWFKIARQSKY

SEQ ID NO: 70229 - DNA, 1726 bp, Helianthus annuus
  CDS (63)..(1538)
ctgttttgccaatcggaattttccagatcttttcatcttcattgtttctcataagaatagacatggctgatcaatcgaagctaacaagagttgggcttgccggtcttgctgttatgggccaaaacctggccctgaacattgctgaaaaagggttcccaatctctgtctacaatcgcagtacatccaaagttgacgaaaccgttgagcgagctaaaaaggaaggcgatctcccagtttttggcttccatgatcccgaatctttcgttaactcaattcaaaaaccccgggtgattatcatgctcgtcaaagccggtgcacccgttgaccaaacaatcaaaactttatctcaatacatggagaaaggtgattgcatcattgatggtggtaatgagtggtatgaaaacaccgaaagaagagaaaaggccatggctgaattaggccttttgtatctcgggatgggtgtttctggtggtgaagaaggtgcgagaaacgggccatccatgatgcccggtgggtctattgaggcttacaagtacattgaggacattgttctcaaagtagccgctcaagtacccgacagtggcccatgtgtgacatatatcggtgaaggtggttcaggcaacttcgtcaagatggttcataacggaatcgagtacggtgacatgcaactaatttcagaagcttatgatgtattaaaatccgttggaaagctttccaatgaggaactacatgaagtcttctcagaatggaacaaaggagagcttcaaagctttttaatcgagatcaccgctgacattttcggcatcaaggatgataagggagatggttatctggttgacaaagtgttggataaaaccggcatgaaaggtaccggtaaatggaccgtccaacaagccgccgatctgtcaattgccgctcccacaatcgcagcatctttagactcacgttttcttagtggtttaaaagacgaacgtgtagaagctgcaaaggtattcaaatcaggcgggtttgacgatattctcgcagatcaacaggtggataaagaaaagttgatcaatgacgtaaggcaagctctatacgcagcgaaaatatgcagttacgcacaagggatgaacctgatacgcgccaagagcaatgaaaagggatggaacctgaaactcggtgagttggctagaatctggaaaggtgggtgcatcattcgagccatattcttggaccgtatcaagcaggcttatgacaggaaccctgaactggctaaccttttggtggaccccgagtttgctaaggaaatggtcgagcgtcaatctgcttggagaagagttgtgtgtttggctattaattcaggtattagcactccgggtatgtcttctagccttgcttatttcgatacttataggagggagaggctgcctgctaatttggttcaagctcaaagagattactttggtgctcatacttatgaaaggaccgatatgcccggttctttccacaccgaatggttcaaactcgccaaacaggcaaacaatagccgtctttaggtgatgtctgtcttgtccttttgagatcgaaagtataataaatgtcatatttgagatttgtattcttgtctaatatgttggatgagggtttttggtaatttgttttgttgttttgtgttcgagcagacgttacttcatttcgaattataataattttatcttgttactaaatcaaaaaaaaaaaaaaa

SEQ ID NO: 70230 - protein, 491 aa, Helianthus annuus
MADQSKLTRVGLAGLAVMGQNLALNIAEKGFPISVYNRSTSKVDETVERAKKEGDLPVFGFHDPESFVNSIQKPRVIIMLVKAGAPVDQTIKTLSQYMEKGDCIIDGGNEWYENTERREKAMAELGLLYLGMGVSGGEEGARNGPSMMPGGSIEAYKYIEDIVLKVAAQVPDSGPCVTYIGEGGSGNFVKMVHNGIEYGDMQLISEAYDVLKSVGKLSNEELHEVFSEWNKGELQSFLIEITADIFGIKDDKGDGYLVDKVLDKTGMKGTGKWTVQQAADLSIAAPTIAASLDSRFLSGLKDERVEAAKVFKSGGFDDILADQQVDKEKLINDVRQALYAAKICSYAQGMNLIRAKSNEKGWNLKLGELARIWKGGCIIRAIFLDRIKQAYDRNPELANLLVDPEFAKEMVERQSAWRRVVCLAINSGISTPGMSSSLAYFDTYRRERLPANLVQAQRDYFGAHTYERTDMPGSFHTEWFKLAKQANNSRL

SEQ ID NO: 70231 - DNA, 1127 bp, Glycine max
  CDS (199)..(879)
gtcgacgtttcgtaaaacgtgtcgttttgttcgttcagttctgttaccctaattgaggcacatgtttggcttgttcttgaacttgtggaggctgcaattgacttcttgttgcaattgatggcaagtactgaatgataattgttgctgaagagagttaaataaagaccaggaatttcactgccagaaacgttcaatattatggagattgaagccgacgcaagagatagttctcttgttctgctcaagcaaggagctgaagctagggtttttgagtcttcttttgtgggaaggaaatccgttgtcaaggaacgcttctcaaagaagtacaggcatccaactttggattcaaaattgaccctcaagcgcttaaatgcggaggcaaggtgcatgaccaaagcaaggcgacttggggtttgtactcctgtgctgtatgctgtggatcctgctttgcacacgttaacatttgaatatgttgagggcccttctgtcaaagatgtgtttcttgaattcaggtcacatgttgtcaataaagagtggctggatgatattgcatcccaaattggtgatgcaattggaaagctacatgatggtggtcttattcatggtgatttaacaacatcaaatatgttactgaagagtgatacaaagcagttggttcttatcgattttggtttgagcttcacttcaactctaccagaagataaggctgttgatttgtatgttctggaaagagctcttatttcaatgcattcgtcatgtgggaatgtgatggatcagatacttgctgcatacaggaagtcatcaaagcagtggtcatccacattgaacaaacttgcacaagtgcgacaaagaggacggaagaggaccatggttggatgaatctttatcaaatttcatttcattattgagatataaaagagatggcaactatggatgttatgtaatttatttttacattgtctctctattgcatatttgtagtctgcttttctaactgtttataaaaatgcaatgacttttgaactttttgttgacatttattcctactgagtgtgcaactaacaaatcaaaattgtttgaaagtattctcactgcttatgttgatatgtccgaaaaaaaaaaaaaaa

SEQ ID NO: 70232 - protein, 226 aa, Glycine max
MEIEADARDSSLVLLKQGAEARVFESSFVGRKSVVKERFSKKYRHPTLDSKLTLKRLNAEARCMTKARRLGVCTPVLYAVDPALHTLTFEYVEGPSVKDVFLEFRSHVVNKEWLDDIASQIGDAIGKLHDGGLIHGDLTTSNMLLKSDTKQLVLIDFGLSFTSTLPEDKAVDLYVLERALISMHSSCGNVMDQILAAYRKSSKQWSSTLNKLAQVRQRGRKRTMVG

SEQ ID NO: 70233 - DNA, 1936 bp, Hordeum vulgare
  CDS (65)..(1642)
ggtacgttcgtacggtgaagcaggcggaatccaccttcttctagaatcaacccgcccgcccgccatggcgagcttcgcgagggaggagcaccagttcctcgccgagctcggcctcgcgccgcgcaacccgggctccttcgcctgcggcgcctggggcggctcgggccccgtcgtcgccaccaccaaccccaccaacaacgaggtcattgccgaggtcgtcgaagcgtccgtggacgactacgagaagggcatgagcgcctgcttcgatgccgccaggacctggatggctgtcccggctccgaaacgaggagaaattgttaggcagattggtgatgccctgagagcaaagcttcatcacctcggcagacttctgtcacttgagatggggaaaattctccctgaaggaattggggaggttcaggaaattattgacatgtgtgattatgctgtggggctaagtcgtcagctaaatggatccatcataccatctgaacgcccaaaccatatgatgatggaggtctggaatcctcttggagttgttggtgtcatcacagcattcaatttcccttgcgccgtgctgggttggaatgcttgcattgctttggtctgcggcaactgtgttgtctggaagggtgctccaactactccattgatcactattgcaatgactaaaatagtggctagtgtatttgagaagaacaacttgccaagtgcaatcttcacagctttttgtgggggtgctgaaattggtcaagcaattgctcttgacacaaggatacctttggtttcattcacaggaagtacaaaggttggtcaaatggttcagcaacaggttagcgcgagatttggtaaatgccttcttgaacttagtgggaacaatgccattattgtcatggatgatgcagacattccactagctgtgcgttctgttttgtttgctgctgttggcacagcagggcaacgatgcactacatgtcgtaggctgcttcttcatgaaagcatatatcaaacatttcttgatcaacttgttgaggtttataaacaagtccgtattggggatcctatggaaaagggcaccttgctgggaccactgcacactactgcatcaaaagaaagctttttgaaaggcatccaaactatcagatcccagggaggaaaaatccttctaggaggatcttctattgaatcagaagggaactttgttcaaccaacaattgtggaaatttcacctgatgcgccagttgtgagggaagaattgtttggtcctgtcctttatgccatgaaatttcagaccctgaaggaagcaattgaaatcaacaattctgttcctcaaggattgagcagttctatatttacaaggaagccagatgctattttcaagtggattgggcctcatggtagtgattgtggtatagtgaatgtaaatatacccactaatggtgctgaaattggtggagcttttggtggagaaaaagcaaccggtggcggacgagaagcaggaagtgattcctggaagcaatacatgaggagggctacttgtacaatcaactacggaagcgagctgcctctagcacagggaataaattttggctagtttggtgctgaaggattgccagtgaatcgtgctgcaacttggggataaggtgttgagatatctgcagcgtgcagccatcatcttcaggaaattctctgtgtcgatcattgcacccaaattgcgacgtgctgctgagtacatataataagagatatgttgatctcatgtatgcattgttcatgccttttggcatgtttagccatctgtgccctagtgtattactaataaactggaaaaatagcttctcttccggtgagagcaacattgtccgcattttaccctgagatcggaccggtcgaaataaaaggagatcgtagccttcaggttaaaaaaaaaaaaaaa

SEQ ID NO: 70234 - protein, 509 aa, Hordeum vulgare
MASFAREEHQFLAELGLAPRNPGSFACGAWGGSGPVVATTNPTNNEVIAEVVEASVDDYEKGMSACFDAARTWMAVPAPKRGEIVRQIGDALRAKLHHLGRLLSLEMGKILPEGIGEVQEIIDMCDYAVGLSRQLNGSIIPSERPNHMMMEVWNPLGVVGVITAFNFPCAVLGWNACIALVCGNCVVWKGAPTTPLITIAMTKIVASVFEKNNLPSAIFTAFCGGAEIGQAIALDTRIPLVSFTGSTKVGQMVQQQVSARFGKCLLELSGNNAIIVMDDADIPLAVRSVLFAAVGTAGQRCTTCRRLLLHESIYQTFLDQLVEVYKQVRIGDPMEKGTLLGPLHTTASKESFLKGIQTIRSQGGKILLGGSSIESEGNFVQPTIVEISPDAPVVREELFGPVLYAMKFQTLKEAIEINNSVPQGLSSSIFTRKPDAIFKWIGPHGSDCGIVNVNIPTNGAEIGGAFGGEKATGGGREAGSDSWKQYMRRATCTINYGSELPLAQGINFG

SEQ ID NO: 70235 - DNA, 1902 bp, Glycine max
  CDS (86)..(1699)
ggcacatacactatagctgattcacttcatccagcgcaagtaaacaaaaaccactgcaatttttctattaggacgaccaccgcaaatggcagcattgaacctttgccgcatggcacttcgatcctcgaagcttctctctcgcccttatcatcgtctttctgttcagttgcagatgcagatgcagccctcttctcctccactcactcgaaagatgagcatggatgcacagagtgttgcttctcagcttaatagttctggattgttgaggactcagggccttattggagggaaatggagtgatgcttatgatggcaaaaccataaaggtttataatccagcaactggtgaatctattgtagatgttgcatgcatgggtggaagagagacaaatgatgcaatttctgcagcctatgatgcatatggatcatggagcaaaaccactgccgctgaacgaagcaaatttctgaggaaatggtatgatttgctaatggtacataaagaagaacttgcacagcttataaccttggagcaggggaaacctcttaaagagtctgttggtgagataaactatggggctggctttattgagtttgcagctgaggaggcaaaacgtatatatggggatataattcctgcacctctatctgatcggcgattatttgttctaaagcagcctgtaggggttgtaggtgcaattacaccttggaactttccccttgctatgattactcgaaaggttggtccagcccttgcatgtggctgtacagtggtcataaagccctctgaacttacgcctctcaccgctttagctgcagcggaactctccattcaagctggaataccaccgggtgtcgtgaatgtggtaatgggaaatgctcctgatattggggacgctttacttgcaagtccacaggtaaggaagatcacattcacaggctcgacggctgttgggaagaaattgatggctggttcagctgaaacagttaaaaaagtatctcttgaactcggcggcaatgcaccttgcatagtttttgatgatgctgacctggatgttgcagtaaaaggaactcttgcagcaaagttccgtaacagtggacaaacatgtgtttgtgcaaatagaattattgtgcaagaaggtatatatgagaagtttgcaaatgctttacgtgatactgttcagaatatgaaagttggggatggtttcagtgaaggtgtggcacagggtcctctaatcaatgaagctgctgtcaaaaaggttgagtccttaattcatgatgctacatcaaagggggcaaaagtaattcttgggggtaaaagacatagccttggatttactttttatgaacccacggtcatcagtgatgtcaacagtgatatgcgcatatcaagagaggaagcatttggacctgttgcaccccttttgagattcaaaactgaagaggatgctatcagaattgctaacgacactaatgcaggtttgggttcatacatatttacaaacagtatccaacgatcatggcgtgttgctgaggctctagaatatggacttgtgggtgttaatgaaggagtaatttcaactgaggtggctccattcggtggttttaaacagtccggcctcggaagagaaggctccaaatatgggatggatgaatatttagagatcaagtatgtttgcttgggaaacatgcacaaagcttgaacaaaggtatacatgaggcagtggctagctagagggaaaagtacttaccttcagtgagtttgttgaagaatatgcatatagctgcacacgtgttgtatacaaataagggcaggcttgcaaaggacctcctcatttttctgtttttctttttcttttcattttcattgctttctttttatggtcttttagaaaaaaaaaaaaaa

SEQ ID NO: 70236 - protein, 537 aa, Glycine max
MAALNLCRMALRSSKLLSRPYHRLSVQLQMQMQPSSPPLTRKMSMDAQSVASQLNSSGLLRTQGLIGGKWSDAYDGKTIKVYNPATGESIVDVACMGGRETNDAISAAYDAYGSWSKTTAAERSKFLRKWYDLLMVHKEELAQLITLEQGKPLKESVGEINYGAGFIEFAAEEAKRIYGDIIPAPLSDRRLFVLKQPVGVVGAITPWNFPLAMITRKVGPALACGCTVVIKPSELTPLTALAAAELSIQAGIPPGVVNVVMGNAPDIGDALLASPQVRKITFTGSTAVGKKLMAGSAETVKKVSLELGGNAPCIVFDDADLDVAVKGTLAAKFRNSGQTCVCANRIIVQEGIYEKFANALRDTVQNMKVGDGFSEGVAQGPLINEAAVKKVESLIHDATSKGAKVILGGKRHSLGFTFYEPTVISDVNSDMRISREEAFGPVAPLLRFKTEEDAIRIANDTNAGLGSYIFTNSIQRSWRVAEALEYGLVGVNEGVISTEVAPFGGFKQSGLGREGSKYGMDEYLEIKYVCLGNMHKA

SEQ ID NO: 70237 - DNA, 1786 bp, Glycine max
  CDS (9)..(1619)
acactatcatggcttcttcactcagaatctcaagacttatctctcgctccttttcttctacttctttcttttcacgaggtgggaatggtttccttggttcaagacaaagtaaattcagcacttctgctgccattgaggaagaacccattaaaccatcaatacaagtagaacacacccaactcttaattgatggaaaatttgtagatgctgcttctggtaaaacttttcaaactttagatcctaggacaggtgaagtgattgctcatgttgctgagggtcactctgaagatgttgatcgagcagtttcagctgcacgaaaagcatttgatcatggaccatggcctaagatgacagcttatgaacggcaaaggatcttgttgcgtgtggccgatctgatcgagaagcataatgatgagcttgcagcacttgagacttgggataatggaaagccttatgaacaagctgctaagattgaagttccaatgcttgttcgcctgattcgatactatgctggttgggcagataagattcatggtctaacagttccagctgatggaccttatcatgtgcaaacattgcacgaaccgattgatgttgccggtcagatcattccatggaacttccctcttctcatgtttgcctggaaggttggaccggcattggcctgtggcaacaccattgttctcaaaacagctgagcagacaccattatctgctttatatgcagcaaaactatttcatgaggctggacttcctgctggtgttttgaatgtagtttccggctttggtccaactgctggtgctgctcttgctagtcacatggaggttgataagcttgcttttaccggttccactgatactgggaaagttgtccttgaactggcggctaaaagcaatcttaagcctgttactttggagcttggtgggaaatctccctttatagtgtgtgaagacgctgatgtagatcaggctgttgagctcgcacactttgccttattctttaatcagggacaatgttgctgtgctgggtctcgaacatttgtacatgaaaatgtatacgaggagtttgttcagaaagcaaaggctcgtgctttgagacgtgttgttggtgatccattcaaggggggaatagagcaaggtcctcagattgattcagaccaatttgagaaaatactgaggtacatcagatccggtgttgaaagcggggcaacccttgaaacaggaggagacaagcttggcaacaagggcttctacattcaacctacagtcttctcaaatgttaaggatggcatgctgattgcaaaggatgagatctttggtccagtccaatccatattaaaattcaaggaccttggtgaggtagttcaaagagcgaacaacacacgttacgggcttgcggcaggagtgttcacaaagaacatggacactgcaaacactttgacgcgggcactgagagttggaacagtttggataaactgctttgacacatttgatgctgcaattccctttggagggtacaaaatgagtggtcaaggcagagaaaaaggagagtatagtctcaaaaactacttgcaagtgaaggctgtcgttaatcccttgaagaacccagcatggctttgagaaacactagtgccttccttggatgatcaactatcagtgcctcaatgataatgatgataaaaacaaaatccttttttttttttgttacacgagttgagttatgacattgtaaacataatagtaaagaatcttgtcaatgaaaaaaaaaaaaataaaaaaaaaaaaaa

SEQ ID NO: 70238 - protein, 536 aa, Glycine max
MASSLRISRLISRSFSSTSFFSRGGNGFLGSRQSKFSTSAAIEEEPIKPSIQVEHTQLLIDGKFVDAASGKTFQTLDPRTGEVIAHVAEGHSEDVDRAVSAARKAFDHGPWPKMTAYERQRILLRVADLIEKHNDELAALETWDNGKPYEQAAKIEVPMLVRLIRYYAGWADKIHGLTVPADGPYHVQTLHEPIDVAGQIIPWNFPLLMFAWKVGPALACGNTIVLKTAEQTPLSALYAAKLFHEAGLPAGVLNVVSGFGPTAGAALASHMEVDKLAFTGSTDTGKVVLELAAKSNLKPVTLELGGKSPFIVCEDADVDQAVELAHFALFFNQGQCCCAGSRTFVHENVYEEFVQKAKARALRRVVGDPFKGGIEQGPQIDSDQFEKILRYIRSGVESGATLETGGDKLGNKGFYIQPTVFSNVKDGMLIAKDEIFGPVQSILKFKDLGEVVQRANNTRYGLAAGVFTKNMDTANTLTRALRVGTVWINCFDTFDAAIPFGGYKMSGQGREKGEYSLKNYLQVKAVVNPLKNPAWL

SEQ ID NO: 70239 - DNA, 2180 bp, Zea mays
  CDS (77)..(1774)
cgcgaatcgccgcggacctcgccggaggcggcgacgagctcggatcccggcgatctagtcgccggaggcggtcccgatggctcggcggtcgtcttcctcgtcgtcggggacctggcggtacctgaacccggcgtactacctcaagcggcccaagcgcctggcgctcctcttcttcgtcttcgtcgcggccaccttcgccttctgggaccgccagtcgctcgtcagcgagtacgagtctgagatttcccgattagaagatgatataaatcggttgcatgaccagctaagaaaggctggagttaatctggatgaaaatccagtagtaagcaataagaattccagaaaagatcttgtagtagaaattgatcctgtcaataatgaaagacgggaaaaagttaaagaggcaatgctccatgcttggaattcttatgttaagtatgcctggggaatggacgagcttcagccacaatcgaagaatggtatcaacagctttggtggtcttggagcaacccttgttgactcacttgataccctatacataatgggcctgaaagatgaatttcagaaagctagagactgggtggcggagtcattagactttgacaaggattatgatgcgagtgtttttgaaacgaccataagggttgttggaggtctgcttagttcatacgatctatctggtgataaagtatttcttgataaggctaaagatattacagatcgactcttacctgcttgggatacaacatctggcatcccttataatagaataaacctagctcatggacgagcccataatcctggatggactaacggtgatagtatccttgcagattctggtacggagcaacttgaattcatagctctgtcacagaggactggagatcccaaataccagcagaaggcggagaacgtcattaaacagcttcaaaagatatatccaagtgatggtttactgcctatttacataaatcctcattctgggacagcatcatactcaactatcacatttggtgctatgggagacagcttctacgaatatttgctcaaggtctggatccaggggaataaaactgagcatgtaaaacactacagacaaatgtgggagacatcaatggaaggtctattaagtttaaccaagaaaactacaccatctaattactactacatttgtgaaaagaatggtggctcgttgtctgacaagatggatgaacttgcttgctttgctcctggtatgctggccttaggagcctctggttacgggccagaaaaatcagagcaaattatgaatcttgcaaaagagcttgctaggacctgctataatttctaccaaaccactcccacgaagttggctggagaaaattattttttccatactggacaggacatgggtgtggtcacgtcgtggaacatcttgagaccggagactgttgaatcactgatgtacctgtggcgcttgacggggaataaaacataccaagattgggggtgggacatattccaggcatttgagaagaactcccgcatagaatctggatatgtgggactgagagatgtgaacactggtgaaaaagacaacatgatgcagagtttcttcctggcagagacgctgaagtacctgtacctacttttctcccctccatcagtcatatccttcgacgagtgggttttcaatactgaagctcacccattgagaattgttccagtaagtgataacaaaggcattggaacaccggtccgacaattcgggagaaaacagggaaagcctgagtaaccttggatatagagcagtggatttttgaatctgccgtctgattctgacctccctgttgatgtgttctgacacgagggaactttctgcctgaagcagtaagggttagaaattacggcgatagattgtttagagcaaaaatcataggtagaggatgatgttatatgcggggcagtgacctccgtgaggtcaagagccccatagaagcttttatctttggatttgcttacgcaccctgaggtgcattgttgatgtgtagcatacatctaactcactgtccatatgttgttgctttcctgggggctctgcgagctgtattgtcattatgtaccccctagttattacttcttttcagatatgattcatataaatataaaacgtaaagtatctatgcaaaaaaaaaaaaaaa

SEQ ID NO: 70240 - protein, 565 aa, Zea mays
MARRSSSSSSGTWRYLNPAYYLKRPKRLALLFFVFVAATFAFWDRQSLVSEYESEISRLEDDINRLHDQLRKAGVNLDENPVVSNKNSRKDLVVEIDPVNNERREKVKEAMLHAWNSYVKYAWGMDELQPQSKNGINSFGGLGATLVDSLDTLYIMGLKDEFQKARDWVAESLDFDKDYDASVFETTIRVVGGLLSSYDLSGDKVFLDKAKDITDRLLPAWDTTSGIPYNRINLAHGRAHNPGWTNGDSILADSGTEQLEFIALSQRTGDPKYQQKAENVIKQLQKIYPSDGLLPIYINPHSGTASYSTITFGAMGDSFYEYLLKVWIQGNKTEHVKHYRQMWETSMEGLLSLTKKTTPSNYYYICEKNGGSLSDKMDELACFAPGMLALGASGYGPEKSEQIMNLAKELARTCYNFYQTTPTKLAGENYFFHTGQDMGVVTSWNILRPETVESLMYLWRLTGNKTYQDWGWDIFQAFEKNSRIESGYVGLRDVNTGEKDNMMQSFFLAETLKYLYLLFSPPSVISFDEWVFNTEAHPLRIVPVSDNKGIGTPVRQFGRKQGKPE

SEQ ID NO: 70241 - DNA, 2253 bp, Hordeum vulgare
  CDS (8)..(2023)
gcagccgatgcggctgcggagccaaggccggggttcccccctcctctgcctctccgccgccctcctcgcggtcgccctgctccccggcgccgccgtcgcagacggcgtcacgcctaccgaggcgctccggctacgcgacgaggtgaaagatatgttttatcatgcatttgatgggtacatgcaacatgcttttccacttgatgaactgcgaccgttgagttgtcaaggggaagactcccttggtggttatgcacttactcttatcgactctttggatactctggctttactaggtgataaggagagatttgctgctggtgtggagtgggttggtaagaacgtccgctttgatatcaacaaaactgtctcagttttcgagaccaatatacgtatccttggcggtctgttatcagctcacttgattgccagtgactatgccactggtatgaagattgagtcttatgatgatcagttacttcatttggccgctgacttagcccagaggttattacctgcatttgacactcctacaggtattccatttggatctgttaatttactgtatggagtcgatgatgatgaaagcaagataacatcgacggctggtggtggcactttgacattggagttcggtgtcttgagtcggttgactaataacactgtttttgagcaagttaccaaaaattcagtgcgtgggatatgggcacgcaggtcaaaactcaaccttgttggagcccatataaatgtcttcactggtgaatggacacaaaaggatgcaggaatcggcacaagcatcgactcattctacgaatatcttctgaaggcatatttattgttcggagatgaagaatacttgtatgtatttgaagaggcttacaaggctgccatgcactacctccaccatgatccttggtatattgaggtaaatatgaattctggtgctactgtttggccactattcaatagtctgcaggcattctggccaggacttcaggttttagctggagatgtcgatcctgccattcgaacacatgctgccttctttagcgtctggaaaaaatatgggttcactccagaagggtttaatctcgctacatctactgttcagaatggacaacggagctacccgctgcggcctgagttgattgaaagcacatattggctattcaaggctaccagagattttaggtaccttgatgttggaagggacatactagcaagccttcaatatgctgctaaatgtccttgtggctactgccacatatcagatgtggaaacccacaagcaggatgaccacatggagagttttttccttgcagaaacggtaaaatatctctggcttctttttgatttagctgtaggccctgataacattgttgaaaatgggccttataaatacatattcagcacagaaggccatttgttacctgctactcccgaaatatccttggtagatgagcattgcctttattttgaagcattctgtaataacagtacagaccgtggctacatcagcgctgatggttccagtaaacatccaagtgttaactgcacccattttgatgaaagacagactgtttccagtcaaaattcattgtccaatgttttgtctacaacaagaggttacatcaagggagtttgtccaggattgagtcatgcacagaaacttggcatatcgtaccatgacaacacggtagagcagaattccagaagtcatgagaaccccgatgaatcttacacggaccaatccagtgtccagattcaatcaagttctgtgatattgatctctcatccagccacaagcccacccgatgagcctttggaaaccgggtcaagaactcaataccttgaaaatattgtggtaactggcgactctgagccggtagaagttagtggctcgtcccaagggaacaccgaaaaccttgctgaggacaccaccttaggcatctctgaacagatagaagttactgctgctgaagaggttgggtctcaggacattcatattgaagatggtaccagctgaccaatggagtaggcaccaattttcccacctaacttggagcaccttatgaatcgacattcattgaccgattttgttgtagatctgaaagtaatattctttcgtagctgtcagatatatgtttaacgatatggttttgatcaaatagctgatgtaaagttatgtacaccagaagcaaaggaactacatggccgaaatgcaacatactacagtatcacaaaaaaaaaaaaaaa

SEQ ID NO: 70242 - protein, 671 aa, Hordeum vulgare
MRLRSQGRGSPLLCLSAALLAVALLPGAAVADGVTPTEALRLRDEVKDMFYHAFDGYMQHAFPLDELRPLSCQGEDSLGGYALTLIDSLDTLALLGDKERFAAGVEWVGKNVRFDINKTVSVFETNIRILGGLLSAHLIASDYATGMKIESYDDQLLHLAADLAQRLLPAFDTPTGIPFGSVNLLYGVDDDESKITSTAGGGTLTLEFGVLSRLTNNTVFEQVTKNSVRGIWARRSKLNLVGAHINVFTGEWTQKDAGIGTSIDSFYEYLLKAYLLFGDEEYLYVFEEAYKAAMHYLHHDPWYIEVNMNSGATVWPLFNSLQAFWPGLQVLAGDVDPAIRTHAAFFSVWKKYGFTPEGFNLATSTVQNGQRSYPLRPELIESTYWLFKATRDFRYLDVGRDILASLQYAAKCPCGYCHISDVETHKQDDHMESFFLAETVKYLWLLFDLAVGPDNIVENGPYKYIFSTEGHLLPATPEISLVDEHCLYFEAFCNNSTDRGYISADGSSKHPSVNCTHFDERQTVSSQNSLSNVLSTTRGYIKGVCPGLSHAQKLGISYHDNTVEQNSRSHENPDESYTDQSSVQIQSSSVILISHPATSPPDEPLETGSRTQYLENIVVTGDSEPVEVSGSSQGNTENLAEDTTLGISEQIEVTAAEEVGSQDIHIEDGTS

SEQ ID NO: 70243 - DNA, 1596 bp, Zea mays
  CDS (68)..(1297)
gaattcccgggtcgacgatttcgtagcagacacctccgccacctccaccctcgaatcgttccccaccatggcgtcgcagggatcctccgtcttcgccgcactcgagcaggccccggaggaccccatcctcggagtgaccgttgcctacaacaaggatcccagccccatgaaggtcaacctcggggttggcgcctaccggaccgaggaagggaagcccctagtgctgaacgtggtcaggcgcgccgagcaaatgttgatcaataatccgtcacgtgtcaaggagtacctaccaatcaccggtctggctgaattcaataagctgagcgctaagcttatctttggcgctgacagccctgctattcaggagaatagggttgctaccgtgcagtgcctatcgggtactggttctttaagagtcggaggtgaatttcttgcaaggcactatcacgagcgcactatctacatcccacaaccaacctggggaaatcacccaaaagtcttcaccctatctggcttgaacgttaggagctaccgctattatgatcctgcaacatgcagccttcacttcgaaggactcatggaagacctcggttctgctccttcaggttcaattgtactgctgcatgcctgtgcccacaaccctactggagtagatcctaccatcgaacagtgggaacagattaggcagctgatgagatcaaaatcactgcttccgttctttgacagtgcctatcaaggctttgcaagtggaagtcttgacaaagatgctcagtcagtgcgtatgtttgttgctgatggtggtgaactgctcatggctcagagctacgctaagaacatgggattgtatggagagcgtgttggcgctttgagcattgtatgtagaagtgccgatgtagctgttagggttgaaagtcaactcaaacttgtcatcaggcctatgtattcaaaccctcctcttcatggtgcctctattgttgctaccatactcagggacagcgagatgttcaacgaatggactctggaactgaaggccatggctgataggatcattaacatgaggcaacaactatttaatgcgctgaaatccagaggaacccctggtgattggagccatatcattaagcaaattgggatgtttactttcactgggctgaatagcgaacaagtggcattcatgaggcaggaataccacatttatatgacatctgatgggaggatcagcatggccggtttgagcatgaggactgtgccccatcttgcagatgccatacacgctgcagttactcaactgaaatgaggatagtatcgcagctttcgtgaataaaacctgaatcacccacaacaatgttctaagtactcagccagtggtatttactggttgacctactgtagtttgcgtcggaatagatttgtttttttactctgttcgtggggcagttttgtattggtggattcataatgactctgattatggtgcgttgggaacttctaataatatgcacatgaaattttgcttcaggtgcaaaaaaaaaaaaaaaaaaaaaaaaaaaaaaaaaaaaaaaaaaaaaataaaaaaaaaaaaaaaaaagcggccgc

SEQ ID NO: 70244 - protein, 409 aa, Zea mays
MASQGSSVFAALEQAPEDPILGVTVAYNKDPSPMKVNLGVGAYRTEEGKPLVLNVVRRAEQMLINNPSRVKEYLPITGLAEFNKLSAKLIFGADSPAIQENRVATVQCLSGTGSLRVGGEFLARHYHERTIYIPQPTWGNHPKVFTLSGLNVRSYRYYDPATCSLHFEGLMEDLGSAPSGSIVLLHACAHNPTGVDPTIEQWEQIRQLMRSKSLLPFFDSAYQGFASGSLDKDAQSVRMFVADGGELLMAQSYAKNMGLYGERVGALSIVCRSADVAVRVESQLKLVIRPMYSNPPLHGASIVATILRDSEMFNEWTLELKAMADRIINMRQQLFNALKSRGTPGDWSHIIKQIGMFTFTGLNSEQVAFMRQEYHIYMTSDGRISMAGLSMRTVPHLADAIHAAVTQLK

SEQ ID NO: 70245 - DNA, 1450 bp, Brassica napus
  CDS (31)..(1272)
gcaatccgtaactccgcttcacgggggacgatgatgagccgtcagatctcggggttgagatccatgtcttcgtggtggaagaacgtcgagcccgctcccaaagatcccatcctcggagtcaccgaggcctttctcgctgatcctagtcccgacaaagttaacgttggtgtgggagcatatcgagatgataatgggaagcctgttgtcttggaatgtgtccgtgaagctgagcgtaggatcgctggcacctccttcatggagtatcttccgatgggagggagtgtcaaaatggtggacgagacattgaagcttgcctatggggacaactctgagtttatcaaagacaaaaggattgctgcagttcagtctctctccggcactggagcttgccggctcttcgcagacttccagaaacgtttccgtcccgattcgcagatctacattcctgtaccaacctggtccaaccaccacaacatctggagagatgcacaagtcactcaaaagacgtaccattactaccatccagaaaccaagggcttggatttctcagggttgatggatgatgtgaagaatgctccgcaaggctccttcttccttctccacgcttgtgctcacaatcctactggagtagaccctacagaggagcaatggagagagatctcacagctattcaaggccaaaaaccatttcgcattcttcgacatggcctatcaaggctttgcaagcggtgaccctgcgagagacgccaagtccatcaggatctttctcgaggacggtcatcatattggaatctctcagtcttatgctaagaacatgggactctacggccagagggtcggatgtctcagcgtgctttgtgaagatgagaagcaagccgtgactgtgaaaagccagttgcagcaactagctagaccaatgtacagcaacccacctttgcatggagctcaaatagtctcaaccattctcggagacccagcgttaaaaggcctctggctaaaggaagttaaggtcatggctgatcggataattggcatgagaactgctttgagagaaagcttagagaagttaggatcgcctctatcatgggagcacgtaaccaagcagattggaatgttctgctacagtgggatgacaccagaacaggttgaccgtttaacaagcgaatatcacatctatatgacccgtaatggtcgtatcagtatggccggtgttacaacaggaaacgtgggataccttgcgaatgctatacatgaagtcaccaagtcatcttaaattgttttacatgtctcaagtcgagagataaatttgtttctttttgaaagagttaataagacagaggaagcttacaacatttgttcttcttcaattgttttggtggggactgaaagtcttacccacaaacagtaacttatcagcgcaataaaattttgaaccgcaaaaaaaaaaaaaa

SEQ ID NO: 70246 - protein, 413 aa, Brassica napus
MMSRQISGLRSMSSWWKNVEPAPKDPILGVTEAFLADPSPDKVNVGVGAYRDDNGKPVVLECVREAERRIAGTSFMEYLPMGGSVKMVDETLKLAYGDNSEFIKDKRIAAVQSLSGTGACRLFADFQKRFRPDSQIYIPVPTWSNHHNIWRDAQVTQKTYHYYHPETKGLDFSGLMDDVKNAPQGSFFLLHACAHNPTGVDPTEEQWREISQLFKAKNHFAFFDMAYQGFASGDPARDAKSIRIFLEDGHHIGISQSYAKNMGLYGQRVGCLSVLCEDEKQAVTVKSQLQQLARPMYSNPPLHGAQIVSTILGDPALKGLWLKEVKVMADRIIGMRTALRESLEKLGSPLSWEHVTKQIGMFCYSGMTPEQVDRLTSEYHIYMTRNGRISMAGVTTGNVGYLANAIHEVTKSS

SEQ ID NO: 70247 - DNA, 1535 bp, Brassica napus
  CDS (89)..(1306)
taactttgatactctcaaaaagcttcgtgaagaaaaaaaaagataaattctcttcatccagattcatctttttacgatacttgctctaatggagtccgtcttctcaaacgtcgttcgtgctcccgaagatcctattctcggtgtgacggttgcttacaataatgatccaagcccagctaagctcaatttgggtgtcggtgcctatcgaactgaggaagggaagccacttgttcttgacgtggtgcgaagggcggagcaacagcttgtgaacgatccgtcccgggtcaaggaatacattcctattgctggacttgctgattttaacaaacttagcgctaagctcatcttaggtgctgatagtcctgcaattcaagagagtagagttgctacaatccagtgcttgtctggtactgggtcattgagagttggggctgagtttctcaaaaaacactaccaccaaagtgtcattttcattccgaaaccaacttgggggaaccatcccaaagttttcaacctggctggcttgtctgtggagtactaccgttactatgatccctcgacccgtggacttgacttccaaggcttactcgaggatcttggtgctgcaccatctggagcgattgtcttacttcatgcatgtgctcacaatcccactggagttgacccaacctctgaacagtgggaacagattcggcaactaataagatctaaaagcttgttaccgttttttgatagtgcatatcagggttttgctagtggtagcctagacacagatgcacattcagtccgcacctttgttgctgatggcggtgaatgcttgatagctcaaagttatgccaaaaatatgggactctatggggagcgtgttggtgcccttagcattgtctgcaagtcatcagatgtggctagtaaggttgagagccaggtgaaacttgttgtgcgacccatgtactcgagcccacctattcatggagcatcaattgttgccaccattctgaaaagcagtgatatgtacaatgactggaccatcgagctgaaaggaatggctggccgcattattagcatgcgccaacacttatttgaagctctacaagctaaaggcacacctggtgattggagtcacattatcaaacagattgggatgttcacttttactggattgaacaaggagcaagttgccttcatgaccaaagagtttcacatttacatgacatctgacgggagaataagcatggcaggtctcagttcgaagacggtgcctcacctggttgaagctatacatgctgcagttacccgcgtcgcctaaactaaagcgagacgatatttttcttgtttcgtcgaataaaatgaaattttcaaaaacaaaaaaaaaaacatcttccttggtttatagactaaggatttttcccattggtatcatatgtttcctcatatctttttggccaaggatgtttgaaccaaacaaaccgagtattgcgacactgaaatcttcaatgttgaaggaaaatattggttattagcaaaaaaaaaaaaaa

SEQ ID NO: 70248 - protein, 405 aa, Brassica napus
MESVFSNVVRAPEDPILGVTVAYNNDPSPAKLNLGVGAYRTEEGKPLVLDVVRRAEQQLVNDPSRVKEYIPIAGLADFNKLSAKLILGADSPAIQESRVATIQCLSGTGSLRVGAEFLKKHYHQSVIFIPKPTWGNHPKVFNLAGLSVEYYRYYDPSTRGLDFQGLLEDLGAAPSGAIVLLHACAHNPTGVDPTSEQWEQIRQLIRSKSLLPFFDSAYQGFASGSLDTDAHSVRTFVADGGECLIAQSYAKNMGLYGERVGALSIVCKSSDVASKVESQVKLVVRPMYSSPPIHGASIVATILKSSDMYNDWTIELKGMAGRIISMRQHLFEALQAKGTPGDWSHIIKQIGMFTFTGLNKEQVAFMTKEFHIYMTSDGRISMAGLSSKTVPHLVEAIHAAVTRVA

SEQ ID NO: 70249 - DNA, 1435 bp, Brassica napus
  CDS (75)..(1325)
aatcatgcttaaataattgaggactctacaaccttttcttccaaattcactatcgattgattagtcattttgtgatgagttccatcttgtcaaacgtccttcctgctccggaagatccttttctcagtgcttttaatcttctttgtatggtcacaaaacaggttatttttgcctgtagggatgatccttgtccagttaagttgaatttgagtgcgggtgcctatcgaaccgaggagggaaagcctcttgttcttgaggtggtgagaaaagcagagcaacagttagcgaatgacctatcttgtgacaagggttatctctcaattgatggacttgctgattttaacaaattgagcgccaagctgatcttaggtgatgatagtcatgcagtggatgagaatagagttgttactatccagtgtttgtctggtactggttctttgagagtcggagctgagtttctagcaaaacaccaccaacaacgagtcgttttcgttccaaatccaacttgggggaaccatccctttattttcacattggcgggtttaagtgtagagtatttccgttactatgatccgcaaacccgaggactcgacttcgaaggcatgctcgaggatcttggtgctgcaccgcctggagctattgtggtattgcaatcttgtgcgcataaccccacaggaattgacccaacactggaacaatgggaaaagattcgacaaattgtgaggtctaaaggtttattacccttctttgataatgcatatcagggttttgctagtgggaaccttgactcagatgcacaatcggtgcgtatgtttgttgctgatggaggtgaatgtttgatagctcaaagttttgccaaaaacatgggtctttatggtgagcgtattggtgctcttaccattgtatgcacctcacaagatgtggctaggaaaattcacagtcaagtgttacttgttgttagacctatgtatcttagcccaccaattcatggagcatccattgttaccacaattcttaaaaacagtgatatgtacaaggactggactatcgagctgaaaggcatggctgaccgcatcataagcatgcgccaacagttatatgaagctatacaagctagaggtacacccggtgattggagtcacattatcaaacagattgggatgttttcttttacaggactgaatgagaagcaagttcgttggatggccaaagaatatcacatttatattacttatgatgggaggataagcattgcaagtctaagttcaaagacagtgcctcaactcgctgatgctatacatgctgcagttacccgccttgcctaatccaatgattctgttcttttgttgtttcataaataaattggttaaaaacagagttcctggttaacatttcattagcgaaaacaaagaagcgtacttaaaaaaaaaaaaaa

SEQ ID NO: 70250 - protein, 416 aa, Brassica napus
MSSILSNVLPAPEDPFLSAFNLLCMVTKQVIFACRDDPCPVKLNLSAGAYRTEEGKPLVLEVVRKAEQQLANDLSCDKGYLSIDGLADFNKLSAKLILGDDSHAVDENRVVTIQCLSGTGSLRVGAEFLAKHHQQRVVFVPNPTWGNHPFIFTLAGLSVEYFRYYDPQTRGLDFEGMLEDLGAAPPGAIVVLQSCAHNPTGIDPTLEQWEKIRQIVRSKGLLPFFDNAYQGFASGNLDSDAQSVRMFVADGGECLIAQSFAKNMGLYGERIGALTIVCTSQDVARKIHSQVLLVVRPMYLSPPIHGASIVTTILKNSDMYKDWTIELKGMADRIISMRQQLYEAIQARGTPGDWSHIIKQIGMFSFTGLNEKQVRWMAKEYHIYITYDGRISIASLSSKTVPQLADAIHAAVTRLA

SEQ ID NO: 70251 - DNA, 1633 bp, Glycine max
  CDS (49)..(1332)
cctctctgttcgcactctgtctttcccctgtttccgcgtcactgagtcatggcgattcgcaactcgctcaccggccaattcctccgccgcagctccgtcgccggagcaaggctcatgtcttcttcgtcctcatggttccggagcatcgagcccgctcccaaggatcctatcctcggagtcactgaagctttcctcgccgatcagagtccaaacaaagtcaacgtcggagtgggtgcgtatcgcgatgaccacggaaaacctgtggttttggaatgtgttagagaagcagagaggagggttgccggaagtcaattcatggagtatcttcccatgggtggaagcataaaaatgatagaagaatcgctgaagctggcatttggagacaactctgagttcatcaaggataaaagaatagctgcagtgcaggctttatctgggactggtgcatgtcgactttttgctgcatttcaacagagatttcatcctaatacccaaatctatataccagtgcctacctgggccaaccaccataacatttggagagatgctggagtgcctatgaagacattccgttactatcaccctgagtctagaggattggatttttcaggactgatggatgacataaagaatgctccagatggttccttctttctgcttcatgcttgtgctcataatcctactggagtagatccttcagaagaacaatggagagagatctcttcccagataaaggctaagggtcatttccctttctttgacatggcatatcaaggttttgctagtggtgatccagagagagatgcaaaagccataaagatttttcttgaggatggtcatttaataggacttgctcagtcatatgcaaaaaatatgggactgtatggccagcgagcaggaagcctgagtgtgctttgtgaagatgagaaacaagctgtggctgtaaaaagtcagttgcagctgattgctagacccatgtacagtaacccacctctccatggagcacttatagtttctactgtccttggtgatccagatttgaagaagttatggcttaaagaagtcaaggttatggcagaccgcatcatcggaatgaggactacactacgagaaaacttagaaaagaaggggtctactttgccatggcagcatataactaatcagattggtatgttctgctacagtggattgacacctgaacaggttgatcgtatgacaaacgagtttcatatttacatgacccgtaacggtcgtatcagtatggctggtcttaatacgggcaacgttggatatgttgctgacgctatccatgaggttacaaaatcattctagattattcaatcacccaacaggtgaccaaatttttgtctttggagacaaacatctcagaagtagtacccttatccaggggagcaaaataaatttaataaagtctgacaaattttcaacttgtttcggggtaagatagtgatactcttcagggtttaccttgcatattgaagacccttattgcaatacgtatccgatttatcatatccatgcaccatagattatatccatttttacagacatcttgtttagcactttaatgagcataaccctgtatcatcattttttttaaaaaaaaaaaaaa

SEQ ID NO: 70252 - protein, 427 aa, Glycine max
MAIRNSLTGQFLRRSSVAGARLMSSSSSWFRSIEPAPKDPILGVTEAFLADQSPNKVNVGVGAYRDDHGKPVVLECVREAERRVAGSQFMEYLPMGGSIKMIEESLKLAFGDNSEFIKDKRIAAVQALSGTGACRLFAAFQQRFHPNTQIYIPVPTWANHHNIWRDAGVPMKTFRYYHPESRGLDFSGLMDDIKNAPDGSFFLLHACAHNPTGVDPSEEQWREISSQIKAKGHFPFFDMAYQGFASGDPERDAKAIKIFLEDGHLIGLAQSYAKNMGLYGQRAGSLSVLCEDEKQAVAVKSQLQLIARPMYSNPPLHGALIVSTVLGDPDLKKLWLKEVKVMADRIIGMRTTLRENLEKKGSTLPWQHITNQIGMFCYSGLTPEQVDRMTNEFHIYMTRNGRISMAGLNTGNVGYVADAIHEVTKSF

SEQ ID NO: 70253 - DNA, 1692 bp, Brassica napus
  CDS (138)..(1499)
gaattcccgggtcgacgtaagccacttgaagagggagcatcacccaaggaagaacctctttcacgctaacacaatctcgatctgatcgttttcgaaaccgcgcggttccaacgaagctcagcttaccgattgattccatggcttcatcaatgctgtctctcggttctacttctctgctacctcgcgtgattaacaaggataagctaaagcttggaacttccggttccaaccccttcctgaaagcaaagtcttttagcagggtgaccatgtcggttacagtcaagccttctcgctttgagggtatcactatggctccaccagaccctattcttggagtcagcgaagctttcaaagctgacactaacgagcttaagctcaatctcggtgttggtgcttatcgaactgaggaactccagccttatgtccttaatgttgttaaaaaggcggagaacctgatgttggagagaggagataacaaagagtatctcccaatcgaagggttggctgcattcaacaaggccactgctgagctgctgtttggagctggtcatcctgttattaaggaacaaaaggtggcaacaattcaaggtctttccggaacaggttcactgagactagcagcggctcttatcgagcgttattttcctggagctaaagtgcttatatctgcaccaacatggggtaaccacaagaacatcttcaacgacgccaaagttccctggtctgaataccgctactatgatcccaaaacaattggtttggactttgaagggatgatagcagatataaaggaagctccagaaggatcattcatactgctacacggatgtgctcacaacccaactggaatcgacccaacacctgaacagtgggtgaaaattgctgacgtcattcaagaaaagaaccacatcccatttttcgatgttgcataccagggctttgctagtggaagccttgacgaagacgcagcttccgtgagactatttgctgagcgtgggatggagtttttcgtcgctcagtcgtatagtaaaaacttgggtctttatgctgaaaggattggagctatcaacgtcgtctgctcatcagctgatgctgctacaagggtgaagagccagttgaaaaggatagctaggcctatgtactcgaacccaccggttcacggtgcgaggatcgtggctaatgtagtgggagatgcagctatgttcaacgagtggaaagcagagatggaaatgatggcggggaggattaagacggtgagacagcagctgtacgacagcctcgtttcgaaggataagagcggcaaagactggtcgtttattctgaagcagattggcatgttctcattcaccggtctcaacaaagctcagagtgataacatgacggacaagtggcatgtgtacatgactaaagacgggaggatatcgttggctggactgtctatggcgaaatgcgagtaccttgctgatgccatcatcgactcgtaccataacgtaagctgagttttggttttcgagaagattacaatgagaactgaagttttatttataccctttttagcttctccttcatctcatttgaaagaattgctaaaatgaataagctaagctcagctcaggctgttatatctatgacatttagtcaaggaaactttttttaatttgattgtgtttcacaggctaaaaaaaaaaaaaa

SEQ ID NO: 70254 - protein, 453 aa, Brassica napus
MASSMLSLGSTSLLPRVINKDKLKLGTSGSNPFLKAKSFSRVTMSVTVKPSRFEGITMAPPDPILGVSEAFKADTNELKLNLGVGAYRTEELQPYVLNVVKKAENLMLERGDNKEYLPIEGLAAFNKATAELLFGAGHPVIKEQKVATIQGLSGTGSLRLAAALIERYFPGAKVLISAPTWGNHKNIFNDAKVPWSEYRYYDPKTIGLDFEGMIADIKEAPEGSFILLHGCAHNPTGIDPTPEQWVKIADVIQEKNHIPFFDVAYQGFASGSLDEDAASVRLFAERGMEFFVAQSYSKNLGLYAERIGAINVVCSSADAATRVKSQLKRIARPMYSNPPVHGARIVANVVGDAAMFNEWKAEMEMMAGRIKTVRQQLYDSLVSKDKSGKDWSFILKQIGMFSFTGLNKAQSDNMTDKWHVYMTKDGRISLAGLSMAKCEYLADAIIDSYHNVS

SEQ ID NO: 70255 - DNA, 1601 bp, Triticum aestivum
  CDS (132)..(1412)
cagaacaacatagcggcacgcaacacgccagccgcagcaaagcaccggtgccgcgccgcttcctcaggacccaagtcacctgccatctcctccccagcagcggcaaactcgccaccgcacgcagcgacggcatggcgatgtctcgcgccgcggcagcggtcgggcggcgccggtgcgggccgcgcctgcccgcggcgaggtccatggcgtcgtggttcggccacgtggagccggccgccaaggaccccatcctcggcgtcaccgaggccttcctcgccgacccctcgccggacaaagtgaacgtcggcgtcggtgcgtaccgggacgacgacgggaagcccgtggtgctcgagtgcgtgcgcgaggcggagcggcgcatcgccgggagcaccaacatggagtaccttccaatgggaggaagcgtgaagatgatcgaggagtcgctgaagctggcatacggggaggattctgagttcatcaaggacaagaggattgcggcagtgcaggctctttcagggactggtgcatgtcgcctctttgcagatttccagaaacgcttcttgccggattcacagatctacatacctacgcctacatggtcaaaccatcacaacatttggagggatgcccaggtaccacaaagaacatttgcctactaccacccggaatcaagaggactggactttgcaggcctaatggatgatatcaagaacgctccagagggttccttctttttgcttcatgcatgtgctcacaatcccactggggtcgatccttctgaggaacagtggagagagatatctcaacaattcaaggtgaagaaccatttcccatttttcgacatggcataccaaggatttgccagtggtgacccagagagagatgccaaggcaattcggatctttctcgaagatggacatcaaattggatgtgcacagtcatatgcaaaaaacatgggactttatggccaaagagcaggatgccttagtattctctgcgacgatgaaatacaagcagttgatgtgaagagccagttacaacagattgccagacctatgtacagcaacccaccccttcacggcgcactaattgtttccactatccttggtgatccagcactgaaaagcttatggctgaaagaggtcaagggtatggctgatcgcattattggaatgcgaaaagcacttaaggagagccttgaaaagttgggttcaccattatcatgggaacatattactaatcagattggcatgttttgctacagcgggatgacacctgaacaagttgatcgcttaacaaatgaatttcacatatacatgactcgtaatggcaggataagcatggctggtgtaacaacaggaaatgtcgcatatttggctaacgctattcatgaggtcactaagccaatttaagaccccttcctccctcctgccattttgagaaataagaggagcctttcaacttcaagttgcagtttgcttttaatttccttaaaccttttatgttccaacaatgttgtttttatcaaacaatgtcccatattgttgtgacctatgggtgtgcaaatattgatttgtttcatcccgacacgcagcggccgc

SEQ ID NO: 70256 - protein, 426 aa, Triticum aestivum
MAMSRAAAAVGRRRCGPRLPAARSMASWFGHVEPAAKDPILGVTEAFLADPSPDKVNVGVGAYRDDDGKPVVLECVREAERRIAGSTNMEYLPMGGSVKMIEESLKLAYGEDSEFIKDKRIAAVQALSGTGACRLFADFQKRFLPDSQIYIPTPTWSNHHNIWRDAQVPQRTFAYYHPESRGLDFAGLMDDIKNAPEGSFFLLHACAHNPTGVDPSEEQWREISQQFKVKNHFPFFDMAYQGFASGDPERDAKAIRIFLEDGHQIGCAQSYAKNMGLYGQRAGCLSILCDDEIQAVDVKSQLQQIARPMYSNPPLHGALIVSTILGDPALKSLWLKEVKGMADRIIGMRKALKESLEKLGSPLSWEHITNQIGMFCYSGMTPEQVDRLTNEFHIYMTRNGRISMAGVTTGNVAYLANAIHEVTKPI

SEQ ID NO: 70257 - DNA, 1509 bp, Glycine max
  CDS (103)..(1362)
ccggttattctcaaaactaccacctctcttttggattcttcttcttcttcaccaccctgtgatcgcagactcaacactctcgctagacacttccttccgcaaatggcttctcacgacagcatctccgcttctccaacctccgcttctgattccgtcttcaatcacctcgttcgtgctcccgaagatcctatcctcggggtaactgtcgcttataacaaagatccaagtccagttaagctcaacttgggagttggtgcttaccgaactgaggaaggaaaacctcttgttttgaatgtagtgaggcgagttgaacagcaactcataaatgacgtgtcacgcaacaaggaatatattccgatcgttgggcttgctgattttaataaattgagtgctaagcttatttttggggctgacagccctgctattcaagacaacagggttaccactgttcaatgcttgtctggaactggttctttaagagttgggggtgaatttttggctaaacactatcaccaacggactatatacttgccaacaccaacttggggcaatcacccgaaggttttcaacttagcaggcttgtctgtcaaaacataccgctactatgctccagcaacacgaggacttgactttcaaggacttctggaagaccttggttctgctccatctggatctattgttttgctacatgcatgcgcacataaccccactggtgtggatccaacccttgagcaatgggagcagattaggcagctaataagatcaaaagctttgttacctttctttgacagtgcttatcagggttttgctagtggaagtctagatgcagatgcccaacctgttcgtttgtttgttgctgatggaggcgaattgctggtagcacaaagctatgcaaagaatctgggtctttatggggaacgtgttggcgccttaagcattgtctgcaagtcagctgatgttgcaagcagggttgagagccagctgaagctagtgattaggcccatgtactcaagtcctcccattcatggtgcatccattgtggctgccattctcaaggaccggaatttgttcaatgactggactattgagttgaaggcaatggctgatcgcatcatcagtatgcgccaagaacttttcgatgctttatgttccagaggcacacctggcgattggagtcacattatcaaacagattggaatgtttactttcactggattgaatgcggaacaagtttccttcatgactaaagagttccatatatacatgacatctgatgggaggattagcatggctggtctgagttccaaaactgtcccacttctggcggatgcgatacatgcagctgtaacccgagttgtctaaaacatgttgacaacagttttcaacatgctccctagtccctataggagaacttccattatttttgtttaataattgtcaacatcaacaatgaaaccttttatttgatgtgagatttttaaaggaaacttttctgaaaaaaaaaaaaaa

SEQ ID NO: 70258 - protein, 419 aa, Glycine max; identical to SEQ ID NO: 12975

SEQ ID NO: 70259 - DNA, 1624 bp, Hordeum vulgare
  CDS (91)..(1464)
ccaaggccatcgccatccacccgctccgctctgatcccagatcaccctcgccccctcctgctccgaacgctgcacctctcgccccagcggatggcctccgccctctccgcgccggcggcctccgccgtcgccgccgccgccgcccggcgcaaggtgttcggcggaggaaggaacgacgggagggccgggtgccgcgtcgggatcgcgaggaagaatactggccacatagcgatggcacttacagtacacgcttctcgctttgaaggagtgtcgatggcccctccagacccgatccttggggtctcggaagcgtttaaagcagatacaagtgatctgaagctcaaccttggtgttggcgcctacagaacggaagagctacagcccgcagtcctcaacgttgtcaagaaggctgaaaaacttatgctagagaaaggagaaaacaaagagtatctgcctattgaaggctttgctgcatttaacaaagcaactgcagatctattgcttggagctgacaatcctgtcatcaagcaaggacgggttgctactcttcagtctctctcagggactggatcattacgccttgctgcagcatttattcagagatacttccctgatgcaaaagtacttatatcatctcccacatggggaaaccacaaaaacatattcaatgatgctagggtgccatggtcagaataccggtattatgatcccaagactgttgggctggattttgaaggaatgatagctgacatacaggctgccccagaagggtcttttgttctgctacatggttgtgctcacaatccaactggaatagacccaactcctcaacagtgggagaaactggcagatctgattgaagagaaaaaacatatgcctttctttgatgttgcctatcaaggttttgccagtggaagccttgatgaagatgcatcctccgtcaggctttttgttaagcgtggcctggaagtgtttgttgcacagtcttacagcaagaaccttggtctatatgcagaaaggatcggtgcgataaatgtcatttgcacagcaccggaagttgcagatagggtgaagagccagttgaagcgattggcgcggcccatgtactcaaacccacctattcacggtgccaagatcgtcgccaacgttgttggagaccctaccatgttcggtgagtggaaagaagagatggaacaaatggcagggcggatcaagaatgttcggcagaagctttacgatagcttgactgcaaaggaccagtctggcaaggactggtctttcattcttagccagataggcatgttctccttcacgggcttgaacagaacccagagcgataacatgaccgataaatggcacatatatatgaccaaggacgggaggatttcgttggcagggctgaacctggcgaaatgcgagtaccttgctgatgccatcatcgactccttccacaatgtcaactagattacgatttgcgtcgcagccacgctattgtgagtagttccttctatagtttgctgggatttttgggtccttccagctcgagttgtaagtcaggatgctgatgatgtgtccgttaattcagaggtacagtaataaataatctggcaaaaaaaaaaaaaaa

SEQ ID NO: 70260 - protein, 457 aa, Hordeum vulgare
MASALSAPAASAVAAAAARRKVFGGGRNDGRAGCRVGIARKNTGHIAMALTVHASRFEGVSMAPPDPILGVSEAFKADTSDLKLNLGVGAYRTEELQPAVLNVVKKAEKLMLEKGENKEYLPIEGFAAFNKATADLLLGADNPVIKQGRVATLQSLSGTGSLRLAAAFIQRYFPDAKVLISSPTWGNHKNIFNDARVPWSEYRYYDPKTVGLDFEGMIADIQAAPEGSFVLLHGCAHNPTGIDPTPQQWEKLADLIEEKKHMPFFDVAYQGFASGSLDEDASSVRLFVKRGLEVFVAQSYSKNLGLYAERIGAINVICTAPEVADRVKSQLKRLARPMYSNPPIHGAKIVANVVGDPTMFGEWKEEMEQMAGRIKNVRQKLYDSLTAKDQSGKDWSFILSQIGMFSFTGLNRTQSDNMTDKWHIYMTKDGRISLAGLNLAKCEYLADAIIDSFHNVN

SEQ ID NO: 70261 - DNA, 1836 bp, Glycine max
  CDS (42)..(1598)
acaattcacaaccttcaaacatatttataagaataacaccaatggatactccaatgaccctcacgggcttgctccgcgacgtcgccgccaaattcccttcccgccgcgccatctccgtcgccggaaaattcgacctcacccactcccgcctccatcaactggttgaatccgccgccgcccgcttagtcgccgccggaatcaaacccggcgacgtcatcgctctcaccttccccaataccgtcgagtttgttgtcttgtttctagccgtcattcgagtgcgcgccacagccgcgccgttaaacgcggcttacacagccgaagagtttgagttttacttgtccgactccgagtccaagcttcttctaacatcagcagaaggaaacaactcagctcaagccgcagcttcaaaactcaacatccttcacagcacagcttcaataacccaagccggagacaaagaagccgagctgagcctctcattaagccactccgagtcagagtcaattaactcggttgagtcactcggaaacgatccagatgacgtggcgcttttccttcacacctcgggcaccacgagccgacccaagggagtgcctttgacgcaacacaacctgttctcttccgtgaacaacattaaatcggtgtaccgactcactgagtccgactcgacggtgatcgttcttcctttattccacgtgcacggtttgatcgcggggctcctgagttcgctcggcaccggggcggcggtggcgctgccggcagcggggagattctccgcctcgtcattctggaaggacatgattaaatacagcgccacgtggtacacagcggttcctacaatacaccagatcatactggaccgccactcgaacagccccgaaccggtttacccgcgcctccggttcattcgaagctgcagcgcgtcgctcgcaccggctattctgggtaaacttgaggaggccttcggtgcgccagtgctggaggcttacgcgatgacggaagcgtcgcatttgatggcttcgaaccctttgccgcaagatgggccccacaaggccgggtcggttgggaaacccgtgggtcaagaaatggttatattggacgaaacgggtcgggttcaagatgctgaagttagtggagaggtttgcattaggggtcctaatgttacgaagggatataaaaataacgtggatgccaatacggcggcgtttttgtttggttggtttcacaccggtgatgttgggtacttggattctgatgggtatttgcatctcgtgggtcggatcaaggagctcatcaaccgaggaggagaaaagatatcaccaatagaagtggatgctgtccttctttcacacccagacattgctcaggcagttgcttttggagtgcctgatccaaagtatggggaggagatatactgtgctgtaatcccaagagaaggatcagacattgatgatgcagagttgctaagatattgcaagaagaatcttgcatctttcaaagtccccaaaaaggtcttcattaccgattctttgcccaagactgccaccggaaagattttgcgtcgtcttgtggcagaacactttgtctctcaaatttgagcaactcaagtcctacatttgaagactccatacctggccatacatagttggagtccacacaccataaatttcaacagtagtttggcaacttggcatttaggaggaggatatttctgcaaatggtctttcatacaggatacagtatattgtagttttcaatgattcatgtgaaatgttcacagggtaatgttttcaaggttttaaagatcttaaataatttctcaaaaaaaaaaaaaaa

SEQ ID NO: 70262 - protein, 518 aa, Glycine max
MDTPMTLTGLLRDVAAKFPSRRAISVAGKFDLTHSRLHQLVESAAARLVAAGIKPGDVIALTFPNTVEFVVLFLAVIRVRATAAPLNAAYTAEEFEFYLSDSESKLLLTSAEGNNSAQAAASKLNILHSTASITQAGDKEAELSLSLSHSESESINSVESLGNDPDDVALFLHTSGTTSRPKGVPLTQHNLFSSVNNIKSVYRLTESDSTVIVLPLFHVHGLIAGLLSSLGTGAAVALPAAGRFSASSFWKDMIKYSATWYTAVPTIHQIILDRHSNSPEPVYPRLRFIRSCSASLAPAILGKLEEAFGAPVLEAYAMTEASHLMASNPLPQDGPHKAGSVGKPVGQEMVILDETGRVQDAEVSGEVCIRGPNVTKGYKNNVDANTAAFLFGWFHTGDVGYLDSDGYLHLVGRIKELINRGGEKISPIEVDAVLLSHPDIAQAVAFGVPDPKYGEEIYCAVIPREGSDIDDAELLRYCKKNLASFKVPKKVFITDSLPKTATGKILRRLVAEHFVSQI

SEQ ID NO: 70263 - DNA, 1989 bp, Brassica napus
  CDS (70)..(1725)
cgcaaaaccaaaacttctccaaagctttgaaaagaaaaaccaaagtgttaaattgtctaaaaacttagaatggctccacaagaagacgccatgcagaaacagagcagcaacaagagtgacgtcatattccgatcaaagcttccggatatttacatcccgaaccacctccctctccacgactacatcttccaaaacatctccgagttcgcctccaagccttgcctgatcaacggtcccaccggccacgtgtacacttactccgaggtccatgtcgcttcccgtcgcatcgccgccggttttcaaaaactcggcgttaaccaaaacgacgtcgtgatgatcctcctctcgaattgccccgagttcgtcctctctttcctcgccgcctccttccgcggcgcaacggccaccgccgctaacccgtttttcactccggcggagatcgccaaacaggccaaagcctcgaactcgaagctcatcgtcaccgagtctcgctacgtcgataaaatcaaagacctccaaaacgacggcgttataatcgtctgcaccgacgaggaaccttctccgatcccggaaggctgcctccgattcaccgagttgactcagtcaaccgaaattgaaacggtggagatttcttccgacgacgtggtggcgcttccttactcctccggcacgacgggtctacccaaaggagtgatgctgactcacaagggactagtcacgagcgtcgctcagcaagtcgacggcgataatccgaatctttacttccacagcgatgacgtcatactctgtgtcttgcccatgttccatatctacgctttgaactcgatcatgctgtgtgggcttagagttggtgcctcgatcttgatcatgccaaagttcgagattaatctgctcttggagctgatacagaggtgtaaagtgacggttgctccgatggttccgccgattgttttggcgatggcgaagtcgccggagacggagaagtatgacttgagctcgattagggttgtgaaatctggtgctgctccgcttggtaaggagcttgaagatgccgtcagtgccaagtttcctaacgccaaactcggtcagggatacggaatgacggaagcaggtccggtgctagcaatgtcgttagggttcgcgaaagagccgtttccagtgaagtcgggagcttgtggtacggtggttagaaacgccgaaatgaaaatcatcgatccagacaccggagactcactttccaaaaacaaacctggagagatttgcatccgtggtcaccagatcatgaaaggttacctcaacaacccggcggctacatcagagaccatagacaaagacggctggcttcacacgggagatatcggattgatcgatgacgacgacgagcttttcattgtcgatagattgaaagaacttatcaagtacaaaggttttcaagtggctccggctgagctagaggctctcctcatcggtcatcaggatatcaccgacgtggccgttgtcgccatgaaagaagaggctgctggtgaagttcccgttgcgtttgttgtgaaatccaaggattcagagttatcagaagatgatgtgaaacaattcgtggcgaaacaggttgtgttttacaagagaatcaacaaagtgttcttcgttgagtccattcctaaagctccgtcagggaagatattgaggaaagacctgagggcaaaactagcaaatgggttggtaaactaaagaaacgaaacgcaaaagatgttccattgtatatacatacaactgtttgacgatcccaatgaaggactagagaaactcatacgaatcaatcaatgcctgtttctttttgtctttgtgttgttgttgtctttggttcatgtaatgaaccttttgtaataaaaggtggtttctttttttttgggtttcatgtaacttgtgctggagaagaccagcagactttttcataaaataaattactgttgttaaagcaaaaaaaaaaaaaaa

SEQ ID NO: 70264 - protein, 551 aa, Brassica napus
MAPQEDAMQKQSSNKSDVIFRSKLPDIYIPNHLPLHDYIFQNISEFASKPCLINGPTGHVYTYSEVHVASRRIAAGFQKLGVNQNDVVMILLSNCPEFVLSFLAASFRGATATAANPFFTPAEIAKQAKASNSKLIVTESRYVDKIKDLQNDGVIIVCTDEEPSPIPEGCLRFTELTQSTEIETVEISSDDVVALPYSSGTTGLPKGVMLTHKGLVTSVAQQVDGDNPNLYFHSDDVILCVLPMFHIYALNSIMLCGLRVGASILIMPKFEINLLLELIQRCKVTVAPMVPPIVLAMAKSPETEKYDLSSIRVVKSGAAPLGKELEDAVSAKFPNAKLGQGYGMTEAGPVLAMSLGFAKEPFPVKSGACGTVVRNAEMKIIDPDTGDSLSKNKPGEICIRGHQIMKGYLNNPAATSETIDKDGWLHTGDIGLIDDDDELFIVDRLKELIKYKGFQVAPAELEALLIGHQDITDVAVVAMKEEAAGEVPVAFVVKSKDSELSEDDVKQFVAKQVVFYKRINKVFFVESIPKAPSGKILRKDLRAKLANGLVN

SEQ ID NO: 70265 - DNA, 2025 bp, Glycine max
  CDS (60)..(1748)
gaattcccgggtcgacttcgctgtcgacgatttcgtcgtaaacacattcagacaccaccatgataactctagctccttctcttgatactccaaaaactgatcaaaaccaagtttctgatccccaaactagccatgtcttcaaatcaaaattaccagatatcccaatctccaaccacctccctctccactcctactgcttccagaacctctcccaatttgcccaccgcccttgcctcatcgtcggacccgcctccaaaaccttcacctacgccgacacccacctcatttccagcaagatcgccgccggattgtccaacctcggaatcctcaagggcgacgtcgtcatgatcctcctccagaactccgccgatttcgtcttctccttcctcgccatctccatgattggcgccgtcgccaccaccgccaacccgttctacaccgccccggagatcttcaagcagttcaccgtctccaaggcgaagtcgatcataacacaggcaatgtacgtggacaagctccgcaaccacgacggcgcgaagctcggcgaggacttcaaggtcgtaaccgtcgacgatccgccggagaattgcctccacttctctgtcctctcggaggcgaacgagagcgacgtgccagaggtggagatccacccggacgacgcggtggcgatgccgttctcctccggcacgacgggtttacctaaaggagtgattctcacgcacaagagtttaaccacgagtgtggcgcagcaagttgacggagagaaccctaacctctacctcaccaccgaggacgtgctcctctgcgtgcttccgctctttcacatattctcgctcaacagtgtgctattgtgcgccctcagggcggggagtgcagttttgttgatgcagaagttcgagatcgggacactgctggagctgatacagcggcaccgagtgtcggtggcgatggtggtgcccccgctggtgttggcgttggcaaagaatccgatggtggcggattttgacctgagttcaatacggttagtgctgtccggagctgctcccttggggaaggagctcgaggaggctctccggaacaggatgcctcaagctgttttgggacagggttacgggatgacagaagcagggccagtgctgtccatgtgcttgggctttgcaaagcaacctttccaaacaaaatcaggctcttgtggtaccgtagtcagaaatgcagaactcaaggttgttgaccctgaaactggtcgttctcttggctacaatcaacccggtgaaatttgcatccgagggcaacagatcatgaaaggatatctgaacgatgaggcagcgacagcatcgaccatagattcagagggttggcttcacaccggtgatgttggctacgtagatgatgatgacgaaattttcattgttgacagggtgaaggaactcatcaaatataaaggcttccaggtgccccctgcagaacttgaagggcttcttgtaagccatccctccattgcagatgcagctgttgtcccacaaaaggatgttgctgctggtgaagttcctgttgccttcgttgtgagatcaaacggctttgatctaactgaagaggctgtaaaagagtttatagctaaacaggtagtgttttacaaaagactgcacaaagtttattttgttcatgctattcccaagtctccatcaggaaagatattaaggaaagacctcagagcaaagctagaaaccgccgccactcagacgccttaaaggctagctagaacctgcccccttttttcttggcaatattttccttattttttatttatattattggtttcacacgtgtaatttacgtatcaatgcttcacggcattaagccaatccgagaagcagttgcacttacgtataatcattgtatttttatgtccattgtccaccaccatgtctgtattgtggttttagatcactaattttcgagaccttgtattattggtgttatcaaatccttgctattctgcaaaaaaaaccgacacgcagcggccgc

SEQ ID NO: 70266 - protein, 562 aa, Glycine max
MITLAPSLDTPKTDQNQVSDPQTSHVFKSKLPDIPISNHLPLHSYCFQNLSQFAHRPCLIVGPASKTFTYADTHLISSKIAAGLSNLGILKGDVVMILLQNSADFVFSFLAISMIGAVATTANPFYTAPEIFKQFTVSKAKSIITQAMYVDKLRNHDGAKLGEDFKVVTVDDPPENCLHFSVLSEANESDVPEVEIHPDDAVAMPFSSGTTGLPKGVILTHKSLTTSVAQQVDGENPNLYLTTEDVLLCVLPLFHIFSLNSVLLCALRAGSAVLLMQKFEIGTLLELIQRHRVSVAMVVPPLVLALAKNPMVADFDLSSIRLVLSGAAPLGKELEEALRNRMPQAVLGQGYGMTEAGPVLSMCLGFAKQPFQTKSGSCGTVVRNAELKVVDPETGRSLGYNQPGEICIRGQQIMKGYLNDEAATASTIDSEGWLHTGDVGYVDDDDEIFIVDRVKELIKYKGFQVPPAELEGLLVSHPSIADAAVVPQKDVAAGEVPVAFVVRSNGFDLTEEAVKEFIAKQVVFYKRLHKVYFVHAIPKSPSGKILRKDLRAKLETAATQTP

SEQ ID NO: 70267 - DNA, 1927 bp, Glycine max
  CDS (86)..(1729)
gaattcccgggtcgacttcgctgtcgacgatttcgttcaatctccaggctatctatcaagtaagaaagctgttaagaggaggagaatggctgatgatggaagcaggagggaattgatattcaggtcgaagcttccggatatctacatccccaaacatatgcccctccactcttactgcttcgagaatttgagagagtgtggttcacgcccctgcctgatcaatgcccccacgggagacgtctacagctaccacgaggtggacagcaccgccagaaaggtggcgagggggctgaagaaagagggcgtggaacagggccaggtcatcatgatcctcctccccaattgccccgaattcgtcttctcgtttcttggcgcatcccaccgcggtgccatggccactgccgccaaccctttcttcacccccgccgagattgcaaagcaagcccatgcctccaatgccaagctcctcatcacccaggcctcttactacgacaaagtcaaggacctccgcgacatcaagctcgtattcgtcgactcttgtcccccccatacagaggagaagcagcatctccatttctcacatctgtgtgaggataacggtgacgctgatgttgatgttgatgttgatatcaagcccgatgacgtggttgcattgccttattcttcgggaacaactggtcttcccaagggagtgatgctgagccacaaggggctggtgaccagcattgctcagcaggttgacggtgataatcccaacctctattaccactgccacgacaccatcctctgcgtgcttcccctctttcacatttactctctcaactccgttcttctctgtggcttgcgtgccaaggctaccattctcctcatgcccaagttcgatattaactccttgcttgctctcattcacaagcacaaagtcactattgcccctgtcgtccctcccattgttctcgccatttccaaatcacccgatctccacaagtacgacctgtcttccatcagagtcttgaagtccgggggagcccctctgggtaaggaactcgaagacactctcagagctaaattccccaacgccaaacttggccagggatacggaatgactgaggcagggcctgtgctaacaatgtctttagcttttgctaaagaaccgatagacgtgaaaccaggtgcatgtggaaccgttgtaagaaatgcagagatgaagattgtcgatcctgaaaccggtcattctttacccagaaaccaatccggtgaaatttgcataagaggcgaccagattatgaaaggttatctaaatgatggagaggctacagagagaaccatagacaaagatggttggttgcacacaggtgacatcggttacatcgacgatgacgatgagttattcatcgttgacaggctcaaggaattgatcaaatacaaaggatttcaagtggctccagctgaacttgaagcccttcttctcactcatcctaagatctctgatgctgctgttgttccaatgaaggatgaagccgcgggagaggtacctgttgcatttgtggtcatatcaaatggttataccgacacaaccgaggatgaaattaagcagtttatctccaaacaggtggtgttttacaaaagaataaaccgagtattcttcattgatgcaattcccaagtcaccgtcaggcaaaatcttgcgcaaggatctaagagcaaagatagcggcaagtgttccaaaatgaaattaaaccaaacccatcatgttatggtgttattatacgatgcccgcataagcaagcttcaacacaaaaggaagaggcgctgttgcttgatcccgctagcttttacgtattttctcttacgtaacaaccgtgtataagttaccagtgtgattttcttacagaactatcttctgtaaagattccaaaaaaaaaaaaaaa

SEQ ID NO: 70268 - protein, 547 aa, Glycine max; identical to SEQ ID NO: 672

SEQ ID NO: 70269 - DNA, 402 bp, Unknown
  CDS (1)..(399): n means a or g or c or t/u, s means g or c
atgaaagacacaatggaaactcctacgacactcaccaccttgctccgccacgtcgccgccaaattcccctcccgccgtgccatctccgtcgctgccaaattcgacctcacccactcccgcctccaccgcctggtcgaatccgccgccgctcagttagtctccgccggcgtcaaacccggcgacgtcgtcgccctcaccttccccaacaccatcgagtttgtagtcatgttcctagccgtcattcgggctcgagccacagccgcgccgttaaactcggcttacacagcggaagagttcgagttttacttatccgactcggagtccaagctcctcctaacatcaccagaaggaagaattgacatgtgtcatgtccatggccttatactgggtttcaaataatcc

SEQ ID NO: 70270 - protein, 132 aa, Unknown
  protein
MKDTMETPTTLTTLLRHVAAKFPSRRAISVAAKFDLTHSRLHRLVESAAAQLVSAGVKPGDVVALTFPNTIEFVVMFLAVIRARATAAPLNSAYTAEEFEFYLSDSESKLLLTSPEGRIDMCHVHGLILGFK

SEQ ID NO: 70271 - DNA, 1842 bp, Hordeum vulgare
  CDS (95)..(1339)
cgccgcgcaggctggaggaggtcgaattccctgccgcctagcgtcgcctcgtcccgaagaaggctagctgccccgcgagcggaccgcggcgcccatggcgttcgagaagatccaggttgccaaccccatcgtcgagatggacggtgatgagatgacacgaattatatggaaatggatcaaagataagcttatatttcctttcctggacctggacataaaatactttgacttaggtctacctaaccgtgacgctactggggataaagtaacgatagaaagtgcagaagctaccctaaagtataacgtggccatcaaatgtgcaactgtcaccccagatgaaggacgcgtaaaagagtttaatttaaaagctatgtggaggagtccaaatgggacaataaggaacatcttaaatggaactgttttccgagaaccaatcatctgcaagaatgttcctcggcttgtgcctggatggacaaaacccatatgcattggcagacatgcttttggtgatcaataccgagcaacagatataatcattagagggacagggaagctcaagttgatatttgatggcatagaggaacaaatagagttggatgtgttcaactttagtggtgctggtggagtagcattatctatgtataacactgatgagtctattcgagcatttgctgaagcttcgatgaacatggcttaccagaagagatggccactttatcttagtacgaagaacacaatcctgaaaaaatatgacggaaggtttaaagacatattccaacaaaactatgaaacaaattggagatgcaggtttgaggatgcaggaatatggtatgaacatagactgattgatgatatggtggcctatgccctaaagagtgaaggtggctatgtttgggcttgcaagaattatgatggagatgtgcagagcgatctaattgctcaaggttttggatcgttaggtctcatgacatcggttttggtgtgccctgatggtagaacagttgaagctgaagctgcacacggtacagtcacacgacattacagagtccaccaaaaaggaggcgaaactagcacaaacagcattgcgtcaatctttgcatggtctactggattagcacatagggcaaagctggatgacaacaaaagactgttggatttcacacaaaaacttgaagctgcttgtgtggggacagtggaatctggaaagatgacaaaggacctagctcttctcatccatgggccaactgttagtcgtgataagtatctgaacaccatggagttcattgatgcggttgctgaggagttgaggacaagattgtccgcaaaatcaaagttatgaaggtactacaagtaagataatttccttgtctatcagcttcttgtaatggttctgaagctcatgtaatgcttctgaagctcatgttttctcatctaagcattatctgccatttttgacacagcagcgataggacaagtgacttgttaggatcctataatacaaggtttacggtttacctttgtgctatgaataagagcgtgggcaacatatcttcgttatagtgctcaaatagagcctttggtgacagtctgaatgcacctccgaacaatgtaaggaagatgctgtctagctcgaaaataagaagttttttcttttctttttcaaatcaaattcctggtcagtttcaggtagctcttctcatagtgatgtccaaatcaagttgggcttcttacacctacacaccctaagtggtgtttgtaccaaagaaataagctggagtactttatttaaacattttaatgtcatgacatgaaatcgaatgccaatttaaaaaaaaaaaaaaa

SEQ ID NO: 70272 - protein, 414 aa, Hordeum vulgare
MAFEKIQVANPIVEMDGDEMTRIIWKWIKDKLIFPFLDLDIKYFDLGLPNRDATGDKVTIESAEATLKYNVAIKCATVTPDEGRVKEFNLKAMWRSPNGTIRNILNGTVFREPIICKNVPRLVPGWTKPICIGRHAFGDQYRATDIIIRGTGKLKLIFDGIEEQIELDVFNFSGAGGVALSMYNTDESIRAFAEASMNMAYQKRWPLYLSTKNTILKKYDGRFKDIFQQNYETNWRCRFEDAGIWYEHRLIDDMVAYALKSEGGYVWACKNYDGDVQSDLIAQGFGSLGLMTSVLVCPDGRTVEAEAAHGTVTRHYRVHQKGGETSTNSIASIFAWSTGLAHRAKLDDNKRLLDFTQKLEAACVGTVESGKMTKDLALLIHGPTVSRDKYLNTMEFIDAVAEELRTRLSAKSKL

SEQ ID NO: 70273 - DNA, 1591 bp, Brassica napus
  CDS (56)..(1306)
agtctcgtaggcaggccaggcacaaagcacttggagcagcagagaagaggcaaagatggaattcgagaagatcaaggtggccaatccgattgttgaaatggatggagacgagatgactcgagttatctggaaattcattaaagacaagcttattttaccttacctggagttggatatcaaatactttgatctcggactgcctaaccgcgattctactgatgataaggttactacagagagtgctgaagctactctaaagtataacgtggcaatcaagtgtgcgacgattactcctgatgaaactcgtgttagggagtttggtttgaaaaaaatgtggaggagtcctaacggaactataaggaacattttaaacggcacggtcttcagggaacctataatttgcagaaatatccctcgcattgtaccaggatggactaaaccaatctgtattggaaggcatgcttttggagatcagtatagagctactgatatcgttgttaatgaaccaggaaaactgaaactgattttcgagccaagtggatcttcacgtaagaccgaatttgaagtcttcaatttcactggtgctggaggtgttgctttggccatgtataacaccgatgagtctatccgttcatttgccgagtcatcgatgtacacagcttaccagaaaaaatggccgctgtacctctccacaaaaaacaccatcctcaaaacatatgacggaagattcaaggatatattccaagaagtttatgaaactaactggagatctaagtttgaagctgctgggatatggtatgagcatcgtctgatagatgatatggttgcttatgccatgaaaagtgaggggggttacgtttgggcatgcaagaactacgatggagatgtgcagagcgatttcttagcccaaggatatggatctctgggactgatgacgtcggtgttggtttgtcctgatggaaagaccattgaagcagaggcagctcatggcacagtaacacgccactacagagttcaccaaaaaggtggcgaaacaagcaccaacagcatagcctctatttttgcttggtccagaggccttgcccacagggcaaagctggacagcaatgcgtcgttgttgaactttactgagaaactagaagcggcttgtatggggacggtggagtctggaaaaatgaccaaggatctcgcgctgttgatccatggatccaaggttaagagggatgattatgtgaatactgaagagttcattgatgctgtggcgtgggagttaagaaaaagactgttaggcagctccaggttgtgaggagaagatttgaaaagcaaaaaacctttgcagtttccatcgagtaacattcatcatcataatgtgtagaaaataaaggcaagtgtgttgtatgtttgggcgtaaaaaggatgggtaataataattaaccgcccaactcaaaagctcctctcgtcctctgttgtaatggctgctactatttacttttcattagcttgaacctatctctcccagtctctcgctctctctaaatgaaggcggggagtaacgccttatctttgtaaaaaaagcaaaaaaaaaaaaaaa

SEQ ID NO: 70274 - protein, 416 aa, Brassica napus
MEFEKIKVANPIVEMDGDEMTRVIWKFIKDKLILPYLELDIKYFDLGLPNRDSTDDKVTTESAEATLKYNVAIKCATITPDETRVREFGLKKMWRSPNGTIRNILNGTVFREPIICRNIPRIVPGWTKPICIGRHAFGDQYRATDIVVNEPGKLKLIFEPSGSSRKTEFEVFNFTGAGGVALAMYNTDESIRSFAESSMYTAYQKKWPLYLSTKNTILKTYDGRFKDIFQEVYETNWRSKFEAAGIWYEHRLIDDMVAYAMKSEGGYVWACKNYDGDVQSDFLAQGYGSLGLMTSVLVCPDGKTIEAEAAHGTVTRHYRVHQKGGETSTNSIASIFAWSRGLAHRAKLDSNASLLNFTEKLEAACMGTVESGKMTKDLALLIHGSKVKRDDYVNTEEFIDAVAWELRKRLLGSSRL

SEQ ID NO: 70275 - DNA, 1663 bp, Brassica napus
  CDS (81)..(1532)
gctttttgcaataagacttgccgaagcttcgtgttcagtgatcgaagttgagaaacagaaagcgtagcgcggagtctcggatgctcaacaacctcacacgcggcggtttcatgtaccgtgccagcgtcacgatgttatcttcgtctacttcttcctcctcctctgctgctttatcgtcttcatggaagtctccgcgatttctcagctccggtgtgttatcgggtggtggttcgaggaatcgcgtggcctttcccgttcgttttcatcgcgctttatctgttcgatgttttgcctcttctggtggctctgataggattcaggttcagaacccaatcgttgaaatggacggtgatgaaatgacgagggtgatatggagtatgataaaggataaacttattttgccttatctggatctggatattaagtacttcgacttggggattctgaatcgcgatgctactgatgacagagttacagttgaaagtgctgaagctgctcttaagtacaacgttgctatcaaatgtgccactataactcctgatgagggcagagtgaaggagtttggactgaaatcaatgtggaggagtcctaatggaacaatcagaaacattttagatggaactgttttccgtgaacctatcatgtgtggcaatatccctcggcttgttcctggttggagaaaaccaatatgcattggtaggcatgcctttggtgaccagtatcgtgccacggatcaagtagttaaaggaccaggaaagttgaaaatggtttttgtcccagaagatgggagcgcacctgaggaactagacgtatatgatttcaaaggcccaggtgtagctctggctatgtacaacgtagatgagtcaattcgtgcttttgctgagtcatctatggcgatggcacttgcaaagaaatggccactatacttgagcaccaagaacacaattcttaaaaaatatgatggcaggttcaaggacatatttcaagaagtttatgaggcgaattggaagcaaaagtttgaagagcactcaatatggtatgaacatcgcttaatcgatgacatggtggcttatgcagtaaagagcgaaggtggatatgtctgggcttgcaaaaattacgacggtgatgttcaaagcgatcttcttgcccaagggtttggctcactaggcctcatgacctcagttttgttatcctctgatgggaaaacactcgagtcagaggcggctcatggaaccgtaactcgacatttccgactgcaccaaaagggacaagagaccagtactaatagcatcgcctccatatttgcatggacacgcggcttagaacacagggcaaaactggataagaacgaaaaattgatggattttgtcaagaagctcgagtcgtcgtgtgttaacactgttgagacagggaaaatgaccaaggatcttgcccttctggtccatggtcccaaggtgagtagggatgtgtacttgaacacagaagagttcattgatgcagttgcctccaatctccagtcaaagctcaattgagcctctacttttgtctgaccatttctgccaacaatacaaaaaataatgctcgccactgtttcacgttatgaacaaacaaaaaaactagtattggcgggtctagtgatttttcttttaaaaaaaaaaaaaaa

SEQ ID NO: 70276 - protein, 483 aa, Brassica napus
MLNNLTRGGFMYRASVTMLSSSTSSSSSAALSSSWKSPRFLSSGVLSGGGSRNRVAFPVRFHRALSVRCFASSGGSDRIQVQNPIVEMDGDEMTRVIWSMIKDKLILPYLDLDIKYFDLGILNRDATDDRVTVESAEAALKYNVAIKCATITPDEGRVKEFGLKSMWRSPNGTIRNILDGTVFREPIMCGNIPRLVPGWRKPICIGRHAFGDQYRATDQVVKGPGKLKMVFVPEDGSAPEELDVYDFKGPGVALAMYNVDESIRAFAESSMAMALAKKWPLYLSTKNTILKKYDGRFKDIFQEVYEANWKQKFEEHSIWYEHRLIDDMVAYAVKSEGGYVWACKNYDGDVQSDLLAQGFGSLGLMTSVLLSSDGKTLESEAAHGTVTRHFRLHQKGQETSTNSIASIFAWTRGLEHRAKLDKNEKLMDFVKKLESSCVNTVETGKMTKDLALLVHGPKVSRDVYLNTEEFIDAVASNLQSKLN

SEQ ID NO: 70277 - DNA, 1577 bp, Linum usitatissimum
  CDS (90)..(1325)
ccctcactcacattcccagtgttcttccatcgattcaatctcatctcaagagcgagctaacagagaagtccctgcatccagctacagccatggctttcgagaagatcaaggtcactaaccccatcgtcgagatggacggagatgaaatgacccgagttatatggcaatcaattaaggataagcttatcctcccatttgtggagttggacatcaagtactttgaccttggccttcctcatcgtgatgctaccgatgataaagttacagttgaaagtgcagaagctactctgaagtataatgtagcaatcaagtgtgctacaattactccagatgaagctcgagtcaaggagttcaacttgaaacaaatgtggattagtccaaatgggacaatcaggaatattttgaatggtactgtgtttagagaaccaattctttgtaaaaatgtcccccgtcttgttccaggttggacaaagccaatttgcattggcagacatgcttttggcgatcaatataaggcaaaagacactgtcattaaagggaagggcaaactcaaattgctgtttgttccagaagatggcgaggcacaagaaattgaggtttacaactttacaggtgctggtggggtagcacaggccatgtacaacactgatgagtccatccgctcatttgctgatgcttctatgaacgttgcttttgagaaaaagtggccactttatcttagcacaaaaaataccatcctcaagaagtacgacggaagattcaaggatatctttcaagaagtttatgaagctagctggaagtccaagtttgacgaggctggaatatggtatgagcaccgactcattgatgatatggtggcctatgctctcaagagtgaaggaggatacgtatgggcttgcaagaattatgatggagatgtccagagtgatttcttagctcaaggttttggatctcttggattgatgacatctgtactggtatgccctgatggaaagaccatcgaagctgaggcagcccacggaactgtcactcgccattacagagttcatcagaaaggtggtgaaaccagcaccaacagtatcgcttcaatctttgcttggactagaggacttgcacacagggcaaagctggacgacaatgctagactcctggaattcaccgagaaactcgaagctgcctgcatcggaactgtggagtctggaaagatgaccaaagatcttgcgctgatcagtcatggatccaacttgaccagggagcattacctcaacactgaggagttcattgatgctgttgctgctgagctgaagacagcactctctgcttgatttgactgctgagatgtggaagattgggctatggtgcgaaagctcttttgttgttttaatttcaccaaggcggggctgggttggttgagtggtctcattgcgaatgaataaaaggggggaatgggtattaagagatggctgagatttagttctagttacttgaactctgctctggattctcgattttaatctgtttacttcttccttgcttctctctattggacagaatattcacagaaaaaaaaaaaaaaa

SEQ ID NO: 70278 - protein, 411 aa, Linum usitatissimum
MAFEKIKVTNPIVEMDGDEMTRVIWQSIKDKLILPFVELDIKYFDLGLPHRDATDDKVTVESAEATLKYNVAIKCATITPDEARVKEFNLKQMWISPNGTIRNILNGTVFREPILCKNVPRLVPGWTKPICIGRHAFGDQYKAKDTVIKGKGKLKLLFVPEDGEAQEIEVYNFTGAGGVAQAMYNTDESIRSFADASMNVAFEKKWPLYLSTKNTILKKYDGRFKDIFQEVYEASWKSKFDEAGIWYEHRLIDDMVAYALKSEGGYVWACKNYDGDVQSDFLAQGFGSLGLMTSVLVCPDGKTIEAEAAHGTVTRHYRVHQKGGETSTNSIASIFAWTRGLAHRAKLDDNARLLEFTEKLEAACIGTVESGKMTKDLALISHGSNLTREHYLNTEEFIDAVAAELKTALSA

SEQ ID NO: 70279 - DNA, 1599 bp, Linum usitatissimum
  CDS (102)..(1352)
aaagtctcagctccgattctgtactccccaccggaagaacatctggagaaacgaaagacggtcggcggagcaagtagcagcatagaacagtttcgttagaaatgtctttccagaagatcagagtcaccaatcccatcgtcgagatggacggggatgaaatgactagagtgttctggaaatcgatcaaggataagcttatattccccttcttggatctggatatcaagtattttgaccttggcttaccaaaccgggatgccacaaacgatcaagtgaccatagatagtgctgaagctactcttaagtataacgttgctatcaagtgtgcaactataactccagatgaagaccgtgtaaaagagttcaacttgaaaaaaatgtggaggagccctaacgggacaattcggaacattctaaatggtactgttttcagagaaccaatcatctgcaggaacgttccacgtcttgtcccaggttggacaaggccaatatgcattggaaggcatgcatttggtgatcaataccgagcaactgatttggtcgtgggcgagcctggcaagctcaagatggtgtttgtgcctgatggacacagcaaaacaacagaacttgaggtttttaagtttactggagctggaggtgtaggtttggccatgtataacactgacgagtccattcgtgcttttgcggaggcttcgatgaacactgcataccataaaaggtggccgctttatcttagcacgaaaaataccatcctcaagaagtacgatggaagatttaaagacatatttcaggaagtttatgaaagcagatggaaatccaagtatgaagctgcaaaaatatggtatgaacatcgccttatcgatgatatggtcgcttactctctaaaaagcgacggagggtatgtctgggcgtgcaagaattacgatggagatgtccagagtgatttcctagctcaaggatttggttctcttggcttgatgacatcagtattggtatgcccagatggtaaaacaatcgaagctgaagcagctcatggcacagtgactcgccattaccgtgtccaccagaagggaggagaaacgagcacgaacagcattgcgtccattttcgcttggtcacgaggcttagctcacagggcaaagctggatggtaatgctcgactttcggacttcaccaagaagctcgaagcagcctgcgttggaactgtcgaatcaggaaagatgaccaaggatcttgctcttctcatccatggacccaaggttactagggctcagtacttgaatactgaagagttcattgatgcagtagcagaccagctgaaacaaagactaatggtcaaatcaaagctgtaactaaccaagtgtctgggcttagcctttagggacaacaatggctgaatggagaagaagattgaaccaatggtttttattaggctaaacgctcgagtttgagaaggaataaatgggatactagacgctttgttttagcgaaacggtagttgaagtcaacactatgtaacaaaacaatactgccgtacatatttagtcttcgatccgtttcgtgcaatcaacatgccatccactgaaaaaaaaaaaaaaa

SEQ ID NO: 70280 - protein, 416 aa, Linum usitatissimum
MSFQKIRVTNPIVEMDGDEMTRVFWKSIKDKLIFPFLDLDIKYFDLGLPNRDATNDQVTIDSAEATLKYNVAIKCATITPDEDRVKEFNLKKMWRSPNGTIRNILNGTVFREPIICRNVPRLVPGWTRPICIGRHAFGDQYRATDLVVGEPGKLKMVFVPDGHSKTTELEVFKFTGAGGVGLAMYNTDESIRAFAEASMNTAYHKRWPLYLSTKNTILKKYDGRFKDIFQEVYESRWKSKYEAAKIWYEHRLIDDMVAYSLKSDGGYVWACKNYDGDVQSDFLAQGFGSLGLMTSVLVCPDGKTIEAEAAHGTVTRHYRVHQKGGETSTNSIASIFAWSRGLAHRAKLDGNARLSDFTKKLEAACVGTVESGKMTKDLALLIHGPKVTRAQYLNTEEFIDAVADQLKQRLMVKSKL

SEQ ID NO: 70281 - DNA, 1610 bp, Helianthus annuus
  CDS (142)..(1392)
ccacctaccattcgtattaggcattcgccgtcctataaatatcctaaacccccactccgtcactatctcaccatctttctcactccgatctccggcaaacttttctccggcgatctcatcgttcgttcagaagcagtagcaatgtctttcgccaaaatcaaagtcgaaaaccccatcgttgagatggacggagatgaaatgactcgtgtcttttggcaatcaatcaaggataagctcattttccccttcgtagatctcgacattaagtattacgacctgggtcttcctaaccgtgatgctactgacgataaagttaccatcgaaagtgccgaagctactcttaagtacaatgttgcgattaagtgcgccaccattacccctgatgaggctcgtatgaaggagttcactttgaaaagcatgtggaagagtccaaacgggacgatcagaaatatattgaacggcacagtttttagagaaccaattctttgcaaaaatattcccaaactagttccaggatggacaaagcctatttgcatcggaagacatgcatttggtgatcaatacaaagctactgatgcagtgattaagggacccggaaagcttaagcttgtttttgttcccgaaggagaaggtgaaaacatagacttggaagtttacaacttcactggtgccggaggggtagctttgtcaatgtacaacactgaagagtccattgccgcttttgctgaggcctcgatgaacacagcttatcagaagaagtggccactttatcttagcacgaagaacactattctgaagaaatatgacggaagattcaaggacatatttcaagatgtttatgaaagcaactggaagtcgaagttcgaggctgctggaatatggtatgaacaccgtctcatcgatgatatggttgcttatgctcttaagagtgatggaggttatgtatgggcatgcaaaaactacgatggtgatgttcaaagtgatatgttggctcaagggttcggatcacttggattgatgacatcagtcttggtttgccctgatgggaagaccattgaatccgaagcagctcacggcactgtaactcgtcattacagagtgcatcaaaagggaggtgaaactagcactaatagtatagcctcaatctttgcttggacccgaggactggcccacagggcaaagttggacaacaacgctaagcttttggatttcactgagaagctggaagccgcatgtatcggaactgttgaatccggaaagatgacaaaggatcttgcactcattattcatggatccaagctcagtagggagcactatttgaacaccgaagaatttatcgatgctgtagccgatgagctgaaagcaagacttgtgggcaaatcatcactgtaagtgcatgatgagcagttgagagtaatgactggaccaagaagatttatgttcattgttccatgtgtttggttgaattcagcacaccattattgatatattggtggttattttaagaatttatattatgcttttttgtttaatctgggaacctgatttgatcagtttcagtttgaatggaatggaatggaagtttttatatttgcaaaaaaaaaaaaaaa

SEQ ID NO: 70282 - protein, 416 aa, Helianthus annuus
MSFAKIKVENPIVEMDGDEMTRVFWQSIKDKLIFPFVDLDIKYYDLGLPNRDATDDKVTIESAEATLKYNVAIKCATITPDEARMKEFTLKSMWKSPNGTIRNILNGTVFREPILCKNIPKLVPGWTKPICIGRHAFGDQYKATDAVIKGPGKLKLVFVPEGEGENIDLEVYNFTGAGGVALSMYNTEESIAAFAEASMNTAYQKKWPLYLSTKNTILKKYDGRFKDIFQDVYESNWKSKFEAAGIWYEHRLIDDMVAYALKSDGGYVWACKNYDGDVQSDMLAQGFGSLGLMTSVLVCPDGKTIESEAAHGTVTRHYRVHQKGGETSTNSIASIFAWTRGLAHRAKLDNNAKLLDFTEKLEAACIGTVESGKMTKDLALIIHGSKLSREHYLNTEEFIDAVADELKARLVGKSSL

SEQ ID NO: 70283 - DNA, 1897 bp, Glycine max
  CDS (133)..(1689)
gaaaacaccaactgttttgagttttccaaccttaaaaagactctctcttctctctctctctttctctccctgaagcaaaacaacattagcatcaaaaccagagtggttctagtaatccggtgctgctagaggatgggaactagtgaatggcatatcgagcgaagatctagcttcggcactgaatcccccttagcaagagaggcaggaaatgtgcctgaaactgggtcactctctattgttgtgcttggcgcttctggggatcttgctaagaagaagacatttcctgcacttttccatctataccggcagggattcttaccagcagatgaagttcacatttttggctatgcaaggacaaaaatatctgatgatgaattgagaaaccggttgcgtggctatcttgttccaaacaaaggtgcttctccccaactgttggaggatgtagagaagtttttacagctgatcaaatatgtaagtggctcttatgattctgaggatggatttcgcttgttggataaagagatttcagagcatgaatatttgaaaaagagtgttgagggtttatctcggaggcttttctatcttgctcttccaccttcagtatatccatctgtttgcaagatgatcaagacttgttgcatgaataaatctgatcttggtggatggacacgtgttgttgtcgagaagccttttggtaaggatctagaatctgcagaggaactcagtactgagattggaaagttgtttgaggaaccacagatttatcgtattgatcactacttgggaaaggaactagtgcagaacttgttggtacttcgctttgcaaatcggtttttcttgccactttggaaccgcgacaacattgacaatgtacagatagttttcagagaggattttggaactgatggccgtggtggatattttgaccaatatggaattattcgagatattattcaaaaccatttgctgcaggttctttgcttggttgctatggaaaaaccagtttctctcaggcctgagcacattcgggatgagaaagtgaaggttcttgaatcagtgctccctattagagatgatgaggttgttcttggacaatacgaaggctataaagatgacccaacagtacctgacaagtcaaacaccccaacatttgcaactgttattctgcgaatacacaatgaaagatgggaaggtgttccgttcatactaaaagcagggaaggcactaaattctagaaaggcagagatcagggttcaattcaaggatgtccctggtgatattttcaagtgtaaaaagcaggggagaaatgagtttgttatccgcctacaacctttagaagctatgtacatgaagcttacggtcaagcaacctggactggagatgtcaacagttcaaagtgagctagacttgtcatatggacaacggtatcaaggagtaaccattcctgaggcttatgaacgcctaattcttgacacaattaaaggtgatcagcagcattttgttcgcagagatgagttgaaggcatcctggcagatcttcaccccacttttgcacagaattgatgaaggggaattcaagccactcccctacaaaccaggaagcagaggtcctgcagaagcagatcagttacttgaaaaagcaggctatgttcaaacacacggctacatatggatccctcctaccttgtagagtaatctaatgtaataacatgaggaatctttagttgctaatgaatacacaataagcttgagaggcttcccttggaaccactcctcatgaatgtgtaatcaagcatttgaactatgagagtgtttgacacggtttgtgtaactgatttgcctttaaatgcaaaataaatggaaaatgaagtctatttaccggcaaaaaaaaaaaaaaa

SEQ ID NO: 70284 - protein, 518 aa, Glycine max
MGTSEWHIERRSSFGTESPLAREAGNVPETGSLSIVVLGASGDLAKKKTFPALFHLYRQGFLPADEVHIFGYARTKISDDELRNRLRGYLVPNKGASPQLLEDVEKFLQLIKYVSGSYDSEDGFRLLDKEISEHEYLKKSVEGLSRRLFYLALPPSVYPSVCKMIKTCCMNKSDLGGWTRVVVEKPFGKDLESAEELSTEIGKLFEEPQIYRIDHYLGKELVQNLLVLRFANRFFLPLWNRDNIDNVQIVFREDFGTDGRGGYFDQYGIIRDIIQNHLLQVLCLVAMEKPVSLRPEHIRDEKVKVLESVLPIRDDEVVLGQYEGYKDDPTVPDKSNTPTFATVILRIHNERWEGVPFILKAGKALNSRKAEIRVQFKDVPGDIFKCKKQGRNEFVIRLQPLEAMYMKLTVKQPGLEMSTVQSELDLSYGQRYQGVTIPEAYERLILDTIKGDQQHFVRRDELKASWQIFTPLLHRIDEGEFKPLPYKPGSRGPAEADQLLEKAGYVQTHGYIWIPPTL

SEQ ID NO: 70285 - DNA, 1782 bp, Brassica napus
  CDS (143)..(1693)
attttgcctccggtcgagatctcttgtcgttttctttgtctttctgatctttttcttttcctccgtttgttttgcgtgtttttgtgtttcgtggtagctgttgcacgtgtgagagtgtgacacgttcttgcttccgagaaagatggattctgggcagtggcacgttgagaagaggtccactttgaggaacgaatcgtttttaaaagagtacggtccagtctccgaaactggtagcctctccatcgtagttcttggtgcttctggtgatctcgccaagaagaagacttttcctgctcttttcaatctctaccaccaggggttccttaatccagatgaagttcatatctttggatatgcaaggagtaagatttctgatcaggagctgagagacaagatccatggatatcttgttgatgagaagaatgcttctgagaaagcggaagctttgtccaagtttctccagctgattaagtatgtgagtggtccttatgattctgaggacgggttcaaaaggctagaaaaggcaatctccgagcacgaaatctcgaaaaagacctctgaaggatcttcgaggagattgttttatcttgctctccctccctctgtataccctcctgtatgcaagatgatcaaggcatggtgcactaacacatctgatcttggtggatggacacgtgtcgtcgttgagaagccatttggaaaggacttggaatctgcagagcagcttagttcccagattggagcactgtttgatgagcctcagatttaccgtattgatcattacctgggaaaggaactagtccaaaacatgctggtccttaggtttgccaaccggttatttctgccgctatggaaccgtgacaacatagctaacgtccagattgttttcagggaagattttggaactgaaggccgtgggggatactttgatgaatacggaatcatccgtgatattattcaaaaccacttgctccaggttctttgccttgttgcaatggagaaaccagtctctcttaaacctgagcacatccgtgatgagaaagtgaaggttcttcaatcagtgatgcctataaaagatgaagaggtggttcttggacagtacgaaggttatagagatgatccaactgttccaaacgactcaaacactccaacctttgccacaacaattcttcgcatagacaatgaaagatgggaaggtgttccgtttatactgaaagccggaaaggcaatgagttcaaagaaggcagatattcggattcagtttaaggatgttcctggcgacatattcaaatgtcaaaagcaagggaggaacgagtttgtcatacgcttgcaaccttcggaggccatgtacatgaagctaactgtgaagcaaccgggtctagagatgcaaaccgtgcagagtgaactagacctatcttacaagcaacgttaccaagatgtcccgattccagaggcttacgagcgcctcattctcgacacaatcaaaggtgaccagcaacactttgttcgcagagatgagctgaaggcagcttgggaaatcttcactccactacttcacaggataggtaacggagaagtgaaatcgatcccatacaaaccaggaagccgagggccaacggaagcagatcagctgctagagaaaactggttatttgcagacccatggctacatatggatccctcctacgctgtaaacaaggagatgataatgagtgcactgcacatgaaataagagctcctctgtttttgttttcttgttttcttttccaaaaaaaaaaaaaaa

SEQ ID NO: 70286 - protein, 516 aa, Brassica napus
MDSGQWHVEKRSTLRNESFLKEYGPVSETGSLSIVVLGASGDLAKKKTFPALFNLYHQGFLNPDEVHIFGYARSKISDQELRDKIHGYLVDEKNASEKAEALSKFLQLIKYVSGPYDSEDGFKRLEKAISEHEISKKTSEGSSRRLFYLALPPSVYPPVCKMIKAWCTNTSDLGGWTRVVVEKPFGKDLESAEQLSSQIGALFDEPQIYRIDHYLGKELVQNMLVLRFANRLFLPLWNRDNIANVQIVFREDFGTEGRGGYFDEYGIIRDIIQNHLLQVLCLVAMEKPVSLKPEHIRDEKVKVLQSVMPIKDEEVVLGQYEGYRDDPTVPNDSNTPTFATTILRIDNERWEGVPFILKAGKAMSSKKADIRIQFKDVPGDIFKCQKQGRNEFVIRLQPSEAMYMKLTVKQPGLEMQTVQSELDLSYKQRYQDVPIPEAYERLILDTIKGDQQHFVRRDELKAAWEIFTPLLHRIGNGEVKSIPYKPGSRGPTEADQLLEKTGYLQTHGYIWIPPTL

SEQ ID NO: 70287 - DNA, 2034 bp, Brassica napus
  CDS (85)..(1797)
atcatgacagcctcacaaatgataagcagaggcaatcaaaatcacatatgaattttttgaagaaaattaatctaatatctctccatggcgacgcatactatgatcgttcgttcctcatcctctgctctcgctgcttcgtctccattaacagagactctaccactcttcactactagatctctcacattcccgagaaaatcctccttctctcgtcttcgcttgagattctttgccgaaaaactttctcagctcgactcctctaatcgctgtgcctctttacaagactctggagaacatcttacagaggagcatgacacaaaagaagagtcatccactcttagtattacagtggttggagcctctggagatttggccaataagaaaatattccctgcattgtttgctctcttttacgagggttgtcttcctcaggacttctctgtttttggttatgctcggaccaaactcacccatgaggagcttcgtgtcatgatcagtagaactttaacttgtcggatagaccaaagggagaactgtgtggacaaaatggatcagttcttaaagagatgcttttaccattcgggtcagtataactctgaagatgattttgcagaactaaacaccaagctcaaagagaaagaggaaggaaagctatcaaacaggctgtactatttgtcaattccaccaaacatattcgtggatgtggtaaggtgtgcaagccttagagcctcctcagtgaatggctggacaagagtcattgtcgaaaagccattcggtcgcgactctgaatcatctggagagttaaccagatgtcttaaacagtatctcacagaggagcaaatcttcaggatcgaccactatttgggaaaagaactcgttgagaacctttcagtgcttcgattctcaaatcttgttttcgagcctctttggtctagaaattacatacgcaacgttcaactcattttctctgaagactttggtacagaaggacgcggaggttactttgatcaatatggaatcatacgagacatcatgcaaaaccatctcttgcaaattcttgcacttttcgcaatggagacacctgtgagcttagacgctgaggacataaggagcgaaaaggtcaaagttctgaggtcaatgaaaccgttgctgcttcaagatatgattgtgggtcagtacaaaggtcatagcaagggtggaaaggcttatcctggttatacggacgacccaacagttcccacaaacagtctcactcctacatttgctgcagccgctatgttcatcaacaacgcgagatgggacggtgtccctttccttatgaaagctggaaaagctctgcataccagaggtgcagagatcagagttcagttcagacatgtcccggggaacttgtacaagaagaatttcgccactgatttagacaaggcaactaatgagctagtgatcagagttcaacctgatgaaggtatatacctgaggatcaacaacaaagtccctggtctcggaatgagactcgaccgaagcgaccttaaccttctctatcggtccaggtatccaagagagatcccagatgcatatgaaaggctgcttcttgatgctattgaaggagaaaggaggttgtttataagaagtgatgagttagatgcagcatgggatctattcacaccggctttgaaggagctcgagcacaagaaaatagttcctgagctatatccatatgggagcagaggtcctgttggcgctcattaccttgcatctaagtacaatgtgagatggggagatcttgaagatgcttaagcttttgacggaatcatggatatcaaattgatttggtgttaatttgggacgagctaactcttccatgtgttgtgagcttttacaacttttatcaaattcatcattacataggtttttttttgggccaaaaactatgtgtgatttcaactagtacatacattttgttcaaggaccgatgaccaaatgttagaattttatagttaactaggaaaaaaaaaaaataaaaaaaaaaaaaaa

SEQ ID NO: 70288 - protein, 570 aa, Brassica napus
MATHTMIVRSSSSALAASSPLTETLPLFTTRSLTFPRKSSFSRLRLRFFAEKLSQLDSSNRCASLQDSGEHLTEEHDTKEESSTLSITVVGASGDLANKKIFPALFALFYEGCLPQDFSVFGYARTKLTHEELRVMISRTLTCRIDQRENCVDKMDQFLKRCFYHSGQYNSEDDFAELNTKLKEKEEGKLSNRLYYLSIPPNIFVDVVRCASLRASSVNGWTRVIVEKPFGRDSESSGELTRCLKQYLTEEQIFRIDHYLGKELVENLSVLRFSNLVFEPLWSRNYIRNVQLIFSEDFGTEGRGGYFDQYGIIRDIMQNHLLQILALFAMETPVSLDAEDIRSEKVKVLRSMKPLLLQDMIVGQYKGHSKGGKAYPGYTDDPTVPTNSLTPTFAAAAMFINNARWDGVPFLMKAGKALHTRGAEIRVQFRHVPGNLYKKNFATDLDKATNELVIRVQPDEGIYLRINNKVPGLGMRLDRSDLNLLYRSRYPREIPDAYERLLLDAIEGERRLFIRSDELDAAWDLFTPALKELEHKKIVPELYPYGSRGPVGAHYLASKYNVRWGDLEDA

SEQ ID NO: 70289 - DNA, 2094 bp, Hordeum vulgare
  CDS (41)..(1909)
cgggatacggcggactgagaaagaagcgctaaccccgagcatggttacgacagtcctcgccgtggcggcttcagcagctccagcgccgcctccgtcgttggctgcgcgcttcagcccggttgcaggacctgctgtcggttttagagcgcattgttggattactgccaagatgaagctccacaaggccctggggaggcatggatggcaagtccagagaaagctggatattcgaggggatggtaaaattcctgactacttcgaggttgcatggcggactggaaatataactcgtcggaatgtacaacctgctggtgaaactggaggtgaaacggcaaatacaagctctgttatgtcagataactcgatcgatgacaaaggtttattgcatctgggactcaacaactctgaagctgatcgtcctgtactagaggaagaccttgttctgtttgataactttaatgaccaacctgaaagtgtaccatctctttgcattgctgtcattggagctactggcgaactggcaagaagtaaagtcttcccagcactatttgctctgtattacagtggttttcttcctcagaatgttgccatatttggatattctagaaagacattggcagacgaggatttaagatccatgattgaatccaatttgacctgtcgggtagatcaccacgaaaactgtgaagacaagttaaatgaattccttaaaaggacatactatgtcgatgcaggacacgataataaagatgggatggcgaaactaaatttgagaatgacacagatagagggcacttgtgcagcaaacaggatattctaccttgctgttccccaagaggcacttcttgatgtggcattgccattatctgacattgcccaaactaagcatggctggaataggataattatcgagaaaccatttggcttcactagtttgtcctcacaacgggtaacacagtctttgttgtcaagatttgaagagaagcaaatttaccgaattgatcatcttttggggaaggatctaattgaaaatctcactgtcttgagattttctaatttggtgtttgaaccattatggagtaggaagtacatacgtaatgtgcaggtcgttttttcagaagaaacatcaacagaaacacaagggaggtacttcggaaactatgggataatccgtgatatagtgcacagccacattcttcaaacgatagcactatttgctatggaaccacctgtaagtcttgatggggaggatatccgcgatgagaaggtgaaggtgctcagatcaattagaaaagtggacattgatgatgtcgtccttggtcaactcaaaaatacctgtggtaaagttgaccaatatacaaaatcaatgacacctacctacttggctgccgcaatgtacattgacaatgcacgttgggatggggtaccttttttgatcaagactggaatgggacttatggagaatagagctgagattcgtattcaatttcatcacgtccctggcaatatctaccgtgaacgttttggtcatgacatagatcttgacacaaatgagctggttttacgtgacctacccgaagaagccattctcttgaaagtcaacaataaggtcccgggtcttgggctccagttggatgcttcagagctcaacctactttacagagacaggtacgatgttgaagttccagattcatatgagcatcttcttttggatgttctagatggcgatagtcatctgttcatgcgaagtgatgaattagctgctgcatggagcgtgttggcgccaatactccatgagatcgaccagaagagggttgctcctgagctctacgaggctggggataaaggaccgattaatgcttactatctcgctgctaaacatggagtccgatgggatgatggctgctgagcggatgcttgggagctgctcaatgtatttcgcttccttctctctatgtagcaaaatctgtttggtaagaaatagagagaaaaaaagtgtttcttgcttgttgattcaaacccttccaaggtggatcaaagctactactccctccatcccaaaataaatgtctcaacattaaaaaaaaaaaaaaa

SEQ ID NO: 70290 - protein, 622 aa, Hordeum vulgare
MVTTVLAVAASAAPAPPPSLAARFSPVAGPAVGFRAHCWITAKMKLHKALGRHGWQVQRKLDIRGDGKIPDYFEVAWRTGNITRRNVQPAGETGGETANTSSVMSDNSIDDKGLLHLGLNNSEADRPVLEEDLVLFDNFNDQPESVPSLCIAVIGATGELARSKVFPALFALYYSGFLPQNVAIFGYSRKTLADEDLRSMIESNLTCRVDHHENCEDKLNEFLKRTYYVDAGHDNKDGMAKLNLRMTQIEGTCAANRIFYLAVPQEALLDVALPLSDIAQTKHGWNRIIIEKPFGFTSLSSQRVTQSLLSRFEEKQIYRIDHLLGKDLIENLTVLRFSNLVFEPLWSRKYIRNVQVVFSEETSTETQGRYFGNYGIIRDIVHSHILQTIALFAMEPPVSLDGEDIRDEKVKVLRSIRKVDIDDVVLGQLKNTCGKVDQYTKSMTPTYLAAAMYIDNARWDGVPFLIKTGMGLMENRAEIRIQFHHVPGNIYRERFGHDIDLDTNELVLRDLPEEAILLKVNNKVPGLGLQLDASELNLLYRDRYDVEVPDSYEHLLLDVLDGDSHLFMRSDELAAAWSVLAPILHEIDQKRVAPELYEAGDKGPINAYYLAAKHGVRWDDGC

SEQ ID NO: 70291 - DNA, 1640 bp, Brassica napus; identical to SEQ ID NO: 70115
  CDS (45)..(1496)

SEQ ID NO: 70292 - protein, 483 aa, Brassica napus; identical to SEQ ID NO: 70116

SEQ ID NO: 70293 - DNA, 2318 bp, Glycine max; identical to SEQ ID NO: 70117
  CDS (128)..(2110)

SEQ ID NO: 70294 - protein, 660 aa, Glycine max; identical to SEQ ID NO: 70118

SEQ ID NO: 70295 - DNA, 1771 bp, Glycine max; identical to SEQ ID NO: 70119
  CDS (278)..(1501)

SEQ ID NO: 70296 - protein, 407 aa, Glycine max; identical to SEQ ID NO: 70120

SEQ ID NO: 70297 - DNA, 1574 bp, Linum usitatissimum; identical to SEQ ID NO: 70113
  CDS (96)..(1547)

SEQ ID NO: 70298 - protein, 483 aa, Linum usitatissimum; identical to SEQ ID NO: 70114

SEQ ID NO: 70299 - DNA, 1279 bp, Brassica napus; identical to SEQ ID NO: 70193
  CDS (43)..(1119)

SEQ ID NO: 70300 - protein, 358 aa, Brassica napus; identical to SEQ ID NO: 70194

SEQ ID NO: 70301 - DNA, 1222 bp, Brassica napus; identical to SEQ ID NO: 70181
  CDS (45)..(1070)

SEQ ID NO: 70302 - protein, 341 aa, Brassica napus; identical to SEQ ID NO: 70182

SEQ ID NO: 70303 - DNA, 1319 bp, Brassica napus; identical to SEQ ID NO: 70183
  CDS (104)..(1126)

SEQ ID NO: 70304 - protein, 340 aa, Brassica napus; identical to SEQ ID NO: 70184

SEQ ID NO: 70305 - DNA, 1320 bp, Brassica napus; identical to SEQ ID NO: 70185
  CDS (61)..(1092)

SEQ ID NO: 70306 - protein, 343 aa, Brassica napus; identical to SEQ ID NO: 70186

SEQ ID NO: 70307 - DNA, 1522 bp, Brassica napus; identical to SEQ ID NO: 70187
  CDS (89)..(1285)

SEQ ID NO: 70308 - protein, 398 aa, Brassica napus; identical to SEQ ID NO: 70188

SEQ ID NO: 70309 - DNA, 1459 bp, Brassica napus; identical to SEQ ID NO: 70189
  CDS (178)..(1239)

SEQ ID NO: 70310 - protein, 353 aa, Brassica napus; identical to SEQ ID NO: 70190

SEQ ID NO: 70311 - DNA, 1297 bp, Glycine max; identical to SEQ ID NO: 70191
  CDS (56)..(1093)

SEQ ID NO: 70312 - protein, 345 aa, Glycine max; identical to SEQ ID NO: 70192

SEQ ID NO: 70313 - DNA, 1744 bp, Triticum aestivum; identical to SEQ ID NO: 70195
  CDS (126)..(1310)

SEQ ID NO: 70314 - protein, 394 aa, Triticum aestivum; identical to SEQ ID NO: 70196

SEQ ID NO: 70315 - DNA, 1448 bp, Zea mays; identical to SEQ ID NO: 70197
  CDS (204)..(1388)

SEQ ID NO: 70316 - protein, 394 aa, Zea mays; identical to SEQ ID NO: 70198

SEQ ID NO: 70317 - DNA, 1358 bp, Glycine max; identical to SEQ ID NO: 70199
  CDS (68)..(1138)

SEQ ID NO: 70318 - protein, 356 aa, Glycine max; identical to SEQ ID NO: 70200

SEQ ID NO: 70319 - DNA, 1858 bp, Glycine max; identical to SEQ ID NO: 70201
  CDS (317)..(1546)

SEQ ID NO: 70320 - protein, 409 aa, Glycine max; identical to SEQ ID NO: 70202

SEQ ID NO: 70321 - DNA, 1545 bp, Triticum aestivum; identical to SEQ ID NO: 70203
  CDS (160)..(1236)

SEQ ID NO: 70322 - protein, 358 aa, Triticum aestivum; identical to SEQ ID NO: 70204

SEQ ID NO: 70323 - DNA, 1322 bp, Hordeum vulgare; identical to SEQ ID NO: 70179
  CDS (14)..(1051)

SEQ ID NO: 70324 - protein, 345 aa, Hordeum vulgare; identical to SEQ ID NO: 70180

SEQ ID NO: 70325 - DNA, 1335 bp, Hordeum vulgare; identical to SEQ ID NO: 70205
  CDS (38)..(1114)

SEQ ID NO: 70326 - protein, 358 aa, Hordeum vulgare; identical to SEQ ID NO: 70206

SEQ ID NO: 70327 - DNA, 1574 bp, Zea mays
  CDS (30)..(1301)
gaattcccgggtcgacggttggttcgggaatggcgcaggcggtggtgccggcgatgcagtgccgggtcggagtgaaggcggcggcggggagggtgtggagcgccggcaggactaggaccggccgcggcggcgcctcgccggggttcaaggtcatggccgtcagcacgggcagcaccggggtggtgccgcgcctcgagcagctgctcaacatggacaccacgccctacaccgacaaggtcatcgccgagtacatctgggtcggaggatctggaatcgacatccgaagcaaatcaaggacgatttcgaaacccgtggaggatccctcggaactaccaaaatggaactacgatggatctagcacaggacaagccccgggagaagacagtgaagtcattctatacccccaggctatcttcaaggacccattccgaggtggcaacaacgttttggttatctgtgacacctacacgccacaggaggaaccccttccaactaacaaacgccacagggctgcgcaaattttcagtgacccaaaggtcgctgaacaagtgccatggtttggcatagagcaagagtacactttgctccagaaagatgtaaattggcctcttggttggcctgttggaggcttccctggtccccagggtccatactactgtgccgtaggagccgacaaatcatttggccgtgacatatcagatgctcactacaaggcatgcctctacgctggaatcaacattagtggaacaaacggggaggtcatgcctggtcagtgggagtaccaagttggacctagtgttggtattgaagcaggagatcacatatggatttcgagatacattctcgagagaatcacagagcaagctggggttgtccttacccttgatccaaaaccaattcagggtgactggaacggagctggctgccacacaaattacagcacaaagaccatgcgcgaagacggcgggtttgaagagatcaagagagcaatcctgaacctttctctgcgccatgatctgcatattagtgcatacggagaaggaaatgaaagaagactgactgggaaacatgagactgcgagcatcggaacgttctcatggggtgtggcaaaccgcggctgctctatccgtgtggggcgggataccgaggcaaaagggaaaggttacctggaagaccgtcggccggcatcaaacatggacccgtacattgtgacggggctactggccgagaccacgatcctctggcagccatccctcgaggcggaggctcttgccgccaagaagctggcgctgaaggtgtgaagcagctgaaggatggttcaggcaccaatataaaccggtccgcgacaagattgatctttgtgtccatggcgtgggtcttgcgactctctgctcggcggtgccactctgtacaaaatcacggctgtctttgattcatcggatattcggatacgtttgtttgttactttttgcttggacacccaccatgtttggaacttttttgggctccgtttgggggctgaacgatggtcagtggaaattttaaaaattcgtcgtcccaaaaaaaaaaaaaaa

SEQ ID NO: 70328 - protein, 423 aa, Zea mays
MAQAVVPAMQCRVGVKAAAGRVWSAGRTRTGRGGASPGFKVMAVSTGSTGVVPRLEQLLNMDTTPYTDKVIAEYIWVGGSGIDIRSKSRTISKPVEDPSELPKWNYDGSSTGQAPGEDSEVILYPQAIFKDPFRGGNNVLVICDTYTPQEEPLPTNKRHRAAQIFSDPKVAEQVPWFGIEQEYTLLQKDVNWPLGWPVGGFPGPQGPYYCAVGADKSFGRDISDAHYKACLYAGINISGTNGEVMPGQWEYQVGPSVGIEAGDHIWISRYILERITEQAGVVLTLDPKPIQGDWNGAGCHTNYSTKTMREDGGFEEIKRAILNLSLRHDLHISAYGEGNERRLTGKHETASIGTFSWGVANRGCSIRVGRDTEAKGKGYLEDRRPASNMDPYIVTGLLAETTILWQPSLEAEALAAKKLALKV

SEQ ID NO: 70329 - DNA, 1371 bp, Brassica napus
  CDS (89)..(1159)
gaattcccgggtcgacagcgaagtttattcgattttatctgtcatttgcttcagctgttactatcgaccaatctcggtgttcgtagccatgagtcttcttacagatctcgttaaccttaacctctcagagaccactgacaaaatcattgcggaatacatatgggttggaggttcaggaatggatatgagaagcaaagccaggactcttcctggaccagtgagtgacccttcggagctaccaaagtggaactatgatggctcaagcacaggccaagctcctggtgaagacagtgaagtcatcttataccctcaagccatattcaaagatcctttccgtagaggcaacaacattcttgtcatgtgcgatgcttacactccagcgggcgaaccaatcccaacaaacaaaagacacgctgcggctaaggtctttagccaccctgatgttgtagctgaagtgccatggtatggtattgagcaagagtacactttacttcagaaagatgtgaagtggcctgttggttggcctattggtggcttccccggtcctcagggaccatactattgtagtgttggagcagataaatcttttggtagagacattgttgatgctcattacaaggcctgcttatacgctggcatcaccattagtggcatcaatggagaagtcatgccgggtcagtgggagttccaagttggtccagctgttggtatctcggccggtgatgaaatttgggtcgcacgttacattttggagaggatcacagaggttgctggtgtggtggtatcttttgacccaaaacctattcccggtgactggaatggtgctggtgctcactgcaactatagtaccaagtcaatgagggaagatggtggttacgagattatcaagaaggcaatcgataaactgggaatgagacacaaggaacacattgctgcttatggtgaaggcaatgagcgtcgtctcacgggtcatcacgagactgctgacatcaacactttcctctggggtgttgcgaatcgtggagcatcaatccgtgtaggacgcgacacagagaaagaagggaaaggatactttgaggataggaggccagcttcgaacatggatccttacattgtgacttccatgattgcagagaccacaatcctctggaaaccttgatcagatcaaagaagattgttgaagaatgttcactccatttgggtttcttgcatggttcaacgtttgtatgtttctctatcaagcattgtctcagaacaaagtcaagagatttgctctgttcttatggcttttattgtttcacatccattgaaaacatctctttgtatcaatttatgaataaagtgtggtttggttctaaaaaaaaaaaaaaa

SEQ ID NO: 70330 - protein, 356 aa, Brassica napus
MSLLTDLVNLNLSETTDKIIAEYIWVGGSGMDMRSKARTLPGPVSDPSELPKWNYDGSSTGQAPGEDSEVILYPQAIFKDPFRRGNNILVMCDAYTPAGEPIPTNKRHAAAKVFSHPDVVAEVPWYGIEQEYTLLQKDVKWPVGWPIGGFPGPQGPYYCSVGADKSFGRDIVDAHYKACLYAGITISGINGEVMPGQWEFQVGPAVGISAGDEIWVARYILERITEVAGVVVSFDPKPIPGDWNGAGAHCNYSTKSMREDGGYEIIKKAIDKLGMRHKEHIAAYGEGNERRLTGHHETADINTFLWGVANRGASIRVGRDTEKEGKGYFEDRRPASNMDPYIVTSMIAETTILWKP

SEQ ID NO: 70331 - DNA, 1317 bp, Brassica napus
  CDS (43)..(1107)
ctaaacaacactgattgattatctttctctcgtgacggcgccatgtctctcctctcagatctcgtcaacctcaacctctctgactccaccgagaaaatcatagccgaatacatatggatcggtggatctggaatggacatcagaagcaaagccagaacactcccaggaccagtgagcgatccatcaaagcttcctaagtggaactacgacggatccagcaccggtcaagccgccggagatgacagtgaagtcattctataccctcaggcgatattccgtgatccgttcaggaaaggcaacaacattctggtgatgtgtgatgcttacacgccggcagggaatccaattccgaccaacaagaggcacaacgctgctaagatcttcagcaaccccaaagttgcctctgaggagccttggtatgggattgaacaagaatacacattgatgcaaaagggtgtgaactggcccattggttggcctatcggtggcttccctggcccacagggaccatactactgtggtgtgggagctgacaaagccattggtcgtgacatcgtggatgcgcactacaaggcctgtatttacgcaggtattggcatctctggtgtcaatggagaagtcatgcctggccagtgggagttccaagtcggtcctgttgagggtattagtgctggtgaccaagtctgggtcgctagataccttcttgagaggatcaccgagatctctggtgtcaatgtcagcttcgaccctaagccagtcccgggtgattggaacggagctggagctcactgcaactacagcacgaagtcgatgaggaacgacggaggattagctgtgattaagaaagccatagagaagcttcaggtgaagcacaaggagcacattgctgcttacggtgaaggcaacgagcgtcgcctcacggggaagcacgagaccgcggacatcaacacgttctcttggggagtggcgaaccgtggagcttcggtgagagtgggacgtgacactgagaaagaaggcaaaggttacttcgaggacagaaggccagcttctaacatggatccttacgttgttacttccatgattgctgaaaccaccatcctcggttaaaatcgcacacgttcttatgtttgggtttatcttatctggtctggttttcaatttgcaaacttgtgcttgtgattgccggtttatctcggtttaaataattcttatgacgacattttgtattttttttcttcctagtttcgaataattaaataaggtattcatatggtgaaaaaagtctatcagcgacttttgtgcaaaaaaaaaaaaaaa

SEQ ID NO: 70332 - protein, 354 aa, Brassica napus
MSLLSDLVNLNLSDSTEKIIAEYIWIGGSGMDIRSKARTLPGPVSDPSKLPKWNYDGSSTGQAAGDDSEVILYPQAIFRDPFRKGNNILVMCDAYTPAGNPIPTNKRHNAAKIFSNPKVASEEPWYGIEQEYTLMQKGVNWPIGWPIGGFPGPQGPYYCGVGADKAIGRDIVDAHYKACIYAGIGISGVNGEVMPGQWEFQVGPVEGISAGDQVWVARYLLERITEISGVNVSFDPKPVPGDWNGAGAHCNYSTKSMRNDGGLAVIKKAIEKLQVKHKEHIAAYGEGNERRLTGKHETADINTFSWGVANRGASVRVGRDTEKEGKGYFEDRRPASNMDPYVVTSMIAETTILG

SEQ ID NO: 70333 - DNA, 1589 bp, Glycine max
  CDS (320)..(1390)
atttccggggtttcagttatagcataaacttcactttatttcttttttataaaaagaaaaccatagattatcactatcttatatcttattccgggtctcaagattcaactgtgaggaagaaaaaggtctccaaacacatagaagcacgtgtatgtatgtattgtgcaagtcatagtattcaacgttaacaccactgactcacttataaaaggcgctttaacaccaaacggagtctccctatcaaaaaaagctacctagagcttgcacctattggtatcttctacaatatcctaaagtgtttttcttcttcttcatcaccatgtctttactttcagacctcatcaacctcaatctctcagaatccacagaaaagatcattgctgagtacatatgggttggtggatctggtatggacctcagaagcaaagccaggactcttcctgggccagtgagtgaccctgcaaaacttccgaagtggaactatgatgggtctagcacagatcaagctccaggggatgacagtgaagtcattttatacccacaagctattttcaaggacccctttaggagaggaaacaatattcttgtcatttgtgatgtgtacaccccagctggtgagccacttccaaccaacaacaggtatggtgctgccaaaattttcagtcaccctgatgttgctgctgaggaaccatggtatggtattgagcaagagtataccttattgcagaaagatgtaaattggccacttgggtggccacttggcgggtttcctggaccacagggcccatactactgtggaattggtgctgataaagcctatggccgtgatattgtagatgcacattacaaagcttgtatttatgctggcattaacattagtggcatcaatggagaggttatgcctggccagtgggaatttcaagttggtccttctgttggtatctctgctggagatgaggtgtgggctgctcgctacattttggagaggattacagagatagctggagcaattgtttcatttgatcccaagcctattccgggagattggaatggagctggagctcactcaaactacagcaccaagtccatgagagaagagggtggttatgaggtgatcaagaaggccattgaaaagcttggattgaggcacaaggagcacatcgcagcatatggagaaggcaacgagagacgtctcacgggaagacatgaaactgcagacatcaacaccttctcttggggtgtggcaaaccgtggaagctccattagagttggaagagacacagagaaaaatggcaaaggttacttcgaggacagaaggcctgcttctaatatggatccctatgtagtcacctccatgatcgcagagactaccatcctctggaaaccatgaaaacacagtcatatgtctctagatttggaccacttaaaattgtgtgttcaatagtcatttgatctaaaattttatatttgcaaggtgttgtttagttaggaattgccaagtggtcttttgagcctccatgtaccatgtgtatggtagagaataatctcgtcattaataacaagaattgcttcttaaaaaaaaaaaaaaa

SEQ ID NO: 70334 - protein, 356 aa, Glycine max
MSLLSDLINLNLSESTEKIIAEYIWVGGSGMDLRSKARTLPGPVSDPAKLPKWNYDGSSTDQAPGDDSEVILYPQAIFKDPFRRGNNILVICDVYTPAGEPLPTNNRYGAAKIFSHPDVAAEEPWYGIEQEYTLLQKDVNWPLGWPLGGFPGPQGPYYCGIGADKAYGRDIVDAHYKACIYAGINISGINGEVMPGQWEFQVGPSVGISAGDEVWAARYILERITEIAGAIVSFDPKPIPGDWNGAGAHSNYSTKSMREEGGYEVIKKAIEKLGLRHKEHIAAYGEGNERRLTGRHETADINTFSWGVANRGSSIRVGRDTEKNGKGYFEDRRPASNMDPYVVTSMIAETTILWKP

SEQ ID NO: 70335 - DNA, 821 bp, Triticum aestivum
  CDS (57)..(560)
ctcatcatcgtcttccccccattgccattccctccttgcgagtagtagcagcagcaatggccagcctcgccgacctcgtcaacctcgacctcagcgactgcaccgacaagatcatcgtcgagtacctctgggttggaggatccggtatcgacatcaggagcaaagcaaggacggtgaacggccccatcaccgacgcgagccagctgcccaagtggaactacgacggctccagcaccggccaggctcccggagaggacagcgaagtcatcctctacccccaggccattttcaaggacccgttcaggaggggtgacaacctccttgttatgtgcgactgctacacaccacaaggtgttccaatccccactaacaagaggcacaatgctgccaagatcttcaacaccttcaagtggggcgtggctgaccgcggcgcgtccatccgcgtggggcgcgacacggagaaggacggcaagggctacttcgaggaccgcaggccggcctccaacatggacccctacgtcgtcacctccatgatcgccgagaccaccctcctcctctgagccagcagcagatgacacacgcacacgctttcttcctctacctcggagtgagagagggcgacgatgaatttctttctgcaaaacgtctcctgtttccatttcttttgcaaggtctagtctgtttttggggcgtgcctttcgtgtctttcactttactcgttcagataagagtcttccgtgtactctgaaaataatgttcttctttccgcattccgataaatgaaatcatggaaccggttgtgattcaaaaaaaaaaaaaaa

SEQ ID NO: 70336 - protein, 167 aa, Triticum aestivum
MASLADLVNLDLSDCTDKIIVEYLWVGGSGIDIRSKARTVNGPITDASQLPKWNYDGSSTGQAPGEDSEVILYPQAIFKDPFRRGDNLLVMCDCYTPQGVPIPTNKRHNAAKIFNTFKWGVADRGASIRVGRDTEKDGKGYFEDRRPASNMDPYVVTSMIAETTLLL

SEQ ID NO: 70337 - DNA, 1397 bp, Triticum aestivum
  CDS (62)..(1126)
gctgcacacctcatctcatatcattgccattccctccttgcgagtagcaccggcagcagcaatggccagcctcgccgacctcgtcaacctcgacctcagcgactgcaccgacaagatcatcgtcgagtacctctggattggaggatccggtatcgacatcaggagcaaagcaaggacggtgaacggccccatcacggacgcgagccagctgcccaagtggaactacgacggctccagcaccggccaggctcccggagaggacagcgaagtcatcctctacccccaggccattttcaaggacccgttcaggaggggcgacaacctccttgttatgtgtgactgctacacaccacaaggtgtgccaatccccaccaacaagaggcacaatgccgccaagatcttcaacacccccaaggttgcagctgaggagacatggtatggaattgagcaggagtacactctcctccagaaggacgtgaactggcctcttggctggcccattggtggctaccctggtcctcagggaccatactactgcgccgccggcgccgacaaggcgttcgggcgtgacatcgtggacgcccactacaaggcgtgcctctacgccgggatcaacatcagcggcatcaacggggaggtcatgcccggccagtgggagttccaagtcgggccgtccgtcgggatcgccgcctcagaccagctgtgggtggcgcgctacatcctcgagaggatcacggaggttgccggggtggtgctgtccctggacccgaagccgatcccgggcgactggaacggcgccggcgcgcacaccaactacagcaccaagtcgatgcgggaggccggcgggtacggcgtgatcaagacggccatcgagaagctgggcaagcggcacgcgcagcacatcgccgcctacggcgagggcaacgagcgccgcctcacgggccaccacgagaccgccgacatcaacaccttcaagtggggcgtggcggaccgcggcgcgtccatccgcgtgggccgcgacacggagaaggacggcaagggctacttcgaggaccgcaggccggcctccaacatggacccctacgtcgtcacctccatgatcgccgagaccaccctcctcctctgagctctgagcgaccagcagccaatgcctaccacaccgccggacgacacttaggctctcgaccttctcgatcgagggtggccattgattgatttctgcaaaatgtttcgtgttttccgtttcttttgcaaggtctagcctgttttgggggcgtgtctttcactttactcgttcagataagagtaagagtcctcagtgtgctctgaaaataatgttgtttcctcattcccataaatgaaatcatggaaccttgtgatggaaaaaaaaaaaaaaa

SEQ ID NO: 70338 - protein, 354 aa, Triticum aestivum
MASLADLVNLDLSDCTDKIIVEYLWIGGSGIDIRSKARTVNGPITDASQLPKWNYDGSSTGQAPGEDSEVILYPQAIFKDPFRRGDNLLVMCDCYTPQGVPIPTNKRHNAAKIFNTPKVAAEETWYGIEQEYTLLQKDVNWPLGWPIGGYPGPQGPYYCAAGADKAFGRDIVDAHYKACLYAGINISGINGEVMPGQWEFQVGPSVGIAASDQLWVARYILERITEVAGVVLSLDPKPIPGDWNGAGAHTNYSTKSMREAGGYGVIKTAIEKLGKRHAQHIAAYGEGNERRLTGHHETADINTFKWGVADRGASIRVGRDTEKDGKGYFEDRRPASNMDPYVVTSMIAETTLLL

SEQ ID NO: 70339 - DNA, 1326 bp, Zea mays
  CDS (17)..(1213)
ctgcctactacgagtgatggccagcctcactgacctcgtcaacctcgacctgagtgactgcacagacaggatcatcgccgagtacatctgggttggaggatccggcatagacctcaggagcaaagcaaggacggtgaaaggccccatcaccgatccgagccagctgccaaaatggaactacgacggctccagcaccgggcaggctcccggagaggacagcgaagtcatcctctaccctcaagccattttcaaggacccgttcaggaagggtaacaacatccttgtgatgtgtgactgctacacgccacaaggcgagccaatccccagtaacaagaggtacaaagctgccacggttttcagccaccccgatgttgcagctgaggtgccatggtacggtattgagcaggagtacactctccttcagaaggatgtgagctggccccttggctggcctgttggtggataccctggtcctcaggcaagagatcgatccttcttcaacttttatcgattgcatgcgagttatctgttggcggaagaggcagggctttgcaaagttatcaactgttcggtgtattttttatttatttatttttggcagggaccatactactgtgctgccggtgccgataaggcctttgggcgcgacgtggttgacgcccactacaaagcctgcctctacgccggcatcaacatcagcggcatcaacggcgaagtcatgcctggacagtgggagttccaagtcgggccgtccgttgggatctctgccggcgacgagatatgggtcgcccgctacattctcgagaggatcactgagatggccgggatcgttctctccctcgacccgaagccgatcaagggtgactggaacggcgccggcgctcacaccaactacagcaccaagtcgatgagggaggccggtggctacgaggtgatcaaggaggcgatcgagaagctggggaggaggcacagggagcacatcgccgcgtacggcgagggcaacgagcgccgcctcacgggccgccacgagaccgccgacatcaacaccttcaaatggggcgtggcgaaccgcggcgcgtccatccgcgtcggccgcgacaccgagaaggagggcaagggatacttcgaggaccgcaggccggcttccaacatggacccctacgtcgtcaccggcatgatcgccgacaccaccatcctgtggaagggaaactgataaaaccactgttcttctcctgcacgcatgcatccgccccgtgctgtcactttttgtttttcaaatttcgattcccgtcctaaagtttgttaccacttaaaaaaaaaaaaaaa

SEQ ID NO: 70340 - protein, 398 aa, Zea mays
MASLTDLVNLDLSDCTDRIIAEYIWVGGSGIDLRSKARTVKGPITDPSQLPKWNYDGSSTGQAPGEDSEVILYPQAIFKDPFRKGNNILVMCDCYTPQGEPIPSNKRYKAATVFSHPDVAAEVPWYGIEQEYTLLQKDVSWPLGWPVGGYPGPQARDRSFFNFYRLHASYLLAEEAGLCKVINCSVYFLFIYFWQGPYYCAAGADKAFGRDVVDAHYKACLYAGINISGINGEVMPGQWEFQVGPSVGISAGDEIWVARYILERITEMAGIVLSLDPKPIKGDWNGAGAHTNYSTKSMREAGGYEVIKEAIEKLGRRHREHIAAYGEGNERRLTGRHETADINTFKWGVANRGASIRVGRDTEKEGKGYFEDRRPASNMDPYVVTGMIADTTILWKGN

SEQ ID NO: 70341 - DNA, 1363 bp, Triticum aestivum
  CDS (16)..(1080)
cgagtagcagcagcaatggccagcctcgccgacctcgtcaacctcgacctcagcgactgcaccgacaagatcatcgtcgagtacctctgggttggaggatccggtatcgacatcaggagcaaagcaaggacggtgaacggccccatcaccgacgcgagccagctgcccaagtggaactacgacggctccagcaccggccaggctcccggagaggacagcgaagtcatcctctacccccaggccattttcaaggacccgttcaggaggggtgacaacctccttgttatgtgcgactgctacacaccccaaggtgtgccaatccccacgaacaagaggcacaacgctgccaagatcttcaacaccccgaaggttgcagctgaggagacatggtatggaattgagcaggagtacactctcctccagaaggacgtgaactggcctcttggctggcccattggtggctaccctggtccgcagggaccatactactgcgccgccggcgcggacaaggcgttcgggcgtgacatcgtggacgcccactacaaggcctgcctctacgccgggatcaacatcagcggcatcaacggggaggtcatgcccggccagtgggagttccaagttgggccgtccgtcgggatcgcggcgtccgaccagctgtgggtggcgcgctacatcctcgagaggatcactgaggttgccggggtggtgctgtccctggacccgaagccgatcccgggcgactggaacggcgcgggcgcgcacaccaactacagcaccaagtcgatgcgggaggccggcgggtacgaggtgatcaagacggccatcgagaagctgggcaagcggcacgcgcagcacatcgccgcctacggcgagggcaacgagcgccgcctcacgggccaccacgagaccgccgacatcaacaccttcaagtggggcgtggcggaccgcggcgcgtccgtccgcgtgggccgcgacaccgagaaggacggcaagggctacttcgaggaccgcaggccggcctccaacatggacccctacgtcgtcacctccatgatcgccgagaccacgctcctcctctgagccacccacccacggccatgcctaccgccgccagatcatgacacccaggctctcgactctctcgatcgagggtggcgattgattaatttctgcaaaacgtttcgtgtttccatttcttttgcaaggtctagtctgtttttggggcgtgcctttggtgtctttcactttactcgttcagataagagtaagagtcttcagtctactctgaaaataatgttgttttcgcattccgataaatgaaatcatggagccggttatgattctgtccaaaaaaaaaaaaaaa

SEQ ID NO: 70342 - protein, 354 aa, Triticum aestivum
MASLADLVNLDLSDCTDKIIVEYLWVGGSGIDIRSKARTVNGPITDASQLPKWNYDGSSTGQAPGEDSEVILYPQAIFKDPFRRGDNLLVMCDCYTPQGVPIPTNKRHNAAKIFNTPKVAAEETWYGIEQEYTLLQKDVNWPLGWPIGGYPGPQGPYYCAAGADKAFGRDIVDAHYKACLYAGINISGINGEVMPGQWEFQVGPSVGIAASDQLWVARYILERITEVAGVVLSLDPKPIPGDWNGAGAHTNYSTKSMREAGGYEVIKTAIEKLGKRHAQHIAAYGEGNERRLTGHHETADINTFKWGVADRGASVRVGRDTEKDGKGYFEDRRPASNMDPYVVTSMIAETTLLL

SEQ ID NO: 70343 - DNA, 1483 bp, Glycine max
  CDS (109)..(1179)
gaattcccgggtcgacttcgctgtcgacgatttcgtaatctcagaattctctaaaagagatctttttctgctctttgaagaaagaagggtctttgcttgattttggagatgtctctgctctcagatctcatcaaccttaacctctccgataccaccgagaaggtgatcgcagagtacatatggatcggtggatcaggaatggacctgaggagcaaagcaaggactctcccaggaccagttagcgacccttcagagcttcccaagtggaactatgatggttccagcacaggtcaagctcctggtgaagacagtgaagtgattttatacccacaagccattttcagggatccattcagaaggggtaacaatatcttggttatctgtgatgcctacactcctgctggagaacctattcccactaacaagaggcacgctgctgccaaggttttcagccatcctgatgttgttgctgaagtgccatggtacggtattgaacaagaatacaccttgttgcagaaagatatccaatggcctcttgggtggcctgttggtggtttccctggacctcagggtccatactactgtggtgttggcgctgacaaggcttttggccgtgacattgttgacgcacactacaaagcctgtatttatgctggcatcaacatcagtggaattaatggagaagtgatgcccggtcagtgggaattccaagttggaccttcagttggaatctcagctggtgatgagatttgggcagctcgttacatcttggagaggatcactgagattgctggtgtggtggtttcctttgaccccaagccaattaagggtgattggaatggtgctggtgctcacacaaactacagcaccaagtccatgagagaagatggtggctatgaagtgatcaaagcagcaattgacaagttggggaagaagcacaaggagcacattgctgcttatggagaaggcaacgaacgtcgtttgacaggacgccacgaaaccgctgacatcaacaccttcttatggggagttgcaaaccgtggagcttctgttagggttgggagagacacagagaaagcagggaagggatattttgaggacagaaggccagcttccaacatggacccatacgtggttacttccatgattgcagacacaaccattctgtggaagccatgagcaaaacctgcatgttttctccctttggatggaaaggaacagttatgcttttcttagtaggatttggtctctctctctttttaccttttgattggtactatggttggtgccttgttggttggtgcaactaactggcaagggttgttcattgttttcttctattcctttccctcgttttccgattgttacaatgacaataatttaatagttattatcagtcttgaacaaagaaatgctgattgtgaagtataataataatatatgaaattgtcatgttcattggagtaggaaaaaaaaaaaaaaa

SEQ ID NO: 70344 - protein, 356 aa, Glycine max; identical to SEQ ID NO: 21308

SEQ ID NO: 70345 - DNA, 1801 bp, Triticum aestivum
  CDS (351)..(1634)
gaattcccgggtcgacttcgctgtcgacgatttcgtgccttctttggacggttttttgcctccggtgcagctgcaagggccgcctcaaatctcgtccacccagagccctatcgcctaatcaagagccagatgccactgcccgcgccgcggccactagaatctcccccgcaatctaaattacttataccaccggcctccgcttccataaataatatttccagcgcgatctcgcaaggtcgttccgccccccttccctccctcctctcctccctcgtctcgtccccgtcgttgtctctccgctagcgctgaaggggaaggcggcggagtaagtaggtaagcacgcagcggcgatggcgcaggcggtggtgccggcgatgcagtgccaggtgggcgtgcggggcaggtcggccgtcccggcgaggcagcccgcgggcagggtgtggggcgtcaggaggaccgcccgcgccgcctccggcttcaaggtgctcgccctcggcccggagaccaccggcgtcatccagaggatgcagcagctactcgacatggacaccacgcccttcaccgacaagatcatcgccgagtacatctgggttggaggatctggaattgacctcagaagcaaatcaaggacgatttcgaagccagtggaggacccgtcagagctaccgaaatggaactacgatggatcgagcacaggccaggctcctggagaagacagtgaagtcatcctatacccacaggccatattcaaggacccattccgaggaggcaacaacatactggttatctgtgacacctacacaccacaaggggaacccatccctactaacaaacgacacatggctgcacaaatcttcagtgaccccaaggtcacttcacaagtgccatggtttggaatcgaacaggagtacactctgatgcagagggatgtgaactggcctcttggctggcctgttggagggtaccctggcccccagggtccatactactgcgccgtaggatcagacaagtcatttggccgtgacatttcagatgctcactacaaggcatgcctttacgccggaattgaaatcagtggaacaaacggggaggtcatgcctggtcagtgggagtaccaggttggacccagcgttggtattgatgcaggagatcacatatgggcttcaagatacattctcgagagaatcacggagcaagctggtgtcgtgctcacccttgacccaaaaccaatccagggtgactggaatggagctggctgccacacaaattacagcacattgagcatgcgtgaggatggaggtttcgacgtgatcaagaaggcaatcctgaacctttcacttcgccatgacttgcacatagccgcatatggtgaaggaaacgaacggaggttgacagggctacatgagacagctagcatatcagacttctcatggggtgtcgcgaatcgtggctgctctattcgtgtggggcgagagactgaggcaaagggcaaaggatacctggaggaccgtcgcccggcctcgaacatggacccatacaccgtgacggcgctgctggccgagaccacgatcctgtgggagccgaccctcgaggcagaggccctcgctgccaagaagctggcgctgaaggtatgaaggacctgaaaaggccgaattcttccggggaaaagaaaataaatcggcgagaccgttggccgtccattcttgttgatcctgtggttccgtcggggcactgtctgtacaaaatcctcacagtttgtagaaccacttcgcatgttttttcgcgtaaaaaaaaaaaaaaa

SEQ ID NO: 70346 - protein, 427 aa, Triticum aestivum
MAQAVVPAMQCQVGVRGRSAVPARQPAGRVWGVRRTARAASGFKVLALGPETTGVIQRMQQLLDMDTTPFTDKIIAEYIWVGGSGIDLRSKSRTISKPVEDPSELPKWNYDGSSTGQAPGEDSEVILYPQAIFKDPFRGGNNILVICDTYTPQGEPIPTNKRHMAAQIFSDPKVTSQVPWFGIEQEYTLMQRDVNWPLGWPVGGYPGPQGPYYCAVGSDKSFGRDISDAHYKACLYAGIEISGTNGEVMPGQWEYQVGPSVGIDAGDHIWASRYILERITEQAGVVLTLDPKPIQGDWNGAGCHTNYSTLSMREDGGFDVIKKAILNLSLRHDLHIAAYGEGNERRLTGLHETASISDFSWGVANRGCSIRVGRETEAKGKGYLEDRRPASNMDPYTVTALLAETTILWEPTLEAEALAAKKLALKV

SEQ ID NO: 70347 - DNA, 1302 bp, Linum usitatissimum
  CDS (53)..(1162)
ttcagttttcggtgtcaacctccagcttacagaagagaggaaaataaatcaaatgtcgtccagtaatcttctctccgatctcatcaacctcaaccttcccgaggacaaggttattgcagagtacatatgggttggcgggtctgggatggatatccggagcaaagccaggacactgtctggagccgtgaccgacccttcaaagctacccaagtggacgtacgatggttccagcactggccaagctgcaggggatgacagcgaagtcctactatttccacaggcaattttcaaggacccattcaggaggggaaacaacatcctggtgatgtgcgatgcttacactcccgccggagacccaattcagaccaacaagagatttccggcagcgaagatattgagccgtcctgaagtggaagctgaggagccatggtttggcatagagcaggaatacactctgcttcagaaacacgtcgattggcctctcggctggcccatcggtggttaccctgcccctcaggggaaatactactgcggtgtgggggctgacaaggcgtacggaagggatatagtggaagcacatttcaaagcttgcctttatgcggggatcaatatcagtggcatcaatggcgaagtcatgcctggccagtgggaattccaaatagggccttcagttggcatttcagcagcagatgagctatgggtggctcgctatatcctccagaggattggggagattgatggagtggtggtttcattcgatccaaagcctgttcaggggaattggaatggagctggtgcacacacaaattacagcaccaagtcgatgaggaaggagggaggatacgagaaggtgatgaaggaagcaatagagaagctgagaatgaggcatgaagaacatgtggcatcatacggggaagggaacgtacgtaggctaacaggaagccacgagacagcggacataaacagcttctcgtggggagtggggacacgaggagcgtcgatacgagtggggaagaagacggagaaggaagggaaaggatatttagaagatagaaggccgtcttctaacatggacccttacctcgtcatttccatgatcgctggaactactcttctctgggaaccacctcttactactcctccccctccatcatcttcttaattatcttcctcttgatcaatgtctctgtttttatatacttcgtatttgtcatgtttgggttactctgttattcggttgttgaagtaaagggttaaattcctaatatgtcatgacattttagagctaaaaaaaaaaaaaaa

SEQ ID NO: 70348 - protein, 369 aa, Linum usitatissimum
MSSSNLLSDLINLNLPEDKVIAEYIWVGGSGMDIRSKARTLSGAVTDPSKLPKWTYDGSSTGQAAGDDSEVLLFPQAIFKDPFRRGNNILVMCDAYTPAGDPIQTNKRFPAAKILSRPEVEAEEPWFGIEQEYTLLQKHVDWPLGWPIGGYPAPQGKYYCGVGADKAYGRDIVEAHFKACLYAGINISGINGEVMPGQWEFQIGPSVGISAADELWVARYILQRIGEIDGVVVSFDPKPVQGNWNGAGAHTNYSTKSMRKEGGYEKVMKEAIEKLRMRHEEHVASYGEGNVRRLTGSHETADINSFSWGVGTRGASIRVGKKTEKEGKGYLEDRRPSSNMDPYLVISMIAGTTLLWEPPLTTPPPPSSS

SEQ ID NO: 70349 - DNA, 1528 bp, Zea mays
  CDS (112)..(1182)
gaattcccgggtcgacttcgctgtcgacgatttcgtcccctccttcctccttgggttcccagcccgtgcgccccgcctgtcgcagtcgcagtcgcgccgcagccgccggccatggcctgcctcaccgacctcgtcaacctcaacctctcggacaccacagagaagatcatcgccgagtacatatggatcggtggatctggcatggatctcaggagcaaagccaggaccctcccgggcccggtaaccgatcccagcaagctgcccaagtggaactacgacggctccagcaccggccaggcccccggcgaggacagcgaggtcatcctgtacccgcaggccatcttcaaggacccattcaggaggggcaacaacatccttgtcatgtgcgattgctacaccccagctggcgagccaattcccaccaacaagaggtacagcgccgccaagatcttcagcagccctgaggtcgctgccgaggagccctggtatggtatcgagcaggagtacaccctccttcagaaggacaccaactggcccctcgggtggcctattggcggcttccctggccctcagggtccttactactgtggaatcggcgcggagaaatcgttcgggcgtgacatagtcgacgcccactacaaggcatgcctgtacgcaggcatcaacatcagtggcatcaacggggaggtcatgccggggcagtgggagttccaggtcggaccgtccgtcggcatctcttcgggcgatcaggtgtgggttgctcgctacattcttgagaggatcaccgagatcgccggcgtggtggtgacgttcgacccgaagccgatcccgggcgactggaacggcgcgggcgcccacaccaactacagcaccgagtccatgaggaaggagggcgggtacgaggtgatcaaggcggccatcgagaagctgaagctgcggcacaaggagcacatcgcggcctacggcgagggcaacgagcgccggctcaccggcaggcacgagaccgccgacatcaacaccttcagctggggagtcgccaaccgtggcgcgtcggtgcgcgtgggtcgcgagacggagcagaacggcaagggctacttcgaggaccgccggccggcgtccaacatggatccctacgtggtcacctccatgatcgccgagaccaccatcgtctggaagccctgaggcatcccgtggccgtgtcgtgtcggtttgctccgcgtacggcgctggccgttgcatcgcagggcccagcggttgcgcaactattttcccttccccgttctgtttgcttgtactactactctaccgctagtcctgcatagcattttagctagaacacaacaacagcccaaaaaaaaacattgttgcttgcttcggcttcgacgcttcccaccacttccattccatgccgtccgtccgcttccttcctgtgtaatcctcctccaataatagacgtgtcatgctgcatcctctgcattgtataaaagtggcgtaattcttttgctacgcctccaaaaaaaaaaaaaaa

SEQ ID NO: 70350 - protein, 356 aa, Zea mays
MACLTDLVNLNLSDTTEKIIAEYIWIGGSGMDLRSKARTLPGPVTDPSKLPKWNYDGSSTGQAPGEDSEVILYPQAIFKDPFRRGNNILVMCDCYTPAGEPIPTNKRYSAAKIFSSPEVAAEEPWYGIEQEYTLLQKDTNWPLGWPIGGFPGPQGPYYCGIGAEKSFGRDIVDAHYKACLYAGINISGINGEVMPGQWEFQVGPSVGISSGDQVWVARYILERITEIAGVVVTFDPKPIPGDWNGAGAHTNYSTESMRKEGGYEVIKAAIEKLKLRHKEHIAAYGEGNERRLTGRHETADINTFSWGVANRGASVRVGRETEQNGKGYFEDRRPASNMDPYVVTSMIAETTIVWKP

SEQ ID NO: 70351 - DNA, 66 bp, Escherichia coli
  CDS (1)..(66)
atgaaacgcattagcaccaccattaccaccaccatcaccattaccacaggtaacggtgcgggctga

SEQ ID NO: 70352 - protein, 21 aa, Escherichia coli [sequence omitted]

SEQ ID NO: 70353 - DNA, 20 bp, Artificial sequence
  primer
atgaaacgcattagcaccac

SEQ ID NO: 70354 - DNA, 23 bp, Artificial sequence
  primer
ttagcccgcaccgttacctgtgg

SEQ ID NO: 70355 - DNA, 2463 bp, Escherichia coli
  CDS (1)..(2463)
atgcgagtgttgaagttcggcggtacatcagtggcaaatgcagaacgttttctgcgtgttgccgatattctggaaagcaatgccaggcaggggcaggtggccaccgtcctctctgcccccgccaaaatcaccaaccacctggtggcgatgattgaaaaaaccattagcggccaggatgctttacccaatatcagcgatgccgaacgtatttttgccgaacttttgacgggactcgccgccgcccagccggggttcccgctggcgcaattgaaaactttcgtcgatcaggaatttgcccaaataaaacatgtcctgcatggcattagtttgttggggcagtgcccggatagcatcaacgctgcgctgatttgccgtggcgagaaaatgtcgatcgccattatggccggcgtattagaagcgcgcggtcacaacgttactgttatcgatccggtcgaaaaactgctggcagtggggcattacctcgaatctaccgtcgatattgctgagtccacccgccgtattgcggcaagccgcattccggctgatcacatggtgctgatggcaggtttcaccgccggtaatgaaaaaggcgaactggtggtgcttggacgcaacggttccgactactctgctgcggtgctggctgcctgtttacgcgccgattgttgcgagatttggacggacgttgacggggtctatacctgcgacccgcgtcaggtgcccgatgcgaggttgttgaagtcgatgtcctaccaggaagcgatggagctttcctacttcggcgctaaagttcttcacccccgcaccattacccccatcgcccagttccagatcccttgcctgattaaaaataccggaaatcctcaagcaccaggtacgctcattggtgccagccgtgatgaagacgaattaccggtcaagggcatttccaatctgaataacatggcaatgttcagcgtttctggtccggggatgaaagggatggtcggcatggcggcgcgcgtctttgcagcgatgtcacgcgcccgtatttccgtggtgctgattacgcaatcatcttccgaatacagcatcagtttctgcgttccacaaagcgactgtgtgcgagctgaacgggcaatgcaggaagagttctacctggaactgaaagaaggcttactggagccgctggcagtgacggaacggctggccattatctcggtggtaggtgatggtatgcgcaccttgcgtgggatctcggcgaaattctttgccgcactggcccgcgccaatatcaacattgtcgccattgctcagggatcttctgaacgctcaatctctgtcgtggtaaataacgatgatgcgaccactggcgtgcgcgttactcatcagatgctgttcaataccgatcaggttatcgaagtgtttgtgattggcgtcggtggcgttggcggtgcgctgctggagcaactgaagcgtcagcaaagctggctgaagaataaacatatcgacttacgtgtctgcggtgttgccaactcgaaggctctgctcaccaatgtacatggccttaatctggaaaactggcaggaagaactggcgcaagccaaagagccgtttaatctcgggcgcttaattcgcctcgtgaaagaatatcatctgctgaacccggtcattgttgactgcacttccagccaggcagtggcggatcaatatgccgacttcctgcgcgaaggtttccacgttgtcacgccgaacaaaaaggccaacacctcgtcgatggattactaccatcagttgcgttatgcggcggaaaaatcgcggcgtaaattcctctatgacaccaacgttggggctggattaccggttattgagaacctgcaaaatctgctcaatgcaggtgatgaattgatgaagttctccggcattctttctggttcgctttcttatatcttcggcaagttagacgaaggcatgagtttctccgaggcgaccacgctggcgcgggaaatgggttataccgaaccggacccgcgagatgatctttctggtatggatgtggcgcgtaaactattgattctcgctcgtgaaacgggacgtgaactggagctggcggatattgaaattgaacctgtgctgcccgcagagtttaacgccgagggtgatgttgccgcttttatggcgaatctgtcacaactcgacgatctctttgccgcgcgcgtggcgaaggcccgtgatgaaggaaaagttttgcgctatgttggcaatattgatgaagatggcgtctgccgcgtgaagattgccgaagtggatggtaatgatccgctgttcaaagtgaaaaatggcgaaaacgccctggccttctatagccactattatcagccgctgccgttggtactgcgcggatatggtgcgggcaatgacgttacagctgccggtgtctttgctgatctgctacgtaccctctcatggaagttaggagtctga

SEQ ID NO: 70356 - protein, 820 aa, Escherichia coli
MRVLKFGGTSVANAERFLRVADILESNARQGQVATVLSAPAKITNHLVAMIEKTISGQDALPNISDAERIFAELLTGLAAAQPGFPLAQLKTFVDQEFAQIKHVLHGISLLGQCPDSINAALICRGEKMSIAIMAGVLEARGHNVTVIDPVEKLLAVGHYLESTVDIAESTRRIAASRIPADHMVLMAGFTAGNEKGELVVLGRNGSDYSAAVLAACLRADCCEIWTDVDGVYTCDPRQVPDARLLKSMSYQEAMELSYFGAKVLHPRTITPIAQFQIPCLIKNTGNPQAPGTLIGASRDEDELPVKGISNLNNMAMFSVSGPGMKGMVGMAARVFAAMSRARISVVLITQSSSEYSISFCVPQSDCVRAERAMQEEFYLELKEGLLEPLAVTERLAIISVVGDGMRTLRGISAKFFAALARANINIVAIAQGSSERSISVVVNNDDATTGVRVTHQMLFNTDQVIEVFVIGVGGVGGALLEQLKRQQSWLKNKHIDLRVCGVANSKALLTNVHGLNLENWQEELAQAKEPFNLGRLIRLVKEYHLLNPVIVDCTSSQAVADQYADFLREGFHVVTPNKKANTSSMDYYHQLRYAAEKSRRKFLYDTNVGAGLPVIENLQNLLNAGDELMKFSGILSGSLSYIFGKLDEGMSFSEATTLAREMGYTEPDPRDDLSGMDVARKLLILARETGRELELADIEIEPVLPAEFNAEGDVAAFMANLSQLDDLFAARVAKARDEGKVLRYVGNIDEDGVCRVKIAEVDGNDPLFKVKNGENALAFYSHYYQPLPLVLRGYGAGNDVTAAGVFADLLRTLSWKLGV

SEQ ID NO: 70357 - DNA, 2736 bp, Arabidopsis thaliana
  CDS (1)..(2736)
atgccggtggtttctctggctaaggttgttacttctccggcggtggccggagatttagcggttcgtgttccgttcatttatgggaaacgactagtgtcgaatcgtgtttctttcgggaaattgaggcgccggagttgtataggtcaatgcgtaagaagcgaattgcaaagtcctcgtgtcttaggttccgtcacagatttagcgttggataattctgtggagaatggtcatcttcccaaaggagattcatgggctgtacacaaatttggaggaacttgtgtgggaaattctgagaggataaaggatgttgctgctgttgttgttaaggatgactctgagaggaagttggtggttgtgtcagcaatgtcgaaagtcactgatatgatgtatgatctcattcacagagcagagtctcgtgatgattcatatctgtctgctttgagtggtgttcttgaaaagcaccgagcaactgctgttgacttgcttgatggagatgaactctcaagtttcttggctcggttaaatgatgatataaataatctcaaagcaatgcttcgtgccatttacatagctggtcatgcaaccgaatctttctcagacttcgttgttggccacggagagttgtggtctgctcagatgttagctgctgttgtgagaaagagcggattggactgcacttggatggatgcaagggatgtgcttgttgttattccaacgagctctaatcaagttgaccctgactttgtggaatcagaaaaaagactggaaaaatggtttactcagaactcggcaaagattattatagcaactggtttcatagccagtacaccacagaacattccaacgactcttaaaagggatgggagtgacttctctgcagctataatgagtgctctgtttagatctcaccaactcacaatctggacagatgttgatggtgtgtacagtgcagatcccaggaaagttagtgaagctgttgtgctgaagactctttcttatcaagaggcttgggaaatgtcttactttggggcaaacgttttacatcctcggaccattattccagtgatgaaatatgacattccaattgtaataaggaatattttcaacctctctgcccctggaacaatgatatgccggcagattgatgatgaagatggattcaaattagacgctcctgtgaaaggatttgcgacgattgacaatttggctcttgtcaatgtagaaggaactggaatggctggtgttcctggtactgccagtgccattttttctgctgtcaaggaagttggagccaatgtgattatgatatcgcaggctagtagcgagcattctgtgtgctttgctgtacctgagaaggaagtgaaagctgtttctgaagcattgaactcaagatttcgtcaagctttggctggtggccgcctttcccagattgaaatcatccctaattgtagcatattagcagcagttggccagaaaatggcgagcactcctggtgtttctgccactttttttaatgcattagcaaaggccaatatcaacatccgtgctatagcccaaggttgctccgagttcaatattacagtagtcgtcaagcgtgaagactgcatcagggcattaagagctgtgcactcaagattttacctttcgagaaccactttggcagtgggaatcataggaccgggattaattggtggaaccttacttgatcagattagagatcaggcggcagtgctcaaagaagaatttaaaattgacttgcgtgttatagggatcacgggctcaagtaaaatgttgatgagtgaatcggggattgacttatcaagatggagagagcttatgaaagaagagggagaaaaagctgacatggagaagttcacccaatatgtgaagggaaatcatttcatcccaaactctgttatggttgattgtacagccgatgctgacatcgctagctgttactacgactggttgctacgaggaattcatgtggtcactccgaacaaaaaggctaactctggaccacttgatcagtatctaaagatcagagatcttcaacgaaaatcgtacacacattacttttatgaagccaccgttggagctggtcttccaattattagcaccttacgtggtctcctcgaaacaggggataaaatactgcgaattgagggaattttcagtggtactttaagttacctcttcaacaactttgtcggcaccagaagcttcagtgaagttgtagcagaagcaaagcaagcaggtttcacagaaccagatccacgagatgatctatctggaacagatgttgccagaaaagtaacaatccttgccagagaatcaggcttaaaattggatcttgagggccttccagtccagaatcttgtgccaaagccgttacaagcttgtgcatcagcagaagagttcatggagaagcttcctcagtttgatgaagaattatccaaacaaagagaagaggctgaagcagcaggagaagtcttgagatacgtaggagttgtagatgcagtagagaaaaagggaacagtcgagttgaaacggtacaaaaaagatcatccgtttgctcagctatcgggtgctgataacatcatcgctttcacaaccaaacggtacaaagaacagcctctgattgttcgtggacctggtgctggtgctcaagtcacagccggtggaatcttcagtgacattcttcgccttgctttctatctcggggctccgtcttaa

SEQ ID NO: 70358 - protein, 911 aa, Arabidopsis thaliana
MPVVSLAKVVTSPAVAGDLAVRVPFIYGKRLVSNRVSFGKLRRRSCIGQCVRSELQSPRVLGSVTDLALDNSVENGHLPKGDSWAVHKFGGTCVGNSERIKDVAAVVVKDDSERKLVVVSAMSKVTDMMYDLIHRAESRDDSYLSALSGVLEKHRATAVDLLDGDELSSFLARLNDDINNLKAMLRAIYIAGHATESFSDFVVGHGELWSAQMLAAVVRKSGLDCTWMDARDVLVVIPTSSNQVDPDFVESEKRLEKWFTQNSAKIIIATGFIASTPQNIPTTLKRDGSDFSAAIMSALFRSHQLTIWTDVDGVYSADPRKVSEAVVLKTLSYQEAWEMSYFGANVLHPRTIIPVMKYDIPIVIRNIFNLSAPGTMICRQIDDEDGFKLDAPVKGFATIDNLALVNVEGTGMAGVPGTASAIFSAVKEVGANVIMISQASSEHSVCFAVPEKEVKAVSEALNSRFRQALAGGRLSQIEIIPNCSILAAVGQKMASTPGVSATFFNALAKANINIRAIAQGCSEFNITVVVKREDCIRALRAVHSRFYLSRTTLAVGIIGPGLIGGTLLDQIRDQAAVLKEEFKIDLRVIGITGSSKMLMSESGIDLSRWRELMKEEGEKADMEKFTQYVKGNHFIPNSVMVDCTADADIASCYYDWLLRGIHVVTPNKKANSGPLDQYLKIRDLQRKSYTHYFYEATVGAGLPIISTLRGLLETGDKILRIEGIFSGTLSYLFNNFVGTRSFSEVVAEAKQAGFTEPDPRDDLSGTDVARKVTILARESGLKLDLEGLPVQNLVPKPLQACASAEEFMEKLPQFDEELSKQREEAEAAGEVLRYVGVVDAVEKKGTVELKRYKKDHPFAQLSGADNIIAFTTKRYKEQPLIVRGPGAGAQVTAGGIFSDILRLAFYLGAPS

SEQ ID NO: 70359 - DNA, 2478 bp, Vibrio cholerae O1 biovar eltor str. N16961
  CDS (1)..(2478): transl_table=11
atgcatttggaggaagggatgcgagtattaaagtttggaggttcatcgctggcggatccggagcgttttctacgcgctgccgatatcatcgcgaataacgcacagcaggaagaggtggccgttgtcctctctgctccgggaaaaaccaccaataaattggtggcagtgattgaaagtgctttacgtcagggagaggtggaagcgcaaatcgtagagctagagagctcattctatgccttgcttgatggcattaaagcgcagctcccgaatttggatgacagtgcttatcaacagcaagtgcactcttccatgactcagttacgccagtttgtgcatggcattacgttgctcggtatgtgtccagacaatgtgaatgcacgcattatcagtaaaggtgaacgcgtttccattcaattgatgaaagcggtgatggaagccaaaggtctgccagcgaatttggttgaccccgttaaatacctgcttgccaaaggggatcatcttgaagctatggtcgatgtggaaatctcgactcagcgtttcagacaagcaccattgccacaacagcacgtcaatatcatgccgggctttactgcgggtaatgcacagggtgagttggtctgtttagggcgtaacggttcggattactcagccgcagtactggctgcctgtttacgtgcggattgttgtgaaatctggacggatgtggatggagtttataactgcgatccgcgtttggtcgatgatgcgcgtcttttgaaatcccttagctatcaagaggcgatggagctttcttacttcggagcatctgtgttgcatccgaagaccattgcaccgattgctcaatttcaaatcccttgcctgatcaaaaacagcttcaatccacaaggtgcgggcaccttgattggccaagacactggcgaagataaactcgcgatcaaaggcattaccactctgagcaatctgaccatggtcaacgtttctggtccaggaatgaaaggcatggtggggatggcgagccgcgtgtttggcgcgatgtcagcggcagatgtgtcgatcgtgctcattactcaatcttcttcggaatacagcatcagtttctgtatcgaagcacaacataaagctttggcacagcaagcgctggcggatgcatttgaactggaactcaaagatggcctgcttgagccggttgagtttgtcgataacgtcgccatcatcacgctggttggtgatggtatgcgtacctctcgcggtgtcgcgtcgcaatttttctcatctctggccgaagtacacgtcaacgtgattgcgattgcccaaggctcttctgagcgtgcgatttcagcggtgatccccgatgataagatttcagaagcgatcaaggcctgtcacgaaaacctcttcaactctaaacactttttagatgtgtttgtggtcggtgttggtggcgtgggcggtgagttggtggatcaaattcagcgtcaacaagccaagcttgcggaaaaaggcatcatgatgcgcgtttgtggcctcgctaacagtaaaggcatgctgcttgatagccaaggcttgccgttagagcagtggcgcgatcgtatgatcaatgcggatcaagcgttcagtttagagaatctggtggctttggtgcagcgtaatcacatcattaacccagtattggtggattgcacgtccagtgatgagattgctaaccagtatgcggatttcctcgccgcgggtttccatgtggtgaccccgaacaagaaagccaataccgctagcatgagttattaccatcagctacgtaatgtggctcgtcattcgcgtcgcaaactgatgtatgaaactacagttggcgcgggtctacccgttatcgaaaacttgcaaaacctaattgcagcaggggatgagctggaaaaattcagcggtattctctcaggttctctctcctttatcttcggtaaattggatgaaggcatgaccttgagccaagcaacgcagcttgctaaagagaaaggctttacagagccagatccgcgcgatgatctctctggtatggatgtggcgcgcaagttactgattttggcgcgtgaagcagggtacgaattggagctgagcgatgtggatgttgaacaagcactgcccgctggctttgatgcttcaggcagtgttgaggagttcatggctcgtttagcgcaagccgatgccgcgtttgccgagcgagtggcgcaagccaaagccgaaggcaaagtgcttcgctatgtggcgcaaatcgtcgatggccagtgccaagtgcggattgtcgcggttgatgaaaacgatcctatgttcaaagtcaaagaaggtgaaaacgcgctggctttctacagccgttactatcagccaatcccattggtattacgtggttacggcgcgggttctgaagtgactgctgcaggcgtgttctcagatgtgatgcgtacactcggttggaaattaggggtttaa

SEQ ID NO: 70360 - protein, 825 aa, Vibrio cholerae O1 biovar eltor str. N16961
MHLEEGMRVLKFGGSSLADPERFLRAADIIANNAQQEEVAVVLSAPGKTTNKLVAVIESALRQGEVEAQIVELESSFYALLDGIKAQLPNLDDSAYQQQVHSSMTQLRQFVHGITLLGMCPDNVNARIISKGERVSIQLMKAVMEAKGLPANLVDPVKYLLAKGDHLEAMVDVEISTQRFRQAPLPQQHVNIMPGFTAGNAQGELVCLGRNGSDYSAAVLAACLRADCCEIWTDVDGVYNCDPRLVDDARLLKSLSYQEAMELSYFGASVLHPKTIAPIAQFQIPCLIKNSFNPQGAGTLIGQDTGEDKLAIKGITTLSNLTMVNVSGPGMKGMVGMASRVFGAMSAADVSIVLITQSSSEYSISFCIEAQHKALAQQALADAFELELKDGLLEPVEFVDNVAIITLVGDGMRTSRGVASQFFSSLAEVHVNVIAIAQGSSERAISAVIPDDKISEAIKACHENLFNSKHFLDVFVVGVGGVGGELVDQIQRQQAKLAEKGIMMRVCGLANSKGMLLDSQGLPLEQWRDRMINADQAFSLENLVALVQRNHIINPVLVDCTSSDEIANQYADFLAAGFHVVTPNKKANTASMSYYHQLRNVARHSRRKLMYETTVGAGLPVIENLQNLIAAGDELEKFSGILSGSLSFIFGKLDEGMTLSQATQLAKEKGFTEPDPRDDLSGMDVARKLLILAREAGYELELSDVDVEQALPAGFDASGSVEEFMARLAQADAAFAERVAQAKAEGKVLRYVAQIVDGQCQVRIVAVDENDPMFKVKEGENALAFYSRYYQPIPLVLRGYGAGSEVTAAGVFSDVMRTLGWKLGV

SEQ ID NO: 70361 - DNA, 2448 bp, Pasteurella multocida subsp. multocida str. Pm70
  CDS (1)..(2448): transl_table=11
atgcgtgtactaaaattcggggggacgtctttagccaatccagagcgtttttcgcaggcggcacagcttatcgaaaaagcccattttgaagaacaagccgctggcgtgttatcagcccctgcaaaaattaccaaccatcttgtcgccctttctgaaaaagccagtttaaatcaacctaccgatgccaatttcaatgaagctattgagattttttatcacattattcatggtttacacgcagaaaataatcgttttgatctagaagggacaaaagctttaattgataccgagtttgcacaaatcagccagttgttggaagaaattcgtcaacaaggttttgtgtcggatgcggttaaagccacgattgattgtcgtggtgaaaaactgtctattgcgatgatgaaggcatggtttgaagctcgcggttatgacgtgactgtgattgatccagtcgaaaaattattagcacacgggagctatttagagtcttcagtggatattgaagaatcgacaaaacgcgtagatgccaagtcaattccaaccaaaaatgtagtgttaatggcaggctttaccgcaggtaatgaaaaaggtgagctcgttttactcgggcgtaatggttccgattattctgctgcttgtttagccgcttgtttgggcgcaagtgcttgtgaaatttggaccgatgtagatggggtctttacctgtgatccgcgtttggtaccagatgctcgcttattgccaagcttgtcttatcgcgaagcgatggaattgtcttatttcggtgcaaaagtgattcatccacgcacgattggaccattagtacaaactaatattccttgcttaattaaaaatacgggcaatccttctgcaccgggttcgattattgatggcaacattcaatctgaacagttgcaagtaaaagggattactaatttagataatgtggcgatgtttaacgtgtctggtcctgggatgcaggggatggtgggcatggcgtcacgtgttttctctgccatgtcaaatgcaggcgtttcggtgattttaattacgcaatcttcctcggaatacagtatcagtttctgtgtaccagccaaatcagttgaggtagcaaaacaggcgttagagaaagaatttgagcaagaattaaaagctaatgatcttgaaccaattgatgtaattcgtgacttatccattatttcggtagtgggtgatggcatgaaacaagccaaagggattgccgcacgtttcttctcagcccttgcccaagcgaacatcagtattgttgctattgcacagggttcctctgagcgttcaatttctgccgtggttgcactgaataaagcaattgaagccgtgaaagccacacaccaagctctctttaataataaaaaggtcgttgatgtttttttagttggggtagggggtgtcggtggcgagttgattgagcaaattaaacatcagaaaagttatctagccaagaaagatattgaaattcgggtgtgtgcgattgccaattcaaacaaaatgttattaaaagcagatggcttaaatttagaaaattggcaagcagatttggaaaccgcgactcaaccttctgattttgatgtgttactgtcctttattaaattgcaccatgtcgtgaatccggtatttgtggattgtacgtcagcggattctgtagctggtttatatgtgcgtgcactgggagaagggttccatgttgtgacaccaaataaaaaagccaatacgcgtgaactggcgtattataatgcactgcgtgaaagtgcccgtaataaccaacgtaaattcttgtatgatacaaacgttggcgcagggttacccgtcattgaaaacttgcagaatttattggctgcgggtgatgaagtcgtcaagtttagtggcgtactctcggggtcgttgtcctttatctttggcgagttagaaaacggactcacgttatctgaagcgactgctcttgcgcgtgaaaaagggtttactgaacctgatccaagagatgatctttctggacaagatgttgccaggaaactgttgattttagcgcgtgaaaccggtgcacaattggaattaacagatattgaggtagaaagtgtgctcccagcgggatttgctgaagggaagaccacacaggaatttatggcgatgttaccacaattagacgcagaatttagccaacgtgttgctaacgcgaaagcagaagggaaagtattgcgttatgtgggacaaattgaaaacaacagttgtaaagtctctgtgttggaagtcgatgcagatgatccattatataaagtaaaaaatggtgaaaatgcgttagccttctatactcgttattatcaaccgattccgttacttttacgtggttatggcgcgggaaattccgtaactgcagcggggatttttgccgatatattgagaacgctacaacattaa

SEQ ID NO: 70362 - protein, 815 aa, Pasteurella multocida subsp. multocida str. Pm70
MRVLKFGGTSLANPERFSQAAQLIEKAHFEEQAAGVLSAPAKITNHLVALSEKASLNQPTDANFNEAIEIFYHIIHGLHAENNRFDLEGTKALIDTEFAQISQLLEEIRQQGFVSDAVKATIDCRGEKLSIAMMKAWFEARGYDVTVIDPVEKLLAHGSYLESSVDIEESTKRVDAKSIPTKNVVLMAGFTAGNEKGELVLLGRNGSDYSAACLAACLGASACEIWTDVDGVFTCDPRLVPDARLLPSLSYREAMELSYFGAKVIHPRTIGPLVQTNIPCLIKNTGNPSAPGSIIDGNIQSEQLQVKGITNLDNVAMFNVSGPGMQGMVGMASRVFSAMSNAGVSVILITQSSSEYSISFCVPAKSVEVAKQALEKEFEQELKANDLEPIDVIRDLSIISVVGDGMKQAKGIAARFFSALAQANISIVAIAQGSSERSISAVVALNKAIEAVKATHQALFNNKKVVDVFLVGVGGVGGELIEQIKHQKSYLAKKDIEIRVCAIANSNKMLLKADGLNLENWQADLETATQPSDFDVLLSFIKLHHVVNPVFVDCTSADSVAGLYVRALGEGFHVVTPNKKANTRELAYYNALRESARNNQRKFLYDTNVGAGLPVIENLQNLLAAGDEVVKFSGVLSGSLSFIFGELENGLTLSEATALAREKGFTEPDPRDDLSGQDVARKLLILARETGAQLELTDIEVESVLPAGFAEGKTTQEFMAMLPQLDAEFSQRVANAKAEGKVLRYVGQIENNSCKVSVLEVDADDPLYKVKNGENALAFYTRYYQPIPLLLRGYGAGNSVTAAGIFADILRTLQH

SEQ ID NO: 70363 - DNA, 2460 bp, Yersinia pestis CO92
  CDS (1)..(2460): transl_table=11
atgcgagtgctgaaatttggcgggacatcagtggcaaatgccgagcgctttatgcgtgttgccgatatcatcgaaagtaatgcgcgtcagggacaagtggctacggtgttatccgctcccgcgaagataacgaaccatctcgttgccatgatcgataaaatggtcgcagggcaagatatctccccgaacatcagcgatgctgagcggatttttgctgagttattgcgtggattagctgatactcagccaggctttgattatgatcgcctaaaagccttggtcggccatgagtttgcgcaactcaaacacctgctacacggtatttcgttgttggggcagtgcccagacagcattaatgcctcaattatctgccgtggcgaaaaactctccatcgccattatggaggcgttatttcaggctaagggttatcacgttacggtgattaatccagtcgaaaaattgttggcgcagggccattatctcgaatccactgttgatatcacggagtctacccgccgtatcggtgccagcggtattccatctgatcacatcatcctgatggctggttttactgcgggtaatgataaaggtgaattggtggtgttggggcgtaatggctctgattattccgctgccgtgctggctgcttgcttacgggcagattgttgtgagatttggaccgatgtcgacggggtctatacttgtgacccgcgtaccgttccagatgccagattactgaaatcgatgtcataccaagaggcaatggagctttcctattttggtgctaaagttcttcaccctcgcactatcgctcctattgcccgcttccaaattccttgtctgataaaaaacacctctaacccgcaagcccccggtaccttgattggtggtgaaagcattgatgaggattctccggtcaaaggcattaccaacctgaataatatggcgatgattaatgtttcagggccaggaatgaaagggatggtcggtatggctgcccgcgtctttgcggtgatgtcgcgcagcggtatttcagtggtgctaatcactcagtcctcttctgaatacagcatcagtttttgtgtgccgcaaggtgagttattgcgcgcccgccgagcgctggaagatgagttttatctggagttgaaagacggtgtcttggatcctctggatgtgatggaacatctggcaattatctctgtggtcggtgacggtatgcgcaccctgcgcggtatttctgcccgtttcttctcggctctggcgcgcgccaacatcaatattattgctatcgctcaaggctcgtctgagcgctctatttctgtggttgtcaataatgatgcggtcactaccggggtgcgagtttgccaccagatgctgtttaacacggatcaagtcattgaggtgtttgtcattggcgtgggtggtgtggggggcgcattaatcgaacaaatctatcgccagcaaccgtggttgaaacagcgtcatattgatttacgtgtttgtggtatcgcgaattccaaagccatgttgaccaacgtgcatggcattgcattagataactggcgtcaggaactggctgaagttcaggagccgtttaacctgagccgcttgatccgtctggttaaagagtatcacttactgaacccggtcattgttgactgtacctcaagccaggcggttgctgatcaatatgctgatttcctgaccgatggcttccatgtggtgacgccaaacaagaaagccaacacttcatcaatgaattattaccgccaaatgcgtgccgctgcgacgaaatcgtgccgtaaattcttgtatgacacaaacgttggggcggggctaccggtgatcgagaacttacagaacctgctcaatgcgggtgatgaactgatgcgcttcaccggtattctgtccggttcactttccttcatcttcggtaagctagatgaggggatgtcattgtcagaggcaacacggcaagctaaggcgttggggtataccgaacccgatccacgtgatgatctctctgggatggatgttgcccgtaaattgttgattttggcccgtgaagcagggtacaaacttgagttggctgatatcgaggttgagtccgtcttaccagcaagctttgatgcttcaggtgatgtggatactttcctggcgcgcctgccatcattggatgctgaatttacccgcttggtagcgaatgctgcggagcagggcaaagtgctacgttatgtcggagtgattgaagacgggcgttgtaaagtgcggatggaggcagttgacggtaacgacccgttgtataaagttaagaatggcgagaatgcgttggctttctatacccgctattatcagccaattccgttggtgctacgcggttatggcgcaggcaatgatgtgactgccgctggggtgtttgccgatcttttacgcacattatcatggaagttgggagtttaa

SEQ ID NO: 70364 - protein, 819 aa, Yersinia pestis CO92
MRVLKFGGTSVANAERFMRVADIIESNARQGQVATVLSAPAKITNHLVAMIDKMVAGQDISPNISDAERIFAELLRGLADTQPGFDYDRLKALVGHEFAQLKHLLHGISLLGQCPDSINASIICRGEKLSIAIMEALFQAKGYHVTVINPVEKLLAQGHYLESTVDITESTRRIGASGIPSDHIILMAGFTAGNDKGELVVLGRNGSDYSAAVLAACLRADCCEIWTDVDGVYTCDPRTVPDARLLKSMSYQEAMELSYFGAKVLHPRTIAPIARFQIPCLIKNTSNPQAPGTLIGGESIDEDSPVKGITNLNNMAMINVSGPGMKGMVGMAARVFAVMSRSGISVVLITQSSSEYSISFCVPQGELLRARRALEDEFYLELKDGVLDPLDVMEHLAIISVVGDGMRTLRGISARFFSALARANINIIAIAQGSSERSISVVVNNDAVTTGVRVCHQMLFNTDQVIEVFVIGVGGVGGALIEQIYRQQPWLKQRHIDLRVCGIANSKAMLTNVHGIALDNWRQELAEVQEPFNLSRLIRLVKEYHLLNPVIVDCTSSQAVADQYADFLTDGFHVVTPNKKANTSSMNYYRQMRAAATKSCRKFLYDTNVGAGLPVIENLQNLLNAGDELMRFTGILSGSLSFIFGKLDEGMSLSEATRQAKALGYTEPDPRDDLSGMDVARKLLILAREAGYKLELADIEVESVLPASFDASGDVDTFLARLPSLDAEFTRLVANAAEQGKVLRYVGVIEDGRCKVRMEAVDGNDPLYKVKNGENALAFYTRYYQPIPLVLRGYGAGNDVTAAGVFADLLRTLSWKLGV

SEQ ID NO: 70365 - DNA, 2463 bp, Salmonella enterica subsp. enterica serovar Typhi str. CT18
  CDS (1)..(2463): transl_table=11
atgcgagtgttgaagttcggcggtacatcagtggcaaatgcagaacgttttctgcgtgttgccgatattctggaaagcaattccaggcaagggcaggtagcgaccgtactttccgcccccgcgaaaattaccaaccatctggtggcgatgattgaaaaaactatcggcggccaggatgctttgccgaatatcagcgatgccgaacgtattttttctgacctgctcgcaggacttgccagcgcgcagccgggattcccgcttgcacggttgaaaatggttgtcgaacaagaattcgctcagatcaaacatgttttgcatggtatcagcctgctgggtcagtgcccggatagcatcaacgccgcgctgatttgccgtggcgaaaaaatgtcgatcgcgattatggcgggactcctggaggcgcgtggacatcgcgtcacggtgatcgatccggtagaaaaactgctggcggtgggccattaccttgaatctaccgtcgatatcgcggaatcgactcgccgtatcgccgccagccagatcccggccgatcacatgatcctgatggcgggctttactgccggtaatgaaaagggtgaactggtggtgctgggccgtaatggttccgactattccgccgccgtgctggccgcctgtttacgcgctgactgctgtgaaatctggactgacgtcgatggcgtgtatacctgtgacccgcgccaggtgccggacgccaggctgttgaaatcgatgtcctaccaggaagcgatggagctctcttacttcggcgctaaagtccttcaccctcgcaccataacgcctatcgcccagttccagatcccctgtctgattaaaaataccggcaatccgcaggcgccaggaacgctgatcggcgcgtccagcgacgatgataatctgccggttaaagggatctctaaccttaacaacatggcgatgtttagcgtctccggcccgggaatgaaagggatgattgggatggcggcgcgtgttttcgccgccatgtctcgcgccgggatctcggtggtgctcattacccagtcctcctctgagtacagcatcagcttctgtgtgccgcagagtgactgcgcgcgtgcccgccgtgcgatgcaggatgagttctatctggagctgaaagaggggctgctggagccgctggcggttacggagcggttggcgattatctctgttgtcggcgacggtatgcgcacgctacgcggcatttcagcgaaattcttcgccgcgctggcgcgggctaatatcaatatcgtggcgatcgctcagggatcttctgagcgttccatttctgtggtggtgaataacgacgatgccaccaccggcgtgcgggtaacgcaccagatgctgttcaataccgatcaggtgattgaagtgtttgtcattggcgtcggcggcgtcggcggcgcgctactggaacagcttaaacgtcagcaaacctggctgaagaacaagcacatcgatctacgcgtgtgcggcgtggcgaactcaaaggcgttgctaaccaatgtgcatggcctgaatctggacaactggcaggcggaactggcgcaagcgaacgcgccgttcaatctgggacgtttaattcgcctggtgaaagaatatcatctactcaatccggtgattgttgattgtacctccagtcaggcggtggccgaccagtatgccgacttcctgcgcgaagggttccatgtggtgacgccgaacaagaaagcgaacacctcgtcgatggactactaccatcagctacgtttcgccgccgcgcaatcacggcgcaaattcttgtatgacaccaacgtcggcgccggtttgccggtaatcgaaaacctgcaaaacctgctgaatgcgggtgatgaactgcaaaaattttccggcattctttccgggtcgctctcttttattttcggtaaactggaagaggggatgagtctctcacaggcgaccgctctggcgcgcgagatgggctataccgaacccgatccgcgcgacgatctttccggtatggatgtggcgcgtaaactgttgatcctcgcccgcgagacgggccgcgagctggagctttccgatatcgtgattgaaccggtgttgccggacgagtttgacgcctccggcgatgtgaccgcctttatggcgcatctgccgcagcttgacgacgcgtttgccgcccgtgtggcgaaagctcgtgatgaaggtaaggtattgcgctatgtgggcaatatcgaagaggatggcgtgtgccgcgtgaagattgccgaagttgatggtaacgatccgctcttcaaagtgaaaaacggtgaaaacgcgctggcgttctacagccattattatcagcccttgccgttggtgctgcgcggctacggcgcaggcaatgatgtgacggcggcgggcgtgtttgccgatctgttacggaccctctcatggaagttaggagtttaa

SEQ ID NO: 70366 - protein, 820 aa, Salmonella enterica subsp. enterica serovar Typhi str. CT18
MRVLKFGGTSVANAERFLRVADILESNSRQGQVATVLSAPAKITNHLVAMIEKTIGGQDALPNISDAERIFSDLLAGLASAQPGFPLARLKMVVEQEFAQIKHVLHGISLLGQCPDSINAALICRGEKMSIAIMAGLLEARGHRVTVIDPVEKLLAVGHYLESTVDIAESTRRIAASQIPADHMILMAGFTAGNEKGELVVLGRNGSDYSAAVLAACLRADCCEIWTDVDGVYTCDPRQVPDARLLKSMSYQEAMELSYFGAKVLHPRTITPIAQFQIPCLIKNTGNPQAPGTLIGASSDDDNLPVKGISNLNNMAMFSVSGPGMKGMIGMAARVFAAMSRAGISVVLITQSSSEYSISFCVPQSDCARARRAMQDEFYLELKEGLLEPLAVTERLAIISVVGDGMRTLRGISAKFFAALARANINIVAIAQGSSERSISVVVNNDDATTGVRVTHQMLFNTDQVIEVFVIGVGGVGGALLEQLKRQQTWLKNKHIDLRVCGVANSKALLTNVHGLNLDNWQAELAQANAPFNLGRLIRLVKEYHLLNPVIVDCTSSQAVADQYADFLREGFHVVTPNKKANTSSMDYYHQLRFAAAQSRRKFLYDTNVGAGLPVIENLQNLLNAGDELQKFSGILSGSLSFIFGKLEEGMSLSQATALAREMGYTEPDPRDDLSGMDVARKLLILARETGRELELSDIVIEPVLPDEFDASGDVTAFMAHLPQLDDAFAARVAKARDEGKVLRYVGNIEEDGVCRVKIAEVDGNDPLFKVKNGENALAFYSHYYQPLPLVLRGYGAGNDVTAAGVFADLLRTLSWKLGV

SEQ ID NO: 70367 - DNA, 2463 bp, Salmonella typhimurium LT2
  CDS (1)..(2463): transl_table=11
atgcgagtgttgaagttcggcggtacatcagtggcaaatgcagaacgttttctgcgtgttgccgatattctggaaagcaatgccaggcaagggcaggtagcgaccgtactttccgcccccgcgaaaattaccaaccatctggtggcaatgattgaaaaaactatcggcggccaggatgctttgccgaatatcagcgatgcagaacgtattttttctgacctgctcgcaggacttgccagcgcgcagccgggattcccgcttgcacggttgaaaatggttgtcgaacaagaattcgctcagatcaaacatgttctgcatggtatcagcctgctgggtcagtgcccggatagcatcaacgccgcgctgatttgccgtggcgaaaaaatgtcgatcgcgattatggcgggacttctggaggcgcgtgggcatcgcgtcacggtgatcgatccggtagaaaaattgctggcggtgggccattaccttgaatctaccgttgatatcgcggaatcgactcgccgtatcgccgccagccagatcccggccgatcacatgatcctgatggcgggctttaccgccggtaatgaaaagggtgaactggtggtgctgggccgtaatggttccgactattccgccgccgtgctggccgcctgtttacgcgctgactgctgtgaaatctggactgacgtcgatggcgtgtatacctgtgacccgcgccaggtgccggacgccaggctgctgaaatcgatgtcctaccaggaagcgatggaactctcttacttcggcgccaaagtccttcaccctcgcaccattacgcccatcgcccagttccagatcccctgtctgattaaaaataccggtaatccgcaggcgccaggaacgctgatcggcgcgtccagcgacgatgataacctgccggttaaagggatctctaaccttaacaacatggcgatgtttagcgtctccggcccgggaatgaaagggatgattgggatggcggcgcgtgttttcgccgccatgtctcgcgccgggatctcggtggtgctcattacccagtcctcctctgagtacagcatcagtttctgtgtgccgcagagtgactgcgcgcgtgcccgccgtgcgatgcaggatgagttctatctggagctgaaagaggggctgctggagccgctggcggttacggagcggttggcgattatctctgttgtcggcgacggtatgcgcacgctacgcggcatttcagcgaaattcttcgccgcgctggcgcgggctaatatcaatatcgtggcgatcgctcagggatcttctgagcgttctatttctgtggtggtgaataacgacgatgccaccaccggcgtgcgggtaacgcaccagatgctgttcaataccgatcaggtgattgaagtgtttgtcattggcgtcggcggcgtcggcggcgcgctactggaacagcttaaacgtcagcaaacctggctgaagaacaagcacatcgatctacgcgtgtgcggcgtggcgaactcaaaggcgttgctaaccaatgtgcatggcctgaatctggacaactggcaggcggaactggcgcaagcgaacgcgccgttcaatctgggacgcttaattcgcctggtgaaagaatatcatctactcaatccggtgattgttgattgtacctccagtcaggcggtggccgaccagtatgccgacttcctgcgtgaagggttccatgtggtgacgccaaacaagaaagcgaacacctcgtcaatggactactaccatcagctacgtttcgccgccgcgcaatcacggcgcaaattcttgtatgacaccaacgtcggcgccggtttgccggtaatcgaaaacctgcaaaacctgctgaatgccggtgatgaactgcaaaaattttccggcattctttccgggtcgctctcttttattttcggtaaactggaagaggggatgagtctctcacaggcgaccgccctggcgcgcgagatgggctataccgaacccgatccgcgcgacgatctttccggtatggatgtggcgcgtaaactgttgatcctcgcccgcgagacgggccgcgagctggagctttccgatattgtgattgaaccggtgttgccgaacgagtttgacgcctccggcgatgtgaccgcctttatggcacatctgccgcagcttgacgacgcgtttgccgcccgtgtggcgaaagctcgtgatgaaggtaaggtattgcgctatgtgggcaatatcgaagaggatggcgtgtgccgcgtgaaaattgccgaagttgatggtaacgatccgctcttcaaagtgaaaaacggtgaaaacgcgctggcgttctacagccactattatcagcccttgccgttggtgctgcgcggctacggcgcaggcaatgatgtgacggcggcgggcgtgtttgccgatctgttacggaccctctcatggaagttaggagtttaa

SEQ ID NO: 70368 - protein, 820 aa, Salmonella typhimurium LT2
MRVLKFGGTSVANAERFLRVADILESNARQGQVATVLSAPAKITNHLVAMIEKTIGGQDALPNISDAERIFSDLLAGLASAQPGFPLARLKMVVEQEFAQIKHVLHGISLLGQCPDSINAALICRGEKMSIAIMAGLLEARGHRVTVIDPVEKLLAVGHYLESTVDIAESTRRIAASQIPADHMILMAGFTAGNEKGELVVLGRNGSDYSAAVLAACLRADCCEIWTDVDGVYTCDPRQVPDARLLKSMSYQEAMELSYFGAKVLHPRTITPIAQFQIPCLIKNTGNPQAPGTLIGASSDDDNLPVKGISNLNNMAMFSVSGPGMKGMIGMAARVFAAMSRAGISVVLITQSSSEYSISFCVPQSDCARARRAMQDEFYLELKEGLLEPLAVTERLAIISVVGDGMRTLRGISAKFFAALARANINIVAIAQGSSERSISVVVNNDDATTGVRVTHQMLFNTDQVIEVFVIGVGGVGGALLEQLKRQQTWLKNKHIDLRVCGVANSKALLTNVHGLNLDNWQAELAQANAPFNLGRLIRLVKEYHLLNPVIVDCTSSQAVADQYADFLREGFHVVTPNKKANTSSMDYYHQLRFAAAQSRRKFLYDTNVGAGLPVIENLQNLLNAGDELQKFSGILSGSLSFIFGKLEEGMSLSQATALAREMGYTEPDPRDDLSGMDVARKLLILARETGRELELSDIVIEPVLPNEFDASGDVTAFMAHLPQLDDAFAARVAKARDEGKVLRYVGNIEEDGVCRVKIAEVDGNDPLFKVKNGENALAFYSHYYQPLPLVLRGYGAGNDVTAAGVFADLLRTLSWKLGV

SEQ ID NO: 70369 - DNA, 2538 bp, Yersinia pestis KIM
  CDS (1)..(2538): transl_table=11
gtgcgggctttttttttcaatcaaatctttgcaaaaaaagtttgcgataaaaagcgcgaaagcgggagagaatcagaaatgcgagtgctgaaatttggcgggacatcagtggcaaatgccgagcgctttatgcgtgttgccgatatcatcgaaagtaatgcgcgtcagggacaagtggctacggtgttatccgctcccgcgaagataacgaaccatctcgttgccatgatcgataaaatggtcgcagggcaagatatctccccgaacatcagcgatgctgagcggatttttgctgagttattgcgtggattagctgatactcagccaggctttgattatgatcgcctaaaagccttggtcggccatgagtttgcgcaactcaaacacctgctacacggtatttcgttgttggggcagtgcccagacagcattaatgcctcaattatctgccgtggcgaaaaactctccatcgccattatggaggcgttatttcaggctaagggttatcacgttacggtgattaatccagtcgaaaaattgttggcgcagggccattatctcgaatccactgttgatatcacggagtctacccgccgtatcggtgccagcggtattccatctgatcacatcatcctgatggctggttttactgcgggtaatgataaaggtgaattggtggtgttggggcgtaatggctctgattattccgctgccgtgctggctgcttgcttacgggcagattgttgtgagatttggaccgatgtcgacggggtctatacttgtgacccgcgtaccgttccagatgccagattactgaaatcgatgtcataccaagaggcaatggagctttcctattttggtgctaaagttcttcaccctcgcactatcgctcctattgcccgcttccaaattccttgtctgataaaaaacacctctaacccgcaagcccccggtaccttgattggtggtgaaagcattgatgaggattctccggtcaaaggcattaccaacctgaataatatggcgatgattaatgtttcagggccaggaatgaaagggatggtcggtatggctgcccgcgtctttgcggtgatgtcgcgcagcggtatttcagtggtgctaatcactcagtcctcttctgaatacagcatcagtttttgtgtgccgcaaggtgagttattgcgcgcccgccgagcgctggaagatgagttttatctggagttgaaagacggtgtcttggatcctctggatgtgatggaacatctggcaattatctctgtggtcggtgacggtatgcgcaccctgcgcggtatttctgcccgtttcttctcggctctggcgcgcgccaacatcaatattattgctatcgctcaaggctcgtctgagcgctctatttctgtggttgtcaataatgatgcggtcactaccggggtgcgagtttgccaccagatgctgtttaacacggatcaagtcattgaggtgtttgtcattggcgtgggtggtgtggggggcgcattaatcgaacaaatctatcgccagcaaccgtggttgaaacagcgtcatattgatttacgtgtttgtggtatcgcgaattccaaagccatgttgaccaacgtgcatggcattgcattagataactggcgtcaggaactggctgaagttcaggagccgtttaacctgagccgcttgatccgtctggttaaagagtatcacttactgaacccggtcattgttgactgtacctcaagccaggcggttgctgatcaatatgctgatttcctgaccgatggcttccatgtggtgacgccaaacaagaaagccaacacttcatcaatgaattattaccgccaaatgcgtgccgctgcgacgaaatcgtgccgtaaattcttgtatgacacaaacgttggggcggggctaccggtgatcgagaacttacagaacctgctcaatgcgggtgatgaactgatgcgcttcaccggtattctgtccggttcactttccttcatcttcggtaagctagatgaggggatgtcattgtcagaggcaacacggcaagctaaggcgttggggtataccgaacccgatccacgtgatgatctctctgggatggatgttgcccgtaaattgttgattttggcccgtgaagcagggtacaaacttgagttggctgatatcgaggttgagtccgtcttaccagcaagctttgatgcttcaggtgatgtggatactttcctggcgcgcctgccatcattggatgctgaatttacccgcttggtagcgaatgctgcggagcagggcaaagtgctacgttatgtcggagtgattgaagacgggcgttgtaaagtgcggatggaggcagttgacggtaacgacccgttgtataaagttaagaatggcgagaatgcgttggctttctatacccgctattatcagccaattccgttggtgctacgcggttatggcgcaggcaatgatgtgactgccgctggggtgtttgccgatcttttacgcacattatcatggaagttgggagtttaa

SEQ ID NO: 70370 - protein, 845 aa, Yersinia pestis KIM
MRAFFFNQIFAKKVCDKKRESGRESEMRVLKFGGTSVANAERFMRVADIIESNARQGQVATVLSAPAKITNHLVAMIDKMVAGQDISPNISDAERIFAELLRGLADTQPGFDYDRLKALVGHEFAQLKHLLHGISLLGQCPDSINASIICRGEKLSIAIMEALFQAKGYHVTVINPVEKLLAQGHYLESTVDITESTRRIGASGIPSDHIILMAGFTAGNDKGELVVLGRNGSDYSAAVLAACLRADCCEIWTDVDGVYTCDPRTVPDARLLKSMSYQEAMELSYFGAKVLHPRTIAPIARFQIPCLIKNTSNPQAPGTLIGGESIDEDSPVKGITNLNNMAMINVSGPGMKGMVGMAARVFAVMSRSGISVVLITQSSSEYSISFCVPQGELLRARRALEDEFYLELKDGVLDPLDVMEHLAIISVVGDGMRTLRGISARFFSALARANINIIAIAQGSSERSISVVVNNDAVTTGVRVCHQMLFNTDQVIEVFVIGVGGVGGALIEQIYRQQPWLKQRHIDLRVCGIANSKAMLTNVHGIALDNWRQELAEVQEPFNLSRLIRLVKEYHLLNPVIVDCTSSQAVADQYADFLTDGFHVVTPNKKANTSSMNYYRQMRAAATKSCRKFLYDTNVGAGLPVIENLQNLLNAGDELMRFTGILSGSLSFIFGKLDEGMSLSEATRQAKALGYTEPDPRDDLSGMDVARKLLILAREAGYKLELADIEVESVLPASFDASGDVDTFLARLPSLDAEFTRLVANAAEQGKVLRYVGVIEDGRCKVRMEAVDGNDPLYKVKNGENALAFYTRYYQPIPLVLRGYGAGNDVTAAGVFADLLRTLSWKLGV

SEQ ID NO: 70371 - DNA, 2469 bp, Shewanella oneidensis MR-1
  CDS (1)..(2469): transl_table=11
atgaaagtaatgaaatttggtggtacctcgctggcaaattggcagcgattttcaatggcggcggatatcgtcgctaaagcggcaacaatggagcctgttgcaactgtgctctctgcgcctgcaaccgtgactaatgccctgctagaaatggtgaatttagcggtaaaaggcgaagattattcgcctgttattcagcatgttgagcgggtttttacctctctgtatcaagatgcggtgagttcaggtttatcgagtactcaaagtgagctgctttttgcaggtcttggcgcgcagcttgctcgttggcaagatagattacacggtatcacgttgctgcaagaatgtcctgacggtatatgtgccgaaatcgtggtggcgggtgagcgattatcggcggccctaatggaacaagttatgctggccaaaggtattacctcggcgcagcttgatccacgtaagctgtttttaggccgtggtcgtccgctcgagtcagtggtggatattgctgtcagtaagccgcgatttaagaatctgttgctcgatgaaaagcgtgtttgggtgatgcctggctttaccgcagccgatgaagatggcaaggtcgtgacgttagggcgtaatggttctgactactctgctgcggtgctggctgcttgtttagatgcctcaagctgtgagatttggacggatgtcgatggggtttacaataccgatcctcgcgtcgtagcagatgctaagttgttatcgcagttaagttatcaggaggcgatggaactatcgtattttggtgctaaggtactgcaccctaaaaccattgcaccgattgcccagtttcatattccttgttacatcaaaaacagctttaaccccgatgcgcctgggactttggtctcaaaccttgccgacgcaagtgggttacaagttaaagccatttcaaacctcgataatcaaacaatgtttgatgtttcaggccctggtatgaagggcatggtcggcatggcgagtcgcacactggcggcgatttcccgtagtggcgtttctgtgtctcttattacgcaaagttcttgcgaatacagcatcagtttctgtgtggcgaccagtgagtccgccaaggtgaaattggcgctggagcaagagtttgagttagaaatcaaaagtgatttactcgaaccgattgaaatgcgccatgacttagccattgtctcgttaattggcgatggtatgcgcacccataaaggtgtcgctgcgcgctttttccaagcgttagcgcaggcgagtgtgaatattattgcgattgcccaaggctcttctgaacgttctatttcaacagttatcgaacagcgtaagaccaaacatgcggtagccgcctgtcatcagggctttttcgatgtgcagcagtatttggatgtgtttttagtgggttgcggcaatgtgggcgcaggcttactcgagcagatcaaacaacaggcgatcgtgttaaaagagcagcatattagtatccgtgtctgcggtatcgtgaattcaagcaaaatgttactcgatagtgcgggaatcgatttaaacaattggcaaaacctgcttgccgacagtcagcagtcaagtgatcttcctgcattactggcgtgggtaaaagagcaacaattgttaaaccctgtgctggtggattgcacctcgagcgaacaagtatcgaaccagtatttagaggtaatgaacgccggcatgcatgtcgtcacgcccaataaaaaggctaacactcgcgattacgcctattaccaagctctgcgtcagaccgcgttgacacagcgccgtcagttcctgtacgagaccaacgtgggcgcgggattacccgttatcgataacttgaaaaaactgttattcgctggtgataaattacacaagtttaatggcattttgtcaggctctttatcctttatctttggcaagcttgatgaggggatgtcactttctgaggcgactaaactggcgcgggagaaatgctttactgagcccgatccccgtgatgatttaagtggcatggatgtggcgcgtaaggtactgattttggcccgtgaagtggggttgaaacttgagttaagtgatattgttgtcgactcagtcttgcctgaaagttttgatgattctggcgatgtggaaagttttatggcgcgtttacccgaggctgatgcggcgattgcggcgcgagtcgctgaggcgaaagcgcagggtaaagtgctgcgctatgtggggcagattgaagaaggcgcgtgccatgtgcgcatagccgaagtcgacgccaccgatccactttatagcgtaaaaggcggggaaaacgccctagcattctacagccgttattatcagcccattccctttgtgctgcgtggatatggtgcgggcacagaagtgacagcagctggtgcctttgctgatgtattaagaactttaaattggactcgtgaggtgagtgtatga

SEQ ID NO: 70372 - protein, 822 aa, Shewanella oneidensis MR-1
MKVMKFGGTSLANWQRFSMAADIVAKAATMEPVATVLSAPATVTNALLEMVNLAVKGEDYSPVIQHVERVFTSLYQDAVSSGLSSTQSELLFAGLGAQLARWQDRLHGITLLQECPDGICAEIVVAGERLSAALMEQVMLAKGITSAQLDPRKLFLGRGRPLESVVDIAVSKPRFKNLLLDEKRVWVMPGFTAADEDGKVVTLGRNGSDYSAAVLAACLDASSCEIWTDVDGVYNTDPRVVADAKLLSQLSYQEAMELSYFGAKVLHPKTIAPIAQFHIPCYIKNSFNPDAPGTLVSNLADASGLQVKAISNLDNQTMFDVSGPGMKGMVGMASRTLAAISRSGVSVSLITQSSCEYSISFCVATSESAKVKLALEQEFELEIKSDLLEPIEMRHDLAIVSLIGDGMRTHKGVAARFFQALAQASVNIIAIAQGSSERSISTVIEQRKTKHAVAACHQGFFDVQQYLDVFLVGCGNVGAGLLEQIKQQAIVLKEQHISIRVCGIVNSSKMLLDSAGIDLNNWQNLLADSQQSSDLPALLAWVKEQQLLNPVLVDCTSSEQVSNQYLEVMNAGMHVVTPNKKANTRDYAYYQALRQTALTQRRQFLYETNVGAGLPVIDNLKKLLFAGDKLHKFNGILSGSLSFIFGKLDEGMSLSEATKLAREKCFTEPDPRDDLSGMDVARKVLILAREVGLKLELSDIVVDSVLPESFDDSGDVESFMARLPEADAAIAARVAEAKAQGKVLRYVGQIEEGACHVRIAEVDATDPLYSVKGGENALAFYSRYYQPIPFVLRGYGAGTEVTAAGAFADVLRTLNWTREVSV

SEQ ID NO: 70373 - DNA, 2460 bp, Vibrio vulnificus CMCP6
  CDS (1)..(2460): transl_table=11
atgcgagtattaaagtttggtggctcatcgttagccgatgcagaccgctttttaagagcggcggacattgttgctaacaatgccaagcaggaagaagtttctgtagtgttgtcggcgccagggaaaacaaccaataaattggtcgcggtcattgagtctgcactgaaaaatggcgaagcagaacgacaagtcgacgagctagacagtgcgttcaaacaactactgagtgatattaaacagcagcttcctagccttaacggtgacgcgtatttaaagcaagtcgcggattcactttcgcaactgcgtcaatttgttcatggtatcggcttgttggggatgtgtcctgacaacgtcaatgctcgcatcatcagtaaaggtgagcgtgtttccatccagttgatgaaggcggtgttggaagcaaaaggtcatctcgttaatcttattgacccggttgactacttgcttgcccatggtgatcacctcgaagggatggtggatgtcgatgtatctacgcaaaacttccgttcaaatcctcttcctcaggggcacgttcatatcatgccaggctttaccgcgggcaataagcatggtgagttggttactctaggtcgtaatggttccgattactcagcagccgtgttagcggcatgtctgcgcgcggattgttgtgagatctggacggatgtggatggggtgtacaactgtgacccgcgtttagtcgaagatgctcgcttattgaagtccttaagctatcaagaggccatggagctttcatactttggcgcatccgttttgcatcccaaaaccattgcgccaattgctcaatttcatattccatgtttgattaagaacagcttcaatcctcaaggtgctggtacgctgattggccaagatacaggcgaagataatctagcgatcaaaggcatcactacgctcaataacctgacgatggtcaacgtgtccggaccgggaatgaaaggcatggttggtatggcgagccgagtatttggtgcgatgtcggcctctggcgtgtcaatcgttctgattactcagtcttcttctgagtacagtatcagcttctgtattgaagctgccgacagacctttagccgagcaggcactctcagatgcttttgagttggaactgaaagatggtctattggagcccgtcgagttcctgactaatgtctctatcatcacgctggtgggtgatggtatgcgcacttccaaaggtgtcgcatcacaattctttgcttctcttgcggaagtgagtgtcaatgtcatcgctattgctcaaggttcgtcagaacgcgctatttcagcggtgatcccagaggataagatctctcaagcgatcaaagcgtgtcatgaaaatctcttcaactcgaaacattaccttgatgtgtttgttgttggtgtcggtggtgttggtggtgagttggtggatcagatccagcgtcagcaagccaaactggcagacaaaggcattgtcatccgagtgtgtggtttggccaatagcaaagggctgttgttagacagtaatggcttaccactggaacattggcgtgaccgcatggccaatgcatctgaagcgtttagccttgccagtttgattgccactgtgcagcgtaaccatatcatcaaccctgtgctcgtcgattgtacttctagcgacgtgattgctaaccaatacgcagagtttttagccgctggtttccatgttgtgacgccaaataagaaagcaaataccgcgagtatggcgtattaccatcagctacgcgatgtggcacgcagctctcgtcgtaagttgatgtatgaaaccacggttggtgcaggcttgcctgtgatcgagaacttgcaaaatctgatttctgccggagatgagttggagcgattcagcggcattctctctggttcactttcctttatcttcggtaagttggatgaaggcatgacgttgagtgaggcgaccaatatcgccaaacaaaatggctttacagagccggatcctcgtgatgatctgtccggaatggatgtggcgcgtaaactgttgatcttggcgcgtgaagcgggcatggcattagagctggaagatgtcgaagtggatcaagccttgccaccaagttttgatgattcaggcagtgtcgatgaatttatggctcgactaccggaagctgatgcgtacttcaagcaactttctgcgcaagcggccgaagaaggcaaggtactgcgttatgtcggtgaaatcatcgatggtaagtgcaaagtctcgatcgctgcggtagatgaaaatgatccgatgttcaaaattaaagatggtgaaaatgcgttagcattctacagccgttactatcagccgatcccgttagtattgagaggttacggtgccggtactcaagtgactgcggcaggcgtgttctcagatgtgatgcgtactttaggctggaaattaggggtttaa

SEQ ID NO: 70374 - protein, 819 aa, Vibrio vulnificus CMCP6
MRVLKFGGSSLADADRFLRAADIVANNAKQEEVSVVLSAPGKTTNKLVAVIESALKNGEAERQVDELDSAFKQLLSDIKQQLPSLNGDAYLKQVADSLSQLRQFVHGIGLLGMCPDNVNARIISKGERVSIQLMKAVLEAKGHLVNLIDPVDYLLAHGDHLEGMVDVDVSTQNFRSNPLPQGHVHIMPGFTAGNKHGELVTLGRNGSDYSAAVLAACLRADCCEIWTDVDGVYNCDPRLVEDARLLKSLSYQEAMELSYFGASVLHPKTIAPIAQFHIPCLIKNSFNPQGAGTLIGQDTGEDNLAIKGITTLNNLTMVNVSGPGMKGMVGMASRVFGAMSASGVSIVLITQSSSEYSISFCIEAADRPLAEQALSDAFELELKDGLLEPVEFLTNVSIITLVGDGMRTSKGVASQFFASLAEVSVNVIAIAQGSSERAISAVIPEDKISQAIKACHENLFNSKHYLDVFVVGVGGVGGELVDQIQRQQAKLADKGIVIRVCGLANSKGLLLDSNGLPLEHWRDRMANASEAFSLASLIATVQRNHIINPVLVDCTSSDVIANQYAEFLAAGFHVVTPNKKANTASMAYYHQLRDVARSSRRKLMYETTVGAGLPVIENLQNLISAGDELERFSGILSGSLSFIFGKLDEGMTLSEATNIAKQNGFTEPDPRDDLSGMDVARKLLILAREAGMALELEDVEVDQALPPSFDDSGSVDEFMARLPEADAYFKQLSAQAAEEGKVLRYVGEIIDGKCKVSIAAVDENDPMFKIKDGENALAFYSRYYQPIPLVLRGYGAGTQVTAAGVFSDVMRTLGWKLGV

SEQ ID NO: 70375 - DNA, 2460 bp, Vibrio parahaemolyticus RIMD 2210633
  CDS (1)..(2460): transl_table=11
atgcgagtattgaagtttggcggttcatcactagcggatgcagatcgctttttaagagcggcagatatcattgccaataacgctcaacaagaagaagtggccgttgtactttcagcgccgggtaaaacgacgaataagttagtcgcagtcattgaaggtgcacttcgcaatggtgaagctgagctgcaaatcaatgagttggaagagtcgtttaaaacgctttttgctgatatccaagcggtattgcctaacctagaaggtgcggcgttcgataaccaagttaaaacctctctttctcaactgcgtcagtttgtgcacggcatcaacttacttggtatgtgtccaaacaacgtcaatgctcgcatcatcagtaaaggtgagcgagtttcgattcaattgatgaaggcggtactggaagccaaagggcaaaaagcgaacctcattgatcctgttgaatatctgtatgcgaaaggcgaccacctagaagccatggtggatgttgatgtatcgacacagaacttccgtcaaaatcctcttcctaaagatcatgtgaacatcatgccgggctttactgcgggtaatgaaaaaggcgaattggtgacgctgggtcgtaacggttctgactattcagcggcagtattagcggcttgtttacgtgctgattgttgtgaaatctggacggacgtggatggcgtttacaactgcgatcctcgattggttgaagatgctcgactgcttaagtctctcagctatcaagaagcaatggagctttcttacttcggtgcatccgttctgcatccgaagaccattgctcctatcgcgcaattccacattccatgtctgatcaaaaacagctttaaccctcaaggtgcgggtacgcttatcggccaagatactggtgaagataatcttgcgatcaaaggtattacaacgcttaacgacctaaccatggttaacgtatcaggcccaggtatgaaggggatggtaggcatggcgagccgagtatttggtgcgatgtcttctgctggtgtctctattgtattaattactcaatcatcgtctgagtacagcatcagcttctgtatcgaggccgatgataagctgaaagctcaacaagttctggcggatgcgtttgaacttgaactaaaagacggtctattggaaccggttgattttatcgatgatgtttctatcgttaccttggttggtgacggcatgcgtacatcccgtggtgttgcttcacgtttcttctcttctcttgcggaagtgaacgtcaatatcgtcgcgattgcgcagggttcttcagagcgtgctatctctgcggtaattccggaagacaaaatttctgaggcgatcaaagcgtgtcatgaaaacctatttaactcgaagtacttcctcgatgtgtttgttgttggtgttggcggtgttggcggtgagctggtggatcagatccaacgtcaacaatccaaactggcagaaaaaggtatcgtgattcgagtgtgtggtttagcaaatagcaaaggcttgctactcgatagtgaaggcttaccactagaacactggcgcgaccgcatgtctgcggcaacagaagaattcagtctagctcgtttaatcgcgttagttcagcgcaatcacatcatcaaccctgtacttgtggattgtacgtctagtgaagacattgcaaatcaatatgcagactttctagcagcaggtttccacgtggtcacgccaaacaaaaaagcaaacacagcaagcatggcgtactaccatcagcttcgagatgtcgctcgtagctcgcgtcgcaagttgatgtacgaaacaaccgtaggggcaggcctaccggttatcgaaaacttacaaaacctgattgcagcaggcgatgagcttgaacgatttagtggcattttgtcaggttcactgtcttacatcttcggtaaacttgacgagggtatgagcctgagcgaagcgacgaatattgcgaaagaaaatggcttcactgagccagatcctcgtgatgacctttctggtatggacgttgcgcgtaagctgctcatcctagctcgcgaagcaggtatgtcattagagcttgaagatgtggtcgttgaccaagcgctaccaccaggctttgatgattcaggcagtgttgatgaatttatggctcgtttgccagaagcggacgcgtacttcaaagagttatcagcgaaagcggcagaagaaggcaaagtgctacgttatgttggtgaaattaatgatggcaagtgcactgtgagcatggccgctgtcgatgaaaatgatccaatgttcaaaattaaagacggtgaaaacgcgttggcgttttatagtcgctactaccagccaattcctttagtgctgcgtggttacggtgccggtacagaagtgacggcagcaggcgtattctctgatgtaatgcgtactttaggttggaaactaggggtataa

SEQ ID NO: 70376 - protein, 819 aa, Vibrio parahaemolyticus RIMD 2210633
MRVLKFGGSSLADADRFLRAADIIANNAQQEEVAVVLSAPGKTTNKLVAVIEGALRNGEAELQINELEESFKTLFADIQAVLPNLEGAAFDNQVKTSLSQLRQFVHGINLLGMCPNNVNARIISKGERVSIQLMKAVLEAKGQKANLIDPVEYLYAKGDHLEAMVDVDVSTQNFRQNPLPKDHVNIMPGFTAGNEKGELVTLGRNGSDYSAAVLAACLRADCCEIWTDVDGVYNCDPRLVEDARLLKSLSYQEAMELSYFGASVLHPKTIAPIAQFHIPCLIKNSFNPQGAGTLIGQDTGEDNLAIKGITTLNDLTMVNVSGPGMKGMVGMASRVFGAMSSAGVSIVLITQSSSEYSISFCIEADDKLKAQQVLADAFELELKDGLLEPVDFIDDVSIVTLVGDGMRTSRGVASRFFSSLAEVNVNIVAIAQGSSERAISAVIPEDKISEAIKACHENLFNSKYFLDVFVVGVGGVGGELVDQIQRQQSKLAEKGIVIRVCGLANSKGLLLDSEGLPLEHWRDRMSAATEEFSLARLIALVQRNHIINPVLVDCTSSEDIANQYADFLAAGFHVVTPNKKANTASMAYYHQLRDVARSSRRKLMYETTVGAGLPVIENLQNLIAAGDELERFSGILSGSLSYIFGKLDEGMSLSEATNIAKENGFTEPDPRDDLSGMDVARKLLILAREAGMSLELEDVVVDQALPPGFDDSGSVDEFMARLPEADAYFKELSAKAAEEGKVLRYVGEINDGKCTVSMAAVDENDPMFKIKDGENALAFYSRYYQPIPLVLRGYGAGTEVTAAGVFSDVMRTLGWKLGV

SEQ ID NO: 70377 - DNA, 2457 bp, Candidatus Blochmannia floridanus
  CDS (1)..(2457): transl_table=11
atgcgagtattaaaatttggaggaacttcattatctaatgcaagccaatttatacatgttgctaatattcttgaaaaaaatgctcagaaagaacaaatagcagtagtattgtcagcccctgcacgcgttaccaattatttagttgaagctattaataatacattacgtggtaataatatattagagagtgttttaaatatagaaaatatttttaatactttactgaaggatattgctcaatttcagtctaaatttaattatgtagtttttcataacactttaaaacaggaatttaatagtttaaaacaattattacaaggtatttcgttacttaatttttgccctgacagtgtaaatgctcatattatttgtttaggagaaaaatggtctgtaattttaatgcaagggattttaattgcaaaagatcttaaaataataaatttagatccagttaaatctattttaactcagggtgatgggtattctacatctgtagtaaatatcgaggaatcgacttgtcgtattcataatgtgcttttatctcattatgcagatattattttgatggctggatttatggctggaaataaaaaaggagaattagttacgttaggacgtaatggctctgattattcagcggctattttggcagcttgtttgcaggctaggcgctgtgaaatttggacagatgtagatggaatttatacttgtgatcctcgtcaagtgcctgatgcaaggttattacatgaattatcttatcaagaagctatggagctttcttattttggagctaaaattttacatccacgtactattgtgccaatcgctcaatttcatataccatgtttaataaaaaatacttcaaaacctgatttttctggaacgttaattagcgcaaagaataaagatataaatattatagctaaaggtattacgtatttaaaagatatggttatgataaatgtttccggtccaggtatgaaaggtatgattggaatggctgcgcgagtatttgcagcaatgtctagagcaacatgctcagttgtattaattactcaatcatcttcagagtacagtattagtttttgtgttccatatcaagaatatgcaaaagcatgtgatgcattagatgaagaatttaatttggaattaaaaaatggattattagaacctataggagttatatgtgatttagcgattatttcagttgtaggtgatggtatgcgtactcaattaggattatctggaaaattatttggagctttagctcgagcaagtataaatattattgcaatttcacaaggttcatcagaacgttctatttctgtagttgtaaaaaataatgttactactataggtgtgaaagctgtacaccaaacattgtttaatactgatcaaattattgaagtatttattattggagttggaggagttggtagtgctttgatagaacaaattaaaaaacagtatagttggttaaaaaataaacatattgatttacgagtatgcggaattgttaattctcaggttatgttaactgattcagatggtataaatttaaataattggaaatcattattaatacagtcttgcaagtctagtgatttagagaaattaattattactattaagcaatatcatttgttaaatcctgtaattgtagattgtacgagtagtgaaaaggtagcaaattattatgtaaattttttatcaggtggatgtcatgtgattgctcctaataaaaaagctaatactggacctataggatattatcgtaaactcagggaaacgatggttatagctcgtagaaaatttttatatgatacaaatgtaggagctggtttaccagtaatagaaaatttacaaaatttattgaatgctggagatgaattaataaaattttcaggaattttgtctggatctttatcttatatttttgggaaattagatgaaggtttatcattgtctgaagctactattttagctaaaaagaatggttacactgaacctgatccaagagatgacttatctggtatggatgtggctagaaaattattaattcttgctagagaggtaggatatgtgctagaaatgaaagatattaaaattgaaccagtaatacctgataattttataaagaatgatgttatttctgtagataatttttttgagaaattattatcattagataatatgtttactcttaaagtaaaaaaagcacgggaatctggttgtgtattgcgttatattggtaatatacaagaaggtaagtgttgtgttaaaatggaatctgtaaatgatgagcatcctttatttcaagtgaaagatggagagaatgctctagcatttttgacaaagtattatcaaccattgccattgatattaaggggttatggagctggaaataacgttacagcagctggtgtttttgctgatttgttacgaactgtatattag

SEQ ID NO: 70378 - protein, 818 aa, Candidatus Blochmannia floridanus
MRVLKFGGTSLSNASQFIHVANILEKNAQKEQIAVVLSAPARVTNYLVEAINNTLRGNNILESVLNIENIFNTLLKDIAQFQSKFNYVVFHNTLKQEFNSLKQLLQGISLLNFCPDSVNAHIICLGEKWSVILMQGILIAKDLKIINLDPVKSILTQGDGYSTSVVNIEESTCRIHNVLLSHYADIILMAGFMAGNKKGELVTLGRNGSDYSAAILAACLQARRCEIWTDVDGIYTCDPRQVPDARLLHELSYQEAMELSYFGAKILHPRTIVPIAQFHIPCLIKNTSKPDFSGTLISAKNKDINIIAKGITYLKDMVMINVSGPGMKGMIGMAARVFAAMSRATCSVVLITQSSSEYSISFCVPYQEYAKACDALDEEFNLELKNGLLEPIGVICDLAIISVVGDGMRTQLGLSGKLFGALARASINIIAISQGSSERSISVVVKNNVTTIGVKAVHQTLFNTDQIIEVFIIGVGGVGSALIEQIKKQYSWLKNKHIDLRVCGIVNSQVMLTDSDGINLNNWKSLLIQSCKSSDLEKLIITIKQYHLLNPVIVDCTSSEKVANYYVNFLSGGCHVIAPNKKANTGPIGYYRKLRETMVIARRKFLYDTNVGAGLPVIENLQNLLNAGDELIKFSGILSGSLSYIFGKLDEGLSLSEATILAKKNGYTEPDPRDDLSGMDVARKLLILAREVGYVLEMKDIKIEPVIPDNFIKNDVISVDNFFEKLLSLDNMFTLKVKKARESGCVLRYIGNIQEGKCCVKMESVNDEHPLFQVKDGENALAFLTKYYQPLPLILRGYGAGNNVTAAGVFADLLRTVY

SEQ ID NO: 70379 - DNA, 2460 bp, Photorhabdus luminescens subsp. laumondii TTO1
  CDS (1)..(2460): transl_table=11
atgcgagtacttaaatttggaggaacttcggtcgctaattaccagcgggtgttgagcgttgccgacattgcagagaaaaaattttctcaaggcggggtcgcgttggtgctttctgctccggcaaaaattaccaatcatttagtggctatgattgaaaaaacggtcgccgggcaagagatcattacccatatgcacgatgctgagcagatctttgttgatttattacaggggatggcacgggcgcaacccggttttgcttatgaacggttaaaaatgatggttgagcaagaatttgctcaattgaaacaggttctgcatggtatttcgttactgggccaatgcccggacagcattaacgcttccctgatttgtcgtggggaaaaactctctatcgctatcatggagtctgtattgcaggcacgtggtcacaaggtcacggtgattgatccggtagaaaatttgttggcacaaggtcattaccttgaatctacggtagatatcaacgagtctactaagcgcattgcttctctgaatattccagatgaccatattgtcctgatggctggatttacggctggaaatgataaaggggagctcgttgtcttggggcgtaatggttctgactattctgctgcggttttggcggcttgcttgcgggcgacatgttgtgaaatctggactgatgtggatggtgtttatacttgtgatcccagagttgtgccggatgcacggttattaaaaggcatgtcctatcaggaagcgatggagctctcttattttggtgccaaggtattgcatccacggaccattgcgccaattgctcaatttcagatcccttgcttgattaaaaataccgccaatccagatgcgccgggaacactgatcggcgatgggcaaaaagatgaaagtacgccggtaaaagggataaccaacctgagcaatatggcaatgattaacgtatcaggtccaggtatgaaagggatggtggggatggcggcaagggtatttgctgtcatgtcccgcaaagggatctctgttgtgctgattactcagtcatcttcagaatacagtatcagcttctgtgtccctcaacgtgaattggaacgcgcgcgtcaggcgctgagtgaagaattctatcttgagctgaaagagggggtgcttgatcctttggatgtgatggaaaatctttccattatctcggttgttggcgatggtatgcgtaccctgcgtggcatctctgcccgtttcttctctgcattggcgcgcggtaatatcaatattgttgccatcgcacagggatcttctgaacgttctatctctgcggttatcgataatgaagtggcaacaacagccgttcgtttgtgccatcagatgttatttaataccgatcaagtgatcgaagtttttgttgtcggcgttggtggcgtaggcagtgttttgattgagcagatccgtcgtcaacaaacatggttgaagcaaaagcacattgatttacgggtatgtggtattgctaattcacgggccatgttgacggacatgagaggtatttgccttgataattggccgcagtgtttatcagaggccaaagaaccttttagtttgagccgcctgatccgtttggagaaagagtaccatttgctgaacccggtgatagtggattgtacctctaatcagcaaattgctgatcaatacgctagtttcctgagagatggtttcaatgtggttacgccgaataaaaaagccaatacttcgtcgatggcttattatcatcagatccgtaaggcggcagagaaatctaaacgtaaatttctgtatgacactaacgtaggcgctggtctgcctgttattgagaacttacaaaacttgctaaatgcgggtgatgaattggttcagttcaatggcattctttccggttctctctcctttattttcggtatgctggatgaaggaatgtcactatctcaggcgacgttactggcaaaagagaagggttataccgaacccgatccgcgtgatgatctatctggtgtggatgttgctcgtaagctgttgatcctcgcccgagaatcaggttatgaacttgaattggatgatattgatgtggagcctgtactgccagcttcctttgataaccgaggggatgtggatgctttccttgaacgtttacccgctcttgatcaggttttcagccagcgtgtggcagaagcgaaagaacaagagaaagtgttgcgctatattggcgtgattgaagatggctgttgtagagtgaaaatcgcggcagtagacagcaatgatccgctttataaagtcaaaaatggcgaaaatgcattggcattctacacgcgttactatcagccgataccgctggtactgcggggatacggagcaggtaatgatgtcactgccgcaggtgttttcgccgatatgctgcgtactttgtcctggaaacagggagtttaa

SEQ ID NO: 70380 - protein, 819 aa, Photorhabdus luminescens subsp. laumondii TTO1
MRVLKFGGTSVANYQRVLSVADIAEKKFSQGGVALVLSAPAKITNHLVAMIEKTVAGQEIITHMHDAEQIFVDLLQGMARAQPGFAYERLKMMVEQEFAQLKQVLHGISLLGQCPDSINASLICRGEKLSIAIMESVLQARGHKVTVIDPVENLLAQGHYLESTVDINESTKRIASLNIPDDHIVLMAGFTAGNDKGELVVLGRNGSDYSAAVLAACLRATCCEIWTDVDGVYTCDPRVVPDARLLKGMSYQEAMELSYFGAKVLHPRTIAPIAQFQIPCLIKNTANPDAPGTLIGDGQKDESTPVKGITNLSNMAMINVSGPGMKGMVGMAARVFAVMSRKGISVVLITQSSSEYSISFCVPQRELERARQALSEEFYLELKEGVLDPLDVMENLSIISVVGDGMRTLRGISARFFSALARGNINIVAIAQGSSERSISAVIDNEVATTAVRLCHQMLFNTDQVIEVFVVGVGGVGSVLIEQIRRQQTWLKQKHIDLRVCGIANSRAMLTDMRGICLDNWPQCLSEAKEPFSLSRLIRLEKEYHLLNPVIVDCTSNQQIADQYASFLRDGFNVVTPNKKANTSSMAYYHQIRKAAEKSKRKFLYDTNVGAGLPVIENLQNLLNAGDELVQFNGILSGSLSFIFGMLDEGMSLSQATLLAKEKGYTEPDPRDDLSGVDVARKLLILARESGYELELDDIDVEPVLPASFDNRGDVDAFLERLPALDQVFSQRVAEAKEQEKVLRYIGVIEDGCCRVKIAAVDSNDPLYKVKNGENALAFYTRYYQPIPLVLRGYGAGNDVTAAGVFADMLRTLSWKQGV

SEQ ID NO: 70381 - DNA, 2568 bp, Vibrio vulnificus YJ016
  CDS (1)..(2568): transl_table=11
atgttggggcaggctgctgagcgaaagaacaaatttcaaaaaaaggcctgtatccaacaagatacaggcctttttttatacagattaaaaataatccgggaggaagggatgcgagtattaaagtttggtggctcatcgttagccgatgcagaccgctttttaagagcggcggacattgttgctaacaatgccaagcaggaagaagtttctgtagtgttgtcggcgccagggaaaacaaccaataaattggtcgcggtcattgagtctgcactgaaaaatggcgaagcagaacgacaagtcgacgagctagacactgcgttcaaacaactgctgagtgatattaaacagcagcttcctagccttaacggtgacgcgtatttaaagcaagtcgcggattcactttcgcaactgcgtcaatttgttcatggtatcggcttgttggggatgtgtcctgacaacgtcaatgctcgcatcatcagtaaaggtgagcgtgtttccatccagttgatgaaggcggtgttggaagcaaaaggtcatctcgttaatcttattgacccggttgactacttgcttgcccatggtgatcacttagaagggatggtggatgtcgatgtatctacgcaaaacttccgttcaaatcctcttcctcaggggcacgttcatatcatgcctggctttaccgcgggcaataagcatggtgagctggtcactctaggtcgtaatggttccgattactcagcagccgtgttggctgcatgtctgcgcgcggattgttgtgagatctggacggatgtggatggggtgtacaactgtgaccctcgtttagtcgaagatgctcgcttattgaagtcattaagctatcaagaggccatggagctttcatactttggtgcatccgttttgcatcccaaaaccattgcgccaattgctcaatttcatatcccatgtttgattaagaacagcttcaatcctcaaggtgctggtacgctgattggtcaagatacaggcgaagataatctagcgatcaaaggcatcactacgctcaataacctgacgatggtcaacgtgtctggaccgggaatgaaaggcatggttggtatggcgagccgagtatttggtgcgatgtcggcctctggcgtgtcaatcgttctgattactcagtcttcttctgagtacagtatcagcttctgtattgaagctgccgacagacctttagccgaacaggcactctcagatgcttttgagttagaactgaaagatggtctattggagcccgtcgagttcctgactaatgtctctatcatcacgctggtgggtgatggtatgcgcacttccaaaggtgtcgcatcacaattctttgcttctcttgcggaagtgagtgtcaatgttatcgctattgctcaaggttcgtcagagcgcgctatttcagcggtgatcccagaggataagatctcccaagcgatcaaagcgtgtcatgaaaatctcttcaactcgaaacattaccttgatgtgtttgttgttggtgtcggtggtgttggtggtgagttggtggatcagatccagcgtcagcaagccaaactggcagacaaaggcattgtcatccgagtgtgtggtttggctaatagcaaagggctgttgttagacagtaacggcttaccactggaacattggcgtgaccgcatggccaatgcatctgaagcgtttagccttgccagtttgattgccactgtgcagcgtaaccatatcatcaaccctgtgctcgtcgattgtacttctagcgacgtgattgctaaccaatacgcagagtttttagccgctggtttccatgttgtgacgccaaataagaaagcaaataccgcgagtatggcgtattaccatcagctacgcgatgtggcacgcagctctcgtcgtaagttgatgtatgaaaccacggttggtgcaggcttgcctgtgatcgagaacttgcaaaatctgatttctgccggagatgagttggagcgattcagcggcattctctctggttcactttcctttatcttcggtaagttggatgaaggcatgacgttgagtgaggcgaccaatatcgccaaacaaaatggctttacagagccggatcctcgtgatgatctgtccggaatggatgtggcgcgtaaactgttgatcttggcgcgtgaagcgggcatggcattagagctggaagatgtcgaagtggatcaagccttgccaccaagttttgatgattcaggcagtgtcgatgaatttatggctcgactaccggaagctgatgcgtacttcaagcaactttctgcgcaagcggccgaagaaggcaaagtactgcgttatgtcggtgaaatcatcgatggtaagtgcaaagtctcgatcgctgcggtagatgaaaatgatccgatgttcaaaattaaagatggtgaaaatgcgttagcattttacagccgttactatcagccgatcccgttagtattgagaggttacggtgccggtactcaagtgactgcggcaggcgtgttctcagatgtgatgcgtactttaggctggaaattaggggtttaa

SEQ ID NO: 70382 - protein, 855 aa, Vibrio vulnificus YJ016
MLGQAAERKNKFQKKACIQQDTGLFLYRLKIIREEGMRVLKFGGSSLADADRFLRAADIVANNAKQEEVSVVLSAPGKTTNKLVAVIESALKNGEAERQVDELDTAFKQLLSDIKQQLPSLNGDAYLKQVADSLSQLRQFVHGIGLLGMCPDNVNARIISKGERVSIQLMKAVLEAKGHLVNLIDPVDYLLAHGDHLEGMVDVDVSTQNFRSNPLPQGHVHIMPGFTAGNKHGELVTLGRNGSDYSAAVLAACLRADCCEIWTDVDGVYNCDPRLVEDARLLKSLSYQEAMELSYFGASVLHPKTIAPIAQFHIPCLIKNSFNPQGAGTLIGQDTGEDNLAIKGITTLNNLTMVNVSGPGMKGMVGMASRVFGAMSASGVSIVLITQSSSEYSISFCIEAADRPLAEQALSDAFELELKDGLLEPVEFLTNVSIITLVGDGMRTSKGVASQFFASLAEVSVNVIAIAQGSSERAISAVIPEDKISQAIKACHENLFNSKHYLDVFVVGVGGVGGELVDQIQRQQAKLADKGIVIRVCGLANSKGLLLDSNGLPLEHWRDRMANASEAFSLASLIATVQRNHIINPVLVDCTSSDVIANQYAEFLAAGFHVVTPNKKANTASMAYYHQLRDVARSSRRKLMYETTVGAGLPVIENLQNLISAGDELERFSGILSGSLSFIFGKLDEGMTLSEATNIAKQNGFTEPDPRDDLSGMDVARKLLILAREAGMALELEDVEVDQALPPSFDDSGSVDEFMARLPEADAYFKQLSAQAAEEGKVLRYVGEIIDGKCKVSIAAVDENDPMFKIKDGENALAFYSRYYQPIPLVLRGYGAGTQVTAAGVFSDVMRTLGWKLGV

SEQ ID NO: 70383 - DNA, 2454 bp, Yersinia pestis biovar Medievalis str. 91001
  CDS (1)..(2454): transl_table=11
gtgctgaaatttggcgggacatcagtggcaaatgccgagcgctttatgcgtgttgccgatatcatcgaaagtaatgcgcgtcagggacaagtggctacggtgttatccgctcccgcgaagataacgaaccatctcgttgccatgatcgataaaatggtcgcagggcaagatatctccccgaacatcagcgatgctgagcggatttttgctgagttattgcgtggattagctgatactcagccaggctttgattatgatcgcctaaaagccttggtcggccatgagtttgcgcaactcaaacacctgctacacggtatttcgttgttggggcagtgcccagacagcattaatgcctcaattatctgccgtggcgaaaaactctccatcgccattatggaggcgttatttcaggctaagggttatcacgttacggtgattaatccagtcgaaaaattgttggcgcagggccattatctcgaatccactgttgatatcacggagtctacccgccgtatcggtgccagcggtattccatctgatcacatcatcctgatggctggttttactgcgggtaatgataaaggtgaattggtggtgttggggcgtaatggctctgattattccgctgccgtgctggctgcttgcttacgggcagattgttgtgagatttggaccgatgtcgacggggtctatacttgtgacccgcgtaccgttccagatgccagattactgaaatcgatgtcataccaagaggcaatggagctttcctattttggtgctaaagttcttcaccctcgcactatcgctcctattgcccgcttccaaattccttgtctgataaaaaacacctctaacccgcaagcccccggtaccttgattggtggtgaaagcattgatgaggattctccggtcaaaggcattaccaacctgaataatatggcgatgattaatgtttcagggccaggaatgaaagggatggtcggtatggctgcccgcgtctttgcggtgatgtcgcgcagcggtatttcagtggtgctaatcactcagtcctcttctgaatacagcatcagtttttgtgtgccgcaaggtgagttattgcgcgcccgccgagcgctggaagatgagttttatctggagttgaaagacggtgtcttggatcctctggatgtgatggaacatctggcaattatctctgtggtcggtgacggtatgcgcaccctgcgcggtatttctgcccgtttcttctcggctctggcgcgcgccaacatcaatattattgctatcgctcaaggctcgtctgagcgctctatttctgtggttgtcaataatgatgcggtcactaccggggtgcgagtttgccaccagatgctgtttaacacggatcaagtcattgaggtgtttgtcattggcgtgggtggtgtggggggcgcattaatcgaacaaatctatcgccagcaaccgtggttgaaacagcgtcatattgatttacgtgtttgtggtatcgcgaattccaaagccatgttgaccaacgtgcatggcattgcattagataactggcgtcaggaactggctgaagttcaggagccgtttaacctgagccgcttgatccgtctggttaaagagtatcacttactgaacccggtcattgttgactgtacctcaagccaggcggttgctgatcaatatgctgatttcctgaccgatggcttccatgtggtgacgccaaacaagaaagccaacacttcatcaatgaattattaccgccaaatgcgtgccgctgcgacgaaatcgtgccgtaaattcttgtatgacacaaacgttggggcggggctaccggtgatcgagaacttacagaacctgctcaatgcgggtgatgaactgatgcgcttcaccggtattctgtccggttcactttccttcatcttcggtaagctagatgaggggatgtcattgtcagaggcaacacggcaagctaaggcgttggggtataccgaacccgatccacgtgatgatctctctgggatggatgttgcccgtaaattgttgattttggcccgtgaagcagggtacaaacttgagttggctgatatcgaggttgagtccgtcttaccagcaagctttgatgcttcaggtgatgtggatactttcctggcgcgcctgccatcattggatgctgaatttacccgcttggtagcgaatgctgcggagcagggcaaagtgctacgttatgtcggagtgattgaagacgggcgttgtaaagtgcggatggaggcagttgacggtaacgacccgttgtataaagttaagaatggcgagaatgcgttggctttctatacccgctattatcagccaattccgttggtgctacgcggttatggcgcaggcaatgatgtgactgccgctggggtgtttgccgatcttttacgcacattatcatggaagttgggagtttaa

SEQ ID NO: 70384 - protein, 817 aa, Yersinia pestis biovar Medievalis str. 91001
MLKFGGTSVANAERFMRVADIIESNARQGQVATVLSAPAKITNHLVAMIDKMVAGQDISPNISDAERIFAELLRGLADTQPGFDYDRLKALVGHEFAQLKHLLHGISLLGQCPDSINASIICRGEKLSIAIMEALFQAKGYHVTVINPVEKLLAQGHYLESTVDITESTRRIGASGIPSDHIILMAGFTAGNDKGELVVLGRNGSDYSAAVLAACLRADCCEIWTDVDGVYTCDPRTVPDARLLKSMSYQEAMELSYFGAKVLHPRTIAPIARFQIPCLIKNTSNPQAPGTLIGGESIDEDSPVKGITNLNNMAMINVSGPGMKGMVGMAARVFAVMSRSGISVVLITQSSSEYSISFCVPQGELLRARRALEDEFYLELKDGVLDPLDVMEHLAIISVVGDGMRTLRGISARFFSALARANINIIAIAQGSSERSISVVVNNDAVTTGVRVCHQMLFNTDQVIEVFVIGVGGVGGALIEQIYRQQPWLKQRHIDLRVCGIANSKAMLTNVHGIALDNWRQELAEVQEPFNLSRLIRLVKEYHLLNPVIVDCTSSQAVADQYADFLTDGFHVVTPNKKANTSSMNYYRQMRAAATKSCRKFLYDTNVGAGLPVIENLQNLLNAGDELMRFTGILSGSLSFIFGKLDEGMSLSEATRQAKALGYTEPDPRDDLSGMDVARKLLILAREAGYKLELADIEVESVLPASFDASGDVDTFLARLPSLDAEFTRLVANAAEQGKVLRYVGVIEDGRCKVRMEAVDGNDPLYKVKNGENALAFYTRYYQPIPLVLRGYGAGNDVTAAGVFADLLRTLSWKLGV

SEQ ID NO: 70385 - DNA, 2766 bp, Oryza sativa (japonica cultivar-group)
  CDS (1)..(2766)
atgtggagcctcgccgtcgcgagcccgcaccccgccgccgccttcgccgcggcccgtccccgccgcggccctcgccccgccgccgccccctcccacagaggtgtgaatccgcagcggtggcgatgtgagaagactcaggcatggtcgttttggagctctctgtgggccagcgaccttccaggaggactttatggggatgtttcgaagaatatgctcaagccagctgctgctgtttcagttgagcaagctgaagctagtgctcaccttccaaaaggtgacatgtggtctgtgcataaatttggtgggacctgcatgggaacctcccagaggattcagaatgtggctgacataatccttcgcgacccttctgagaggaaactggtagttgtgtctgcaatgtctaaagtcactgacatgatgtacaaccttgtaaataaggctcaatcaagggatgattcttatatcactgcacttgatgaagttttcgagaagcatatggcagcagcaaaggatctgcttggaggagaggaccttgcaagattcttatctcagttgcacgcggatgtcagtaacctaaaagcaatgcttcgtgcaatttgcatagctgggcatgccacggagtctttctcagattttgttgttggacatggagagatatggtcagctcaattgttgtcatttgccataaagaagtctggaaccccttgcagttggatggacacacgagaagttttagttgtaaatcctacaggttccaaccaagtagatcctgactatttggaatctgagaaacgacttgagaaatggttcgctcgacagccagctgagacaataattgctactgggtttattgcgagtacacctgaaaacattcctacaaccttgaaaagagatggaagtgatttctctgcagccataattggttcacttgttaaggctggtcaggtcactatctggactgatgttgatggggtctttagtgcagatcccagaaaagttagcgaggctgtcatattaagcactttatcatatcaggaggcgtgggaaatgtcgtattttggggcaaatgtattacatccgcgtaccatcatacctgtgatgaaatacaatatcccaattgttataagaaatatgttcaatatttctgcccctggtaccatgatctgccagcagcctgcgaatgaaagtggtgatttggaggcttgcgtcaaagcatttgcaactatagataaattgtctcttgttaacgttgaaggaactggaatggctggtgttcctggtactgcaagtgccatatttggtgctgtgaaggatgttggagctaatgttatcatgatatcgcaggctagtagtgaacactccgtatgctttgctgtaccagaaaaggaagttgctgcagtttctgcagctttgcatgtcaggttccgtgaagcattatctgcaggcaggctatctaaggtcgaagtcattcataattgtagcatccttgctgctgtcggcctgaagatggcaagtactcctggggtcagtgcaaccctttttgatgcacttgcaaaggcaaatattaatgtaagggcaatagctcaaggttgtagtgagtacaacatcactgttgtattgaagcaagaggactgcgtaagggctcttagagctgctcactcaaggttcttcctctccaaaaccacacttgctgtcggaattattggacctgggttgattggtcgtactctccttaaccagctgaaggatcaggctgcagttcttaaggaaaatatgaacattgatctgcgtgtcatgggaatcactggttcgaggacaatggttttgagtgatacaggaatagatttggcccattggaaagagcagctacaaactgaagcagaaccagccaaccttgacaagtttgttgatcatttgtccgagaatcaattattccctaacagggttttggtggactgcacagcagacacaagtgttgcatcccactattatgactggttaaagaagggaatccatgtcatcacgccaaataagaaagcaaattcagggccactggacaagtatttgaaacttaggactctacaacgtgcatcatatacccattacttctatgaagcaactgttggtgctggccttcctatcattagcactctgcgcggtctcctggaaacaggtgacaagatattgcgtattgaggggatcttcagtggaacattgagttacattttcaacaattttgaaggaacaagagctttcagtgatgttgtttctgaagcaaaagaggctggatacactgaacctgatccaagagatgatctgtctggaactgatgtagccagaaaggtaataattcttgctagggaatctggattgaagcttgagctttctgatattcctgtaaggagtcttgtgccggaggcattgagatcctgttcaacagctgatgaatacatgcaaaagttaccatcctttgaccaggactgggcaagagagagtaaagatgctgaagctgccggagaagttttgcggtatgttggagtggtggatttggtgaacaaggagggtcaggtcgagctgcggaggtacaagaaggaccacccgttcgcgcagctatctggctccgacaacatcatcgccttcacgacgtcaagatacaaggagcaaccgctgatcgtgcgaggcccgggcgccggtgcagaggtgaccgcaggaggtgtcttcagtgacatactacggctggcctcctacctaggcgctccctcataa

SEQ ID NO: 70386 - protein, 921 aa, Oryza sativa (japonica cultivar-group)
MWSLAVASPHPAAAFAAARPRRGPRPAAAPSHRGVNPQRWRCEKTQAWSFWSSLWASDLPGGLYGDVSKNMLKPAAAVSVEQAEASAHLPKGDMWSVHKFGGTCMGTSQRIQNVADIILRDPSERKLVVVSAMSKVTDMMYNLVNKAQSRDDSYITALDEVFEKHMAAAKDLLGGEDLARFLSQLHADVSNLKAMLRAICIAGHATESFSDFVVGHGEIWSAQLLSFAIKKSGTPCSWMDTREVLVVNPTGSNQVDPDYLESEKRLEKWFARQPAETIIATGFIASTPENIPTTLKRDGSDFSAAIIGSLVKAGQVTIWTDVDGVFSADPRKVSEAVILSTLSYQEAWEMSYFGANVLHPRTIIPVMKYNIPIVIRNMFNISAPGTMICQQPANESGDLEACVKAFATIDKLSLVNVEGTGMAGVPGTASAIFGAVKDVGANVIMISQASSEHSVCFAVPEKEVAAVSAALHVRFREALSAGRLSKVEVIHNCSILAAVGLKMASTPGVSATLFDALAKANINVRAIAQGCSEYNITVVLKQEDCVRALRAAHSRFFLSKTTLAVGIIGPGLIGRTLLNQLKDQAAVLKENMNIDLRVMGITGSRTMVLSDTGIDLAHWKEQLQTEAEPANLDKFVDHLSENQLFPNRVLVDCTADTSVASHYYDWLKKGIHVITPNKKANSGPLDKYLKLRTLQRASYTHYFYEATVGAGLPIISTLRGLLETGDKILRIEGIFSGTLSYIFNNFEGTRAFSDVVSEAKEAGYTEPDPRDDLSGTDVARKVIILARESGLKLELSDIPVRSLVPEALRSCSTADEYMQKLPSFDQDWARESKDAEAAGEVLRYVGVVDLVNKEGQVELRRYKKDHPFAQLSGSDNIIAFTTSRYKEQPLIVRGPGAGAEVTAGGVFSDILRLASYLGAPS

SEQ ID NO: 70387 - DNA, 2460 bp, Erwinia carotovora subsp. atroseptica SCRI1043
  CDS (1)..(2460): transl_table=11
atgcgagtgttgaaatttggcgggacttcagtagcgaatgcggagcgctttgcccgcgttgccgacattatcgaaaataacgcgcgccagggacaggtcgctaccgtattgtccgcgccggcgaaaattaccaaccatctggttgccatgattgagaaaaccgtcgccggacaagatatcctgcctcatttaaacgacgccgaaactatcttctcttcgctgctgcaaggtcttgctgcatcccagccgggttttgaacacgcccgcctgaaggcattcgtggaacaggaattcgcacagctgaaacacgtcttgcatggtatcgctctgctggggcagtgtcctgacagcgtgaatgccgcgatcatctgccgaggggaaaaactgtctattgccatcatggaagcggtctttcaggcgcgcggctatggggtatccgtcatcaatccggtcgaaaaactgctagcgcagggacattatctcgaatctaccgtcgatatcactgagtcgactcgccgtatcgctgaaagcgcgatcccgaaagatcatgtgatcctgatggcaggctttactgctggcaacgacaaaggcgagctggtggtgctgggccgcaacggttcagactattccgctgcggtgctggctgcgtgcctgcgtgcggactgttgtgagatctggaccgatgttgacggcgtttatacttgcgatcctcgtcaggtgccggatgcccgattattgaaatcaatgtcctatcaggaggcgatggagctgtcctatttcggcgccaaagttctccaccctcgcaccattgctcctatcgcccagttccagattccctgtctcatcaaaaacactgaaaatcctcaggctcccggtacgctcatcggcatggacagtaccgatacacagtatccggtgaagggcattaccaacctgaacaacatggcgatggttaacgtatccggccccggcatgaaaggtatggtcggcatggcagcgcgcgtgtttgccgcgatgtcgcgtgcgggtatctctgtggtgctgatcacgcagtcatcttctgaatacagcatcagcttctgcgtatcgcagaacgagctggcgcgtgccagaaaaacgctggaagacgagttctatctggaactgaaagaaggcgtgctggagccgctggatgtgatggaacgtctggcgatcatctctgtggtgggcgatggcatgcgcacgttgcgcggtctgtctgctcgtctgttctctgcgctggcgacggcaaacatcaatatcgtggctatcgcacagggctcgtccgagcgctctatctctgtcgtagtcaacaatgatgtcgccacgactggcgtgcgcgttgcacaccagatgctgtttaacaccgatcaggtgatcgacgtgtttgttatcggcgtcggcggcgtgggtggtgcactgctggagcaaattcaccgccagcagccgtggttgaaagacaagcatatcgacctgcgtgtgtgtgggatcgccaattctaaagccatgctgaccaacattaacggcgtttcgatggacacctggcgtgaagatctggcaaaagctcgtgagccgttcaatctgggccgtctgattcgtctggttaaagagtatcacctactgaacccagtgattgtcgattgcacctcgaatcaggctgttgccgatcagtatgtggatttcctggccgacggcttccacgtggtgacgccaaacaagaaagccaacaccgggtcgatgaattattatcatcaactgcgtagcgccgcatcgaaatcccgtcgtcgtttcctgtatgacaccaacgtcggtgcaggtctgccggtgatcgagaacctgcaaaatctgctgaatgcgggtgatgagctgattcgctttaccggtattctctctggctcgctgtcctttattttcggtaaactcgatgaaggcatgtcactgtcggaagcgacgacgcaggcgaaagaaaaaggctataccgaacccgatccacgtgacgatctgtctggtatggacgtggcgcgtaagctgctgattctggcgcgtgaagcgggttatcaattggagctgggtgatattgaggtggagtccgttctgcctatcagtttcgatgcctccggcgatgtcgccagctttatgcagcgcctgccggcggcagacgatgagtttgccagccgtgttgcacaagcgcgtgatgaaggtaaagtattgcgctatgtcggcgtcattgaagaaggtcgctgtaaggtcaaaatcagtgcggttggcggtaacgatccactgtttaaagtcaaagatggtgagaatgcgctggcgttctacagccgttattatcagccactgccgcttgtattgcgcgggtatggcgcgggtaacgatgttaccgctgctggtgtgttcgccgatctgctgcgcaccttgtcatggaagttgggagcataa

SEQ ID NO: 70388 - protein, 819 aa, Erwinia carotovora subsp. atroseptica SCRI1043
MRVLKFGGTSVANAERFARVADIIENNARQGQVATVLSAPAKITNHLVAMIEKTVAGQDILPHLNDAETIFSSLLQGLAASQPGFEHARLKAFVEQEFAQLKHVLHGIALLGQCPDSVNAAIICRGEKLSIAIMEAVFQARGYGVSVINPVEKLLAQGHYLESTVDITESTRRIAESAIPKDHVILMAGFTAGNDKGELVVLGRNGSDYSAAVLAACLRADCCEIWTDVDGVYTCDPRQVPDARLLKSMSYQEAMELSYFGAKVLHPRTIAPIAQFQIPCLIKNTENPQAPGTLIGMDSTDTQYPVKGITNLNNMAMVNVSGPGMKGMVGMAARVFAAMSRAGISVVLITQSSSEYSISFCVSQNELARARKTLEDEFYLELKEGVLEPLDVMERLAIISVVGDGMRTLRGLSARLFSALATANINIVAIAQGSSERSISVVVNNDVATTGVRVAHQMLFNTDQVIDVFVIGVGGVGGALLEQIHRQQPWLKDKHIDLRVCGIANSKAMLTNINGVSMDTWREDLAKAREPFNLGRLIRLVKEYHLLNPVIVDCTSNQAVADQYVDFLADGFHVVTPNKKANTGSMNYYHQLRSAASKSRRRFLYDTNVGAGLPVIENLQNLLNAGDELIRFTGILSGSLSFIFGKLDEGMSLSEATTQAKEKGYTEPDPRDDLSGMDVARKLLILAREAGYQLELGDIEVESVLPISFDASGDVASFMQRLPAADDEFASRVAQARDEGKVLRYVGVIEEGRCKVKISAVGGNDPLFKVKDGENALAFYSRYYQPLPLVLRGYGAGNDVTAAGVFADLLRTLSWKLGA

SEQ ID NO: 70389 - DNA, 2451 bp, Mannheimia succiniciproducens MBEL55E
  CDS (1)..(2451): transl_table=11
atgcgcgtacttaaatttggcggcacctcgcttgccaacccggaaagatttttgcaggcagcccggcttatcgaaaaagctcatttggaagagcaggccgccgccgttttgtcggcgcccgcaaaaattaccaatcacctcgtcgctctttctgaaaaagccagccttaatcaacctaccgaaacaaattttaatgaagcgttagacattttttataacattattaacgggctgcatgaaaaaaataataattttgatcttaaaggtacatcgcagcttatcgaaagcgaattcaatcagcttgcggaattattagaacaaattcgccaagcgggcaaagtggaagacgcggtaaaagcaacaatcgactgtcgcggtgaaaaattatctatcgctatgatgaaagcctggtttgaagcttgcggatatgaggtaacggtaattaatccggtggaaaaactgttagcttacggcaattacctggagtcatcggtcgatattgaggaatcggcaaaacgtgttgatgtggcttcaattccgaaaaataacgtcgtattaatggcgggatttaccgcaggaaatgaaaaaggcgaacttgttctgttaggacgtaacggttcggattattccgccgcttgtttagcggcctgcttgaacgccagtgcttgcgaaatctggactgatgttgacggcgtgtttacctgcgatccgcgtttggtaccggatgcccgtttgctgccaagtctttcttaccgcgaagcgatggaattgtcttatttcggtgcaaaagtgattcatccgagaaccatcggcccgttagttcgcagcaatattccttgtttgattaaaaatacgggaaatccgaccgcccccggttctattattgacggaaatgagccgcaatcaggcgaattacaggttaaaggtattaccaatttagataatgtggcgatgtttaatgtgtcgggtccgggtatgcaaggcatggtaggcatggctgcacgggttttctcaacgatgtcgaaagccggtgtttccgttattttgattactcaatcttcttccgaatacagtattagtttctgtgtgccgagtaaattagctgcgaaagcaaaagacgcgttaaatacggaattcgctaaagaattattagacaaagatttagaaccggttgaggttatcgaagatctttcaattatttccgtagtcggcgacggtatgaaacaggcgaaaggtattgcggcgcgtttcttctccgcattatcacaggcgaatatcagcattgtcgccattgcccaggggtcttccgaacgttcgatttccgccgtagtggcgcaaaataaagctattgaagcggtgaagtccacccaccaggcacttttcaacaataagaaaagcgtcgatatgtttcttgtgggggtcggcggtgtcggtggcgaattaatcgaacagattaagcagcaaaaagagtatctggcaaaaaaggatattgaaattcgggtttgcgctttggcaaactcgaataaaatgttgttgaatgaaaacggtttatcgctggataactggaaagaagatctatccaatgccacccaaccgtcggactttgacgtattactgtcatttattaaattgcaccatgtggtgaatccggtatttgtggactgcacaacggcagagtccgtatccggtttatatgcgcgcgctttaagcgagggttttcatgtggttacgccaaataaaaaagccaatacccgcgaaatggcgtattataatttggtacgtgaaaatgcgcgcaaaaatcaacgtaaattcctgtacgataccaatgtcggtgcgggcttgccggttatcgaaaatctgcagaatttgcttgccgccggcgatgaagtagaacgtttcaacggaattttatccggttccttatcctttattttcggtaaactggaagaaggtctgacattgtcgcaggcaacggcgcttgcccgtgaaaaaggctttaccgagccggatccgcgtgacgatttatccggtcaggatgtggcgcgtaagctgttaattttagcccgcgaaagcggtttagaattagaactttccgatgtggaagtggaaagcgtattgccgaaaggtttttccgaaggaaaaagtgcggtggaatttatggaaattttgccgcaactggatgccgaatttgccgcccgtgtagaaaaagcaggtgctcagaataaggttttacgttatgtcggacaaataaatgacggcaaatgcaaggtgtcgattgtggaagtcgatgcggacgatccgttatataaagtcaaaaacggtgaaaacgcactggcattttatactcgctactatcaaccgattccgctattattacgtggttacggtgcaggtaatgcggtaaccgccgccggtatttttgccgatatcctcagaacgttaagaaattaa

SEQ ID NO: 70390 - protein, 816 aa, Mannheimia succiniciproducens MBEL55E
MRVLKFGGTSLANPERFLQAARLIEKAHLEEQAAAVLSAPAKITNHLVALSEKASLNQPTETNFNEALDIFYNIINGLHEKNNNFDLKGTSQLIESEFNQLAELLEQIRQAGKVEDAVKATIDCRGEKLSIAMMKAWFEACGYEVTVINPVEKLLAYGNYLESSVDIEESAKRVDVASIPKNNVVLMAGFTAGNEKGELVLLGRNGSDYSAACLAACLNASACEIWTDVDGVFTCDPRLVPDARLLPSLSYREAMELSYFGAKVIHPRTIGPLVRSNIPCLIKNTGNPTAPGSIIDGNEPQSGELQVKGITNLDNVAMFNVSGPGMQGMVGMAARVFSTMSKAGVSVILITQSSSEYSISFCVPSKLAAKAKDALNTEFAKELLDKDLEPVEVIEDLSIISVVGDGMKQAKGIAARFFSALSQANISIVAIAQGSSERSISAVVAQNKAIEAVKSTHQALFNNKKSVDMFLVGVGGVGGELIEQIKQQKEYLAKKDIEIRVCALANSNKMLLNENGLSLDNWKEDLSNATQPSDFDVLLSFIKLHHVVNPVFVDCTTAESVSGLYARALSEGFHVVTPNKKANTREMAYYNLVRENARKNQRKFLYDTNVGAGLPVIENLQNLLAAGDEVERFNGILSGSLSFIFGKLEEGLTLSQATALAREKGFTEPDPRDDLSGQDVARKLLILARESGLELELSDVEVESVLPKGFSEGKSAVEFMEILPQLDAEFAARVEKAGAQNKVLRYVGQINDGKCKVSIVEVDADDPLYKVKNGENALAFYTRYYQPIPLLLRGYGAGNAVTAAGIFADILRTLRN

SEQ ID NO: 70391 - DNA, 2448 bp, Haemophilus influenzae 86-028NP
  CDS (1)..(2448): transl_table=11
atgcgcgtacttaaatttggcggcacttcgcttgcaaatccggaacgtttttcccaagcggcgaaattgatcgaacaagctcatttagaagagcaggctgcaggtgttttatctgcaccagccaaaataaccaaccatctcgtcgccctttctgaaaaagctgcattaaatcaatcaaccgatacgcatttcaacgaagcaatcgaaattttctataacatcatcaatggcttacatgccgaaaataatcaattcgacttaaatggcaccaaggcacttattgatgctgaatttgctcaaatcaaaggattattagaagaaattcgtcaggcaggaaaagtagaagatgcagttaaagcgaccattgattgccgtggggaaaaactttctattgcaatgatgaaagcttggtttgaagcgcgtggctatagcgtacatattgtggatcctgtcaaacaattattggcaaaaggcggttatcttgaatcttctgttgaaattgaagaatcaacaaaacgtgttgatgcagcaaatatcgcaaaagataaagtggtgctgatggcaggttttactgcgggtaatgaaaaaggcgagttggtattgctcggtcgtaatggctcagactattctgccgcctgtttagccgcttgtttaggcgcaagtgtatgcgaaatttggaccgatgtggacggcgtttatacttgcgatccgcgtttagtgcctgatgcacgtttattaccaacgctttcttatcgtgaagcgatggaactctcttatttcggtgcgaaagtgattcatcctcgtacgattgggccattgttgccacaaaatattccttgtgtcattaaaaatacaggaaatccttctgcgccaggttcgattattgatggcaatgtgaaatcagaaagtttgcaagttaaaggtatcactaacttagacaatttggcgatgtttaatgtgtcaggccccggtatgcaaggtatggtaggcatggcatctcgcgtattttcagccatgtcaggcgcaggcatttcagttattttaattactcagtcttcgtctgaatatagtattagtttctgtgtgcctgtgaaatctgcagaagtagcgaaaaccgtactagaaacggagtttgctaatgaattaaatgaacatcaattagaatcaattgaagtgattaaagatttatccattatttctgttgtgggcgatggaatgaagcaagcgaaaggcattgctgctcgtttcttctcggcattagcgcaggcaaacattagcattgtggcgattgcacaaggatctagcgaacgttcaatttctgcggttgtgccgcaaaataaagccattgaagcggtgaaggctacccatcaggcgcttttcaataataaaaaagtcgtggatatgtttttagtgggcgttggtggagtaggcggagaattaatagagcaggtaaagcgtcaaaaggagtatctagcaaagaagaatgttgaaattcgagtttgtgctattgcgaattccaaccgtatgttgcttgatgaaaatggattaaatttagaggattggaaaaacgatttagaaaatgcgactcagccatcagattttgatgtattgctttctttcattaaattacatcatgtggtgaatccagtatttgtagattgtacttcagccgaatctgtagcagggctttatgctcgtgcgttaaaagaaggtttccatgtggttacgccaaacaaaaaagcgaatacacgagaattagtttattacaatgagttacgccaaaatgcccaagcaagccagcataaatttttatatgaaaccaatgtaggtgcgggcttgccagttattgaaaatctccaaaacttacttgcagcaggtgatgagcttgaatattttgaagggattttatctggctcgctttcctttatttttggtaagttggaagaaggactttctctttcagaagtaaccgcacttgcgcgtgaaaaaggctttactgagccagatcctcgagatgatctttctggacaagatgtagcgcgcaaattattaattcttgctcgtgaagcgggaattgaacttgaactttcagatgttgaagttgaaggtgtattgccgaaaggcttctctgaaggaaaatctgcagatgagtttatggcaatgttgccacagcttgacaaggagtttaaaactcgcgttgccacagctaaagcagaaggcaaagtattgcgttatgttggaaaaattagtgaaggaaaatgcaaagtatccatcgttgcggtagatctgaataatccactttataaagtgaaagatggtgaaaatgccttggcattttatactcgttattatcaaccgattccacttttattacgtggttatggcgcaggtaatgcagttactgcggcaggtatctttgcagatattttaagaacattacaacattaa

SEQ ID NO: 70392 - protein, 815 aa, Haemophilus influenzae 86-028NP
MRVLKFGGTSLANPERFSQAAKLIEQAHLEEQAAGVLSAPAKITNHLVALSEKAALNQSTDTHFNEAIEIFYNIINGLHAENNQFDLNGTKALIDAEFAQIKGLLEEIRQAGKVEDAVKATIDCRGEKLSIAMMKAWFEARGYSVHIVDPVKQLLAKGGYLESSVEIEESTKRVDAANIAKDKVVLMAGFTAGNEKGELVLLGRNGSDYSAACLAACLGASVCEIWTDVDGVYTCDPRLVPDARLLPTLSYREAMELSYFGAKVIHPRTIGPLLPQNIPCVIKNTGNPSAPGSIIDGNVKSESLQVKGITNLDNLAMFNVSGPGMQGMVGMASRVFSAMSGAGISVILITQSSSEYSISFCVPVKSAEVAKTVLETEFANELNEHQLESIEVIKDLSIISVVGDGMKQAKGIAARFFSALAQANISIVAIAQGSSERSISAVVPQNKAIEAVKATHQALFNNKKVVDMFLVGVGGVGGELIEQVKRQKEYLAKKNVEIRVCAIANSNRMLLDENGLNLEDWKNDLENATQPSDFDVLLSFIKLHHVVNPVFVDCTSAESVAGLYARALKEGFHVVTPNKKANTRELVYYNELRQNAQASQHKFLYETNVGAGLPVIENLQNLLAAGDELEYFEGILSGSLSFIFGKLEEGLSLSEVTALAREKGFTEPDPRDDLSGQDVARKLLILAREAGIELELSDVEVEGVLPKGFSEGKSADEFMAMLPQLDKEFKTRVATAKAEGKVLRYVGKISEGKCKVSIVAVDLNNPLYKVKDGENALAFYTRYYQPIPLLLRGYGAGNAVTAAGIFADILRTLQH

SEQ ID NO: 70393 - DNA, 2478 bp, Colwellia psychrerythraea 34H
  CDS (1)..(2478): transl_table=11
atgcgtgtacttaaatttggtggctcttcactagcttcagcagagcgttttcgtcaagttgccgatattatccatgataaaagcaaatcatcaaaacttgccgttgttgtatcggccccacaaggggttaccaaccacttagttgctatgactgaaaatattagcgatgaagaaaaagtagtggcagatttaggtcacttcaaacgtgcaattactactattattgatgatttatcggcaagtataagcaactttaacaatcaacattgtgagcaagcgttagcgaattatgaacatcaaatttcacgctatatgcaaggtgcaatgttactaacctattgcccagatcatatccgtgcccgtattatcagtactggtgaacgtttaagtgtggcaatacttgatgccgtgttacaagcttatagcgtacaagtatcactgttagcaccagaaaagtttttgtataccaacaagtcatctttaaatgcagtagcagatttagtgttgtcgaaagaaaaatttgagcatgaatacactgaattaaatcaagtatcgttaatgccaggctttattggggtgaatgcggacaacaatgatggtacgccagaagtaactacattagggcgtaatggctctgattattcggcagcggtattagctgtttgtgctgtcgctgagtgttgtgagatttggacggatgtagatggagtctataacgcagatccgcgttacattaaagaagctaaattactcgattatttatcgtatcaagaagcaatggagctctcttattttggcgccagtgttttacacccaaaaacaattggaccaattgctcagtatcatatcccttgtttaattaagaataccagtaacccaagtgcaccaggtaccttaatttccaatgagaatgaccaacaaaaacgcgttaaagcaatttctaaccttgatgacttaaccatggtaaacgtgtcaggacctggcatgaaaggcatggtaggcatggcgagccgtgtattcgcaactatgagcagagaaaatatttctttggtgcttattagtcaatcatctagtgagtattgcattagcttctgtatttattcaagtgactctgcgcgtgctaaacaaagcttacacgaagagtttgaattagagctgttaaatggcctacttgaaccgttagcgctaaaaggtgaactatcaattgtgtcacttgttggtgatggtatgcaccatcaacgaggcgtggcagctaaattctttagttcattagcacaagcacgagttaatgtggttgctattgctcaagattcatcggagcgcagtatctcagttgttgtggaacaacgaaaatgtatggatgcgatgaaagtaagtcaccagaacttcttttctcataaaccaacgattgatgttttcttagtcggctgtggtgttgttggcagtgagctaatagcgcaaatatctcgtcaacaagcgagtttgaaaaagcaaaacattgtcttgaaagtttacggtattgctaactcgaaaggcatggtatttgataaagaaggtatcgacttaaataactggcaagatgctatggcgaatgcaactgaagcgctagcagttaatgtagataatcttaaaggttttgttcgtgataaccatctaatcaaccctgtttttgttgactcaacgtcaaatgaaacattagcaatgagttatgtagattaccttgctgaaggttttcatattgttacgccaaataaaaaagcaaatactgactcttgggaatattatcaagagttacgtagtactgcacaaaaaaccaatcgtcgtttcttatatgaaacaacggtcggtgctggtttacctgttattgataccctacaaagcttaattaaagcgggcgatgagttacagcgtttcgaaggtgtcttgtcgggttcgttatcttatatgtttggtaaattagaagagggtatgtcgttatcagaggcgactgcaattgctaaagaaaatggtttcactgaaccagaccctcgtgatgacttaagtggtatggacgttgcgcgtaaattattaattatggctcgtgaagctggcatgcagttagagttatcagatatcaatattgagtcagtattacccgacgattttgatgccagcggtgatgttagtcagtttatgagtaacttaactaagcttgatggtgactttgcagagcgcgtagcgagtgcaaaattagaaggtaaagtacttcgttatattggtaatattgttgatggtaattgccaagtttctatagagtctgtaggaattaaccacccgttatatagcattaaagatggcgaaaacgccttggctattcatagtcgttattaccagcctttaccgtttgttttacgcggttacggtgcgggcgcagcggttacagctgcaggtgtttttggtgatttattaagaaccttagcatgggagcaacagcactaa

SEQ ID NO: 70394 - protein, 825 aa, Colwellia psychrerythraea 34H
MRVLKFGGSSLASAERFRQVADIIHDKSKSSKLAVVVSAPQGVTNHLVAMTENISDEEKVVADLGHFKRAITTIIDDLSASISNFNNQHCEQALANYEHQISRYMQGAMLLTYCPDHIRARIISTGERLSVAILDAVLQAYSVQVSLLAPEKFLYTNKSSLNAVADLVLSKEKFEHEYTELNQVSLMPGFIGVNADNNDGTPEVTTLGRNGSDYSAAVLAVCAVAECCEIWTDVDGVYNADPRYIKEAKLLDYLSYQEAMELSYFGASVLHPKTIGPIAQYHIPCLIKNTSNPSAPGTLISNENDQQKRVKAISNLDDLTMVNVSGPGMKGMVGMASRVFATMSRENISLVLISQSSSEYCISFCIYSSDSARAKQSLHEEFELELLNGLLEPLALKGELSIVSLVGDGMHHQRGVAAKFFSSLAQARVNVVAIAQDSSERSISVVVEQRKCMDAMKVSHQNFFSHKPTIDVFLVGCGVVGSELIAQISRQQASLKKQNIVLKVYGIANSKGMVFDKEGIDLNNWQDAMANATEALAVNVDNLKGFVRDNHLINPVFVDSTSNETLAMSYVDYLAEGFHIVTPNKKANTDSWEYYQELRSTAQKTNRRFLYETTVGAGLPVIDTLQSLIKAGDELQRFEGVLSGSLSYMFGKLEEGMSLSEATAIAKENGFTEPDPRDDLSGMDVARKLLIMAREAGMQLELSDINIESVLPDDFDASGDVSQFMSNLTKLDGDFAERVASAKLEGKVLRYIGNIVDGNCQVSIESVGINHPLYSIKDGENALAIHSRYYQPLPFVLRGYGAGAAVTAAGVFGDLLRTLAWEQQH

SEQ ID NO: 70395 - DNA, 2451 bp, Haemophilus somnus 129PT
  CDS (1)..(2451)
atgcgagtactcaaatttggcggcacatctttagcgaatccgcaacgctttttacaagcagcagcacttattgaaaaagcacatttagaggaacaagccgccggcgttctctctgcaccggcaaagattaccaatcatcttgtagcactttctgaaaaagccgctttaaatcaacctactgatggtcattttgatgaggctcttgagattttttataatattattaatggcttatatgcagaaaatactcattttgatcttgttggcaccaaagcattaattgagtcggagtttgcacaaattaagggattattagaaaacattcgtcaggcgggaaaagtagacgatgcggtaaaagcgacgattgactgtcgaggtgaaaaattatctattgcgatgatgaacgcttggtttgaagccaaaggatatacggttactgtgattaatccggtagagaaattattggcttatggctcttatttggaaagcagtgtggatattgcggaatcaactaaacgagttgatgcaaaatctattcctgctaaaaatattgttttgatggcaggatttacagctggaaatgacaaaggcgaattagttttattgggtcgtaacggttctgattattcggcagcgtgtttggctgcttgtttaggtgcaagtgtttgtgaaatttggacggatgtagatggtgtttatacctgtgatcctcgtttagtccctgatgctcggttactttccagtttatcttatcgtgaagcaatggagctttcttattttggggctaaagttattcaccctcgcactattggtcctttagttgagccgcaaattccttgtttgataaaaaatacgggtaaccctgaaggtgcaggatcaattattgacaatcgtgaaaatatttctgaagggctacaggttaaaggcattactaatttagataatgttgctatgttcaatgtatcaggaccgggtatgcaggggatggttggtatggcagcgcgtgttttttccgccatgtcaaaagccagcgtttccgttattttaatcacgcaatcttcttctgaatatagtattagtttttgcgtaccgactaaagctattgaaaaagcaaaagcggcactaaatgctgagtttgaacaggagcttgtcgctaaagatcttgatcctgtggaagtaattcatgatttgtcaattatttccgtagtaggtgatggtatggcgcagtctaaagggattgccgctagtttcttttcggcgttagctagtgccaatatcagtattgttgctattgcacaaggctcttccgaacgttcgatttcagcggttgttcctttgaataaggcgattgaagcggttaaagcaactcatcaggcattgttcaataatcgtaaagttgttgatatgtttttagtcggtgttggtggggtcggtggtgaacttattgaacaaattaaacggcaaagtgaatatttggcaaaaaaagatattgagattcgtgtttgtgcattggctaattcgaataaaatgttgttaaatgaaaatgggttaaatcttgataattggcgtgaagatttggcaaatgcaacgcaaccgtcagattttgatgtattgctttctttcattaaattacatcatgtggttaaccctgtttttgtggattgcacaaccgctgaaagtgtagcaggattatatgagagagctttgaaagaaggctttcatgtgattacaccgaacaaaaaagccaatacccgtgagctggattactataaccaagtgcgtgaaaatgcacgtaaaaatcatcgtaaattcctttacgatactaacgttggtgcaggattgcctgtgattgataacttacaaaatctattagccgccggtgatgatgtagtgagttttaacggtattttgtcaggatctctctctttcattttcggtaagttggaggaggggctttctctttcagaagctaccgcacttgcccgtgaaaaaggctttacagaaccggatccgagggatgatttatcagggcaagatgtggctcgtaagttattgattttggcacgtgaaatcggtttagaacttgagttgtcggatattgaggtagagggcgttttaccgcaaggtttctcagagggaaaatcagcagatgaatttatggcgatgttgccttcattggacgaagaatttgcagaacgtgttgcaaaagcaaaatcggaaggcaaagtattgcgttatgtaggacaaattgaagaaggcaaatgtaaggtttctattgttgcagttgatggagacgcaccgttatataaagtgaagaacggtgaaaatgcgttagctttttatactcgttattatcagccgattcctttgttattgcgtggttatggtgctggtaatgcggtaacggctgccggaatttttgccgatattttaagaaccttaaaacattaa

SEQ ID NO: 70396 - protein, 816 aa, Haemophilus somnus 129PT
MRVLKFGGTSLANPQRFLQAAALIEKAHLEEQAAGVLSAPAKITNHLVALSEKAALNQPTDGHFDEALEIFYNIINGLYAENTHFDLVGTKALIESEFAQIKGLLENIRQAGKVDDAVKATIDCRGEKLSIAMMNAWFEAKGYTVTVINPVEKLLAYGSYLESSVDIAESTKRVDAKSIPAKNIVLMAGFTAGNDKGELVLLGRNGSDYSAACLAACLGASVCEIWTDVDGVYTCDPRLVPDARLLSSLSYREAMELSYFGAKVIHPRTIGPLVEPQIPCLIKNTGNPEGAGSIIDNRENISEGLQVKGITNLDNVAMFNVSGPGMQGMVGMAARVFSAMSKASVSVILITQSSSEYSISFCVPTKAIEKAKAALNAEFEQELVAKDLDPVEVIHDLSIISVVGDGMAQSKGIAASFFSALASANISIVAIAQGSSERSISAVVPLNKAIEAVKATHQALFNNRKVVDMFLVGVGGVGGELIEQIKRQSEYLAKKDIEIRVCALANSNKMLLNENGLNLDNWREDLANATQPSDFDVLLSFIKLHHVVNPVFVDCTTAESVAGLYERALKEGFHVITPNKKANTRELDYYNQVRENARKNHRKFLYDTNVGAGLPVIDNLQNLLAAGDDVVSFNGILSGSLSFIFGKLEEGLSLSEATALAREKGFTEPDPRDDLSGQDVARKLLILAREIGLELELSDIEVEGVLPQGFSEGKSADEFMAMLPSLDEEFAERVAKAKSEGKVLRYVGQIEEGKCKVSIVAVDGDAPLYKVKNGENALAFYTRYYQPIPLLLRGYGAGNAVTAAGIFADILRTLKH

SEQ ID NO: 70397 - DNA, 2451 bp, Haemophilus somnus 2336
  CDS (1)..(2451)
atgcgagtactcaaatttggcggcacatctttagcgaatccgcaacgctttttacaagcagcagcacttattgaaaaagcacatttagaggaacaagccgcaggcgttctctctgcaccggcaaagattaccaatcatcttgtagcactttctgaaaaagccgctttaaatcaacctactgatggtcattttgatgaggctattgagattttttataatattattaatggcttatatgcagaaaatactcattttgatcttgttggcaccaaagcattaattgagtcggagtttgcacaaattaagggattattagaaaacattcgtcaggcgggaaaagtagaagatgcggtaaaagcgacgattgactgtcgaggtgaaaaattatctattgcgatgatgaacgcttggtttgaagccaaaggatatacggttactgtgattaatccggtagagaaattattggcttatggctcttatttggaaagcagtgtggatattgcggaatcaactaaacgagttgatgcaaaatctattcctgctaaaaatattgttttgatggcaggatttacagctggaaatgacaaaggcgaattagttttattgggtcgtaacggttctgattattcggcagcgtgtttggctgcttgtttaggtgcaagtgtttgtgaaatttggacggatgtagatggtgtttatacctgtgatcctcgtttagtccctgatgctcggttactttccagtttatcttatcgtgaagcaatggagctttcttattttggggctaaagttattcaccctcgcactattggtcctttagttgagccgcaaattccttgtttgataaaaaatacgggtaaccctgaaggtgcaggatcaattattgacaatcgtgaaaatatttctgaagggctacaggttaaaggcattactaatttagataatgttgctatgttcaatgtatcaggaccgggtatgcaggggatggttggtatggcagcacgtgttttttccgccatgtcaaaagccagcgtttccgttattttaatcacgcaatcttcttctgaatatagtattagtttttgcgtaccgactaaagctattgaaaaggcaaaagcggcactaaatgctgagtttgaacaggaacttgtcgctaaagatcttgatcctgtggaagtaattcatgatttgtcaattatttccgtagtaggtgatggtatggagcggtctaaagggattgccgctagtttcttttcggcattagctagtgccaatatcagtattgttgctattgcacaaggctcttccgagcgttcgatttcagcggttgttcctttgaataaggcgattgaagcggttaaagcaactcatcaggcattgtttaataatcgtaaagttgttgatatgtttttagtcggtgttggtggggtcggtggtgaacttattgaacaaattaaacggcaaagtgaatatttggcaaaaaaagatattgagattcgtgtttgtgcgttggctaattcgaataaaatgttgttaaatgaaaatgggttaaatcttggtaattggcgtgaagatttggcaaatgcaacacaaccgtcagattttgatgtattgctttctttcattaaattacatcatgtggttaaccctgtttttgtggattgcacaaccgctgaaagtgtagcaggattatatgaaagagctttgaaagaaggctttcatgtgattacaccgaacaaaaaagccaatacccgtgagctggattactataaccaagtgcgtgaaaatgcacgtaaaaatcatcgtaaattcctttacgatactaacgttggtgcaggattgcctgtgattgataacttacaaaatctattagccgccggcgatgatgtagtgagttttaacggtattttgtcaggatctctctctttcattttcggtaagttggaggaggggctttctctttcagaagctaccgcacttgctcgtgaaaaaggctttacagaaccggatccgagggatgatttatcagggcaagatgtggctcgtaaattattgattttggcacgtgaaatcggtttagaacttgagttgtcggatattgaggtagagggcgttttaccgcaaggtttctcagagggaaaatcagcagatgaatttatggcgatgttgccttcattggacgaagaatttgcagaacgtgttgcaaaagcaaaatcggaaggcaaagtattgcgttatgtaggacaaattgaagaaggcaaatgtaaggtttctattgttgcagttgatggagacgcaccgttatataaagtgaagaacggtgaaaatgcgttagctttttatactcgttattatcagccgattcctttgttattgcgtggttatggtgctggtaatgcggtaacggctgccggaatttttgccgatattttaagaaccttaaaacattaa

SEQ ID NO: 70398 - protein, 816 aa, Haemophilus somnus 2336
MRVLKFGGTSLANPQRFLQAAALIEKAHLEEQAAGVLSAPAKITNHLVALSEKAALNQPTDGHFDEAIEIFYNIINGLYAENTHFDLVGTKALIESEFAQIKGLLENIRQAGKVEDAVKATIDCRGEKLSIAMMNAWFEAKGYTVTVINPVEKLLAYGSYLESSVDIAESTKRVDAKSIPAKNIVLMAGFTAGNDKGELVLLGRNGSDYSAACLAACLGASVCEIWTDVDGVYTCDPRLVPDARLLSSLSYREAMELSYFGAKVIHPRTIGPLVEPQIPCLIKNTGNPEGAGSIIDNRENISEGLQVKGITNLDNVAMFNVSGPGMQGMVGMAARVFSAMSKASVSVILITQSSSEYSISFCVPTKAIEKAKAALNAEFEQELVAKDLDPVEVIHDLSIISVVGDGMERSKGIAASFFSALASANISIVAIAQGSSERSISAVVPLNKAIEAVKATHQALFNNRKVVDMFLVGVGGVGGELIEQIKRQSEYLAKKDIEIRVCALANSNKMLLNENGLNLGNWREDLANATQPSDFDVLLSFIKLHHVVNPVFVDCTTAESVAGLYERALKEGFHVITPNKKANTRELDYYNQVRENARKNHRKFLYDTNVGAGLPVIDNLQNLLAAGDDVVSFNGILSGSLSFIFGKLEEGLSLSEATALAREKGFTEPDPRDDLSGQDVARKLLILAREIGLELELSDIEVEGVLPQGFSEGKSADEFMAMLPSLDEEFAERVAKAKSEGKVLRYVGQIEEGKCKVSIVAVDGDAPLYKVKNGENALAFYTRYYQPIPLLLRGYGAGNAVTAAGIFADILRTLKH

SEQ ID NO: 70399 - DNA, 2448 bp, Haemophilus influenzae R2846
  CDS (1)..(2448)
atgcgcgtacttaaatttggcggcacttcgcttgcaaatccggaacgtttttcccaagcggcgaaattgatcgagcaagctcatttagaagagcaggctgcaggtgttttatcagcaccagccaaaataaccaaccatctcgtcgccctttctgaaaaagctgcattaaatcaatcaaccgatacgcatttcaacgaagcaatcgaaattttctataacatcattaatggcttacatgccgaaaataatcaattcgacttaaatggcaccaaggcacttattgatgctgaatttgctcaaatcaaaggattattagaagaaattcgtcaggcaggaaaagtagaagatgcagttaaagcgaccattgattgccgtggggaaaaactttctattgcaatgatgaaagcttggtttgaagcacgtggctatagcgtacatattgtggatccggtcaagcaattattagcaaaaggcggttatcttgagtcttcagttgaaattgaagaatcaacaaaacgtgttgatgcagcaagtattgcaaaagataaagtggtgctgatggcaggttttactgcgggtaatgaaaaaggcgagttggtattgctcggtcgtaatggctcagactattctgcagcctgtttagccgcttgtttaggcgcaagtgtatgcgaaatttggaccgatgtggacggcgtttatacttgcgatccgcgtttagtgcctgatgcacgtttattaccaacgctttcttatcgtgaagcgatggaactctcttatttcggtgcgaaagtgattcatcctcgtacgattgggccattgttgccacaaaatattccttgtgtcattaaaaatacaggaaatccttctgcgccaggttcgattattgatggcaatgtgaaatcagaaagtttgcaagttaaaggtatcactaacttagacaatttggcgatgtttaatgtgtcaggccctggtatgcaaggtatggtaggcatggcatctcgcgtattttcagccatgtcaggtgcaggcatttcagttattttaattactcagtcttcgtctgaatatagtattagtttctgtgtgcctgtgaaatctgcagaagtagcgaaaaccgtactagaaacggagtttgctaatgaattaaatgaacatcaattagaatcaattgaagtgattaaagatttatccattatttctgttgtgggcgatggaatgaagcaagcgaaaggcattgctgctcgtttcttctcggcattagcgcaggcaaacattagcattgtggcgattgcacaaggatctagcgaacgttcaatttctgcggttgtgccgcaaaataaagccattgaagcggtgaaggctacccatcaggcgcttttcaataataaaaaagtcgtggatatgtttttagtgggcgttggcggagtaggcggagaattaattgagcaggtaaagcgtcaaaaggagtatctagcaaagaagaatgttgaaattcgagtttgtgctattgcgaattccaaccgtatgttgcttgatgaaaatggattaaatttagaggattggaaaaacgatttagaaaatgcgactcagccatcagattttgatgtattgctttctttcattaaattacatcatgtggtgaatccagtatttgtagattgtacttcagccgaatctgtagcagggctttatgctcgtgcgttaaaagaaggtttccatgtggttacgccaaacaaaaaagcgaatacacgagaattagtttattacaatgagttacgccaaaatgcccaagcaagccagcataaatttttatatgaaaccaatgtaggtgcgggcttgccagttattgaaaatctccaaaacttacttgcagcaggtgatgagcttgaatattttgaagggattttatctggctcgctttcctttatttttggtaagttggaagaaggactttctctttcagaagtaaccgcacttgcgcgtgaaaaaggctttactgagccagatcctcgagatgatctttctggacaagatgtagcacgcaaattattaattcttgctcgtgaagcgggaattgaacttgaactttcagatgttgaagttgaaggtgtattgccgaaaggcttctccgatggaaaatctgcagatgagtttatggcaatgttgccacagcttgacgaggagtttaaaactcgcgttgccacagctaaagcagaaggcaaagtattgcgttatgttggaaaaattagtgaaggaaaatgcaaagtatccatcgttgcggtagatctgaataatccactttataaagtgaaagatggtgaaaatgccttggcattttatactcgttattatcaaccgattccacttttattacgtggttatggcgcaggtaatgcagttactgcggcaggtatctttgcagatattttaagaacattacaacattaa

SEQ ID NO: 70400 - protein, 815 aa, Haemophilus influenzae R2846
MRVLKFGGTSLANPERFSQAAKLIEQAHLEEQAAGVLSAPAKITNHLVALSEKAALNQSTDTHFNEAIEIFYNIINGLHAENNQFDLNGTKALIDAEFAQIKGLLEEIRQAGKVEDAVKATIDCRGEKLSIAMMKAWFEARGYSVHIVDPVKQLLAKGGYLESSVEIEESTKRVDAASIAKDKVVLMAGFTAGNEKGELVLLGRNGSDYSAACLAACLGASVCEIWTDVDGVYTCDPRLVPDARLLPTLSYREAMELSYFGAKVIHPRTIGPLLPQNIPCVIKNTGNPSAPGSIIDGNVKSESLQVKGITNLDNLAMFNVSGPGMQGMVGMASRVFSAMSGAGISVILITQSSSEYSISFCVPVKSAEVAKTVLETEFANELNEHQLESIEVIKDLSIISVVGDGMKQAKGIAARFFSALAQANISIVAIAQGSSERSISAVVPQNKAIEAVKATHQALFNNKKVVDMFLVGVGGVGGELIEQVKRQKEYLAKKNVEIRVCAIANSNRMLLDENGLNLEDWKNDLENATQPSDFDVLLSFIKLHHVVNPVFVDCTSAESVAGLYARALKEGFHVVTPNKKANTRELVYYNELRQNAQASQHKFLYETNVGAGLPVIENLQNLLAAGDELEYFEGILSGSLSFIFGKLEEGLSLSEVTALAREKGFTEPDPRDDLSGQDVARKLLILAREAGIELELSDVEVEGVLPKGFSDGKSADEFMAMLPQLDEEFKTRVATAKAEGKVLRYVGKISEGKCKVSIVAVDLNNPLYKVKDGENALAFYTRYYQPIPLLLRGYGAGNAVTAAGIFADILRTLQH

SEQ ID NO: 70401 - DNA, 2448 bp, Haemophilus influenzae R2866
  CDS (1)..(2448)
atgcgcgtacttaaatttggcggcacttcgcttgcaaatccggaacgtttttcccaagcggcgaaattgatcgaacaagctcatttagaagagcaggctgcaggtgttttatctgcaccagccaaaataaccaaccatctcgtcgccctttctgaaaaagctgcattaaatcaatcaaccgatacgcatttcaacgaagcaatcgaaattttctataacatcatcaacggcttacatacggaaaataatcaattcgacttaaatggtaccaaagcacttattgatgctgaatttgctcaaatcaaaggattattagaagaaattcgtcaagcgggaaaagtagaagatgcagttaaagcgaccattgattgccgtggggaaaaactttctattgcaatgatgaaagcttggtttgaagcgcgtggctatagcatacatattgtggatcctgtcaaacaattattggcaaaaggcggttatcttgaatcttctgttgaaattgaagaatcaacaaaacgtgttgatgcagcaaatatcgcaaaagataaagtggtgctgatggcaggttttactgcgggtaatgaaaaaggcgagttggtattgctcggtcgtaatggctcagactattctgccgcctgtttagccgcttgtttaggcgcaagtgtatgcgaaatttggaccgatgtggacggcgtttatacttgcgatccgcgtttagtgcctgatgcacgtttattaccaacgctttcttatcgtgaagcgatggaactctcttatttcggtgcgaaagtgattcatcctcgtacgattgggccattgttgccacaaaatattccttgtgtcattaaaaatacaggaaatccttctgcgccaggttcgattattgatggcaatgtgaaatcagaaagtttgcaagttaaaggtatcactaacttagacaatttggcgatgtttaatgtgtcaggccccggtatgcaaggtatggtaggcatggcatctcgcgtattttcagccatgtcaggcgcaggcatttcagttattttaattactcagtcttcgtctgaatatagtattagtttctgtgtgcctgtgaaatctgcagaagtagcgaaaaccgtactagaaacggagtttgctaatgaattaaatgaacatcaattagaatcaattgaagtgattaaagatttatccattatttctgttgtgggcgatggaatgaagcaagcgaaaggcattgctgctcgtttcttctcggcattagcgcaggcaaacattagcattgtggcgattgcacaaggatctagcgaacgttcaatttctgcggttgtgccgcaaaataaagccattgaagcggtgaaggccacccatcaggcgcttttcaataataaaaaagtcgtggatatgtttttagtgggcgttggtggagtaggcggagaattaatagagcaggtaaagcgtcaaaaggagtatctagcaaagaagaatgttgaaattcgagtttgtgctattgcgaattccaaccgtatgttgcttgatgaaaatggattaaatttagaggattggaaaaacgatttagaaaatgcgactcagccatcagattttgatgtattgctttctttcattaaattacatcatgtggtgaatccagtatttgtagattgtacttcagccgaatctgtagcagggctttatgctcgtgcgttaaaagaaggtttccatgtggttacgccaaacaaaaaagcgaatacacgagaattagtttattacaatgagttacgccaaaatgcccaagcaagccagcataaatttttatatgaaaccaatgtaggtgcgggcttgccagttattgaaaatctccaaaacttacttgcagcaggtgatgagcttgaatattttgaagggattttatctggctcgctttcctttatttttggtaagttggaagaaggactttctctttcagaagtaaccgcacttgcgcgtgaaaaaggctttactgagccagatcctcgagatgatctttctggacaagatgtagcgcgcaaattattaattcttgctcgtgaagcgggaattgaacttgaactttcagatgttgaagttgaaggtgtattgccgaaaggcttctctgaaggaaaatctgcagatgagtttatggcaatgttgccacagcttgacgaggagtttaaaactcgcgttgccacagctaaagcagaaggcaaagtattgcgttatgttggaaaaattagtgaaggaaaatgcaaagtatccatcgttgcggtagatctgaataatccactttataaagtgaaagatggtgaaaatgccttggcattttatactcgttattatcaaccgattccacttttattacgtggttatggcgcaggtaatgcagttactgcggcaggtatctttgcagatattttaagaacattacaacattaa

SEQ ID NO: 70402 - protein, 815 aa, Haemophilus influenzae R2866
MRVLKFGGTSLANPERFSQAAKLIEQAHLEEQAAGVLSAPAKITNHLVALSEKAALNQSTDTHFNEAIEIFYNIINGLHTENNQFDLNGTKALIDAEFAQIKGLLEEIRQAGKVEDAVKATIDCRGEKLSIAMMKAWFEARGYSIHIVDPVKQLLAKGGYLESSVEIEESTKRVDAANIAKDKVVLMAGFTAGNEKGELVLLGRNGSDYSAACLAACLGASVCEIWTDVDGVYTCDPRLVPDARLLPTLSYREAMELSYFGAKVIHPRTIGPLLPQNIPCVIKNTGNPSAPGSIIDGNVKSESLQVKGITNLDNLAMFNVSGPGMQGMVGMASRVFSAMSGAGISVILITQSSSEYSISFCVPVKSAEVAKTVLETEFANELNEHQLESIEVIKDLSIISVVGDGMKQAKGIAARFFSALAQANISIVAIAQGSSERSISAVVPQNKAIEAVKATHQALFNNKKVVDMFLVGVGGVGGELIEQVKRQKEYLAKKNVEIRVCAIANSNRMLLDENGLNLEDWKNDLENATQPSDFDVLLSFIKLHHVVNPVFVDCTSAESVAGLYARALKEGFHVVTPNKKANTRELVYYNELRQNAQASQHKFLYETNVGAGLPVIENLQNLLAAGDELEYFEGILSGSLSFIFGKLEEGLSLSEVTALAREKGFTEPDPRDDLSGQDVARKLLILAREAGIELELSDVEVEGVLPKGFSEGKSADEFMAMLPQLDEEFKTRVATAKAEGKVLRYVGKISEGKCKVSIVAVDLNNPLYKVKDGENALAFYTRYYQPIPLLLRGYGAGNAVTAAGIFADILRTLQH

SEQ ID NO: 70403 - DNA, 2457 bp, Actinobacillus pleuropneumoniae serovar 1 str. 4074
  CDS (1)..(2457)
atgcgagttcttaaatttggcggtacatcccttgcaaacccggagcgttttatccaagcggcggatattattgaaaaggcgcatttgaaagatcaagccgcaggcgtactttccgcaccggcaaaaatcaccaaccaccttgttgcaattgtcgataaagcgattgcaggcgaatcattcgaatccaacctaaaagaagccaccgaaattttccacaatatcatcaacggattatacgcaatcaataataaggttgatcgtgaaggcttattagctttagtagaagcggaactcgcacaaattcaaagtgtggcaagtgaagcggcaaaaagcaaatcattaccggatagtgttgcggcgacgattcactgccgtggcgaaaaactatcgattgcaatgatgcaagcgtggtttgaagcaaaaggttatgaagttactcgtattgatcctgtcgaaaaattattagcgcacggcagttatttagaatcctccgtcgatattgccgaatcaaccaaacgtgtcgatgctaattcgattccaaagaaaaatgtcgtattaatggcaggttttaccgctggtaatgaaaacggtgaactggtcttactcggtcgtaacggttccgactattcggcagcatgtttagccgcttgtttaaaagcggattgttgcgaaatttggacggatgtggacggtgtttatacttgtgaccctcgcttagtgcctgaagcgatttgtttagaatcaatgagttatcaagaagcgatggagctttcttacttcggtgcgaaagtcattcaccctcgtactatcggtccgttagtgccgttaaatattccatgtttaattaaaaataccgcaaatcctgatgcgaaaggcacattaatcgacggcaacgtagcgactgacggtttaaaagtaaaaggcattactaatcttgataatgttgcaatgtttaacgtatccggtgccggtatgcaaggtatggtcggtatggcggctcgcgtattctcgactatgtcgaaagccggcatttcggtcattctaattactcaatcttcttccgaatacagtatcagtttctgcgtacctgcaaaatttgaggaaaaagcgaccgcttgcttaaatgcggaatttgctcaagagttaagtaaaggcgatttggatccgattgatatgatccgtgagctttctatcatctcggtagtcggtgacggtatgcgtaccgcaaagggaattgccgctcgtttcttctcttcactggcacaagccaatatcagcatcgttgccattgcacaaggttcgtccgagcgttcaatttcagcggtagtgccgatgaataaagcgattgaagcggttaaagcgacccatcaaggtttattcagcaataaaaaatcgattgaagtctttctagtcggtgtaggcggagtcggaagcgaacttatcgatcaaatcaaacaacaaaaagaatttttagcaaagaaggatattgaaatccgtgtatgcgcattggcgaatgcggataaaatgctcctcaacgaaaacggtttaaatttagataattggaaaagcgatttagaaacggcaacccaaccgtccgatttcgacgttttactctcgtttattaagttacaccacgtagtaaatccggtatttgtcgattgtaccgcggcgcaatcggtagcaaacctttatacccgagcgttaaaagaaggtttccacgttgttaccccaaacaagaaagccaataccggtagttaccgatattaccaagaattacgtgaagctgctcgccaaggtcagcataaattcttatacgaaacgaacgtaggcgcaggcttaccggttattgaaaacttacaaaacttgttggctgccggtgacgaagtggaaaaattcgaggggattttatccggctcgctttcatttattttcggtaaattagacgaaggtttaagcctttcggaagcaacgttaatcgcaaaagaaaaaggctttaccgagccggatccgcgtgatgacctttcaggtgcggatgtcgctcgtaaactattgattcttgcgcgcgaaaccggtttggcactggaattcgacgatattgaagtggaaggcgtactaccgaagggcttctcggacggtatgagtaaagaagaattcttaaaagtcttgccggaaatcgacgcacagtttaatgaacgagttcaagcggctaaagcggaaggtaaagtattacgctatgtcggttcgattaccggcgataaatgtcgtgttgctattgaagcggtagatgaaaatcacccgctttataaagtaaaagacggtgaaaatgcgctggcattcttaacccgttactatagcccgattccgctcttattaagaggttacggtgcaggtacggacgtaactgccgccggtatttttgccgatattctgcgtacattacacggaggttcaaactaa

SEQ ID NO: 70404 - protein, 818 aa, Actinobacillus pleuropneumoniae serovar 1 str. 4074
MRVLKFGGTSLANPERFIQAADIIEKAHLKDQAAGVLSAPAKITNHLVAIVDKAIAGESFESNLKEATEIFHNIINGLYAINNKVDREGLLALVEAELAQIQSVASEAAKSKSLPDSVAATIHCRGEKLSIAMMQAWFEAKGYEVTRIDPVEKLLAHGSYLESSVDIAESTKRVDANSIPKKNVVLMAGFTAGNENGELVLLGRNGSDYSAACLAACLKADCCEIWTDVDGVYTCDPRLVPEAICLESMSYQEAMELSYFGAKVIHPRTIGPLVPLNIPCLIKNTANPDAKGTLIDGNVATDGLKVKGITNLDNVAMFNVSGAGMQGMVGMAARVFSTMSKAGISVILITQSSSEYSISFCVPAKFEEKATACLNAEFAQELSKGDLDPIDMIRELSIISVVGDGMRTAKGIAARFFSSLAQANISIVAIAQGSSERSISAVVPMNKAIEAVKATHQGLFSNKKSIEVFLVGVGGVGSELIDQIKQQKEFLAKKDIEIRVCALANADKMLLNENGLNLDNWKSDLETATQPSDFDVLLSFIKLHHVVNPVFVDCTAAQSVANLYTRALKEGFHVVTPNKKANTGSYRYYQELREAARQGQHKFLYETNVGAGLPVIENLQNLLAAGDEVEKFEGILSGSLSFIFGKLDEGLSLSEATLIAKEKGFTEPDPRDDLSGADVARKLLILARETGLALEFDDIEVEGVLPKGFSDGMSKEEFLKVLPEIDAQFNERVQAAKAEGKVLRYVGSITGDKCRVAIEAVDENHPLYKVKDGENALAFLTRYYSPIPLLLRGYGAGTDVTAAGIFADILRTLHGGSN

SEQ ID NO: 70405 - DNA, 2460 bp, Vibrio sp. Ex25
  CDS (1)..(2460)
atgcgagtattgaagtttggcggttcatcactagctgatgcagatcgctttttaagagcggcagacatcattgccaataacgctcaacaagaagaagtggctgttgttctttcagccccaggtaaaacaacaaataagttggttgcagtcattgaaggcgcgttgcgcaatggtgaagcagagctgcaaatcaaagagttggatgaatcgtttaaaacgctcttcactcaaatccaagcagtactccccaatattgatggttcagctttcgataaccaagtgaaaacctcgctatctcaattacgtcaatttgttcacggcatcaatctattaggtatgtgcccaaacaacgtaaatgcgcgcattattagtaaaggtgagcgtgtttccattcagttgatgaaagctgtcttggaggcgaagggacaacaagcgagcttgatcgatcctgtcgagtatctgtatgcccaaggtgatcatcttgaagctatggttgatgtggatatttcaacgcaaaacttccgtcaaaaaccccttcctcagggtcatgtgaacattatgccgggctttacagctggcaacgaaaaaggagagcttgtcacgcttggtcggaatggctctgactactcggcagcggttcttgcagcttgtttacgcgcagactgctgtgaaatctggaccgacgttgatggtgtatacaactgtgacccacgtttagtcgaagatgctcgcctacttaaatcactaagctaccaagaagcgatggagctttcttattttggtgcttccgttctgcacccgaaaaccatcgcccctattgctcaattccacattccatgtctgatcaaaaacagctttaaccctcaaggtgcaggtactcttatcggccaagatactggtgaagataatcttgcgatcaaaggtattacaacacttaacgacctaaccatggttaacgtatcaggccctggtatgaaaggcatggtaggcatggcgagccgtgtattcggtgcgatgtcgtctgctggtgtatctattgttctgatcactcagtcttcttctgaatacagcatcagcttctgtattgaggctgaagataaagcgaaagcgcagcaagtgctggcagatgcgttcgagctagaactgaaagatggcttactagaaccggtcgagtttattgataatgtttcaatcattacgcttgttggtgacggtatgcgcacatcgcgtggtgtggcttctcgcttcttctcttctctagctgaagtgaacgtgaatatcgtagcgatagcacaaggctcatcagaacgtgcgatttctgccgttattccagaagacaaaatttctgaagcgatcaaagcgtgtcacgaaaacctattcaactcgaaacacttcctcgatgtgttcgttgttggtgttggtggtgtgggtggcgagcttgtggatcagatcgagcgccaacaagtcaaactggctgagaaaggcattgtgattcgagtttgtggcttagcaaacagcaaaggtcttttgcttgatagcgaaggcttaccgcttgagcactggcgtgatcgtatgtcagcagccacagaagagttcagcctagcgcgtctgatttctttggtacaacgcaatcatattatcaacccagtattggttgattgtacgtccagtgaagacattgctaaacaatacgccgattttctagcggcaggttttcatgttgtaacaccaaacaaaaaagcaaacacagcaagcatggcgtactaccatcagcttcgcgatgtggctcgtagctcccgtcgtaaattgatgtatgaaacaaccgtaggtgcaggcctaccggttattgaaaacttgcaaaacctaatttctgcaggcgatgaactggagcgcttcagcggtattctttccggttctctttcttatattttcggtaagttagatgaaggaatgagcttaagtgaagcgacgaatatcgcaaaagaaaatggctttactgaaccagatcctcgtgatgacctgtctggtatggatgtcgcgcgtaagctgttgatcctagctcgtgaagcgggcatgtcactagagcttgaagatgttgttgttgaccaagcgctaccgccaggttttgatgattcaggcagtgttgatgagtttatggcgcgtcttccagaagcagacgcttacttcaaagagttatcggctaaagcagcagaagaaggcaaagtactgcgttacgttggtgaaattaacgagggcaagtgcacagtaagcatcgctgcggtggatgaaaacgatccgatgtataaaatcaaagacggtgaaaacgcactggcattttacagccgttactaccagccaatcccacttgtgttgcgtggctatggcgcaggtactgaggtaacggctgcgggtgtattctctgacgtgatgcgtactttaggttggaaactaggggtataa

SEQ ID NO: 70406 - protein, 819 aa, Vibrio sp. Ex25
MRVLKFGGSSLADADRFLRAADIIANNAQQEEVAVVLSAPGKTTNKLVAVIEGALRNGEAELQIKELDESFKTLFTQIQAVLPNIDGSAFDNQVKTSLSQLRQFVHGINLLGMCPNNVNARIISKGERVSIQLMKAVLEAKGQQASLIDPVEYLYAQGDHLEAMVDVDISTQNFRQKPLPQGHVNIMPGFTAGNEKGELVTLGRNGSDYSAAVLAACLRADCCEIWTDVDGVYNCDPRLVEDARLLKSLSYQEAMELSYFGASVLHPKTIAPIAQFHIPCLIKNSFNPQGAGTLIGQDTGEDNLAIKGITTLNDLTMVNVSGPGMKGMVGMASRVFGAMSSAGVSIVLITQSSSEYSISFCIEAEDKAKAQQVLADAFELELKDGLLEPVEFIDNVSIITLVGDGMRTSRGVASRFFSSLAEVNVNIVAIAQGSSERAISAVIPEDKISEAIKACHENLFNSKHFLDVFVVGVGGVGGELVDQIERQQVKLAEKGIVIRVCGLANSKGLLLDSEGLPLEHWRDRMSAATEEFSLARLISLVQRNHIINPVLVDCTSSEDIAKQYADFLAAGFHVVTPNKKANTASMAYYHQLRDVARSSRRKLMYETTVGAGLPVIENLQNLISAGDELERFSGILSGSLSYIFGKLDEGMSLSEATNIAKENGFTEPDPRDDLSGMDVARKLLILAREAGMSLELEDVVVDQALPPGFDDSGSVDEFMARLPEADAYFKELSAKAAEEGKVLRYVGEINEGKCTVSIAAVDENDPMYKIKDGENALAFYSRYYQPIPLVLRGYGAGTEVTAAGVFSDVMRTLGWKLGV

SEQ ID NO: 70407 - DNA, 2469 bp, Shewanella sp. ANA-3
  CDS (1)..(2469): transl_table=11
atgaaagtaatgaaatttggtggtacctcgcttgcaaattggcagcgattttcaatggcggcggatatcgtggccaaggcggcgaaagcagaacctgtggctacagtgctttctgcgcccgcgacagtgacaaacgccttgctagaaatggtggatgtggcggtgaaaggggaagattattcgccagtcattcaacacgttgaacgggtgtttacctcgctctatcaggatgcggtcagttctggactctcgagcagtcaaagcgaagtgttgttcgccggactgagtgtgcagcttgcgcgttggcaggacagattacgcggtattacgctgctgcaggaatgccctgacggagtacgcgctgaaatcgttgttgctggcgagcgtttgtctgctgctttgatggagcaagtcatgctggcaaaaggcatcacttcggcgcagctagacccgcgtgagctgtttttaggtcgtggtcgtccgctcgaatccgtggtggatattgccgtcagtaaaccgcgattcaaaaatcttgccctcgatgaaaaacgggtttgggtgatgcccggctttaccgccgccgatgaagacggcaaggtcgtgaccttaggccgtaatggctctgactattccgctgccgtgctggccgcttgtttagatgcttcaagttgtgagatttggaccgacgttgacggcgtatacaacaccgatcctcgggttgtcaccgatgctaaattgttgtcacagctcagttatcaagaggcgatggagctgtcttactttggggctaaggtgctgcatcctaaaaccattgcgcctatcgctcagttccacatcccctgttatatcaagaacagctttaatcccgatgcgcccggcactctggtatcgaatcaggccgatgaaagcggtctgcaggtgaaggccatttctaatctggataatcaaaccatgtttgatgtttcaggccccggcatgaagggcatggtcggcatggcgagccgcacgctggcggcaatttcccgtagtggcgtttccgtgtcactcatcacccagagttcttgcgaatacagcatcagcttttgtgtggcgactagcgatgcggccaaggtgaaatcggcgctggagcaagagtttgaactagaaatcaaaagtgatttactcgagccgattgaaatgcgccatgacttagcaatcgtctccttgatcggtgatggcatgcgtacccataaaggtgtggcggcgcggttcttccaggcgttagcgcaggcgagtgtgaatatcatcgcgattgcgcaaggctcttctgaacgttctatttcaacggtaatcgagcagcgaaagaccaagcatgcggtagcggcttgtcatcagggctttttcgatgtgcagcaatatttggatgtgtttttagtgggttgcggcaatgttggcgcaggcttactcgagcaaatcaaacatcaggcgagcgtgttaaaagagcagcacattagcattcgtgtctgcggcatcgtgaattcaagcaagatgttactcgatagtgcgggtatcgatttaaacaattggcaaaacctgcttgccgacagtcagcaaccaagcgatctttctgcgctattggcttgggtgaaagagcaacagttattaaaccctgtgctggtggattgtacttcaagcgatcaagtgtcgaaccagtatttagaggtgatgaatgcgggcatgcacgtggtgacgcccaataagaaggccaatactcgagactacgcttactaccaagcactgcgtcaaacagccttgaaacaacgtcgtcagttcctgtatgagaccaacgttggcgccggattgcccgttatcgataatttgaaaaaactgttatttgctggcgataagttacacaagtttaacggtattttgtcaggctccttatcctttatcttcggtaaactcgatgagggtatgacgctgtcagaagcgactaaactggcgcgggaaaaatgctttaccgagcccgatccccgtgatgatttaagtggtatggatgtggcgcgtaaagtgctgattttggcccgtgaagtgggtttgaaacttgagctaagcgatatcgttgtcgactcagtcttacctgacgattttgatgattcaggcgatgtggaaagttttatggcgcgtttaaccgaggcagatgcggcgattgcggcgcgagtggcagaggcgaaagcgcagggtaaagtgctgcgttatgtggggcagattgaagaaggcgcgtgttatgtgcgtatcaccgaagtcgatgctaccgatccgctctacagcgtaaaaggtggtgaaaatgccctggcattctacagccgttattatcagccgattccttttgtattacgtggatacggtgcgggtacagaagtgacagcggccggcgcctttgccgatgtattaagaaccttaaattggactcgtgaggtgagtgtatga

SEQ ID NO: 70408 - protein, 822 aa, Shewanella sp. ANA-3
MKVMKFGGTSLANWQRFSMAADIVAKAAKAEPVATVLSAPATVTNALLEMVDVAVKGEDYSPVIQHVERVFTSLYQDAVSSGLSSSQSEVLFAGLSVQLARWQDRLRGITLLQECPDGVRAEIVVAGERLSAALMEQVMLAKGITSAQLDPRELFLGRGRPLESVVDIAVSKPRFKNLALDEKRVWVMPGFTAADEDGKVVTLGRNGSDYSAAVLAACLDASSCEIWTDVDGVYNTDPRVVTDAKLLSQLSYQEAMELSYFGAKVLHPKTIAPIAQFHIPCYIKNSFNPDAPGTLVSNQADESGLQVKAISNLDNQTMFDVSGPGMKGMVGMASRTLAAISRSGVSVSLITQSSCEYSISFCVATSDAAKVKSALEQEFELEIKSDLLEPIEMRHDLAIVSLIGDGMRTHKGVAARFFQALAQASVNIIAIAQGSSERSISTVIEQRKTKHAVAACHQGFFDVQQYLDVFLVGCGNVGAGLLEQIKHQASVLKEQHISIRVCGIVNSSKMLLDSAGIDLNNWQNLLADSQQPSDLSALLAWVKEQQLLNPVLVDCTSSDQVSNQYLEVMNAGMHVVTPNKKANTRDYAYYQALRQTALKQRRQFLYETNVGAGLPVIDNLKKLLFAGDKLHKFNGILSGSLSFIFGKLDEGMTLSEATKLAREKCFTEPDPRDDLSGMDVARKVLILAREVGLKLELSDIVVDSVLPDDFDDSGDVESFMARLTEADAAIAARVAEAKAQGKVLRYVGQIEEGACYVRITEVDATDPLYSVKGGENALAFYSRYYQPIPFVLRGYGAGTEVTAAGAFADVLRTLNWTREVSV

SEQ ID NO: 70409 - DNA, 2469 bp, Shewanella sp. MR-7
  CDS (1)..(2469): transl_table=11
atgaaagtaatgaagtttggtggtacctcgcttgcaaattggcagcgattttcaatggcggcggatatcgtggccaaagcggcgaaagtagagccagtagccactgtgctgtccgcgcccgcaactgtgacaaacgccctgctcgaaatggtggatgtagcggtgaaaggggaagattattcgccagtcattcaacacgttgagcgggtgtttacttcgctctatcaggatgcggtcagttctggactctcgagtagccagagtgaagtgttgttcgccggactgagtgcacagcttgtgcgttggcaggacagattgcgcggtattacgctgctgcaggaatgccctgatggagtgcgtgccgaaatcgtcgttgcgggtgagcgtttgtctgccgctttgatggaacaagtgatgctggcaaaaggcattacttcatcgcagcttgacccgcgagagctgtttttaggccgtggtcgtccgcttgaatccgtggtggatattgccgtcagtaaaccgcgatttaaaaatcttgccctcgatgagaagcgggtttgggtgatgcccggctttaccgccgccgatgaagacggaaaggtcgtgaccttaggccgtaacggctctgactattccgctgccgtgctggccgcttgtttagatgcttcgagttgtgagatctggaccgacgttgacggcgtatacaacaccgatcctcgggttgtcaccgatgctaagttgttgtcacagctcagttatcaagaggcgatggagctgtcttactttggcgctaaggtgctgcatcctaaaaccattgcgcctatcgcccagttccacatcccctgttatatcaagaacagctttaatcccgatgcgcctggcactctagtatcgaatcaggctgatgagagcggtttgcaggtgaaggccatttctaatctggataatcaaaccatgtttgatgtttcaggccccggcatgaagggcatggtcggcatggcgagccgcacactggcggcaatttcccgtagtggcgtttccgtgtcactcatcacccagagttcttgcgaatacagcatcagcttttgtgtggcgaccagcgagtccgccaaagtgaagtcggcgctggagcaggaatttgagttagaaatcaaaagtgacttactcgagccgattgaaatgcgccatgacttagcaatcgtctccttgattggtgatggcatgcgaacccataaaggtgtggcggcgcggttcttccaagcgttagcgcaggcgagtgtgaatatcatcgcgattgcgcaaggctcctccgagcgttctatttcaacggtaatcgaacagcgaaagactaagcatgcggttgccgcctgtcatcagggctttttcgatgtgcagcagtatttggatgtgtttttagtgggttgcggcaacgtcggtgcaggcttactcgagcaaatcaaacatcaggcgagcgtgttaaaagagcagcacattagcattcgtgtctgcggcatcgtgaattcaagcaagatgttactcgatagtgcgggtatcgatttaaacaattggcaaaacctgcttgccgacagtcagcagccaagcgatctgcctgcgctattggcttgggtgaaagagcaacagttattaaaccctgtgctggtggattgtacttcaagcgatcaagtgtcgaaccagtatttagaggtaatgaatgcgggcatgcacgtggtgacacctaataaaaaggccaatactcgagactacgcttactaccaagcactgcgtcaaacagccttgaaacaacgtcgtcagttcctgtatgagaccaacgttggcgccggattgcccgttatcgacaacttgaaaaaactgttatttgctggcgataagttgcacaagtttaacggtattttatcaggctccttatcctttatcttcggtaaactcgatgagggcatgacactgtcagaagcgactaaactggcgcgggaaaaatgctttaccgagcccgatccccgtgatgatttaagtggtatggatgtggcgcgtaaagtgctgatcttggcccgtgaagtgggtttgaaacttgagctaagcgatatcgttgtcgactcagttctgcctgacgattttgatgattcaggcgatgtggaaagttttatggcgcgtttacccgaggccgatgctgcgattgcggcgcgagtggcagaggcgaaagcgcagggtaaagtgctgcgttatgtggggcagattgaagaaggcgcgtgttatgtgcgtatcaccgaagtcgatgccaccgatccgctctacagtgtaaaaggcggtgaaaacgcgctggcattctacagccgttattatcagccgattccttttgtattacgtggatacggtgcgggtacagaagtgacagcggccggcgcctttgccgatgtattaagaaccttaaattggactcgtgaggtgagtgtatga

SEQ ID NO: 70410 - protein, 822 aa, Shewanella sp. MR-7
MKVMKFGGTSLANWQRFSMAADIVAKAAKVEPVATVLSAPATVTNALLEMVDVAVKGEDYSPVIQHVERVFTSLYQDAVSSGLSSSQSEVLFAGLSAQLVRWQDRLRGITLLQECPDGVRAEIVVAGERLSAALMEQVMLAKGITSSQLDPRELFLGRGRPLESVVDIAVSKPRFKNLALDEKRVWVMPGFTAADEDGKVVTLGRNGSDYSAAVLAACLDASSCEIWTDVDGVYNTDPRVVTDAKLLSQLSYQEAMELSYFGAKVLHPKTIAPIAQFHIPCYIKNSFNPDAPGTLVSNQADESGLQVKAISNLDNQTMFDVSGPGMKGMVGMASRTLAAISRSGVSVSLITQSSCEYSISFCVATSESAKVKSALEQEFELEIKSDLLEPIEMRHDLAIVSLIGDGMRTHKGVAARFFQALAQASVNIIAIAQGSSERSISTVIEQRKTKHAVAACHQGFFDVQQYLDVFLVGCGNVGAGLLEQIKHQASVLKEQHISIRVCGIVNSSKMLLDSAGIDLNNWQNLLADSQQPSDLPALLAWVKEQQLLNPVLVDCTSSDQVSNQYLEVMNAGMHVVTPNKKANTRDYAYYQALRQTALKQRRQFLYETNVGAGLPVIDNLKKLLFAGDKLHKFNGILSGSLSFIFGKLDEGMTLSEATKLAREKCFTEPDPRDDLSGMDVARKVLILAREVGLKLELSDIVVDSVLPDDFDDSGDVESFMARLPEADAAIAARVAEAKAQGKVLRYVGQIEEGACYVRITEVDATDPLYSVKGGENALAFYSRYYQPIPFVLRGYGAGTEVTAAGAFADVLRTLNWTREVSV

SEQ ID NO: 70411 - DNA, 2469 bp, Shewanella sp. MR-4
  CDS (1)..(2469): transl_table=11
atgaaagttatgaaatttggtggtacctcgcttgcaaattggcagcgattttcaatggcggcggatatcgtggccaaggcggcaaaagcagagccggtggctacagtgctttctgcgcccgcgacagtgacaaacgccttgctagaaatggtcgatgtggcggtgaaaggggaagattattcgccagtcattcaacacgttgagcgggtgtttacctcgatctatcaggatgcggtcagttctggactctcgagcagtcaaagcgaagtgttgttcgccggactgagtgcgcagcttgcgcgttggcaggacagattacgcggtattacgctgctgcaggaatgccctgacggagtacgcgccgagatcgttgttgctggcgagcgtttgtctgctgctttgatggagcaagtcatgctggcaaaaggcatcacttcggcgcagctagatccgcgtgagctgtttttaggccgtggtcgtccactcgaatccgtggtggatattgccgtcagtaaaccgcgattcaaaaatcttgccctcgatgaaaaacgggtttgggtgatgcccggctttactgccgccgatgaagacggcaaggttgtgaccttaggccgtaacggttctgactattccgctgccgtgctggccgcttgtttagatgcttcaagttgtgagatctggaccgacgttgacggcgtatacaacaccgatcctcgggttgtcaccgatgctaagttgctgtcacagctcagttatcaagaggcgatggagctgtcttattttggggctaaggtactgcatcctaaaaccattgcgcctatcgctcagtttcatattccctgttatatcaagaacagctttaatcccgatgcgcccggcactctagtatcgaatcaggccgatgaaagcggtctgcaggtgaaggccatttctaatctggataatcaaaccatgtttgatgtatcaggccccggcatgaagggcatggtcggcatggcgagccgcacactggcggcaatttcccgtagtggcgtttccgtgtcactcatcacccagagttcttgcgaatacagcatcagcttttgtgtggctacaagcgagtccgccaaagtgaagtcggcactggagcaagagtttgagctagaaatcaaaagtgacttactcgagccgattgaaatgcgccatgacttagcaatcgtctccttgatcggtgatggaatgcgtacccataaaggtgtggcggcgcggttcttccaagcgttagcgcaggcgagtgtgaatattatcgcgattgcgcaaggctcctccgagcgttctatttcaactgtaatcgagcagcgaaagaccaaacatgcggttgccgcctgtcatcagggctttttcgatgtgcagcaatatttggatgtgtttttagtgggttgcggcaatgttggcgcaggcttactcgagcaaatcaaacatcaggcgagtgtgttaaaagagcagcacattagtattcgtgtctgcggcatcgtgaattcaagcaagatgttactcgatagtgccggtattgatttaaataattggcaaaacctgcttgccgacagtcagcagccaagcgatctgcccgcgctattggcttgggtgaaagagcaacaattattaaaccctgtactggtggattgtacttcaagcgatcaagtgtcgaaccagtatttagaggtaatgaatgcgggcatgcacgtggtgacgcccaataagaaggccaatactcgagactacgcttactaccaagcactgcgtcaaacagccttgaaacaacgtcgtcagttcttgtatgagactaacgttggcgcaggattgcccgttatcgataacttgaaaaaactgttatttgctggcgataagttgcacaagtttaacggtattttgtcaggctccttatcctttatcttcggtaaactcgatgagggtatgacgctgtcagaagcgactaaactggcgcgggaaaaatgctttaccgagcccgatccccgtgatgatttaagtggtatggatgtggcgcgtaaagtgctgatcttggcccgtgaagtgggtttgaaacttgagctaagcgatatcgttgtcgactcagtcttacctgacgattttgatgattcaggcgatgtggaaagttttatggcgcgtttacccgaggccgatgccgcgattgcggcgcgagtggcagaggcgaaagcgcagggtaaagtgctgcgttatgtggggcagattgaagaaggcgcgtgttatgtgcgtatcaccgaagtcgatgctaccgatccgctctacagcgtaaaaggcggtgaaaacgcgctagcattctacagccgttattatcagccgattccttttgtattacgtggatacggtgcgggtacagaagtgacagcggccggcgcctttgccgatgtattaagaaccttaaattggactcgtgaggtgagtgtatga

SEQ ID NO: 70412 - protein, 822 aa, Shewanella sp. MR-4
MKVMKFGGTSLANWQRFSMAADIVAKAAKAEPVATVLSAPATVTNALLEMVDVAVKGEDYSPVIQHVERVFTSIYQDAVSSGLSSSQSEVLFAGLSAQLARWQDRLRGITLLQECPDGVRAEIVVAGERLSAALMEQVMLAKGITSAQLDPRELFLGRGRPLESVVDIAVSKPRFKNLALDEKRVWVMPGFTAADEDGKVVTLGRNGSDYSAAVLAACLDASSCEIWTDVDGVYNTDPRVVTDAKLLSQLSYQEAMELSYFGAKVLHPKTIAPIAQFHIPCYIKNSFNPDAPGTLVSNQADESGLQVKAISNLDNQTMFDVSGPGMKGMVGMASRTLAAISRSGVSVSLITQSSCEYSISFCVATSESAKVKSALEQEFELEIKSDLLEPIEMRHDLAIVSLIGDGMRTHKGVAARFFQALAQASVNIIAIAQGSSERSISTVIEQRKTKHAVAACHQGFFDVQQYLDVFLVGCGNVGAGLLEQIKHQASVLKEQHISIRVCGIVNSSKMLLDSAGIDLNNWQNLLADSQQPSDLPALLAWVKEQQLLNPVLVDCTSSDQVSNQYLEVMNAGMHVVTPNKKANTRDYAYYQALRQTALKQRRQFLYETNVGAGLPVIDNLKKLLFAGDKLHKFNGILSGSLSFIFGKLDEGMTLSEATKLAREKCFTEPDPRDDLSGMDVARKVLILAREVGLKLELSDIVVDSVLPDDFDDSGDVESFMARLPEADAAIAARVAEAKAQGKVLRYVGQIEEGACYVRITEVDATDPLYSVKGGENALAFYSRYYQPIPFVLRGYGAGTEVTAAGAFADVLRTLNWTREVSV

SEQ ID NO: 70413 - DNA, 2418 bp, Pseudoalteromonas tunicata D2
  CDS (1)..(2418): transl_table=11
atgaaagttatgaagtttggtgggtcgtcactggctgattatgcttgcttaaagcaagttgctcagttagtaaatgctcagttatcgtcacaggtattgctagtattgtctgctccaggtggcatgacagataagttggttgagctggcagagttcgctgaaaatggtgtggattatcaagtgcagtgggaagccttgttatctcgcagtttagaattaaaacaacatgttgaaagtgctggtagagtcattagtaattggcctgattttaaattattacaacaaaagttatcaggtgtttcgttactcggtgtatgtccagattcagtgcgcgcgtttgttatttcgtttggtgaacgtttaagtgttgcactgatgcaagcattgcttagtgagcacaatcctacatatttggaagcaactaattgtattttatctcgtggtggtcacttagatgcagaagcgagcatttctttaagtactcctcgttttgctgaccaaatggcattggcaccaagtcaaatttatatcatgcctggttttacggctagtaatgatgcgggtgagctcacgacacttggccgtaatggttctgactattcggcggcgattgcagctgcgtgcgtaaaagccgatgtatgccagatttggactgatgtagatggtgtttatagtgctgatcctcgttatatcagcaaagcaacaaaaatcgatagtttgtcatataaagaggcaatggagttatcgtattttggtgcaaaagtattacatccgaaaacaattttaccctgtgctaaagcaggtgtgccatgtgaaattaaaaatacccataaccctgaagcaccaggctctttaattagtgaagtttcaagcgctgaagagcccgtaaaagcattgtcgagtttgcaagaccttgcaatgttgacagtctcaggcccaggtatgaaaggcaaagttggcatggctgcgcgtgtatttactgcacttgcgcaagataacgtttcaattgtcttaattacacaatcttcatgtgaatttagcattagtttttgtgtgcatgaagctgatttaaatttggcattagatgcgcttgaggtagcttttgagctggaatcacaagcaggtttaattgagccggtacaagttaaacgtgagctggctattgtcactttggtgggggacaatatgaaagcgcaccgaggcttggcggcaaagttttttgcttctcttgcacaagcacaagtaaacattgtggctattgcacaagattcaactgaaagctctatttcagcggttatagatggggcattatgtaacgatgcggtaaaagtgtgtcacgaaaatttctttacccatatcccatcaattgatgtgtttttattaggttgcggtctagtgggggctgagctgattaagcaatttgaaaaacaacagcagtggcttgaacagcgtaatatcaaacttaacctatatggcgtggcaaattctaaacaattgttcttgaacgaggacggcatttgtttacaaaattggcctgcgcaattggccgaatcaacccaaagctttgagttagcaacacttgaagcgtttgttaaagcgaatcatttgattaacccggttattgtcgattgtagttcatcaagccaattggctgatcaatatgtgtcgtttttggccgctggttttcatgtggttgcagcgaataaaaaagccaatacttcatcacaagcttattaccagcaattaattcaaactagcctaaaaaataatcgtaaatttttatacgaaactaatgtgggtgcaggcttgccagtattagataacttgaaattacttttaagtgccggtgatgagttacttagttttaatggtattttatctggttcgttatcgtatatttttggtgccttacaagacggtttaacattatctgaagcaacattacaagcgaagaaaaacggttttaccgaacctgaccctcgtgatgacttatcagggacagatgtagctcgaaaactgctgatcatcgctcgtgaatcagggcttgagcttgagctttctgatattgaagttgagtctgtattacctaaggattttgccaaaggggcaagtgttgatgagtttatggcgcaattaccaagtttagatgtggcatttggcgcaaaagtacatcaagcacgtgatgaaggtaaagtattgcgttatgtcggcagcattgtaaatggtcattgtaaagtaggtattgaagccgttgcggccgagcatgcacttaatgatattcgtgatggtgagaatgcccttgcaattttaagtcagtattatcaacctcgtccgtttgtcattcgtggttatggagcgggtgcgcaagtcactgcggctggtgtattttctgatatcttaaaaatcgtatcacgctag

SEQ ID NO: 70414 - protein, 805 aa, Pseudoalteromonas tunicata D2
MKVMKFGGSSLADYACLKQVAQLVNAQLSSQVLLVLSAPGGMTDKLVELAEFAENGVDYQVQWEALLSRSLELKQHVESAGRVISNWPDFKLLQQKLSGVSLLGVCPDSVRAFVISFGERLSVALMQALLSEHNPTYLEATNCILSRGGHLDAEASISLSTPRFADQMALAPSQIYIMPGFTASNDAGELTTLGRNGSDYSAAIAAACVKADVCQIWTDVDGVYSADPRYISKATKIDSLSYKEAMELSYFGAKVLHPKTILPCAKAGVPCEIKNTHNPEAPGSLISEVSSAEEPVKALSSLQDLAMLTVSGPGMKGKVGMAARVFTALAQDNVSIVLITQSSCEFSISFCVHEADLNLALDALEVAFELESQAGLIEPVQVKRELAIVTLVGDNMKAHRGLAAKFFASLAQAQVNIVAIAQDSTESSISAVIDGALCNDAVKVCHENFFTHIPSIDVFLLGCGLVGAELIKQFEKQQQWLEQRNIKLNLYGVANSKQLFLNEDGICLQNWPAQLAESTQSFELATLEAFVKANHLINPVIVDCSSSSQLADQYVSFLAAGFHVVAANKKANTSSQAYYQQLIQTSLKNNRKFLYETNVGAGLPVLDNLKLLLSAGDELLSFNGILSGSLSYIFGALQDGLTLSEATLQAKKNGFTEPDPRDDLSGTDVARKLLIIARESGLELELSDIEVESVLPKDFAKGASVDEFMAQLPSLDVAFGAKVHQARDEGKVLRYVGSIVNGHCKVGIEAVAAEHALNDIRDGENALAILSQYYQPRPFVIRGYGAGAQVTAAGVFSDILKIVSR

SEQ ID NO: 70415 - DNA, 2460 bp, Photobacterium sp. SKA34
  CDS (1)..(2460): transl_table=11
atgcgagtatttaaatttggcggttcatcattagccgatgcagagcgatttttaagagcagcagatattattgcgagtaatgctcagcaaggtgacgtttctgtggtgctatcagcaccggggaaagtaacaaataaattagtttcagtgattgataacactgtgaaagccggtgagtcatcgctacagttggccgatctagaacaggtatttactgaattgttcagtggcttaaaagccttagaacctcagtttgataaagccgctttagatgcaaaactggcgagctctctaggacaattaaaagagtatgttcacggaattaaactattaggtttatgtcctgataacgtgtatgcgacgatcatcagtaaaggtgaacgtctttctattgcagcgatgaaagctttacttgaagcgaaaggacagcctgcgagcctgatcgatccgattaaatatctttacgctgaaggtgattaccttgaggcgcatgtcgatattgaaatttcaacgcagaatttccgacgagatccattacctgcagggcatgtttgtattatgccgggctttaccgcaggtaacagcaaaggtgagctagtgacactggggcgtaatggctctgattattctgctgcggtacttgcagcatgtctacgcgcggattgttgtgaaatttggacggatgttgatggtgtctatagctgtgatcctcgcttagtccctgatgcgcgcttgttgaaatctttaagctatcaagaagcgatggaactgtcttactttggcgcttctgtacttcaccctaaaactatcgctcctatcgcccaatttcaaattccatgtttaattaaaaatagctttagtccacaagcgcctgggacattgattggtcaagacacaggtgaagatcaattagccattaaaggtattaccaccttaaaagatcttacgatggttaacgtatcaggccctggtatgaaggggatggtaggtatggctgcacgcgtatttggcgcaatgtcatctgcgggtgtatctattgtgttgatcacccaatcatcgtctgaatacagcattagtttctgtattgaatcggctgatcatgttcaagctgaaaaagcgctaaacgaaagttttgaattggaattaaaagaaggcctgcttgagaccgttgagtttttagataacgtatctatcgttactttagttggcgatggtatgcgtacttctcacggcgttgcatcacgtttctttacctctttggctgaagtggatgtcaatattgttgcgattgcacaaggatcatctgagcgtgctatttcagcggttattccacaaaataaagtgccagaagctgtcaaagcgtgtcatgagaacttatttaatagccagcatttcttagatgttttcgtgattggtgtcggcggtgttggtggtgagctgatcgatcagatccagcgtcagcaaagtaaacttgctgatgacggcattgttattcgagtctgcggtatggcgaacagcaaaggattactccttagctgtgagggctttgacttagataactggcgcgatcaaatgggggcagtgaatgagccactcaatcttgctcgtatgatccagcttgttcagcgtaatcacattatcaatccagtgatcattgattgtacgtcggatcaaactattgctgagcaatatgccgattaccttgctgcaggcttccatgttattacaccgaataagaaagcaaacacggctagcatggcttattaccagcaattacgccaagcggcacgtttaagccgtcgtaaatttatgtatgacactacggtaggtgcaggtttacccgttattgaaaacttgcagaatctattggccgcaggtgatgaattacagcgcttctctggcattttatctggctcaatgtcatatatcttcggtaaattggatgaaggcatgagctttagcgaagcgacaaccgttgcgcgtaataatggctttactgagcccgatcctcgtgatgatttatcaggtatggatgtggcacgtaagctacttattctggcacgtgaatcagggcttgaattagagctttcagacgttgatgttgaacaagcactaccaccaggttttgatgcttcaggctctgttgatgactttatggcgcgtttatcacaagcggatgcatactttactcaattagctcaagaagcagcaaaagaagataaagtgctgcgttatgtcggtgaaatcgataatggtcattgctcggtgaaaattgttgcggtgaaccctgatgatccaatgtttaaaattaaagatggtgagaatgccttagctttctacagccgttactaccaaccgatcccgctggtattacgtggttacggtgcgggtacggaagtaactgcagcgggtgtctttgccgatctaatgcgtacattaggctggaagcgaggagtataa

SEQ ID NO: 70416 - protein, 819 aa, Photobacterium sp. SKA34
MRVFKFGGSSLADAERFLRAADIIASNAQQGDVSVVLSAPGKVTNKLVSVIDNTVKAGESSLQLADLEQVFTELFSGLKALEPQFDKAALDAKLASSLGQLKEYVHGIKLLGLCPDNVYATIISKGERLSIAAMKALLEAKGQPASLIDPIKYLYAEGDYLEAHVDIEISTQNFRRDPLPAGHVCIMPGFTAGNSKGELVTLGRNGSDYSAAVLAACLRADCCEIWTDVDGVYSCDPRLVPDARLLKSLSYQEAMELSYFGASVLHPKTIAPIAQFQIPCLIKNSFSPQAPGTLIGQDTGEDQLAIKGITTLKDLTMVNVSGPGMKGMVGMAARVFGAMSSAGVSIVLITQSSSEYSISFCIESADHVQAEKALNESFELELKEGLLETVEFLDNVSIVTLVGDGMRTSHGVASRFFTSLAEVDVNIVAIAQGSSERAISAVIPQNKVPEAVKACHENLFNSQHFLDVFVIGVGGVGGELIDQIQRQQSKLADDGIVIRVCGMANSKGLLLSCEGFDLDNWRDQMGAVNEPLNLARMIQLVQRNHIINPVIIDCTSDQTIAEQYADYLAAGFHVITPNKKANTASMAYYQQLRQAARLSRRKFMYDTTVGAGLPVIENLQNLLAAGDELQRFSGILSGSMSYIFGKLDEGMSFSEATTVARNNGFTEPDPRDDLSGMDVARKLLILARESGLELELSDVDVEQALPPGFDASGSVDDFMARLSQADAYFTQLAQEAAKEDKVLRYVGEIDNGHCSVKIVAVNPDDPMFKIKDGENALAFYSRYYQPIPLVLRGYGAGTEVTAAGVFADLMRTLGWKRGV

SEQ ID NO: 70417 - DNA, 2751 bp, Glycine max
  CDS (1)..(2751)
atggcgtcgttttccgccgccgtcgctcagttctcccgcgtttcaccttctcacacttcgctccactctcactctcacggcacgctcttccaatctcaatgccgccctttcttcctctcgcgcacttcccattcactccggaagggtcttactttaccacggggaagagaggcaccgagtacatctgtacgtgcttcatttacagatgtttcaccgaatgtgtccttggaggaaaaacaactacccaaaggagaaacttggtctgttcacaaatttggtggaacctgtgtgggaacctctcagagaataaaaaatgttgcggacataattcttaaggatgattcggagaggaaattggtggttgtttctgcaatgtcaaaggtgacagatatgatgtatgaccttatccacaaggctcaatcacgcgatgagtcttatacagctgcattaaatgctgttttggagaagcacagtgcaactgcacatgacatacttgatggagataatcttgctactttcttgtctaaattgcatcatgatattagtaaccttaaggcgatgcttcgtgcaatatacatagctggtcatgcaacagagtcctttacagattttgttgtgggacatggagaattatggtctgctcagatgttgtctctagttattaggaagaatgggactgattgcaaatggatggatacaagggatgtccttatcgtaaatcctactggttctaatcaagttgatcctgactatttggaatctgagcaaagacttgaaaaatggtactctttgaatccatgtaaggtaatcattgccactggattcattgcaagcacacctcaaaacattcctaccacactgaagagagatggaagtgacttctcggcagcaattatgggtgctctatttaaggcccgtcaggtcacaatttggacagatgttgatggtgtgtatagtgcagatcctagaaaagttagtgaggctgtgattttgaagacactgtcttatcaagaggcttgggaaatgtcttattttggtgccaatgtcttgcatccccgcacaattattcctgtgatgcgatatggcatacccattatgataaggaacattttcaacctttctgctcctggaacaaagatctgccatccttctgttaatgatcatgaagatagccagaacctgcaaaattttgtcaaaggatttgcaaccatagacaacttggcacttgtaaacgtcgagggaactggaatggctggtgttccaggtactgccagtgctatttttggtgcagtaaaagatgttggagctaatgttatcatgatatctcaggctagtagtgagcattctgtatgctttgctgtgcccgagaaagaagtaaaagctgttgctgaggcattgcaatctagatttcgtcaagctttggataatgggcgtctttctcaggttgcagtcattccaaattgtagcattctggctgcagttggccagaaaatggcaagcactcctggtgttagtgcctcccttttcaatgcattggctaaggccaatataaatgtccgtgctatagcccaaggttgttctgagtacaatattactgttgttgttaagcgagaggattgtataaaggctttacgagctgtccattccagattttatctctcaagaaccaccatagcaatgggcattattggacctggattaattgggagcacactacttgagcagctaagggatcaggcctcaaccctaaaagaagaattcaacatcgatttgcgtgtaatgggcatacttggttcaaagtcaatgcttcttagtgatgtgggcattgacttagctagatggagagaacttcgagaggaaagaggagaagtggctaatatggaaaaatttgttcaacatgtacatggaaatcattttataccaaacacggcattagtggactgcacagctgactctgtcattgctggctattactatgattggttgcgcaaaggaatacatgtagttactcctaacaagaaggcaaattcaggaccacttgatcagtatttgaagttaagagctcttcaaaggcaatcctatacacattacttctatgaagcaactgtcggagctggtcttccaattgttagcactttacgtggcctccttgaaactggagacaaaatattacaaatcgaaggcatctttagtgggactttgagttacatatttaataactttaaagatggccgggcttttagtgaggtagtttctgaagcaaaggaagcaggttatactgagccagatccaagagatgatctgtctggaacagatgttgccagaaaggttataattcttgctagggagtcgggtttaaagctagaactgtctaatattccagttgaaagccctgtgccagaaccactacgagcttgtgcatcagctcaggagtttatgcaagagctaccaaaatttgatcaggagttcacaaagaaacaagaagatgctgagaatgctggggaagtcttgagatacgttggagtggtggacgtgactaataaaaaaggagtggtagagctgcgaagatacaagaaggatcatccctttgcgcaattgtctgggtcagataacattattgcatttacaacacgaaggtataaggatcagcctctgatagttcgtgggccaggagctggtgctcaagtcaccgctggtggaatatttagtgatattttacgacttgcctcatatcttggtgctccatcgtaa

SEQ ID NO: 70418 - protein, 916 aa, Glycine max
MASFSAAVAQFSRVSPSHTSLHSHSHGTLFQSQCRPFFLSRTSHSLRKGLTLPRGREAPSTSVRASFTDVSPNVSLEEKQLPKGETWSVHKFGGTCVGTSQRIKNVADIILKDDSERKLVVVSAMSKVTDMMYDLIHKAQSRDESYTAALNAVLEKHSATAHDILDGDNLATFLSKLHHDISNLKAMLRAIYIAGHATESFTDFVVGHGELWSAQMLSLVIRKNGTDCKWMDTRDVLIVNPTGSNQVDPDYLESEQRLEKWYSLNPCKVIIATGFIASTPQNIPTTLKRDGSDFSAAIMGALFKARQVTIWTDVDGVYSADPRKVSEAVILKTLSYQEAWEMSYFGANVLHPRTIIPVMRYGIPIMIRNIFNLSAPGTKICHPSVNDHEDSQNLQNFVKGFATIDNLALVNVEGTGMAGVPGTASAIFGAVKDVGANVIMISQASSEHSVCFAVPEKEVKAVAEALQSRFRQALDNGRLSQVAVIPNCSILAAVGQKMASTPGVSASLFNALAKANINVRAIAQGCSEYNITVVVKREDCIKALRAVHSRFYLSRTTIAMGIIGPGLIGSTLLEQLRDQASTLKEEFNIDLRVMGILGSKSMLLSDVGIDLARWRELREERGEVANMEKFVQHVHGNHFIPNTALVDCTADSVIAGYYYDWLRKGIHVVTPNKKANSGPLDQYLKLRALQRQSYTHYFYEATVGAGLPIVSTLRGLLETGDKILQIEGIFSGTLSYIFNNFKDGRAFSEVVSEAKEAGYTEPDPRDDLSGTDVARKVIILARESGLKLELSNIPVESPVPEPLRACASAQEFMQELPKFDQEFTKKQEDAENAGEVLRYVGVVDVTNKKGVVELRRYKKDHPFAQLSGSDNIIAFTTRRYKDQPLIVRGPGAGAQVTAGGIFSDILRLASYLGAPS

SEQ ID NO: 70419 - DNA, 2748 bp, Oryza sativa
  CDS (1)..(2748)
atgcggagcctcgccgtcgcgagccccctcccgcccgccgccgcggttcgccgccggccacgcgcatccgcctccggaagggaagtgatttcacaatgttggaagtgtgagataaatcaggaccaacctttggggaactccctaaggataggtcactcacaaggtagtttgcaaagacatggttccaggaatttgctcgcagctgctgcggctatttcaattgaacaagctgaagtcagtacttatcttccaaaaggtgacatgtggtctgtgcacaagtttggtggcacctgtatgggaacaccccagagaattcagaatgttgctgatattgttcttggtgactcttctgagaggaagctgatcattgtttctgcaatgtccaaagtcactgacatgatgttcaaccttgtgcataaagctcagtcaagggataattcttatgtgactgcactggatgaagtttttaataagcatatggctgcagcaaaggaacttcttgatggagaagacctagcaagattcttggctcagttgcattctgacatcagtaacctgagagcgatgcttcgtgctatttttatagctggacatgcaacagaatcgttctctgatttcgttgttgggcatggagagttgtggtcagctcaaatgttgtcgtatgctataaaaaagtctggggtgccttgcagttggatggatacaagagaagttctagtagtgaaacctagtggttctaatcaggtcgatcctgactatttggaatctgagaagcgactccagaaatggttttcacgacaaccagcagagataataatcgctactgggtttattgccagtacagccgaaaacattcctactacgcttaaaagggatggaagcgacttctcagcatcaataattggatcccttgttagggcatgtcaggtcactatctggactgatgttgatggggtatttagtgcagatcctagaaaagttagtgaggctgtgatcttaagcacattatcttatcaggaggcctgggaaatgtcatattttggtgcaaatgttttgcatccccgcaccattatacctgtgatgaaagacaatattcctattgtcattaggaatatgttcaatctatctgcccctggaacaacaatttgcaagcagcctgctaatgaaaatgctgatttagatgcttgtgtcaaatcatttgctactatagacaaattggcccttgttaatgtggaaggaactggaatggctggtgttccaggtacagcaagtgccatatttagtgctgccaaggatgttggagctaatggtatcatgatatctcaggctagcagcgaacactcggtatgctttgctgttccagaaaaggaagttgcagcagtctcgacagccttgcatgttaggtttcgtgaggcattagcagctggaaggctatctaaggtcgaagtcattcgtgggtgcagcattcttgctgctgttggcttgaggatggccagtactcctggagtcagtgcaatcctttttgatgcattagcaaaggcaaatattaatgtacgagcaatagcccaaggttgcagtgaatacaatattactgttgtgttgaagcaagaagattgtgtgagggctttgagagctgttcattcaaggttcttcctctccaaaaccactcttgccgttgggatcattggaccaggtttaattggtggaacacttcttgaccagctgaaagatcaggctgctgttctcaaggaaaatatgaatattgatctacgtgttattggaatatctggctcaagaacgatgcatttgagtgacataggggtagacttaaaccagtggaaagaccttctacgaaaagaagcagaaccagcagatcttgatagttttgttcgccatttgtctgaaaatcatgtatttccaaacaaagttttggtggactgcacagcagatacatacgtagcatgccactattatgattggttgaagaagggtatccatgtcatcacgccaaataagaaagcaaattctggtccgcttgatcggtatctgaaattaaggactctgcagcgtgcatcgtatactcattacttttatgaagcaactgttggtgctggccttccaatcattagcaccctacgaggtcttctagagacaggtgacaagatattgcgtattgagggcattttcagtgggactttgagttatattttcaacaattttgaaggtacacgaacttttagtaatgttgttgctgaagcaaaagaagctggatatacagagccagatccaagagatgatctatcaggaactgatgttgccagaaaggttattatccttgcaagggagtctggtctgaggctcgagctttccgatattcccgtaaagagcctgttgccagaggcactgaggtcatgttcgtcagcagatgaattcatgcagaagctaccgtcctttgatcaggactgggacaggcaacgcgatgaagctgaagctgcaggagaagtgctgcggtatgtgggcgtggtggacgtggcgaacaggaagggccgggtagagctgcagaggtacaagagagaccaccccttcgcgcagctctccggctccgacaacatcatcgccttcaccacgtcgaggtacaaggagcagccgctgatcgtgcgaggccccggcgccggcgcggaggtcaccgccggtggcgtcttctgcgacatcctgcggctggcgtcctacctgggagcaccctcctag

SEQ ID NO: 70420 - protein, 915 aa, Oryza sativa
MRSLAVASPLPPAAAVRRRPRASASGREVISQCWKCEINQDQPLGNSLRIGHSQGSLQRHGSRNLLAAAAAISIEQAEVSTYLPKGDMWSVHKFGGTCMGTPQRIQNVADIVLGDSSERKLIIVSAMSKVTDMMFNLVHKAQSRDNSYVTALDEVFNKHMAAAKELLDGEDLARFLAQLHSDISNLRAMLRAIFIAGHATESFSDFVVGHGELWSAQMLSYAIKKSGVPCSWMDTREVLVVKPSGSNQVDPDYLESEKRLQKWFSRQPAEIIIATGFIASTAENIPTTLKRDGSDFSASIIGSLVRACQVTIWTDVDGVFSADPRKVSEAVILSTLSYQEAWEMSYFGANVLHPRTIIPVMKDNIPIVIRNMFNLSAPGTTICKQPANENADLDACVKSFATIDKLALVNVEGTGMAGVPGTASAIFSAAKDVGANGIMISQASSEHSVCFAVPEKEVAAVSTALHVRFREALAAGRLSKVEVIRGCSILAAVGLRMASTPGVSAILFDALAKANINVRAIAQGCSEYNITVVLKQEDCVRALRAVHSRFFLSKTTLAVGIIGPGLIGGTLLDQLKDQAAVLKENMNIDLRVIGISGSRTMHLSDIGVDLNQWKDLLRKEAEPADLDSFVRHLSENHVFPNKVLVDCTADTYVACHYYDWLKKGIHVITPNKKANSGPLDRYLKLRTLQRASYTHYFYEATVGAGLPIISTLRGLLETGDKILRIEGIFSGTLSYIFNNFEGTRTFSNVVAEAKEAGYTEPDPRDDLSGTDVARKVIILARESGLRLELSDIPVKSLLPEALRSCSSADEFMQKLPSFDQDWDRQRDEAEAAGEVLRYVGVVDVANRKGRVELQRYKRDHPFAQLSGSDNIIAFTTSRYKEQPLIVRGPGAGAEVTAGGVFCDILRLASYLGAPS

SEQ ID NO: 70421 - DNA, 2754 bp, Medicago truncatula
  CDS (1)..(2754)
atggcgtcgtcgctttcttcatccctctctcacttctctcgcatttcagtcacttctctccaacacgactataacaacaagatccccgccgattctcaatgtcgccacttcctcctctcccgccgtttccactctctccgtaagggtattactttacctcgacgacgagagtcaccgagctctgggatatgtgcttcacttacagatgtttcggtgaatgtggcagtggaggaaaaagagctttcgaaaggagactcttggtctgttcacaaatttggtggaacttgtatgggaagctcacaaagaataaagaatgttggagacatagttttgaatgatgattccgagaggaaattggtggttgtttctgcaatgtctaaggtgacggatatgatgtatgatcttatcaataaggctcaatcgcgtgatgagtcttatatatcttccttggatgctgttttggagaagcatagtgcaactgcacatgacatacttgatggagaaactcttgctattttcttgtctaagttgcatgaagacatcagcaaccttaaggcgatgcttcgggctatatacataggtcctggtcatgtgacagaatcctttacagattttgttgtaggacatggggaattatggtctgcccagatgttgtctctagttattaggaagaatggaatagattgcaaatggatggatacaagggaagtcttgattgtaaatcctactagttctaatcaagttgatcccgactatttggaatctgagcgaagacttgagaaatggtactctctgaatccatgtaaggtaatcattgctactgggttcattgcaagcacacctgaaaatattcctactacattgaagcgagatggaagtgatttctcggcagcaattatgggttcgctatttagagctcgtcaggtcacaatttggacagatgttgatggtgtgtatagtgcagatcctagaaaagttagtgaggctgtgattttgaagacattgtcttatcaagaggcttgggaaatgtcttattttggagctaatgttttgcatcctcgcacaataattcctgtgatgagatatggcatacccattttgataaggaatattttcaacctttctgctcctgggacaaagatatgtcatcctgttgttagtgattatgaagataagtcgaacctgcaaaattatgtcaaaggattcgcaacaatagacaacttagcacttgtaaatgttgagggaactggaatggctggtgttccaggtacagctagtgctatttttgctgcagtaaaagatgttggagctaatgttattatgatatctcaggctagtagtgagcattctgtatgctttgctgtgcccgagaaggaagtaaaagctgtagctgaggcattgcaatcaaggtttcgtcaagctttggataatgggcgtctttctcaggttgctgttatcccaaattgtagcattttggctgctgttggccagaaaatggcaagcactcctggagttagtgccacccttttcaacgcattggctaaggccaatataaatgtccgtgccatagcacaaggttgttctgagtataatattactgttgttattaagcgagaggatagtataaaagctttacgggctgtccattccagattttatctctcaagaaccaccatagcaatgggaattattggaccaggattaattgggagcacgctacttgatcaactaagggatcaggcttcaattctgaaagaagaatttaacattgatctgcgtgtaatgggcataattggctcaaagtcaatgcttctcagtgatgtgggtattgacttagcaaagtggaaagaacttcgggaggaaagaggagaagtggctaatttggaaaaatttgctcagcacgtgcatggaaataattttataccaaacacggcattagtagactgcacggctgattctatcattgctggccattactatgagtggttgtgcaaaggaatacatgtaattacccccaataagaaggcaaattcgggaccacttgagcagtatttgaggttaagagctctccagaggcaatcctatactcactacttctatgaagctactgttggagctggtcttcctatagtcagcactttgcgtggcctccttgaaactggagacaaaattttgcaaattgaaggcatattcagtgggacattgagttacatctttaataacttcaaagatggccgggcttttagtgaggtagttggtgaagcaaaggaagcaggttatactgagcctgatccaagagatgatctgtctggaacagatgttgctagaaaggtgataatcctcgcaagggaatctggtttaaagctagagctgtctaatattccaattgaaagtctagtgccagaaccactacgggcgtgtgcatcagctcaggagtttatgcaacagctaccaaaatttgaccaggagtttgcaaagaaacaagaagatgctgacaatgctggggaagtattgagatacgtgggagtggtggatgtgacaaataaaaaaggagttgtagagctgcgaaaatacaagaaggatcatccatttgcacaattgtctgggtcagataatataattgcattcacaacaagaaggtataagaatcaacctctgatagttcgcgggccaggagctggtgctcaagtcacagcgggtggaatatttagtgatattttacgacttgcctcatatctaggcgctccatcatag

SEQ ID NO: 70422 - protein, 917 aa, Medicago truncatula
MASSLSSSLSHFSRISVTSLQHDYNNKIPADSQCRHFLLSRRFHSLRKGITLPRRRESPSSGICASLTDVSVNVAVEEKELSKGDSWSVHKFGGTCMGSSQRIKNVGDIVLNDDSERKLVVVSAMSKVTDMMYDLINKAQSRDESYISSLDAVLEKHSATAHDILDGETLAIFLSKLHEDISNLKAMLRAIYIGPGHVTESFTDFVVGHGELWSAQMLSLVIRKNGIDCKWMDTREVLIVNPTSSNQVDPDYLESERRLEKWYSLNPCKVIIATGFIASTPENIPTTLKRDGSDFSAAIMGSLFRARQVTIWTDVDGVYSADPRKVSEAVILKTLSYQEAWEMSYFGANVLHPRTIIPVMRYGIPILIRNIFNLSAPGTKICHPVVSDYEDKSNLQNYVKGFATIDNLALVNVEGTGMAGVPGTASAIFAAVKDVGANVIMISQASSEHSVCFAVPEKEVKAVAEALQSRFRQALDNGRLSQVAVIPNCSILAAVGQKMASTPGVSATLFNALAKANINVRAIAQGCSEYNITVVIKREDSIKALRAVHSRFYLSRTTIAMGIIGPGLIGSTLLDQLRDQASILKEEFNIDLRVMGIIGSKSMLLSDVGIDLAKWKELREERGEVANLEKFAQHVHGNNFIPNTALVDCTADSIIAGHYYEWLCKGIHVITPNKKANSGPLEQYLRLRALQRQSYTHYFYEATVGAGLPIVSTLRGLLETGDKILQIEGIFSGTLSYIFNNFKDGRAFSEVVGEAKEAGYTEPDPRDDLSGTDVARKVIILARESGLKLELSNIPIESLVPEPLRACASAQEFMQQLPKFDQEFAKKQEDADNAGEVLRYVGVVDVTNKKGVVELRKYKKDHPFAQLSGSDNIIAFTTRRYKNQPLIVRGPGAGAQVTAGGIFSDILRLASYLGAPS

SEQ ID NO: 70423 - DNA, 2748 bp, Oryza sativa
  CDS (1)..(2748)
atgcggagcctcgccgtcgcgagccccctcccgcccgccgccgcggttcgccgccggccacgcgcatccgcctccggaagggaagtgatttcacaatgttggaagtgtgagataaatcaggaccaacctttggggaactccctaaggataggtcactcacaaggtagtttgcaaagacatggttccaggaatttgctcgcagctgctgcggctatttcaattgaacaagctgaagtcagtacttatcttccaaaaggtgacatgtggtctgtgcacaagtttggtggcacctgtatgggaacaccccagagaattcagaatgttgctgatattgttcttggtgactcttctgagaggaagctgatcattgtttctgcaatgtccaaagtcactgacatgatgttcaaccttgtgcataaagctcagtcaagggataattcttatgtgactgcactggatgaagtttttaataagcatatggctgcagcaaaggaacttcttgatggagaagacctagcaagattcttggctcagttgcattctgacatcagtaacctgagagcgatgcttcgtgctatttttatagctggacatgcaacagaatcgttctctgatttcgttgttgggcatggagagttgtggtcagctcaaatgttgtcgtatgctataaaaaagtctggggtgccttgcagttggatggatacaagagaagttctagtagtgaaacctagtggttctaatcaggtcgatcctgactatttggaatctgagaagcgactccagaaatggttttcacgacaaccagcagagataataatcgctactgggtttattgccagtacagccgaaaacattcctactacgcttaaaagggatggaagcgacttctcagcatcaataattggatcccttgttagggcatgtcaggtcactatctggactgatgttgatggggtatttagtgcagatcctagaaaagttagtgaggctgtgatcttaagcacattatcttatcaggaggcctgggaaatgtcatattttggtgcaaatgttttgcatccccgcaccattatacctgtgatgaaagacaatattcctattgtcattaggaatatgttcaatctatctgcccctggaacaacaatttgcaagcagcctgctaatgaaaatgctgatttagatgcttgtgtcaaatcatttgctactatagacaaattggcccttgttaatgtggaaggaactggaatggctggtgttccaggtacagcaagtgccatatttagtgctgccaaggatgttggagctaatgttatcatgatatctcaggctagcagcgaacactcggtatgctttgctgttccagaaaaggaagttgcagcagtctcgacagccttgcatgttaggtttcgtgaggcattagcagctggaaggctatctaaggtcgaagtcattcgtgggtgcagcattcttgctgctgttggcttgaggatggccagtactcctggagtcagtgcaatcctttttgatgcattagcaaaggcaaatattaatgtacgagcaatagcccaaggttgcagtgaatacaatattactgttgtgttgaagcaagaagattgtgtgagggctttgagagctgttcattcaaggttcttcctctccaaaaccactcttgccgttgggatcattggaccaggtttaattggtggaacacttcttgaccagctgaaagatcaggctgctgttctcaaggaaaatatgaatattgatctacgtgttattggaatatctggctcaagaacgatgcatttgagtgacataggggtagacttaaaccagtggaaagagcttctacgaaaagaagcagaaccagcagatcttgatagttttgttcgccatttgtctgaaaatcatgtatttccaaacaaagttttggtggactgcacagcagatacatacgtagcatgccactattatgattggttgaagaagggtatccatgtcatcacgccaaataagaaagcaaattctggtccgcttgatcggtatctgaaattaaggactctgcagcgtgcatcgtatactcattacttttatgaagcaactgttggtgctggccttccaatcattagcaccctacgaggtcttctagagacaggtgacaagatattgcgtattgagggcattttcagtgggactttgagttatattttcaacaattttgaaggtacacgaacttttagtaatgttgttgctgaagcaaaagaagctggatatacagagccagatccaagagatgatctatcaggaactgatgttgccagaaaggttattatccttgcaagggagtctggtctgaggctcgagctttccgatattcccgtaaagagccttgtgccagaggcactgaggtcatgttcgtcagcagatgaattcatgcagaagctaccgtcctttgatcaggactgggacaggcaacgcgatgaagctgaagctgcaggagaagtgctgcggtatgtgggcgtggtggacgtggcgaacaggaagggccgggtagagctgcagaggtacaagagagaccaccccttcgcgcagctgtccggctccgacaacatcatcgccttcaccacgtcgaggtacaaggagcagccgctgatcgtgcgaggccccggcgccggcgcggaggtcaccgccggtggcgtcttctgcgacatcctgcggctggcgtcctacctgggagcaccctcctag

SEQ ID NO: 70424 - protein, 915 aa, Oryza sativa
MRSLAVASPLPPAAAVRRRPRASASGREVISQCWKCEINQDQPLGNSLRIGHSQGSLQRHGSRNLLAAAAAISIEQAEVSTYLPKGDMWSVHKFGGTCMGTPQRIQNVADIVLGDSSERKLIIVSAMSKVTDMMFNLVHKAQSRDNSYVTALDEVFNKHMAAAKELLDGEDLARFLAQLHSDISNLRAMLRAIFIAGHATESFSDFVVGHGELWSAQMLSYAIKKSGVPCSWMDTREVLVVKPSGSNQVDPDYLESEKRLQKWFSRQPAEIIIATGFIASTAENIPTTLKRDGSDFSASIIGSLVRACQVTIWTDVDGVFSADPRKVSEAVILSTLSYQEAWEMSYFGANVLHPRTIIPVMKDNIPIVIRNMFNLSAPGTTICKQPANENADLDACVKSFATIDKLALVNVEGTGMAGVPGTASAIFSAAKDVGANVIMISQASSEHSVCFAVPEKEVAAVSTALHVRFREALAAGRLSKVEVIRGCSILAAVGLRMASTPGVSAILFDALAKANINVRAIAQGCSEYNITVVLKQEDCVRALRAVHSRFFLSKTTLAVGIIGPGLIGGTLLDQLKDQAAVLKENMNIDLRVIGISGSRTMHLSDIGVDLNQWKELLRKEAEPADLDSFVRHLSENHVFPNKVLVDCTADTYVACHYYDWLKKGIHVITPNKKANSGPLDRYLKLRTLQRASYTHYFYEATVGAGLPIISTLRGLLETGDKILRIEGIFSGTLSYIFNNFEGTRTFSNVVAEAKEAGYTEPDPRDDLSGTDVARKVIILARESGLRLELSDIPVKSLVPEALRSCSSADEFMQKLPSFDQDWDRQRDEAEAAGEVLRYVGVVDVANRKGRVELQRYKRDHPFAQLSGSDNIIAFTTSRYKEQPLIVRGPGAGAEVTAGGVFCDILRLASYLGAPS

SEQ ID NO: 70425 - DNA, 2460 bp, Serratia marcescens
  CDS (1)..(2460): transl_table=11
atgcgagtgctgaaatttggcggaacctcggtagcgaatgcggaacgttttctgcgcgtcgccgacatcatggagagtaacgcgcgtcagggacaggtagccacggtcttgtccgcccccgcaaagatcaccaaccatctggtggcgatgatcgacaaaacggtggcgggccaggacattctgccgaatatgagcgacgccgagcggatctttgccgacctgctgagcggactggcgcaggcgctgccgggctttgaatacgatcgtttgaaaggcgtggtcgatcaggaattcgcgcagctcaaacaggtgctgcatggcgtctcgctgctggggcagtgcccggacagcgtgaacgcggcgatcatctgccgtggcgaaaagctctccatcgccatcatggaaggggtgttccgcgccaagggttatccggtcacggtgatcaacccggtggagaaactgctggcgcagggccactacctggagtccaccgtggacatcgccgagtctacgctgcgcatcgccgccgcggcgatcccggccgatcacatcgtgctgatggccggtttcaccgccggtaatgataagggcgagctggtggtgctgggccgcaacggctccgactattccgccgcggtgctggccgcctgcctgcgcgccgactgttgcgagatctggaccgacgtcgacggcgtttatacctgcgatccgcgcaccgtgccggacgccaggttactgaaatcgatgtcgtaccaggaagcgatggagctttcctatttcggcgccaaagtgttacacccccgcaccatcactccgattgcccagtttcaaatcccttgcctgattaaaaacacctccaacccgcaggcccccggcacgctgatcggcaaagacagcaccgatgccgatatgccggtgaagggcatcaccaacctgaacaacatggcgatgatcaacgtctccggcccgggcatgaaaggcatggtcggcatggccgcacgggtcttcgccgtgatgtcgcgcgccggcatttcggtggtgctgatcacccaatcctcttccgaatacagcatcagcttctgcgtgccgcagggtgaactgcagcgcgcccgtcgcgcgctggaagaggagttctatctggagctgaaagacggcgtgctggatccgctggacgtgatggaacgcctggcgatcatctcggtggttggcgacggcatgcgcaccctgcgcggcatttccgcacgcttcttctccgcgctggcgcgcgccaacatcaatatcgttgccatcgcccaagggtcttccgaacgttccatttcggtggtggtcagcaatgattccgccaccaccggcgtgcgcgtcagccaccagatgctgttcaacaccgatcaggtgatcgaagtgttcgtcatcggcgtcggcggcgtcggcggggcgctgatcgagcagatctatcgccagcagccgtggctgaagcaaaaacatatcgatctgcgggtgtgcggcatcgccaactcgcgcgtgatgctgaccaatgtgcacggcatcgcgctggacagctggcgcgacgcgctggccggcgcgcaggagccgttcaatctcggccgtctgatccggctggtgaaggaatatcacctgctgaacccggtgatcgtcgactgtacctccagtcaggcggtggccgatcagtacgtggacttcctggcggacggcttccatgtggtgacgccgaacaaaaaggccaacacctcgtcgatgaactattatcagcaactgcgcgcggccgccgccggttcgcatcgcaagttcctgtacgacaccaacgtcggtgccggtctgccggtgattgagaacctgcaaaacctgctgaacgccggtgatgaactggtacgtttctccggtatcctgtccggctcgctgtcctttatcttcggcaagctggacgaagggctgtcgctgtcggcggcgaccctgcaggcccgggccaacggctacaccgagccggatccgcgcgacgatctgtccgggatggatgtggcgcgtaagctgctgatcctggcgcgcgaggccggttacaaactggaactgagcgatatcgaggtcgagccggtgctgccgccgtccttcgacgcgtcgggcgacgtggacaccttcctggcgcggttgccggagctggataaagagttcgcgcgcaacgtggctaacgccgccgagcaaggcaaggtgctgcgctatgtcggcctgatcgacgaagggcgctgcaaggtgcgcattgaggcggtggacggcaacgatccgttgtataaagtgaagaacggcgagaacgcgctggccttctacagccgctactatcagccgttgccgctggtgctgcgcggctacggcgccggtaacgatgtgactgcagcgggcgtattcgccgatctgctgcgcacactgtcatggaagttgggagtttaa

SEQ ID NO: 70426 - protein, 819 aa, Serratia marcescens
MRVLKFGGTSVANAERFLRVADIMESNARQGQVATVLSAPAKITNHLVAMIDKTVAGQDILPNMSDAERIFADLLSGLAQALPGFEYDRLKGVVDQEFAQLKQVLHGVSLLGQCPDSVNAAIICRGEKLSIAIMEGVFRAKGYPVTVINPVEKLLAQGHYLESTVDIAESTLRIAAAAIPADHIVLMAGFTAGNDKGELVVLGRNGSDYSAAVLAACLRADCCEIWTDVDGVYTCDPRTVPDARLLKSMSYQEAMELSYFGAKVLHPRTITPIAQFQIPCLIKNTSNPQAPGTLIGKDSTDADMPVKGITNLNNMAMINVSGPGMKGMVGMAARVFAVMSRAGISVVLITQSSSEYSISFCVPQGELQRARRALEEEFYLELKDGVLDPLDVMERLAIISVVGDGMRTLRGISARFFSALARANINIVAIAQGSSERSISVVVSNDSATTGVRVSHQMLFNTDQVIEVFVIGVGGVGGALIEQIYRQQPWLKQKHIDLRVCGIANSRVMLTNVHGIALDSWRDALAGAQEPFNLGRLIRLVKEYHLLNPVIVDCTSSQAVADQYVDFLADGFHVVTPNKKANTSSMNYYQQLRAAAAGSHRKFLYDTNVGAGLPVIENLQNLLNAGDELVRFSGILSGSLSFIFGKLDEGLSLSAATLQARANGYTEPDPRDDLSGMDVARKLLILAREAGYKLELSDIEVEPVLPPSFDASGDVDTFLARLPELDKEFARNVANAAEQGKVLRYVGLIDEGRCKVRIEAVDGNDPLYKVKNGENALAFYSRYYQPLPLVLRGYGAGNDVTAAGVFADLLRTLSWKLGV

SEQ ID NO: 70427 - DNA, 2763 bp, Zea mays
  CDS (1)..(2763)
atgaggagcctcaccgtggcaagccgccacccgggcgccgctttctctacccgccgccgcccccttcttcaccccgccgcagccggaagggactcgaccttccagcggtgctggcgatgggaaaaaactcaggacagctccttcgggagctcactaaggaccagccgccttccaagaactgtgcacggagatattttgaagaatttgctcgcaccaactgctggtgctgtttcagttgagcaagctgaagctattgctgacctcccaaaaggtgacatgtggtcggtgcacaagtttggtggcacatgcatggggacctctgagagaattcacaatgttgctgatatagtccttcgtgatccttctgagaggaaactggtagttgtatctgcaatgtctaaggttaccgacatgatgtataatcttgtaaacaaggctcaatcaagggatgattcttacattgctgtactggatgaagtttttgataagcatatgacaacagcaaaggatttgcttgctggagaagaccttgcaagattcctgtctcagttacatgcagacatcagtaacctaaaagcaatgcttcgggccatatatatagctgggcatgcaacagagtctttctctgattttgttgttggtcatggagagttatggtctgctcaaatgttatcatatgcaatacagaagtctggaacaccatgcagttggatggatacaagggaagttctagttgtgaatccgtcaggagccaaccaggtagatcctgactatttggaatctgaaaaacgacttgaaaaatggttttctcgatgtccggctgagacaataattgctactgggtttattgcgagtacacctgaaaacatcccaacaaccttaaaaagagatggaagtgatttctctgcagccataattggttcccttgttaaggctcgccaggtgaccatctggactgatgttgatggggtatttagtgcagatcccagaaaagttagtgaggctgtaatcttaagcacattgtcgtatcaggaggcctgggaaatgtcatattttggggcaaatgtcttgcatccacgtactattatacctgtgatgaaatataatatccctattgttataaggaacatattcaatacttctgcccctggaactatgatctgtcaacagcctgctaatgaaaacggtgatttggaggcttgtgtcaaagcttttgcaactatagataaattggctttggttaatgtcgaagggactggaatggctggtgtcccaggtacagcaaatgccatatttggtgctgtgaaggatgttggagcaaatgttatcatgatatcacaggctagcagtgaacactctgtatgctttgctgttccagaaaaggaagttgcattggtttctgcagccttgcatgctaggtttcgtgaagcattggcagcagggaggttatctaaggttgaagtcattcataattgtagcatccttgctactgtcggcctgaggatggcaagtacacctggagtcagcgcgaccctttttgatgcactagctaaggcaaatattaatgtaagggcgatagctcaaggttgcagtgagtacaacattactattgtactgaagcaagaagactgcgtgcgggctctgagagctgcccactcaaggttcttcctctccaaaaccacactggctgttggcatcattggacctgggttgattggtcgcacactacttaatcagctgaaggatcaggctgctgtcctcaaggaaaatatgaacattgatttgcgtgtcatgggaatagctggttctaggacaatgcttttaagtgatataggagtagatttgacccagtggaaagagaagctacaaactgaagcagaacctgccaatcttgataagtttgttcatcatttgtctgagaatcactttttccctaacagagttttggtagattgcacagcagatacaagtgttgcatctcactattatgattggctaaagaaaggaatccatgtcatcactccaaacaagaaagcaaattcagggccacttgacaggtatcttaaacttagaactcttcagcgtgcatcatatactcattacttctatgaagcaactgttggtgctggcctccctatcattagcactctgcgtggtctcctagagacaggtgacaagatattgcgcattgaagggattttcagtggaacgttaagttatatttttaacaacttcgaaggagcaagaacctttagtgatgttgttgctgaagcaaaaaaagcaggatacacagaaccagatccaagagatgatctgtctggtactgatgttgccaggaaggtcataattcttgcaagggaatctggtttggggcttgaactttctgatattcctgtacgaagtcttgtgccggaggcacttaagtcatgtacctcagccgacgaatacatgcagaagttaccatcttttgacgaggattgggcaagagagaggaaaaatgctgaagctgcgggagaagttctgcggtatgttggagtggtggatgtggtcagcaagaaggggcaggtggagctgcgagcctacaagagggaccacccgttcgcgcagctatctggttccgacaacatcatagccttcaccacctcgaggtacaaggatcagccactgatcgtgcgtggtccgggggctggtgcggaagtgactgcaggaggcgtcttctgcgacatactgcgcctgtcttcctaccttggtgccccctcgtag

SEQ ID NO: 70428 - protein, 920 aa, Zea mays
MRSLTVASRHPGAAFSTRRRPLLHPAAAGRDSTFQRCWRWEKTQDSSFGSSLRTSRLPRTVHGDILKNLLAPTAGAVSVEQAEAIADLPKGDMWSVHKFGGTCMGTSERIHNVADIVLRDPSERKLVVVSAMSKVTDMMYNLVNKAQSRDDSYIAVLDEVFDKHMTTAKDLLAGEDLARFLSQLHADISNLKAMLRAIYIAGHATESFSDFVVGHGELWSAQMLSYAIQKSGTPCSWMDTREVLVVNPSGANQVDPDYLESEKRLEKWFSRCPAETIIATGFIASTPENIPTTLKRDGSDFSAAIIGSLVKARQVTIWTDVDGVFSADPRKVSEAVILSTLSYQEAWEMSYFGANVLHPRTIIPVMKYNIPIVIRNIFNTSAPGTMICQQPANENGDLEACVKAFATIDKLALVNVEGTGMAGVPGTANAIFGAVKDVGANVIMISQASSEHSVCFAVPEKEVALVSAALHARFREALAAGRLSKVEVIHNCSILATVGLRMASTPGVSATLFDALAKANINVRAIAQGCSEYNITIVLKQEDCVRALRAAHSRFFLSKTTLAVGIIGPGLIGRTLLNQLKDQAAVLKENMNIDLRVMGIAGSRTMLLSDIGVDLTQWKEKLQTEAEPANLDKFVHHLSENHFFPNRVLVDCTADTSVASHYYDWLKKGIHVITPNKKANSGPLDRYLKLRTLQRASYTHYFYEATVGAGLPIISTLRGLLETGDKILRIEGIFSGTLSYIFNNFEGARTFSDVVAEAKKAGYTEPDPRDDLSGTDVARKVIILARESGLGLELSDIPVRSLVPEALKSCTSADEYMQKLPSFDEDWARERKNAEAAGEVLRYVGVVDVVSKKGQVELRAYKRDHPFAQLSGSDNIIAFTTSRYKDQPLIVRGPGAGAEVTAGGVFCDILRLSSYLGAPS

SEQ ID NO: 70429 - DNA, 2751 bp, Arabidopsis thaliana
  CDS (1)..(2751)
atggcgactctgaagccgtcatttactgtttctccgccgaatagtaatccgattagatttggaagttttccgccgcaatgctttctccgtgttccgaaaccgcggcgacttatattgcctaggtttcggaagacgactggtggtggcggcggcttgattcgatgtgagcttccagattttcatctatcagcaacagcaactactgtatcaggtgtatcgacggtgaatttagtggatcaagttcagattcctaaaggtgaaatgtggagtgttcacaagtttggtgggacttgtgtgggaaactctcagaggatcagaaatgtagcagaggttataatcaatgataattccgaaagaaaacttgtggttgtctcggcgatgtcgaaggttacggacatgatgtatgacttaatccgcaaggcacaatcacgagatgattcttatttatccgcgttggaagctgtcttggaaaagcatcgtttaacagctcgtgaccttctcgatggagatgatctcgctagtttcttgtcacatttgcataatgatattagtaatcttaaagcaatgcttcgtgctatatacatagctggccatgcatcagagtcgttttcagattttgttgcaggacatggggagctttggtctgctcagatgctatcatatgttgtcagaaagactgggcttgagtgcaagtggatggatactagagacgtgctcattgttaatcccaccagctctaatcaggttgatcctgattttggtgaatctgagaagagactcgataaatggttctccttaaatccgtcgaaaattattattgcgactgggtttattgctagcactccgcaaaatattccaacaactttgaaaagagatgggagtgatttctcagcagctattatgggtgctttattgagagctcgtcaagtaaccatttggacagatgttgatggtgtatacagtgcggatcctcgtaaagttaatgaggcagtgatactccagacactttcttatcaagaggcctgggaaatgtcttattttggagcaaatgtgttacatcctcgcaccatcattcctgtgatgcgatataatattccgattgtgattagaaatattttcaatctctctgcaccgggaacaataatctgtcaacctcctgaagatgattatgaccttaaactgacaactcctgtcaaagggtttgcaactattgacaatttggccctcataaatgttgaaggtactggaatggctggtgtacccggtactgcaagtgacatttttggctgtgtaaaagatgttggagctaatgtgattatgatatcacaggctagcagtgagcattctgtgtgctttgctgtgcctgagaaggaagtaaacgcagtctctgaggcattgcggtcgagatttagtgaagctttacaagcgggacgtctttctcagattgaggtgataccaaactgtagcatcttagctgcagtcggccagaaaatggctagtacacctggagttagttgtacacttttcagtgctttggcgaaggctaatattaatgtccgagctatatctcaaggttgttctgagtacaatgttactgtcgttattaaacgtgaagatagcgttaaggcgttaagagctgtacactcgaggtttttcttgtcaagaacaacattagcaatgggaatcgtaggaccgggcttgattggtgcaacattacttgaccagctgcgggatcaggctgctgttctcaaacaagaatttaacattgatctgcgtgttttgggaatcactggttcaaagaagatgttattgagtgacattggtattgatttgtcgagatggagagaacttctaaacgagaagggaacagaggcggatttggataaattcactcaacaagtgcatggaaatcattttatccccaactctgtagtggttgattgtacagcagactctgctattgcaagccgttactatgattggttacgaaagggaattcatgtcattaccccaaataaaaaggctaactcaggtcccctcgatcagtacttgaaactgagagatcttcaaaggaaatcctacactcattacttctacgaagccactgttggagctggtcttccaattatcagcactttacgtggtctccttgagacaggagataagatactacgcatagagggcatttgcagtggaactttgagttatctattcaacaattttgttggagatcgaagtttcagcgaggttgtcactgaagcaaagaacgcaggtttcactgagcctgatccaagagatgatttatctggaactgatgttgcaaggaaggtgattatcctcgctcgagaatctggactgaaattggacctcgctgatctccccattagaagtctcgtaccagaacctctaaaaggatgcacttctgttgaagaattcatggagaaactcccacagtacgatggagacctagcaaaagaaaggctagatgctgaaaactctggggaagttctgagatatgttggagtggtggacgctgttaaccaaaagggaacagttgaacttcgaagatacaagaaagaacatccatttgcgcagctcgcaggttcagacaacataatagccttcacaacgacaaggtacaaggatcatccacttatagtccgaggacctggagctggtgctcaagtcacggccggtggtatattcagcgacatactaaggcttgcatcttatctcggtgcaccgtcttaa

SEQ ID NO: 70430 - protein, 916 aa, Arabidopsis thaliana
MATLKPSFTVSPPNSNPIRFGSFPPQCFLRVPKPRRLILPRFRKTTGGGGGLIRCELPDFHLSATATTVSGVSTVNLVDQVQIPKGEMWSVHKFGGTCVGNSQRIRNVAEVIINDNSERKLVVVSAMSKVTDMMYDLIRKAQSRDDSYLSALEAVLEKHRLTARDLLDGDDLASFLSHLHNDISNLKAMLRAIYIAGHASESFSDFVAGHGELWSAQMLSYVVRKTGLECKWMDTRDVLIVNPTSSNQVDPDFGESEKRLDKWFSLNPSKIIIATGFIASTPQNIPTTLKRDGSDFSAAIMGALLRARQVTIWTDVDGVYSADPRKVNEAVILQTLSYQEAWEMSYFGANVLHPRTIIPVMRYNIPIVIRNIFNLSAPGTIICQPPEDDYDLKLTTPVKGFATIDNLALINVEGTGMAGVPGTASDIFGCVKDVGANVIMISQASSEHSVCFAVPEKEVNAVSEALRSRFSEALQAGRLSQIEVIPNCSILAAVGQKMASTPGVSCTLFSALAKANINVRAISQGCSEYNVTVVIKREDSVKALRAVHSRFFLSRTTLAMGIVGPGLIGATLLDQLRDQAAVLKQEFNIDLRVLGITGSKKMLLSDIGIDLSRWRELLNEKGTEADLDKFTQQVHGNHFIPNSVVVDCTADSAIASRYYDWLRKGIHVITPNKKANSGPLDQYLKLRDLQRKSYTHYFYEATVGAGLPIISTLRGLLETGDKILRIEGICSGTLSYLFNNFVGDRSFSEVVTEAKNAGFTEPDPRDDLSGTDVARKVIILARESGLKLDLADLPIRSLVPEPLKGCTSVEEFMEKLPQYDGDLAKERLDAENSGEVLRYVGVVDAVNQKGTVELRRYKKEHPFAQLAGSDNIIAFTTTRYKDHPLIVRGPGAGAQVTAGGIFSDILRLASYLGAPS

SEQ ID NO: 70431 - DNA, 2754 bp, Zea mays
  CDS (1)..(2754)
atgcagggcctagccgtatcatgccagcttcctcctgctgcggccgcagctcggtggcggccgcgcgcttcttcctctaatagggaagcagttttacaatgttggaagtatgaattaagtcaagaccactatttgggaggccccctaaggataggtcagtctcaaggaagtttgcacagacatcgctctacaaattttctcagaccagctgctgcagctatttcagttgaacaagatgaagtcaatacttatcttccaaaaggtgatatgtggtctgtgcacaagttcggtggaacctgtatgggaactcccaaaagaatccagtgtgttgcaaatatagttcttggtgattcttctgagaggaagctgatcattgtttccgcaatgtccaaagtaactgacatgatgtacaaccttgtacaaaaggctcagtcacgggatgattcatatgcaatagcactggcagaagtttttgagaagcatatgactgcagcaaaggatcttcttgacggagaagatcttgcaagattcttgtctcagttgcattcagacgtcagcaacttgcgagccatgctccgtgctatttatatagctgggcatgcgacagaatctttctctgactttgttgttgggcatggagagttgtggtctgcgcagatgctgtcgtatgcaataaagaagtctggggcaccctgcagttggatggatacaagagaagttctagttgtaacacccagtggttgtaatcaagtagaccctgattacttggaatgtgagaagcgacttcagaaatggttttctcgacaaccagctgagataatagttgctacaggatttattgcaagtacagctggaaacattccaacaactctaaaaagggatggaagtgatttctcagcagccatagttggttctcttgtcagggcacgccaggtcactatttggactgatgttgacggggtatttagcgcagatcctagaaaagttagtgaggctgtgatcttaagcactctgtcttaccaggaggcctgggaaatgtcatattttggggcaaatgttttgcatccgcgcaccattatacctgtgatgaaagacaacattcccattgttattaggaacatgttcaacctctctgcccctggaaccatgatttgcaagcagcctgccaatgaaaatggtgatttagacgcatgtgtcaaatcatttgctactgtcgataatttagcacttgttaatgttgaaggaactggaatggctggcgttccaggtacagcaagtgctatatttagtgctgttaaggatgttggagctaatgttatcatgatatctcaggctagcagcgaacattcagtatgctttgctgttccagaaaaggaagttgctgtagtttctgctgagttacatgataggtttcgtgaggcattagctgcagggaggctgtctaaggttgaagttattaatggttgcagcattcttgctgctgttggtctgaggatggccagcactccaggagtcagtgcaatactttttgatgcattagcaaaggcaaacattaatgttcgagcaatagctcaaggttgcagtgaatacaatattactgttgtattgaagcaacaagattgtgtaagggctctgagagctgctcactcaaggttcttcctctccaaaaccacacttgctgttgggatcattggacctggtttaattggtggagcactccttaaccagttgaagaatcagactgctgttctcaaggaaaatatgaacattgatctgcgtgtcattggaataactggctcaagtacaatgcttctgagcgacacgggaatagacttaacccagtggaaacagcttctacaaaaggaagcagaaccagctgatattggtagttttgttcatcatttatctgataatcatgtatttccgaacaaagttttggtggactgcacagcggatacaagtgtggcatcccactattacgattggttaaagaagggtattcatgtcatcacgccaaataagaaagcaaattctgggccacttgatcagtacctgaaattacggactatgcagcgtgcctcatacactcattacttttatgaagcaactgttggtgctggcctcccaatcatcagcaccttgcgaggtcttctggagacgggtgacaagatactgcgtattgagggcattttcagtggaactttgagttatatatttaacaatttcgaaggaacaagggcgtttagtgatgttgttgccgaagcaagagaggcgggatacactgaacctgacccaagggatgatctatctggaactgacgttgcccgaaaggtcgttgtcctcgcgagggaatctggtctgaggcttgaactttctgacattcctgtgaagagccttgtgccagaaacacttgcatcatgctcgtcagcagatgaattcatgcagaagctaccgtccttcgacgaggactgggccaggcaacgcagtgatgctgaggctgcaggcgaagtcctgcgttacgttggagcgttggatgcggtgaacaggagcggacaggtggagctacgcaggtacaggagggaccacccgttcgcgcagctctccggctccgacaacatcatcgccttcaccacgtccaggtacaaggagcagccgctgatcgtgcggggtccgggtgccggcgcggaggtgacagccggtggcgtcttctgcgacattctgcggctggcgtcttacctcggtgctccttcttga

SEQ ID NO: 70432 - protein, 917 aa, Zea mays
MQGLAVSCQLPPAAAAARWRPRASSSNREAVLQCWKYELSQDHYLGGPLRIGQSQGSLHRHRSTNFLRPAAAAISVEQDEVNTYLPKGDMWSVHKFGGTCMGTPKRIQCVANIVLGDSSERKLIIVSAMSKVTDMMYNLVQKAQSRDDSYAIALAEVFEKHMTAAKDLLDGEDLARFLSQLHSDVSNLRAMLRAIYIAGHATESFSDFVVGHGELWSAQMLSYAIKKSGAPCSWMDTREVLVVTPSGCNQVDPDYLECEKRLQKWFSRQPAEIIVATGFIASTAGNIPTTLKRDGSDFSAAIVGSLVRARQVTIWTDVDGVFSADPRKVSEAVILSTLSYQEAWEMSYFGANVLHPRTIIPVMKDNIPIVIRNMFNLSAPGTMICKQPANENGDLDACVKSFATVDNLALVNVEGTGMAGVPGTASAIFSAVKDVGANVIMISQASSEHSVCFAVPEKEVAVVSAELHDRFREALAAGRLSKVEVINGCSILAAVGLRMASTPGVSAILFDALAKANINVRAIAQGCSEYNITVVLKQQDCVRALRAAHSRFFLSKTTLAVGIIGPGLIGGALLNQLKNQTAVLKENMNIDLRVIGITGSSTMLLSDTGIDLTQWKQLLQKEAEPADIGSFVHHLSDNHVFPNKVLVDCTADTSVASHYYDWLKKGIHVITPNKKANSGPLDQYLKLRTMQRASYTHYFYEATVGAGLPIISTLRGLLETGDKILRIEGIFSGTLSYIFNNFEGTRAFSDVVAEAREAGYTEPDPRDDLSGTDVARKVVVLARESGLRLELSDIPVKSLVPETLASCSSADEFMQKLPSFDEDWARQRSDAEAAGEVLRYVGALDAVNRSGQVELRRYRRDHPFAQLSGSDNIIAFTTSRYKEQPLIVRGPGAGAEVTAGGVFCDILRLASYLGAPS

SEQ ID NO: 70433 - DNA, 2451 bp, Buchnera aphidicola subsp
  CDS (1)..(2451): transl_table=11
atgaaattattaaaatttggtggtacatcattagctaatgcagaaaaatttttatctgtatctagtattattgaagaaaacactcaaacagatcaaattgcggtagtactttctgcaccagctaaaattactaactatctagtaaaaattatagaaaacactattaagaataatcaaattttagaaacagtacatcttgcagaaaatatatttatgcaactaataaacaattttttaaatatacaatctaattttcctcataaagaaatagaaaaaattataaaaaaagaatttaatgagttaaaaaatatcatacaagggattttattattaaaacagtgtccagataatattcgtgcaattataatttctcgtggagaaatactttcagttttcataatgaaaagtatattacaatctaaaaattataatgtaactattattaatcctgttaaaaatttagttgctataggtgataattatcttgattcaactgttgatatatctgaatctaaaaaaaatattcagaacatgaatattaatcaaagtaatattattttaatggctggttttattgcgggaaataaagataaaaaattagtggtattaggacgaaatggttctgattattcagctgcggtgttagcggcttgtttagatgcgaattgttgtgaaatctggactgatgttgacggagtttttacttctgatccaagaaaagttccaaatgctcgtttattaaaatcaatatcatatcaagaagcaatggaactgtcttatttcggtgctaaggtgctacaccctcgtactattgaaccaattgctcaatttaaaattccatgtttaattaaaaatacaaataatgttaaatctattggaacattaatttgcgaacaaaactgttccgaaaaagatttcctaaaaggggttactcatcttgatgaaatagcaatgtttaatatatctggacctcatataaaagatgtaggaagtgtaatttcacgtatatttacaatgatgtctagaggaaatattaaaatattattaattactcaatcatcttcagaaaataaaattaatttctgtgtttacgaacatgatatttataaaattttatatttattcaataaagaatttcaactagaattaaaagatggtttgttgaatcccttcaaaataaagaaaaatttatctatcctctcaatagtaggatcgaatatctataaaaaacacaatattgcgtcaaaaatattttctgttctaggcgctttaaaaatcaacgtcattgcaatctcacaaggttcttcgaaacattctatttcattagtgattaaaaaagaaaacattttaaaagctgttcaacatgttcataatacattgttttttaataaaaaaactattcatatgtttttaataggaataggtggaattggcagtacattactgaaccaaatattaaaacaaaaacaatttttagataaaaaaaatatagaaattaaaatttgtgctattgcaaattctaaaaaaatattattgttagacaatacaaatgatttatctaactggaaaaatgattttaaaaaatcaactcaaaaatttaatttagaattgttaaataatctaataaaaaataatcatttttcaaactcagtcattgtagattgtacatctagtcaattattatccgaacaatatgtaaattttattgataataattttcatgtcgttacttcaaataaaaaagcaaataccagcgaatggaattactataaaaaaataagaaagtctgtggctcaaacaggtaaaaaatttctatatgaaactaatgtcggtgctggattacctgtaatagaaactcttcaaaatttatttaaatcgggtgataatttaatttgttttaaaggtatattatctggatcactatcttttatatttggaagattagaagaaggtattttgttatcacaagctactagagaagctaaggaattgggttttactgaaccaaacccgtgtgatgatttatcaggtatagatgtagcacgaaaattactaattttagcacgtgaatctggatataatatagaattaaaagatattaaaattgaacctttattgccaaataattttaaaatatatgaggacactgataaatttttattaaaattaaaagaactagacgtatatttttcaaataaaatcaaacaggcgcttaatgtaggtaatgtattacgatttgtagcaacaatagaacaaaaaagacaattttttataaaacttgaagaagttaatattaataatccattatacaaagtaaaaaatggtgaaaatgcactagcattttatactaattattatcaaccaattcctctggtactaagaggctacggtgctggtaacaatgttacggcgtctggagtattttccgacttactgcgtacactatcataa

SEQ ID NO: 70434 - protein, 816 aa, Buchnera aphidicola subsp
MKLLKFGGTSLANAEKFLSVSSIIEENTQTDQIAVVLSAPAKITNYLVKIIENTIKNNQILETVHLAENIFMQLINNFLNIQSNFPHKEIEKIIKKEFNELKNIIQGILLLKQCPDNIRAIIISRGEILSVFIMKSILQSKNYNVTIINPVKNLVAIGDNYLDSTVDISESKKNIQNMNINQSNIILMAGFIAGNKDKKLVVLGRNGSDYSAAVLAACLDANCCEIWTDVDGVFTSDPRKVPNARLLKSISYQEAMELSYFGAKVLHPRTIEPIAQFKIPCLIKNTNNVKSIGTLICEQNCSEKDFLKGVTHLDEIAMFNISGPHIKDVGSVISRIFTMMSRGNIKILLITQSSSENKINFCVYEHDIYKILYLFNKEFQLELKDGLLNPFKIKKNLSILSIVGSNIYKKHNIASKIFSVLGALKINVIAISQGSSKHSISLVIKKENILKAVQHVHNTLFFNKKTIHMFLIGIGGIGSTLLNQILKQKQFLDKKNIEIKICAIANSKKILLLDNTNDLSNWKNDFKKSTQKFNLELLNNLIKNNHFSNSVIVDCTSSQLLSEQYVNFIDNNFHVVTSNKKANTSEWNYYKKIRKSVAQTGKKFLYETNVGAGLPVIETLQNLFKSGDNLICFKGILSGSLSFIFGRLEEGILLSQATREAKELGFTEPNPCDDLSGIDVARKLLILARESGYNIELKDIKIEPLLPNNFKIYEDTDKFLLKLKELDVYFSNKIKQALNVGNVLRFVATIEQKRQFFIKLEEVNINNPLYKVKNGENALAFYTNYYQPIPLVLRGYGAGNNVTASGVFSDLLRTLS

SEQ ID NO: 70435 - DNA, 2445 bp, Buchnera aphidicola subsp
  CDS (1)..(2445): transl_table=11
atgaaactattgaaatttggtggaacttcgctagctaatgcaaaaaagtttttatgtgtagctgacattatagaaaaaaaaaataaaaaggaacaaattgcagttgttctttcagctccagctaaaataactaattacttagctacaataattgaaaataagattgatgatgaagttttaaaaaaaattaatcttgcaaaaaacatttttattgaattaatacaagacattaaaagaatacaaccacttttcccatatgaaaatacaaaatcaacaattgaaatagaatttaataaattaaaaaaaataatcaatggtattcttttaataaaacaatgtccagaaggtattaaacctatcataatatctcgtggagaaatactttcagttgatattatgaaaaatatattacaatctagaaatcatgaagttactattttaaatccagtcacaaatcttttatcaataggaaactatttagattctactattgatattaaagagtctaaaaaacgtattaaaaaaattaatatagatcaaaaaaatattattttaatggctggttttattgcaggcaataaagaaggagaattagtagtactaggacgtaatggttctgattattctgctgcaattttagcttcttgcttaaatgccaaatgttgtgaaatttggactgatgttgatggtgttttgacagcagatccgaggatagtttcaaatacttacctattggattacatatcatatcaagaagccatggaattatcttattttggggctaaggtactacatcctcgaactattgaaccaatttctcagtttcaaataccttgcgtcataaaaaacactaataacactgagtctaagggaacttggattggtaaagaaaataatccaagtgacaattctctaaaaggggtgacatatcttgataacatcataatgttcaatatttctggttcttgtctaaaagattcaggaaatacaattgcacgtatttttactattctctcaagagagagtatgaaaattattttaataatacaatcttcttcagaaaatcaaataaatttttgtactttcgaaaaagacattgattatattttattaatattaaaaaaagaatttacgttagaaataaaagaaggattattaaatgattttaatatagtaaaaaatttaactattttgtcagttattggctctaatatttctgaaaaaaataatattgcatcaaaaattttttcttctttaggttcatcaaaaatcaatgtacttgcaattgcacatggatcttcaaaacattctatatcaatagtaattaaaaaagaaaaccttttacaaggtatacaaaatattcataatacattattttttaagaaaacaatcataaatgtttttctaattggaataggtggagtgggaaaagcattattaaaacaaatcttaaagcaagaaaaatttttagaccaaaaaaatataaaaatacaatttcgtatgattgctaattctaaaaaattactttttttaaaaaattcaataaatttaaataattgggaagaaaattttaaaaaatcaaaagaaaaatttaatttaacaatattaaatgaactattaaaaaatacctgcgattctaattcagtaataatagattgtacatctgattatattttgtcaaagcaatatatcagtttcattaaaaagggatttcatataattacttcgaataaaaaagctaatacagattcgttaaaatattacagtgaaattagaactactgcattaaaagaaaataaaaaatttttatatgaaactaatgttggagcaggattaccagttattaacacacttcaaagtttatttagtacaggtgattgtcttatatcttttaaaggtatattatctggttctttatctttcatatttggaaaactggaagaaggtgttttattatctgaagcaactaaagaagcaaaaaaattaggttttactgaacctaatcccttcgatgatttatctggaatcgacgttgctagaaaactattagttttagctcgagaaattggatattcaatagaactaaaagacataagcattgaacccatattaccagaaagatttaaaaaatatcaaaattctgaagaatttttatttaaattaaaagaactagattcattcttttcagaaagagttaataaagcacgtgatataggcaatgtactgcgttttattggaagtatagaaaaaaatggaaaatgttcagtgaaaattgaggaaataaatagcaataatccattatataaggtaaaaaatggtgaaaatgcactaacattttatacaaattattatcaaccaattcctcttgtattaagaggatatggtgcgggtaacgatgttactgcctctggggtgttttccgacttactacgtataatattataa

SEQ ID NO: 70436 - protein, 814 aa, Buchnera aphidicola subsp
MKLLKFGGTSLANAKKFLCVADIIEKKNKKEQIAVVLSAPAKITNYLATIIENKIDDEVLKKINLAKNIFIELIQDIKRIQPLFPYENTKSTIEIEFNKLKKIINGILLIKQCPEGIKPIIISRGEILSVDIMKNILQSRNHEVTILNPVTNLLSIGNYLDSTIDIKESKKRIKKINIDQKNIILMAGFIAGNKEGELVVLGRNGSDYSAAILASCLNAKCCEIWTDVDGVLTADPRIVSNTYLLDYISYQEAMELSYFGAKVLHPRTIEPISQFQIPCVIKNTNNTESKGTWIGKENNPSDNSLKGVTYLDNIIMFNISGSCLKDSGNTIARIFTILSRESMKIILIIQSSSENQINFCTFEKDIDYILLILKKEFTLEIKEGLLNDFNIVKNLTILSVIGSNISEKNNIASKIFSSLGSSKINVLAIAHGSSKHSISIVIKKENLLQGIQNIHNTLFFKKTIINVFLIGIGGVGKALLKQILKQEKFLDQKNIKIQFRMIANSKKLLFLKNSINLNNWEENFKKSKEKFNLTILNELLKNTCDSNSVIIDCTSDYILSKQYISFIKKGFHIITSNKKANTDSLKYYSEIRTTALKENKKFLYETNVGAGLPVINTLQSLFSTGDCLISFKGILSGSLSFIFGKLEEGVLLSEATKEAKKLGFTEPNPFDDLSGIDVARKLLVLAREIGYSIELKDISIEPILPERFKKYQNSEEFLFKLKELDSFFSERVNKARDIGNVLRFIGSIEKNGKCSVKIEEINSNNPLYKVKNGENALTFYTNYYQPIPLVLRGYGAGNDVTASGVFSDLLRIIL

SEQ ID NO: 70437 - DNA, 2451 bp, Buchnera aphidicola subsp
  CDS (1)..(2451): transl_table=11
atgaaaatactaaaatttggcggtacttcgctttcaaattcagaactattttttcatgtagcaactattattgaaaataatttaaataacgaacaaattgctattgtattatcagcgcctggtaacaccactaatttattggaaatagctattaatcaaaccataaataataaaaatataataccaattgttcaaaaaatagaaaaaaattttttaaaattaattaatgatatttatcaagtagaacaaaaactattatacgaaaaaattaaaaataatattgaaaacaaactactagaattaaaaaacctgcttcaaggaataaatttattacgacaatgccctgacaaaattcgagcaaaaataattagttcaggagaatatttgtctatttctatcatgaactcaattttaatatcgagaggttataatactacaataatcgatcccgtaaaaaaactgttaactaaagaagatacctatctcaatgctactgttaatataaaaatatctaaattccgcattctttctatgaaaataccaaaacatcacattattcttatgccaggctttacagctggaaataaacaaggagaattagtaacattaggacgaaatggttcagattattcggcaactattctatctgtttgtctaaatagtactatgtgcgaaatctggacagatgtcaatggagtatatacatgtgatcctaaattagtgtctgatgctaaactattaacatcattgtcttatcgagaagcaatagaattatcttatcttggagcaaaaattctacatcctaacactatttatcctatacaaaagtttaaaattccatgtacaataaaaaatactcacaatccatcttccattggtactaaaatcagttgtaatcatgtcaaaaataaaaacttgataacaggtgttacataccttgagaatgttcacatgttttcaatttcatgtttatactctaaaaatatagaaacaattatccctaaaatattttcttgtatgtcattatctaaaatttggataattttaactattcaaacatcttcgcaaaatacaattagcttttgtatattaaaaacaatgaccaatacagctttacatgtattacataaagcactatacctagaattaaaacataagttattaaaaccaattaaagtagaaaaaaaactaactctaatttctgttatcagttcagacatattaaacaatactaaaattactgaaaaagttttctcaattctgaaacatgttaatatcaatacacttgctatttctaagggagcatcaaaaaactctatttctattgtcgttaaacatgatgacggtatattaggagttagagcactacataaaggaatatttaacaaaaattgcactgctgaaatattcttaattggaataggacgagtaggacaaacatttttaaaacaaataatagaacaaaaaaactggctaaaatctaaaaatatagatctaaaaatttgtggcattgctaattctaaaaattttattttaaatttagacggaattaacccaaaaaattggaaacgagatttaaatttatctaaaaaatcatttaattttaaacatcttctaaactcaattcaaaactactatctaataaatccaataattgtcgattgtacatccgacaaaaatatagctaaccagtatatatcctttattaattgtggttttcacattgttacccctaataaaaaagcaaatactacaaattggaaatattatgaagacatacgattagctgcgcaaaaagaaaaaaagaaatttttctacgaaactaatgttggggcaggactacctgtaatagaaaatttaaaaaacttactacgtacaggagacacattaatacactttaaaggaattctatcaggatctttgtcatttatttttggaaaattagaagataatatatctttatctgaagcaacaaaacaagcacaaagtctaggattcactgaaccaaatccaaaagacgatttatctggaatagacgtagctcgaaaattgttaatattggctagagaagtaggatataagttagaattaaaagatattaaaatagaacctctattacctaaagaatttaacaacatttctaatacaactgattttataactaaactgaaagaactcgaccaaatattttgtaatcgagttaaaaaagcgcgaaaattaggaaaacgtctcagatttgttggaataatcaatcaaaaaggaaattgccaagttaaaatagacgaagtagatcataacgatccactatacaatatcaaaaatggagaaaatgcactagcattctatagtaaatactatcaaccaattccattagtactgagaggttacggagctggaaataatgtaactgcttctggaatattttcagatgtattacgcatcttgttatga

SEQ ID NO: 70438 - protein, 816 aa, Buchnera aphidicola subsp
MKILKFGGTSLSNSELFFHVATIIENNLNNEQIAIVLSAPGNTTNLLEIAINQTINNKNIIPIVQKIEKNFLKLINDIYQVEQKLLYEKIKNNIENKLLELKNLLQGINLLRQCPDKIRAKIISSGEYLSISIMNSILISRGYNTTIIDPVKKLLTKEDTYLNATVNIKISKFRILSMKIPKHHIILMPGFTAGNKQGELVTLGRNGSDYSATILSVCLNSTMCEIWTDVNGVYTCDPKLVSDAKLLTSLSYREAIELSYLGAKILHPNTIYPIQKFKIPCTIKNTHNPSSIGTKISCNHVKNKNLITGVTYLENVHMFSISCLYSKNIETIIPKIFSCMSLSKIWIILTIQTSSQNTISFCILKTMTNTALHVLHKALYLELKHKLLKPIKVEKKLTLISVISSDILNNTKITEKVFSILKHVNINTLAISKGASKNSISIVVKHDDGILGVRALHKGIFNKNCTAEIFLIGIGRVGQTFLKQIIEQKNWLKSKNIDLKICGIANSKNFILNLDGINPKNWKRDLNLSKKSFNFKHLLNSIQNYYLINPIIVDCTSDKNIANQYISFINCGFHIVTPNKKANTTNWKYYEDIRLAAQKEKKKFFYETNVGAGLPVIENLKNLLRTGDTLIHFKGILSGSLSFIFGKLEDNISLSEATKQAQSLGFTEPNPKDDLSGIDVARKLLILAREVGYKLELKDIKIEPLLPKEFNNISNTTDFITKLKELDQIFCNRVKKARKLGKRLRFVGIINQKGNCQVKIDEVDHNDPLYNIKNGENALAFYSKYYQPIPLVLRGYGAGNNVTASGIFSDVLRILL

SEQ ID NO: 70439 - DNA, 2448 bp, Haemophilus influenzae
  CDS (1)..(2448): transl_table=11
atgcgcgtacttaaatttggcggcacttcgcttgcaaatccggaacgtttttcccaagcggcgaaattgatcgagcaagctcatttagaagagcaggctgcaggtgttttatctgcaccagccaaaataaccaaccatctcgtcgccctttctgaaaaagcagcattaaatcaatcaaccgatacgcatttcaacgaagcaatcgaaattttctataacatcatcaacggcttacatacggaaaataatcaattcgacttaaatggtaccaaagcacttattgatgctgaatttgttcaaattaaaggattattagaagaaatccgtcaggcaggaaaagtagaagatgcagttaaagcgaccattgattgccgtggggaaaaactttctattgcaatgatgaaagcttggtttgaagcgcgtggctatagcgtacatattgtggatcctgtcaaacaattattggcaaaaggcggttatcttgaatcttctgttgaaattgaagaatcaacaaaacgtgttgatgcagcaaatatcgcaaaagataaagtggtgctgatggcaggttttactgcgggtaatgaaaaaggcgagttggtattgctcggtcgtaatggctcagactattctgccgcctgtttagccgcttgtttaggcgcaagtgtatgcgaaatttggaccgatgtggacggcgtttatacttgcgatccgcgtttagtgcctgatgcacgtttattaccaacgctttcttatcgtgaagcgatggaactctcttatttcggtgcgaaagtgattcatcctcgtacgattgggccattgttgccacaaaatattccttgtgtcattaaaaatacaggaaatccttctgcaccaggttcgattattgatggcaatgtgaaatcagaaagtttgcaagttaaaggtatcactaacttagacaatttggcgatgtttaatgtgtcaggccctggtatgcaaggtatggtaggcatggcatctcgcgtattttcagccatgtcaggcgcaggcatttcagttattttaattactcagtcttcgtctgaatatagtattagtttctgtgtgcctgtgaaatctgcagaagtagcgaaaaccgtactagaaacggagtttgctaatgaattaaatgaacatcaattagaaccaattgaagtgattaaagacttatccattatttctgttgtgggcgatggaatgaagcaagcgaaaggcattgctgctcgtttcttctcggcattagcgcaggcaaacattagcattgtggcgattgcacaaggatctagcgaacgttcaatttctgcggttgtgccgcaaaataaagccattgaagcggtgaaggctacccatcaggcgcttttcaataataaaaaagtcgtggatatgtttttagtgggcgttggtggagtaggcggagaattaattgagcaggtaaagcgtcaaaaggagtatctagcaaagaagaatgttgaaattcgagtttgtgctattgcgaattccaaccgtatgttgcttgatgaaaatggattaaatttagaggattggaaaaacgatttagaaaatgcgactcagccatcagattttgatgtattgctttctttcattaaattacatcatgtggtgaatccagtatttgtagattgtacttcagccgaatctgtagcagggctttatgctcgtgcgttaaaagaaggtttccatgtggttacgccaaacaaaaaagcgaatacacgagaattagtttattacaatgagttacgccaaaatgcccaagcaagccagcataaatttttatatgaaaccaatgtaggtgcgggcttgccagttattgaaaatctccaaaacttacttgcagcaggtgatgagcttgaatattttgaagggattttatctggctcgctttcctttatttttggtaagttggaagaaggactttctctttcagaagtaaccgcacttgcgcgtgaaaaaggctttactgagccagatcctcgagatgatctttctggacaagatgtagcacgcaaattattaattcttgctcgtgaagcgggaattgaacttgaactttcagatgttgaagttgaaggtgtattgccaaaaggcttctccgatggaaaatctgcagatgagtttatggcaatgttgcctcagcttgatgaagaatttaaaactcgcgttgccacagctaaagcagaaggcaaagtattgcgttatgttggaaaaattagtgaaggaaaatgcaaagtatccatcgttgcggtagatctgaataatccactttataaagtgaaagatggtgaaaatgccttggcattttacactcgctattatcagccgattccacttttattacgtggttatggcgcaggtaatgcagttactgcggcaggtatctttgcagatattttaagaacattacaacattaa

SEQ ID NO: 70440 - protein, 815 aa, Haemophilus influenzae
MRVLKFGGTSLANPERFSQAAKLIEQAHLEEQAAGVLSAPAKITNHLVALSEKAALNQSTDTHFNEAIEIFYNIINGLHTENNQFDLNGTKALIDAEFVQIKGLLEEIRQAGKVEDAVKATIDCRGEKLSIAMMKAWFEARGYSVHIVDPVKQLLAKGGYLESSVEIEESTKRVDAANIAKDKVVLMAGFTAGNEKGELVLLGRNGSDYSAACLAACLGASVCEIWTDVDGVYTCDPRLVPDARLLPTLSYREAMELSYFGAKVIHPRTIGPLLPQNIPCVIKNTGNPSAPGSIIDGNVKSESLQVKGITNLDNLAMFNVSGPGMQGMVGMASRVFSAMSGAGISVILITQSSSEYSISFCVPVKSAEVAKTVLETEFANELNEHQLEPIEVIKDLSIISVVGDGMKQAKGIAARFFSALAQANISIVAIAQGSSERSISAVVPQNKAIEAVKATHQALFNNKKVVDMFLVGVGGVGGELIEQVKRQKEYLAKKNVEIRVCAIANSNRMLLDENGLNLEDWKNDLENATQPSDFDVLLSFIKLHHVVNPVFVDCTSAESVAGLYARALKEGFHVVTPNKKANTRELVYYNELRQNAQASQHKFLYETNVGAGLPVIENLQNLLAAGDELEYFEGILSGSLSFIFGKLEEGLSLSEVTALAREKGFTEPDPRDDLSGQDVARKLLILAREAGIELELSDVEVEGVLPKGFSDGKSADEFMAMLPQLDEEFKTRVATAKAEGKVLRYVGKISEGKCKVSIVAVDLNNPLYKVKDGENALAFYTRYYQPIPLLLRGYGAGNAVTAAGIFADILRTLQH

SEQ ID NO: 70441 - DNA, 20 bp, Artificial sequence
  primer
atgcgagtgttgaagttcgg

SEQ ID NO: 70442 - DNA, 25 bp, Artificial sequence
  primer
ttagactcctaacttccatgagagg

SEQ ID NO: 70443 - protein, 833 aa, Artificial sequence
  consensus sequence
  Variant (2)..(2): Xaa in position 2 is any amino acid
  Variant (8)..(13): Xaa in position 8 to 13 is any amino acid
  Variant (15)..(18): Xaa in position 15 to 18 is any amino acid
  Variant (20)..(32): Xaa in position 20 to 32 is any amino acid
  Variant (33)..(33): Xaa in position 33 is any or no amino acid
  Variant (35)..(35): Xaa in position 35 is any amino acid
  Variant (38)..(39): Xaa in position 38 to 39 is any amino acid
  Variant (41)..(41): Xaa in position 41 is any amino acid
  Variant (43)..(64): Xaa in position 43 to 64 is any amino acid
  Variant (65)..(68): Xaa in position 65 to 68 is any or no amino acid
  Variant (70)..(102): Xaa in position 70 to 102 is any amino acid
  Variant (103)..(106): Xaa in position 103 to 106 is any or no amino acid
  Variant (108)..(124): Xaa in position 108 to 124 is any amino acid
  Variant (125)..(125): Xaa in position 125 is any or no amino acid
  Variant (128)..(129): Xaa in position 128 to 129 is any amino acid
  Variant (131)..(141): Xaa in position 131 to 141 is any amino acid
  Variant (143)..(151): Xaa in position 143 to 151 is any amino acid
  Variant (152)..(153): Xaa in position 152 to 153 is any or no amino acid
  Variant (155)..(165): Xaa in position 155 to 165 is any amino acid
  Variant (166)..(166): Xaa in position 166 is any or no amino acid
  Variant (168)..(170): Xaa in position 168 to 170 is any amino acid
  Variant (172)..(173): Xaa in position 172 to 173 is any amino acid
  Variant (175)..(189): Xaa in position 175 to 189 is any amino acid
  Variant (190)..(190): Xaa in position 190 is any or no amino acid
  Variant (193)..(193): Xaa in position 193 is any amino acid
  Variant (194)..(196): Xaa in position 194 to 196 is any or no amino acid
  Variant (198)..(206): Xaa in position 198 to 206 is any amino acid
  Variant (207)..(208): Xaa in position 207 to 208 is any or no amino acid
  Variant (210)..(210): Xaa in position 210 is any amino acid
  Variant (212)..(212): Xaa in position 212 is any amino acid
  Variant (216)..(216): Xaa in position 216 is any amino acid
  Variant (220)..(226): Xaa in position 220 to 226 is any amino acid
  Variant (228)..(231): Xaa in position 228 to 231 is any amino acid
  Variant (240)..(242): Xaa in position 240 to 242 is any amino acid
  Variant (246)..(246): Xaa in position 246 is any amino acid
  Variant (248)..(249): Xaa in position 248 to 249 is any amino acid
  Variant (251)..(252): Xaa in position 251 to 252 is any amino acid
  Variant (254)..(256): Xaa in position 254 to 256 is any amino acid
  Variant (259)..(259): Xaa in position 259 is any amino acid
  Variant (262)..(262): Xaa in position 262 is any amino acid
  Variant (264)..(264): Xaa in position 264 is any amino acid
  Variant (270)..(270): Xaa in position 270 is any amino acid
  Variant (272)..(272): Xaa in position 272 is any amino acid
  Variant (275)..(275): Xaa in position 275 is any amino acid
  Variant (278)..(278): Xaa in position 278 is any amino acid
  Variant (280)..(284): Xaa in position 280 to 284 is any amino acid
  Variant (287)..(288): Xaa in position 287 to 288 is any amino acid
  Variant (290)..(290): Xaa in position 290 is any amino acid
  Variant (292)..(293): Xaa in position 292 to 293 is any amino acid
  Variant (295)..(298): Xaa in position 295 to 298 is any amino acid
  Variant (300)..(301): Xaa in position 300 to 301 is any amino acid
  Variant (303)..(312): Xaa in position 303 to 312 is any amino acid
  Variant (313)..(320): Xaa in position 313 to 320 is any or no amino acid
  Variant (322)..(333): Xaa in position 322 to 333 is any amino acid
  Variant (335)..(335): Xaa in position 335 is any amino acid
  Variant (337)..(337): Xaa in position 337 is any amino acid
  Variant (340)..(340): Xaa in position 340 is any amino acid
  Variant (342)..(343): Xaa in position 342 to 343 is any amino acid
  Variant (345)..(345): Xaa in position 345 is any amino acid
  Variant (347)..(349): Xaa in position 347 to 349 is any amino acid
  Variant (351)..(362): Xaa in position 351 to 362 is any amino acid
  Variant (364)..(364): Xaa in position 364 is any amino acid
  Variant (366)..(366): Xaa in position 366 is any amino acid
  Variant (370)..(370): Xaa in position 370 is any amino acid
  Variant (372)..(373): Xaa in position 372 to 373 is any amino acid
  Variant (375)..(387): Xaa in position 375 to 387 is any amino acid
  Variant (389)..(391): Xaa in position 389 to 391 is any amino acid
  Variant (393)..(395): Xaa in position 393 to 395 is any amino acid
  Variant (397)..(400): Xaa in position 397 to 400 is any amino acid
  Variant (402)..(411): Xaa in position 402 to 411 is any amino acid
  Variant (413)..(415): Xaa in position 413 to 415 is any amino acid
  Variant (418)..(419): Xaa in position 418 to 419 is any amino acid
  Variant (421)..(424): Xaa in position 421 to 424 is any amino acid
  Variant (426)..(430): Xaa in position 426 to 430 is any amino acid
  Variant (432)..(433): Xaa in position 432 to 433 is any amino acid
  Variant (436)..(442): Xaa in position 436 to 442 is any amino acid
  Variant (448)..(448): Xaa in position 448 is any amino acid
  Variant (451)..(452): Xaa in position 451 to 452 is any amino acid
  Variant (454)..(455): Xaa in position 454 to 455 is any amino acid
  Variant (457)..(469): Xaa in position 457 to 469 is any amino acid
  Variant (471)..(473): Xaa in position 471 to 473 is any amino acid
  Variant (475)..(485): Xaa in position 475 to 485 is any amino acid
  Variant (487)..(487): Xaa in position 487 is any amino acid
  Variant (489)..(490): Xaa in position 489 to 490 is any amino acid
  Variant (492)..(493): Xaa in position 492 to 493 is any amino acid
  Variant (495)..(496): Xaa in position 495 to 496 is any amino acid
  Variant (498)..(500): Xaa in position 498 to 500 is any amino acid
  Variant (502)..(504): Xaa in position 502 to 504 is any amino acid
  Variant (506)..(509): Xaa in position 506 to 509 is any amino acid
  Variant (510)..(510): Xaa in position 510 is any or no amino acid
  Variant (512)..(513): Xaa in position 512 to 513 is any amino acid
  Variant (516)..(520): Xaa in position 516 to 520 is any amino acid
  Variant (522)..(524): Xaa in position 522 to 524 is any amino acid
  Variant (526)..(529): Xaa in position 526 to 529 is any amino acid
  Variant (531)..(532): Xaa in position 531 to 532 is any amino acid
  Variant (534)..(535): Xaa in position 534 to 535 is any amino acid
  Variant (537)..(559): Xaa in position 537 to 559 is any amino acid
  Variant (560)..(561): Xaa in position 560 to 561 is any or no amino acid
  Variant (563)..(564): Xaa in position 563 to 564 is any amino acid
  Variant (565)..(565): Xaa in position 565 is any or no amino acid
  Variant (567)..(567): Xaa in position 567 is any amino acid
  Variant (569)..(569): Xaa in position 569 is any amino acid
  Variant (574)..(578): Xaa in position 574 to 578 is any amino acid
  Variant (580)..(581): Xaa in position 580 to 581 is any amino acid
  Variant (583)..(585): Xaa in position 583 to 585 is any amino acid
  Variant (587)..(588): Xaa in position 587 to 588 is any amino acid
  Variant (590)..(590): Xaa in position 590 is any amino acid
  Variant (593)..(593): Xaa in position 593 is any amino acid
  Variant (601)..(606): Xaa in position 601 to 606 is any amino acid
  Variant (608)..(610): Xaa in position 608 to 610 is any amino acid
  Variant (612)..(622): Xaa in position 612 to 622 is any amino acid
  Variant (624)..(626): Xaa in position 624 to 626 is any amino acid
  Variant (633)..(633): Xaa in position 633 is any amino acid
  Variant (635)..(636): Xaa in position 635 to 636 is any amino acid
  Variant (638)..(639): Xaa in position 638 to 639 is any amino acid
  Variant (642)..(643): Xaa in position 642 to 643 is any amino acid
  Variant (646)..(651): Xaa in position 646 to 651 is any amino acid
  Variant (654)..(654): Xaa in position 654 is any amino acid
  Variant (657)..(657): Xaa in position 657 is any amino acid
  Variant (660)..(660): Xaa in position 660 is any amino acid
  Variant (663)..(667): Xaa in position 663 to 667 is any amino acid
  Variant (669)..(671): Xaa in position 669 to 671 is any amino acid
  Variant (673)..(677): Xaa in position 673 to 677 is any amino acid
  Variant (679)..(681): Xaa in position 679 to 681 is any amino acid
  Variant (683)..(683): Xaa in position 683 is any amino acid
  Variant (695)..(695): Xaa in position 695 is any amino acid
  Variant (701)..(702): Xaa in position 701 to 702 is any amino acid
  Variant (708)..(708): Xaa in position 708 is any amino acid
  Variant (710)..(711): Xaa in position 710 to 711 is any amino acid
  Variant (715)..(715): Xaa in position 715 is any amino acid
  Variant (717)..(723): Xaa in position 717 to 723 is any amino acid
  Variant (725)..(735): Xaa in position 725 to 735 is any amino acid
  Variant (736)..(737): Xaa in position 736 to 737 is any or no amino acid
  Variant (739)..(741): Xaa in position 739 to 741 is any amino acid
  Variant (743)..(745): Xaa in position 743 to 745 is any amino acid
  Variant (747)..(755): Xaa in position 747 to 755 is any amino acid
  Variant (757)..(759): Xaa in position 757 to 759 is any amino acid
  Variant (761)..(761): Xaa in position 761 is any amino acid
  Variant (768)..(775): Xaa in position 768 to 775 is any amino acid
  Variant (776)..(777): Xaa in position 776 to 777 is any or no amino acid
  Variant (779)..(787): Xaa in position 779 to 787 is any amino acid
  Variant (789)..(796): Xaa in position 789 to 796 is any amino acid
  Variant (798)..(799): Xaa in position 798 to 799 is any amino acid
  Variant (802)..(805): Xaa in position 802 to 805 is any amino acid
  Variant (807)..(809): Xaa in position 807 to 809 is any amino acid
  Variant (812)..(813): Xaa in position 812 to 813 is any amino acid
  Variant (816)..(816): Xaa in position 816 is any amino acid
  Variant (820)..(821): Xaa in position 820 to 821 is any amino acid
  Variant (825)..(825): Xaa in position 825 is any amino acid
  Variant (827)..(827): Xaa in position 827 is any amino acid
  Variant (829)..(829): Xaa in position 829 is any amino acid
  Variant (831)..(831): Xaa in position 831 is any amino acid
VXKFGGTXXXXXXRXXXXAXXXXXXXXXXXXXXVXSAXXKXTXXXXXXXXXXXXXXXXXXXXXXXXXXFXXXXXXXXXXXXXXXXXXXXXXXXXXXXXXXXXXXXXIXXXXXXXXXXXXXXXXXXGEXXSXXXXXXXXXXXGXXXXXXXXXXXLXXXXXXXXXXXXDXXXSXXRXXXXXXXXXXXXXXXXGFXXXXAXXXXXXXXXXXLXRXGSDXSAAXXXXXXXAXXXXIWTDVDGVXXXDPRXVXXAXXLXXXSYXEAXEXSYFGAXVXHPXTIXPXXXXXIPXXIXNXXNXXXXGXXIXXXXXXXXXXXXXXXXXXKXXXXXXXXXXXXVXGXGMXGXXGXAXXXFXXXXXXXXXXXXIXQXSSEXSXXFXXXXXXXXXXXXXLXXXFXXXLXXXXLXXXXXXXXXXIXXXVGXXMXXXXGXXXXXFXXLAXXXXXXXAIAQGXSEXXIXXVXXXXXXXXXXXXXHXXXFXXXXXXXXXXXGXGXXGXXLXXQXXXQXXXLXXXXXIXXRVXXXXXSXXXLXXXXGXXLXXWXXXXXXXXXXXXXXXXXXXXXXXXXHXXXNXVXVDCTXXXXXAXXYXXXLXXGXHVXTPNKKANXXXXXXYXXXRXXXXXXXXXXXYXXXVGAGLPXIXXLXXLLXXGDXXXXXXGIXSGXLSXIFXXXXXGXXXSXXXXXAXXXGXTEPDPRDDLSGXDVARKXXILAREXGXXLELXDXXXXXXXPXXXXXXXXXXXXXFXXXLXXXDXXXXXXXXXAXXXGXVLRYVGXXXXXXXXXXVXXXXXXXXXPXXXXXXXXNXXAFXXXXYXXXPLXXRGXGAGXXVTAXGXFXDXLR

SEQ ID NO: 70444 - protein, 58 aa, Artificial sequence
  protein pattern
  Variant (9)..(9): Xaa in position 9 is Phe or Tyr
  Variant (10)..(10): Xaa in position 10 is Asn, Ser or Thr
  Variant (11)..(11): Xaa in position 11 is Ala, Cys or Thr
  Variant (15)..(15): Xaa in position 15 is any amino acid
  Variant (17)..(17): Xaa in position 17 is Asp, Glu, Pro, Ser or Thr
  Variant (18)..(18): Xaa in position 18 is Asp or Glu
  Variant (20)..(21): Xaa in position 20 to 21 is any amino acid
  Variant (23)..(23): Xaa in position 23 is any amino acid
  Variant (24)..(24): Xaa in position 24 is Gly, Gln, Ser or Thr
  Variant (25)..(25): Xaa in position 25 is Leu or Met
  Variant (28)..(28): Xaa in position 28 is Gln or Arg
  Variant (31)..(31): Xaa in position 31 is any amino acid
  Variant (33)..(33): Xaa in position 33 is Leu or Met
  Variant (39)..(39): Xaa in position 39 is any amino acid
  Variant (41)..(41): Xaa in position 41 is Ile or Leu
  Variant (44)..(44): Xaa in position 44 is Lys or Arg
  Variant (47)..(47): Xaa in position 47 is any amino acid
  Variant (49)..(49): Xaa in position 49 is Ile, Leu or Val
  Variant (50)..(53): Xaa in position 50 to 53 is any amino acid
  Variant (56)..(57): Xaa in position 56 to 57 is any amino acid
IWTDVDGVXXXDPRXVXXAXXLXXXSYXEAXEXSYFGAXVXHPXTIXPXXXXXIPXXI

SEQ ID NO: 70445 - protein, 58 aa, Artificial sequence
  protein pattern
  Variant (3)..(3): Xaa in position 3 is Phe or Leu
  Variant (6)..(6): Xaa in position 6 is Ser or Thr
  Variant (9)..(9): Xaa in position 9 is Phe or Tyr
  Variant (12)..(12): Xaa in position 12 is Gly or Asn
  Variant (13)..(13): Xaa in position 13 is any amino acid
  Variant (14)..(14): Xaa in position 14 is Phe or Leu
  Variant (15)..(15): Xaa in position 15 is any amino acid
  Variant (16)..(16): Xaa in position 16 is Asp, Glu or Gly
  Variant (17)..(17): Xaa in position 17 is Ala, Gly or Thr
  Variant (18)..(18): Xaa in position 18 is any amino acid
  Variant (19)..(19): Xaa in position 19 is Ala, Ser or Thr
  Variant (20)..(20): Xaa in position 20 is Phe or Leu
  Variant (22)..(22): Xaa in position 22 is Ala, Asp, Glu, Asn or Gln
  Variant (23)..(23): Xaa in position 23 is Ala or Val
  Variant (24)..(24): Xaa in position 24 is Thr or Val
  Variant (25)..(26): Xaa in position 25 to 26 is any amino acid
  Variant (28)..(28): Xaa in position 28 is Lys or Arg
  Variant (29)..(30): Xaa in position 29 to 30 is any amino acid
  Variant (31)..(31): Xaa in position 31 is Cys or Gly
  Variant (32)..(32): Xaa in position 32 is Phe or Tyr
  Variant (44)..(44): Xaa in position 44 is any amino acid
  Variant (50)..(50): Xaa in position 50 is Leu or Val
  Variant (51)..(51): Xaa in position 51 is Ile, Leu or Val
  Variant (52)..(52): Xaa in position 52 is Ile or Val
  Variant (53)..(53): Xaa in position 53 is Ile or Leu
  Variant (57)..(57): Xaa in position 57 is any amino acid
GIXSGXLSXIFXXXXXXXXXSXXXXXAXXXXXTEPDPRDDLSGXDVARKXXXXAREXG

SEQ ID NO: 70446 - protein, 58 aa, Artificial sequence
  protein pattern
  Variant (2)..(6): Xaa in position 2 to 6 is any amino acid
  Variant (7)..(8): Xaa in position 7 to 8 is any or no amino acid
  Variant (10)..(10): Xaa in position 10 is any amino acid
  Variant (11)..(12): Xaa in position 11 to 12 is any or no amino acid
  Variant (14)..(14): Xaa in position 14 is Phe, Leu or Met
  Variant (15)..(16): Xaa in position 15 to 16 is any amino acid
  Variant (17)..(17): Xaa in position 17 is Ile, Leu or Val
  Variant (18)..(18): Xaa in position 18 is any amino acid
  Variant (19)..(19): Xaa in position 19 is Asp, Gly or Asn
  Variant (20)..(20): Xaa in position 20 is Gly or Ser
  Variant (21)..(21): Xaa in position 21 is Asp or Glu
  Variant (23)..(23): Xaa in position 23 is Ala or Ile
  Variant (24)..(24): Xaa in position 24 is Ile or Leu
  Variant (27)..(27): Xaa in position 27 is any amino acid
  Variant (28)..(28): Xaa in position 28 is Ser or Thr
  Variant (29)..(30): Xaa in position 29 to 30 is any amino acid
  Variant (32)..(32): Xaa in position 32 is any amino acid
  Variant (33)..(33): Xaa in position 33 is Asp, Glu, Asn or Pro
  Variant (34)..(34): Xaa in position 34 is any amino acid
  Variant (36)..(36): Xaa in position 36 is Phe or Leu
  Variant (37)..(37): Xaa in position 37 is Ile, Leu or Val
  Variant (38)..(38): Xaa in position 38 is Leu or Val
  Variant (41)..(41): Xaa in position 41 is any amino acid
  Variant (45)..(45): Xaa in position 45 is Ala, Asn or Thr
  Variant (46)..(46): Xaa in position 46 is Ala, Asp, Glu, Asn, Gln or Ser
  Variant (50)..(50): Xaa in position 50 is Ala, Gly or Ser
  Variant (52)..(52): Xaa in position 52 is Ala, Ile or Val
  Variant (54)..(54): Xaa in position 54 is Ala, Cys or Ser
  Variant (56)..(56): Xaa in position 56 is Ile, Leu, Met or Val
  Variant (57)..(57): Xaa in position 57 is Leu or Met
VXXXXXXXDXXXPXXXXXXXXNXXAFXXXXYXXXPXXXRGXGAGXXVTAXGXFXDXXR

SEQ ID NO: 70447 - protein, 59 aa, Artificial sequence
  protein pattern
  Variant (2)..(2): Xaa in position 2 is Phe, Ile or Met
  Variant (5)..(5): Xaa in position 5 is Ile or Val
  Variant (13)..(17): Xaa in position 13 to 17 is any amino acid
  Variant (18)..(18): Xaa in position 18 is any or no amino acid
  Variant (20)..(20): Xaa in position 20 is any amino acid
  Variant (21)..(22): Xaa in position 21 to 22 is any or no amino acid
  Variant (24)..(25): Xaa in position 24 to 25 is any amino acid
  Variant (26)..(26): Xaa in position 26 is Ala or Gln
  Variant (27)..(28): Xaa in position 27 to 28 is any amino acid
  Variant (29)..(29): Xaa in position 29 is Asn, Gln or Ser
  Variant (30)..(33): Xaa in position 30 to 33 is any amino acid
  Variant (34)..(34): Xaa in position 34 is Phe, Leu or Met
  Variant (36)..(36): Xaa in position 36 is Asp or Glu
  Variant (37)..(37): Xaa in position 37 is Ala or Thr
  Variant (38)..(38): Xaa in position 38 is Asn or Thr
  Variant (45)..(46): Xaa in position 45 to 46 is Ile or Val
  Variant (47)..(47): Xaa in position 47 is Asp, Glu or Ser
  Variant (48)..(48): Xaa in position 48 is Asn or Thr
  Variant (50)..(51): Xaa in position 50 to 51 is any amino acid
  Variant (53)..(53): Xaa in position 53 is Ile or Leu
  Variant (54)..(54): Xaa in position 54 is any amino acid
  Variant (55)..(55): Xaa in position 55 is Ala or Thr
  Variant (58)..(58): Xaa in position 58 is Asp, Glu or Lys
  Variant (59)..(59): Xaa in position 59 is Ile, Leu or Val
GXHVXTPNKKANXXXXXXYXXXRXXXXXXXXXXXYXXXVGAGLPXXXXLXXLXXXGDXX

SEQ ID NO: 70448 - protein, 49 aa, Artificial sequence
  protein pattern
  Variant (2)..(3): Xaa in position 2 to 3 is any amino acid
  Variant (4)..(8): Xaa in position 4 to 8 is any or no amino acid
  Variant (10)..(10): Xaa in position 10 is Ala, Pro or Thr
  Variant (13)..(13): Xaa in position 13 is any amino acid
  Variant (15)..(15): Xaa in position 15 is Met or Val
  Variant (16)..(16): Xaa in position 16 is Ile, Pro or Val
  Variant (18)..(18): Xaa in position 18 is any amino acid
  Variant (20)..(20): Xaa in position 20 is Ala, Asn or Ser
  Variant (21)..(21): Xaa in position 21 is any amino acid
  Variant (22)..(22): Xaa in position 22 is Ile or Val
  Variant (24)..(24): Xaa in position 24 is Ala, Gly or Ser
  Variant (25)..(25): Xaa in position 25 is Ala, Cys, Thr or Val
  Variant (26)..(31): Xaa in position 26 to 31 is any amino acid
  Variant (32)..(32): Xaa in position 32 is Asn or Ser
  Variant (33)..(33): Xaa in position 33 is Gly, Ile, Leu or Val
  Variant (34)..(34): Xaa in position 34 is Ile or Val
  Variant (35)..(35): Xaa in position 35 is Leu or Met
  Variant (37)..(37): Xaa in position 37 is Ser or Thr
  Variant (39)..(39): Xaa in position 39 is Ala or Ser
  Variant (43)..(43): Xaa in position 43 is His or Tyr
  Variant (44)..(44): Xaa in position 44 is Cys or Ser
  Variant (45)..(45): Xaa in position 45 is Ile or Val
  Variant (46)..(46): Xaa in position 46 is Cys or Ser
  Variant (48)..(48): Xaa in position 48 is Ala or Cys
  Variant (49)..(49): Xaa in position 49 is Ile or Val
NXXXXXXXGXGMXGXXGXAXXXFXXXXXXXXXXXXIXQXSSEXXXXFXX

SEQ ID NO: 70449 - protein, 61 aa, Artificial sequence
  protein pattern
  Variant (2)..(2): Xaa in position 2 is any or no amino acid
  Variant (4)..(6): Xaa in position 4 to 6 is any or no amino acid
  Variant (12)..(12): Xaa in position 12 is Cys or Ser
  Variant (15)..(15): Xaa in position 15 is any amino acid
  Variant (16)..(16): Xaa in position 16 is Ala, Asn or Ser
  Variant (18)..(18): Xaa in position 18 is Ser or Thr
  Variant (19)..(19): Xaa in position 19 is Ala, Thr or Val
  Variant (21)..(21): Xaa in position 21 is Ile, Leu or Val
  Variant (22)..(23): Xaa in position 22 to 23 is any amino acid
  Variant (24)..(24): Xaa in position 24 is Asp, Glu, Asn, Gln or Arg
  Variant (25)..(28): Xaa in position 25 to 28 is any amino acid
  Variant (29)..(29): Xaa in position 29 is Ala or Gly
  Variant (30)..(30): Xaa in position 30 is Ile, Leu or Val
  Variant (31)..(32): Xaa in position 31 to 32 is any amino acid
  Variant (33)..(33): Xaa in position 33 is Ala, Cys, Ser, Thr or Val
  Variant (35)..(35): Xaa in position 35 is Glu, Gln or Ser
  Variant (36)..(36): Xaa in position 36 is any amino acid
  Variant (37)..(37): Xaa in position 37 is Phe or Leu
  Variant (38)..(38): Xaa in position 38 is Phe or Tyr
  Variant (39)..(39): Xaa in position 39 is any amino acid
  Variant (40)..(40): Xaa in position 40 is Asn, Ser, Thr or Val
  Variant (41)..(43): Xaa in position 41 to 43 is any amino acid
  Variant (44)..(44): Xaa in position 44 is Ile, Leu or Val
  Variant (45)..(45): Xaa in position 45 is Ala, Asp or Glu
  Variant (46)..(46): Xaa in position 46 is Met or Val
  Variant (47)..(47): Xaa in position 47 is any amino acid
  Variant (48)..(48): Xaa in position 48 is Ile, Leu or Val
  Variant (49)..(49): Xaa in position 49 is Ile or Val
  Variant (51)..(51): Xaa in position 51 is Cys, Pro or Val
  Variant (53)..(53): Xaa in position 53 is any amino acid
  Variant (54)..(54): Xaa in position 54 is Ile or Val
  Variant (56)..(57): Xaa in position 56 to 57 is any amino acid
  Variant (59)..(59): Xaa in position 59 is Ile, Leu or Val
  Variant (60)..(60): Xaa in position 60 is Asp, Glu or Asn
NXIXXXAIAQGXSEXXIXXVXXXXXXXXXXXXXHXXXXXXXXXXXXXXXGXGXXGXXLXXQ

SEQ ID NO: 70450 - protein, 28 aa, Artificial sequence
  protein pattern
  Variant (3)..(3): Xaa in position 3 is any amino acid
  Variant (5)..(5): Xaa in position 5 is Gly or Ser
  Variant (6)..(6): Xaa in position 6 is Asn or Thr
  Variant (7)..(10): Xaa in position 7 to 10 is any amino acid
  Variant (11)..(11): Xaa in position 11 is Leu or Pro
  Variant (12)..(12): Xaa in position 12 is Thr or Val
  Variant (13)..(13): Xaa in position 13 is any amino acid
  Variant (15)..(15): Xaa in position 15 is any amino acid
  Variant (17)..(17): Xaa in position 17 is Asp or Asn
  Variant (21)..(21): Xaa in position 21 is Phe or Tyr
  Variant (25)..(26): Xaa in position 25 to 26 is any amino acid
  Variant (27)..(27): Xaa in position 27 is Ala, Gly or Ser
  Variant (28)..(28): Xaa in position 28 is Ala or Ser
GFXAXXXXXXXXXLXRXGSDXSAAXXXX

SEQ ID NO: 70451 - protein, 37 aa, Artificial sequence
  protein pattern
  Variant (3)..(3): Xaa in position 3 is any amino acid
  Variant (4)..(4): Xaa in position 4 is Ala or Gly
  Variant (5)..(5): Xaa in position 5 is Ile, Leu or Val
  Variant (6)..(6): Xaa in position 6 is any amino acid
  Variant (7)..(7): Xaa in position 7 is Gly or Asn
  Variant (9)..(11): Xaa in position 9 to 11 is any amino acid
  Variant (12)..(12): Xaa in position 12 is any or no amino acid
  Variant (14)..(16): Xaa in position 14 to 16 is any amino acid
  Variant (17)..(17): Xaa in position 17 is any or no amino acid
  Variant (19)..(19): Xaa in position 19 is Ile, Leu or Val
  Variant (20)..(20): Xaa in position 20 is any amino acid
  Variant (22)..(22): Xaa in position 22 is Ala, Asp, Glu, Gly, Asn, Ser or Thr
  Variant (23)..(23): Xaa in position 23 is any amino acid
  Variant (25)..(25): Xaa in position 25 is any amino acid
  Variant (26)..(26): Xaa in position 26 is Ala, Asp, Glu, Asn, Gln or Ser
  Variant (27)..(35): Xaa in position 27 to 35 is any amino acid
  Variant (36)..(36): Xaa in position 36 is Asp, Asn or Ser
  Variant (37)..(37): Xaa in position 37 is Phe, Ile, Leu or Met
RVXXXXXSXXXXLXXXXGXXLXXWXXXXXXXXXXXXX

SEQ ID NO: 70452 - protein, 22 aa, Artificial sequence
  protein pattern
  Variant (2)..(3): Xaa in position 2 to 3 is any or no amino acid
  Variant (5)..(5): Xaa in position 5 is Phe, Ile, Leu, Met or Val
  Variant (10)..(10): Xaa in position 10 is Ala, Ser or Thr
  Variant (11)..(11): Xaa in position 11 is Ala, Asp, Asn or Ser
  Variant (12)..(12): Xaa in position 12 is Ala, Asp, Glu, Gln, Ser or Thr
  Variant (13)..(13): Xaa in position 13 is any amino acid
  Variant (14)..(14): Xaa in position 14 is Ile or Val
  Variant (15)..(15): Xaa in position 15 is Ala or Ser
  Variant (16)..(17): Xaa in position 16 to 17 is any amino acid
  Variant (19)..(19): Xaa in position 19 is any amino acid
  Variant (20)..(20): Xaa in position 20 is Asp, Glu, Asn, Arg or Ser
  Variant (21)..(21): Xaa in position 21 is any amino acid
  Variant (22)..(22): Xaa in position 22 is Leu or Met
PXXVXVDCTXXXXXXXXYXXXX

SEQ ID NO: 70453 - protein, 21 aa, Artificial sequence
  protein pattern
  Variant (2)..(2): Xaa in position 2 is any amino acid
  Variant (7)..(7): Xaa in position 7 is Ser or Thr
  Variant (8)..(8): Xaa in position 8 is Cys or Ser
  Variant (9)..(9): Xaa in position 9 is Leu, Met or Val
  Variant (10)..(10): Xaa in position 10 is Ala or Gly
  Variant (11)..(11): Xaa in position 11 is Asp, Asn or Thr
  Variant (12)..(12): Xaa in position 12 is any amino acid
  Variant (13)..(13): Xaa in position 13 is Ala, Asp, Glu or Gln
  Variant (14)..(14): Xaa in position 14 is any amino acid
  Variant (15)..(15): Xaa in position 15 is Phe, Ile, Leu or Val
  Variant (16)..(17): Xaa in position 16 to 17 is any amino acid
  Variant (18)..(18): Xaa in position 18 is Ala or Val
  Variant (20)..(20): Xaa in position 20 is any amino acid
  Variant (21)..(21): Xaa in position 21 is Ile, Leu or Val
VXKFGGXXXXXXXXXXXXAXX

SEQ ID NO: 70454 - protein, 41 aa, Artificial sequence
  protein pattern
  Variant (2)..(2): Xaa in position 2 is any amino acid
  Variant (3)..(3): Xaa in position 3 is any or no amino acid
  Variant (5)..(9): Xaa in position 5 to 9 is any amino acid
  Variant (10)..(10): Xaa in position 10 is any or no amino acid
  Variant (12)..(12): Xaa in position 12 is Asp, Glu or Ser
  Variant (13)..(13): Xaa in position 13 is any amino acid
  Variant (14)..(14): Xaa in position 14 is Ile, Leu or Val
  Variant (15)..(15): Xaa in position 15 is Ala, Asp or Glu
  Variant (16)..(16): Xaa in position 16 is Phe, Leu, Met or Val
  Variant (17)..(20): Xaa in position 17 to 20 is any amino acid
  Variant (21)..(21): Xaa in position 21 is Ala or Ser
  Variant (23)..(23): Xaa in position 23 is Ile, Leu or Val
  Variant (24)..(24): Xaa in position 24 is Ala, Ser or Thr
  Variant (25)..(25): Xaa in position 25 is any amino acid
  Variant (26)..(26): Xaa in position 26 is Ile or Val
  Variant (28)..(29): Xaa in position 28 to 29 is any amino acid
  Variant (31)..(34): Xaa in position 31 to 34 is any amino acid
  Variant (36)..(36): Xaa in position 36 is Ile, Leu or Val
  Variant (37)..(37): Xaa in position 37 is Ala or Ser
  Variant (38)..(38): Xaa in position 38 is Ala, Cys or Ser
  Variant (39)..(39): Xaa in position 39 is any amino acid
  Variant (40)..(40): Xaa in position 40 is Phe or Leu
FXXEXXXXXXLXXXXXXXXXXIXXXXGXXMXXXXGXXXXXF

SEQ ID NO: 70455 - protein, 17 aa, Artificial sequence
  protein pattern
  Variant (2)..(4): Xaa in position 2 to 4 is any or no amino acid
  Variant (7)..(7): Xaa in position 7 is any amino acid
  Variant (8)..(8): Xaa in position 8 is Ala, Gly or Ser
  Variant (10)..(10): Xaa in position 10 is any amino acid
  Variant (12)..(12): Xaa in position 12 is Asp or Asn
  Variant (13)..(13): Xaa in position 13 is any amino acid
  Variant (14)..(14): Xaa in position 14 is Leu or Met
  Variant (15)..(16): Xaa in position 15 to 16 is any amino acid
  Variant (17)..(17): Xaa in position 17 is Ile, Leu, Met or Val
LXXXSAXXKXTXXXXXX

SEQ ID NO: 70456 - protein, 17 aa, Artificial sequence
  protein pattern
  Variant (2)..(2): Xaa in position 2 is any amino acid
  Variant (3)..(4): Xaa in position 3 to 4 is any or no amino acid
  Variant (6)..(6): Xaa in position 6 is Glu or Lys
  Variant (12)..(12): Xaa in position 12 is Ala or Gly
  Variant (13)..(13): Xaa in position 13 is any amino acid
  Variant (14)..(14): Xaa in position 14 is Ile, Leu or Val
  Variant (15)..(16): Xaa in position 15 to 16 is any amino acid
  Variant (17)..(17): Xaa in position 17 is Ala, Asp, Gly, Asn, Thr or Val
AXXXGXVLRYVXXXXXX

SEQ ID NO: 70457 - DNA, 942 bp, Escherichia coli
  CDS (1)..(942)
atgaagctgatacgcggcatacataatctcagccaggccccgcaagaagggtgtgtgctgactattggtaatttcgacggcgtgcatcgcggtcatcgcgcgctgttacagggcttgcaggaagaagggcgcaagcgcaacttaccggtgatggtgatgctttttgaacctcaaccactggaactgtttgctaccgataaagccccggcaagactgacccggctgcgggaaaaactgcgttaccttgcagagtgtggcgttgattacgtgctgtgcgtgcgtttcgacaggcgtttcgcggcgttaaccgcgcaaaatttcatcagcgatcttctggtgaagcatttgcgcgtaaaatttcttgccgtaggtgatgatttccgctttggcgctggtcgtgaaggcgatttcttgttattacagaaagctggcatggaatacggcttcgatatcaccagtacgcaaactttttgcgaaggtggcgtgcgcatcagcagcaccgccgtgcgtcaggcccttgcggatgacaatctggctctggcagagagtttactggggcacccgtttgccatctccgggcgtgtagtccacggtgatgaattagggcgcactataggtttcccgacggcgaatgtaccgctgcgccgtcaggtttccccggtgaaaggggtttatgcggtagaagtgctgggcctcggtgaaaagccgttacccggcgtggcaaacatcggaacacgcccaacggttgccggtattcgccagcagctggaagtgcatttgttagatgttgcaatggacctttacggtcgccatatacaagtagtgctgcgtaaaaaaatacgcaatgagcagcgatttgcgtcgctggacgaactgaaagcgcagattgcgcgtgatgaattaaccgcccgcgaattttttgggctaacaaaaccggcttaa

SEQ ID NO: 70458 - protein, 313 aa, Escherichia coli
MKLIRGIHNLSQAPQEGCVLTIGNFDGVHRGHRALLQGLQEEGRKRNLPVMVMLFEPQPLELFATDKAPARLTRLREKLRYLAECGVDYVLCVRFDRRFAALTAQNFISDLLVKHLRVKFLAVGDDFRFGAGREGDFLLLQKAGMEYGFDITSTQTFCEGGVRISSTAVRQALADDNLALAESLLGHPFAISGRVVHGDELGRTIGFPTANVPLRRQVSPVKGVYAVEVLGLGEKPLPGVANIGTRPTVAGIRQQLEVHLLDVAMDLYGRHIQVVLRKKIRNEQRFASLDELKAQIARDELTAREFFGLTKPA

SEQ ID NO: 70459 - DNA, 924 bp, Chlamydia trachomatis
  CDS (1)..(924)
  misc_feature <87>..<87>: n is a, c, g, or t
  misc_feature <105>..<105>: n is a, c, g, or t
  misc_feature <109>..<109>: n is a, c, g, or t
atgtatctccttatttacgtgatgcaaatggacttattctacagcctgctcccgtcctctaatcctatagaatctgttactataggntttttcgatgggtgtcanttangacaccaagctttgctttcttttttaacgaagtttcctggcaaatctggagtaattacgttcagccagcatcctgagcatactttgtctaactctcctccagaaactattacctctcttgaggagcgtattcagcttctagctggctgcggcattgattatctagccgttctcccttttaaccaggaaatagctaatcaagaggcagagctatttatccagtctatttacaagactctacatccatcaagaattgtcttaggttacgattctagacttgggaagggtggtttaggaacagcacaaacgttaaggccttttgctgcctctttagggatatctctagaagaagtccctcccctacagattgaaggcactattgtatctagcagaaaaattcgacaatttcttagagagaaagatttgtgctctgcagaaaagtttcttgggagaccttttgcttatacaggaaaggttgctcatggacgaggaatcgggacatcttttggatatgcaacaatcaatcttccccttacccattctctacttcctttaggggtatatacttgtactatcgttattgaagggttcagctatgcaggtgttatgaatttaggtatggcgcccacaatgcaaagacaccaactatgcctagaggcacatatccttgatttttcagaagatctctacgataagagtattactgtgattcttgagcaatttctcagggaagaaaagctcttttcttctaaagacgagcttgtccttgccattcaagaagatatccgccaagcccgtctcaataaaaatagatga

SEQ ID NO: 70460 - protein, 307 aa, Chlamydia trachomatis
  misc_feature <35>..<35>: The Xaa at location 35 stands for Gln, or His.
  misc_feature <37>..<37>: The Xaa at location 37 stands for    , Arg, or Gly.
MYLLIYVMQMDLFYSLLPSSNPIESVTIGFFDGCXLXHQALLSFLTKFPGKSGVITFSQHPEHTLSNSPPETITSLEERIQLLAGCGIDYLAVLPFNQEIANQEAELFIQSIYKTLHPSRIVLGYDSRLGKGGLGTAQTLRPFAASLGISLEEVPPLQIEGTIVSSRKIRQFLREKDLCSAEKFLGRPFAYTGKVAHGRGIGTSFGYATINLPLTHSLLPLGVYTCTIVIEGFSYAGVMNLGMAPTMQRHQLCLEAHILDFSEDLYDKSITVILEQFLREEKLFSSKDELVLAIQEDIRQARLNKNR

SEQ ID NO: 70461 - DNA, 903 bp, Lactococcus lactis; IL1403
  CDS (1)..(903)
atggaaatattagaatttaatgatgaactaaaatttgatgaagaacttatccttgtcctcggttattttgatggattacaccgaggacatcaaagtctttttacagaagctaaaaaaattgcggcggtattgaatttaaaaatagctgtttttacctttccggaaaaaccaacattaaccttcaacaaatttgagcctgaaatgcttttgaaattaacttcagatgaaaaacgagcagatctctttgctgaaaatggggtagattaccttgtatttaaagatttcacttctaattttgctcatcaaacttcaactgaattcgcagaaagtgtcgtcaaaagatttaatcccaaagtggtgattacaggatttgattatacgacaggttctgatatgaaaaatctcaagtcaacggaagactaccgtgtggtcatcatgccggaaaaagcggatgaacatggaaaaatttcatcgacacggattagaaaagcagttgaagaaggtgatattgcacaagcaaatgaacttttaggttattcttatgaaacaagaggccttgttgttcatggttttgcccgcggaagacaactgggctatccaacagcaaatctagtaattaaagattacgttcatttgccagctgttggagtttatacctgtgatgtcatttttgctggagaacgtcatcgtggctttgcttcaattggatataatgatacttttaacgggactgaaaaaacagttgaagttcatatttttgattttaatggagaaatttatggtgaaaaattgactgttttatggctagataaaattcgcgatatgattaaatttgatgggatagatcaattaattaaacaaatgaaagaagacgagcaaattgctcgtgatttcaaagcgtaa

SEQ ID NO: 70462 - protein, 300 aa, Lactococcus lactis; IL1403
MEILEFNDELKFDEELILVLGYFDGLHRGHQSLFTEAKKIAAVLNLKIAVFTFPEKPTLTFNKFEPEMLLKLTSDEKRADLFAENGVDYLVFKDFTSNFAHQTSTEFAESVVKRFNPKVVITGFDYTTGSDMKNLKSTEDYRVVIMPEKADEHGKISSTRIRKAVEEGDIAQANELLGYSYETRGLVVHGFARGRQLGYPTANLVIKDYVHLPAVGVYTCDVIFAGERHRGFASIGYNDTFNGTEKTVEVHIFDFNGEIYGEKLTVLWLDKIRDMIKFDGIDQLIKQMKEDEQIARDFKA

SEQ ID NO: 70463 - DNA, 927 bp, Myxococcus xanthus
  CDS (1)..(927)
atgaaggtctaccctgcggtggcggacgcgggccgggcgctggccggacaggcactcgcgctgggcaacttcgacggtgtgcacgtgggccatcaggccctcttcgcggaggcgcgccgccacgggcgggccgccgccttcaccttcaatccccatccaggcaaggtgctccagccggagctggcgccgaagctcatcaccctgctgccgcgcaagctggagctgttcgaggagctcgggttggacgccgcggtggtgcaacccttctcgcgcgaatacgcgcgcacgccgcccgcggacttcgaggcagcgctcttcgacgcgctcggcgtcgcgcacgtcgtggtgggcagcgacttcacctacggctcggcccggcgcggcaccgcggagacgctgcgcgaggccgcggcacggcgtggcgccacggtgcacgtggttcctcccgtcacggtggatggcgtggtggcgtcgtcatcgcgcgttcgcgagtacatcctggaggggcgcgtgtccgcggcgcggcggctgctgggccgtcccttcgacctggatggcacggtggtgacgggcgcggggcgggggcggggcatcggctttcccaccgcgaacgtggacacgcagaacgagctgcgccccgcaccgggtgtctatgccatccgcgtccaactgccgggcgagtcaaagggcacctggcatggcggtgcggcgaacatcggtgtgaagcctacctttggcggcacggaggtgacgatcgaagcgcacctgctcgacttcaccggcgacctgtacggcaaggagctgcgcgtgcagttcctcgaccgcctgcgccccgagcagcgtttcggttcggtggtggagctgacggggcagatcaagcgtgacgtggaggccgcgcgcgcagtgattgcgcgcgaggagagctga

SEQ ID NO: 70464 - protein, 308 aa, Myxococcus xanthus
MKVYPAVADAGRALAGQALALGNFDGVHVGHQALFAEARRHGRAAAFTFNPHPGKVLQPELAPKLITLLPRKLELFEELGLDAAVVQPFSREYARTPPADFEAALFDALGVAHVVVGSDFTYGSARRGTAETLREAAARRGATVHVVPPVTVDGVVASSSRVREYILEGRVSAARRLLGRPFDLDGTVVTGAGRGRGIGFPTANVDTQNELRPAPGVYAIRVQLPGESKGTWHGGAANIGVKPTFGGTEVTIEAHLLDFTGDLYGKELRVQFLDRLRPEQRFGSVVELTGQIKRDVEAARAVIAREES

SEQ ID NO: 70465 - DNA, 945 bp, Listeria monocytogenes
  CDS (1)..(945)
atgaagacgatatacttacatcatccgattacaacggacgagtggactgacataaacaaagtaatggcacttggtttttttgatggcgtccatttgggacatcaagcagttattaaacaagcgaaacagattgccggacaaaaaggacttcaaactgcagtgttaacctttgatccgcatccatctgtggttttaagcaatatacgaaaacaagtaaaatatctcacaccacttgaagataaagcagaaaaaatggctaaacttggcgtagatattatgtatgtagttcgctttacaacacagttttccgagctatctccgcaagcctttgtggataactatttagtcgctttacatgtagaacatgtggtagctggtttcgactattcttacggtaaaaaaggtgaaggtaaaatgaccgatttggctaaatatgctgatggtcgctttgaggttacgattgtcgataaacaaactgccgcaagcgacaaaataagttcaacaaacattagacgtgccatcacagaaggcgaactagaagaagcaaatcaattactgggctatccttatacaacgaaaggaaccgtgattcatggggacaaacgcggcagaacaattgggtttccaacagcgaacatccgcgtaaatgaagattatttgattccgaagcttggtgtttatgcagtgaaattccgtgtgaatggggaaactcacttgggtatggcgagtattggctataacatcacgtttaaagatgaccaagcactctctattgaggtgtatattctagattttcaccgcgaaatttacggagaagaagcagaaattaaatggtatcaatttttccgcccagaacttaaatttaatggtgtagaaggtttgattgctcagttagaaaaagacgaacaagatacaagagctttttttgctaaattagaagattaa

SEQ ID NO: 70466 - protein, 314 aa, Listeria monocytogenes
MKTIYLHHPITTDEWTDINKVMALGFFDGVHLGHQAVIKQAKQIAGQKGLQTAVLTFDPHPSVVLSNIRKQVKYLTPLEDKAEKMAKLGVDIMYVVRFTTQFSELSPQAFVDNYLVALHVEHVVAGFDYSYGKKGEGKMTDLAKYADGRFEVTIVDKQTAASDKISSTNIRRAITEGELEEANQLLGYPYTTKGTVIHGDKRGRTIGFPTANIRVNEDYLIPKLGVYAVKFRVNGETHLGMASIGYNITFKDDQALSIEVYILDFHREIYGEEAEIKWYQFFRPELKFNGVEGLIAQLEKDEQDTRAFFAKLED

SEQ ID NO: 70467 - DNA, 996 bp, Mycobacterium leprae
  CDS (1)..(996)
atggggagccgtaggcttgcgatcgtgcagcggtggcggggacaagacgagatccccacggattggggcagatgcgtgcttactatcggggtgttcgatggtgtgcaccgcgggcacaccgagcttatcgcacacacggtgcaaactggccgcgcacgcaacgtgcctaccgtgttgatgacgttcgacccgcacccgatggaagtggtctatccaggcagccacccggcgcagctgaccacgttgacccgacgagctgaactcatcgaggagttgggcatcgacgtgttcctggtgatgccgttcacgaccgatttcatgaaactcaccccggaccgctacgtccacgagttgctggttgaacacctgcacgtggtggaggtcgtggtgggggagaacttcaccttcggcaagaaagcggccggcaacgtcatcatgttgcgtcgggccgggcagcggtttgggtttgcggtcgggtcgatgtcactgttgtccgaacatcgcggtaatgagaccgtggcgttctcatcgacctacatccggtcctgtgtggacgccggtgacatgatggcggcgaccgaagcgctgggccgcccacaccgcgtcgaggggatggtggtccgcggccaaggccgaggcactgagcttggctttccaaccgcgaatgtggcttcgccgatgtattcggccaccccagccgacggtgtctatgccgcgtggttcaccgtgcttgggcacggtccggtgactggtaccgtggtcccaggtgaatgctatcaggccgcagtgtctgtcgggaccaatccgactttttccggacgcacccgcaccgtagaggcgttcgttctcgacgccgtcgccgacctgtatggacagcatgtagcgctggacttcgttgggcgcattcgtgggcaacgaaaatttgactcggtggccgatttagtcgccgagatggagaaggacattgaccgggcgcgggccctgctggctgattga

SEQ ID NO: 70468 - protein, 331 aa, Mycobacterium leprae
MGSRRLAIVQRWRGQDEIPTDWGRCVLTIGVFDGVHRGHTELIAHTVQTGRARNVPTVLMTFDPHPMEVVYPGSHPAQLTTLTRRAELIEELGIDVFLVMPFTTDFMKLTPDRYVHELLVEHLHVVEVVVGENFTFGKKAAGNVIMLRRAGQRFGFAVGSMSLLSEHRGNETVAFSSTYIRSCVDAGDMMAATEALGRPHRVEGMVVRGQGRGTELGFPTANVASPMYSATPADGVYAAWFTVLGHGPVTGTVVPGECYQAAVSVGTNPTFSGRTRTVEAFVLDAVADLYGQHVALDFVGRIRGQRKFDSVADLVAEMEKDIDRARALLAD

SEQ ID NO: 70469 - DNA, 987 bp, Legionella pneumophila
  CDS (1)..(987)
atgaaattgttacgcggttctactcattttgctatatttgataagggtgcagttgccactattggcaattttgatggcgtgcatttaggccatcagcatttgattaaggccctaagagcaaaggctgatgaaatgaacttgcctttagttattttattgtttgagcctcagcctaaagagtattttcacagagagaaagcaccagcaagactttctaccttgagagaaaaaatagatgccttaaacttatgtcaggtggattacatctattgcatcaagtttgatgcaaggctggctcaaacttccgctttgtattttgctcagttttatttatttgaagcattgaaaatacgctaccttctggttggccaggattttcgttttggcaaaagcagagaaggtgatgttaatttactcaaaacactaggtgctaattattcctgtgaagtgacagtacaatctgattttcttatagaaaatgaaaaaatcagttcgacgagaatcagagaagcgttgcaacaggggaatttgcgtttcgcagccaagttgttgggaagaccatacagcatgtgtggacgtgttatcaaaggagatggccgtggtcgtcaatgggggataccgacagccaatttaggcatgcatcgtttatcgatccctttgcaaggtgtatatgctgtacaagtccatattaattcaaatgtcttttatggggttgcaaatattggaaagcggccaacagtagctggaaccaaaaatattttggaggtccatttatttgattttcacgggtctctgtatggtcagctagtgcaggtaattttcttgcacaaacttcgagatgaagttaaattctcaagtgtggaagcgttaattacgcagattaatagtgacatcatattggcaaaggcctatttaagacagaattggcttgatagtgtgattgattcatcgaatgatgttgcgaatggaatcaataataccgtttaa

SEQ ID NO: 70470 - protein, 328 aa, Legionella pneumophila
MKLLRGSTHFAIFDKGAVATIGNFDGVHLGHQHLIKALRAKADEMNLPLVILLFEPQPKEYFHREKAPARLSTLREKIDALNLCQVDYIYCIKFDARLAQTSALYFAQFYLFEALKIRYLLVGQDFRFGKSREGDVNLLKTLGANYSCEVTVQSDFLIENEKISSTRIREALQQGNLRFAAKLLGRPYSMCGRVIKGDGRGRQWGIPTANLGMHRLSIPLQGVYAVQVHINSNVFYGVANIGKRPTVAGTKNILEVHLFDFHGSLYGQLVQVIFLHKLRDEVKFSSVEALITQINSDIILAKAYLRQNWLDSVIDSSNDVANGINNTV

SEQ ID NO: 70471 - DNA, 918 bp, Streptococcus pneumoniae
  CDS (1)..(918)
atgattattactattcctataaaaaaccaaaaagatattggcacaccatctgattcagtcgttgttctcggctattttgatggcatacataaggggcatcaagaattatttcgtgttgccaacaaggctgcgagaaaggatttgttgcctatcgtcgttatgacctttaatgaatctccaaagatcgctttagagccttatcatccagatttgtttttgcatattttgaaccctgctgaacgtgaaagaaaattaaagcgcgaaggtgtagaagaattatatctccttgattttagtagtcaattcgctagtctcactgcacaagaattctttgcaacttatatcaaggctatgaatgccaaaattattgttgcaggttttgattatacatttggttctgacaaaaaaacagcagaagatttaaagaattactttgatggagaagttatcattgttccacctgtagaagatgagaaaggaaagattagttcaactcgtatccgtcaagctattttagatggaaatgtgaaagaagcaggaaaacttttgggggcaccgcttccatcaagaggtatggtggttcatggtaatgctcgtggtcgtacaattggttatccgacagcgaatttagtgcttttagaccgtacttatatgccagcagatggcgtttatgttgttgatgttgagattcaaagacagaagtatcgtgctatggctagtgtcgggaaaaatgtgacctttgatggagaagaagcacgttttgaagtcaatatttttgattttaatcaagatatttatggggaaaccgtcatggtttattggcttgatcgcattcgagatatgaccaaatttgactcagttgaccaattagtggatcagttaaaggctgatgaagaagtaactcggaattggtcttaa

SEQ ID NO: 70472 - protein, 305 aa, Streptococcus pneumoniae
MIITIPIKNQKDIGTPSDSVVVLGYFDGIHKGHQELFRVANKAARKDLLPIVVMTFNESPKIALEPYHPDLFLHILNPAERERKLKREGVEELYLLDFSSQFASLTAQEFFATYIKAMNAKIIVAGFDYTFGSDKKTAEDLKNYFDGEVIIVPPVEDEKGKISSTRIRQAILDGNVKEAGKLLGAPLPSRGMVVHGNARGRTIGYPTANLVLLDRTYMPADGVYVVDVEIQRQKYRAMASVGKNVTFDGEEARFEVNIFDFNQDIYGETVMVYWLDRIRDMTKFDSVDQLVDQLKADEEVTRNWS

SEQ ID NO: 70473 - DNA, 918 bp, Streptococcus pneumoniae
  CDS (1)..(918)
atgattattactattcctataaaaaaccaaaaagatattggcacaccatctgattcagttgttgttctcggatattttgatggcatacataaggggcatcaagaattatttcgtgttgccaacaaggctgcgagaaaggatttattgcctatcgtcgttatgacctttaatgaatctccaaagatcgctttagagccttatcatccagatttgtttttgcatattttgaaccctgctgaacgtgaaagaaaattaaagcgcgaaggtgtagaagaattatatctccttgattttagtagtcaattcgctagtctcactgcacaagaattctttgcaacttatatcaaggctatgaatgccaaaattattgttgcaggttttgattatacatttggttctgacaaaaaaacagcagaagatttaaaggattactttgatggagaagttatcattgttccacctgtagaagatgagaaaggaaagattagttcaactcgtatccgtcaagctattttagatggaaatgtgaaagaagcaggaaaacttttgggggcaccgcttccatcaagaggtatggtagttcatggtaatgctcgtggtcgtacaattggttatccgacagcgaatttagtgcttttagaccgtacttatatgccagcagatggcgtttatgttgtggatgttgagattcaaagacagaagtatcgtgctatggctagtgtcgggaaaaatgtgacctttgatggagaagaagcacgttttgaagtcaatatttttgattttaatcaagatatttatggggaaaccgtcatggtttattggcttgatcgcattcgagatatgaccaaatttgactcagttgaccaattagtggatcagttaaaggctgatgaagaagtaactcggaattggtcttaa

SEQ ID NO: 70474 - protein, 305 aa, Streptococcus pneumoniae
MIITIPIKNQKDIGTPSDSVVVLGYFDGIHKGHQELFRVANKAARKDLLPIVVMTFNESPKIALEPYHPDLFLHILNPAERERKLKREGVEELYLLDFSSQFASLTAQEFFATYIKAMNAKIIVAGFDYTFGSDKKTAEDLKDYFDGEVIIVPPVEDEKGKISSTRIRQAILDGNVKEAGKLLGAPLPSRGMVVHGNARGRTIGYPTANLVLLDRTYMPADGVYVVDVEIQRQKYRAMASVGKNVTFDGEEARFEVNIFDFNQDIYGETVMVYWLDRIRDMTKFDSVDQLVDQLKADEEVTRNWS

SEQ ID NO: 70475 - DNA, 969 bp, Vibrio cholerae O1 biovar eltor str. N16961
  CDS (1)..(969): transl_table=11
atggaattaatacgcggtattcataacattcaatctcgccatcacggctgtgtattgacgattggcaactttgacggtgttcatcttggtcatcaacaagtgctcagtcaggtggtgcagcgtgcccagcagatgggtttgccttcggtagtgatgacgtttgaacctcagcccctagagctgtttgccaaacaacaagcgcccgcgcgtttaacacgtctgcgcgataagtttgtgcaactcagcaaactcggggttgatcgcctgctgtgcgttaatttcaaccatcattttgcccaattggatgcccacacgtttattcgtgacttgttggtgacccgtttgggtgttaagtttctggtggttggtgatgatttctgcttcggtaaagagcgtcaaggtaactttgcgctgctacaacaggcagggcaagccctagattttgaggtggtgagcacccaaagcttctgtttgcaacaactgcgcgtgagtagcaccgcgattcgtgaagcgttagcggctgaccaattgagcagtgcctcggctatgttggggcgccattacagcatcagcggtcgtgtctcgcatggtcaaaaactcgggcgaacgatcggctttcccaccgccaacattccactgaaacgttgtgtttctccggtttctggagtgtatgtggttgaagcctatggtttgggcccaacgccagtcggtggggttgccaatatcggtaatcgtccgacggtcgatggtgttcgccagcagctagaagtgcacttttttgactttcaaggcaacctgtacggaaagcagttggaagtcgcgctgttacataaactacgtgatgagcgcaaattcgcctcttttgaggcactaaagcaacaaattgaattggatgctgaagcagcaagggtgtggctgcgtcagcttaagggttgctcggttgattccacccagcaacaacatgtctaa

SEQ ID NO: 70476 - protein, 322 aa, Vibrio cholerae O1 biovar eltor str. N16961
MELIRGIHNIQSRHHGCVLTIGNFDGVHLGHQQVLSQVVQRAQQMGLPSVVMTFEPQPLELFAKQQAPARLTRLRDKFVQLSKLGVDRLLCVNFNHHFAQLDAHTFIRDLLVTRLGVKFLVVGDDFCFGKERQGNFALLQQAGQALDFEVVSTQSFCLQQLRVSSTAIREALAADQLSSASAMLGRHYSISGRVSHGQKLGRTIGFPTANIPLKRCVSPVSGVYVVEAYGLGPTPVGGVANIGNRPTVDGVRQQLEVHFFDFQGNLYGKQLEVALLHKLRDERKFASFEALKQQIELDAEAARVWLRQLKGCSVDSTQQQHV

SEQ ID NO: 70477 - DNA, 936 bp, Pasteurella multocida subsp. multocida str. Pm70
  CDS (1)..(936): transl_table=11
atgcgactgattcgtggcattcacaatttacccccaaatttatctggttgtgcgctgactattggcaattttgatggtgtacatttaggtcatcaagccattttgcgccatttacgtcaaaaagccgatgcgttgaatttgccggtggtcgtgatgttatttgaaccacaaccgcgcgaatactttactggcgacgccattcccgcacgcctgatgcgcctacgtgataaattacattatctcgctcaagcaaaagtagattatgtgctttgtattcgttttaatgaaaattttgctagccaaaccgccgaagaatttattgaagattggctcgtcaaaaagttgaatgtccgctttttaagtattggtgatgatttccgttttggggcgaaacgacaaggtgactttgccctgttacagaagtcaggcgaggcatttggctttttcgtggaagataaccacagtttttgctgtgacgagttacgtattagtagcactgcgatccgagaagccttagccgaggatgatttagcctatgctgaaaaaatgttaggtaaaccttatcgcatcttagggcgtgttgcacacggcaataaattaggtcgtactatcggttttccgacagccaacattccattacatcggcaagtgaaccccgttaaaggggtttacgcggtaaaagtgcggttaaaaaatcaagagatttatcacggtgttgcgaatattggtaaacgacccacgattaatggcgttgtacagctgttagaggtgcatatttttgattttcattcaaccatttatggacagtgcctagaagtcgaattttgccacaaaatccgtaacgaatttaagtttccctcttttgaggcattaaaagagcaaatcgcccaagatgtggaaaccgcaaagcattttttcagaacacaacaaatttaa

SEQ ID NO: 70478 - protein, 311 aa, Pasteurella multocida subsp. multocida str. Pm70
MRLIRGIHNLPPNLSGCALTIGNFDGVHLGHQAILRHLRQKADALNLPVVVMLFEPQPREYFTGDAIPARLMRLRDKLHYLAQAKVDYVLCIRFNENFASQTAEEFIEDWLVKKLNVRFLSIGDDFRFGAKRQGDFALLQKSGEAFGFFVEDNHSFCCDELRISSTAIREALAEDDLAYAEKMLGKPYRILGRVAHGNKLGRTIGFPTANIPLHRQVNPVKGVYAVKVRLKNQEIYHGVANIGKRPTINGVVQLLEVHIFDFHSTIYGQCLEVEFCHKIRNEFKFPSFEALKEQIAQDVETAKHFFRTQQI

SEQ ID NO: 70479 - DNA, 939 bp, Pseudomonas aeruginosa PAO1
  CDS (1)..(939): transl_table=11
atgcagctgcttcgcggactacacaacctgcagcccctggccgggggctgcgtcgccaccatcggtaacttcgacggcgtccacctcgggcaccaggctatcctggcgcgtctgcgcgagcgctcgctggagctgggcgtacccagctgcgtggtgattttcgagccgcagccgcgcgagttcttctcccccgattcggcgccggtgcgtctgacccgcctgcgcgagaaactcgagttgctgcgtgggcagggcgtcgacgtggtgctctgcctggccttcaaccgccgcttgcgcgagctgtcggcagccgagttcgtccgccaggtcctggtcgatggactggcggtgcggcatcttgaagtgggcgacgatttccgtttcggctgcgaccgctccggtgacttcgccttcctggtgaacgccagtcgcgagcaggggttcaccgtcgaggcggccaccaccgtcgaactggacggtgtgcgggtgagcagcacgcgggtccgccaggccctggccgagggcgacctgcatctcgccgagcgccttctggggcgtcccttcagcctgagcggacgggtcctgcatggacagaaactcggccggcaactgggctcgcccacggccaacattcaactgaaacggcgcaaggcgccgttgaacggcgtctacctggtcagtacgctggtcgatggccagcgttgccagggggtggcgaacatcggcacccgcccttcggtgaacggcgacggccgtccccatctggaagtgcacctgctcgatttcgccggcgatctatacggccggcatctgcaggtgaccttccaccagaagctgcgcgacgagcagcgttttgcctccctggaggcactcaaggcggcgattctcgcggatatcgccgccgcccgggcctactggctgggccaaccgcttgattga

SEQ ID NO: 70480 - protein, 312 aa, Pseudomonas aeruginosa PAO1
MQLLRGLHNLQPLAGGCVATIGNFDGVHLGHQAILARLRERSLELGVPSCVVIFEPQPREFFSPDSAPVRLTRLREKLELLRGQGVDVVLCLAFNRRLRELSAAEFVRQVLVDGLAVRHLEVGDDFRFGCDRSGDFAFLVNASREQGFTVEAATTVELDGVRVSSTRVRQALAEGDLHLAERLLGRPFSLSGRVLHGQKLGRQLGSPTANIQLKRRKAPLNGVYLVSTLVDGQRCQGVANIGTRPSVNGDGRPHLEVHLLDFAGDLYGRHLQVTFHQKLRDEQRFASLEALKAAILADIAAARAYWLGQPLD

SEQ ID NO: 70481 - DNA, 921 bp, Neisseria meningitidis MC58
  CDS (1)..(921): transl_table=11
atgagaatcaggctggggcggcacaacgcgcccgactttccacagggtgccgccgtaaccataggcaatttcgacggcgtacacctcggacacaaacacatcctccaaaaactccgcctcgaagccgacgcgcgcggactgcccgtcgtgaccgtcgttttcgaaccccaacccaaagaatttttcgcactccgcaccggcaggatgccaccgtgtcggatcagccccctgcgcaccaagctcgaattattggaaggcacaggctgtgtcgatgccgtctgggttttgcgtttcgatcaaaatttttccgaaatatccgcgcaagggtttatcgaccgcctgctgcgtcaaaccttgaatacgcgttatttgctcgtcggcgatgatttccgtttcggtgcggggcgggaaggctgttttgaacttttggcacaacagcccgatatgcagaccgagcgtacgccttccgtcatcgtcgaagacatccgcaccagcagtaccgccgtgcgacaagccctttcagacggcaaccttgcctatgcgaaaaaacttttgggacacgactacgtcttgagcggcagggtggtgcacggcagaaaactcggacgcaccttaaacgccccgactgccaacatccgcctgccccgccaccgttatgcactcggcggcgtgtttgtcgtcgaagcagacggcgcattcggcacgcggcgcggcgtggcgagtttcggcttcaatcccaccgttgatagcggctgttctcaaaagcttgaagtccacctgttcgactttcaaggcgacctgtacggacaagggctgaacgtccgcttcctgcacaaactgcgcgatgaggaaaagtttgacggtatggaagaactgaaaaggcagattgaagccgatatggaagccgcaaggcgttggtag

SEQ ID NO: 70482 - protein, 306 aa, Neisseria meningitidis MC58
MRIRLGRHNAPDFPQGAAVTIGNFDGVHLGHKHILQKLRLEADARGLPVVTVVFEPQPKEFFALRTGRMPPCRISPLRTKLELLEGTGCVDAVWVLRFDQNFSEISAQGFIDRLLRQTLNTRYLLVGDDFRFGAGREGCFELLAQQPDMQTERTPSVIVEDIRTSSTAVRQALSDGNLAYAKKLLGHDYVLSGRVVHGRKLGRTLNAPTANIRLPRHRYALGGVFVVEADGAFGTRRGVASFGFNPTVDSGCSQKLEVHLFDFQGDLYGQGLNVRFLHKLRDEEKFDGMEELKRQIEADMEAARRW

SEQ ID NO: 70483 - DNA, 957 bp, Neisseria meningitidis Z2491
  CDS (1)..(957): transl_table=11
atgaccgcctgtttcaccacatacccgaacataacaatgagaatcaggctggggcggcacaactcgcccgactttccgcacggggccgccgtaaccataggcaattttgacggcgtacacctcggacacaaacacatcctccaaaaactccgcctcgaagccgatacgcgcggattacccgtcgtggccgtcgttttcgaaccccaacccaaagaatttttcgcactccgcaccggcaggatgccaccgtgccgcatcagtcccctgcgcaccaagctcgaattattggaaggcacaggctgcgtcgatgccgtctgggttttgtgtttcgatcggaatttttccgaaatatccgcgcaagcatttatcgaccgcctgctgcgtcaaaccttgaatacgcgttatttgctcgtcggcgacgatttccgtttcggtgcggggcgggaaggctgttttgaacttttggcacaacagcccgatatgcagaccgagcgtacgccttccgtcatcgtcgaagacatccgcaccagcagtaccgccgtgcgacaagccctttcagacggcaaccttgcctatgcgaaaaaacttttgggacacgactacgtcttgagcggcagggtggtgcacggcagaaaactcggacgcaccttaaacgccccgactgccaacatccgcctgccccgccaccgttatgcactcggcggcgtgttcgtcgtcgaagcggacggcgcattcggcacgcggcgcggcgtggcgagcttcggcttcaatcccaccgttgatagcggctgttctcaaaagcttgaagtccacctgttcgactttcaaggcgacctgtacggacaacggttgaacgtccgcttcctgcacaaactgcgcgatgaagaaaagtttgacggtatggcagaactgaaaaggcagatagcagccgatatggaagccgcaaagtgttggtag

SEQ ID NO: 70484 - protein, 318 aa, Neisseria meningitidis Z2491
MTACFTTYPNITMRIRLGRHNSPDFPHGAAVTIGNFDGVHLGHKHILQKLRLEADTRGLPVVAVVFEPQPKEFFALRTGRMPPCRISPLRTKLELLEGTGCVDAVWVLCFDRNFSEISAQAFIDRLLRQTLNTRYLLVGDDFRFGAGREGCFELLAQQPDMQTERTPSVIVEDIRTSSTAVRQALSDGNLAYAKKLLGHDYVLSGRVVHGRKLGRTLNAPTANIRLPRHRYALGGVFVVEADGAFGTRRGVASFGFNPTVDSGCSQKLEVHLFDFQGDLYGQRLNVRFLHKLRDEEKFDGMAELKRQIAADMEAAKCW

SEQ ID NO: 70485 - DNA, 939 bp, Haemophilus influenzae Rd KW20
  CDS (1)..(939): transl_table=11
atggataaggacatgcaattaattcgcgggcttcacaatgcaaatcgtgttttacaaggttgtgcgctaacgatcggcaactttgatggcgtgcatttagggcatcaaaccgtccttcgccatttgcgtcaaaaagctgacgaattaaatttacccatggcggtattgttatttgaatcacagcctcgtgaatattttatggggaaaaatgcaccagcccgtttaatgcgtttgcgtgacaaaatttattatctcgaaaaggctaaggtcgatgtcgtaattgtggcgaaatttgaccgcacttttgccgagcaactagccgatgtttttattgaacaaacgcttgttaatcatctacatgtgaaatttttaagcattggcgatgatttcaaattcggctcaaaacgccaaggtaattttgccatgttgcaagcagctagtaagcgttttggttttattgttgaagataaccgtagtttttgtctagatgcacagcgaattagtagcacggcaattcgcgaagcgttagcgaatgatgacttacaacttgcagaaaatttactcggtaaaccttatcgtattttcgggcgtgtgattcatgggaataaattaggcagaacaataggatttccaacggcaaatattcgtttgcatagacaagtaaatccaatcaaaggcgtttatgccgtaaaagtgcggttaaaatcgggggagatttttaacggcgtggcaaacatgggaaaacgcccaactataaatggattaatgcaattattagaagtccatttatttgatttttctcagaatatttatggccaaatggtggaagtggaattctgccacaagattagaaacgagattaaattcccctcttttgatgatttgaaagtgcaaattgagaaagatgtagaaactgcgaaagcgttttttaacagttaa

SEQ ID NO: 70486 - protein, 312 aa, Haemophilus influenzae Rd KW20
MDKDMQLIRGLHNANRVLQGCALTIGNFDGVHLGHQTVLRHLRQKADELNLPMAVLLFESQPREYFMGKNAPARLMRLRDKIYYLEKAKVDVVIVAKFDRTFAEQLADVFIEQTLVNHLHVKFLSIGDDFKFGSKRQGNFAMLQAASKRFGFIVEDNRSFCLDAQRISSTAIREALANDDLQLAENLLGKPYRIFGRVIHGNKLGRTIGFPTANIRLHRQVNPIKGVYAVKVRLKSGEIFNGVANMGKRPTINGLMQLLEVHLFDFSQNIYGQMVEVEFCHKIRNEIKFPSFDDLKVQIEKDVETAKAFFNS

SEQ ID NO: 70487 - DNA, 939 bp, Salmonella typhimurium LT2
  CDS (1)..(939): transl_table=11
atgaagctgatacgcggcatacataatctcagtcaggccccgcatgggtgtgtgctgaccattggtaatttcgacggcgtacatcgggggcatcgcgctctactgcagggtttgcaggaagaaggacgcagacgcggtctgccggtggtggtcatgattttcgaaccgcagccgctggagctgttcgcgacggataaagcgcccgctcgcctgacgcgcctgcgtgaaaaactgcattaccttgcgcagtgcggcgtggactatgtgctgtgcgtgaaattcgatcgccgctttgccgctttgacggcgcaaacgtttatcagcgaactgctggtggagcgacttggcgtgcaatttcttgccgtcggcgatgatttccgctttggtgctagccgcgcgggcgatttcttgttattacagaaggcgggggcggagtatggttttgcggtttccagcacccaaaccttttgtgaaggcggcgtgcgtatcagtagtaccgcagtgagacaggcgctggcggaagataacctggcgcttgccgaaagtctgctgggacatccctttactatttccgggcgtgtcgttcatggcgacgagctgggacgtaccattggcttcccgacggcgaacttaccgctgcgccgtcaggtctccccggtcaaaggggtctatgcggtggaagtcaccgggcttggcgataagccgttacccggcgtagcgaacattggcactcgtccaacggtggctggcgtgcgtcaacaactggaagtgcatctgctggacgttgtaatggacctctacggtcgccatatagatgtaatactgcgtaaaaagatacgtaatgagcagcgatttgcgtcgcttgatgagctaaaagcgcaaatcgcacgcgatgagttaacggcccgcaagttttttgggctagccgggcaggtgtaa

SEQ ID NO: 70488 - protein, 312 aa, Salmonella typhimurium LT2
MKLIRGIHNLSQAPHGCVLTIGNFDGVHRGHRALLQGLQEEGRRRGLPVVVMIFEPQPLELFATDKAPARLTRLREKLHYLAQCGVDYVLCVKFDRRFAALTAQTFISELLVERLGVQFLAVGDDFRFGASRAGDFLLLQKAGAEYGFAVSSTQTFCEGGVRISSTAVRQALAEDNLALAESLLGHPFTISGRVVHGDELGRTIGFPTANLPLRRQVSPVKGVYAVEVTGLGDKPLPGVANIGTRPTVAGVRQQLEVHLLDVVMDLYGRHIDVILRKKIRNEQRFASLDELKAQIARDELTARKFFGLAGQV

SEQ ID NO: 70489 - DNA, 1089 bp, Nostoc sp. PCC 7120
  CDS (1)..(1089): transl_table=11
gtgctaaatctgtctcaaaatgggtgttctgtgtgggttgcttcttcaactgaaatggttctcacgccaacggctgttgctcttggtaagtttgatggagtgcatcttggccatcaaagggtcattcaaccagttttgcagtcaaccaggagcgcacaaacatggggagatgcactagactcatcagcccaatcagcaaaccctccagcagcaccacaagaacggatatactccacagttgtcacttttcgtcctcatccccaagagttctttacaggacaagcccgtacttggttaactcctctagatgaaaaagtacaacaattgcgatcgcttggggtagatcaactagtactactaccctttgacaaagaattaactgctttgtcgccggaagagtttgtcgaaaaaatccttgtgcaacaactacgctgtcaacgaattagcgtcgggcaagatttttgttttggcaaacagcgccgtggtaccgccaaggacttgcagttaattgcagccaaataccatattcctgttagcatagttcctttacaaacttctgatgggcaatttctggaagatggcaactgtggaagctttgagtctctagaagatgctcctattagtacctcattaattcgccaagctctagaaacgggcgatatcaaaactgccaacagattcttaggaagaccctacattctcattggcgtagtcgttgaaggcgaacaacttggtagaaccattggttttcctacagccaacctggagctaccaaaagataagtttgtcccccgtcaaggagtttacgccgtccgtgtcaaaattctcggtgagagtgcagatgctaatataccactggaaattttgggggtgatgaatattggcaaccgtcccacagttaatggtacttattcatcagtagaagtgtatcttcttgattggtctggggatttatatggtaaagaactagccgtgcagttagtggactttctgcgaccagaacaaaaatttccgtctctagaagccttaaaagcacaaattcaacaagactgcactgtcgctagacaaattttgtcaagggagaattga

SEQ ID NO: 70490 - protein, 362 aa, Nostoc sp. PCC 7120
MLNLSQNGCSVWVASSTEMVLTPTAVALGKFDGVHLGHQRVIQPVLQSTRSAQTWGDALDSSAQSANPPAAPQERIYSTVVTFRPHPQEFFTGQARTWLTPLDEKVQQLRSLGVDQLVLLPFDKELTALSPEEFVEKILVQQLRCQRISVGQDFCFGKQRRGTAKDLQLIAAKYHIPVSIVPLQTSDGQFLEDGNCGSFESLEDAPISTSLIRQALETGDIKTANRFLGRPYILIGVVVEGEQLGRTIGFPTANLELPKDKFVPRQGVYAVRVKILGESADANIPLEILGVMNIGNRPTVNGTYSSVEVYLLDWSGDLYGKELAVQLVDFLRPEQKFPSLEALKAQIQQDCTVARQILSREN

SEQ ID NO: 70491 - DNA, 999 bp, Ralstonia solanacearum GMI1000
  CDS (1)..(999): transl_table=11
gtgaaagtctttcgcggcctgcccaatgccgagagccgcacgccctgcgcactgaccatcggcaacttcgacggcgtgcaccgcggccaccagtccctgctggcccgcgcgcgcgcggcggccgacgcgcgcggactgccgctgacggtcatgaccttcgagccgcatccgcgcgagttcttcatgccggaccgcgcgcccacccgcatcgcgctgttgcgcgacaagctggaaagcctgcgccgccagggcgtcgaccgggtggtcgtcgagcacttcaatgcgcatttcgccgcgcagacgccgcaggcgttcgtgcgcaatgtgctggtcgacgggctgcacgcgcgctggctgctggtcggcgacgacttccgcttcggcgccaagcgtgccggcgatttcacctacctgcaggcggcgggcgcgcagttcggcttcgaggtcgagcagatgggctcggtctcggaaagcggcatccgcatctccagctccgcggtgcgcgaggcgctggccgccggcgacctcgaacacgcccggcgcctgctcggccacggctacgccatcagcggccatgtggtgcacgggcagaagctcggccgctcgctgggctttcccacgctgaacctgcgcatctcgcaccgcaagccggccgtgtcgggcatcttcatcgtgcaggtgcacgggctgacggaaaagccgctgcccgccgtcgccagcatcggcgtgcgcccgaccgtggacgattccggccgtgtgctgctggaggcgcatctcttcgatttccatgccaacgtctacggccggctggtgcgcgtcgaattcatgaagaagctgcgcgacgaggcccgcttcgattcgctcgacgcgctcaaggatgcgatcgccagggattgcgtcgatgcgcgccatttcttcggcctggccatcccgccggccggcgaatcacccgcgctgcggcgcgacttcgccacctcggccaccgaccgaattcagtag

SEQ ID NO: 70492 - protein, 332 aa, Ralstonia solanacearum GMI1000
MKVFRGLPNAESRTPCALTIGNFDGVHRGHQSLLARARAAADARGLPLTVMTFEPHPREFFMPDRAPTRIALLRDKLESLRRQGVDRVVVEHFNAHFAAQTPQAFVRNVLVDGLHARWLLVGDDFRFGAKRAGDFTYLQAAGAQFGFEVEQMGSVSESGIRISSSAVREALAAGDLEHARRLLGHGYAISGHVVHGQKLGRSLGFPTLNLRISHRKPAVSGIFIVQVHGLTEKPLPAVASIGVRPTVDDSGRVLLEAHLFDFHANVYGRLVRVEFMKKLRDEARFDSLDALKDAIARDCVDARHFFGLAIPPAGESPALRRDFATSATDRIQ

SEQ ID NO: 70493 - DNA, 1089 bp, Xanthomonas campestris pv. campestris str. ATCC 33913
  CDS (1)..(1089): transl_table=11
atgagcaggctgtttagagacgtcgagggcgggacgctgttcccgcacggaagcgtggtctgcatcggtgccttcgatggcctgcacctgggccatcaggcgctggtgcgccatgcggtcgaacgtgcgcgtgcgctgggcgtgccggcggtggcggtgagcttcgagccgttgccgcgcgaattcttcgccaacgacacgccgccgccgcgcctgaccctggcccgcgccaagatcgaaggcttgtacggctttggtgccgatagcgtcggcatgatccgtttcgacggccggctgtcggcgatgagcgcgcaggacttcgtccgcctggcattggtagggcgcctgtgcgcacgcgaagtctggattggcccggagttccgcttcggccatcgacgtggcggcgacattgcgctgttgcgtgccctgggcgagcagcacggctttgctgccggcgagattgcgccggtgcatctgcgcggcgagcgcatctcggcaacgcgcatccgggaactgctggtggccggtgaatttgcccatgccggcgaattgctcggccggccgtacgcgatcggtggacgtgtggtccgcggcaagcagcttggccgcacgttggggtatcccaccgccaatctgcggttttcccgcaccccggcgctgtccggcatctatgccacctgggtgcatggcgtggccgcgcagccatggccgtcggtctccagcttcggtacgcggcccacggttgccgggatcgagccgttgctggaagcgcacctgttcgatttccagggcgacttgtacgggcgccacatcgcggtcgaattcgtcgccaagctgcgcgatgaagaaaagtttgatggcttggaagcgctgaccgtgcagatgcatcgcgatgccgagcaggcgcgcgccgtgcttgccacgcatgcgcgcacgcattctttgccgcagcaggccgatgcacagcacgccgatgcaccttcgacgcagacagctacgcacatgtctgcagagacctcacctgcgagcccctcgcaaagccctgcgcacgcccgtgcggacggttcacataacgcagcgcaacggtag

SEQ ID NO: 70494 - protein, 362 aa, Xanthomonas campestris pv. campestris str. ATCC 33913
MSRLFRDVEGGTLFPHGSVVCIGAFDGLHLGHQALVRHAVERARALGVPAVAVSFEPLPREFFANDTPPPRLTLARAKIEGLYGFGADSVGMIRFDGRLSAMSAQDFVRLALVGRLCAREVWIGPEFRFGHRRGGDIALLRALGEQHGFAAGEIAPVHLRGERISATRIRELLVAGEFAHAGELLGRPYAIGGRVVRGKQLGRTLGYPTANLRFSRTPALSGIYATWVHGVAAQPWPSVSSFGTRPTVAGIEPLLEAHLFDFQGDLYGRHIAVEFVAKLRDEEKFDGLEALTVQMHRDAEQARAVLATHARTHSLPQQADAQHADAPSTQTATHMSAETSPASPSQSPAHARADGSHNAAQR

SEQ ID NO: 70495 - DNA, 1023 bp, Xanthomonas axonopodis pv. citri str. 306
  CDS (1)..(1023): transl_table=11
atgagcaggctgtttagagacgtcgagggcgggacgctgttcccgcgcggaagcgtggtctgcatcggcgccttcgatggcctgcatctggggcatcggacgctggtgcaacacgctgtggcacgtgcccgcgcactcggtgtgccggcagtggcggtgagcttcgagccgctgccgcgcgagttcttcgcacccgccgcgccgccgccgcgtctgaccctggcacgcgccaagatcgaaggcctgtacgggttcggcgccgacagcgtgggcatgatccgtttcgacggtcgcctgtccaagatgcgtgcggaagatttcgtgcggctggcgctggttgcccggctgcgcgcgcgcgaagtctggattggcccggaattccgtttcggccatcgacgcagcggcgacatcggcctgttgcgtacgctcggcgagcagcatggctttgtggcgggcgagattgcgccggtgcatctgcatggggagcggatttcggcaacgcggattcgcgaactgctcggcgccggcgaattcgcccgcgctggcgacttgctcggtcgcccgtacgccatcggtggccgggtcgtgcgcggcaagcagcttggtcgtaccttgggctatcccaccgccaacctgcgctttccgcgcacgccggcgttgtcggggatctatgcgacctgggtgcatggcgtggccgagcggccgtggccgtcggtctccagcttcggcacgcgtcccaccgtggcgggcgtggagccgctgctggaagcgcacttgttcgacttccagtgcgatctgtatggccggcacattgccgtcgaattcgttgccaagttgcgcgacgaagaaaagttcgatggcctggaggcgctgaccgtgcagatgcaccgcgatgccgagcaggcacgtgaggtactggcggcgcatatgcgttctgagcaacaaccctcgactacggcgagtccctcgcaagagcccgcacgtccatgtgcggacttctcaagcaatccagcgcaacggtag

SEQ ID NO: 70496 - protein, 340 aa, Xanthomonas axonopodis pv. citri str. 306
MSRLFRDVEGGTLFPRGSVVCIGAFDGLHLGHRTLVQHAVARARALGVPAVAVSFEPLPREFFAPAAPPPRLTLARAKIEGLYGFGADSVGMIRFDGRLSKMRAEDFVRLALVARLRAREVWIGPEFRFGHRRSGDIGLLRTLGEQHGFVAGEIAPVHLHGERISATRIRELLGAGEFARAGDLLGRPYAIGGRVVRGKQLGRTLGYPTANLRFPRTPALSGIYATWVHGVAERPWPSVSSFGTRPTVAGVEPLLEAHLFDFQCDLYGRHIAVEFVAKLRDEEKFDGLEALTVQMHRDAEQAREVLAAHMRSEQQPSTTASPSQEPARPCADFSSNPAQR

SEQ ID NO: 70497 - DNA, 939 bp, Yersinia pestis KIM
  CDS (1)..(939): transl_table=11
atggagctaattcgcggtatacataatatccgggcacgccaccatggttgcgtgctgactatcggtaactttgatggtgtccaccgtggacatcaggctttattagagcaactaaagcgcgaggggcagcgtttaggcctacccgttatggtgatgatatttgaaccgcaaccactggaattgtttgcagcagataaagcacccgcccgattgacacgcttgcgtgataaagccaaatatctggctcaggctggggttgattatttattgtgcgttaagtttgacccacgttttgccgccaatacagcgcaagcttttgttgctcagttgctggtagagaaattgggtgttaaatttttaacggtaggtgatgacttccgctttggcgcagggcgccagggggattttcaactactgcagcaagctggtgctgagtttggttttgatgttatcagcaccgacagtttttgtgatggcggcttgcgaatcagcagcaccgcgattcgtcaggcactgcatgatgatgatttggtgttggccgaaacgttattgggtcacccgtacagtatttcgggccgagtggttcacggtgatgaactggggcggacgataggtttccctacggcgaatttgccgttaaaacgtttagttgctccggtgaaaggggtgtatgcagtagatgtgtatggtttgggttcaacgccattgtatggtgtcgcgaatatcggcacccggcctaccgttgctggcgtccgtcagcagcttgaggttcatctgcttgatgtaactatggatctttatgggtgccatattgatgtggtgctacgcgcaaaactgcgcaacgaacagcgttttgcttcgcttgaggccttaaagcagcaaatcgccaacgatgtggtgacggcccgaacatttttcgggctaaagacaccggtttaa

SEQ ID NO: 70498 - protein, 312 aa, Yersinia pestis KIM
MELIRGIHNIRARHHGCVLTIGNFDGVHRGHQALLEQLKREGQRLGLPVMVMIFEPQPLELFAADKAPARLTRLRDKAKYLAQAGVDYLLCVKFDPRFAANTAQAFVAQLLVEKLGVKFLTVGDDFRFGAGRQGDFQLLQQAGAEFGFDVISTDSFCDGGLRISSTAIRQALHDDDLVLAETLLGHPYSISGRVVHGDELGRTIGFPTANLPLKRLVAPVKGVYAVDVYGLGSTPLYGVANIGTRPTVAGVRQQLEVHLLDVTMDLYGCHIDVVLRAKLRNEQRFASLEALKQQIANDVVTARTFFGLKTPV

SEQ ID NO: 70499 - DNA, 936 bp, Shewanella oneidensis MR-1
  CDS (1)..(936): transl_table=11
atggaattaatccgcggtatacataacattttgtcatctcaccatggctgtgtgctgacgataggtaattttgatggcgtgcatcgcggtcatgcacaggtgattgctaatctcgtgcaaaaggccaagcagctatcgttacccccgactgtcatgacatttgagcctcagccacaggagttattccgtggtgaaaatgcgcccgcgcgtttgagcttactacgtgacaaaattgtcttgcttgatgagttaggcgttgagcggttagtgtgtgttaactttaaccgtgcctttgctgatcaacctgcggagcatttcattgaagaattgctggtgcgtaagttagggattaagtatctcgttgtcggcgatgatttttgttttggcaaaggccggaaaggcgattttgacatgctgaagcaagcgggaacccgatatggctttaccgtggttagcacccagagttttatcgtgggatcgcaacgcgtcagttctactgccgtcagagagcaattggctaaaggtaaccttgagcaggcaagacggctactcggtcatccttttaccttaagtggccgtgttgcacacgggcaaaaaatcggtagaaccataggtttccctaccgccaatattgcgcttaagcgcaatgtggtgcctgtgcgcggggtatttgcggtgaaactctattgggaagatagcgatatttatgagggtgttgccaatataggtttccgcccgacggtgaatggtcaaatttgccagcttgaggttcatcttttggattttgaaggtgacatttatggcaaacatgttgaggttgagttagtggcaaaacttcgcgatgaacaaccttttgattcattggatgccctaaaacaacagattttgaatgatgcaaatgaggccagagctttatttggtaacgatgcaggctga

SEQ ID NO: 70500 - protein, 311 aa, Shewanella oneidensis MR-1
MELIRGIHNILSSHHGCVLTIGNFDGVHRGHAQVIANLVQKAKQLSLPPTVMTFEPQPQELFRGENAPARLSLLRDKIVLLDELGVERLVCVNFNRAFADQPAEHFIEELLVRKLGIKYLVVGDDFCFGKGRKGDFDMLKQAGTRYGFTVVSTQSFIVGSQRVSSTAVREQLAKGNLEQARRLLGHPFTLSGRVAHGQKIGRTIGFPTANIALKRNVVPVRGVFAVKLYWEDSDIYEGVANIGFRPTVNGQICQLEVHLLDFEGDIYGKHVEVELVAKLRDEQPFDSLDALKQQILNDANEARALFGNDAG

SEQ ID NO: 70501 - DNA, 951 bp, Pseudomonas putida KT2440
  CDS (1)..(951): transl_table=11
atgcagctggttcgaggtcttcacaacctgcgccccgagcaccggggctgtgtcgccaccattggcaacttcgacggggttcaccgcggccaccaggcaatcctggcgcgcctgcgcgagcgcggtcaggccttgggcctgccgacctgcgtggtgatcttcgaaccacaaccacgcgagtacttcgcacccgataccgcgccagcgcgcctggcccggctgcgcgacaagatcgagctgctggcgaccgaaggcatcgaccgggtgctgtgcctggcgttcaaccagcgtctgagcaagctcagtgccgatgccttcgtcaaggccatcctggtcgacggcctgggcgtgcgtcatctcgaagtgggcgatgacttccgcttcggctgcgaccgcgctggcgacttcgctttcctggtcgaggccggcaacgcgtacggctttaccgtcgaggccgccaacacggtcatccaggatggcctgcgggtcagcagcaccgaagtgcgcaaggccttgtccgagggcgacttcgaactggccgaacacctgctgggccgcccgtaccgcattacaggccgcgtgctgcacggccagaagctggcccgccagctcggcacaccaaccgccaacatccagctcaagcgccgccgcgtgccgctgtccggggtatacctggccagcatcgtgatcgacggcaaagcttggccgggtgtcggcaatatcggcgtgcgccccaccgttgccggtgatgggcgcccgcacctggagattcatcttctggactttgccggcgatctttacggccggcgcctgacggtggagttccaccacaagctgcgtgaagagcagcgattcgcctccctggaggcgctgaagtcggcgatcgatgcggatatcgccgccgcacgtgcacattggcacgctcaaccgctaacgaagagcctgaaatga

SEQ ID NO: 70502 - protein, 316 aa, Pseudomonas putida KT2440
MQLVRGLHNLRPEHRGCVATIGNFDGVHRGHQAILARLRERGQALGLPTCVVIFEPQPREYFAPDTAPARLARLRDKIELLATEGIDRVLCLAFNQRLSKLSADAFVKAILVDGLGVRHLEVGDDFRFGCDRAGDFAFLVEAGNAYGFTVEAANTVIQDGLRVSSTEVRKALSEGDFELAEHLLGRPYRITGRVLHGQKLARQLGTPTANIQLKRRRVPLSGVYLASIVIDGKAWPGVGNIGVRPTVAGDGRPHLEIHLLDFAGDLYGRRLTVEFHHKLREEQRFASLEALKSAIDADIAAARAHWHAQPLTKSLK

SEQ ID NO: 70503 - DNA, 936 bp, Vibrio vulnificus CMCP6
  CDS (1)..(936): transl_table=11
atggaactgatacgaggtatacacaatataaaaccacagcatcgcggctgtgtattgaccataggtaactttgatggtgtgcatttagggcaccaagaagtgttgcgtcaagtctctctgcgagctagggaaatgtcgttaccttctgtcgtgatgacatttgaacctcagcctttagagctgtttgccaaagagaaagcccctgcgcgcttaacgcgtttacgcgataagtttgtccaattgggtaagcttgagatcgaccgattgttgtgcgtcaactttaatcgtcatttcgcttccttagatgcggatgcctttattcgcgacttgttggttgagcgtttgggtgttaagtttctcgttgttggcgatgacttttgttttggtaaagcaagacaaggcaattttgccatgctgcaagaagcgggcaaaaaatacggtttcaccgtagtgaatacccaaagcttctgtttagcgcagttaagagttagtagtaccgccattcgtgaagcgcttgctcacgatcagctagcggttgccgctcaaatgttagggcgggattacagcattagcggacgtgtttcacatggccgtaaattaggcaggacgataggttttcctaccgccaatattccgctaaaacgctgtgtttctcccgtctctggcgtgtatgtcgttcaagcgttaggcttggataacaaaccgattggtggtgtggccaatattggccaaagaccgacggttaacggcgtgcgtcagcagttagaggtacatttattcgactttcaagccaacttgtatggcaagcagttagaagtggtacttttgcataaactgcgtgatgaaaagaagtttgagtcttttgacgcactcaaacagcaaattgaattggatgctgaggcagcaagggtgtggctgcgtcagctaaagcgttga

SEQ ID NO: 70504 - protein, 311 aa, Vibrio vulnificus CMCP6
MELIRGIHNIKPQHRGCVLTIGNFDGVHLGHQEVLRQVSLRAREMSLPSVVMTFEPQPLELFAKEKAPARLTRLRDKFVQLGKLEIDRLLCVNFNRHFASLDADAFIRDLLVERLGVKFLVVGDDFCFGKARQGNFAMLQEAGKKYGFTVVNTQSFCLAQLRVSSTAIREALAHDQLAVAAQMLGRDYSISGRVSHGRKLGRTIGFPTANIPLKRCVSPVSGVYVVQALGLDNKPIGGVANIGQRPTVNGVRQQLEVHLFDFQANLYGKQLEVVLLHKLRDEKKFESFDALKQQIELDAEAARVWLRQLKR

SEQ ID NO: 70505 - DNA, 948 bp, Xylella fastidiosa Temecula1
  CDS (1)..(948): transl_table=11
atgggcagcgtgtttagacatatcgaaggcgggatgctgttcccgcaaggaagtgtaacctgcattggtgcttttgatggcctgcacctggggcatcgtgcccttgtacgtcatgccttacaacgtgcaactgcattgcacctgcccaccgttgccctgagctttgaaccgcttccacgtgaatacttcgcctccaccaccccgcccccgcgtttgaccctgacacgcgccaaaattcagggcctgcaccgcttcggtgctgatagcgtcggcttactacgttttgacagccgcttggcatccatgagccctcaaacctttgtcgagcgtgttttgctcggacgcttgggagtgcgtgaagtgctgatcgggccacagttccgctttggacatcagcgcagcggtgatatcgccttattgcagcgactgggcctggagcacggttttacagccaccgagatcccacccttacacctgaataatgaacgcatctccgcaacaaaaatccgcgccttgctggcagcgggcgactttgctcatgcggccgaactactaggccgaccttacatgatcggtggccgcgtcgtgcgcggccagcagcttggcagcaccctaggctacccgaccgcgaatctgcgtttcccccatcccatcgcactgtccggcatttatgccacctgggtgcatggcatcttcgaacaaccctggccttccgtctccagcttcggcacccggcccaccgtcgccggcgtggaaccactcctagaagtgcatctattcgacttccacagtgacctctatggacgtcgtatcgacgtcgaattcatcgccaaactacgtgacgaagaaacattccccgacctccacacaatgaccacacaaatacatcgtgacgcccaacaggcgcgccacatcctttccgaacatcgattgcgagccaccgcgtga

SEQ ID NO: 70506 - protein, 315 aa, Xylella fastidiosa Temecula1
MGSVFRHIEGGMLFPQGSVTCIGAFDGLHLGHRALVRHALQRATALHLPTVALSFEPLPREYFASTTPPPRLTLTRAKIQGLHRFGADSVGLLRFDSRLASMSPQTFVERVLLGRLGVREVLIGPQFRFGHQRSGDIALLQRLGLEHGFTATEIPPLHLNNERISATKIRALLAAGDFAHAAELLGRPYMIGGRVVRGQQLGSTLGYPTANLRFPHPIALSGIYATWVHGIFEQPWPSVSSFGTRPTVAGVEPLLEVHLFDFHSDLYGRRIDVEFIAKLRDEETFPDLHTMTTQIHRDAQQARHILSEHRLRATA

SEQ ID NO: 70507 - DNA, 927 bp, Pseudomonas syringae pv. tomato str. DC3000
  CDS (1)..(927): transl_table=11
atgcagctggttagaggccttcacaacctgcgccccgagcatcggggctgcgtcgccacgattggcaatttcgacggtgttcaccgcggccaccaggcgatcctggcgcgtttgcgtgagcgtgccgtcgaattgggtgtgcccagctgcgcggtgatcttcgagccgcagccgcgtgagttcttcgcgccgcaaacggctccggcacgtctggcgcgtttgcgcgacaagcttgaactgctgggtgccgagggcgtggaccgggtattgtgtctgtccttcaaccagcgcctgagcaaactcagtgcggcaagcttcgtcgagaccgtgctgatcgacggtctgggcgtgcagcaccttgaagtaggcgacgattttcgttttggctacgaccgggtcggtgattttgattttctgcagcaggccggcacgacgtatggttttaccgtagaagcggcgcagaccgttgaaatcgatggcctgcgcgtcagcagcaccaaggtgcgtaaagccctggctgcggcggactttgcccttgccgagcgcatgctcggtcgcccgttccagataaccggacgggtattgcatggccagaagctggcgcgtcagttgggtacgcccaccgccaacgtgcaactcaagcgtcgtcgtgtaccgttgagcggggtttatctggtcagcatggacatcgacggcaagccttggccaggcgtcgccaacatcggtgtgcgtccgacggtggcgggtgatggcagcgcgcacctcgaagtgcatcttctggattttgccggcgatctttacggtcggcgtttaacggtggctttccaccacaagctgcgtgatgagcagcgtttcgcctcactggaggcgctcaagacggcgatcaatgcggacgtcgccgccgcccgtgcccattggcatggctaa

SEQ ID NO: 70508 - protein, 308 aa, Pseudomonas syringae pv. tomato str. DC3000
MQLVRGLHNLRPEHRGCVATIGNFDGVHRGHQAILARLRERAVELGVPSCAVIFEPQPREFFAPQTAPARLARLRDKLELLGAEGVDRVLCLSFNQRLSKLSAASFVETVLIDGLGVQHLEVGDDFRFGYDRVGDFDFLQQAGTTYGFTVEAAQTVEIDGLRVSSTKVRKALAAADFALAERMLGRPFQITGRVLHGQKLARQLGTPTANVQLKRRRVPLSGVYLVSMDIDGKPWPGVANIGVRPTVAGDGSAHLEVHLLDFAGDLYGRRLTVAFHHKLRDEQRFASLEALKTAINADVAAARAHWHG

SEQ ID NO: 70509 - DNA, 936 bp, Vibrio parahaemolyticus RIMD 2210633
  CDS (1)..(936): transl_table=11
atggaactgattagaggcattcataatatcgcaccacatcattatggttgtgtgttgacgatcggcaatttcgatggcgtacacaaaggccatcaacaagtattgcagcaagtgtctgagcaagcggagaaactttcgttaccgtcggttgtgatgacctttgaacctcagccaatggagctgtttgccaaagacaaagcgcccgcaaggttgacgcgactgcgcgacaagttcgttcaattaagcaagctcgacatcgatcgtttgctttgcgtcaactttaatcgccattttgccagcctgacagcggaagagtttatccgcgacttgttggtcgagcgtttgggtgttaagtttcttgtcgttggtgatgatttctgctttggcaaaggccgtttaggtaactttgctatgttgcaggaagcaggggaaaaatacggctttgaagtcgtcagtacccaaagcttttgtttacaacagttacgagtgagtagcaccgcgattcgcgaagccttagctcgtgacgatttgcatgccgcacaagagatgctgggaagagattacagcatcagcggtcgcgtttcacacggaagaaagttaggaagaaccattggattcccgacggccaatattccactgaaacgttgtgtttctccggtttccggagtctatgttgttcaagcgctaggcttgggtgataagccagtcggtggcgtggctaatattggccaacgacctacagtaaatggcgttcgccaacagttagaagtacacttatttgactttcatgccaatttatatggcaagcaactagaagtggaacttttgcacaaacttcgagatgagcaaaagtttgagtcgtttgaagcacttaaacaacaaatcgaattggatgctgaagcagcaagggtgtggctgcgtcagcttaagagttga

SEQ ID NO: 70510 - protein, 311 aa, Vibrio parahaemolyticus RIMD 2210633
MELIRGIHNIAPHHYGCVLTIGNFDGVHKGHQQVLQQVSEQAEKLSLPSVVMTFEPQPMELFAKDKAPARLTRLRDKFVQLSKLDIDRLLCVNFNRHFASLTAEEFIRDLLVERLGVKFLVVGDDFCFGKGRLGNFAMLQEAGEKYGFEVVSTQSFCLQQLRVSSTAIREALARDDLHAAQEMLGRDYSISGRVSHGRKLGRTIGFPTANIPLKRCVSPVSGVYVVQALGLGDKPVGGVANIGQRPTVNGVRQQLEVHLFDFHANLYGKQLEVELLHKLRDEQKFESFEALKQQIELDAEAARVWLRQLKS

SEQ ID NO: 70511 - DNA, 963 bp, Coxiella burnetii RSA 493
  CDS (1)..(963): transl_table=11
atgaaattaatacgtggtaaacataatttactcacccctttgaatggttgcgtggccacgttgggtaattttgatgggctgcatttgggtcatcaagcgttattgaaaacgttgaagcaattggctcgagaattaaagcttccaacggtggtcattatttttgaacctcagcccaaagaattttttgcaaaaggtcaaacggaagcgcgattgatgcgttttcgggaaaaatggttggggtttgctgaatggaagattgattaccttttgtgtttgcgctttgatcgcgcgttagccgatttagcggcggaagattttgttaagcaaattttagtggatcgattgggagcgaaagccgttgtggtgggcgatgattgtcgttttggcgcgaaaagagcgggcgattatgcgttgttaaagcaattgggcgaggaatataattttaaggcaattgaaatgccctcggttatttacgatggccagcgcgtgagtagtacgcgtgtgcggcaagctttgcaagcaggggatatggccgtgatgcaagctttgctgggccgaccgtatcgactttgcggccgcgttattgccggcgagaagcggggtcgagagttgggctttcctacggcgaatatcgacttgcatcgtgcgattgcgccaatgtctggtatttttgtagttcgcgcttttttaaataaaaaatcttatcggggcgtagctagtttgggggtccgtcctacttttaaagatgaaaacgcccgattgttgttagaagtttatttatttgatttttctaaaacgatttacggttgttatttagaagtggaatttttacataaacttcgagaagaagtgcgttttgattcgataagcgctttaatcgaacaaatgcaccgcgacgttattgaagcagaaaaatactaccaaattttatcatccttgcgggacccggaatctcagcgttaa

SEQ ID NO: 70512 - protein, 320 aa, Coxiella burnetii RSA 493
MKLIRGKHNLLTPLNGCVATLGNFDGLHLGHQALLKTLKQLARELKLPTVVIIFEPQPKEFFAKGQTEARLMRFREKWLGFAEWKIDYLLCLRFDRALADLAAEDFVKQILVDRLGAKAVVVGDDCRFGAKRAGDYALLKQLGEEYNFKAIEMPSVIYDGQRVSSTRVRQALQAGDMAVMQALLGRPYRLCGRVIAGEKRGRELGFPTANIDLHRAIAPMSGIFVVRAFLNKKSYRGVASLGVRPTFKDENARLLLEVYLFDFSKTIYGCYLEVEFLHKLREEVRFDSISALIEQMHRDVIEAEKYYQILSSLRDPESQR

SEQ ID NO: 70513 - DNA, 972 bp, Nitrosomonas europaea ATCC 19718
  CDS (1)..(972): transl_table=11
atgcgtataacccgacggtcggtgatctataggggagagcctgttgctctgaccataggcaattttgacggtgtgcatcttggccatcaggcaatgatcgcccgcctgaagcgggttgccggtcgtttgggaattgcatcatgtgtcatgacgtttgaaccgcatccgcgagagcgtctgatgcccgagcaggctccggcgcggttgacggatttgcgtgagaaactggaactgctggcgggttatggcgtgagtcgtacgcagatctgtcgtttcgaccatgaatttgccggaatcagtgcggaatcgttcatcacacgtattctgctgcaggaaatgaatgtccgctggctgctgataggagaggattttcgttttggtgcccggcgttcgggagatcttaccttgctgagaaagttcttttcggagccagatgagctggaggtcatgtcccccgttactgtggatgaattgagggtatcaagtacagcagtgcgcgatgccctggcatcgggcaacctcgatctggctgcagacttcctggggcgcccttacagcatcagcgggcgggtggtggatggcatcaaactgggcaaaaaactgggttttccgacggccaacatatggttgaagcatcatcatcttccactaagcggtattttcgtggtggaagcaaactggtgtaatgattcaggccatacacggcgaatccggggagtagccagtgtgggtgtccggccaaccgttttcgaacacgcacaaccgctgctggaagtacatttgtttgattttgatgaacagatctatggacagcatttgcgagtcgattttttacaaaaactcagagatgaagaaaaatttcctgatatggaaacactcgtaaaacaaatagaacaggacgtggatcgcgccaaagcctatttttcccgaacagatgctgccatgcatcaaacgatctgcctggattgctga

SEQ ID NO: 70514 - protein, 323 aa, Nitrosomonas europaea ATCC 19718
MRITRRSVIYRGEPVALTIGNFDGVHLGHQAMIARLKRVAGRLGIASCVMTFEPHPRERLMPEQAPARLTDLREKLELLAGYGVSRTQICRFDHEFAGISAESFITRILLQEMNVRWLLIGEDFRFGARRSGDLTLLRKFFSEPDELEVMSPVTVDELRVSSTAVRDALASGNLDLAADFLGRPYSISGRVVDGIKLGKKLGFPTANIWLKHHHLPLSGIFVVEANWCNDSGHTRRIRGVASVGVRPTVFEHAQPLLEVHLFDFDEQIYGQHLRVDFLQKLRDEEKFPDMETLVKQIEQDVDRAKAYFSRTDAAMHQTICLDC

SEQ ID NO: 70515 - DNA, 963 bp, Wigglesworthia glossinidia endosymbiont of Glossina brevipalpis
  CDS (1)..(963): transl_table=11
atgaaatttaaacatattagaaatatatttaatttaaaaaaacaatatataaatggatgcgtaattacaattggaaattttgatggagtccatttaggacatcaaaaaataattagtaaattaaaaaatgaaagtttaaaacgtaatttgcctatgattgtcgttatttttgagcctcaaccaaaagaatttattaacaaaaattctccatcaaggataacaggtttgcgtgataaaataaaatacttcaaaaaaatgggaattaaacaagtattatgtatcaattttaataaaaattttttaatgttaaatgcaaaagattttataaaaaactttttaattaaatctttaaacatgaaatgcataattattggaaaagactttagatttggatataaagcatacggggatgttaaattattaaaaaatagtggaaaaaaattaggttttaacgtattagaagtaaaaactctagaaattgatagtgaaaaaattagcagtactgcaataagaaatgctcttaaaaataataaattagaaaaagcaataaaatttttaggtcatgaatattctatttctggtagagttgtttgtggaaaagctataggtagattaattggatttccaactataaatatatcttctaaaaatataaaatttcctattaatggagtatatgccgtagaagttaacggtattacaaaaaaaataatttatggaatagctaatataggaacaaggccaactttctttggattaaatcagaaagtagaagttcatttattaaataagtctggaaatttttattcttgtcacattgaaataataataagaaaaaaaataagagaagagaggttttttagatctacttttgatttaaaaaatcagatattatatgatattaataaagtaaatgattattttgtttatttaaaaaataaaaggaaattttttgatgaatga

SEQ ID NO: 70516 - protein, 320 aa, Wigglesworthia glossinidia endosymbiont of Glossina brevipalpis
MKFKHIRNIFNLKKQYINGCVITIGNFDGVHLGHQKIISKLKNESLKRNLPMIVVIFEPQPKEFINKNSPSRITGLRDKIKYFKKMGIKQVLCINFNKNFLMLNAKDFIKNFLIKSLNMKCIIIGKDFRFGYKAYGDVKLLKNSGKKLGFNVLEVKTLEIDSEKISSTAIRNALKNNKLEKAIKFLGHEYSISGRVVCGKAIGRLIGFPTINISSKNIKFPINGVYAVEVNGITKKIIYGIANIGTRPTFFGLNQKVEVHLLNKSGNFYSCHIEIIIRKKIREERFFRSTFDLKNQILYDINKVNDYFVYLKNKRKFFDE

SEQ ID NO: 70517 - DNA, 981 bp, Haemophilus ducreyi 35000HP
  CDS (1)..(981): transl_table=11
atgcaattaatccgtggctttcacaatttagctaactatgatgcactaaaaaaaggttgtgtattaaccattggcaattttgatggtgtacacataggccatcaaaatattttagcccgtttatgcgatcaatcattagctatcggtttaccttcagtggttatgctatttgaacctcaaccgcgtgaattttttgctaaaaatagccaaaatcagaccgctagcgctctatccaacgctgtaccagcaaggctaatgcgtttacgcgataagctgaaatatttagctgaaatgggggttgattttgtactttgtgtcaatttcaatcaaaaatttgcgaaatattcggcggaagattttattactgaattattggtaaaaaaattgaaagttcgttatcttagtgttggcgatgattttcgttttggtattgaacgtcgcggtaattttgaaatgctacgaaatgcaggcttaacacatcgttttgcagttgaagaaagccacactcatcgctttgatacactcagaattagtagttcattaatccgacaagcgttacaacaaaatgacttagccttagtagaaaatttacttggtaaaccttattcaatccgtggacgtgttgctcacggcaataaactcggtagaacaattggcttcccaaccgcaaacattatgctgaatcggttagtaacgccgattcaaggcgtgttcattgtagaagttcaaaccatttacgggcgcttcaatggcattgctaatgtaggaaatagaccaaccattaacggcacaaaaccgttattagaagtacatatttttgactttaataacgctatttatcatcaaatcattgaagtgatttttataaaaaaaatccgtgatgaactaaaatttgctagttttaccttactaaaagagcagattgaaaaagattgtcaacaagcggttgaattttttaatcaattacccaagacaaaataa

SEQ ID NO: 70518 - protein, 326 aa, Haemophilus ducreyi 35000HP
MQLIRGFHNLANYDALKKGCVLTIGNFDGVHIGHQNILARLCDQSLAIGLPSVVMLFEPQPREFFAKNSQNQTASALSNAVPARLMRLRDKLKYLAEMGVDFVLCVNFNQKFAKYSAEDFITELLVKKLKVRYLSVGDDFRFGIERRGNFEMLRNAGLTHRFAVEESHTHRFDTLRISSSLIRQALQQNDLALVENLLGKPYSIRGRVAHGNKLGRTIGFPTANIMLNRLVTPIQGVFIVEVQTIYGRFNGIANVGNRPTINGTKPLLEVHIFDFNNAIYHQIIEVIFIKKIRDELKFASFTLLKEQIEKDCQQAVEFFNQLPKTK

SEQ ID NO: 70519 - DNA, 936 bp, Candidatus Blochmannia floridanus
  CDS (1)..(936): transl_table=11
atggagcttatccgaggattacataatatcaagtctcatcatagaggttgtctattggctattggtaattttgatggatttcatcgaggtcatcaagcattaatttcccaattgaataaaaagaaaatcaattataaaagacctgttatggtgatgatttttgaaccacagcctaaagaatatttttctaaaatcattactattagattaactagattccgagataaggttcaatatttatttactgctggagtagatatagttttatgtgtaggatttaataaaaaactcgcttctattaaagcatataattttgttaaagaaattcttatatataaattaggagtacgatgtgtctgtgtgggtaatgattttagatttggagcgtttaggcacggcgattataattttttaaaaactttaggaaaacataaaggatttaaagttatatgtgctgatacttgtttagattcttatggaaaaaaaataagtagcactttagtcaagacagctttaatagaaaatagaattgtagatgctgaatttttaatggggcattcttattgtatttctggaaaggtaatacatggtaatgaattgggacgtatcattgggtttcctacagctaatatttcattaaaaggaaaaaatttacctgtgcatggtgtatatgcagtaaaagtatatggtattcttcattttccattaccagggatagctaatattggaactcgacccactattaatggagttactcaacatcaattagaagttcatatattaaatatatctactaacttatattcttattatattacagtagttattcttgataaaatacgtaatgaacagtgttttaattctatacataaattacaacgtcaaattaaatatgatatagatcaagttaataattattttaaaaaattgtcttaa

SEQ ID NO: 70520 - protein, 311 aa, Candidatus Blochmannia floridanus
MELIRGLHNIKSHHRGCLLAIGNFDGFHRGHQALISQLNKKKINYKRPVMVMIFEPQPKEYFSKIITIRLTRFRDKVQYLFTAGVDIVLCVGFNKKLASIKAYNFVKEILIYKLGVRCVCVGNDFRFGAFRHGDYNFLKTLGKHKGFKVICADTCLDSYGKKISSTLVKTALIENRIVDAEFLMGHSYCISGKVIHGNELGRIIGFPTANISLKGKNLPVHGVYAVKVYGILHFPLPGIANIGTRPTINGVTQHQLEVHILNISTNLYSYYITVVILDKIRNEQCFNSIHKLQRQIKYDIDQVNNYFKKLS

SEQ ID NO: 70521 - DNA, 966 bp, Bordetella pertussis Tohama I
  CDS (1)..(966): transl_table=11
gtgaaaccatcgctgcgcatctaccgctacccgcccccgccctcgcaacgcacgccgtgcgccctgacgatcggcaatttcgacggcgtccatctcggccatcaggccatcctggcgcgcgtgcgccaggaggcccgcgcgcgcggcctggtgcccgccgtcatgaccttcgagccgcacccgcgcgagtacttcgccaccctgaaccgccgccccgaactggcgcccacccgcatttccgggctgcgcgacaagctgcaggcgctggcggccgccggcatcgaacaggtcgtggtcgagcgcttcgacgcccggctggccgaaatgtcggccaacgccttcatcgaagacctgctggtggccggcctgcagacccgctggctgctggtcggcgaggatttccgctatggccacaagcgcagcggcgacatcgacctgctgcgcgaagcgggcctgacgcacggtttcgaagtctgtaccctggccgacatcaccgaccgccagggccaccgcatttccagctccgaggtgcgcaccgccctggcggtgggcgacctggaccgcgccgcgcaactgctgggccagccgttccatatcagcggccatgtcatccatggccagaaactgggccgcgaactgggcttcccgaccatgaacctgcgggtggcgccgcgctgcgccacccgctcgggcatttacgtggtgcgcgtgctcggcctgcaggaccggcccttgccggcggtggccagcctgggcgtgcgtccgacggtcgaagaccgcggccgggtgctgctcgaagcccacctgctcgacgagagcctcgacgcatacggtaaactcgtgcgagtcgagttcctgcacaagctgcgggacgaagaaaaattcgccgatctcccctccctgactgccgccatcgcccaagacgcgcaaaacgcgcgcgcctattttgccgttcatggactataa

SEQ ID NO: 70522 - protein, 321 aa, Bordetella pertussis Tohama I
MKPSLRIYRYPPPPSQRTPCALTIGNFDGVHLGHQAILARVRQEARARGLVPAVMTFEPHPREYFATLNRRPELAPTRISGLRDKLQALAAAGIEQVVVERFDARLAEMSANAFIEDLLVAGLQTRWLLVGEDFRYGHKRSGDIDLLREAGLTHGFEVCTLADITDRQGHRISSSEVRTALAVGDLDRAAQLLGQPFHISGHVIHGQKLGRELGFPTMNLRVAPRCATRSGIYVVRVLGLQDRPLPAVASLGVRPTVEDRGRVLLEAHLLDESLDAYGKLVRVEFLHKLRDEEKFADLPSLTAAIAQDAQNARAYFAVHGL

SEQ ID NO: 70523 - DNA, 966 bp, Bordetella bronchiseptica RB50
  CDS (1)..(966): transl_table=11
gtgaaaccatcgctgcgcatctaccgctacccgcccccgccctcgcaacgcacgccgtgcgccctgacgatcggcaatttcgacggcgtccacctcggccatcaggccatcctggcgcgcgtgcgccaggaggcccgcgcgcgcggcctcgtgcccgccgtcatgaccttcgagccgcacccgcgcgaatacttcgccaccctgaaccgccgccccgaactggcgcccacccgcatttccggactgcgcgacaagctgcaggcgctggcagccgccggcatcgaacaggtcgcggtcgagcgcttcgacgcccggctggccgaaatgtcggccaacgccttcatcgaagacctgctggtggccggcctgcagacccgctggctgctggtcggcgaggatttccgctatggccacaagcgcagcggcgacatcgacctgctgcgcgaggcaggcctggcgcacggtttcgaagtctgtaccctggccgacatcaccgaccgccagggccaccgcatttccagctccgaggtacgcaccgccctggcggtgggcgacctggaccgcgccgcgcagctgctgggccagccgttccatatcagcggccatgtgatccatggccggaaactgggccgcgaactgggtttcccgaccatgaacctgcgggtggcgccgcgctgcgccacccgctcgggtatttacgtggtgcgcgtgctcggcctgcaggaccggcccttgccggcggtggccagcctgggcgtgcgtccgacggtcgaagaccgcggccgggtgctgctcgaagcccacctgctcgacgagagcctcgacgcatacggtaaactcgtgcgagtcgagttcctgcacaagctgcgggacgaagaaaaattcgccgatctcccctccctgactgccgccatcgcccaagacgcgcaaaacgcgcgcgcctattttgccgttcatggactataa

SEQ ID NO: 70524 - protein, 321 aa, Bordetella bronchiseptica RB50
MKPSLRIYRYPPPPSQRTPCALTIGNFDGVHLGHQAILARVRQEARARGLVPAVMTFEPHPREYFATLNRRPELAPTRISGLRDKLQALAAAGIEQVAVERFDARLAEMSANAFIEDLLVAGLQTRWLLVGEDFRYGHKRSGDIDLLREAGLAHGFEVCTLADITDRQGHRISSSEVRTALAVGDLDRAAQLLGQPFHISGHVIHGRKLGRELGFPTMNLRVAPRCATRSGIYVVRVLGLQDRPLPAVASLGVRPTVEDRGRVLLEAHLLDESLDAYGKLVRVEFLHKLRDEEKFADLPSLTAAIAQDAQNARAYFAVHGL

SEQ ID NO: 70525 - DNA, 936 bp, Chromobacterium violaceum ATCC 12472
  CDS (1)..(936): transl_table=11
atgcaggtatttctgggggacccgcgccgtttcggcctgcctggatgcgcgttgaccatcggcaatttcgatggcgtgcatcagggccaccggcgcatgctggagcgtctgcgcgcggaggcgcgcgcccgcgagctgccgacagccttgctgaccttcgaaccgcacccgcgcgagtttttcgtccgcgccaatccgccggcgcgtttgtcgaccttgcgcgacaagttctccttgctggaagagctggggctggttgattatgtgtttgtctaccgcttcaaccacagcttttccaatatgccggcaagggatttcgtcgatcaggtgctggtgacggagttgaacacccgctatctgctgatcggcgacgatttccagttcggctccggacggaagggcgatttcgagctgctggcttcctgtccgcgtttcgccacggaggcgatgccgtcggtgctggtcaaaggcgagcgcgcttccagcacgctggtgcgcgagcgattgggcgcgggcgatctggactcggccaatgccttgctgggcggcgtgtaccggatatcgggcaaggtgatgcatggcaagaagttgggacgcacgataggctttcccaccgccaacatccatttgccgcatttgaaaccggcgctgcagggcgtattcgtggtggaggtcgatactccgggcggccgcctgggcggcgtggccagcctgggattgaatccgacggtcagcgacacgccggattacaagctggaagtgcacctgttcgatttctcgggcgatctgtacggccagcggctgacagtgcgtttcctgaaaaagttgcgcgatgaagcgcgctatgatgatttggcgacgctggtggcgcagatcgaacgcgacgcggccagcgccaagacctatttgacaagtttgcagcgagagcaggcatga

SEQ ID NO: 70526 - protein, 311 aa, Chromobacterium violaceum ATCC 12472
MQVFLGDPRRFGLPGCALTIGNFDGVHQGHRRMLERLRAEARARELPTALLTFEPHPREFFVRANPPARLSTLRDKFSLLEELGLVDYVFVYRFNHSFSNMPARDFVDQVLVTELNTRYLLIGDDFQFGSGRKGDFELLASCPRFATEAMPSVLVKGERASSTLVRERLGAGDLDSANALLGGVYRISGKVMHGKKLGRTIGFPTANIHLPHLKPALQGVFVVEVDTPGGRLGGVASLGLNPTVSDTPDYKLEVHLFDFSGDLYGQRLTVRFLKKLRDEARYDDLATLVAQIERDAASAKTYLTSLQREQA

SEQ ID NO: 70527 - DNA, 945 bp, Photorhabdus luminescens subsp. laumondii TTO1
  CDS (1)..(945): transl_table=11
atggagctaattcgcggtatacgtaatatccggacatgtcaccgcggttgcgtgttgacgattggtaattttgatggtgtccacagaggtcatcaggcactactgaaacacttaaaacacgaagggcagcgtctgggattaccagtaatggtcatgatttttgagccacaacctttggagttttttgctaagggtcatgcgcctgcgcgtctgacgagattgagggataaagccaaatatctcgcccaatgtggagtggattatttattatgtgtgaaatttgatagaaattttgcggcaaatacgccagaagcctttgtttcacggttgctggtggaaaaattgggtgttaagtttctcgctgtaggagacgactttcgttttggtcaatctcgcagtggtgattttgcctttttgcagcgagccggtgagtcatacggctttgatgtgaccagcagtgaaagtttttgtgatgatggtttacggattagcagtacagctatccgtcaagcactgcaaaatgatgatttggtattagccgaaacattattgggacatccatacagcatttgtggtcgggtcgttcatggtaagcgactagggagcactattggttttccaacagcaaatttgccgttaaaacgattagtggttccggtacacggcgtttatgttgttgaagtttatggtttaggagaccagcctttaccgggtgttgccaatattggtacacgtccaacagtctctggtcagggtcaacaacttgaagtacatctaattgatacccaaatggatctctatgggcgttatattgatgtggtgttacgtaaaaaattgcgtaatgaacagcggtttgcttcccttgatgcactcaagcagcaaattgcgaatgatttggttgctgcgaaggaattttttaagcagctacctgtgtcatgtatctag

SEQ ID NO: 70528 - protein, 314 aa, Photorhabdus luminescens subsp. laumondii TTO1
MELIRGIRNIRTCHRGCVLTIGNFDGVHRGHQALLKHLKHEGQRLGLPVMVMIFEPQPLEFFAKGHAPARLTRLRDKAKYLAQCGVDYLLCVKFDRNFAANTPEAFVSRLLVEKLGVKFLAVGDDFRFGQSRSGDFAFLQRAGESYGFDVTSSESFCDDGLRISSTAIRQALQNDDLVLAETLLGHPYSICGRVVHGKRLGSTIGFPTANLPLKRLVVPVHGVYVVEVYGLGDQPLPGVANIGTRPTVSGQGQQLEVHLIDTQMDLYGRYIDVVLRKKLRNEQRFASLDALKQQIANDLVAAKEFFKQLPVSCI

SEQ ID NO: 70529 - DNA, 981 bp, Vibrio vulnificus YJ016
  CDS (1)..(981): transl_table=11
ttgacactgcataaaacgaaaacagaggcatttcgctgtatccaaatggaactgatacgaggtatacacaatataaaaccacagcatcgcggctgtgtattgaccataggtaactttgatggtgtgcatttagggcaccaagaagtgttgcgtcaagtctctctgcgagctagggaaatgtcgctaccttctgtcgtgatgacatttgaacctcagcctttagagctgtttgccaaagagaaagcccctgcgcgcttaacgcgtttacgcgataagtttgtccaattgggtaagcttgagatcgaccgattgttgtgcgtcaactttaatcgtcatttcgcttccttagatgcggatgcctttattcgcgacttgttggttgagcgtttgggtgttaagtttctcgttgttggcgatgacttttgttttggtaaagcaagacaaggcaattttgccatgctgcaagaagcgggcaaaaaatacggtttcaccgtagtgaatacccaaagcttctgtttagcgcagttaagagtcagtagtaccgccattcgtgaagcgcttgctcacgatcagctagcggttgccgctcaaatgttagggcgagattacagcattagcggacgtgtttcacatggccgtaaattaggcaggacgataggttttcctaccgccaatattccgctaaaacgctgtgtttctcccgtctctggcgtgtatgtcgttcaagcgttaggcttggataacaaaccgattggtggtgtggccaacattggccaaagaccgacggttaacggcgttcgtcagcagttagaggtacatttattcgactttcaagccaacttgtatggcaagcagttagaagtggtacttttgcataaactgcgtgatgaaaagaagtttgagtcttttgatgcactcaaacagcaaattgaattggatgctgaggcagcaagggtgtggctgcgtcagctaaagcgttga

SEQ ID NO: 70530 - protein, 326 aa, Vibrio vulnificus YJ016
MTLHKTKTEAFRCIQMELIRGIHNIKPQHRGCVLTIGNFDGVHLGHQEVLRQVSLRAREMSLPSVVMTFEPQPLELFAKEKAPARLTRLRDKFVQLGKLEIDRLLCVNFNRHFASLDADAFIRDLLVERLGVKFLVVGDDFCFGKARQGNFAMLQEAGKKYGFTVVNTQSFCLAQLRVSSTAIREALAHDQLAVAAQMLGRDYSISGRVSHGRKLGRTIGFPTANIPLKRCVSPVSGVYVVQALGLDNKPIGGVANIGQRPTVNGVRQQLEVHLFDFQANLYGKQLEVVLLHKLRDEKKFESFDALKQQIELDAEAARVWLRQLKR

SEQ ID NO: 70531 - DNA, 1002 bp, Acinetobacter sp. ADP1
  CDS (1)..(1002): transl_table=11
atgaaactgctccgtcttaatgcgttatcgccagattttgagttagctgccactgcggtcacgattggcaattttgatggcgtccatcttggacatcaggccatgattagtcagcttaaaaatattgcagatgcgaacagcctgaaaacgttagtgatgatttttgagcctcagccgcttgaatacttcaagggttatgaagcaccgccacgcatcagttcactcagagaaaaagtcgaatacttgactgaattgggcgtcgattatattgcgattgcaaaatttgatcattatttccgtggactcagtgcccaagaatttgcagacctactcaaatttaagctgaatgccaaacagcttgtactgggtgacgattttcattttggtaaaaatcgtcagggaaatagtgaatttttacgggattatggctttaaaatcaccaaccttgacaccatagagttcaaaggagaacgtgtcagttccacccgtattcgtcaggttctggcagagggtgatctggcattggcagccaagttacttggacgtccatatagtatgattggtcgtgtgcaatatggtgaccaaattggtcgtacactcaattttccaaccatcaatgtccgtttaggccggcataaaccgtgtctgagtggtatttatggtgtagatgtcgtctgtgaaacaacgtctttacgcaagaagatcatgcatgatccgaatgcacctaaaggtattgcaggctacgacccagacagcttatatggtgcgggtcatgttggaactcgtcctgccatcaaacaggcgcatcccgaatggcgattggaagtacattttccagaagtttctgctaatctgtatggcctattaatgcgggtgacgtttttacactatttacatggtgagcgaaactatccttcgctagacgcgctgaaagctgggattgaccaagatgttgaggatttgctcgaatttcgtaagcaaaatacccaacgccctttttaa

SEQ ID NO: 70532 - protein, 333 aa, Acinetobacter sp. ADP1
MKLLRLNALSPDFELAATAVTIGNFDGVHLGHQAMISQLKNIADANSLKTLVMIFEPQPLEYFKGYEAPPRISSLREKVEYLTELGVDYIAIAKFDHYFRGLSAQEFADLLKFKLNAKQLVLGDDFHFGKNRQGNSEFLRDYGFKITNLDTIEFKGERVSSTRIRQVLAEGDLALAAKLLGRPYSMIGRVQYGDQIGRTLNFPTINVRLGRHKPCLSGIYGVDVVCETTSLRKKIMHDPNAPKGIAGYDPDSLYGAGHVGTRPAIKQAHPEWRLEVHFPEVSANLYGLLMRVTFLHYLHGERNYPSLDALKAGIDQDVEDLLEFRKQNTQRPF

SEQ ID NO: 70533 - DNA, 942 bp, Erwinia carotovora subsp. atroseptica SCRI1043
  CDS (1)..(942): transl_table=11
atgcagctaattcgcggtatacacaatcttcgagcacaccattatggctgtgtgctcactattggtaattttgacggcgtgcaccttggacaccaaatgctgcttgaacgactgaagcaggaaggtcgtgctcgtgggttgccggtgatggtcatgatttttgaaccacagccgctggaactctttgctgcggaaaaagcgcccgcacgtttgacgcgtttgcgtgacaaggtgaaatacctggcgcaggctggtgtggactatctgctgtgcgtcaggttcgacgcgcgttttgccgccaatgatgcagagacgttcgtttcttctctgctggcgaagaaattgggcgtgaagtttctggttgtcggggatgacttccgcttcggcgctggtcgtcagggagatttcctgttattacagaaggctgggcgtgagtcggggtttgatgtcattagtaccgattcgttctgtaatggcggtaagcgggtcagcagcactgcagtacgtgaagcgctcagtcgtgatgagcttgaactagcagaaagcctgctgggccatccttactgcatttccggacgcgtggaacatggcaaagaattggggcgaaccattgggttccctaccgccaatttaccgctgaaacgtcaggtttcccctgtcagcggcgtgtatgccgtcagcgtttatgggctggggcaagaaccgctgccgggtgtcgccaatattggtacgcgtccaaccgtaaacggtgacaaacgccagcagcttgaagtgcatttgctggacgtgacgatagatctctatggtcgtcatattgaagtcgtactgcgtaaaaaaatccgtaatgaacagcgttttgcttcgctcgatgcgttaaaacagcaaatcgccgatgatgtggtgacagcccggacgttcttcgggttaaagacaccggtttaa

SEQ ID NO: 70534 - protein, 313 aa, Erwinia carotovora subsp. atroseptica SCRI1043
MQLIRGIHNLRAHHYGCVLTIGNFDGVHLGHQMLLERLKQEGRARGLPVMVMIFEPQPLELFAAEKAPARLTRLRDKVKYLAQAGVDYLLCVRFDARFAANDAETFVSSLLAKKLGVKFLVVGDDFRFGAGRQGDFLLLQKAGRESGFDVISTDSFCNGGKRVSSTAVREALSRDELELAESLLGHPYCISGRVEHGKELGRTIGFPTANLPLKRQVSPVSGVYAVSVYGLGQEPLPGVANIGTRPTVNGDKRQQLEVHLLDVTIDLYGRHIEVVLRKKIRNEQRFASLDALKQQIADDVVTARTFFGLKTPV

SEQ ID NO: 70535 - DNA, 945 bp, Mannheimia succiniciproducens MBEL55E
  CDS (1)..(945): transl_table=11
atgcagcttattcgcggtttacacaacttgcggcgggatttcgccggttgtgcgctcactatcggtaattttgacggtgtacatttaggacaccaggcgattttgcagcatttgcgtgaaaaagccaatcaattaaagttgccgatggtggtgatgctgttcgaacctcagccgagagagtatttcgtgtctgccgatgcaaagcaacaggctccggctcgtttaatgcgtttacgggataaattgcattatcttcaacaacagggtgtggattacgtaatttgcgtaaaatttgaccgcacttttgccaagcaagatcctaatctgtttatcgaaacttatttagtcaatcggcttcatgtgaagtttttaagtattggtgacgatttccgtttcggcgctaatcgccgaggggatttttctttgcttgaaagtgcgggtaaaaaatacggattttccgtggaagacaaccgcacattttcactggataaactgcgtatcagcagtaccgcaatccgtcatgcgctggcgcatgacgatctcaaaaaagcggaagaactgcttgggcgcgcttacagcattttcggcaaagttgtgcacgggcagaaattaggcagaaccataggttttcctaccgccaatattcgtttgcaacggcaggtaaatccgttgcaaggcgtgtatgccgtacgtattcaatgtccttgcggacgggcttttcaaggggttgccaatatcgggcagcgccctacggtgaacggcgtagagcagcgtttagaagttcatctgtttgattttgatgaaaatctttacgggcaaaatattgccgtgactttttgtcataaaatccgtaatgaaatgaaatttccgtcacttaacgctctgaaacaacaaatcgcccgggatgtattagtggcgcaacagtattttcggcaaaacagttga

SEQ ID NO: 70536 - protein, 314 aa, Mannheimia succiniciproducens MBEL55E
MQLIRGLHNLRRDFAGCALTIGNFDGVHLGHQAILQHLREKANQLKLPMVVMLFEPQPREYFVSADAKQQAPARLMRLRDKLHYLQQQGVDYVICVKFDRTFAKQDPNLFIETYLVNRLHVKFLSIGDDFRFGANRRGDFSLLESAGKKYGFSVEDNRTFSLDKLRISSTAIRHALAHDDLKKAEELLGRAYSIFGKVVHGQKLGRTIGFPTANIRLQRQVNPLQGVYAVRIQCPCGRAFQGVANIGQRPTVNGVEQRLEVHLFDFDENLYGQNIAVTFCHKIRNEMKFPSLNALKQQIARDVLVAQQYFRQNS

SEQ ID NO: 70537 - DNA, 987 bp, Legionella pneumophila subsp. pneumophila str. Philadelphia 1
  CDS (1)..(987): transl_table=11
atgaaattgttacgcggttctactcattttgctatatttgataagggtgcagttgccactattggcaattttgatggcgtgcatttagggcatcagcatttgattaagaccctaagagcaaaggctgatgaaatgaacttgcctttagttattttattgtttgagcctcagcctaaagagtattttcacagagagaaagcaccagcacgactttctaccttgagagaaaaaatagatgtcttaaacttatgtcaggtggattacatctattgcatcaagtttgatgcaaggctggctcaaactcccgctttgtattttgctcagttttatttatttgaagcattgaaaatacgctaccttctggttggccaggattttcgttttggcaaaagcagagaaggtgatgttaatttactcaaaacactaggtgctaattattcctgtgaagtgacagtgcaatctgattttcttatagaaaatgaaaaaatcagttcgacgagaatcagagaagccttgcaacagggaaatttacgtttcgcagccaagttgttgggaagaccatacagcatgtgtggacgtgttatcaaaggggatggtcgtggtcgtcaatgggggataccgacagccaatttaggcatgcatcgtttatcgatccctttgcaaggtgtatatgctgtacaagtccatattaattcgaatgttttttatggggttgcaaatattggaaagcggccaactgtagctggaaccaaaaatattttggaggtccatttatttgattttcacggatctctgtatggtcagctagtgcaggtaattttcttgcacaaacttcgagatgaagttaaattctcaagtgtggaagcgttaattacgcagattaatagtgacatcatattggcaaaggcctatttaaaacagaattggcttgatagtgtgattgattcatcgaatgatgttgcgaatggaatcaataataccgtttaa

SEQ ID NO: 70538 - protein, 328 aa, Legionella pneumophila subsp. pneumophila str. Philadelphia 1
MKLLRGSTHFAIFDKGAVATIGNFDGVHLGHQHLIKTLRAKADEMNLPLVILLFEPQPKEYFHREKAPARLSTLREKIDVLNLCQVDYIYCIKFDARLAQTPALYFAQFYLFEALKIRYLLVGQDFRFGKSREGDVNLLKTLGANYSCEVTVQSDFLIENEKISSTRIREALQQGNLRFAAKLLGRPYSMCGRVIKGDGRGRQWGIPTANLGMHRLSIPLQGVYAVQVHINSNVFYGVANIGKRPTVAGTKNILEVHLFDFHGSLYGQLVQVIFLHKLRDEVKFSSVEALITQINSDIILAKAYLKQNWLDSVIDSSNDVANGINNTV

SEQ ID NO: 70539 - DNA, 993 bp, Burkholderia mallei ATCC 23344
  CDS (1)..(993): transl_table=11
gtgaaagtcttccgcggcctgcccaacgccgagagccgcgccccgtgcgcgttgacgatcggcaacttcgacggtgtccatcgcggccaccaggccctgctcgcgcgcgtgcgcgcggcggcggacgcgcgcgggctgcccgtgtgcgtgatgacgttcgagccgcatccgcgcgaattcttcaatccggcgagcgcgccgccgcgcatcgcgatgctgcgcgacaagctcgaggcgctgcgcgagcacggcgtcgaccgcgtggtcgtcgagcacttcaaccatacgttcgcgagccagtcgcccgaggcgttcgtcgaacgcacgctcgtccatgggctgcacacccgctggatcatggtcggcgacgacttctgctacggcgcgaggcgcgcgggcgatttcgcgtcgctgaaggcggcgggcgagcgcttcggcttcgaggtcgagcagatggaaacgctcgccgacgccgatggcgcgcgcatttcgagctccggcgtgcgcgccgcgctcgcggcgggagatctcgacgccgccgcgcgcgcgctcggccacggctatgcgatcagcggccacgtcgcgcacgggctgaagctcggccgcgacctcggcttcccgacgctgaacctgccgatcgcgcacaagcgcccggccctgtcgggcatcttcgtcgtgcgcgtgcacggcctcgcgcccgagccgctgccgggcgtcgcgagcctcggcgtgcggccgaccgtcgacgattccggccgcgtgctgctcgaagtgcacctgctcgactggcacggcgatgcatacggcaagctcgttcgcgtcgaattcctgaagaagctgcgcgacgaggcgaaattcgtcgatctcgaaacgctctcgcgcgcgatcgcgcaggacgtcgtcgacacgcgcgcgtacttcgccgagcacggtcgcgcgccgggcagccgcgcgaccggcttcgcgacgtcggccaccgaccgaattagctga

SEQ ID NO: 70540 - protein, 330 aa, Burkholderia mallei ATCC 23344
MKVFRGLPNAESRAPCALTIGNFDGVHRGHQALLARVRAAADARGLPVCVMTFEPHPREFFNPASAPPRIAMLRDKLEALREHGVDRVVVEHFNHTFASQSPEAFVERTLVHGLHTRWIMVGDDFCYGARRAGDFASLKAAGERFGFEVEQMETLADADGARISSSGVRAALAAGDLDAAARALGHGYAISGHVAHGLKLGRDLGFPTLNLPIAHKRPALSGIFVVRVHGLAPEPLPGVASLGVRPTVDDSGRVLLEVHLLDWHGDAYGKLVRVEFLKKLRDEAKFVDLETLSRAIAQDVVDTRAYFAEHGRAPGSRATGFATSATDRIS

SEQ ID NO: 70541 - DNA, 930 bp, Methylococcus capsulatus str. Bath
  CDS (1)..(930): transl_table=11
atgcgcgtcattcatggcctctccggtacgatatgccctcccgcctgcgtcgccagcatcggcaacttcgacggtgtccacctaggacatcagaccttggtccggcggctgaccgaacaaggacatcgtctcggcctgccggttgccctcgttctgttcgaaccgcagccacgtgaattcttcgaccaggatcagtcccctccccgtttgatgcggctgtcggagaaactgaccagactcgccgagctgccggtcgactgggtactgctgctgcgtttcgacgagaaactcgccactctggcgccggctgacttcgtccgtcggatactggccgaacgcctgcacgtccggcatctcatcgtcggcgacgacttccgttttggccggggccgcagcggagactatgaactgctgtgccggctcgggcggctccacggcttcgcggtgagcgacaccgaatcggtgacggtgggtggcatccgcgtcagcagcacacgggtacgggaggcgctcggacgaggcgacatggccggcgcggcgaccctgctgggccgcccctatgccctgcgcggacgcgtggtccacggtgaccagctcggccgtcggctgggctttcccaccgccaacatcgagctggggcgtgaaaacattccggtgcaaggcgtatttgccgttacaatgtcgggcatttcagccgaaccctggcctggcgtggccaacatcggcatccggccaaccgtcggcggccaccgcaaggccatgctggaaacccatttgttcgatttcgccggcgacctgtacgggcgccgggtggaaatccatctgcactacaaacttcgcgacgagatgcggttcgccaacctcgaagaactgaaggaacagatcgcctgcgatgcggctgccgcgcgcagccatttcgcggcaggctga

SEQ ID NO: 70542 - protein, 309 aa, Methylococcus capsulatus str. Bath
MRVIHGLSGTICPPACVASIGNFDGVHLGHQTLVRRLTEQGHRLGLPVALVLFEPQPREFFDQDQSPPRLMRLSEKLTRLAELPVDWVLLLRFDEKLATLAPADFVRRILAERLHVRHLIVGDDFRFGRGRSGDYELLCRLGRLHGFAVSDTESVTVGGIRVSSTRVREALGRGDMAGAATLLGRPYALRGRVVHGDQLGRRLGFPTANIELGRENIPVQGVFAVTMSGISAEPWPGVANIGIRPTVGGHRKAMLETHLFDFAGDLYGRRVEIHLHYKLRDEMRFANLEELKEQIACDAAAARSHFAAG

SEQ ID NO: 70543 - DNA, 939 bp, Azoarcus sp. EbN1
  CDS (1)..(939): transl_table=11
atgcaggtttttcgcgggattccggagcgcgccgcgcagtcctcggttctcaccatcggcaatttcgacggggtgcaccgcggccaccaggcgctgctcaagctgctcaccgacaaggcccgttcgctggccctgccggcggtggtgctcacgttcgaaccccatccgcgtgaatacttctgcccggccgatgcgccggcacgcctcgcgtcgctgcgcgaaaagctgctgctgctcgccagctgcggtgttgaccgcgtccacgtctgccgcttcgacgcgcgcttcgcagcgctgaccgcggaccagttcatcgacgacatcctcgtgcgcggcctcggcgtgcgccacttgatcatcggcgacgacttccgtttcggcgtgaagcgccagggcgacttcgcgttgctccaggcacggggcgccagccaccggttcgcggtcgaagcgatgccgaccctcgacatcgatggcgaacgcgcttccagctctgcgatccgcgcggcccttgccgaaggcgatctcgcgcatgccgcgcgcctgctcggccgtccctacagcatcgccgggcgtgtcgtccacggcgacaagatcggccgcacgctcggctatccgaccgtcaacatccagatgaaacaccggcggccggcgttgtccggcgtgttcgcggtcgctgtcgaaggactcgccgcggaacccgtcgcaggcgtcgcgagcattggcgtgcggccgacgataaccgcttcggggcgtccgaggctcgaagtccatctcttcgactggaaccgcgactgttacggcgctcatctgcgcgtccatttcctcaacaagcagcgcgacgaaaccaagttcgaatcgctcgacgcgctcatcgcccagattgcgcgggacgcggaaaatgcccacgcctggttcgcacaacacccgattcgcccctga

SEQ ID NO: 70544 - protein, 312 aa, Azoarcus sp. EbN1
MQVFRGIPERAAQSSVLTIGNFDGVHRGHQALLKLLTDKARSLALPAVVLTFEPHPREYFCPADAPARLASLREKLLLLASCGVDRVHVCRFDARFAALTADQFIDDILVRGLGVRHLIIGDDFRFGVKRQGDFALLQARGASHRFAVEAMPTLDIDGERASSSAIRAALAEGDLAHAARLLGRPYSIAGRVVHGDKIGRTLGYPTVNIQMKHRRPALSGVFAVAVEGLAAEPVAGVASIGVRPTITASGRPRLEVHLFDWNRDCYGAHLRVHFLNKQRDETKFESLDALIAQIARDAENAHAWFAQHPIRP

SEQ ID NO: 70545 - DNA, 960 bp, Neisseria gonorrhoeae FA 1090
  CDS (1)..(960): transl_table=11
atgtccgagtggcggggtttcaaccgaaaaggaaatacaatgaaaatcaggccggggcggcacaacgcgcccgactttccgcacggggccgccgtaaccataggcaatttcgacggcgtacacctcggacacaaacacatcctccaaaaactccgcctcgaagccgacgcacgcggattgcccgtcgtggccgtcgttttcgaaccccaacccaaagaatttttcgcactccgtaccggcaaaaccccgccctgccgtatcagccccctgcgtaccaaactggaattgctggaagggacgggttgcgtcgatgccgcctgggttttgcgtttcgatcggaatttttccgaaatatccgcgcaagcatttatcgaccgcctgctgcgtcaaaccttgaatacgcgctatttgctcgtcggcgatgatttccgtttcggggcggggcgggaaggctgttttgaacttttggcacaacagcccgatatgcagaccgagcgcacgccttctgtcattgtcgaagacatccgcaccagcagtaccgccgtccgccaagccctttcagacggcaaccttgcctatgcgaaaaaacttttggggcacgactacgttttggggggcagggtggtgcacggcagaaaactcgggcgcaccttaaacgccccgaccgccaacatccgactgcccggccaccgttatgcactcggcggcgtgttcgtcgtcgaggcggacggcgcattcggcacgcggcgcggcgtggcgagcttcggcttcaatcccaccgttgatggcggctgttctcaaaagctggaagtccatttgttcgactttcaaggcgatttgtacggacaacggttgaacgtccgcttcctgcacaaactgcgcgacgaggaaaagtttgacggtatggaagaactgaaaaggcggattgaagccgatatggaagccgcaaagtgttggtag

SEQ ID NO: 70546 - protein, 319 aa, Neisseria gonorrhoeae FA 1090
MSEWRGFNRKGNTMKIRPGRHNAPDFPHGAAVTIGNFDGVHLGHKHILQKLRLEADARGLPVVAVVFEPQPKEFFALRTGKTPPCRISPLRTKLELLEGTGCVDAAWVLRFDRNFSEISAQAFIDRLLRQTLNTRYLLVGDDFRFGAGREGCFELLAQQPDMQTERTPSVIVEDIRTSSTAVRQALSDGNLAYAKKLLGHDYVLGGRVVHGRKLGRTLNAPTANIRLPGHRYALGGVFVVEADGAFGTRRGVASFGFNPTVDGGCSQKLEVHLFDFQGDLYGQRLNVRFLHKLRDEEKFDGMEELKRRIEADMEAAKCW

SEQ ID NO: 70547 - DNA, 945 bp, Pseudomonas syringae pv. syringae B728a
  CDS (1)..(945): transl_table=11
atgagcaagaagtgcgttatgcagctggttagaggccttcacaacctgcgccccgaacatcggggctgcgtcgccacgattggcaatttcgacggcgttcatcgcggccaccaggctatcctggcgcgtctgcgcgagcgtgccgtcgaattgggtgtgcccagttgtgtggtgatcttcgagccgcagccgcgtgagttctttgcgcccgagacggcgccggcgcgtctggcccgtctgcgtgacaagcttgagctgctgagtgccgaaggcgttgaccgggtactgtgcctgtccttcaatcagcgtctgtgcaagctcagcgcggcaagttttgtcgagaccgtgctgatcgacggcctcggtgtccagcacctcgaagtgggcgacgattttcgtttcggcttcgaccgggtcggtgacttcgacttcctgcaacaggccggcacatcgtatggttttaccgtagaagcggcgcagaccgttgaaatagatggcatccgggtcagcagcaccaaggtgcgcaaggctctggctgcgtcagactttgccctggccgagcgtatgctcggtcgtccgttccagatagccgggcgggtattgcacggccagaagctggcgcgccagctgggtacgcccaccgccaacgtacaactcaagcgtcgtcgtgtaccgctgagcggggtctatctggtcagcacggacatcgatggcaaaacctggccgggggtcgccaacatcggtgtacgcccgacggtcaccggtgatggcagtgcccaccttgaagtgcatcttctggattttgccggcgatctttatgaccggcgtttgacggtggctttccaccacaagctgcgtgatgagcagcgtttcgcctcactggaggcgctcaagacggcgatcaatgcggacgtcgccgccgcccgtgcccattggcatggctaa

SEQ ID NO: 70548 - protein, 314 aa, Pseudomonas syringae pv. syringae B728a
MSKKCVMQLVRGLHNLRPEHRGCVATIGNFDGVHRGHQAILARLRERAVELGVPSCVVIFEPQPREFFAPETAPARLARLRDKLELLSAEGVDRVLCLSFNQRLCKLSAASFVETVLIDGLGVQHLEVGDDFRFGFDRVGDFDFLQQAGTSYGFTVEAAQTVEIDGIRVSSTKVRKALAASDFALAERMLGRPFQIAGRVLHGQKLARQLGTPTANVQLKRRRVPLSGVYLVSTDIDGKTWPGVANIGVRPTVTGDGSAHLEVHLLDFAGDLYDRRLTVAFHHKLRDEQRFASLEALKTAINADVAAARAHWHG

SEQ ID NO: 70549 - DNA, 939 bp, Haemophilus influenzae 86-028NP
  CDS (1)..(939): transl_table=11
atggataaggacatgcaattaattcgtgggcttcataatgcaaatcgtgttttacaaggttgtgcgctaacgatcggcaactttgatggtgtgcatttagggcatcaaaccgtcctccgccatttgcgccaaaaagctgacgaattaaatttacccatggcggtattgttatttgaatcacagccgcgtgaatattttatgggggaaaatgcacctgcacgtttaatgcgtttgcgtgacaaaatttattatctcgaaaaggctaaggtcgatgtcgtaattgtggcgaaatttgaccgcacttttgccgagcaaccagccgatgtttttattgaacaaacgcttgttaatcatctacatgtgaaatttttaagcattggcgatgatttcaaattcggctcaaaacgccaaggcaattttgccatgttgcaagcagctagtaagcgttttggttttattgttgaagataaccgtagtttttgtctagatgcacagcgaattagtagcactgcgattcgcgaagcgttagcgaatgatgatttacaacttgcagaaaatttactcggtaaaccttatcgtattttcgggcgtgtgattcatgggaataaattaggtagaacaataggatttccaacggcaaatattcgtttgcatagacaagtaaatccaatcaaaggcgtttatgccgtaaaagtgcggttaaaatcgggggagatttttaacggcgtggcaaacatgggaaaacgcccaactataaatggattaatgcaattattagaagtccatttatttgatttttctcagaatatttatggccaaatggtggaagtggaattctgccacaagattagaaacgagattaaattcccctcttttgatgatttgaaagtgcaaattgagaaagacgtagaaactgcgaaagcgttttttaacagttaa

SEQ ID NO: 70550 - protein, 312 aa, Haemophilus influenzae 86-028NP
MDKDMQLIRGLHNANRVLQGCALTIGNFDGVHLGHQTVLRHLRQKADELNLPMAVLLFESQPREYFMGENAPARLMRLRDKIYYLEKAKVDVVIVAKFDRTFAEQPADVFIEQTLVNHLHVKFLSIGDDFKFGSKRQGNFAMLQAASKRFGFIVEDNRSFCLDAQRISSTAIREALANDDLQLAENLLGKPYRIFGRVIHGNKLGRTIGFPTANIRLHRQVNPIKGVYAVKVRLKSGEIFNGVANMGKRPTINGLMQLLEVHLFDFSQNIYGQMVEVEFCHKIRNEIKFPSFDDLKVQIEKDVETAKAFFNS

SEQ ID NO: 70551 - DNA, 945 bp, Pseudomonas fluorescens Pf-5
  CDS (1)..(945): transl_table=11
atgcagctggttcgaggcctccacaatctgcgcccccagcatcggggctgcgtcgccactattggcaactttgacggtgttcaccgtggtcaccaggctatcctgggccggctgcgcgaacgtgcgctcgagttgggcgtgcccagctgcgtggtgattttcgagccccagccgcgggaattctttgcccccgagacggctccggcgcgtctggcccgcctgcgggacaagctgcagttgctggctgacgccggtgtcgaccgggtgctgtgcctggccttcaaccagcgcctgagcaaactcagcgccagcgagttcgtcgagcgaatcctggtggatggcctgggtgtacagcacctggaggtgggtgatgacttccgcttcggttgcgaccgggtcggtgattttgacttcctgcagcaggccggcgccacccacggctttaccgtggaggcggcgcagaccgtcgagctcgacggcctgcgggtgagtagtacccaggtccgcaatgccctggccgccgccgatttcgatctggccgagcgcctgctgggtcgcccgtaccgcattgccgggcgggtgttgcacggccagaaactggcgcgccagttgggtacgcccactgccaatgtgcagttgaagcgccgtcgcgtgccgctttccggggtgtacctggtgagcgtcgagctcgatggcaggacctggcccggcgtcgccaatatcggcgtgcggcccacggttgcaggtgatggcaaggcccacctggaagtacatcttttagattttgccggcgatctgtatgaccggcgtttgacggtggttttccaccacaagctgcgtgaagagcagcgtttcgcctccctggaggcgttgaagacggcgatcaatgcggatgttgccgccgcccgtgcccaagtggcacgtatccatagcgccaatcgctaa

SEQ ID NO: 70552 - protein, 314 aa, Pseudomonas fluorescens Pf-5
MQLVRGLHNLRPQHRGCVATIGNFDGVHRGHQAILGRLRERALELGVPSCVVIFEPQPREFFAPETAPARLARLRDKLQLLADAGVDRVLCLAFNQRLSKLSASEFVERILVDGLGVQHLEVGDDFRFGCDRVGDFDFLQQAGATHGFTVEAAQTVELDGLRVSSTQVRNALAAADFDLAERLLGRPYRIAGRVLHGQKLARQLGTPTANVQLKRRRVPLSGVYLVSVELDGRTWPGVANIGVRPTVAGDGKAHLEVHLLDFAGDLYDRRLTVVFHHKLREEQRFASLEALKTAINADVAAARAQVARIHSANR

SEQ ID NO: 70553 - DNA, 1044 bp, Psychrobacter arcticus 273-4
  CDS (1)..(1044): transl_table=11
atgaacacctattttcttgagcaactgatggcgtcttcagacgcttcgcctacccataccaacccagtagctttagcaccctgtgtgctgactattggcaatttcgatggcgtgcatttgggtcatcaagccatgctcgctcaagtgcgcgaacttgcaaaggctcgtaaacttaactctgccgttatgatatttgagccacagccaagagagttctttgcgccagcggctgctcctgcccgcttaaccaaccttgccgaaaagcaagctttgctagcagaatacggggttgagaccttgattgtggcaggttttgacaacgaatttcgctcattatcagcgcaggcatttgcagatatcttagcgaggcgactgaatgtgcaagccttggtattgggtgatgacttcaaatttggtcatgatcgtaccggtgacagtcagtttttgcgtgattatgggctacatgtgaccaatctgcacaccgtcaatgacgatagtcataaagcggcgcgcatcagctctactcgtatccgtgatttattgttggcaggtgacatcaacgctgccaacgctttattgggtcgagattatgccattactggtacggtcgttggcggtgataaaattggtcgcaccatggatttcccaaccgccaatattgacttagagcgcatgaaacctgctttacacggcatctttgcagtcgatgtcgtcagccttgatcaggatggcaatgttataccagacggtttatacaaacgtgcagataataaccataaaggtataacaggtttgcgagcacatagcctgtttggtactgccaatatcggcaccagaccttctgtcgacaaaacccatgagtggcgtttagaagtgcattttccagaactgcaagccgacttatatggttcaaccttgcaggtgcgttttttgcattacttgcatggtgaacgccattacgaaagtttggatgcgctaaaagaaggtattcatcatgatgtacaagaattgattgaatggcgcgcaaagcaaacggacggttaa

SEQ ID NO: 70554 - protein, 347 aa, Psychrobacter arcticus 273-4
MNTYFLEQLMASSDASPTHTNPVALAPCVLTIGNFDGVHLGHQAMLAQVRELAKARKLNSAVMIFEPQPREFFAPAAAPARLTNLAEKQALLAEYGVETLIVAGFDNEFRSLSAQAFADILARRLNVQALVLGDDFKFGHDRTGDSQFLRDYGLHVTNLHTVNDDSHKAARISSTRIRDLLLAGDINAANALLGRDYAITGTVVGGDKIGRTMDFPTANIDLERMKPALHGIFAVDVVSLDQDGNVIPDGLYKRADNNHKGITGLRAHSLFGTANIGTRPSVDKTHEWRLEVHFPELQADLYGSTLQVRFLHYLHGERHYESLDALKEGIHHDVQELIEWRAKQTDG

SEQ ID NO: 70555 - DNA, 921 bp, Colwellia psychrerythraea 34H
  CDS (1)..(921): transl_table=11
atgcagttagttcgcggaatacataatattcaattaaatgatcatagttgtgtgttaactattggtaattttgatggtgttcatttaggacatcagcaagtgattaaggcgttggtaagtaaagcgaaagctttgaattgtgtggctgcagtgttagtttttgaaccacaaccacaagagcttttttcaccagaaacagcacctgctagattatgccgtctacgcgataaatataatttattagcaaaacttggtgtgcagcgacttatttgtgtcaattttaccgctaaatttgctaatcaaagcgctaaacattttatagaaaatttgttggtagctaaattaggaataaagcatcttatcgtcggcgatgatttccattttggtaagaatcgaaccggtaacttttctatgttacgtcaagcaggagaaaagtttggcttcgatgtttcagataccgcaagttataaaatggcggattgccgcattagttcaaccgctattcgtcaagcattagaacaagatgatttagtgtcagttaaacagatgctaggcagagaatattcgataattggtcgcgtgttccatggtgacaagcgaggtcgacagttaggctttccaaccgctaatgtcttacttaaaaggcgtgtttctccccttagtggtgtttttgctgtgatggtaaaaacaaatgatggtgaatttaaaggggttgcaaatattggtgctaggccaacagttaacggcattaggcaacaattagaagtacatatttttgattttgatgaaaatctctatgggcaatgcattgaagtggtcgttaagagaaaactacgcccagtgattaagtttgacagccttgaagcgcttaccgcgcaaattcgtcaagacagtgaacaagcaaaacaagtattagcttaa

SEQ ID NO: 70556 - protein, 306 aa, Colwellia psychrerythraea 34H
MQLVRGIHNIQLNDHSCVLTIGNFDGVHLGHQQVIKALVSKAKALNCVAAVLVFEPQPQELFSPETAPARLCRLRDKYNLLAKLGVQRLICVNFTAKFANQSAKHFIENLLVAKLGIKHLIVGDDFHFGKNRTGNFSMLRQAGEKFGFDVSDTASYKMADCRISSTAIRQALEQDDLVSVKQMLGREYSIIGRVFHGDKRGRQLGFPTANVLLKRRVSPLSGVFAVMVKTNDGEFKGVANIGARPTVNGIRQQLEVHIFDFDENLYGQCIEVVVKRKLRPVIKFDSLEALTAQIRQDSEQAKQVLA

SEQ ID NO: 70557 - DNA, 1035 bp, Pseudomonas syringae pv. phaseolicola 1448A
  CDS (1)..(1035): transl_table=11
ttgttttctggggccacgccaagaaccttcatccggtcttggtgtgttgcctgtcgcccacggccgtgtgtggttataatcggccactttatgagcaagaagtgcgttatgcagctggttagaggccttcacaacctgcgccccgaacatcggggctgcgtcgccacgattggcaatttcgacggcgttcaccgcggccaccaggctatcctggcgcgtctgcgcgagcgtgccgtcgaattgggtgtgcccagctgtgtggtgattttcgagccgcagccgcgtgagttcttcgctcccgagaccgctccggcacgtctggcccgactgcgtgacaaactcgagctgctgagtgccgaaggcgttgaccgggtactttgcctgtccttcaatcagcgactgtgcaagctgagtgccgcgagtttcgtcgaaaccgtgctgatcgacggcctcggcgttcagcacctcgaagtgggcgacgattttcgcttcggttttgaccgggttggcgattttgacttcctgcaacaggccggcacgacgtatggatttactgtagaagcggcgcagaccgttgaaatagatggcatccgggtcagcagtaccaaggtacgcaaggccttggctgcgtcggattttgccctggccgaacgcatgcttggtcgtccgttccagatcactggacgggtattgcatggtcagaagctggcgcgtcaattgggtacgcccaccgccaatgtgcaactcaagcgtcgtcgtgtgccgttgagcggggtttacctggtcagcacggaaatcgatggcaaaacctggccgggggtcgccaacatcggtgtgcgcccgacggtagcgggtgatggcagtgcccaccttgaagtgcaccttctggattttgccggcgatctttacgaccggcgtttgacggtggctttccaccacaagctgcgtgatgagcagcgtttcgcctcactggaggcgctcaagacggcgatcaatgcggacgtcgccgccgcccgtgcccattggcatggctaa

SEQ ID NO: 70558 - protein, 344 aa, Pseudomonas syringae pv. phaseolicola 1448A
MFSGATPRTFIRSWCVACRPRPCVVIIGHFMSKKCVMQLVRGLHNLRPEHRGCVATIGNFDGVHRGHQAILARLRERAVELGVPSCVVIFEPQPREFFAPETAPARLARLRDKLELLSAEGVDRVLCLSFNQRLCKLSAASFVETVLIDGLGVQHLEVGDDFRFGFDRVGDFDFLQQAGTTYGFTVEAAQTVEIDGIRVSSTKVRKALAASDFALAERMLGRPFQITGRVLHGQKLARQLGTPTANVQLKRRRVPLSGVYLVSTEIDGKTWPGVANIGVRPTVAGDGSAHLEVHLLDFAGDLYDRRLTVAFHHKLRDEQRFASLEALKTAINADVAAARAHWHG

SEQ ID NO: 70559 - DNA, 921 bp, Dechloromonas aromatica RCB
  CDS (1)..(921): transl_table=11
atgcgcgtctttcgcggtcattcgcgtcccgttgtagcccccgtcgtgctcgccatcggaaatttcgatggggttcacctggggcatgccgcgttgatcaggcggctggccgaggtggcagaaaactgccagttggcacccatggtgctgaccttcgagccacatccgcgcgagttctttgcacctgaatcggcgccggcccgtctgagcaccttgcgcgaaaagctcgaattgctcggtgattccggtgtttcgcaggtcatgatctgccccttcaatggagcgttttccgccctttcggccgaagaattcatcgagcaggtgctggtgcgcggctgccaggttcggcatttgatcatcggcgacgattttcgttttggacgaggacgtactggcgatttcgccttgctgcaagaagcggggcagcgtttcggcttcaccgttgaagccatgggcagcgtaacggttgccggtgagcgggtgtccagttcggctgtgcgcaaggcgctggccatcggcgacatggagcatgcggccctgttgctggggcgcccttacatcatcgacggtcaggtatcgcatggccaaaagctggggcgtcaactcggcttcgccacagccaacctgcgcatcaagcacaacccacttccgatgagcggcgtcttcgcagtcgaagtcagcgggctgggtgagcaagcgttgcccggcgtggccaatcttggcatccggccaacggtgggcggcacgcgccccttgctagaagtgcatctgttcgatttcgatcgcgacatctacggcgcccatatttcggttcgttttgtgcataaactgcgcaacgagcaacggtttcccaattttgatgccctcaaggcgcagatcgcggcagacgccgcggccgcccgggccttcttctcgctgtga

SEQ ID NO: 70560 - protein, 306 aa, Dechloromonas aromatica RCB
MRVFRGHSRPVVAPVVLAIGNFDGVHLGHAALIRRLAEVAENCQLAPMVLTFEPHPREFFAPESAPARLSTLREKLELLGDSGVSQVMICPFNGAFSALSAEEFIEQVLVRGCQVRHLIIGDDFRFGRGRTGDFALLQEAGQRFGFTVEAMGSVTVAGERVSSSAVRKALAIGDMEHAALLLGRPYIIDGQVSHGQKLGRQLGFATANLRIKHNPLPMSGVFAVEVSGLGEQALPGVANLGIRPTVGGTRPLLEVHLFDFDRDIYGAHISVRFVHKLRNEQRFPNFDALKAQIAADAAAARAFFSL

SEQ ID NO: 70561 - DNA, 1044 bp, Ralstonia eutropha JMP134
  CDS (1)..(1044): transl_table=11
atgctcgctttacccgaaacatttcccgccgtccccgtgaaagtcttccgcggcctgcccaacgccgagagccgggcgccctgcgcgctcaccatcggcaatttcgacggtgtgcatcgcggccaccagtcgctgcttgcgcgcgcccgcgcggcggccgacgcgcgcggcctgcccctgtgcgtgatgacgtttgagccgcatccgcgcgagttcttcaccccggacaaggcgccgacgcgcatcgccctgctgcgcgacaagctcgaaagcctgcgccgcaacggtgtcgaccgcgtcgtggtcgagcatttcaacgcccatttcgccggccagtcgccgcaggcgttcgtcgagaacgtgctgtggcatggcctgcatgcgcgctgggtgctggtcggcgatgacttccgcttcggcgcgaagcgcgccggcgatttcacttacctgcaggacgccggccgccgctttggcttcgacgtcgagcagatgggctctgtgtccgaaggcgggatccggatctcaagctcggctgtgcgccaggcgctggccgacggcgacctcgaacacgctcgccgcctgctcggccatggctacgcgatcagcgggcacgtgatccacggccgcaagctgggccgcgacctcggcttcccgacgctgaacctgcgcatctcgcacaagcgtcccgcagtcaatggcattttcgtagtgcaggtgcacggcattgccgatcatccggtacccggcgtggccagcatcggcgtacgcccgaccatcgaggatgccggccgggtgctgcttgaagttcacctgttcgacatcaacgaaaacctgtacgggaagctgatccgcgtcgagttcatgaagaagctgcgcgatgaggcgcgtttcgacaacctggaagacctgactgcggccatcgccaaggacagcgccgaggcacgcgccttcttcggcctgaccgcgccggacgcccacaccggccgtgccgaaggcactggcggccgcgacttcgccacgtcggccaccgaccgaattagctag

SEQ ID NO: 70562 - protein, 347 aa, Ralstonia eutropha JMP134
MLALPETFPAVPVKVFRGLPNAESRAPCALTIGNFDGVHRGHQSLLARARAAADARGLPLCVMTFEPHPREFFTPDKAPTRIALLRDKLESLRRNGVDRVVVEHFNAHFAGQSPQAFVENVLWHGLHARWVLVGDDFRFGAKRAGDFTYLQDAGRRFGFDVEQMGSVSEGGIRISSSAVRQALADGDLEHARRLLGHGYAISGHVIHGRKLGRDLGFPTLNLRISHKRPAVNGIFVVQVHGIADHPVPGVASIGVRPTIEDAGRVLLEVHLFDINENLYGKLIRVEFMKKLRDEARFDNLEDLTAAIAKDSAEARAFFGLTAPDAHTGRAEGTGGRDFATSATDRIS

SEQ ID NO: 70563 - DNA, 930 bp, Thiobacillus denitrificans ATCC 25259
  CDS (1)..(930): transl_table=11
atgcgcatcacccacggttttcgtccgctcggcacggcccacgccgtcacgatcggcaactttgacggcctgcacctggggcaccaggccatgctcgcccggctgcaggcagtcgcgcgggcgcgagggctgtcgagctgcgtcttgagcttcgagccgcacccgcgtgaattcttcgctcccgagcaggcacccgcgcgtctgtcgagcctgcgtgagaaggcagagtgcctgcagcgtctcggcgtcgaccgcttccatgtgttccgcttcgaccgccccttctcgagcctgtcggccgaggccttcatcgagcaggtgctcgggcatacgctgcaggcgcgttatgtcctagtcggcgacgatttccgctacggcgccaagcgtgcgggcgactttgcgctgttgcagcaggccggcgctcatctcggcttcgacgccgaacatctgccgacggtcgagatcgcaggcgaacgcgcctcgtcgaccgccgtgcgccaggcgcttgcggccggcgaactccaccacgccggctgcctcctcgggcggccttacagcatttcggggcgcgtcgtgcacggcgacaagcttgggcgggcgatcggcttcccgactgccaacattcagctcaggcacaaccggccgccgctcatgggcatctacgcggtcgaactgtgcgggctcaatggtgcgccgctgcaaggcgtcgcgagcctcggcagacggccgaccgtaaagggcgccgacgcggtaccggtgctcgaagtgcacctgttcgactttgacgccgacatctacggccgccgtgtgcgagtggacttcctgcacaagctgcgcgacgaggaaagatacccggacctcgacagcctcgtcgcgcaaatccgccgcgacgtcgaggacgcgcggcagtttctcgccaagacccgataa

SEQ ID NO: 70564 - protein, 309 aa, Thiobacillus denitrificans ATCC 25259
MRITHGFRPLGTAHAVTIGNFDGLHLGHQAMLARLQAVARARGLSSCVLSFEPHPREFFAPEQAPARLSSLREKAECLQRLGVDRFHVFRFDRPFSSLSAEAFIEQVLGHTLQARYVLVGDDFRYGAKRAGDFALLQQAGAHLGFDAEHLPTVEIAGERASSTAVRQALAAGELHHAGCLLGRPYSISGRVVHGDKLGRAIGFPTANIQLRHNRPPLMGIYAVELCGLNGAPLQGVASLGRRPTVKGADAVPVLEVHLFDFDADIYGRRVRVDFLHKLRDEERYPDLDSLVAQIRRDVEDARQFLAKTR

SEQ ID NO: 70565 - DNA, 1059 bp, Anabaena variabilis ATCC 29413
  CDS (1)..(1059): transl_table=11
gtgtgggttgcttctacaactgaaatggttctcacgccaacggctgttgctcttggtaagtttgatggagtgcatcttggccatcaaagggtcattcaaccagttttgcagtcaactaggagcgcacaaacatggggagatgcactagactcatcagcccaatcagcgaaccctccagcagcaccacaagaacggatatactccacagttgtcacttttcgtcctcatccccaagagttttttacaggacaagcccgtacttggttaactcctctagatgaaaaagtacaacaattgcgatcgcttggggtagatcaactagtactactaccctttgacaaagaattaactgccttgtcaccggaagagtttgtcgaaaaaattcttgtgcaacaactacgctgtcaacgaattagcgtcgggcaagatttttgttttggcaaacaacgccgtggtactgccagggacttgcagttaattgcagccaaataccatatccctgttagcatagttcctttacaaacttctgatgggcagtttcttgaagacggcaactgtggtagctttgagtctctagaatatgctcctattagtacttcattaattcgccaagctctagaaaccggtgatatcaaaactgccaatcaattcttaggaagaccctacattctcatgggcgtagtcgttgaaggcgaacaacttggtagaaccattggttttcctacagccaacttggaactaccaaaagataaatttatcccccgtcaaggagtttacgccgtccgtgtcaaaattctcggtgagagcgcagatgctaatgtaccaccggaaattttgggggtgatgaatattggcaaccgccccacagttaatggtacttattcatcggtagaagtgcatcttctagattggtctggggatttatatggcaaggaaatagtagtgcagttagtggactttctgcgaccagaacaaaaatttccctctctagaagccttaaaagcgcaaattcaacaagactccactgtcgctagacaaattttgtcaagggagaattga

SEQ ID NO: 70566 - protein, 352 aa, Anabaena variabilis ATCC 29413
MWVASTTEMVLTPTAVALGKFDGVHLGHQRVIQPVLQSTRSAQTWGDALDSSAQSANPPAAPQERIYSTVVTFRPHPQEFFTGQARTWLTPLDEKVQQLRSLGVDQLVLLPFDKELTALSPEEFVEKILVQQLRCQRISVGQDFCFGKQRRGTARDLQLIAAKYHIPVSIVPLQTSDGQFLEDGNCGSFESLEYAPISTSLIRQALETGDIKTANQFLGRPYILMGVVVEGEQLGRTIGFPTANLELPKDKFIPRQGVYAVRVKILGESADANVPPEILGVMNIGNRPTVNGTYSSVEVHLLDWSGDLYGKEIVVQLVDFLRPEQKFPSLEALKAQIQQDSTVARQILSREN

SEQ ID NO: 70567 - DNA, 957 bp, Pseudomonas fluorescens PfO-1
  CDS (1)..(957): transl_table=11
atgagcaagaagcgcgttatgcagctggttcgaggcctccacaatctgcgcccccagcatcggggctgcgtcgccactattggcaactttgacggtgttcaccgcggtcaccaggccatcctggcccgactgcgtgagcgtgcgctcgagttgggcgtacccagctgcgtggtgatttttgagccgcagccacgggaattctttgccccggagaccgcgccggcgcgcctggcccggttgcgcgacaagctgcaactgctggccgccgaaggcgtcgaccgggttctgtgcctggcgttcaaccagcgcctgagcaagctcagcgccagcgagttcgttgataccatcctggttgatggcctcggcgtgcagcatctggaggtcggtgacgatttccgcttcggttgcgaccgtctcggcgatttcgatttcctgttgcaggccgggcaggtccacggttttaccgtggaagcggcgcaaaccgtcgagctggacggcatccgcgtcagcagcactcaggtgcgcaacgcgctggccgccgccgattttgccttggccgagcgcctgctgggtcgcccgtaccggattgccgggcgcgtgctgcatggccagaagttggcccgccagttgggtacgcccacggcgaatattcaactcaaacgccgtcgcgtgccgttcaccggggtttacctggtcgacgtcgacatcgacggcaagacctggcccggcgtcgccaatatcggcgtgcggcccacggtgcaaggtgatggcaaggcccaccttgaagtccatcttttagattttgccggcgatctgtatgaccggcgtttgacggtggttttccaccagaagctgcgtgaagagcagcgtttcgcctccctggaggcattgaaaacggcgatcagcgcggatgtcgccgccgcccgtgcactagccgcacctagcgcccatcgctaa

SEQ ID NO: 70568 - protein, 318 aa, Pseudomonas fluorescens PfO-1
MSKKRVMQLVRGLHNLRPQHRGCVATIGNFDGVHRGHQAILARLRERALELGVPSCVVIFEPQPREFFAPETAPARLARLRDKLQLLAAEGVDRVLCLAFNQRLSKLSASEFVDTILVDGLGVQHLEVGDDFRFGCDRLGDFDFLLQAGQVHGFTVEAAQTVELDGIRVSSTQVRNALAAADFALAERLLGRPYRIAGRVLHGQKLARQLGTPTANIQLKRRRVPFTGVYLVDVDIDGKTWPGVANIGVRPTVQGDGKAHLEVHLLDFAGDLYDRRLTVVFHQKLREEQRFASLEALKTAISADVAAARALAAPSAHR

SEQ ID NO: 70569 - DNA, 993 bp, Burkholderia sp. 383
  CDS (1)..(993): transl_table=11
gtgaaagtcttccgcggcctgcccaacgccgagagccgcgccccgtgcgcgctgacgatcggcaacttcgacggtgtccatcgcggccaccaggccctgctcgcgcgcgtgcgcgcagcagcggacgcgcgcggcctgcccgtgtgcgtgatgacgttcgagccgcacccgcgcgaattcttcaacccggccggcgcgccgccgcgcatcgcgatgctgcgcgacaagctcgaggcgctgcgcgatcacggtgtcgaccgcgtggtcgtcgagcacttcaaccacacgttcgcgagccagtcgccgcaggcgttcgtcgaacgcacgctggtgaacgggctgcacacgcgctggatgatggtcggcgacgatttctgctacggcgcgaaacgcgcaggcaccttcgacacgctgcaggcggccggcgcgcagtacggcttcgaggtcgagcagatggggacggtggccggcagcgacggcacgcgcatctcgagctcgggcgtgcgcgccgcgctcgcggcgggcgatctcgatgcggccgcgcaggcgctcggccatggctatgcgatcagcggccacgtcgcgcacgggctgaagctcggccgcgacctcggcttcccgacgctgaacctgccgatcgcccacaagcggccggcgctcgcgggcatcttcgtcgtgcaggtgcacggcctcggccccgccccgttgccgggcgtcgcgagcctcggcctgcgcccgaccgtcgacgattcgggccgcgtgctgctcgaagtccacctgctcgactggcacggcgacgcatacggcaagctcatccgcgtcgaattcctgaaaaagctgcgcgacgaggcgaaattcgacgatctcgaggcactgtcgcgcgcgatcgcgctggacgtcgcgaatgcgcgtgcgtacttcatcgagcgcgaccgtgcgccgggcagccgcgccacgggtttctcgacgtcggccaccgaccgaattagctga

SEQ ID NO: 70570 - protein, 330 aa, Burkholderia sp. 383
MKVFRGLPNAESRAPCALTIGNFDGVHRGHQALLARVRAAADARGLPVCVMTFEPHPREFFNPAGAPPRIAMLRDKLEALRDHGVDRVVVEHFNHTFASQSPQAFVERTLVNGLHTRWMMVGDDFCYGAKRAGTFDTLQAAGAQYGFEVEQMGTVAGSDGTRISSSGVRAALAAGDLDAAAQALGHGYAISGHVAHGLKLGRDLGFPTLNLPIAHKRPALAGIFVVQVHGLGPAPLPGVASLGLRPTVDDSGRVLLEVHLLDWHGDAYGKLIRVEFLKKLRDEAKFDDLEALSRAIALDVANARAYFIERDRAPGSRATGFSTSATDRIS

SEQ ID NO: 70571 - DNA, 954 bp, Rhodospirillum rubrum ATCC 11170
  CDS (1)..(954): transl_table=11
atgcgtatccttcgccatccctacgagctacccgcctccctgctcgggggctcgctggccttgggcaatttcgacggcgtccaccgtggccatcagcgggtcatcggctcggcccgggccatcgccgcccagcagggcctgccccttggcgtcatgaccttcgccccccatccacggcgcttcttccagcccgacctgccgcccttcaccctgacctccttccgcctgaaggcccatctgatcagcgaggaaggcgccgatttcctttatgtccaggccttcgacgaggcgctgtccaagggctcggccgaatggttcgtcaccgaggtgctggtcaagggcctgcatgtcgcccatgtcgtcgtcggccaggattacgcctttggccaccgccgccagggcacggtcagcctgttgcagaagatggcgcttgatctcggctttggcgtcaccgccgtcgccccggtcaaggacgagggcggcgccatctattcctcgacccgggtgcgcgcctgcctgcaagagggcgacgtcaccaccgcggcgcaaattctgggccatccctgggaggtcgaaggccgggtcgagcatggcgacaagcgcggacggaccatcggcttccccaccgccaacctgaagcttggcgactatcagcggccgcgcgccggcgtctatgcggtcaccgccgggcttgatgacggcgcccagacccgctttcgcccaggcgtggccaacttcggccgccgcccgacgtttgataacggcgacgccctgcttgaagtccatttgttcgatgtcagccctgatctctacggccgccacctgcgggtgcgcttccacgacttcctgcgccccgaacagaccttcccgggccttgaggccctgaaggcccagatcggccaggacgccgcccaagcccgcgccctgttcggactcccccccgccgccccttaa

SEQ ID NO: 70572 - protein, 317 aa, Rhodospirillum rubrum ATCC 11170
MRILRHPYELPASLLGGSLALGNFDGVHRGHQRVIGSARAIAAQQGLPLGVMTFAPHPRRFFQPDLPPFTLTSFRLKAHLISEEGADFLYVQAFDEALSKGSAEWFVTEVLVKGLHVAHVVVGQDYAFGHRRQGTVSLLQKMALDLGFGVTAVAPVKDEGGAIYSSTRVRACLQEGDVTTAAQILGHPWEVEGRVEHGDKRGRTIGFPTANLKLGDYQRPRAGVYAVTAGLDDGAQTRFRPGVANFGRRPTFDNGDALLEVHLFDVSPDLYGRHLRVRFHDFLRPEQTFPGLEALKAQIGQDAAQARALFGLPPAAP

SEQ ID NO: 70573 - DNA, 1038 bp, Burkholderia thailandensis E264
  CDS (1)..(1038): transl_table=11
ttgcggcatccggccgcgctttcccccacgctgtcacccgctatcgtgaaagtctttcgcggcctgcccaacgccgagagccgcgccccgtgcgcgctgacgatcggcaacttcgacggtgtccatcgcggccaccaggccctgctcgcgcgcgtgcgcgcggcggcggacgcgcgcgggctgcccgtgtgcgtgatgacgttcgagccgcacccgcgcgagttcttcaatccggcgagcgcgccgccgcgcatcgcgatgctgcgcgacaagctcgaggcgctgcgcgagcacggcgtggaccgcgtggtcgtcgagcacttcaaccatacgttcgcgagccagtcgcccgagacgttcgtcgaacgcacgctcgtccacgggctgcacacccgctggatcatggtcggcgacgatttctgctacggcgcgaaacgcgcgggcgatttcgcgtcgctgaaggcggcgggcgagcgcttcggtttcgaggtcgagcagatggaaacgctcgccgacgccgacggcgcgcggttctcgagctcaggcgtgcgcgccgcgctcgcggcgggggatctggacgcggccgcgcgagcgctcggccacggctacgcgatcagcggccatgtcacgcacggcctgaagctcggccgcgacctcggcttcccgacgttgaacctgccgatcgcgcacaagcgtcccgcgctgtccggcatcttcgtcgtccgcgtgcacggcatcgggcccgagccgctgcccggtgtcgcgagcctcggcgtgcgcccgaccgtcgacgattccggccgcgtgctgctcgaggtgcatctgctcgactggcacggcgacgcgtacggcaagctcgtgcgcgtcgaattcctgaagaagctgcgcgacgaggcgaaattcgtcgatctcgagacgctctcgcgcgcgatcgcgcaggacgtcgtcgatacgcgcgcgtacttcgccgagcacggccgtgcgccgggcagccgcgcaaccggcttcgcgacgtcggccaccgaccgaattagctga

SEQ ID NO: 70574 - protein, 345 aa, Burkholderia thailandensis E264
MRHPAALSPTLSPAIVKVFRGLPNAESRAPCALTIGNFDGVHRGHQALLARVRAAADARGLPVCVMTFEPHPREFFNPASAPPRIAMLRDKLEALREHGVDRVVVEHFNHTFASQSPETFVERTLVHGLHTRWIMVGDDFCYGAKRAGDFASLKAAGERFGFEVEQMETLADADGARFSSSGVRAALAAGDLDAAARALGHGYAISGHVTHGLKLGRDLGFPTLNLPIAHKRPALSGIFVVRVHGIGPEPLPGVASLGVRPTVDDSGRVLLEVHLLDWHGDAYGKLVRVEFLKKLRDEAKFVDLETLSRAIAQDVVDTRAYFAEHGRAPGSRATGFATSATDRIS

SEQ ID NO: 70575 - DNA, 978 bp, Saccharophagus degradans 2-40
  CDS (1)..(978): transl_table=11
atgacctcccaccaatttgcctgtggccgctttaaacaagcgcaatttttgccaccgtttgatgctactcacaaggcttgtgtggtaaccattggctcgttcgatggggtgcatttggggcatcagcagctattgcagcaagtggttgctcaggcggcgcacttgcagctaccttcggtagtgattgtttttgaaccgcaacctcacgagttcttttcgaaagaaaacgcccccgcacgcttaatgcgcctgcgcgagaaggtgcaggccctgtttgctgcgggggtagataaggtgttgtgtttaaggtttaaccagcagcttcgcaatctaacggcgaatgattttgtggaacaggtgctggtaaaggggctaggggttaaataccttgtagtaggggacgattttaagtttggctgtgatcgcagtggcgactttgcagccttacagcagcagggcgagaaacacggttttagcgtggtagacacgcaaacccagctagcgactaccgaacacgatggtaccgatagaattagtagtacgcgcatacgtgcgttgctagaaaccgataagtttgatcaagccgctgcattattgggcgcgccttttagcgttgctgggcgggttgtatacggcaaacagttgggccgaaccctggggtttcctacggcaaacattggtttggggcgttatcgttcgccggtaaatggtgtgtatggcgtagtgctaatcgccaatgaccagcgctacaacgcggtagcgaatgttggggtaaggcctaccctgggtgggcgcaataaaccaattttagaagtacatgcacttacgcctaccggcaatttgtatggcgagtttgtgcgggttgaatttaaattcaaaattcgccaagaaatgaaatttacttcgttagatgctttaaaaaatcaaatagctgacgatgtgagcacagcgaaacgttattttcaatctaacgattaa

SEQ ID NO: 70576 - protein, 325 aa, Saccharophagus degradans 2-40
MTSHQFACGRFKQAQFLPPFDATHKACVVTIGSFDGVHLGHQQLLQQVVAQAAHLQLPSVVIVFEPQPHEFFSKENAPARLMRLREKVQALFAAGVDKVLCLRFNQQLRNLTANDFVEQVLVKGLGVKYLVVGDDFKFGCDRSGDFAALQQQGEKHGFSVVDTQTQLATTEHDGTDRISSTRIRALLETDKFDQAAALLGAPFSVAGRVVYGKQLGRTLGFPTANIGLGRYRSPVNGVYGVVLIANDQRYNAVANVGVRPTLGGRNKPILEVHALTPTGNLYGEFVRVEFKFKIRQEMKFTSLDALKNQIADDVSTAKRYFQSND

SEQ ID NO: 70577 - DNA, 921 bp, Methylobacillus flagellatus KT
  CDS (1)..(921): transl_table=11
atgcaggtatttcgtcatttccaccaggctgcccatcatccgcttgcggttgctattggaaatttcgatggcgtgcacctgggccaccaggcattgttgcgtcgcctgatcgaggtggcgtctgcacaaggactgaagtcggcagtcatgactttcgagccgcatccgcgggagtttttcgcgcctgacaaggcgcctgcaaggctgacttcgttgcgtgagaagttggagttgtttgcggaagctggtgtcgattatgtctatgtctgtcatttcaaccgccgtttcgccgccatcacggtggaagccttcatgcaggacatcctacgcaatgcgctggatgcccggactatcctggtgggagaggacttccgttttggtgccgggcgccagggcagtatggaggattttgcacgcgcaggattcaatctgcaaagccagccgcaggtcaacctggacggcaagcgtgtttccagcaccgccatccgcgaggcgctggcgaaggggcagctcgatgaagctgcgcgcctgctggggcgcccctacagtatcagcggcaaggtggtgcatggcgacaagcttgcacgcgagcttggctatcctacggcgaatattcacatgctgcatgataggccgccgcttttcggcatctatgcggtaaaattggaaggtttggccgagggcggcgattggccgggtgtagctagcctcggtgtgcgacctaccgtaaagcaggatggcaagccgacgctggaggcgcacctgtttgatttcagcggcgatatctatggccgtcatgtacgcgtgaaattcatgcacaaaatacgcgatgaaatgaaattcgacagcctggaaacattgaagtactggattgccagggatgccgagatggcgcgtgagtattttcgtgccaatccctga

SEQ ID NO: 70578 - protein, 306 aa, Methylobacillus flagellatus KT
MQVFRHFHQAAHHPLAVAIGNFDGVHLGHQALLRRLIEVASAQGLKSAVMTFEPHPREFFAPDKAPARLTSLREKLELFAEAGVDYVYVCHFNRRFAAITVEAFMQDILRNALDARTILVGEDFRFGAGRQGSMEDFARAGFNLQSQPQVNLDGKRVSSTAIREALAKGQLDEAARLLGRPYSISGKVVHGDKLARELGYPTANIHMLHDRPPLFGIYAVKLEGLAEGGDWPGVASLGVRPTVKQDGKPTLEAHLFDFSGDIYGRHVRVKFMHKIRDEMKFDSLETLKYWIARDAEMAREYFRANP

SEQ ID NO: 70579 - DNA, 996 bp, Burkholderia xenovorans LB400
  CDS (1)..(996): transl_table=11
gtgagagtcttccgcggtcttcccaatgctgaaagccgtgcgccctgcgcactgaccatcggcaacttcgacggtgtccaccgcggccaccaggctctgctcgcccacgtgcgggccgcggccgatgcacgcggcctgcccgtctgcgtgatgaccttcgagccgcacccccgcgaattcttcaacccggcgggcgcgccgccgcgcatcgccatgctgcgcgacaagctcgaggcgctgcgcaccaacggcgtcgaccgggtggtcgtcgagcacttcaatcagacgttcgcgagccagtcgccggacgcgttcgtcgaacggatcatcgtcaacgggctgcatgcgcgctgggtcatgatcggcgacgacttccgctacggtgcaaaacgcgcgggcgacttcgcgtcgctcaaggccgcggggcagcaacacggtttcgaagtcgaacagatggccacggtggccgatccgtcgggcgcgcgcatttccagctcgggcgtgcgcgcggcgctggtggcgggcgacctcgactcggcacgcgccgcgctgggccgcgactacgtgatcagcggccacgtcgtgcacggcatgaagctcggccgcgacctcggcttccccacgctgaacctgccgatcgcccacaagcgcccggcgctcgcgggcattttcgtggtgcgcgtgcacggcgtggcggatgaaccgctgcccggcgtcgcgagcctcggcctgcgccccacggtagacgattccggccgcgtgctgctcgaagtccatctgctcgactggcatggcgacgcatatggcaaactcgtgcgcgtcgaattcctgaagaagctgcgcgacgaggaaaagtacgtcgatctcgaaacgctgaccgccgccattgcgcgcgacgtcgccaacgcgcgcgcatggttcgcggccgtcggcgccggcacgccgggcagccgctccaccggcttcgccacctcggccaccgaccgaattagataa

SEQ ID NO: 70580 - protein, 331 aa, Burkholderia xenovorans LB400
MRVFRGLPNAESRAPCALTIGNFDGVHRGHQALLAHVRAAADARGLPVCVMTFEPHPREFFNPAGAPPRIAMLRDKLEALRTNGVDRVVVEHFNQTFASQSPDAFVERIIVNGLHARWVMIGDDFRYGAKRAGDFASLKAAGQQHGFEVEQMATVADPSGARISSSGVRAALVAGDLDSARAALGRDYVISGHVVHGMKLGRDLGFPTLNLPIAHKRPALAGIFVVRVHGVADEPLPGVASLGLRPTVDDSGRVLLEVHLLDWHGDAYGKLVRVEFLKKLRDEEKYVDLETLTAAIARDVANARAWFAAVGAGTPGSRSTGFATSATDRIR

SEQ ID NO: 70581 - DNA, 1029 bp, Ralstonia metallidurans CH34
  CDS (1)..(1029): transl_table=11
atggtatgctcctaccctccccaaaaacgctcgtccgccgtcctcgtgaaagtcttccgcggtctgcccaatgccgaaagccgggcgccttgcgcgcttaccatcggcaatttcgacggtgtgcatcgcggccaccagtcgttgctcgcgcgcgcccgcgcggccgccgatgcacgcggcctgccgctgtgcgtgatgacattcgagccgcatccgcgcgaattcttcgcccccgagcacgctcccacccgtatcgccctgctgcgcgacaagctcgacgcgctgcgccgcaacggcgtggatcgcgtggtggtggagcatttcaacgcgcatttcgccgcccagtcgcctcaggctttcgtcgagaacgtgctctggcacggcctccacgcccgatgggtgctggttggcgacgacttccgcttcggcgccaagcgcgccggcgacttctcctatctgcaggaggccggccggcagttcggtttcgacgtcgagcagatgggatcggtctccgaaggcggcatccgcatctccagctcagccgtgcgccaggcactggccggtggcgacctggaacatgcgcgccggctgctcggccacggctacgcgatcagcggccacgtaatccatggacgcaagctcggccgtgaccttgggtttccgacgctgaacctgcggatctcgcacaagcgcccggccgtgaacggcatcttcgtggtgcaggtgcatggcattgccgaccacccggtgccgggcgtggccagcatcggcgtgcggccgaccgtcgaggacgccggccgcgtgctgctggaagtgcacctcttcgacttcaacgaaaacctgtacggcaagctgatacgggtggaattcatgaagaagctgcgtgacgagaagcgctacgactcgctcgaagcgctgaccgcggccatcgccaaggatgccgccgacgcacgcgcattctttggccagaccgcgccggatgccggccggcgcgacttcgccacctccgccaccgaccgaattagctag

SEQ ID NO: 70582 - protein, 342 aa, Ralstonia metallidurans CH34
MVCSYPPQKRSSAVLVKVFRGLPNAESRAPCALTIGNFDGVHRGHQSLLARARAAADARGLPLCVMTFEPHPREFFAPEHAPTRIALLRDKLDALRRNGVDRVVVEHFNAHFAAQSPQAFVENVLWHGLHARWVLVGDDFRFGAKRAGDFSYLQEAGRQFGFDVEQMGSVSEGGIRISSSAVRQALAGGDLEHARRLLGHGYAISGHVIHGRKLGRDLGFPTLNLRISHKRPAVNGIFVVQVHGIADHPVPGVASIGVRPTVEDAGRVLLEVHLFDFNENLYGKLIRVEFMKKLRDEKRYDSLEALTAAIAKDAADARAFFGQTAPDAGRRDFATSATDRIS

SEQ ID NO: 70583 - DNA, 1002 bp, Magnetospirillum magnetotacticum MS-1
  CDS (1)..(1002)
atgcgcctgatccggcattgcggcgaactatcccccgaccaccgcggttgcgtggtggcgttggggaatttcgacggcgtccatctcggccatcaggcggtgatcctgacggcgcggcgcatggcccaggagctgggcgtggcccatgcggtcatgaccttcgagcctcatccgcgcacactgttcaatcctgatcaggccgccttccgtctgacgccctttcgcgtcaaggcccgcctgatcgaggcgttgggcaccgacttcttgtaccaacagcatttcgaccgcgatttcgccgccatgacggccctggaattcgtgggcgacgttctggtcggttgcctcaaggtcagccatgtggtggtgggctacgactatgtgttcggcaagggccgcctgggcaccggcgccttcttgcaaaaatgcggcgaggaatcgggctttggcgtcaccgtggtgccgcccgccatggccgatcatggcgagacctattcctccaccgccgtgcgcgagcatctggtggccgggcgtcccgattgcgccgcccgtttgctgggccattactgggaggtggagggccgcgtcgagcatggtgatgcccgcggccgcctgttgggctttcccaccgccaatctgcgcctgggcgagtatcagcgcccggcgggcggcgtctatgcggtgcgcgccggaatcgacaagggtggcgccacggtctggcatgacggcgtcgccaatttcggccgccgccccaccttcgacaagaccgacgaattgatggaggtccacctgctggacttcaacgaggatctttatggccgccacctgcgggtggcgctggtcgagcatatccggcccgagcgaaagttcggcgggctggacgaactgacccatcagattaccgccgatgtggaggccgggcgtcgtatcctggccgcccgccgtttttccgccgccgccgggcccatggtgcccgtcgccctgccctttgagagcccgtcatga

SEQ ID NO: 70584 - protein, 333 aa, Magnetospirillum magnetotacticum MS-1
MRLIRHCGELSPDHRGCVVALGNFDGVHLGHQAVILTARRMAQELGVAHAVMTFEPHPRTLFNPDQAAFRLTPFRVKARLIEALGTDFLYQQHFDRDFAAMTALEFVGDVLVGCLKVSHVVVGYDYVFGKGRLGTGAFLQKCGEESGFGVTVVPPAMADHGETYSSTAVREHLVAGRPDCAARLLGHYWEVEGRVEHGDARGRLLGFPTANLRLGEYQRPAGGVYAVRAGIDKGGATVWHDGVANFGRRPTFDKTDELMEVHLLDFNEDLYGRHLRVALVEHIRPERKFGGLDELTHQITADVEAGRRILAARRFSAAAGPMVPVALPFESPS

SEQ ID NO: 70585 - DNA, 945 bp, Haemophilus somnus 2336
  CDS (1)..(945)
atgcaacttattcgtggttttcataatttacccgagcctttaaaacagcagggttgtgctgtaactattggtaattttgatggtgttcatttagggcatcaatccattttgcaacatttaaaagcgaaagcaaaacaactgaatttgcccgttgtagtgatgttatttgaacctcaaccttatgagtattttcaaggtgatcaagcaccggcaaggcttatgcgtttacgagataaactcgcctatctagcacagttaggtgtagattatgttttctgcgttaaattcaaccgcacttttgcccaattaagtgcggagcaatttatttcagattgtttagtgaaacatctgaagatgaagtttttaagcattggtgatgactttcggtttggtttaaatcgagaaggcgactttcgacttctgcaaaaaaaagggcaacaacaaagctttatagtggaagataatcgaagtttacaattaaatgaccagcgtattagtagcaccgccattcgccaagccttatcagaagataatttagcgttggcagaaaagttactgggtaagccatatcgtatttatggacgagttgctcatggcaataaattaggacgaactattggttttcccactgcaaacatttatttacatcggcaagttaatccaattaaaggtgtatacgttgtaaaagtgcggttaaaaaatggcgatatttttcaaggagttgccaacattggcaagcgacctactatcaatggcgtaaaacaattattggaagtgcatttgtttaactttgatcgtgatttgtatggtcaatccttgcaaattgaattttgccataaaattcgccatgaaaaaaaatttccttctctaaatgcccttaaaaatcagattgaaaatgatgttgttgtggcaaaaaagtattttcagcaagtcttgaacctttga

SEQ ID NO: 70586 - protein, 314 aa, Haemophilus somnus 2336
MQLIRGFHNLPEPLKQQGCAVTIGNFDGVHLGHQSILQHLKAKAKQLNLPVVVMLFEPQPYEYFQGDQAPARLMRLRDKLAYLAQLGVDYVFCVKFNRTFAQLSAEQFISDCLVKHLKMKFLSIGDDFRFGLNREGDFRLLQKKGQQQSFIVEDNRSLQLNDQRISSTAIRQALSEDNLALAEKLLGKPYRIYGRVAHGNKLGRTIGFPTANIYLHRQVNPIKGVYVVKVRLKNGDIFQGVANIGKRPTINGVKQLLEVHLFNFDRDLYGQSLQIEFCHKIRHEKKFPSLNALKNQIENDVVVAKKYFQQVLNL

SEQ ID NO: 70587 - DNA, 963 bp, Actinobacillus pleuropneumoniae serovar 1 str. 4074
  CDS (1)..(963)
atgcaactcattcgcggcttatacaatttggcaaatcacaaagacctcgcaaaaggcagcgttatcagtatcggtaattttgacggtgttcacttgggacaccaaaatattctcgctcgcctatgtgatcaagcgcttgagcgtaacttaccttcggtcgtgatgttgtttgaaccgcagccgagagagttttttgcaaataaacaagcaaattcaaccgcttgtatcgctcccgctcgcttgatgcgtttacgggataaattaaaatatcttgaacaagccggcgttgatttcgtcctttgcgtaagatttaacgaacgattcgccaatttatcggctgacgcttttatccgcgagttattagttaaacaattgcgagtgcgttacttaagcgtaggcgacgatttccgcttcggtgcaaaccgaaccggtgattttgccttgttacgtaatgccggattgaaatatcgctttgccgttgaagacagtcagacattaaatcatgcggaacaacgtgtcagcagttctttaattcgaacggcattacagcaagatgatctcgttttagccgaaaaattattaggcaagccttattctatttgcggcagagtggcgcatggtaataagctcgggagaacgatcggttttccgaccgcaaatattatgctaaaccgattagttaccccgctacaaggcgtattcgccgtacaaattcaaacccaaacgggcagacataacgggatcgctaatgtcggaaaccgaccgaccattaacggcacgaaaccgttgcttgaagtgcatatttttgattttaatcgttcgatttacggcgaagcgatagaagtattttttattcgtaaaattcgtaatgaagtcaaatttcccgactttgaagcactgaaagcacaaatcgaaaaagacagagaacaagcgttcgaattttttaaacattttgcaaactag

SEQ ID NO: 70588 - protein, 320 aa, Actinobacillus pleuropneumoniae serovar 1 str. 4074
MQLIRGLYNLANHKDLAKGSVISIGNFDGVHLGHQNILARLCDQALERNLPSVVMLFEPQPREFFANKQANSTACIAPARLMRLRDKLKYLEQAGVDFVLCVRFNERFANLSADAFIRELLVKQLRVRYLSVGDDFRFGANRTGDFALLRNAGLKYRFAVEDSQTLNHAEQRVSSSLIRTALQQDDLVLAEKLLGKPYSICGRVAHGNKLGRTIGFPTANIMLNRLVTPLQGVFAVQIQTQTGRHNGIANVGNRPTINGTKPLLEVHIFDFNRSIYGEAIEVFFIRKIRNEVKFPDFEALKAQIEKDREQAFEFFKHFAN

SEQ ID NO: 70589 - DNA, 939 bp, Pseudomonas aeruginosa UCBPP-PA14
  CDS (1)..(939)
atgcagctgcttcgcggactacacaacctgcagcccctggccgggggctgcgtcgccaccatcggtaacttcgacggcgtccacctcgggcaccaggctatcctggcgcgtctgcgcgagcgctcgctggagctgggcgtacccagctgcgtggtgattttcgagccgcagccgcgcgagttcttctcccccgattcggcgccggtgcgtctgacccgcctgcgcgagaaactcgagttgctgcgtgggcagggcgtcgacgtggtgctctgcctggccttcaaccgccgcttgcgcgagctgtcggcagccgagttcgtccgccaggtcctggtcgatggactggcggtgcggcaccttgaagtgggcgacgatttccgtttcggctgcgaccgctccggtgacttcgccttcctggtgaacgccagtcgcgagcaggggttcaccgtcgaggcggccgccaccgtcgaactggacggcgtgcgggtgagcagcacgcgggtccgccaggccctggccgagggcgacctgcatctcgccgagcgccttctggggcgtcccttcagcctgagcggacgggtcctgcatggacagaaactcggccggcaactgggctcgcccacggccaacattcaactgaaacggcgcaaggcgccgttgaacggggtctacctggtcagtacgctggtcgatggccagcgttgccagggggtggcgaacatcggcacccgcccttcggtgaacggcgacggccgtccccatctggaagtgcacctgctcgatttcgccggcgatctatacggccggcatctgcaggtgaccttccaccagaagctgcgcgacgagcagcgttttgcctccctggaggcactcaaggcggcgattctcgcggatatcgccgccgcccgggcctactggctgggccaaccgcttgattga

SEQ ID NO: 70590 - protein, 312 aa, Pseudomonas aeruginosa UCBPP-PA14
MQLLRGLHNLQPLAGGCVATIGNFDGVHLGHQAILARLRERSLELGVPSCVVIFEPQPREFFSPDSAPVRLTRLREKLELLRGQGVDVVLCLAFNRRLRELSAAEFVRQVLVDGLAVRHLEVGDDFRFGCDRSGDFAFLVNASREQGFTVEAAATVELDGVRVSSTRVRQALAEGDLHLAERLLGRPFSLSGRVLHGQKLGRQLGSPTANIQLKRRKAPLNGVYLVSTLVDGQRCQGVANIGTRPSVNGDGRPHLEVHLLDFAGDLYGRHLQVTFHQKLRDEQRFASLEALKAAILADIAAARAYWLGQPLD

SEQ ID NO: 70591 - DNA, 939 bp, Haemophilus influenzae R2846
  CDS (1)..(939)
atggataaggacatgcaattaattcgtgggcttcataatgcaaatcgtgttttacaaggttgtgcgctaacgatcggcaactttgatggtgtgcatttagggcatcaagcagtcctccgccatttacgccaaaaagctgacgaattaaatttacccatggcggtattgttatttgaatctcagccgcgtgaatattttatgggggaaaatgcacctgcacgtttaatgcgtttgcgtgacaaaatttattatctcgaaaaggctaaggtcgatgtcgtaattgtggcgaaatttgaccgcacttttgccgagcaaccagccgatgtttttattgaacaaacgcttgttaatcatctacatgtgaaatttttaagtattggcgatgatttcaaattcggctcaaaacgccaaggcaattttgccatgttgcaagcagctagtaagcgttttggttttattgttgaagataaccgtagcttttgtctagatgaacagagaattagtagcacggcaattcgcgaagcgttagcgaatgatgacttacaacttgcagaaaatttactcggtaaaccttatcgtattttcgggcgtgtgattcatgggaataaattaggcagaacaataggatttccaacggcaaatattcgtttgcatagacaagtaaatccaatcaaaggcgtttatgccgtaaaagtgcggttaaaatcgggggagatttttaacggcgtggcaaacatgggaaaacgtccaactataaatggattaatgcaattattagaagtccatttatttgatttttctcagaatatttatggccaaatggtggaagtggaattctgccacaagattagaaacgagattaaattcccgtcttttgatgatttgaaagtgcaaattgagaaagatgtagaaactgcgaaagcgttttttaacagttaa

SEQ ID NO: 70592 - protein, 312 aa, Haemophilus influenzae R2846
MDKDMQLIRGLHNANRVLQGCALTIGNFDGVHLGHQAVLRHLRQKADELNLPMAVLLFESQPREYFMGENAPARLMRLRDKIYYLEKAKVDVVIVAKFDRTFAEQPADVFIEQTLVNHLHVKFLSIGDDFKFGSKRQGNFAMLQAASKRFGFIVEDNRSFCLDEQRISSTAIREALANDDLQLAENLLGKPYRIFGRVIHGNKLGRTIGFPTANIRLHRQVNPIKGVYAVKVRLKSGEIFNGVANMGKRPTINGLMQLLEVHLFDFSQNIYGQMVEVEFCHKIRNEIKFPSFDDLKVQIEKDVETAKAFFNS

SEQ ID NO: 70593 - DNA, 939 bp, Haemophilus influenzae R2866
  CDS (1)..(939)
atggataaggacatgcaattaattcgtgggcttcataatgcaaatcgtgttttacaaggttgtgcactaacgatcggcaactttgatggcgtgcatttagggcatcaagcagtccttcgccatttgcgtcaaaaagctgacgaattaaatttacccatggcggtattgttatttgaatcacagccgcgtgaatattttatggggaaaaatgcaccagcccgtttaatgcgtttgcgtgacaaaatttattatctcgaaaaggctaaggtcgatgtcgtaattgtggcgaaatttgaccgcacttttgccgagcaaccagccgatgtttttattgaacaaacgcttgttaatcatctacatgtgaaatttttaagcattggcgatgatttcaaattcggctcaaaacgccaaggtaattttgccatgttgcaagcagctagtaagcgttttggttttattgttgaagataaccgtagtttttgtctagatgcacagcgaattagtagcactgcgattcgcgaagcgttagcgaatgatgacttacaacttgcagaaaatttactcggcaagccttatcgtattttcgggcgtgtgattcatgggaataaattaggcagaacaataggatttccaacggcaaatattcgtttgcatagacaagtaaatccaatcaaaggcgtttatgccgtaaaagtgcggttaaaatcgggggagatttttaacggcgtggcaaacatgggaaaacgcccaactataaatggattaatgcaattattagaagttcatttatttgatttttctcagaatatttatggccaaatggtggaagtggaattctgccacaagattagaaacgagattaaattcccgtcttttgatgatttgaaagtgcaaattgagaaagacgtagaaactgcgaaagcgttttttaacagttaa

SEQ ID NO: 70594 - protein, 312 aa, Haemophilus influenzae R2866
MDKDMQLIRGLHNANRVLQGCALTIGNFDGVHLGHQAVLRHLRQKADELNLPMAVLLFESQPREYFMGKNAPARLMRLRDKIYYLEKAKVDVVIVAKFDRTFAEQPADVFIEQTLVNHLHVKFLSIGDDFKFGSKRQGNFAMLQAASKRFGFIVEDNRSFCLDAQRISSTAIREALANDDLQLAENLLGKPYRIFGRVIHGNKLGRTIGFPTANIRLHRQVNPIKGVYAVKVRLKSGEIFNGVANMGKRPTINGLMQLLEVHLFDFSQNIYGQMVEVEFCHKIRNEIKFPSFDDLKVQIEKDVETAKAFFNS

SEQ ID NO: 70595 - DNA, 1050 bp, Rubrivivax gelatinosus PM1
  CDS (1)..(1050)
atgcaagtgttccgaggtctgcaccacatcctgctggccgatggcggcgcgtcggccgtcacggtcggcaacttcgatggcgtgcaccgcggccaccaggcgatgctggcgctgctcaagagcgaggccgagcaccgcgacctgctcagcaccgtgctgaccttcgagccccatccgcgcgacttcttcgccgcgcgtgccggcaccccggccaaggcgccggcgcgcatcgccacgctgcgcgacaagctcggcgaactggcgcgctgcggcgtgcagcgcgtcgtcgtgctgcgcttcgaccagaccttcgccgaccagtcgccgcaggccttcatcgacgacgtgctgctgcgcggcgtgaaggcgcgctacgtgctggtgggcgacgacttctgcttcggcgcgaagcgggccggcgactacgcgatgctcgacgccgccggcgaacgccagggcttcgacgtggcgcggatgatgagctacgaggtgcacggcctgcgcgtcagcagctcggcggtgcgcgaggcgctgggcgccggcgacatggcgctggtcacccgcctgctggggcggccctacagcatcagcggccacgtcacccacggccgcaagctgggccgcgagctcggcgccggcccggacggcggcgacggcttccgcacgctgaacctgcgtttcccccaccccaagccggccgcgcacggcatctacgtcgtgcgcacccacggcctgaccgccgagccgctcgacggtgtggccagcttgggggcccgccccacggtggacgacagcggccgggtgctcctcgaagtgcactgcctggactggcctgcgcacctgggcgccgaggggggctacggtaaactcgtccgcgtggaactgctgcacaagctacgcgacgaagcccgctacgacgggctcgctgcgctgaccgccgcgatcgcgcaggacgtgagccaggcgcgccagtggctgacgagcagcccgcacgcggcccatgcggccgagcgccgccagaccacccgcgatcgaattcagggccgctga

SEQ ID NO: 70596 - protein, 349 aa, Rubrivivax gelatinosus PM1
MQVFRGLHHILLADGGASAVTVGNFDGVHRGHQAMLALLKSEAEHRDLLSTVLTFEPHPRDFFAARAGTPAKAPARIATLRDKLGELARCGVQRVVVLRFDQTFADQSPQAFIDDVLLRGVKARYVLVGDDFCFGAKRAGDYAMLDAAGERQGFDVARMMSYEVHGLRVSSSAVREALGAGDMALVTRLLGRPYSISGHVTHGRKLGRELGAGPDGGDGFRTLNLRFPHPKPAAHGIYVVRTHGLTAEPLDGVASLGARPTVDDSGRVLLEVHCLDWPAHLGAEGGYGKLVRVELLHKLRDEARYDGLAALTAAIAQDVSQARQWLTSSPHAAHAAERRQTTRDRIQGR

SEQ ID NO: 70597 - DNA, 993 bp, Burkholderia vietnamiensis G4
  CDS (1)..(993): transl_table=11
gtgaaagtcttccgcggcctgcccaacgccgagagccgcgcgccctgcgcgctgacgatcggcaacttcgacggtgtccatcgcggccaccaggccttgctcgcgcgcgtgcgcgcggcagcggacgcgcgtgggctgcccgtgtgcgtgatgaccttcgagccgcatccgcgcgagttcttcaacccggccggcgcgccgccgcgcatcgcgatgctgcgcgacaagctcgaggcgctgcgcgagcacggcgtcgatcgcgtcgtcgtcgagcacttcaaccacacgttcgcgagccagtcgccgcaggcgttcgtcgaacgcacgctggtcggcggcctgcacacgcgctggatgatggtcggcgacgatttctgctacggcgcgaagcgcgcgggcaccttcgacacgctgaaggccgccggcgagctgcacggcttcgaggtcgagcagatggacacggtggccggcagcgacggcacgcgcatttcgagctccggcgtgcgcgcggcgctcgccgccggcgatctcgacgcggccgcgcaggcgctcggccacggctacgccatcagcggccacgtcgcgcacgggctgaagctcggccgcgacctcggcttcccgacgctgaacctgccgatcgcgcacaagcggccggcgctcgccggcatcttcgtcgtgcaggtgcacggcctcgggccggcgccgctgccgggcgtcgcgagcctcggcgtgcgcccgaccgtcgacgattccggccgcgtgctgctcgaagtccacctgctcgactggcatggggacgcgtacggcaagctgatccgcgtcgaattcctgaagaagctgcgcgacgaggccaaatacgacgatctcgaggcgctgtcgcgcgcgatcgcgctcgacgtcgcgaacgcgcgcgcgtatttcgtggagcgcgcacgcgcaccgggcagccgcgcgaccggcttctcgacgtcggcgaccgaccgaattagctga

SEQ ID NO: 70598 - protein, 330 aa, Burkholderia vietnamiensis G4
MKVFRGLPNAESRAPCALTIGNFDGVHRGHQALLARVRAAADARGLPVCVMTFEPHPREFFNPAGAPPRIAMLRDKLEALREHGVDRVVVEHFNHTFASQSPQAFVERTLVGGLHTRWMMVGDDFCYGAKRAGTFDTLKAAGELHGFEVEQMDTVAGSDGTRISSSGVRAALAAGDLDAAAQALGHGYAISGHVAHGLKLGRDLGFPTLNLPIAHKRPALAGIFVVQVHGLGPAPLPGVASLGVRPTVDDSGRVLLEVHLLDWHGDAYGKLIRVEFLKKLRDEAKYDDLEALSRAIALDVANARAYFVERARAPGSRATGFSTSATDRIS

SEQ ID NO: 70599 - DNA, 924 bp, Magnetococcus sp. MC-1
  CDS (1)..(924): transl_table=11
atgtatatcatccgcggtttgatcaatcttccggatcgctttcgcggggcagtgctgaccattggtaattttgatggggttcatcggggtcatcagcgcctctttgcacaacttcatgcgttgggacagctgcaccaagcgcccaccatggccatgacctttgaaccgcacccccgccgggtgttgcgtcctgagcagccccttgatcgcataaccggggtacggggtaaggcgcgatggatggatcaatatggtcttgatgccatgtttatctgtcgttttacccgtcagttgcagacgatgcccgctgaggattttgtgcgggatttgctggcccatgggctaggcattcgcgaggtggtgattggtgaaaattttcgctttggtagtcatggtcgtggcgattttaacaccttggcgaacctggggcagcgctatggctttggcgcgcacaaggcggagctgctgttagaggggggggttaatgtctcctccacaggggtgcggcaggcaattcggcaagcggattttaaagccgctgaagcgctgttgggtcgtccctttgagatagaagggcgggtgatcgccggcatgcggcggggccgaggattggggtttcccacggccaatgtggccctttaccacctattatacccccctgttggggtctatttggtggaggccatggtggaagggctctggtgtccggccattgccaatattggtagcaatcccacctttggggacgagggattgcatatggaggtgcatatgctggttccgtgcagcgacctttaccatcgaaatctacgggtaaagtttcacgcctttgtgcgtggtgaacataaatttccggatgtcgaggcgttaaaggcgcagatcggtgccgatgtggcagcggccaagacctattttaatctgtag

SEQ ID NO: 70600 - protein, 307 aa, Magnetococcus sp. MC-1
MYIIRGLINLPDRFRGAVLTIGNFDGVHRGHQRLFAQLHALGQLHQAPTMAMTFEPHPRRVLRPEQPLDRITGVRGKARWMDQYGLDAMFICRFTRQLQTMPAEDFVRDLLAHGLGIREVVIGENFRFGSHGRGDFNTLANLGQRYGFGAHKAELLLEGGVNVSSTGVRQAIRQADFKAAEALLGRPFEIEGRVIAGMRRGRGLGFPTANVALYHLLYPPVGVYLVEAMVEGLWCPAIANIGSNPTFGDEGLHMEVHMLVPCSDLYHRNLRVKFHAFVRGEHKFPDVEALKAQIGADVAAAKTYFNL

SEQ ID NO: 70601 - DNA, 948 bp, Xylella fastidiosa Dixon
  CDS (1)..(948): transl_table=11
atgggcagcgtgtttagacatatcgaaggcgggatgctgttcccgcaaggaagtgtaacctgcatcggtgcttttgatggcctgcacctggggcatcgtgcccttgtacgtcatgccttacaacgtgcaactgcattgcacctgcctaccgttgccctgagctttgaaccgcttccacgtgaatacttcgcctccgccaccccgcccccgcgtttgaccctgacacgtgccaaaattcagggcttgcaccgctttggtgctgacagcgtcggcttgctacgttttgacagccgcttggcatccatgagccctcaaacctttgtcgagcgtgttttgctcggacgcttgggagtgcgtgaagtgctgatcgggccacagttccgctttggacatcagcgcagcggtgatatcgccttattgcagcgactgggcctggagcacggttttacagctaccgagatcccacccttacacctgaataatgaacgcatctccgcaacaaaaatccgcgccttgctggcagcgggcgactttgctcatgcggccgaactactgggtcgaccttacatgatcggtggccgcgtcgtgcgcggccagcagcttggcagcaccctaggctacccgaccgcgaatctgcgtttcccccatcccatcgcactgtccggcatttatgccacctgggtgcatggcatcttcgaacaaccctggccttccgtctccagcttcggcacccggcccaccgtcgccggcgtggaaccactcctagaagtgcatctattcgacttccacagcgatctctatggacgtcgtatcgacgtcgaattcatcgccaaactacgtgacgaagaaacattccccgacctccacacaatgaccgcacaaatacatcgtgacgcccaacaggcgcgccacatcctttccgaacatcgattgcgagccaccgcgtga

SEQ ID NO: 70602 - protein, 315 aa, Xylella fastidiosa Dixon
MGSVFRHIEGGMLFPQGSVTCIGAFDGLHLGHRALVRHALQRATALHLPTVALSFEPLPREYFASATPPPRLTLTRAKIQGLHRFGADSVGLLRFDSRLASMSPQTFVERVLLGRLGVREVLIGPQFRFGHQRSGDIALLQRLGLEHGFTATEIPPLHLNNERISATKIRALLAAGDFAHAAELLGRPYMIGGRVVRGQQLGSTLGYPTANLRFPHPIALSGIYATWVHGIFEQPWPSVSSFGTRPTVAGVEPLLEVHLFDFHSDLYGRRIDVEFIAKLRDEETFPDLHTMTAQIHRDAQQARHILSEHRLRATA

SEQ ID NO: 70603 - DNA, 1107 bp, Trichodesmium erythraeum IMS101
  CDS (1)..(1107): transl_table=11
gtgtggataacttcttctttagctacagctctaactccaacagcagttgccttaggaaactttgatggtttacatcaaggacataggcaagtaatagaaccaattttaaacttaaagggtagatcaaagttactttctgtttgtccatcagaattgacaagaactacagaagtagatgaagatacaaagcttaaattatggcatcaagattcaaaattatcatcatggcattttgaaaatgaattgggaaaaaatgatgattacctaaggcaaaaaatttattccactgttgttacttttaatcctcatccacaagagttttttagtggaaaaccaaaaaaattgttagctccactagaagaaaaattggcaatatttaaacatatcggagttgaacaagtagtattattgccatttgatcgaaatttggccgatctaactcctaataaatttgtagaagaaattttagtaaaaggcttacaagtacatcaaataagcgtggggtgtgatttttgttttggacaaaaaagagcaggaaaggccaaagatttgcaggcgatcgctggttactatgatatagatgtaacaactgtacctctatatcatagtgaaaatggagagcgtattagtagttctataattcgtcaagctttagaaaaaggagatctagataaatcaaatcgtttattaggtcgtccttacagtttaattggtgaagtggtgcatggacaacaactaggtagaactttaggatttcctacagcaaatcttcagctagcagcacaaaaattcttgcctcgttttggggtttatgctgtggaagtctatctttctcgacaaaaacaacctcaagaaatacttcatgctgagagcccctatttaggagtaatgaacgttggttgccgccctacattaaatagtttagatccaactgttgaagttcacctattagatatgtctcaagatttatatggtcaaactttaactgtaaatttgatagagtttttgcgacctgaacaaaaattcgcttctctagatttactgaaagctcaaatatatgaagattgtagaattgctagaagtatacttaaaaatcaaactatataa

SEQ ID NO: 70604 - protein, 368 aa, Trichodesmium erythraeum IMS101
MWITSSLATALTPTAVALGNFDGLHQGHRQVIEPILNLKGRSKLLSVCPSELTRTTEVDEDTKLKLWHQDSKLSSWHFENELGKNDDYLRQKIYSTVVTFNPHPQEFFSGKPKKLLAPLEEKLAIFKHIGVEQVVLLPFDRNLADLTPNKFVEEILVKGLQVHQISVGCDFCFGQKRAGKAKDLQAIAGYYDIDVTTVPLYHSENGERISSSIIRQALEKGDLDKSNRLLGRPYSLIGEVVHGQQLGRTLGFPTANLQLAAQKFLPRFGVYAVEVYLSRQKQPQEILHAESPYLGVMNVGCRPTLNSLDPTVEVHLLDMSQDLYGQTLTVNLIEFLRPEQKFASLDLLKAQIYEDCRIARSILKNQTI

SEQ ID NO: 70605 - DNA, 936 bp, Vibrio sp. Ex25
  CDS (1)..(936)
atggaactgattagaggcattcacaatatcaccccgcgacatcatggttgcgtgctgactattggcaatttcgatggtgtccataaaggccatcaacaagtattgcagcaagtgtctgagcaagcggacaggctatcattgccttctgttgtgatgacctttgaacctcagccgatggagctgtttgccaaagataaggcacctgcacggttgacgcgattacgcgataagttcgtgcaattgagtaagctcgatattgatcgcttgctctgcgtcaatttcaatcgtcattttgcaagtttaaccgcggaagaatttatccgtgacttgttggtcgagcgtttgggtgttaagtttcttgtcgttggtgatgatttctgctttggcaaaggccgtacaggtaactttgcaatgctgcaggaagcgggggaaaagtacggttttgatgtcgtgagtacccagagcttttgtttacaacaattacgtgtcagcagtacggctatccgtcaagcgctggcgcgtgacgatttgcattccgcgcaacagatgctgggaagaaactacagcatcagcggtcgtgtttctcacggaagaaagctgggcagaacgataggttttcctactgcgaatattcctttgaaacgctgtgtttctccggtttccggagtctatgttgttcaagcgcttggcttaggaaataagccagttggtggtgttgctaatattggtcaaagaccgactgtcaatggcgttcgccagcagttagaagtacacttattcgactttcatgccaatttatatggcaagcaactagaagtggaacttttgcataaacttcgagatgagcaaaagtttgagtcgtttgaagcacttaaacaacaaatcgaattggatgctgaagcagcaagggtgtggctgcgtcagcttaagcgttga

SEQ ID NO: 70606 - protein, 311 aa, Vibrio sp. Ex25
MELIRGIHNITPRHHGCVLTIGNFDGVHKGHQQVLQQVSEQADRLSLPSVVMTFEPQPMELFAKDKAPARLTRLRDKFVQLSKLDIDRLLCVNFNRHFASLTAEEFIRDLLVERLGVKFLVVGDDFCFGKGRTGNFAMLQEAGEKYGFDVVSTQSFCLQQLRVSSTAIRQALARDDLHSAQQMLGRNYSISGRVSHGRKLGRTIGFPTANIPLKRCVSPVSGVYVVQALGLGNKPVGGVANIGQRPTVNGVRQQLEVHLFDFHANLYGKQLEVELLHKLRDEQKFESFEALKQQIELDAEAARVWLRQLKR

SEQ ID NO: 70607 - DNA, 936 bp, Shewanella sp. ANA-3
  CDS (1)..(936): transl_table=11
atggaattaatccgcggtatacataacattttgtcatctcaccatggctgtgtgctgacgataggtaattttgatggcgtgcatcgcggccatgcacaggtgattgccaatctggtgcaaaaggccaagcagctttcattacctccgacagtgatgacatttgagcctcaaccacaggagttgttccgtggtgagaatgcgcccgcacgtttgagcttactgcgggacaaaatcatcctgttagatgagttaggcgttgaacggttagtgtgtgttaacttcaatcgtgcctttgcagatcaaccggctgagcatttcatcgaagaactgctggtgcgcaagctcggggtgaaatacctcgtcgttggcgatgacttttgcttcggtcaaggccgaaaaggcaattttgaaatgctgatgcaggcgggagctcgttatggctttaccgtggtaagcacccagagttttatggtgggctcgcaacgcgtgagttctactgcggtaagagaacaattggctaaaggaaacctagagcaggcgagacgcctactcggtcatccttttaccttaagcggccgcgtggcccatggccaaaaaattggccgcaccataggtttccccaccgccaatattgccctcaaacgcaatgtggtgcccgtgcgcggggtgtttgcggttaaactctattgggatgagagcgatatttatgaaggggttgccaacattggtttccgcccgactgtaaatggtcaagtttgtcagcttgaggtgcatctttttgattttgaaggtgacatttatggcaagcatgttgaggttgagttagtggcaaaacttcgcgatgaacaaccctttgattcattggatgcactaaaacaacagattttgaatgatgcaaatgaggccagagctttatttggtaacgatgcaggctga

SEQ ID NO: 70608 - protein, 311 aa, Shewanella sp. ANA-3
MELIRGIHNILSSHHGCVLTIGNFDGVHRGHAQVIANLVQKAKQLSLPPTVMTFEPQPQELFRGENAPARLSLLRDKIILLDELGVERLVCVNFNRAFADQPAEHFIEELLVRKLGVKYLVVGDDFCFGQGRKGNFEMLMQAGARYGFTVVSTQSFMVGSQRVSSTAVREQLAKGNLEQARRLLGHPFTLSGRVAHGQKIGRTIGFPTANIALKRNVVPVRGVFAVKLYWDESDIYEGVANIGFRPTVNGQVCQLEVHLFDFEGDIYGKHVEVELVAKLRDEQPFDSLDALKQQILNDANEARALFGNDAG

SEQ ID NO: 70609 - DNA, 936 bp, Shewanella sp. MR-7
  CDS (1)..(936): transl_table=11
atggaattaatccgcggtatacataacattttgtcatctcaccatggctgtgtgctgacgataggtaattttgatggcgtgcatcgcggccatgcacaggtggttgccaatctggtgcaaaaggccaagcagctctcattacctccgacagtgatgacatttgagcctcaaccacaggagttattccgtggtgagaatgcgcccgcgcgtctgagcttactgcgggataaaatcatcctgttagatgagttaggcgttgaacggttagtgtgtgttaacttcaaccgtgcctttgctgatcaaccggcggagcatttcatcgaagaactgttggtgcgcaagctcggggtgaaatacctcgtcgttggcgatgacttttgcttcggtcaaggccgaaaaggcaattttgaaatgctgatgcaggcgggagctcgttatggctttaccgtggttagcactcaaagttttatggtgggctcgcaacgtgtgagttcgaccgcggtaagagaacaattggctaaagggaacctagagcaggcgagacgcctactcggtcatccctttaccttaagcggtcgcgtggcccatggccaaaaaattggccgaaccataggttttcccaccgccaatattgccctcaaacgcaatgtggtgcccgtgcgcggggtgtttgcggtgaaactctattgggatgagagcgatatttatgaaggggttgccaacattggtttccgcccgaccgtaaatggtcaagtttgtcagctcgaggtgcatctttttgattttgaaggtgacatttatggcaagcatgttgaggttgagttagtggcaaaacttcgcgatgaacaaccctttgattcattggatgcactaaaacaacagattttgaatgatgcaaatgaggccagagctttatttggtaacgatgcaggctga

SEQ ID NO: 70610 - protein, 311 aa, Shewanella sp. MR-7
MELIRGIHNILSSHHGCVLTIGNFDGVHRGHAQVVANLVQKAKQLSLPPTVMTFEPQPQELFRGENAPARLSLLRDKIILLDELGVERLVCVNFNRAFADQPAEHFIEELLVRKLGVKYLVVGDDFCFGQGRKGNFEMLMQAGARYGFTVVSTQSFMVGSQRVSSTAVREQLAKGNLEQARRLLGHPFTLSGRVAHGQKIGRTIGFPTANIALKRNVVPVRGVFAVKLYWDESDIYEGVANIGFRPTVNGQVCQLEVHLFDFEGDIYGKHVEVELVAKLRDEQPFDSLDALKQQILNDANEARALFGNDAG

SEQ ID NO: 70611 - DNA, 969 bp, Alkalilimnicola ehrlichei MLHE-1
  CDS (1)..(969): transl_table=11
atggaactggtacgcggcctccacaatctgcagccccgccaccgcgggtgcgcgctgaccatcggcaatttcgatggcgtgcacttaggccatcaggccatgctcgacaccctggggcttgcggcgcagcgcttgggtgtaccgccgctgctgcttaccttcgagccgcacccgctggaggccctgcgcccggagcaggcgcccacgcgcatcacccccctgcgcgacaagctcgcggcgttggccgagaccccgctgcagcgggtggtggtggcacgcttcggcgcggccctcgccggcatgtcggcagaggccttcgtcgacgagctgctgatcggccggttgggcgtgcgccacctgctgatcggtgacgacttccgcttcggccgcgcccgccggggcgattatgccatgctggccgaggcctcgcgccggcacggcttcgagctggaccgcctggagaccctggccaccgaggacggtgagcgcatcagcagcacccgcgtacgtgccgccctggctgccggtgacctgggtgaggccgaggacctcctgggccgcccgtacaccctctccggccgggtggtgcggggtgatgccatcggccggcggcttggcttccgcaccgccaacatcgcctttcgcgccaaccagcggccggccctggggggcatcttcaccgtgagtgtggagggcgtggccgaccggccgctgcccggggtggccaatgtcgggacccgcccggcggtggggggcaaacggcacctgctggaggtgcatttgctggactggcaaggcagactatacggctgccatctgcaagtgcgattcctccagcggctgcgcgaggagtggcatttcgactcgctggatgcgctcagcgcccagatcggccgggacgtggaccaagcccgggccctgttcaatgacaaccctctttccgatccgaccccaaggaccgcgacgtga

SEQ ID NO: 70612 - protein, 322 aa, Alkalilimnicola ehrlichei MLHE-1
MELVRGLHNLQPRHRGCALTIGNFDGVHLGHQAMLDTLGLAAQRLGVPPLLLTFEPHPLEALRPEQAPTRITPLRDKLAALAETPLQRVVVARFGAALAGMSAEAFVDELLIGRLGVRHLLIGDDFRFGRARRGDYAMLAEASRRHGFELDRLETLATEDGERISSTRVRAALAAGDLGEAEDLLGRPYTLSGRVVRGDAIGRRLGFRTANIAFRANQRPALGGIFTVSVEGVADRPLPGVANVGTRPAVGGKRHLLEVHLLDWQGRLYGCHLQVRFLQRLREEWHFDSLDALSAQIGRDVDQARALFNDNPLSDPTPRTAT

SEQ ID NO: 70613 - DNA, 921 bp, Pseudoalteromonas tunicata D2
  CDS (1)..(921): transl_table=11
atggagctagtgagaggcgttcataacattagagaccgacatcgaggttgtgtcctcacaattggtaattttgatggtgtgcatttaggccatgttgcggtacttaatggtttaatcgccgatgcaaagcgacttgggttacctagtaccgtaatgctatttgaacctcagccacaagagttttttgccaaaaataatgcgcctgctcgcttaactcgtttacgagacaagcttactttattgaagaaaattggtatcgagcgtgttatttgtatccaattcaatgcaacttttgctaaattagcacctgaatattttgtagatgtaattttgcatcaaaaattaggtgtaaaagcactcacggtgggtgacgattttaaatttggcattaatcgcagtggtgattttaacttattgcagcaattaggcgagaagttaaatatttcagtgcaaaacacggctagctttcgtcagcaaaatagtcgtgttagtagcaccgctattcgtaaatcactcgaaaatgcggattttgctgcagcacaacagatgttgggtcactcttattctatttcaggtcgagtgatccatggttggaaaaagggtcgagagttaggttttccaacggctaacatagcgttaaaaagacaagtaagtccattacacggggtgtttgctgtgagtgtagcaaccgctaacgggattttacggggcgtagctaatattggctgtaaaccaacactcaatggtaaaaccacattattagaagtacatttatttgatttttcaggtgatttgtacggaaaatttattagcgtagaaatagttaaaaaactacgcgatgagcaaaaatttgacacgttagcgcaccttatttcacaaatccaagcagatgtgaaaattgctaaacagtgttttatttaa

SEQ ID NO: 70614 - protein, 306 aa, Pseudoalteromonas tunicata D2
MELVRGVHNIRDRHRGCVLTIGNFDGVHLGHVAVLNGLIADAKRLGLPSTVMLFEPQPQEFFAKNNAPARLTRLRDKLTLLKKIGIERVICIQFNATFAKLAPEYFVDVILHQKLGVKALTVGDDFKFGINRSGDFNLLQQLGEKLNISVQNTASFRQQNSRVSSTAIRKSLENADFAAAQQMLGHSYSISGRVIHGWKKGRELGFPTANIALKRQVSPLHGVFAVSVATANGILRGVANIGCKPTLNGKTTLLEVHLFDFSGDLYGKFISVEIVKKLRDEQKFDTLAHLISQIQADVKIAKQCFI

SEQ ID NO: 70615 - DNA, 963 bp, Photobacterium sp. SKA34
  CDS (1)..(963): transl_table=11
atggaattaattcgaggtatacataatattcaaccccagcatcatggctgtgtgttgactataggcaactttgacggtgttcatttagggcaccaagcattgctacgtcaagtggtagctaaagcccatgcgatgcaactttccgctacggtaatgacatttgagcctcagccgttagaattgtttgcaggagataaagcgccagcacgcttaacccgttttagagataaatatttacagctaaaaaaggtcggtattgatcgtttgttatgcgtgaattttaatcatcattttgccaccatgagcgctgaagatttcgtcgagtgcttgttggttaagcaattgggtgttaagtttcttgttattggcgatgattttcgctttggacaaggccgtaatggtgatttttccatgctagtggaagcgggacgaaaacatggctttgaggtagtaagtacccaaagtttttgtgtttcagagcagcgagtaagcagcactgccattcgtcaagcactagcaaagaatgaacttgaacaagctgaaatgatgcttggtcgaccttacagtattcgcggacgtgtctctcacggacgaaagttaggtcgaacgattggttttcctactgccaatatacctttaaaacgacgtgtaacgccggtagctggtgtttatgctgttgaagtgtatggtgcagatagtcgccctgttatgggggtggctaatgttggtcatcggccaaccgtaaaaggtgtacgccaacaacttgaagtgcacttatttgattttcaagctgatctctacggacatcagcttgaagtcgtgttacgccataaattgcgtgacgaaaagaaatttgaatccttcgatgcgcttaaacgccaaatcgagcgagatgctcaagcagcacgggtgtggctgtctgagcgtaataatgtccaacttcgcccaagtaacggaatctag

SEQ ID NO: 70616 - protein, 320 aa, Photobacterium sp. SKA34
MELIRGIHNIQPQHHGCVLTIGNFDGVHLGHQALLRQVVAKAHAMQLSATVMTFEPQPLELFAGDKAPARLTRFRDKYLQLKKVGIDRLLCVNFNHHFATMSAEDFVECLLVKQLGVKFLVIGDDFRFGQGRNGDFSMLVEAGRKHGFEVVSTQSFCVSEQRVSSTAIRQALAKNELEQAEMMLGRPYSIRGRVSHGRKLGRTIGFPTANIPLKRRVTPVAGVYAVEVYGADSRPVMGVANVGHRPTVKGVRQQLEVHLFDFQADLYGHQLEVVLRHKLRDEKKFESFDALKRQIERDAQAARVWLSERNNVQLRPSNGI

SEQ ID NO: 70617 - DNA, 933 bp, Oceanospirillum sp. MED92
  CDS (1)..(933): transl_table=11
atggaactgattcgcggattacataacctgcgcgaaaagcaccggggttgcgtggcaaccatcggtaattttgatggcgtgcatttaggccatcgtcaggtactggcacaggttaaagctaaggctcaagagctggggttgccttcggttgtgatcacgtttgagcctcagccgcgcgagttttttgccggtgataaggcgccgcctcgattgacccgttttagtgaaaagtaccgtttgctgcaagcggaaggtatggatcggcacctctgcctgactttcaatgaacgtttacgttcaatgactgctgagcagtttgtcgaagaattgctgctgcgagggcttgctgtagaacacttcgtggtgggtgatgactttcgctttggctgtgaccgctcgggtgattacgagatgttaagccaggcgggtgagcgtcacggctttacggtggtgaacactgagacctttctgagtgaagaagaacgggtcagtagtacgcgacttcgtcatgtgcttgaagcaaatgaccttgcgactgcagcagcgttacttggtcgtccgtataccgtgtctggacgcgtgatgcatggccagaaactcggtcgtcagttgggcgtacctactgcaaatgtgagaatgcaccgtttcccttgtccgctgcgtggtgtttatgcggtggaagtaaccgggcagacgttgaaagctcaaggtgtgtgtaatgttgggttaagaccgacggtatgtggtcagcagcctgttttggaaacacatctgtttgattttgataaagatatttatgggcagttactgactgtcgagtttaagcaatttatccgtgaggaacgaaagtttgacggcatagatcagcttaaagagcagatttttaaagatattgaagaagtgcgggactatttctcccgtaccagtcgttaa

SEQ ID NO: 70618 - protein, 310 aa, Oceanospirillum sp. MED92
MELIRGLHNLREKHRGCVATIGNFDGVHLGHRQVLAQVKAKAQELGLPSVVITFEPQPREFFAGDKAPPRLTRFSEKYRLLQAEGMDRHLCLTFNERLRSMTAEQFVEELLLRGLAVEHFVVGDDFRFGCDRSGDYEMLSQAGERHGFTVVNTETFLSEEERVSSTRLRHVLEANDLATAAALLGRPYTVSGRVMHGQKLGRQLGVPTANVRMHRFPCPLRGVYAVEVTGQTLKAQGVCNVGLRPTVCGQQPVLETHLFDFDKDIYGQLLTVEFKQFIREERKFDGIDQLKEQIFKDIEEVRDYFSRTSR

SEQ ID NO: 70619 - DNA, 951 bp, Xanthobacter autotrophicus Py2
  CDS (1)..(951): transl_table=11
atgacaggtgatctctcctccaacttcctcctggtgcgcggccacgcacagcttccgcccgccctggcgcggccggtggtggccatcggcaatttcgacggggtgcatcgcggccaccgggccgtgttcgacaccgcccgcgccatggccgccgaggccggcgtgccggccattgccgtcaccttcgagccccatccgcgcaccttcttcaatcccgcttcggcgccgttccgcctgacccccgaggcgcgcaagctgcgccacatcgccgaaagcgggctgcagggcgccgtcgtgctgcccttcgacgcccagcttgccgccatggaggcggaggatttcgtgcgcgaggtcctggtgggccgctacaatgtcaccggcgtgtcggtgggcttcgacttccatttcggccgcgcccgcgccggctccccggctttccttgaggacgcgggacggcggcacggcttcaaggtcaccgtggtgccccccatgcgcgacgaggacgacgccatctcctccaccgccatccgcagcgcgctggcatcgggacaggtgggccatgcggcgcacatgctgggccggccgttcgcggtggcggccgaggtgatccacggcgacaagcgcggccgcaccatcggctttcccaccgccaacctcgccctcgccgaggacatggacctcgccttcggcatctatgcggtgcgcgcggcaacgccgctcgggcgcttcgacggggtcgccaattacggccgccgtcccaccttcgacaatggacgccccctactggaggtgcacctgttcgacttttccggcgatctctacggcgcgacgctggaagtggaattccacgcctacctgcggccggagctgaaattcgacggtatcgacgccctcgtcgcccagatcgcggccgatgcgcggcaggcccgcgaggttctcgccaaggtttga

SEQ ID NO: 70620 - protein, 316 aa, Xanthobacter autotrophicus Py2
MTGDLSSNFLLVRGHAQLPPALARPVVAIGNFDGVHRGHRAVFDTARAMAAEAGVPAIAVTFEPHPRTFFNPASAPFRLTPEARKLRHIAESGLQGAVVLPFDAQLAAMEAEDFVREVLVGRYNVTGVSVGFDFHFGRARAGSPAFLEDAGRRHGFKVTVVPPMRDEDDAISSTAIRSALASGQVGHAAHMLGRPFAVAAEVIHGDKRGRTIGFPTANLALAEDMDLAFGIYAVRAATPLGRFDGVANYGRRPTFDNGRPLLEVHLFDFSGDLYGATLEVEFHAYLRPELKFDGIDALVAQIAADARQAREVLAKV

SEQ ID NO: 70621 - DNA, 936 bp, marine gamma proteobacterium HTCC2207
  CDS (1)..(936): transl_table=11
ttgacctttgttcgcggtttgcacaacctgcaaactccagatgaaaaatcggtggtcaccatcggttctttcgatggtgtgcatattggtcatcaggcaattttgcgtcaggtaaaagaggcctcgcagcgtttgcaactaccttcggtggccatgacctttgagccgcagccaaaagagtacttttctgctgagcaggcaccagcgcgattgatgagattgcgtgaaaaaattgatacgttgctcgaattgggcgtggattcagtggtttgtctgcagtttaatcgtcgactacgcaacctctctgcggcggattttattgatcaggtgttggtccgcggtttggcggtaagacatctaatcgtcggtgatgattttcattttggctgtgatcgcagcggtgactttgcccgtttgcagcaaaagggcgagcagtgcgggttcgatgtgcatgacacggccacggtcgaagttgaagggcagcgggtaagtagcaccttggtgcgcgaggtggttgagcaagcggattttccccgtgccgcggcgctgctcggacgacctttttcgattagcggtgttgtcggttatggccaacagctcggacgtgaactaggctttcccactgctaacgtgcagctatgtcgttttagtgcgccattgtctggtgtctttgcggtgcaggtaaatgttgcaggtacgctttaccgcggtgctgctaatgtcggcttgcgacccacagtgggggatttggtcaagccaattttagaggtgcacctgctggatttcgccggtgatctctacggtcagcgaatcgcagtcgagtttttgcacaaaatccgtgatgaagagaaatttaccacggttgaaaaactggtggagacaatcactgcagatatcaacattatccgccagtggtttttgcacaatgaaaaatag

SEQ ID NO: 70622 - protein, 311 aa, marine gamma proteobacterium HTCC2207
MTFVRGLHNLQTPDEKSVVTIGSFDGVHIGHQAILRQVKEASQRLQLPSVAMTFEPQPKEYFSAEQAPARLMRLREKIDTLLELGVDSVVCLQFNRRLRNLSAADFIDQVLVRGLAVRHLIVGDDFHFGCDRSGDFARLQQKGEQCGFDVHDTATVEVEGQRVSSTLVREVVEQADFPRAAALLGRPFSISGVVGYGQQLGRELGFPTANVQLCRFSAPLSGVFAVQVNVAGTLYRGAANVGLRPTVGDLVKPILEVHLLDFAGDLYGQRIAVEFLHKIRDEEKFTTVEKLVETITADINIIRQWFLHNEK

SEQ ID NO: 70623 - DNA, 933 bp, Rickettsiella grylli
  CDS (1)..(933)
atgactgaactgattcgcaatagttataatataaaaccgagacagtatggttgcgtagccactatcggaaactttgatggattgcaccgagggcaccaaaaggttatccaatcgttaatcaagcttgctcgacaatttcacagaccgacgtgtgtgattatttttgaaccacatccgcaagagtttttttatcgcgaaaatgcacctgcgcgtttaatgcggtttcgtgaaaaatttaaatctttacaagcgttaggaatcgatcgcgtgctttgcttacggtttaataaacgtctagcagaatgcagcgcaacggattttgttaaaaaaattttaattgaaaaattaggaataaaaggcttaatgattggggatgattttcgtttcggtaaagcgcgtcaaggtgattgggtgttgttgaaaaatctcggtcgcgaatatggatttaaagtgttttcaacgcccacccttttatttgacaacgaacgtattggtagctcgcgcgtaaggaatgcagtaaaacaagccgattttaaattagcagaacggttgctaggccattcgtttacactcagtggtcgagtcatttatggcgatcaacgtggacgattacttggttttccgacggctaacgttggattacatcggcggatagcccccctagaaggcgtatttattgtaaaggtttatggtttagcatcaatacccattgcgggagttgccaattgtggtacacgtccaacaatgaatggattgaaaaatttattagaagtttatttatttgattttaaccgaacgatttatggccaatttatcgaaatagaatttttagaaaaaatacgcgatgaaaaaaaatttgagagtatagaaacactcaaacaacgcattgcgaaagatgtagcgacagcaaaagaatattttataaaaaattaa

SEQ ID NO: 70624 - protein, 310 aa, Rickettsiella grylli
MTELIRNSYNIKPRQYGCVATIGNFDGLHRGHQKVIQSLIKLARQFHRPTCVIIFEPHPQEFFYRENAPARLMRFREKFKSLQALGIDRVLCLRFNKRLAECSATDFVKKILIEKLGIKGLMIGDDFRFGKARQGDWVLLKNLGREYGFKVFSTPTLLFDNERIGSSRVRNAVKQADFKLAERLLGHSFTLSGRVIYGDQRGRLLGFPTANVGLHRRIAPLEGVFIVKVYGLASIPIAGVANCGTRPTMNGLKNLLEVYLFDFNRTIYGQFIEIEFLEKIRDEKKFESIETLKQRIAKDVATAKEYFIKN

SEQ ID NO: 70625 - DNA, 972 bp, Oceanobacter sp. RED65
  CDS (1)..(972): transl_table=11
gtggataaagtcccttataatgcggccttttatcctgaagacgttatgctgttttatcgcggactacacaatacgagacccggttcagaaggctgtgtgctgaccattggtaatttcgatggtgttcacttgggccaccaagcattactggataaagtaaaagccaaaggcgaagagttgagcctgcagacagcggtcatgatattcgagccgcagccgaaagaatttttcgatcccgatggtgcgccggctcggctttgcaatcttgcagaaaagatacaattatttcagcggcaaaatatcgatgtcttggcctgcatggcgttcaacccacgttttcgacaactcaccgcggaagccttcgtacaacaggtactgattgatgcgctcaatgtgaaggcattaatcgtaggcgatgatttccgctttggttgcgaccgttccggtgatttcgcatttttgcaggaggccggtgaacgttatgggttcagcgttgaggatactcaaaccattgctcaatcgggtaatcgcgttagcagtacccgtgtccgccaagctttagaagagggtcgtttgctggacgctgccgagttattggggcgtccttatagtatcagtgggcgtatagctcatgggcaaaagcttggacggactataggaacgcccacggctaatgtgattctcaaacgagagaaagcaccgttacggggtgtatttgcagtgaaagtgatctgcaagcaaggtgagttcaagggtgtagctaatatcggtacacgcccaaccgttggcggagtgaaagccaatttagaagcacacctttttgatttttccggcgacctttatggtcaaaggatagacgtgattttttgtgaaaaaattcgtgatgagaaacgctttgacggcattgatgctttaaaagcggccatcgaacaagatagacaattggccaaggcctattttaacaaacagtaa

SEQ ID NO: 70626 - protein, 323 aa, Oceanobacter sp. RED65
MDKVPYNAAFYPEDVMLFYRGLHNTRPGSEGCVLTIGNFDGVHLGHQALLDKVKAKGEELSLQTAVMIFEPQPKEFFDPDGAPARLCNLAEKIQLFQRQNIDVLACMAFNPRFRQLTAEAFVQQVLIDALNVKALIVGDDFRFGCDRSGDFAFLQEAGERYGFSVEDTQTIAQSGNRVSSTRVRQALEEGRLLDAAELLGRPYSISGRIAHGQKLGRTIGTPTANVILKREKAPLRGVFAVKVICKQGEFKGVANIGTRPTVGGVKANLEAHLFDFSGDLYGQRIDVIFCEKIRDEKRFDGIDALKAAIEQDRQLAKAYFNKQ

SEQ ID NO: 70627 - DNA, 942 bp, Buchnera aphidicola subsp
  CDS (1)..(942): transl_table=11
atgaagattatacgaggtattcataatatcaaggaaataaattctaattcagttgttactattggaaattttgatgggatacatttaggtcatcaaaaattgttttcacatatatatcaaataggtcaaaaatataaattatcaactatagttgttttatttgaaccccaaccgttagaatttttaagaaaaaataatgctcctgttcggattacaaagttccgtgagaaaataagacgtattagttcctacaattttgatagtatattgtgtgttaaatttaataaatcttttcaatctctaagtgcaaaagattttatcataaatatattaataaataaactacacttaaaatttatagtcataggaaatgattttagatttggctttcaaagaaacggcaatatcaatctattaaaaaaactaggatataaatatcaatttaacgtcataaaaattcgaccattatataaaaacaatataaaaatcagtagtactaatattagaaaagcattatctgaaaataatataaaattagcttctcttctcctgggtcgtgtatttagcatatctggcagagtaatccatggaaataaaataggaagaaccatgaattatcctacagcaaatatacttttaagtaaaaattttttattaactaatggagtatatgcagttaaaataaaatattgcccgaataaatacgccataggaatttctaatattggaatcaaacctagtttttccaatactcaaaaaaataaattacttgaagtgtatttgtttgacataaaaattgatttatacggaaaatatatagaaatttttatatataaaaaaatacgggatgaacaattttttccttcaaaaaaagaattaaaaaatcaaatatcacaagatattttaatagttcaaaaatattttaacattcataaaaattaa

SEQ ID NO: 70628 - protein, 313 aa, Buchnera aphidicola subsp
MKIIRGIHNIKEINSNSVVTIGNFDGIHLGHQKLFSHIYQIGQKYKLSTIVVLFEPQPLEFLRKNNAPVRITKFREKIRRISSYNFDSILCVKFNKSFQSLSAKDFIINILINKLHLKFIVIGNDFRFGFQRNGNINLLKKLGYKYQFNVIKIRPLYKNNIKISSTNIRKALSENNIKLASLLLGRVFSISGRVIHGNKIGRTMNYPTANILLSKNFLLTNGVYAVKIKYCPNKYAIGISNIGIKPSFSNTQKNKLLEVYLFDIKIDLYGKYIEIFIYKKIRDEQFFPSKKELKNQISQDILIVQKYFNIHKN

SEQ ID NO: 70629 - DNA, 939 bp, Buchnera aphidicola subsp
  CDS (1)..(939): transl_table=11
atgaagctcatacgaggcattcataatctaaaaaaaataaattctaattcagctgtaagtattggaaattttgatggagtacatctaggacatcaaaaattactttctaatttatacaaaataggaaaaaaaaacaacatattaactgtacttatcttatttgaaccacaaccattagaatttttaaacaataaaaactctcctaaaagacttacaacaatacaaaataaaattaaatacattcaatcatggaaaattgatattattttatgtattaaattcaatgaatctttttcatctttaagcgcagaaaaatttataaaaaatattttaataacaaaattgaatataaaatttataataattggagatgattttagattcggatcaaaaagaaatggaaatatatctctcttaaaagaaattggatatcaatataactttaaagttatagaaatcagttcattattatataaaaataaaattaaaataagcagcactaatataagaaaatgtttattagaaaacaaaattgaactagcaagaaaattacttggtcgaccatttagtatctcaggtcgtgtaattcacgggaataaaataggacgaaaattaggatatccaactgcaaatatatcattacgtaaaaatatacctttaaataacggagtatacgctgtaaaaatctcctgtttttttaataaaaaatttgtaggaatatgtaatattggaattaaaccaagttatttttcttctaaaaaacatagacttcttgaagtccacttattcaattttaatttgaatctatatgaagaaaaaatagaagtttttttatacaaaaaaataagaaatgaatgttttttttcttctaaaaacaaattaaaagaacaaatttcaaaagatattgaaattgttaaaaaatattttaacctaatttaa

SEQ ID NO: 70630 - protein, 312 aa, Buchnera aphidicola subsp
MKLIRGIHNLKKINSNSAVSIGNFDGVHLGHQKLLSNLYKIGKKNNILTVLILFEPQPLEFLNNKNSPKRLTTIQNKIKYIQSWKIDIILCIKFNESFSSLSAEKFIKNILITKLNIKFIIIGDDFRFGSKRNGNISLLKEIGYQYNFKVIEISSLLYKNKIKISSTNIRKCLLENKIELARKLLGRPFSISGRVIHGNKIGRKLGYPTANISLRKNIPLNNGVYAVKISCFFNKKFVGICNIGIKPSYFSSKKHRLLEVHLFNFNLNLYEEKIEVFLYKKIRNECFFSSKNKLKEQISKDIEIVKKYFNLI

SEQ ID NO: 70631 - DNA, 936 bp, Pseudomonas fluorescens
  CDS (1)..(936): transl_table=11
atgcagctggttcgaggtctccacaacctgcgccccgagcatcggggctgcgtcgccactattggcaactttgacggtgttcaccgtggccaccaggctatcctggcaaggctgcgcgagcgtgcggtcgagttgggtgtgcccagctgcgtggtgattttcgagccacaaccgcgggagttctttaccccggaaacagcgccggcccgcttggcgcttgcgcgacaagctgcaactgctggcggagagggcgtggaccgcgtcctctgcctggctttcaaccagcgtttgcgcagcctcagcgccgccgagttcgtcgaccgcattctggtcgatggcctgggtgtacaacacctggaggttggtgacgacttccatttcggttgcgatcgggtcggggatttcgatttcctgcaacatgccggcgtcaaccagggctttaccgttgaagccgcccaaaccgtcgaactggacggcctgcgtgtgagcagcacccaggtgcgtaacgccttggctgccgccgacttcgacctggccgagcgtttgctcggtcgcccgttccgcattgccgggcgggtactgcacggccagaagctggcgcgccaattgggcacgccaactgccaacgtgcaactcaagcgccgccgagtgccgctgactggggtttacctggtgagcgtcgacatcgacggccaatcgtggccgggagtcgccaatataggcgtcaggcccacggttgcaggtgatggcaaggcccacctggaagttcaccttttggattttgccggtgatttatacgaccggcgtttgacggtggttttccaccagaagctgcgtgaagagcagcgtttcgcctccctggaggcgttgaaaacggcgatcaatgcggatgtcgccgccgcccgtgcactagccgcacctagcgcccatcgctaa

SEQ ID NO: 70632 - protein, 311 aa, Pseudomonas fluorescens
MQLVRGLHNLRPEHRGCVATIGNFDGVHRGHQAILARLRERAVELGVPSCVVIFEPQPREFFTPETAPARLALARQAATAGGEGVDRVLCLAFNQRLRSLSAAEFVDRILVDGLGVQHLEVGDDFHFGCDRVGDFDFLQHAGVNQGFTVEAAQTVELDGLRVSSTQVRNALAAADFDLAERLLGRPFRIAGRVLHGQKLARQLGTPTANVQLKRRRVPLTGVYLVSVDIDGQSWPGVANIGVRPTVAGDGKAHLEVHLLDFAGDLYDRRLTVVFHQKLREEQRFASLEALKTAINADVAAARALAAPSAHR

SEQ ID NO: 70633 - protein, 50 aa, Artificial sequence
  (1)..(50): protein
ATGAAGCTGATACGCGGCATACBREVTTAAGCCGGTTTTGTTAGCCCAAA

SEQ ID NO: 70634 - DNA, 24 bp, Artificial sequence
  primer
ttaagccggttttgttagcccaaa

SEQ ID NO: 70635 - protein, 423 aa, Artificial sequence
  consensus sequence
  Variant (2)..(13): Xaa in position 2 to 13 is any amino acid
  Variant (14)..(23): Xaa in position 14 to 23 is any or no amino acid
  Variant (32)..(32): Xaa in position 32 is any amino acid
  Variant (35)..(51): Xaa in position 35 to 51 is any amino acid
  Variant (52)..(105): Xaa in position 52 to 105 is any or no amino acid
  Variant (109)..(109): Xaa in position 109 is any amino acid
  Variant (111)..(111): Xaa in position 111 is any amino acid
  Variant (113)..(113): Xaa in position 113 is any amino acid
  Variant (115)..(118): Xaa in position 115 to 118 is any amino acid
  Variant (119)..(130): Xaa in position 119 to 130 is any or no amino acid
  Variant (132)..(132): Xaa in position 132 is any amino acid
  Variant (134)..(137): Xaa in position 134 to 137 is any amino acid
  Variant (139)..(139): Xaa in position 139 is any amino acid
  Variant (141)..(143): Xaa in position 141 to 143 is any amino acid
  Variant (145)..(147): Xaa in position 145 to 147 is any amino acid
  Variant (149)..(149): Xaa in position 149 is any amino acid
  Variant (150)..(150): Xaa in position 150 is any or no amino acid
  Variant (152)..(157): Xaa in position 152 to 157 is any amino acid
  Variant (159)..(168): Xaa in position 159 to 168 is any amino acid
  Variant (169)..(169): Xaa in position 169 is any or no amino acid
  Variant (171)..(173): Xaa in position 171 to 173 is any amino acid
  Variant (174)..(174): Xaa in position 174 is any or no amino acid
  Variant (176)..(177): Xaa in position 176 to 177 is any amino acid
  Variant (178)..(178): Xaa in position 178 is any or no amino acid
  Variant (180)..(186): Xaa in position 180 to 186 is any amino acid
  Variant (188)..(188): Xaa in position 188 is any amino acid
  Variant (191)..(191): Xaa in position 191 is any amino acid
  Variant (194)..(195): Xaa in position 194 to 195 is any amino acid
  Variant (197)..(197): Xaa in position 197 is any amino acid
  Variant (199)..(202): Xaa in position 199 to 202 is any amino acid
  Variant (204)..(221): Xaa in position 204 to 221 is any amino acid
  Variant (222)..(243): Xaa in position 222 to 243 is any or no amino acid
  Variant (246)..(248): Xaa in position 246 to 248 is any amino acid
  Variant (250)..(251): Xaa in position 250 to 251 is any amino acid
  Variant (253)..(259): Xaa in position 253 to 259 is any amino acid
  Variant (261)..(263): Xaa in position 261 to 263 is any amino acid
  Variant (266)..(271): Xaa in position 266 to 271 is any amino acid
  Variant (273)..(273): Xaa in position 273 is any amino acid
  Variant (275)..(276): Xaa in position 275 to 276 is any amino acid
  Variant (278)..(280): Xaa in position 278 to 280 is any amino acid
  Variant (283)..(284): Xaa in position 283 to 284 is any amino acid
  Variant (286)..(286): Xaa in position 286 is any amino acid
  Variant (287)..(294): Xaa in position 287 to 294 is any or no amino acid
  Variant (299)..(308): Xaa in position 299 to 308 is any amino acid
  Variant (309)..(310): Xaa in position 309 to 310 is any or no amino acid
  Variant (312)..(314): Xaa in position 312 to 314 is any amino acid
  Variant (316)..(325): Xaa in position 316 to 325 is any amino acid
  Variant (326)..(351): Xaa in position 326 to 351 is any or no amino acid
  Variant (355)..(356): Xaa in position 355 to 356 is any amino acid
  Variant (358)..(358): Xaa in position 358 is any amino acid
  Variant (362)..(368): Xaa in position 362 to 368 is any amino acid
  Variant (369)..(370): Xaa in position 369 to 370 is any or no amino acid
  Variant (376)..(376): Xaa in position 376 is any amino acid
  Variant (378)..(382): Xaa in position 378 to 382 is any amino acid
  Variant (383)..(387): Xaa in position 383 to 387 is any or no amino acid
  Variant (390)..(393): Xaa in position 390 to 393 is any amino acid
  Variant (395)..(398): Xaa in position 395 to 398 is any amino acid
  Variant (400)..(400): Xaa in position 400 is any amino acid
  Variant (402)..(402): Xaa in position 402 is any amino acid
  Variant (404)..(405): Xaa in position 404 to 405 is any amino acid
  Variant (407)..(411): Xaa in position 407 to 411 is any amino acid
  Variant (413)..(415): Xaa in position 413 to 415 is any amino acid
  Variant (417)..(418): Xaa in position 417 to 418 is any amino acid
  Variant (420)..(422): Xaa in position 420 to 422 is any amino acid
RXXXXXXXXXXXXXXXXXXXXXXIGNFDGVHXGHXXXXXXXXXXXXXXXXXXXXXXXXXXXXXXXXXXXXXXXXXXXXXXXXXXXXXXXXXXXXXXXXXXXXXXXFEPXPXEXFXXXXXXXXXXXXXXXXPXRXXXXRXKXXXLXXXGXXDXXXXXXFXXXXXXXXXXXFXXXXLXXXLXXXXXXXGXDFXFGXXRXGXXXXLXXXXXXXXXXXXXXXXXXXXXXXXXXXXXXXXXXXXXXXXSSXXXRXXLXXXXXXXAXXXLGXXXXXXGXVXXGXXXGRXXGXXXXXXXXXPTANXXXXXXXXXXXXGXXXVXXXXXXXXXXXXXXXXXXXXXXXXXXXXXXXXXXXXGVAXXGXRPTXXXXXXXXXLEVHLXDXXXXXXXXXXYGXXXXVXXXXKXRXEXXFXXXXXLXXXIXXDXXXA

SEQ ID NO: 70636 - protein, 48 aa, Artificial sequence
  protein pattern
  Variant (2)..(2): Xaa in position 2 is Ser or Thr
  Variant (3)..(3): Xaa in position 3 is any amino acid
  Variant (4)..(4): Xaa in position 4 is Ile, Leu or Val
  Variant (5)..(5): Xaa in position 5 is Lys or Arg
  Variant (6)..(7): Xaa in position 6 to 7 is any amino acid
  Variant (8)..(8): Xaa in position 8 is Ile, Leu or Val
  Variant (9)..(10): Xaa in position 9 to 10 is any amino acid
  Variant (11)..(11): Xaa in position 11 is Ala, Asp, Gly, Asn or Ser
  Variant (12)..(15): Xaa in position 12 to 15 is any amino acid
  Variant (17)..(18): Xaa in position 17 to 18 is any amino acid
  Variant (19)..(19): Xaa in position 19 is any or no amino acid
  Variant (21)..(21): Xaa in position 21 is any or no amino acid
  Variant (23)..(28): Xaa in position 23 to 28 is any amino acid
  Variant (30)..(30): Xaa in position 30 is any amino acid
  Variant (32)..(33): Xaa in position 32 to 33 is any amino acid
  Variant (35)..(37): Xaa in position 35 to 37 is any amino acid
  Variant (38)..(38): Xaa in position 38 is Ala or Gly
  Variant (40)..(41): Xaa in position 40 to 41 is any amino acid
  Variant (42)..(42): Xaa in position 42 is Asp, Gly or Asn
  Variant (43)..(44): Xaa in position 43 to 44 is any amino acid
  Variant (46)..(46): Xaa in position 46 is any amino acid
  Variant (48)..(48): Xaa in position 48 is Ile, Leu or Val
SXXXXXXXXXXXXXXAXXXLXGXXXXXXGXVXXGXXXXRXXXXXTXNX

SEQ ID NO: 70637 - protein, 14 aa, Artificial sequence
  protein pattern
  Variant (6)..(6): Xaa in position 6 is Leu or Val
  Variant (8)..(8): Xaa in position 8 is any amino acid
  Variant (11)..(12): Xaa in position 11 to 12 is any amino acid
  Variant (13)..(13): Xaa in position 13 is Ile, Leu, Met or Val
  Variant (14)..(14): Xaa in position 14 is Phe, Ile, Leu or Val
GNFDGXHXGHXXXX

SEQ ID NO: 70638 - protein, 32 aa, Artificial sequence
  protein pattern
  Variant (2)..(2): Xaa in position 2 is Asp or Gly
  Variant (3)..(4): Xaa in position 3 to 4 is any amino acid
  Variant (5)..(5): Xaa in position 5 is Ile, Leu or Val
  Variant (6)..(6): Xaa in position 6 is any amino acid
  Variant (7)..(7): Xaa in position 7 is Ile or Val
  Variant (8)..(8): Xaa in position 8 is any amino acid
  Variant (9)..(9): Xaa in position 9 is Phe, Ile or Leu
  Variant (10)..(13): Xaa in position 10 to 13 is any amino acid
  Variant (14)..(14): Xaa in position 14 is His or Arg
  Variant (15)..(15): Xaa in position 15 is any amino acid
  Variant (17)..(18): Xaa in position 17 to 18 is any amino acid
  Variant (19)..(19): Xaa in position 19 is Phe or Tyr
  Variant (20)..(20): Xaa in position 20 is any amino acid
  Variant (21)..(21): Xaa in position 21 is Asp, Gly, Asn, Ser or Thr
  Variant (22)..(24): Xaa in position 22 to 24 is any amino acid
  Variant (26)..(28): Xaa in position 26 to 28 is any amino acid
  Variant (30)..(31): Xaa in position 30 to 31 is any amino acid
YXXXXXXXXXXXXXXEXXXXXXXXLXXXIXXD

SEQ ID NO: 70639 - protein, 30 aa, Artificial sequence
  protein pattern
  Variant (2)..(4): Xaa in position 2 to 4 is any amino acid
  Variant (6)..(9): Xaa in position 6 to 9 is any amino acid
  Variant (10)..(10): Xaa in position 10 is Phe, Ile, Leu, Met or Val
  Variant (11)..(11): Xaa in position 11 is any amino acid
  Variant (12)..(12): Xaa in position 12 is Ile, Leu or Val
  Variant (14)..(14): Xaa in position 14 is any or no amino acid
  Variant (16)..(18): Xaa in position 16 to 18 is any amino acid
  Variant (19)..(19): Xaa in position 19 is any or no amino acid
  Variant (21)..(22): Xaa in position 21 to 22 is any amino acid
  Variant (24)..(24): Xaa in position 24 is any amino acid
  Variant (26)..(29): Xaa in position 26 to 29 is any amino acid
  Variant (30)..(30): Xaa in position 30 is Phe or Leu
LXXXLXXXXXXXGXDXXXXGXXRXGXXXXX

SEQ ID NO: 70640 - DNA, 732 bp, Escherichia coli
  CDS (1)..(732)
atgagcactgcaattacacgccagatcgttctcgataccgaaaccaccggtatgaaccagattggtgcgcactatgaaggccacaagatcattgagattggtgccgttgaagtggtgaaccgtcgcctgacgggcaataacttccatgtttatctcaaacccgatcggctggtggatccggaagcctttggcgtacatggtattgccgatgaatttttgctcgataagcccacgtttgccgaagtagccgatgagttcatggactatattcgcggcgcggagttggtgatccataacgcagcgttcgatatcggctttatggactacgagttttcgttgcttaagcgcgatattccgaagaccaatactttctgtaaggtcaccgatagccttgcggtggcgaggaaaatgtttcccggtaagcgcaacagcctcgatgcgttatgtgctcgctacgaaatagataacagtaaacgaacgctgcacggggcattactcgatgcccagatccttgcggaagtttatctggcgatgaccggtggtcaaacgtcgatggcttttgcgatggaaggagagacacaacagcaacaaggtgaagcaacaattcagcgcattgtacgtcaggcaagtaagttacgcgttgtttttgcgacagatgaagagattgcagctcatgaagcccgtctcgatctggtgcagaagaaaggcggaagttgcctctggcgagcataa

SEQ ID NO: 70641 - protein, 243 aa, Escherichia coli
MSTAITRQIVLDTETTGMNQIGAHYEGHKIIEIGAVEVVNRRLTGNNFHVYLKPDRLVDPEAFGVHGIADEFLLDKPTFAEVADEFMDYIRGAELVIHNAAFDIGFMDYEFSLLKRDIPKTNTFCKVTDSLAVARKMFPGKRNSLDALCARYEIDNSKRTLHGALLDAQILAEVYLAMTGGQTSMAFAMEGETQQQQGEATIQRIVRQASKLRVVFATDEEIAAHEARLDLVQKKGGSCLWRA

SEQ ID NO: 70642 - DNA, 723 bp, Mesorhizobium loti MAFF303099
  CDS (1)..(723): transl_table=11
atgcgcgagatcatcttcgatacggaaaccaccggccttgattcgcgcgacgaccgcgtgatcgagttgggcggcgtcgaactcgtcaaccgtttcccgaccggcaggacgttccatcactatatcaacccgcaaggccgcgcgatccacgaggaggcgcaggcggtgcacggcatcagcgcggcggatctcgcgggcaagccgacctttgccgaaatcgctgaggaatggctgaccttcaccgatggcgccaagctggtcgcgcacaacgccactttcgacatcggcttcctcaatgtcgaattcggccggctcggccatcccgtcgtcgatcccggccgtgtcgtcgacacgctggcgctggcgcgccgcaagcatccgatgggtcccaattcgctcgatgcgctctgccggcgctacggcatcgacaatacgaagcgcaccaagcacggcgcgctgctcgattccgaattgctggccgaggtctatatcgagctgatcggcggcaagcaggcggcgctcatcctcgacagcgccaccgcgccggcacagggcgagaatgtcaggcacatcgagatcatcgtcgcagagcgcccgaggccgctgctgccgcgcctgaccgaagcggagcgcgccgcgcatgccgccatggtcgccacgctcggcgaaaaggcgctctggctgaaagccaactcctccgaaaagagcatcgcggcgtcgtaa

SEQ ID NO: 70643 - protein, 240 aa, Mesorhizobium loti MAFF303099
MREIIFDTETTGLDSRDDRVIELGGVELVNRFPTGRTFHHYINPQGRAIHEEAQAVHGISAADLAGKPTFAEIAEEWLTFTDGAKLVAHNATFDIGFLNVEFGRLGHPVVDPGRVVDTLALARRKHPMGPNSLDALCRRYGIDNTKRTKHGALLDSELLAEVYIELIGGKQAALILDSATAPAQGENVRHIEIIVAERPRPLLPRLTEAERAAHAAMVATLGEKALWLKANSSEKSIAAS

SEQ ID NO: 70644 - DNA, 744 bp, Vibrio cholerae O1 biovar eltor str. N16961
  CDS (1)..(744): transl_table=11
atgaatactagcaacaatgcagaataccaacgcatcgtggtgctcgataccgaaaccacgggtatgaaccgcgaaggcggcccccattacgagggacatcgaattattgagatcggtgcagttgaaattatcaaccgtaaactcaccggacggcattttcacgtctacttaaaaccagatcgcgatattcaattagaggcgattgaagttcacggtattaccgatgagtttctaaaagataagcccgagtacaaagatgtccatgaggagtttgtagacttcatcaaaggggccgagctggttgcccacaatgcaccgtttgacgtcggctttatggattacgagtttgctaaactcggtggtgcgatcggtaaaaccagcgatttttgcaaagtgaccgatactttggcgatggccaagcggattttccccggtaaacgcaataacttggatatcttgtgtgagcgttacggcattgataactcacaccgaaccctgcacggcgctttgctcgatgcggagattctagccgacgtttatctattgatgaccggtgggcagacttcactgcaattttcatcggtcacgcaaaatagtggggaattgagcgcagaatcgttaaaacgtgctcgttcagagcgaaaagcgttaaaggttttagcggctagcgccgatgaactacaagcacatcaagatcgtttggacatagtggccaaaagtggcacttgcctatggcgtagttag

SEQ ID NO: 70645 - protein, 247 aa, Vibrio cholerae O1 biovar eltor str. N16961
MNTSNNAEYQRIVVLDTETTGMNREGGPHYEGHRIIEIGAVEIINRKLTGRHFHVYLKPDRDIQLEAIEVHGITDEFLKDKPEYKDVHEEFVDFIKGAELVAHNAPFDVGFMDYEFAKLGGAIGKTSDFCKVTDTLAMAKRIFPGKRNNLDILCERYGIDNSHRTLHGALLDAEILADVYLLMTGGQTSLQFSSVTQNSGELSAESLKRARSERKALKVLAASADELQAHQDRLDIVAKSGTCLWRS

SEQ ID NO: 70646 - DNA, 741 bp, Pseudomonas aeruginosa PAO1
  CDS (1)..(741): transl_table=11
atgcgtagcgtcgtactggataccgaaaccaccggcatgccggtgaccgatggtcaccggatcatcgagatcggctgtgtcgagctggaggggcgccgcctgaccggtcgccacttccacgtctacctgcaacccgatcgcgaggtcgacgaaggggcgatcgccgtccacggcatcaccaacgaatacctgaaggacaagccgcgcttccgcgaggtcgccaacgatttcttcgaattcatccgcggcgcccagctgatcatccacaacgcggcgttcgatatcggcttcatcaacaacgagttcgccctgctgggccagcaggaccgctcggacgtgaccgagtactgctcggtgctggataccctgctgatggcccgcgagcgccatccgggccagcgcaacaacctcgatgcgttgtgcaagcgctacggcgtggacaactccggtcgcgacctgcacggcgcgttgctcgacgccgagatcctcgccgacgtctacctggcgatgaccggcggccagaccagcctgtcgctggccggcagcggcgcggaaggcgacggcagcggccggccgatggtcagcccgatccgtcggctcgatccggcgcgggtagccaccccggtgctgcgcgccaacgccgaagagctggctgcgcatgcggcgcggctggcggtgatcgagaagtcggcaggtggtccgtcactctgggcgcaactggaggcgccggtcggcgaatag

SEQ ID NO: 70647 - protein, 246 aa, Pseudomonas aeruginosa PAO1
MRSVVLDTETTGMPVTDGHRIIEIGCVELEGRRLTGRHFHVYLQPDREVDEGAIAVHGITNEYLKDKPRFREVANDFFEFIRGAQLIIHNAAFDIGFINNEFALLGQQDRSDVTEYCSVLDTLLMARERHPGQRNNLDALCKRYGVDNSGRDLHGALLDAEILADVYLAMTGGQTSLSLAGSGAEGDGSGRPMVSPIRRLDPARVATPVLRANAEELAAHAARLAVIEKSAGGPSLWAQLEAPVGE

SEQ ID NO: 70648 - DNA, 735 bp, Neisseria meningitidis MC58
  CDS (1)..(735): transl_table=11
atgacgacacgccaaatcatcctcgataccgaaaccaccggtctgtatgccgacggcggcgaccgcttggtcgagtttgccggtttggaaatggtcaaccgccaaatgaccgacaaaaacctgcacctctatgtccaccccgagcgcgatatgcccgaagaggcggcacgcgtccacggcttgacgatacaggttttggaagggaaaaacgcgccgccgtttgcagaggtcggcaggcagattgccgatttcctgcgcggtgcggaactgattatccacaatgccaaattcgacgtgggcttcctcaatatggagttccgccggatggggttgccgaccgttgaggaactcggctgtaccgttaccgataccctggcgatggcgcgcgaaatgttccccgggcagaaagccagcctggatgccttgtgcaaccgtttttccgtcgaccgcagcaagcgcgtcctgcacggcgcattgatcgactgcgaacttttgggcgaagtctatcttgctatgacgcggcggcagttcgacctgatgggtgcggccgcagaggaaaaaatggaaaccaaacccgtggtgcataccgaaaccaaacgcagcggcaaactgaaagtcatcagggcggacgaaaacgagttggcggcgcacgggcaatatttggacggcttgggcgaagcctgtatctggcgcaaggaagccgtgccgtctgaaaacggcgggacggacgcatga

SEQ ID NO: 70649 - protein, 244 aa, Neisseria meningitidis MC58
MTTRQIILDTETTGLYADGGDRLVEFAGLEMVNRQMTDKNLHLYVHPERDMPEEAARVHGLTIQVLEGKNAPPFAEVGRQIADFLRGAELIIHNAKFDVGFLNMEFRRMGLPTVEELGCTVTDTLAMAREMFPGQKASLDALCNRFSVDRSKRVLHGALIDCELLGEVYLAMTRRQFDLMGAAAEEKMETKPVVHTETKRSGKLKVIRADENELAAHGQYLDGLGEACIWRKEAVPSENGGTDA

SEQ ID NO: 70650 - DNA, 735 bp, Neisseria meningitidis Z2491
  CDS (1)..(735): transl_table=11
atgacgacacgccaaatcatcctcgataccgaaaccaccggtctgtatgccgacggcggcgaccgcttggtcgagtttgccggtctggaaatggtcaaccgccaaatgaccgacaaaaacctgcacctctatgtccaccccgagcgcgatatgcccgaagaggcggcgagggtgcacggtctgacgatagaggttttggaagggaaaaacgcgccgccgtttgcagaggtcggcaggcagattgccgatttcctgcgcggtgcggaactgattatccacaatgccaaattcgacgtgggcttcctcaatatggagttccgccggatggggttgccgaccgttgaggaactcggctgtaccgttaccgataccctggcgatggcgcgcgaaatgttccccgggcagaaagccagtctagatgccctgtgcaaccgtttttccgtcgaccgcagcaagcgcgtcctgcacggcgcattgatcgactgcgaacttttgggcgaagtctatcttgctatgacgcggcggcagttcgacctgatgggggaggccgaggaggaagagccggcagccaaacctgttgcatctgccgaaatgaaactcggtgccaaactgaaagtgattaaggcggatgaagccgaactggcggcgcacgggcaatatttggacggcttgggcgaagcctgtatctggcgcaaggaagccgtgccgtctgaaaacggcgggacggacgcatga

SEQ ID NO: 70651 - protein, 244 aa, Neisseria meningitidis Z2491
MTTRQIILDTETTGLYADGGDRLVEFAGLEMVNRQMTDKNLHLYVHPERDMPEEAARVHGLTIEVLEGKNAPPFAEVGRQIADFLRGAELIIHNAKFDVGFLNMEFRRMGLPTVEELGCTVTDTLAMAREMFPGQKASLDALCNRFSVDRSKRVLHGALIDCELLGEVYLAMTRRQFDLMGEAEEEEPAAKPVASAEMKLGAKLKVIKADEAELAAHGQYLDGLGEACIWRKEAVPSENGGTDA

SEQ ID NO: 70652 - DNA, 732 bp, Escherichia coli O157:H7 EDL933
  CDS (1)..(732): transl_table=11
atgagcactgcaattacacgccagatcgttctcgataccgaaaccaccggtatgaaccagattggtgcgcactatgaaggccacaagatcattgagattggtgccgttgaagtggtgaaccgtcgcctgacgggcaataacttccatgtttatctcaaacccgatcggctggtggatccggaagcctttggcgtacatggtattgccgatgaatttttgctcgataagcccacgtttgccgaagtagccgatgagttcatggactatatccgcggcgcggagttggtgatccataacgcagcgttcgatatcggctttatggactacgagttctcgttgcttaagcgcgatattccgaagactaataccttctgtaaggtcaccgatagccttgcggtggcgaggaaaatgtttcccggtaaacgcaacagcctcgatgcgttatgtgcccgctacgaaatagataacagtaaacgaacgctgcacggggcattactcgatgcccagatccttgcggaagtttatctggcgatgaccggtggtcaaacgtcgatggcttttgcgatggaaggagagacacaacagcaacaaggtgaagcaacaatccagcgccttgtacgtcaggcaagtaagttacgcgttgtttttgcgacagatgaagagcttgcagcacatgaagcccgtctcgatctggtgcagaaaaagggcggaagctgcctctggcgggcataa

SEQ ID NO: 70653 - protein, 243 aa, Escherichia coli O157:H7 EDL933
MSTAITRQIVLDTETTGMNQIGAHYEGHKIIEIGAVEVVNRRLTGNNFHVYLKPDRLVDPEAFGVHGIADEFLLDKPTFAEVADEFMDYIRGAELVIHNAAFDIGFMDYEFSLLKRDIPKTNTFCKVTDSLAVARKMFPGKRNSLDALCARYEIDNSKRTLHGALLDAQILAEVYLAMTGGQTSMAFAMEGETQQQQGEATIQRLVRQASKLRVVFATDEELAAHEARLDLVQKKGGSCLWRA

SEQ ID NO: 70654 - DNA, 720 bp, Xylella fastidiosa 9a5c
  CDS (1)..(720): transl_table=11
atgaggaataagaagcgtcagattgttcttgatactgagaccactggcctggaatggagcaaggggaaccgcattgtggagatcggtgcggtcgaactgcttgatcgccggctcagtggggacaaatttcatcgttatctcaagcctgatgtgtcgtttgagtccggtgcccaggaggtaacggggctgacgatggagtttctagcggacaagccagagttcagcatgattgccgatgagtttttggcttatatcaatggtgccgaactgattattcacaatgcggcgttcgatctgggattccttgattacgagttatcgcggttgggttcgcagtacgggaaaatcacagatcgtgccagcgtacttgatactttggtgatggctcgggagcgttatccgggtcagcgtaattcactggatgcattatgtaagcgtcttggtgtggataatgcccaccgtcagttacatggtgcattacttgacgcgcagatattggccgatgtttatatcgcgttgacctctggacaagaggagattggttttgcgttgcctgagagcagccgtggtggtgtcgatgccgctagcgtggcatttatgccggatgtgttgttaacacgtccatgtgtggtggtgtcgcaatccgaactggaagcgcatgaggcgcgtttggccaagttgcgtaagatcgctggtcatgtgctgtgggatgcgatatag

SEQ ID NO: 70655 - protein, 239 aa, Xylella fastidiosa 9a5c
MRNKKRQIVLDTETTGLEWSKGNRIVEIGAVELLDRRLSGDKFHRYLKPDVSFESGAQEVTGLTMEFLADKPEFSMIADEFLAYINGAELIIHNAAFDLGFLDYELSRLGSQYGKITDRASVLDTLVMARERYPGQRNSLDALCKRLGVDNAHRQLHGALLDAQILADVYIALTSGQEEIGFALPESSRGGVDAASVAFMPDVLLTRPCVVVSQSELEAHEARLAKLRKIAGHVLWDAI

SEQ ID NO: 70656 - DNA, 729 bp, Sinorhizobium meliloti 1021
  CDS (1)..(729): transl_table=11
atgcgtgaaatcatctttgatacggaaacgaccggcctcgacaaccgcgaggaccgggtgatcgagatcggcggtatcgagctcgagaaccagtttccgacggggcgcacgatccatatctatatcaatccgggggagcgcaaggttcacccggaagcgctggccgtccacggtatcaccgacgagttcctgaaggacaagccgcccttcgccgatgtcgcccaggaaatcgtcgatttcttcggcgatgcccgttgggtcgcccacaacgccaccttcgacatcggcttcatcaatgcggagttcgagcggctcggcctgccgccgatcggcagcgaccgggttatcgacactctggctcttgcccgccgcaagcacccgatggggccgaattcgctcgatgcgctctgccgtcgctacggtgtagacaactcccatcgaaccaggcacggagccctgctcgactccgagctgctggccgaggtctatatcgagatgatcggcgggcgccaggccgcgctcggtctcgtggtgacggaggcaggtgaccggccgatcgaggctgacgacggaccggtcgtcgtggtcacaagggaaaggcctctacggccacggctgacggaggccgagatcgccgcccatgcggcgctcgtcgcgaagatcggcgcgaatgcgatctggtcgaagtacagcgaagccgatgacgttctcagatcggaagctgtctag

SEQ ID NO: 70657 - protein, 242 aa, Sinorhizobium meliloti 1021
MREIIFDTETTGLDNREDRVIEIGGIELENQFPTGRTIHIYINPGERKVHPEALAVHGITDEFLKDKPPFADVAQEIVDFFGDARWVAHNATFDIGFINAEFERLGLPPIGSDRVIDTLALARRKHPMGPNSLDALCRRYGVDNSHRTRHGALLDSELLAEVYIEMIGGRQAALGLVVTEAGDRPIEADDGPVVVVTRERPLRPRLTEAEIAAHAALVAKIGANAIWSKYSEADDVLRSEAV

SEQ ID NO: 70658 - DNA, 729 bp, Ralstonia solanacearum GMI1000
  CDS (1)..(729): transl_table=11
atgcgacagatcgtcctcgataccgaaaccaccggcctgaatgccgccaccggcgaccgcgtgatcgaaatcggctgcgtggagctggtcaaccggcggctgaccggccgcaacctgcatttctacctcaaccccgagcgcgagatcgacgccggcgccatggcggtgcacggcattaccaacgagttcgtcgccgacaagcccaagttcgccgaggtcgtcgacgagatccgggactacgtgcagggcgccgaggcgatcatccataacgccgcgttcgacctgggcttcctcgacatggagttcaagcggttggggctgccgccgttccgcgagcatctggccggccacatcgacacgctgctcgatgcgcgccggatgttccccggcaagcgcaactcgctggacgcgctgtgcgaccgcctcggcgtgagcaacgcccaccgtacgctgcacggcgccttgctggacgcggaactgctggccgaagtctatctggccatgacgcgcggccagaacacgctggtgatcgacatgttggagagcggcgagacggccgccgccgaggccgccgtgatcgacctgagcggcctggagctgccgatcctgctggcgaccgaagcggaagccgcggcgcacgcgaccgtgctcaaggagatcgacaaggccagcggcggcaagacggtctggcttcgggatgctccggaggccgcgccgcaggcgggctga

SEQ ID NO: 70659 - protein, 242 aa, Ralstonia solanacearum GMI1000
MRQIVLDTETTGLNAATGDRVIEIGCVELVNRRLTGRNLHFYLNPEREIDAGAMAVHGITNEFVADKPKFAEVVDEIRDYVQGAEAIIHNAAFDLGFLDMEFKRLGLPPFREHLAGHIDTLLDARRMFPGKRNSLDALCDRLGVSNAHRTLHGALLDAELLAEVYLAMTRGQNTLVIDMLESGETAAAEAAVIDLSGLELPILLATEAEAAAHATVLKEIDKASGGKTVWLRDAPEAAPQAG

SEQ ID NO: 70660 - DNA, 699 bp, Agrobacterium tumefaciens str. C58
  CDS (1)..(699): transl_table=11
atgcgtgagatcattttcgatacggaaaccacgggcctcgaatcgaagctggaccgcgtgattgaaatcggcggtatcgaactgatcaatcattttcccactggccgcacgctgcatctttatatcagcccggaggatcgcaaggtccacccggatgcgcttgccgttcacggcattaccgatgagtttctgaaggacaaaccgaaattcgcagaagtcatcgaccagatccgtgaattcttcgatggcgcacgctgggtggcgcataatgcgaccttcgatatgggcttcatcaatgcggaattcgcgcgtctgggcattgagccggtttccgccgagctggtgaccgacacgctctcacttgcccgtcgcaagaacccgatggggccgaattcgctggatgcgctttgccggcgttacggcatcgacaattcccaccgcaccaaacacggcgcgcttctcgactccgaacttctggccgaagtctatatcgaaatgatcggcggtcgccagacagcgctcggtttcggttccgccgcccggcaggaaacgatcatcatcgaagaagacgtgccgcttgcgccattgcaacggccaagcgctctgccctcgaggctggatgcggacacgatcgcagcgcatggcaaactcgttctcggcatgggcgacaaggcgatctggaaccgctaccagaactaa

SEQ ID NO: 70661 - protein, 232 aa, Agrobacterium tumefaciens str. C58
MREIIFDTETTGLESKLDRVIEIGGIELINHFPTGRTLHLYISPEDRKVHPDALAVHGITDEFLKDKPKFAEVIDQIREFFDGARWVAHNATFDMGFINAEFARLGIEPVSAELVTDTLSLARRKNPMGPNSLDALCRRYGIDNSHRTKHGALLDSELLAEVYIEMIGGRQTALGFGSAARQETIIIEEDVPLAPLQRPSALPSRLDADTIAAHGKLVLGMGDKAIWNRYQN

SEQ ID NO: 70662 - DNA, 747 bp, Brucella melitensis 16M
  CDS (1)..(747): transl_table=11
gtggcctatccttattcagaatatttgcggagaggttcttcaatgcgcgaaatcgtttttgatacggaaaccaccggcctggaacggctggaggaccgcgtgatcgaaattggcggtgtggaacttgtcaaccggtttcctacaggccgcaccttccataaattcatcaatccgcaggggcgtcaggttcatcccgatgcgctcgccgttcatggcatcagcaacgaacaattgctggacaaacctgtttttgcggaaattctggacgagtttctggaattcatcgacggagccaggcttgttgcgcataacgccatgttcgaccttggcttcatcaatgcggaacttgcgcggctagaccaggccgagatcacttcggaacatatcgtggatacgctggcgctcgcccgtcgcaaacacccgatagggccgaactcgctggatgcgctctgcaagcgttatggtatcgacaattcgcaccgcaccctgcacggcgcattgctcgacgcgcagattctggctgaagtctatatcgaattgatcggcggcaagcagaccgcacttggcctgaccatggaaagcggttctgctggcggtgacagtcgcggcaatggcagcgcacccgttgtcctggccgcccgccctcgcccgttgccgccgcgcatttcggatgcggaacgtgcggcccatgccgcactggtggagaaaatgggcgacaaggctgtctggaagaaatatctatcctga

SEQ ID NO: 70663 - protein, 248 aa, Brucella melitensis 16M
MAYPYSEYLRRGSSMREIVFDTETTGLERLEDRVIEIGGVELVNRFPTGRTFHKFINPQGRQVHPDALAVHGISNEQLLDKPVFAEILDEFLEFIDGARLVAHNAMFDLGFINAELARLDQAEITSEHIVDTLALARRKHPIGPNSLDALCKRYGIDNSHRTLHGALLDAQILAEVYIELIGGKQTALGLTMESGSAGGDSRGNGSAPVVLAARPRPLPPRISDAERAAHAALVEKMGDKAVWKKYLS

SEQ ID NO: 70664 - DNA, 738 bp, Xanthomonas campestris pv. campestris str. ATCC 33913
  CDS (1)..(738): transl_table=11
atgcgtcagatcattctcgataccgaaaccaccggcctggaatggcgcaagggcaaccgcgtcgtcgaaatcggtgcggtggaactgctggagcgccgcccgagcggcaacaacttccatcgctatctgcggccggactgcgacttcgagcccggcgcgcaggaggtcaccgggctgaccctggaatttctggcggacaagccggtgtttgccgaggtggtggaagagttcctggcctacatcgacggcgccgaactgatcatccacaacgccgcgttcgacctgggtttcctggacaacgaactgtcgctgctgggcgatcagtttggccgcatcatcgaccgcgccaccgtggtcgataccttgatgatggcgcgcgagcgttatcccggtcagcgcaactcgctggacgcgttgtgcaaacggctgggcgtggacaactcgcaccggcagttgcatggcgccttgctcgatgcgcagatcctggccgatgtctacatcgcgctgacctccgggcaggaagagatcggcttcggcgcgatggatgccggccagcatgccgaaggcggcgagggcatgatcgcgttcgatccgtcgctgttgctgccgcgcccacgcgtggtggtaacgccctcggagctgcaggcacacgaggcgcgtctggagcggctgcgcaagaaggccgggcgtgcgctgtgggatgcgccggagttggacgaggtcgcggtcgccagctaa

SEQ ID NO: 70665 - protein, 245 aa, Xanthomonas campestris pv. campestris str. ATCC 33913
MRQIILDTETTGLEWRKGNRVVEIGAVELLERRPSGNNFHRYLRPDCDFEPGAQEVTGLTLEFLADKPVFAEVVEEFLAYIDGAELIIHNAAFDLGFLDNELSLLGDQFGRIIDRATVVDTLMMARERYPGQRNSLDALCKRLGVDNSHRQLHGALLDAQILADVYIALTSGQEEIGFGAMDAGQHAEGGEGMIAFDPSLLLPRPRVVVTPSELQAHEARLERLRKKAGRALWDAPELDEVAVAS

SEQ ID NO: 70666 - DNA, 735 bp, Xanthomonas axonopodis pv. citri str. 306
  CDS (1)..(735): transl_table=11
atgcgtcagatcattctcgataccgaaaccaccggcctggaatggcgcaagggcaaccgcgtcgtcgaaatcggcgcggtggagctgctggagcggcgcccgagcggcaacaatttccatcgctacctgaagccggactgcgacttcgagccgggcgcgcaggaggtgaccgggctgaccctggaatttctggccgataaaccgctattcggcgaggtggtggacgagtttctcgcctatatcgacggcgcggaactgatcatccacaacgccgcgttcgacctggggtttctggacaacgaactggcgctgctgggcgatcactacgggcgcatcgtcgagcgcgccacggtggtggataccttgatgatggcgcgcgagcgctatccggggcagcgcaattccttggatgccctgtgcaagcgtctgggcgtggacaactcgcatcgccagttgcacggcgccttgctcgatgcgcagatcctggccgatgtgtatatcgcgctgacctcgggtcaggaggagatcgggtttgccagtgccgacgccggccagcaggccgacgccgcgagcggcatgatcgcgttcgatccggcgctgctgttgccgcgtccgcgcgttgcggtgaccgcttccgaatcgcaggcgcacgaggcgcgtctggcgcagttgcgcaagaaagcggggcgtgcgttgtgggatccgccggtcgaagagattgccgtcgccgggtaa

SEQ ID NO: 70667 - protein, 244 aa, Xanthomonas axonopodis pv. citri str. 306
MRQIILDTETTGLEWRKGNRVVEIGAVELLERRPSGNNFHRYLKPDCDFEPGAQEVTGLTLEFLADKPLFGEVVDEFLAYIDGAELIIHNAAFDLGFLDNELALLGDHYGRIVERATVVDTLMMARERYPGQRNSLDALCKRLGVDNSHRQLHGALLDAQILADVYIALTSGQEEIGFASADAGQQADAASGMIAFDPALLLPRPRVAVTASESQAHEARLAQLRKKAGRALWDPPVEEIAVAG

SEQ ID NO: 70668 - DNA, 705 bp, Buchnera aphidicola str. Sg (Schizaphis graminum)
  CDS (1)..(705): transl_table=11
atgatgaataatacacaaagaataattgttttagatactgaaacaacaggaatgaatagtgtaggtccaccttatcttaatcatagaattattgaaattggtgccattgaaataattaatcgtcgttttacagggaaaaaatttcatacttatattaaacctaatagattgatagaatctgacgcttcaaaaattcatggtattactgatgattttttatcagataaaccatcttttaaagacatagctaaagatttttttaattatataaaaaattcagaattaataattcataatgcatcttttgatgtaggtttcataaatcaagaattttcaatgttaactaaaaaaatacaagatatatcaaatttttgtaatattatagatacattaaagatagctagaaaattatttcctggtaaaaaaaataccttagacgcattatgtatgcgttataaaataaaaaattctcatagagttttacatggtgctattttagatgcttttctattaggtaaattatatcttttaatgactagtggtcaagaatcaattatatttaataaaaatatccaaaatgaaagaaattttagatatattaaaaaatcaataacaaaaaaacatcgttttttaaaaataataaaagcaaataaaacagaattaaaacttcataatgaatatttaaaatttttaaaagaaaaataa

SEQ ID NO: 70669 - protein, 234 aa, Buchnera aphidicola str. Sg (Schizaphis graminum)
MMNNTQRIIVLDTETTGMNSVGPPYLNHRIIEIGAIEIINRRFTGKKFHTYIKPNRLIESDASKIHGITDDFLSDKPSFKDIAKDFFNYIKNSELIIHNASFDVGFINQEFSMLTKKIQDISNFCNIIDTLKIARKLFPGKKNTLDALCMRYKIKNSHRVLHGAILDAFLLGKLYLLMTSGQESIIFNKNIQNERNFRYIKKSITKKHRFLKIIKANKTELKLHNEYLKFLKEK

SEQ ID NO: 70670 - DNA, 765 bp, Yersinia pestis KIM
  CDS (1)..(765): transl_table=11
atgatcattacaccgaccagacagattgttctggatactgaaactaccggtatgaataagcttggcgttcattatgaaggccatcgtattattgaaatcggtgccgttgaagttatcaatcgccgcctgaccggcagaaatttccatgtatatgtgaagcccgaccgtttggttgatccagaagcttacggggtgcacgggatcagcgatgagtttttggctgacaagccaacatttgctgatattacgccggagtttttagattttatccgtggcgctgaattagtcatccataatgctgcgtttgatatcggctttatggattacgagttccggatgttgcagcaagatattccgaaaacggagaccttctgtactatcactgatagcctgttgatggctcgccgcttatttcccggtaagcggaataaccttgatgccctgtgtgatcgctatcagatagataataccaaacgaaccttgcacggtgcgttacttgatgccgagattctggctgaagtttatttagcaatgactggcgggcagacatcgctaactttctccatggaaggcgaagtgtcgcagaataacgcgtctgaagatattcaacgcattactcgcccagcatcggcattgaaaattatctatgctaccgaggatgaattggctaatcatgaatcccgtttggattttgtgatgaaaaagggcggcagttgcctgtggcggatgccgcttgaggcagaagaagagacaaaagcagaataa

SEQ ID NO: 70671 - protein, 254 aa, Yersinia pestis KIM
MIITPTRQIVLDTETTGMNKLGVHYEGHRIIEIGAVEVINRRLTGRNFHVYVKPDRLVDPEAYGVHGISDEFLADKPTFADITPEFLDFIRGAELVIHNAAFDIGFMDYEFRMLQQDIPKTETFCTITDSLLMARRLFPGKRNNLDALCDRYQIDNTKRTLHGALLDAEILAEVYLAMTGGQTSLTFSMEGEVSQNNASEDIQRITRPASALKIIYATEDELANHESRLDFVMKKGGSCLWRMPLEAEEETKAE

SEQ ID NO: 70672 - DNA, 705 bp, Brucella suis 1330
  CDS (1)..(705): transl_table=11
atgcgcgaaatcgtttttgatacggaaaccaccggcctggaacggctggaggaccgcgtgatcgaaatcggcggtgtggaacttgtcaaccggtttcccacaggccgcaccttccataaattcatcaatccgcaggggcgtcaggttcatcccgatgcgctcgccgttcatggcatcagcaacgaacaattgctggacaaaccggtttttgcggaaattctggacgagtttctggaattcatcgacggggccaggcttgttgcgcataacgccatgttcgaccttggcttcatcaatgcggaacttgcgcggctagaccaggccgagatcacttcggaacatatcgtggatacgctggcgctcgcccgtcgcaaacacccgatggggccgaactcgctggatgcgctctgcaagcgttatggtatcgacaattcgcaccgcaccctgcacggcgcattgctcgacgcgcagattctggctgaagtctatatcgaattgatcggcggcaagcagaccgcacttggcctgaccatggaaagcggttctgctggcggtgacagtcgcggcaatggcagcgcacccgttgtcctggccgcccgccctcgcccgttgccgccgcgcatttcggatgcggaacgtgcggcccatgccgcactggtggagaaaatgggcgacaaggctgtctggaagaaatatctatcctga

SEQ ID NO: 70673 - protein, 234 aa, Brucella suis 1330
MREIVFDTETTGLERLEDRVIEIGGVELVNRFPTGRTFHKFINPQGRQVHPDALAVHGISNEQLLDKPVFAEILDEFLEFIDGARLVAHNAMFDLGFINAELARLDQAEITSEHIVDTLALARRKHPMGPNSLDALCKRYGIDNSHRTLHGALLDAQILAEVYIELIGGKQTALGLTMESGSAGGDSRGNGSAPVVLAARPRPLPPRISDAERAAHAALVEKMGDKAVWKKYLS

SEQ ID NO: 70674 - DNA, 732 bp, Shigella flexneri 2a str. 301
  CDS (1)..(732): transl_table=11
atgagcactgcaattacacgccagatcgttctcgataccgaaaccaccggtatgaaccagattggtgcacactatgaaggccacaagatcattgagattggtgctgttgaagtagtgaaccgtcgcctgacgggcaataacttccatgtttatctcaaacccgatcggctggtggatccggaagcctttggcgtacatggtattgctgatgaatttttgctcgataagcccacgtttgccgaagtagccgatgagtttatggactatatccgcggcgcggagttggtgatccataacgcagcgttcgatataggctttatggactacgagttttcgttgcttaagcgcgatattccgaagaccaataccttctgtaaggtcaccgatagccttgcggtggcgaggaaaatgtttcccggtaaacgcaacagcctcgatgcgctatgtgcccgctacgaaatagataacagtaaacgaacgctgcacggggcattactcgatgcccagatccttgcggaagtttatctggcgatgaccggtggtcaaacgtcgatggcttttgcgatggaaggagagacacagcagcaacaaggtgaagcaacaattcagcgcattgtacgtcaggcaagtaagttacgcgttgtttttgcgacagatgaagagctggcagcacatgaagcccgtctcgatctggtgcagaaaaaaggcggaagctgcctctggcgggcataa

SEQ ID NO: 70675 - protein, 243 aa, Shigella flexneri 2a str. 301
MSTAITRQIVLDTETTGMNQIGAHYEGHKIIEIGAVEVVNRRLTGNNFHVYLKPDRLVDPEAFGVHGIADEFLLDKPTFAEVADEFMDYIRGAELVIHNAAFDIGFMDYEFSLLKRDIPKTNTFCKVTDSLAVARKMFPGKRNSLDALCARYEIDNSKRTLHGALLDAQILAEVYLAMTGGQTSMAFAMEGETQQQQGEATIQRIVRQASKLRVVFATDEELAAHEARLDLVQKKGGSCLWRA

SEQ ID NO: 70676 - DNA, 729 bp, Shewanella oneidensis MR-1
  CDS (1)..(729): transl_table=11
atgaatattatctcaaacgcaagccgtcaggttattttagatactgaaaccacgggtatgaaccaaggcagtggtgcggtgtatttagggcacagaattattgagataggttgtgttgaggtcatcaaccgccgtttaacgggccgttattatcaccagtatataaatcccggccaagcgattgatccagaagcgatcgcggttcatgggatcaccgatgaacgtgttgcgaatgagccaagattccatcaaatcgcccaagagtttatcgattttatcagtggcgccgaaattgtggcccataacgcaaacttcgacgtgagctttatggaccatgagttttccttactgcagcccttagggccaaagactcgcgacatttgtgagattttagactccctcgacattgctaagtttttgcaccccggacaaaagaacaacttagacgcactctgtaaacgttatggcatcgacaactctcgtcgccattaccatggcgcattactcgacgccgaaatccttgccgatgtctatttatcgatgacgggtgggcagactaagtttaatctctctaacgaagaagtcggtcaagaggggggcggcattcaacgctttgatcccacatcacttaatcttaaagtgatctgcgcatcggccgatgaactcgttatgcatgaaaagcgccttgatttagtcgcaaaatcaggaaaatgcctctggagaggataa

SEQ ID NO: 70677 - protein, 242 aa, Shewanella oneidensis MR-1
MNIISNASRQVILDTETTGMNQGSGAVYLGHRIIEIGCVEVINRRLTGRYYHQYINPGQAIDPEAIAVHGITDERVANEPRFHQIAQEFIDFISGAEIVAHNANFDVSFMDHEFSLLQPLGPKTRDICEILDSLDIAKFLHPGQKNNLDALCKRYGIDNSRRHYHGALLDAEILADVYLSMTGGQTKFNLSNEEVGQEGGGIQRFDPTSLNLKVICASADELVMHEKRLDLVAKSGKCLWRG

SEQ ID NO: 70678 - DNA, 759 bp, Pseudomonas putida KT2440
  CDS (1)..(759): transl_table=11
gtggagcagcagcaagataaacggttcgtcattctcgataccgaaaccacgggtatgccggttggcgaaggccaccggatcatcgagatcggctgtgtcgaggtcatcggccggcgcctgaccgggcggcacttccacgtctacctgcagcccgaccgcgagagtgacgagggcgcgatcaacgttcacggcatcacggatgccttcctggtcggcaagccacgttttggcgatgtcgccgaggagttcttccagttcatccaaggcgccacgctggtcatccacaacgcggcgttcgacgttggcttcatcaacaacgaattcgccttgctgggccagcaggaccgcgctgacatttcgcagcactgcaccattctggacaccctgctgctggcacgttcgcgccacccggggcagcgcaacagcctagatgcgctgtgcaaacgctacgacatcgacaactcgggccgtgagttgcacggcgcactgctcgactcggaactgctggccgacgtttacctggcaatgaccggtggccagaccagcctgtcgttggctgggaatggcgcagataccgaagaggacgggcagggcgctggcggcagcgagatccgccggattgtcgggcgtgcgccagggcgggtgatcatggccagcgctgaagagctggaggcgcatgccgagcggctggcggccattgccaagtcggcgggtgggccttcgctgtggcaggccctgactgagacgccagccggctga

SEQ ID NO: 70679 - protein, 252 aa, Pseudomonas putida KT2440
MEQQQDKRFVILDTETTGMPVGEGHRIIEIGCVEVIGRRLTGRHFHVYLQPDRESDEGAINVHGITDAFLVGKPRFGDVAEEFFQFIQGATLVIHNAAFDVGFINNEFALLGQQDRADISQHCTILDTLLLARSRHPGQRNSLDALCKRYDIDNSGRELHGALLDSELLADVYLAMTGGQTSLSLAGNGADTEEDGQGAGGSEIRRIVGRAPGRVIMASAEELEAHAERLAAIAKSAGGPSLWQALTETPAG

SEQ ID NO: 70680 - DNA, 741 bp, Escherichia coli CFT073
  CDS (1)..(741): transl_table=11
atgaccgctatgagcactgcaattacacgccagatcgttctcgataccgaaaccaccggtatgaaccagattggtgcgcactatgaaggccacaagatcattgagattggtgccgttgaagtggtgaaccgtcgcctgacgggcaataacttccatgtttatctcaaacccgatcggctggtggatccggaagcctttggcgtacatggtattgccgatgaatttttgctcgataagcccacgtttgccgaggtagccgatgagttcatggattatatccgcggcgcggagttggtgatccataacgcagcgtttgatatcggctttatggactacgagttttcgttgcttaagcgcgatattccgaagaccaataccttctgtaaggtcaccgatagccttgcggtggcgaggaaaatgtttcccggtaaacgcaacagcctcgatgcgttatgtgcccgctacgaaatagataacagtaaacgaacgctgcatggggcattactcgatgcccagatccttgcggaagtttatctggcgatgaccggtggtcaaacgtcgatggcttttgcgatggaaggagagacacaacagcaacaaggtgaaacaacaattcagcgcattgtgcgtcaggcaagtaagttacgcgttgtttttgcgacagatgaagagcttgcagcacatgaagcccgtctcgatctggtgcagaagaagggcggaagctgcctctggcgggcataa

SEQ ID NO: 70681 - protein, 246 aa, Escherichia coli CFT073
MTAMSTAITRQIVLDTETTGMNQIGAHYEGHKIIEIGAVEVVNRRLTGNNFHVYLKPDRLVDPEAFGVHGIADEFLLDKPTFAEVADEFMDYIRGAELVIHNAAFDIGFMDYEFSLLKRDIPKTNTFCKVTDSLAVARKMFPGKRNSLDALCARYEIDNSKRTLHGALLDAQILAEVYLAMTGGQTSMAFAMEGETQQQQGETTIQRIVRQASKLRVVFATDEELAAHEARLDLVQKKGGSCLWRA

SEQ ID NO: 70682 - DNA, 732 bp, Vibrio vulnificus CMCP6
  CDS (1)..(732): transl_table=11
atgaataccagtaacaattctgaatacgatcgtatcgtcgtgctcgatacggaaaccacgggtatgaaccgtgaaggtggcccacactatatggggcacagaatcatcgaaatcggggcggtggagatcatcaaccgcaagctgaccgggcgacatttccatgtttaccttaagccagaccgtgaaattcaacccgatgcgatcgatgttcacggtattaccgatcagtttctagttgataaaccggagtatcgtcaagttcaccaagagttcctagagttcattaaaggggctgagctggtggctcataacgcgcccttcgacgtgggctttatggattatgagttcggtaaactcgacgccgccatcggcaaaaccgatgactactgcaaggtgaccgatacgctggcgatggcgaagaagatcttccctggcaagcgtaacaacctagacgttttgtgtgaacgctacggcattgataactcacaccgaacgcttcacggggcattgctcgatgcggagattctggctgatgtttacctgctgatgaccggtgggcaaaccagtttggagttcaacgccaactcgcaagaaggcggtggtgaagacattcgccgagtggcggggcgaaaatctcttaaggttttgcgtgcaacggccgatgaattagaagcgcaccaatctagattggatattgtagaaaaaagcggaacttgcctctggcgtcaatag

SEQ ID NO: 70683 - protein, 243 aa, Vibrio vulnificus CMCP6
MNTSNNSEYDRIVVLDTETTGMNREGGPHYMGHRIIEIGAVEIINRKLTGRHFHVYLKPDREIQPDAIDVHGITDQFLVDKPEYRQVHQEFLEFIKGAELVAHNAPFDVGFMDYEFGKLDAAIGKTDDYCKVTDTLAMAKKIFPGKRNNLDVLCERYGIDNSHRTLHGALLDAEILADVYLLMTGGQTSLEFNANSQEGGGEDIRRVAGRKSLKVLRATADELEAHQSRLDIVEKSGTCLWRQ

SEQ ID NO: 70684 - DNA, 720 bp, Bradyrhizobium japonicum USDA 110
  CDS (1)..(720): transl_table=11
atgcgcgaaatcgttctcgacaccgaaaccaccggcctcgatccgctccgcggcgatcgcctggtcgaaatcggctgtgtcgagatgttcaaccgcatgccgacggggcagacgtatcacgtctacatcaatcccgaacgggacatgccggcggaagcctttgcggtgcacgggctgtcggccgaatttttgtcgaccaagccggtgttccacgaggtcgccgatgcgttcctggagttcatcggcgatgcgccgctggtgatccacaacgcctcgttcgacatcagcttcatcaatgccgagctcgaccggatcaagcgcgccgcgataccgcgcgagcagctggtggacacgctgctgctggcccggcgcaagcatccgggcgtgtccaaccggctcgacgatctctgctcgcgctatgcgatcgacaattcccgccgcaccaagcacggcgcgctgctcgacgccgagcttctggccgaggtctatgtcgatctggtcggggcgaggcagtcgcagctgctgctggcttcggaagccgaggaaattcgcatcaatgcggctggcgatacgccgcggcggcagcgaccgacgccgcttgcgccgcggatttccgacgccgagcgcgaggcccacagggccttcatcgcaacgctcggcgacaaggcgatctggaacgagtttttgcccgctccagttaccgtcaatccggctggttag

SEQ ID NO: 70685 - protein, 239 aa, Bradyrhizobium japonicum USDA 110
MREIVLDTETTGLDPLRGDRLVEIGCVEMFNRMPTGQTYHVYINPERDMPAEAFAVHGLSAEFLSTKPVFHEVADAFLEFIGDAPLVIHNASFDISFINAELDRIKRAAIPREQLVDTLLLARRKHPGVSNRLDDLCSRYAIDNSRRTKHGALLDAELLAEVYVDLVGARQSQLLLASEAEEIRINAAGDTPRRQRPTPLAPRISDAEREAHRAFIATLGDKAIWNEFLPAPVTVNPAG

SEQ ID NO: 70686 - DNA, 720 bp, Xylella fastidiosa Temecula1
  CDS (1)..(720): transl_table=11
atgaggaataagaagcgtcagattgttcttgatactgagaccactggcctggaatggagcaaggggaaccgcattgtggagatcggtgcggtcgaactgcttgatcgccgactcagtggggacaaatttcatcgttatctcaagcctgatgtgtcgtttgagtccggtgcccaggaggtaacggggctgacgatggagtttctagcggacaagccagagttcagcatgattgccgataagtttttggcttatatcaatggtgccgaactgattattcataatgcggcgttcgatctgggattccttgattacgagttatcgcggttgggttcgcagtacgggaaaatcacagatcgtgccagcgtgcttgacactttggtgatggctcgggagcgttatccgggtcagcgtaattcactggatgcattatgtaagcgtcttggtgtggataacgcccaccgtcagttacatggtgcattacttgacgcgcagatattggccgatgtttatatcgcgttgacctctggacaagaggaaattggttttgcattgcctgagagcagccgtggtggtgtcgatgccgctagcgtggcatttatgccggatgtgttgttaacacgtccatgtgtggtggcgtcgcaatccgaactggaggcgcatgaggcgcgtttggccaagttgcgtaagatcgctggtcatgtgctgtgggatgcgatatag

SEQ ID NO: 70687 - protein, 239 aa, Xylella fastidiosa Temecula1
MRNKKRQIVLDTETTGLEWSKGNRIVEIGAVELLDRRLSGDKFHRYLKPDVSFESGAQEVTGLTMEFLADKPEFSMIADKFLAYINGAELIIHNAAFDLGFLDYELSRLGSQYGKITDRASVLDTLVMARERYPGQRNSLDALCKRLGVDNAHRQLHGALLDAQILADVYIALTSGQEEIGFALPESSRGGVDAASVAFMPDVLLTRPCVVASQSELEAHEARLAKLRKIAGHVLWDAI

SEQ ID NO: 70688 - DNA, 774 bp, Pseudomonas syringae pv. tomato str. DC3000
  CDS (1)..(774): transl_table=11
gtgcaaaacctggacaacagatcgatcgttctcgacaccgaaaccaccggtatgccagtgaccgatggtcaccgtatcgtcgagattggttgtgtcgaactgattggccgccgcctgaccgggcggcattttcacgtttacctgcaacccgaccgcgaaagtgacgaaggcgcaatcggtgttcacggcatcaccaacgagtttctggtcggcaagccgcgctttgccgaagttgccgatgagttcttcgagttcatcaagggcgcgcaactgatcatccacaacgcagcgttcgacgttggtttcatcaacaacgaattcgccttgatgggtgcgcaggacaaggccgacatcacccggcactgcaagattctcgacaccctgatgatggcccgcgagcgccatccggggcagcgcaacagcctcgatgcgctgtgcaaacgctatggcgtcgacaactcgggtcgtgagctgcacggcgctttgctcgactccgagattctggccgacgtctatctggcgatgaccggcgggcagaccagcctgtcgctggccggcaacgcctcggatggcaacggctccgctgagggctccggcaatcgcggcagcgaaattcgccgcttgccagctgatcgcaagccttgccgagtcattcgtgcctcggaaagtgaactggccgagcacgaagtccgtatgaccaccatcgccaaggccaccggtgcgcctgccctgtgggtacaaatgctggaagccggggcacaggcctcttcctga

SEQ ID NO: 70689 - protein, 257 aa, Pseudomonas syringae pv. tomato str. DC3000
MQNLDNRSIVLDTETTGMPVTDGHRIVEIGCVELIGRRLTGRHFHVYLQPDRESDEGAIGVHGITNEFLVGKPRFAEVADEFFEFIKGAQLIIHNAAFDVGFINNEFALMGAQDKADITRHCKILDTLMMARERHPGQRNSLDALCKRYGVDNSGRELHGALLDSEILADVYLAMTGGQTSLSLAGNASDGNGSAEGSGNRGSEIRRLPADRKPCRVIRASESELAEHEVRMTTIAKATGAPALWVQMLEAGAQASS

SEQ ID NO: 70690 - DNA, 723 bp, Vibrio parahaemolyticus RIMD 2210633
  CDS (1)..(723): transl_table=11
atgaataccagcagcaattctgaacataatcgcattgtcgttctcgataccgaaaccacaggtatgaaccaagaaggtggtccgcactacttagggcaccgcatcatcgaaatcggtgccgtggagatcatcaaccgtaagctgactggtcgtcattttcatgtgtacattaagcccgatcgtgaaattcaacctgaggcgatacaagtacacggtattaccgatgaattcttggtagataaaccggaatacgcgagtatccaccaagagtttcttgattttatcaaaggcgcagaactggttgcgcataacgcgcccttcgatactggcttcatggattatgagtttgaaaaactcgatccaacaattggtaaaaccgacgattactgcaaggtgacggatacgcttgccatggcgaagaaaatcttcccgggcaagcgcaacaacctcgacgtattatgtgaacgttacggcattgataactcgcaccgtacactccacggggcattgctcgatgcagagattctggccgacgtttacctactgatgactggtgggcaaacgagtctagaatttaacgccaacaaacaagaaggcggggtagaaaccattcgccgtattgaaggaagaaaagcactaaaggttttgcgagcaactgccgatgaattagaagcgcaccagaaaagattagaactggtaaacgactgtatttggcaccaatag

SEQ ID NO: 70691 - protein, 240 aa, Vibrio parahaemolyticus RIMD 2210633
MNTSSNSEHNRIVVLDTETTGMNQEGGPHYLGHRIIEIGAVEIINRKLTGRHFHVYIKPDREIQPEAIQVHGITDEFLVDKPEYASIHQEFLDFIKGAELVAHNAPFDTGFMDYEFEKLDPTIGKTDDYCKVTDTLAMAKKIFPGKRNNLDVLCERYGIDNSHRTLHGALLDAEILADVYLLMTGGQTSLEFNANKQEGGVETIRRIEGRKALKVLRATADELEAHQKRLELVNDCIWHQ

SEQ ID NO: 70692 - DNA, 699 bp, Coxiella burnetii RSA 493
  CDS (1)..(699): transl_table=11
atgcggcaaatcgttttagatacggaaaccaccggccttgtgccggaagaaggccatcggatcatcgaaattggcgcactggaaatggttaatcgccggttgactggcaatcacttgcatttttatatcaatcctgagcgctctattgaacgagacgctatcgaaattcacggcattaccgacagttttttgatcgataaaccgctttttaaagatattgccaccgaactcatttctttcctaaaaggggcggaattaattatccataatgctccctttgacgtcggttttctcaatcacgagctaaagcttaccggccaatcttttaaaacgcttacgcattattgtcaggtcctcgacacactgacaatcgcgcgtcagaagcatccgggccagcacaataacttagatgcgctttgccgacgttaccatgtcgataattctaatcgcgattaccacggggctttactcgatgcagaattattggctcaagtctatttattaatgacgggcggccaaacggtgctatttgaacaacaaggttttgcggtagcatcgcgatcagtatctgttcgtccgttaggtactgatcgcgactccttgtcggtaattagggctaatgcggcagagacagaggcgcatcgggctttcttacaactactcacggaaaacggcctctgtctctggaacgatcaataa

SEQ ID NO: 70693 - protein, 232 aa, Coxiella burnetii RSA 493
MRQIVLDTETTGLVPEEGHRIIEIGALEMVNRRLTGNHLHFYINPERSIERDAIEIHGITDSFLIDKPLFKDIATELISFLKGAELIIHNAPFDVGFLNHELKLTGQSFKTLTHYCQVLDTLTIARQKHPGQHNNLDALCRRYHVDNSNRDYHGALLDAELLAQVYLLMTGGQTVLFEQQGFAVASRSVSVRPLGTDRDSLSVIRANAAETEAHRAFLQLLTENGLCLWNDQ

SEQ ID NO: 70694 - DNA, 699 bp, Nitrosomonas europaea ATCC 19718
  CDS (1)..(699): transl_table=11
atgcggtatgtatttcttgatactgagacgacgggtctggatcctgcactggggcaccgtatcgtcgagatagcagcagtggaagtgtgtaaccggcgtttgaccgatcgtcactttcaccgctatctcaatcccgggcgggagagtgatgaaggtgcactgcgggtacatggactgactcgtgaatttttgcgggataaacccgtattccaggatgtttgcagcgagtttctggagttcatagcagatgccgagattttcattcataacgcgcctttcgatgtggggttcatcaatcgcgaactcgatctgatcagatttgaatcgatgcagaatcattgtctgcagatcatcgatacactggtcctggcaaaagagctgcacccgggcaagagaaacaatctggatgcgttatgtgagcgttatcagatcgataattcccacagaacactgcatggcgctctactcgatgcagagttgctggccgaagtttacctggcaatgacacgtggtcaggaaagcctgctgatggaaatggatgcgccagcatcgcgacaagccgataatccggctgtcggcaaggtggagaatcttgcgctgatcgttcagcctgccacgcaggcagaactcgagttgcatagccggctggtggaacgcatcaacgccgaaagcaaaggtaattgcttgtggaacggttga

SEQ ID NO: 70695 - protein, 232 aa, Nitrosomonas europaea ATCC 19718
MRYVFLDTETTGLDPALGHRIVEIAAVEVCNRRLTDRHFHRYLNPGRESDEGALRVHGLTREFLRDKPVFQDVCSEFLEFIADAEIFIHNAPFDVGFINRELDLIRFESMQNHCLQIIDTLVLAKELHPGKRNNLDALCERYQIDNSHRTLHGALLDAELLAEVYLAMTRGQESLLMEMDAPASRQADNPAVGKVENLALIVQPATQAELELHSRLVERINAESKGNCLWNG

SEQ ID NO: 70696 - DNA, 741 bp, Wigglesworthia glossinidia endosymbiont of Glossina brevipalpis
  CDS (1)..(741): transl_table=11
atgaaaattaatactgaaagacaaattgttttggatactgaaacaactggaatgaataaaaacggacctcattattatggtcatagaattattgaaattggtgcaatagaaatgatcaatagaagattgactggaagatgtttccatacttatttaaaaccagatcgtttagtagaaatagaagcatttaagatacatggaattagtgatgaatttttattttttcaacctacttttgaagaaataatggaaaaatttattaattttataaaaggatctgagttaattattcacaattctgtttttgatataggatttataaataatgaaattcagttatgtaataaaaatttaaataacattaattattactgttcagtaatagatactttaaagttagcaagaaatatatttccaggcaaaagaaataatttagacgcgttatcagatagatacggaattgatactactaaaagaatattacatggagctttgttagatgcagaaattctttctaacgtatatttattaatgactggaggccaaatacctataaatttttcaaaaaaaaaaaataataacttcattaacaagaaaataaaaaataatttcaataattttaaaaaaaataaaaagtataataaaataattaaacctatagtaatatacgccaacgaagaagagattcatgaacataaaaaatttatgaaatctattaatttcataaataaaaataattaa

SEQ ID NO: 70697 - protein, 246 aa, Wigglesworthia glossinidia endosymbiont of Glossina brevipalpis
MKINTERQIVLDTETTGMNKNGPHYYGHRIIEIGAIEMINRRLTGRCFHTYLKPDRLVEIEAFKIHGISDEFLFFQPTFEEIMEKFINFIKGSELIIHNSVFDIGFINNEIQLCNKNLNNINYYCSVIDTLKLARNIFPGKRNNLDALSDRYGIDTTKRILHGALLDAEILSNVYLLMTGGQIPINFSKKKNNNFINKKIKNNFNNFKKNKKYNKIIKPIVIYANEEEIHEHKKFMKSINFINKNN

SEQ ID NO: 70698 - DNA, 771 bp, Haemophilus ducreyi 35000HP
  CDS (1)..(771): transl_table=11
atgagtgaaccgcaaataatccggcaagtcgtattagatactgaaacgacaggaatgaattttaatggcccgccacaaattgggcataacattatcgaaataggcgcagtagaactaatcaatcgccgtttaactggccgtactttccacgtttatataaagccgccccgcgaagttgaagaagaagcaattaaagtacacggcatcactaatgcatttttacaagacaagcccacctttgctgaaattgcacacgaatttctagcgttcattcaaggtgcagaattaattattcataatgcgcccttcgatgtggcctttatcgatcaagaattttcctcgctcgtaaatccacctagcaaaacggctgaaatgtgtacggttactgacactttacaaatggcacgtaaaatgtatccaggtaaacgtaataacttagatgcgctttgtgaccgcttgggaattgataatagcaaacgtgtactacatggtgctttactcgatgcggagattttagctgatgtttttctaatgatgacaggtggacaactagcattattaacggaagaagaacattcccatacacaacaacagcgtgaaacatctctagcagtaaaagaacattttgatacaagcggactaattgtattgcaattaagccaagaagaatgtcaagcacatcaagaatatttagcgctactcgataaaaaatccaaaggcaattgtctttggaacatgctaacaaaagcagaatctgaagctaaacattaa

SEQ ID NO: 70699 - protein, 256 aa, Haemophilus ducreyi 35000HP
MSEPQIIRQVVLDTETTGMNFNGPPQIGHNIIEIGAVELINRRLTGRTFHVYIKPPREVEEEAIKVHGITNAFLQDKPTFAEIAHEFLAFIQGAELIIHNAPFDVAFIDQEFSSLVNPPSKTAEMCTVTDTLQMARKMYPGKRNNLDALCDRLGIDNSKRVLHGALLDAEILADVFLMMTGGQLALLTEEEHSHTQQQRETSLAVKEHFDTSGLIVLQLSQEECQAHQEYLALLDKKSKGNCLWNMLTKAESEAKH

SEQ ID NO: 70700 - DNA, 777 bp, Candidatus Blochmannia floridanus
  CDS (1)..(777): transl_table=11
atgaatattaattctaatcgatatgttgttttagatactgaaactactggtatgaataaatttggagtacattatgaaggtcataggattattgaaattggagcagtggaaataataaatcggcgtttaacaaataaccagtttcatgtttatcttaatcctaatagatctgttgattctgaagcttttgcaatacatggtattagtgatcaatttttagtagatcaaccatgttttttagatattgcaaatgattttttacaatttattagaggtagtactttagttatacataatgcatcatttgatttaggatttttaaattttgaattacataatatttatttaaattctagaacagtagaatcatattgtactgttatagatagtctcaagcttgctcgtaaaatatttccaggtcagcgtaatagtttggatgctttatgtgagcgttattgtattaaaaatagtaaacgtattttacataatgcattaattgatgctcagcttttagcttatgtatttttagttatgacaggaggccaaactagaatacaatttatggatatgttagataatagtgatacaaatatactgaataatactataacgcatgataataagtttgaattatgcttgaataatagtgtgtgtacagaaaagaaatcgttgaaaattctttatgctacttcgatagaaaaattagaacatgaaaaatatttagattttgtaatgaaagcgtctaataatcagtgtttgtggaggaagtgtaaataa

SEQ ID NO: 70701 - protein, 258 aa, Candidatus Blochmannia floridanus
MNINSNRYVVLDTETTGMNKFGVHYEGHRIIEIGAVEIINRRLTNNQFHVYLNPNRSVDSEAFAIHGISDQFLVDQPCFLDIANDFLQFIRGSTLVIHNASFDLGFLNFELHNIYLNSRTVESYCTVIDSLKLARKIFPGQRNSLDALCERYCIKNSKRILHNALIDAQLLAYVFLVMTGGQTRIQFMDMLDNSDTNILNNTITHDNKFELCLNNSVCTEKKSLKILYATSIEKLEHEKYLDFVMKASNNQCLWRKCK

SEQ ID NO: 70702 - DNA, 735 bp, Bordetella bronchiseptica RB50
  CDS (1)..(735): transl_table=11
atgcgccagatcattttcgatacggaaaccaccggcctggacccggcccagggccatcgcatcgtcgaaatcggttgcgtcgagatcgtcaaccggatggtcacgggcaacaatctgcacctctacctgaaccccgaccgcgacagcgaccccgaggcgctggcggtgcacggcctgaccaccgagttcctggccgacaagccgcgctttgccgaagtggccgagcaattcctggctttcatcgccgacgccgagctgatcgcccacaacgccgcgttcgacgtcaagttcttcaacgccgagctgcagcgcatcggccgcgatccgctgaacacccactgcgagaacattgtcgattcgctgctgcatgcgcgcagcctgcaccccggcaagcgcaactcgctcgacgcgctgtgcgaccgctacggcatctccaacgcccaccggaccctgcacggcgccttgctcgactcgcagctgctggccgaggtctggctggcgatgacgcgcggccaggacgccttgctgatcgacgtcgatgaccagggcgcgaacgccaacggcgcgttggtgctgggcaagttcgatgcctcggtgctgaccgtgctggccgccagcgaagcggaattggccgagcatgcggcctatctgcaggcgctggacaaggcggtcggcggggcctgcgcctggcgcgcgatcgagccgctgcccgcggaatccgggcagcctggctga

SEQ ID NO: 70703 - protein, 244 aa, Bordetella bronchiseptica RB50
MRQIIFDTETTGLDPAQGHRIVEIGCVEIVNRMVTGNNLHLYLNPDRDSDPEALAVHGLTTEFLADKPRFAEVAEQFLAFIADAELIAHNAAFDVKFFNAELQRIGRDPLNTHCENIVDSLLHARSLHPGKRNSLDALCDRYGISNAHRTLHGALLDSQLLAEVWLAMTRGQDALLIDVDDQGANANGALVLGKFDASVLTVLAASEAELAEHAAYLQALDKAVGGACAWRAIEPLPAESGQPG

SEQ ID NO: 70704 - DNA, 720 bp, Chromobacterium violaceum ATCC 12472
  CDS (1)..(720): transl_table=11
atgagacagattattctcgataccgaaaccaccggtctcgatccgcagcaaggccaccgcatcattgaattcgccggcctggagatggtcggccgcaagctgaccggcaaacacctgcatctttatatacatccggaacgcgagatcgacccggaggcccagcgcgtgcacggcatttcgctggagtttctggcgggcaagcctgtgttcgccaaggtggcgcacgagatcgcggacttcctgcgcgacgccgagctgatcattcacaacgcgcccttcgacgtcggcttcctcaacgccgagttcgccaaggccggcatcgagccggtgggcaagctgtgcgccagcgtgatcgacacgctggccgaggcgcgcgacatgttccccggcaagcgcaacagcctggacgccttgtgcgaccgcttcgagatcgaccgttccaaccggacgctgcacggcgcgctggtggactgcgagctgctgtccgaagtgtatctatggatgacgcgcgggcaggaaagcctggcgatggacatcgaggtggagctgccgggcggcgacgccggggccatccagttcgagcgcaagccgctgaaggtgctggccgccagcgaggccgaagaggccgagcaccaagcctatcttgacgtgctggacaaggcggtcaagggcatctgcgtctggcgcgggctggcgtcgccggcgcaggcggagggctga

SEQ ID NO: 70705 - protein, 239 aa, Chromobacterium violaceum ATCC 12472
MRQIILDTETTGLDPQQGHRIIEFAGLEMVGRKLTGKHLHLYIHPEREIDPEAQRVHGISLEFLAGKPVFAKVAHEIADFLRDAELIIHNAPFDVGFLNAEFAKAGIEPVGKLCASVIDTLAEARDMFPGKRNSLDALCDRFEIDRSNRTLHGALVDCELLSEVYLWMTRGQESLAMDIEVELPGGDAGAIQFERKPLKVLAASEAEEAEHQAYLDVLDKAVKGICVWRGLASPAQAEG

SEQ ID NO: 70706 - DNA, 747 bp, Photorhabdus luminescens subsp. laumondii TTO1
  CDS (1)..(747): transl_table=11
atgagcacggcaattacacgacaagttgttcttgataccgaaactaccggtatgaataaattaggtgttcactatgaagggcacaaaattattgaaattggggccgtggaggttattaaccgtcgtttaaccggtcgccattttcatgtctatattcagccggatagattggtcgaccctgaagcatttgaagtgcatgggatcagcgatgaatttttgcaagataagccgctgtttgctgacattgcagatgagtttattgaatttattcgcggcgctgaattgattatccataacgctcccttcgatatcggctttatcgattatgagtttggcaaactgaatcgtgatattccgccaactgcggatttctgcaagattactgatagcttacaacttgcaagagggctatttccggggaaaaggaataaccttgatgcgttatgtgatcgttatgatatagacaattctaaacgaaccttacatggggcgttactcgatgctgagatattgtctgatgtctatttgataatgaccggcgggcagacttctcttgccttttcaatggaaggagagattgctagcggtgcgaatgtttctgaaatacagcgtattacccggcctcaaatggcattaaaagttatttatgcaacggatgaagagctcgctgcacatgaatccaggttggatttagtggagaagaaaggcgggagctgtttatggcgtatgaatcttggacaaagctaa

SEQ ID NO: 70707 - protein, 248 aa, Photorhabdus luminescens subsp. laumondii TTO1
MSTAITRQVVLDTETTGMNKLGVHYEGHKIIEIGAVEVINRRLTGRHFHVYIQPDRLVDPEAFEVHGISDEFLQDKPLFADIADEFIEFIRGAELIIHNAPFDIGFIDYEFGKLNRDIPPTADFCKITDSLQLARGLFPGKRNNLDALCDRYDIDNSKRTLHGALLDAEILSDVYLIMTGGQTSLAFSMEGEIASGANVSEIQRITRPQMALKVIYATDEELAAHESRLDLVEKKGGSCLWRMNLGQS

SEQ ID NO: 70708 - DNA, 699 bp, Rhodopseudomonas palustris CGA009
  CDS (1)..(699): transl_table=11
atgcgtgagatcgtcctcgataccgaaaccaccggcctcgatccgctgcgcggcgatcggctggtcgaaatcggctgcgtcgagatcttcaaccggatgccgaccggccgcacctatcatcaatacctcaatcccgaacgggacatgccggctgaagcctttgcggtgcatgggctgtcgagcgaattcctcgccgacaagccgctgttcgcacatgtggcggacgagtttctcgaattcatcggtgatgcgccgctggtgattcacaacgcatcgttcgacatcggcttcatcaatgcggagttgtcgcggctgtcgcgcgcgccggtgccacgcgatcgcctggtcgatacgctgctgctcgcccgccgcaagcatccgggcgtgtcgaaccggctcgacgatctttgctcgcgttacgcgatcgacaattcgcgccggaccaagcacggcgcgctgctcgacgccgagctgttggccgaagtctacatcgacctgatcggcgcccggcagtcgcagctcattctggccgacgtgccggttgaggtggccggagctgccagcgagagccggcgccgccagcgacccgcgccgctgccgaaccggctgaccgacgctgacctcgaagcccaccgcaccttcatcgccaccatgggcgagaaggcgatctggccggactatctgcccgccggcgcctga

SEQ ID NO: 70709 - protein, 232 aa, Rhodopseudomonas palustris CGA009
MREIVLDTETTGLDPLRGDRLVEIGCVEIFNRMPTGRTYHQYLNPERDMPAEAFAVHGLSSEFLADKPLFAHVADEFLEFIGDAPLVIHNASFDIGFINAELSRLSRAPVPRDRLVDTLLLARRKHPGVSNRLDDLCSRYAIDNSRRTKHGALLDAELLAEVYIDLIGARQSQLILADVPVEVAGAASESRRRQRPAPLPNRLTDADLEAHRTFIATMGEKAIWPDYLPAGA

SEQ ID NO: 70710 - DNA, 696 bp, Wolbachia endosymbiont of Drosophila melanogaster
  CDS (1)..(696): transl_table=11
atggaaagcaagctacgcgaaatagtacttgacactgaaacgacaggtcttgacactgaatctggtcatcgaattattgaaatagggtgtgtggaattaattaaccgcattccaacaggtaaagtattccatcggtaccttaacccagaaagagatataccttatcactcgtttaagattcacggtattagtgaagaatttttagaagataaaccattattttcagatgttgcacttgaatttcttgactttatatctaatgatattttggtaattcacaacgctgaattcgatgttaagttccttaacatggagttaagcaagctgaatgctaggttaatttcctcagacagagtgctagatacattacctcttgcgaggaaaaaattcgcaggatcacctgcttctttgaatgcattatgtaagcgttttgatatatcgctagagaatagagaattgcacggagcactagttgatgctcaattgcttgcaaaggtatatgttgaacttacaggagggttacaaacctttctgtttgataatgaatgcaatcaggacagtaactccacattcgttcagcataaagtacgtaatctaactcccagagaacatttaccaaatagtgaagaaattgatgaacataagaaactgttagacaaaattaacaatacactttggaataaatatattgaatag

SEQ ID NO: 70711 - protein, 231 aa, Wolbachia endosymbiont of Drosophila melanogaster
MESKLREIVLDTETTGLDTESGHRIIEIGCVELINRIPTGKVFHRYLNPERDIPYHSFKIHGISEEFLEDKPLFSDVALEFLDFISNDILVIHNAEFDVKFLNMELSKLNARLISSDRVLDTLPLARKKFAGSPASLNALCKRFDISLENRELHGALVDAQLLAKVYVELTGGLQTFLFDNECNQDSNSTFVQHKVRNLTPREHLPNSEEIDEHKKLLDKINNTLWNKYIE

SEQ ID NO: 70712 - DNA, 738 bp, Erwinia carotovora subsp. atroseptica SCRI1043
  CDS (1)..(738): transl_table=11
atgagcactgaaattacgcgacaaatcgtcctggatacagaaaccaccggtatgaataagctgggggttcactacgaagggcataaaattatcgagatcggtgcggtcgaagtgattaaccgccgcctgactggccgtcattttcacgtctacatcaaacccgatcgtttagtggatccagaggcctataacatacatggtatcagcgatgagtttcttgctgataaaccaacgtatgctgatgttgcggatgattttctcgattttatccgcggcgcggagttggtcattcataacgcaacgtttgatatcggctttatggattacgaatttcggttgctgaaccggaatattcccaagacggagacgttctgtaagatcaccgatagcctgtttatggcacggaagatctttcccggtaagcgtaacaatttggatgcgctctgcgatcgctatctgatagataacagcaagcgtacgttgcacggcgcattgctcgatgccgaaattctggcagaagtttatctggcgatgaccggtggtcaaacttctctgactttttcgatggaaggtgaagcgcagcggcagaatgagagtaatgaaacgatccagagaattgtccgccctcaatcggcgttaaaggtgctttacgctgatgaaacagagctgctcgcgcatgaacaacgtctggatttggttgctaaaaaaggcggtagttgcctgtggcgaacagaataa

SEQ ID NO: 70713 - protein, 245 aa, Erwinia carotovora subsp. atroseptica SCRI1043
MSTEITRQIVLDTETTGMNKLGVHYEGHKIIEIGAVEVINRRLTGRHFHVYIKPDRLVDPEAYNIHGISDEFLADKPTYADVADDFLDFIRGAELVIHNATFDIGFMDYEFRLLNRNIPKTETFCKITDSLFMARKIFPGKRNNLDALCDRYLIDNSKRTLHGALLDAEILAEVYLAMTGGQTSLTFSMEGEAQRQNESNETIQRIVRPQSALKVLYADETELLAHEQRLDLVAKKGGSCLWRTE

SEQ ID NO: 70714 - DNA, 690 bp, Rickettsia typhi str. Wilmington
  CDS (1)..(690): transl_table=11
atgtcaagtttaagagaaataattttagatactgaaactacgggacttgatccgcaacaaggtcatcgcatcattgagatcggtgcaattgagatggtgaataaggtattaacaggcaagcattttcattgttatattaatcctgaacgcgatatgcctttcgaagcttataagattcacggtatctcaggagaatttttaaaagataaacctctgtttcatacaatagccaatgattttttaaagtttatagcagatagtacacttattattcataatgctcctttcgatattaaatttctaaatcatgaattatctttattaaagagaaccgaaattaaatttttggaactaacgaatactatagatactctcgttatggcaaggagtatgtttcctggagcaagatatagtcttgatgcattatgtaaaagatttaaagttgataattcaggtcggcaacttcatggagctttaaaagatgcagcattacttgcagaagtgtatgtggcactcacaggaggtagacaatctacttttaagatgattgataaacctaatgaaataaacaacttaacagttaagtgtatagaggttcagaaaataaaaagaagtattgtggttaagcctactaaagaagaattacaaaaacataaagagttcatagataagattttaatacaggcttaa

SEQ ID NO: 70715 - protein, 229 aa, Rickettsia typhi str. Wilmington
MSSLREIILDTETTGLDPQQGHRIIEIGAIEMVNKVLTGKHFHCYINPERDMPFEAYKIHGISGEFLKDKPLFHTIANDFLKFIADSTLIIHNAPFDIKFLNHELSLLKRTEIKFLELTNTIDTLVMARSMFPGARYSLDALCKRFKVDNSGRQLHGALKDAALLAEVYVALTGGRQSTFKMIDKPNEINNLTVKCIEVQKIKRSIVVKPTKEELQKHKEFIDKILIQA

SEQ ID NO: 70716 - DNA, 783 bp, Mannheimia succiniciproducens MBEL55E
  CDS (1)..(783): transl_table=11
atgaaagttgaaattgatttaaatcgccaaatattgctggatacggaaaccacaggtatgaaccaattcggcgcccattatgaagggcattgcatcattgagattggcgcagtggaaatgattaatcgccgatatacgggcagaaaactgcatctttatatcaaaccggatcgactggtggaccctgaggcgattaaagtacatggtattaccgatgaaatgctggaggacaaaccggttttcaccgaagtcgcgcaggaattcattgattttatcaaaggtgccgaattattgattcataatgcgcccttcgatgtgggatttatggattatgaatttcgcaaacaccatattgacgttaaaacggcggatatttgctcggttaccgatacgttacagcttgcccgtcaaatgtatcccggcaaacgtaatagtttagacgccctttgtgaccgtcttggtattgataataccaaacgtgttcttcacggtgcattgctggatgctgagattctgggtgatgtttatttagtgatgacgggcggccagacaagtttatttgacgacaatgagcccgaacttgccgatattcattcggctaaagcacatattttggcgcaaaatgcggataaagtagcgcatcatttatctctgttacaacctacggacgaggaattacaggcacaccttgaatacatcaaattaattaataaaaaaagcaaggataattgcctgtgggaaaaacgccttggttcggattctaatgaagaaacgcagcattag

SEQ ID NO: 70717 - protein, 260 aa, Mannheimia succiniciproducens MBEL55E
MKVEIDLNRQILLDTETTGMNQFGAHYEGHCIIEIGAVEMINRRYTGRKLHLYIKPDRLVDPEAIKVHGITDEMLEDKPVFTEVAQEFIDFIKGAELLIHNAPFDVGFMDYEFRKHHIDVKTADICSVTDTLQLARQMYPGKRNSLDALCDRLGIDNTKRVLHGALLDAEILGDVYLVMTGGQTSLFDDNEPELADIHSAKAHILAQNADKVAHHLSLLQPTDEELQAHLEYIKLINKKSKDNCLWEKRLGSDSNEETQH

SEQ ID NO: 70718 - DNA, 756 bp, Legionella pneumophila subsp. pneumophila str. Philadelphia 1
  CDS (1)..(756): transl_table=11
atgatttggttgatgctttggcaaatttgggtattgaggaattatcatagagttatgagacaagttatattagataccgaaacgactggtattggacctgaacagggacatagagtaattgaaataggttgtattgagcttatcgatagaaaattaaccggcaagcacttccacatataccttaatccacagcgtgaggtggatgaaggggcatttagagttcacggtataagtactgagtttttgcaagataaacctttattccaggatattgtgactgaatttatacaatttgtggaaggttcagaattaattattcacaatgctccatttgatgttggatttcttaattctgaattaaaacatgtgaaatggaataagacattagaagattattgccggattcttgatactttgattttagccagagaaaaacatcctggacagcgtaatagtttggatgctttgtgtaagcgttatgaaatagatcattttaatcgtgaactgcacggtgctttgcttgatgccgaaatattagcttatgtgtatttggcaatgacaggtggccaaagcagtttatttactgaggttgaatccagtttgagtcaatcaaaaataaaaactcaagagataaagtcattaagtttaaaaaagccagtaataatgaaggctaatgaagaggaattaatgcaacatcaaagcttcgttgaatttatatctaaaaaatccggtatcaatcattgggaagaggtatag

SEQ ID NO: 70719 - protein, 251 aa, Legionella pneumophila subsp. pneumophila str. Philadelphia 1
MIWLMLWQIWVLRNYHRVMRQVILDTETTGIGPEQGHRVIEIGCIELIDRKLTGKHFHIYLNPQREVDEGAFRVHGISTEFLQDKPLFQDIVTEFIQFVEGSELIIHNAPFDVGFLNSELKHVKWNKTLEDYCRILDTLILAREKHPGQRNSLDALCKRYEIDHFNRELHGALLDAEILAYVYLAMTGGQSSLFTEVESSLSQSKIKTQEIKSLSLKKPVIMKANEEELMQHQSFVEFISKKSGINHWEEV

SEQ ID NO: 70720 - DNA, 723 bp, Burkholderia mallei ATCC 23344
  CDS (1)..(723): transl_table=11
atgcgccagatcattctcgataccgaaaccaccggcctgaacgcccgcgcgggcgaccgcatcatcgaaatcggctgcgtcgagctgctgaaccgccggctcaccggcaagaacctgcacttctacgtgaatcccgaacgcgacagcgacccgggcgcgctcgcggtgcacggcctcacgaccgaattcctgagcgacaagccgaagttcgccgaaatcgtcgatccgttgcgcgatttcgtccgcgacgcggaactgatcatccacaacgcgccgttcgacctcggctttctcgacgccgagttcgcgctgctcggcctgccgtccttcaccgaccactgcgcgggcgtgatcgacacgctcgtgcaggccaagcaaatgttcccgggcaagcgcaactcgctcgacgcgctgtgcgaccgcttcgggatcagcaacgcgcaccggacgctgcacggcgcgctgctggactccgagttgctcgccgaggtgtatctcgcgatgacgcgcgggcaggaaagcctcgtgatcgacatgctcgacgaagccggcgacgcccatcgcaacggcgacgcgccgcgaatggcgttcagcggactcgatctgccggtgctcgccgcgaccgacgcggaactcgccgcgcacgaggcgcagctcgacgcgctcgacaagtcggccaagggcgtatgcgtgtggcgcaaggaggcggtcggcgaggcttga

SEQ ID NO: 70721 - protein, 240 aa, Burkholderia mallei ATCC 23344
MRQIILDTETTGLNARAGDRIIEIGCVELLNRRLTGKNLHFYVNPERDSDPGALAVHGLTTEFLSDKPKFAEIVDPLRDFVRDAELIIHNAPFDLGFLDAEFALLGLPSFTDHCAGVIDTLVQAKQMFPGKRNSLDALCDRFGISNAHRTLHGALLDSELLAEVYLAMTRGQESLVIDMLDEAGDAHRNGDAPRMAFSGLDLPVLAATDAELAAHEAQLDALDKSAKGVCVWRKEAVGEA

SEQ ID NO: 70722 - DNA, 804 bp, Methylococcus capsulatus str. Bath
  CDS (1)..(804): transl_table=11
atgcgccaaatcgtactggacaccgaaaccaccggcctcgatcccaaagccggccaccgtatcatcgaaatcggctgcgtggagctgctcgaccggcggatcacccagaaccgcttccacgtctatatcaaccccgaacgggaaatcgatgccggcgcgatcgaagtacacggcctgaccaatgagttcctggccggtatgccggtattcaggaacatcgcggacgatttcctgaacttcatcagcggcgccgaactcatcatccataacgcagctttcgacgtcggcttcctcgaccacgaactctcgctcctgggcgaaaaccggggtcggatcgcggactattgcggcatctgcgacaccctggcgatggcgcgcaagaaccacccgggccagcgcaacagcctggatgccctgtgcaaacgctacaatgtcgacaacagccgccgggaactgcacggtgccttgctcgacgcagaaatcctcgccgacgtctacctggcgatgaccggcggacagatcaccatgctgctggaggctgacgccgagtccgggggggctcgcgggtccgatggagggttcgaacggtttgtggtgaacccctctgctggctccgttcatgctcagcccgggccgctcggggcaaattccgtcgaacgggagcaagccgcgcctcggtcggtcgacaccgcccgcccgcggctgcgggtcatccgcagcacgcccgaggaggccgaagcccacgccgctcgcctggaggccatcgccaaggcgagctccggcaactgcctgtggtcccgctag

SEQ ID NO: 70723 - protein, 267 aa, Methylococcus capsulatus str. Bath
MRQIVLDTETTGLDPKAGHRIIEIGCVELLDRRITQNRFHVYINPEREIDAGAIEVHGLTNEFLAGMPVFRNIADDFLNFISGAELIIHNAAFDVGFLDHELSLLGENRGRIADYCGICDTLAMARKNHPGQRNSLDALCKRYNVDNSRRELHGALLDAEILADVYLAMTGGQITMLLEADAESGGARGSDGGFERFVVNPSAGSVHAQPGPLGANSVEREQAAPRSVDTARPRLRVIRSTPEEAEAHAARLEAIAKASSGNCLWSR

SEQ ID NO: 70724 - DNA, 720 bp, Azoarcus sp. EbN1
  CDS (1)..(720): transl_table=11
atgagacagatcgtcctcgacacggaaaccaccggactcgactggcgcaacggcgaccgcgtcatcgaaatcggctgcgtcgagttgctgaaccgcaacctgaccgggcggcattaccacgtctatatcaacccggagcgcggcatcgatgccgaggcgatcgcggtgcacggcattaccgaggatttccttgccgacaagccgacgttcagcgccatcgcggccgagttcgaggatttcatccgcgacgccgaactgatcatccataacgcgagcttcgacgtcggcttcctgaaccacgagctgtcgcggctcgggcgcggaaagctcgacagcctttgcgcgggtgtcatcgatacgctgaagatggcgaaggagcagaacccgggcaagaaggcgtcgctcgacgcgctgtgcgaccggcaccagatcgacaacgcgtcccggacgctgcacggcgcactgctcgacgcggagctgctcgccgaagtctacctggcgatgacgcgcggccaggagagcctgatcatggtgctcgaagagcctgtgccgggcagcgccgaagctggaggcgtgctcgtcgatcggcctccgctgaaagtgctccgcgcgagcggcgaggagctggccgaacatgagcgggtgctgcaggacatcgcgaaagggacgaaaggcacctgcctgtggatcgcgcccgaacctgaagcggccgcggcctga

SEQ ID NO: 70725 - protein, 239 aa, Azoarcus sp. EbN1
MRQIVLDTETTGLDWRNGDRVIEIGCVELLNRNLTGRHYHVYINPERGIDAEAIAVHGITEDFLADKPTFSAIAAEFEDFIRDAELIIHNASFDVGFLNHELSRLGRGKLDSLCAGVIDTLKMAKEQNPGKKASLDALCDRHQIDNASRTLHGALLDAELLAEVYLAMTRGQESLIMVLEEPVPGSAEAGGVLVDRPPLKVLRASGEELAEHERVLQDIAKGTKGTCLWIAPEPEAAAA

SEQ ID NO: 70726 - DNA, 726 bp, Silicibacter pomeroyi DSS-3
  CDS (1)..(726): transl_table=11
atgcgtgaaatcgtactcgacactgaaaccaccggattcgaccctgaaaccggcgaccgcattgtcgagattggcgcggtcgagttgtggaaccacatcgccaccggcaacacctatcaccagtatatcaatcccgaacggatgatgcccgccgaggcttttggcgtgcatggcatcggccccgatatcctggagccgccgcaacagccggaaccgggccaggtgaccctgcgcgacaagccggtctttgccaaagtcggacaggcgtttcgcgatttcgtcgccgattcccatttggtcatccacaacgcgtccttcgacatgaagttcctgaatgccgaactgcgctggatgggcctgcccgagattccgttcgatcgggccatcgacacgctgggcatggcccggcgcaaatttccgggctcgcccgccacgctggatgcgctgtgccggcggtttggcatcgacaactcgaaccgggtgctgcacggggccttgctggatgccgagatcctggccgaggtctatctggaactgatcggtggcaagcagcccgatttcggcctgtcgacggtgacaacgggcgatggccccggacaggaaaccgcctggcgggcgatgccacggccaaccccccttcccgcaaggatcaccgaggcagagcgcacggcgcatgccgagtttgtcgagaaactgggggaaaacgcggtgtggaaacgcgcctga

SEQ ID NO: 70727 - protein, 241 aa, Silicibacter pomeroyi DSS-3
MREIVLDTETTGFDPETGDRIVEIGAVELWNHIATGNTYHQYINPERMMPAEAFGVHGIGPDILEPPQQPEPGQVTLRDKPVFAKVGQAFRDFVADSHLVIHNASFDMKFLNAELRWMGLPEIPFDRAIDTLGMARRKFPGSPATLDALCRRFGIDNSNRVLHGALLDAEILAEVYLELIGGKQPDFGLSTVTTGDGPGQETAWRAMPRPTPLPARITEAERTAHAEFVEKLGENAVWKRA

SEQ ID NO: 70728 - DNA, 735 bp, Neisseria gonorrhoeae FA 1090
  CDS (1)..(735): transl_table=11
atgatgacacgccaaatcatcctcgataccgaaaccaccggcctgtatgccgacggcggcgaccgtctggtcgagtttgccggtctggaaatggtcaaccgccaaatgaccgacaaaaacctgcacctctatgtccaccccgagcgcgatatgcccgaagaggcggcacgcgtccacggcttgacgatacaggttttggaagagaaaaacgcgccgccgtttgcagaggtcggcaggcagattgccgattttctgcgcggtgcggaactgattatccacaatgccaaattcgatgtgggcttcctcaatatggagttccgccgggtggggctgccgaccgtcgaggaactcggctgcaccgttaccgataccctggcgatggcgcgcgaaatgtttccggggcagaaagcgagcctggatgccctgtgcaaccgtttttccgtcgaccgcagcaagcgcgtcctgcacggcgcattgatcgactgcgaacttttgggcgaagtctatctggcgatgacgcggcggcaattcgacttgatgggggagaccgaggaggaagaaccgacagccaaacctgttgcatctgccgaaatgaaactcggtgccaaactgaaagtgattaaggcggatgaagccgaactggcggcgcacgaagaatatctcgacggcttgggcgaagcctgtatttggcgtaaggaagccgtgccgtctgaaaacggcggggaaaacgcatga

SEQ ID NO: 70729 - protein, 244 aa, Neisseria gonorrhoeae FA 1090
MMTRQIILDTETTGLYADGGDRLVEFAGLEMVNRQMTDKNLHLYVHPERDMPEEAARVHGLTIQVLEEKNAPPFAEVGRQIADFLRGAELIIHNAKFDVGFLNMEFRRVGLPTVEELGCTVTDTLAMAREMFPGQKASLDALCNRFSVDRSKRVLHGALIDCELLGEVYLAMTRRQFDLMGETEEEEPTAKPVASAEMKLGAKLKVIKADEAELAAHEEYLDGLGEACIWRKEAVPSENGGENA

SEQ ID NO: 70730 - DNA, 780 bp, Pseudomonas syringae pv. syringae B728a
  CDS (1)..(780): transl_table=11
atggcattgcaaaacctggataacagatcgatcgtcctcgataccgaaaccaccggtatgccggtgacggatggtcaccgcatcatcgagatcggttgtgtcgagttgatcggtcgtcgcctgaccgggcggcattttcacgtttacctgcaacctgatcgcgaaagtgacgaaggcgcgatcggtgttcacggtatcaccaacgaatttctggtcggcaagccgcggtttgccgaagtcgccgatgaattcttcgagttcatcaagggcgcgcagctgatcattcacaacgcagcgttcgacgttggcttcatcaacaacgaatttgccttgatgggttcgcaggacagggctgatatcacccagcactgttcgattctcgataccctgatgatggcgcgagagcgccacccgggtcagcgcaacagcctggatgcactgtgcaagcgctatggcgtcgacaactcgggccgtgagttgcacggcgcattgctcgactccgagattctggctgacgtctacctggcgatgaccggcgggcagaccagcctgtcgctggccggcaatgcttccgatggcaatggttcgggcgaaggctccggcaaccgtggcagcgaaattcgccgcctgccggccgatcgcaagccttgccgcatcattcgcgcttctgaaagtgaactggccgagcacgaagtgcgtatgagcaccatcgccaaggcttgcggtgctcctccgctctgggtacagatgctggaagccggagcaccggcatcttcctga

SEQ ID NO: 70731 - protein, 259 aa, Pseudomonas syringae pv. syringae B728a
MALQNLDNRSIVLDTETTGMPVTDGHRIIEIGCVELIGRRLTGRHFHVYLQPDRESDEGAIGVHGITNEFLVGKPRFAEVADEFFEFIKGAQLIIHNAAFDVGFINNEFALMGSQDRADITQHCSILDTLMMARERHPGQRNSLDALCKRYGVDNSGRELHGALLDSEILADVYLAMTGGQTSLSLAGNASDGNGSGEGSGNRGSEIRRLPADRKPCRIIRASESELAEHEVRMSTIAKACGAPPLWVQMLEAGAPASS

SEQ ID NO: 70732 - DNA, 768 bp, Haemophilus influenzae 86-028NP
  CDS (1)..(768): transl_table=11
atgattaatcccaatcgccaaattgtattagatactgaaactacaggtatgaatcagcttggcgcgcattatgaaggacactgcattattgaaattggtgcagttgaattaataaatcgtcgttacacaggtaataatttccatatttatattaagccagatcgccctgttgatcctgatgcgattaaagttcatggtattactgatgaaatgttagcggataaaccagaattcaaagacgtagcccaagattttttggattatattaatggtgcggaattgcttattcacaatgccccctttgacgttggatttatggattatgaatttcgtaaacttaaccttaatgtgaaaactgacgatatttgtttggtgacagatacgctacaaatggcgcgtcagatgtatcttggaaaacgcaataatttggatgcactttgtgagcgtttaggtattgataatagcaaacgtactttgcacggtgcgttactggatgccgagatcttggcggatgtttatttgatgatgacgggagggcaaacaaatttattcgatgaagaatctgttgagtctgaagttatccatgttatgcaagaaaaaacggcggaagaaataaaaagtgcggtagatttttcgcacaatttgaaattacttcaacctactaatgatgagttacaagcgcatttagaattcttaaagatgatgaataaaaaaagtggaaataattgcctttgggaaaaacgctttggcaataataatgtgcattaa

SEQ ID NO: 70733 - protein, 255 aa, Haemophilus influenzae 86-028NP
MINPNRQIVLDTETTGMNQLGAHYEGHCIIEIGAVELINRRYTGNNFHIYIKPDRPVDPDAIKVHGITDEMLADKPEFKDVAQDFLDYINGAELLIHNAPFDVGFMDYEFRKLNLNVKTDDICLVTDTLQMARQMYLGKRNNLDALCERLGIDNSKRTLHGALLDAEILADVYLMMTGGQTNLFDEESVESEVIHVMQEKTAEEIKSAVDFSHNLKLLQPTNDELQAHLEFLKMMNKKSGNNCLWEKRFGNNNVH

SEQ ID NO: 70734 - DNA, 750 bp, Pseudomonas fluorescens Pf-5
  CDS (1)..(750): transl_table=11
atggccaacagatctgttgtactcgataccgaaaccaccggcatgccggtgaccgacggccaccggatcattgaaatcggttgcgtcgagttgatcggtcggcgcctgaccggccggcacttccacgtttacctgcaaccggatcgcgagagcgatgagggcgccatcggcgtccacggcatcaccaacgaattcctggtgggcaagccgcgtttcgccgaagtcgccgacgagttcttcgacttcatccagggcgcgcagctgatcatccacaacgcggcgttcgacgttggcttcatcaacaacgaattcgccttgatgggccagcacgaacgggccgacatcacccagcactgcaccatcctcgacaccctgatgatggcccgcgagcggcacccggggcagcgcaacagcctcgacgccctgtgcaaacgctacggcgtcgacaactccggccgtgaactgcacggcgccttgctcgactcggagatcctggccgacgtctacctgaccatgaccggtggccagaccagcctgtccctggcgggcaatgcctcggacggcaacggctctggcgagggggccggccaggcttcggaaatccgccgcttgccggccgatcgcccgcgcgggcggatcatccaggccagcgacgccgaactggccgagcaccaggtgcgcctggaaatcatcgccaagtccgccggtgccccggcgctctggacccagttgctcgaaacccagcagtaa

SEQ ID NO: 70735 - protein, 249 aa, Pseudomonas fluorescens Pf-5
MANRSVVLDTETTGMPVTDGHRIIEIGCVELIGRRLTGRHFHVYLQPDRESDEGAIGVHGITNEFLVGKPRFAEVADEFFDFIQGAQLIIHNAAFDVGFINNEFALMGQHERADITQHCTILDTLMMARERHPGQRNSLDALCKRYGVDNSGRELHGALLDSEILADVYLTMTGGQTSLSLAGNASDGNGSGEGAGQASEIRRLPADRPRGRIIQASDAELAEHQVRLEIIAKSAGAPALWTQLLETQQ

SEQ ID NO: 70736 - DNA, 780 bp, Pseudomonas syringae pv. phaseolicola 1448A
  CDS (1)..(780): transl_table=11
atggcattacaaaacctggataacagatcaatcgttctcgataccgaaaccaccggtatgccggtgacagatggtcaccggatcatcgagatcggttgtgtcgagttgattggccggcgcctgaccggtcggcattttcacgtctacctgcaacctgatcgcgaaagtgacgaaggcgcgattggcgttcacggtatcaccaacgaatttctggtcggcaagccccggtttgccgaagtcgccgatgaatttttcgaattcatcaaaggcgcgcaactgatcattcacaacgcagcgttcgatgttggcttcatcaacaacgaatttgccttgatgggttcgcaggacagggctgatatcacccagcactgttcgatcctcgacaccctgatgatggcccgcgagcgccatccggggcagcgcaacagtctggatgccctgtgcaagcgctacggcgtcgacaactcgggccgcgagctgcacggcgcactgctcgactctgaaattctggccgacgtctacctggcgatgaccggcggacagaccagcctgtcgctggctggtaatgcctctgacggcaacggctccggtgaaggctctggcaaccgaggcagcgaaatccgccgtttgcctgccgatcgcaaaccttgccgcatcattcgtgcttcggaaagtgaactggccgagcatgaagtccgtatgagcaccattgccaaggcatccggtgcacctgctttgtgggtacaaatgctggaagccgcagcgcagacgtcctcctga

SEQ ID NO: 70737 - protein, 259 aa, Pseudomonas syringae pv. phaseolicola 1448A
MALQNLDNRSIVLDTETTGMPVTDGHRIIEIGCVELIGRRLTGRHFHVYLQPDRESDEGAIGVHGITNEFLVGKPRFAEVADEFFEFIKGAQLIIHNAAFDVGFINNEFALMGSQDRADITQHCSILDTLMMARERHPGQRNSLDALCKRYGVDNSGRELHGALLDSEILADVYLAMTGGQTSLSLAGNASDGNGSGEGSGNRGSEIRRLPADRKPCRIIRASESELAEHEVRMSTIAKASGAPALWVQMLEAAAQTSS

SEQ ID NO: 70738 - DNA, 717 bp, Dechloromonas aromatica RCB
  CDS (1)..(717): transl_table=11
atgcgacagatcgttctcgacactgaaaccaccggcctagacccccgctcaggccaccgtatcatcgaagtggcgtgcatcgagatggtgaaccgccgctttaccggtcaccacctgcacaaatatattaaccctgagcgcgaaatcgacgaaggcgcccaggcggtgcacggcatcacccttgaattcctggccgacaagcctaaattcgccgacatcgccgacgagtttcttgagttcatcaacggcgccgaattgatcatccacaacgcgcctttcgacatcggcttcctcaatgccgaactcgaccggctcggccgggtgccggtcggcaccatttgcaatggcgtcatcgacaccctgcgcatggccaaggagttgcatcccggcaagcgcaacagccttgatgcgctgtgtgaacgctacgagatcgacaattcgagccggaccctgcacggcgcgctgctcgatacggaattgctggccgacgttttcctggccatgacccgaggccagaacagcctgatgatcgaacccgatgcagagccacgtccgaacatcggcgccgacggccaggttcgcgaacgcaagccactcagcgtacgccgcgccgcgccggaggaaatcgccgagcacgaaacggtattggcggcaatcgacaaggaatcgaagggtgcctgcatctggttgcccaagccagaaaccgaagcagcctga

SEQ ID NO: 70739 - protein, 238 aa, Dechloromonas aromatica RCB
MRQIVLDTETTGLDPRSGHRIIEVACIEMVNRRFTGHHLHKYINPEREIDEGAQAVHGITLEFLADKPKFADIADEFLEFINGAELIIHNAPFDIGFLNAELDRLGRVPVGTICNGVIDTLRMAKELHPGKRNSLDALCERYEIDNSSRTLHGALLDTELLADVFLAMTRGQNSLMIEPDAEPRPNIGADGQVRERKPLSVRRAAPEEIAEHETVLAAIDKESKGACIWLPKPETEAA

SEQ ID NO: 70740 - DNA, 723 bp, Ralstonia eutropha JMP134
  CDS (1)..(723): transl_table=11
atgcgcgccatgcgacaaatcgttctcgacaccgaaaccactggcctcaatgccgccacgggcgaccgcctgatcgaaatcgggtgtgtcgaactggtcaaccgccggctcacgggccgccacctgcacttctacgtcaaccccgagcgcgacatcgacgaaggcgccatcgccgtgcacggcatcaccgtcgaattcctggccgacaagccaaagttcgccgaggtcgtcaacgaggtccgcgacttcgtgcaggacgccgagctgatcatccacaacgcgcagttcgacctgggcttcctggatatggagttccggctgctcggcttgccgccgttccgcgaacacgtcggcagcgtgatcgataccctgctcgaagcgcgccagatgttccccggcaagcgcaattcgctggatgcgctgtgcgaccggcttggcgtgagcaacgcgcaccgcacgctgcacggcgcgttgctcgatgcagaactgctggcagaggtctacctggccatgacgcgcggccagaactcgctggtcatcgacatgctcgacggcgccgaagccgcggacggttccgtcgcggaatcagacctttcgcacatcgtcctgcctgtgctgtatgcgagcgaagccgaagtgtccgagcatctcgctgtgctcaaacaactggacaaggcaagcggcggcaagacggtatggcaggacacccccgcagtgcaatag

SEQ ID NO: 70741 - protein, 240 aa, Ralstonia eutropha JMP134
MRAMRQIVLDTETTGLNAATGDRLIEIGCVELVNRRLTGRHLHFYVNPERDIDEGAIAVHGITVEFLADKPKFAEVVNEVRDFVQDAELIIHNAQFDLGFLDMEFRLLGLPPFREHVGSVIDTLLEARQMFPGKRNSLDALCDRLGVSNAHRTLHGALLDAELLAEVYLAMTRGQNSLVIDMLDGAEAADGSVAESDLSHIVLPVLYASEAEVSEHLAVLKQLDKASGGKTVWQDTPAVQ

SEQ ID NO: 70742 - DNA, 699 bp, Thiobacillus denitrificans ATCC 25259
  CDS (1)..(699): transl_table=11
atgcgtcaaatcatcctcgatacggaaacgaccgggctcgacccggcccagggccatcgcatcatcgaagtcgcggcggtggaaatggtcaaccgccggctgaccggcaatcacctccatcgctacgtcaatccggaccgtgacatcgacgccggagccatgcaggtgcacggcatcacgccggagtttctgcaggacaagccgcgtttcggcgatatcgcgcgcgagttcgtcgatttcatcgacggcgccgagctgatcatccacaacgcaccgttcgacgttggctttctcaacatggagttgcgcctgctcggcatgccgctcctggcgacctgctgcggcggggtgaccgacacgctggcgatggccaaggcgctgcaccccggccagcgcaataacctcgacgcactttgcaaacgctacgccgtcgacaataccgcgcgcacgctgcacggcgcgctgctcgactgcgagttgctggccgcggtctatctggcgctgacccgcggccaggaaagcctttcgatcggactggaaataccgcgttcggagagcggccgtgcggcggaccggccgcggccggcagcgattttgttgccggcggacgcggaggaggaggcagcgcatgcggcgctgctcgcggcgatcgcgaaggagagcaagggcgaatgcctgtggggcgtagaggcgccttga

SEQ ID NO: 70743 - protein, 232 aa, Thiobacillus denitrificans ATCC 25259
MRQIILDTETTGLDPAQGHRIIEVAAVEMVNRRLTGNHLHRYVNPDRDIDAGAMQVHGITPEFLQDKPRFGDIAREFVDFIDGAELIIHNAPFDVGFLNMELRLLGMPLLATCCGGVTDTLAMAKALHPGQRNNLDALCKRYAVDNTARTLHGALLDCELLAAVYLALTRGQESLSIGLEIPRSESGRAADRPRPAAILLPADAEEEAAHAALLAAIAKESKGECLWGVEAP

SEQ ID NO: 70744 - DNA, 759 bp, Pseudomonas fluorescens PfO-1
  CDS (1)..(759): transl_table=11
atggccaccagatccgttgtactcgataccgaaaccaccggcatgccggtgaccgacggccaccggattatcgaaatcggttgtgtcgagttgatcggtcgacgtctgacgggccggcactttcacgtttatctgcaaccggatcgcgagagtgacgaaggcgcgattgccgttcatggcatcaccaacgaattcctggtcggcaagccgcgcttcgccgaagtggccgacgagttcttcgagttcatcaacggcgcgcaactgatcatccataacgcggcgttcgacgttggcttcatcaacaacgaattcgccctgatgggccagcatgatcgcgcggacatcacgcagcactgcacgatcctcgacaccctgatgatggcccgggaacgtcacccgggtcagcgcaacagcctcgatgccctgtgtaaacgctacggcgtcgacaactccggtcgtgagctgcacggcgccttgctcgactcggagattctcgccgacgtctacctgaccatgaccggtggccagaccagcctttcgctggccggcaacgcttccgacggcaatggcacgggcgagggcgcggacaactccgccaccgaaatccgccgtctgccggcagatcgtcagccggggcgaatcattcgcgccactgaagccgagctggccgagcaccaggtgcgcctggaaatcatcgccaagtcagctggcgcccccgcgctgtggactcagttgctggaagccgaagctcaggcgtaa

SEQ ID NO: 70745 - protein, 252 aa, Pseudomonas fluorescens PfO-1
MATRSVVLDTETTGMPVTDGHRIIEIGCVELIGRRLTGRHFHVYLQPDRESDEGAIAVHGITNEFLVGKPRFAEVADEFFEFINGAQLIIHNAAFDVGFINNEFALMGQHDRADITQHCTILDTLMMARERHPGQRNSLDALCKRYGVDNSGRELHGALLDSEILADVYLTMTGGQTSLSLAGNASDGNGTGEGADNSATEIRRLPADRQPGRIIRATEAELAEHQVRLEIIAKSAGAPALWTQLLEAEAQA

SEQ ID NO: 70746 - DNA, 690 bp, Rhodobacter sphaeroides 2.4.1
  CDS (1)..(690): transl_table=11
atgcgtgagatcgtcctcgacaccgaaaccaccggcttcgagccctccgaggggcaccggatcgtcgagatcggcgcggtcgagctcttcaaccacatgccgacggggcgcacctaccaccagtatatcaaccccgagcgcccgatgccgaacgaggccttcgaggttcacggcctcggagacgagttcctgcgcgacaagccggtctttgcggccatcggacgcgccttcctcgatttcgtgggcgaggcccgcctcgtgatccacaacgccgccttcgacatgaaattcctgaatttcgagctcgggcgcgccggcctgccccgcctcgcgcccgatcaggcgctcgacacgctggccctggcgcggcagcggtttccgggcgcgcccgccacgctcgatgcgctgtgccgccgcttcggcgtcgacaattcggcgcgcgaaaagcacggggcgctgctcgacagcgagatcctggcagaggtctatctggaactgatcggcgggcggcagccggatttcggactggccagctcggccggtgcgcgtccgggcagcccggagggcgaatggcgcccgcgtccccggcccgtggcgctgccgccgcgcatcaccgaggaagaggccgccgcccatgctgccttcgtggcgaagctgggcgacggcgcgatctggctcaaacgggcctga

SEQ ID NO: 70747 - protein, 229 aa, Rhodobacter sphaeroides 2.4.1
MREIVLDTETTGFEPSEGHRIVEIGAVELFNHMPTGRTYHQYINPERPMPNEAFEVHGLGDEFLRDKPVFAAIGRAFLDFVGEARLVIHNAAFDMKFLNFELGRAGLPRLAPDQALDTLALARQRFPGAPATLDALCRRFGVDNSAREKHGALLDSEILAEVYLELIGGRQPDFGLASSAGARPGSPEGEWRPRPRPVALPPRITEEEAAAHAAFVAKLGDGAIWLKRA

SEQ ID NO: 70748 - DNA, 735 bp, Burkholderia sp. 383
  CDS (1)..(735): transl_table=11
atgcgccagatcattctcgataccgaaaccaccggcctgaacgcccgcacgggcgaccgcctcatcgaaatcggctgcgtcgagctgctgaaccggcggctcaccggcaacaacctgcacttctacgtgaaccccgagcgcgacagcgatccgggcgcactggcggtgcacgggctcacgaccgaattcctcagcgacaagccgaaattcgcggaagtcgccaaccagattcgcgacttcgtgcaggacgccgagctgatcatccacaacgcgccgttcgaccttggcttcctcgacgcggaattcgcgcggctcgacctgccgccgttcaccaagcattgcggcggcgtgatcgacacgctggtgcaggccaagcagatgttcccgggcaagcgcaactcgctcgacgcgctgtgcgaccgcttcggcatcagcaacgcgcaccgcacgctgcacggcgcactgctcgactcggagctgctcgccgaggtgtatctcgcgatgacgcgcggccaggacagcctcgtgatcgacatgctcgacgacgcgggcgccgacggcggtgcgggcaatggtcagcgcgtgtcgctcgcggcgctcgacctgcccgtggtggccgcgagcgacgacgaactcgccgcccaccaggcgcagctcgacgagctcgacaagtcagtcaagggcacctgcgtgtggcgcacgtcggccgacgcaggtgctgcagaaacggcttaa

SEQ ID NO: 70749 - protein, 244 aa, Burkholderia sp. 383
MRQIILDTETTGLNARTGDRLIEIGCVELLNRRLTGNNLHFYVNPERDSDPGALAVHGLTTEFLSDKPKFAEVANQIRDFVQDAELIIHNAPFDLGFLDAEFARLDLPPFTKHCGGVIDTLVQAKQMFPGKRNSLDALCDRFGISNAHRTLHGALLDSELLAEVYLAMTRGQDSLVIDMLDDAGADGGAGNGQRVSLAALDLPVVAASDDELAAHQAQLDELDKSVKGTCVWRTSADAGAAETA

SEQ ID NO: 70750 - DNA, 693 bp, Rhodospirillum rubrum ATCC 11170
  CDS (1)..(693): transl_table=11
atgcgtgaaatcgttctggatacggaaaccaccgggctggatccggcgaccggcgaccggctggtggaaatcggctgcatcgagctgatcaaccacatgccgagcggcaatgacctgcatctttacgtcaatcccgagcgcgacatgccgcccgaagccttccgcgttcatggcctgtccgaggcgtttctcgccgataagccgctgtttgccgaggtcgtcgacgaattcctggcctttatcggcgaggatcggctgatcatccataacgccgccttcgacatgaaattcctcaatgccgaattggcccgcctgaagcggccgccgctgccgatgagccgagcgctcgataccctgcgcatggcccaggcgcgctttcccggggctcaggccagtctggacgccctctgtcggcgttttggcgtcgatacctcgtcgcgcaccaagcatggcgccctgatcgactgcgtgctgctggccgaggtttatctggaactgatcggcgggcgtgagcccgggctcgccctgtcggccgacaagcgccgcgacggggcggcggtgcaggtggcccgcccgttccgcgcgccacggccccatgccgccagccccgaagaactggccgcccacgaggagtttctgaaaaaggtcaaggatccgatctggcggcgcgacgcgcccaatcccccgtcgtaa

SEQ ID NO: 70751 - protein, 230 aa, Rhodospirillum rubrum ATCC 11170
MREIVLDTETTGLDPATGDRLVEIGCIELINHMPSGNDLHLYVNPERDMPPEAFRVHGLSEAFLADKPLFAEVVDEFLAFIGEDRLIIHNAAFDMKFLNAELARLKRPPLPMSRALDTLRMAQARFPGAQASLDALCRRFGVDTSSRTKHGALIDCVLLAEVYLELIGGREPGLALSADKRRDGAAVQVARPFRAPRPHAASPEELAAHEEFLKKVKDPIWRRDAPNPPS

SEQ ID NO: 70752 - DNA, 726 bp, Burkholderia thailandensis E264
  CDS (1)..(726): transl_table=11
atgcgccagatcattctcgataccgaaaccaccggcctgaacgcccgcgcgggcgaccgcatcatcgaagtcggctgcgtcgagctgctgaaccgccggctcaccggcaacaacctgcacttctacgtgaatcccgagcgcgacagcgatccgggcgcgctcgcggtgcacggcctcacgaccgaattcctgcgcgacaagccgaagttcgccgacatcgtcgatcagttgcgcgacttcgtccgcgacgcggaactcatcatccataacgcgccgttcgacctcggctttctcgacgccgagttcgcgctgctcggcctgccggccttctccgaccactgcgcgggcgtgatcgacacgctcgtgcaagccaagcagatgttccccggcaagcgcaactcgctcgacgcgctgtgcgatcgcttcgggatcagcaacgcgcaccggacgctgcacggcgcgctgctcgactcggagttgctcgccgaggtgtatctcgcgatgacgcgcgggcaggaaagcctcgtcatcgacatgctcgacgaagccggcgacgcgcatcgcaaaggcgacgagccgcaaatggcgttcagcgggctcgacctgccagtgctcgccgcgaccgacgaggaactcgccgatcacgaggcgcaactcgacgcgctcgacaagtccgtcaagggtgcgtgcgtatggcgtaaggaagcggcggtcgacggagcctga

SEQ ID NO: 70753 - protein, 241 aa, Burkholderia thailandensis E264
MRQIILDTETTGLNARAGDRIIEVGCVELLNRRLTGNNLHFYVNPERDSDPGALAVHGLTTEFLRDKPKFADIVDQLRDFVRDAELIIHNAPFDLGFLDAEFALLGLPAFSDHCAGVIDTLVQAKQMFPGKRNSLDALCDRFGISNAHRTLHGALLDSELLAEVYLAMTRGQESLVIDMLDEAGDAHRKGDEPQMAFSGLDLPVLAATDEELADHEAQLDALDKSVKGACVWRKEAAVDGA

SEQ ID NO: 70754 - DNA, 717 bp, Francisella tularensis subsp. holarctica
  CDS (1)..(717): transl_table=11
atgatatatatactattttttagaatgtcacgacaagtttttatagatactgagacaactggctttgattataagattggtaatagaattattgaatttggtgcagttgaagttattgatagaaggataacaggtaataatttacatttttattgtaatccaaattataaagttgaagctggagctttagctattcatggtcttacaaatgaatttctagcagataaacctctttttgaggataaagttgatgagatgattgagtttttaagaggtgctgaagtaatcattcataatgcagcttttgatgtgccatttataaattgggaacttagtctcttaaaaaataataaatacggaacattagagcaaaatgttgctaaaatagtagatagccttgatttagctagaaaaaaacatccattacaaaaaaataatcttgatgctctatgtaaaagatatcaaattaggaatgatcatcgtacctttcacggagcattattagatagtgagctgttagcggatgtttatctagctatgacaggtgggcagactaatctaagtctgcaaacagccaaaactgtgagcaaaaatagtattgatattgatgtcaataaactaaacttacgtaatgctgaagatagtattagcgatatttctgcacatcatagttatcttagtaatttgctaaaactagaagaagatgcaaaatggtaa

SEQ ID NO: 70755 - protein, 238 aa, Francisella tularensis subsp. holarctica
MIYILFFRMSRQVFIDTETTGFDYKIGNRIIEFGAVEVIDRRITGNNLHFYCNPNYKVEAGALAIHGLTNEFLADKPLFEDKVDEMIEFLRGAEVIIHNAAFDVPFINWELSLLKNNKYGTLEQNVAKIVDSLDLARKKHPLQKNNLDALCKRYQIRNDHRTFHGALLDSELLADVYLAMTGGQTNLSLQTAKTVSKNSIDIDVNKLNLRNAEDSISDISAHHSYLSNLLKLEEDAKW

SEQ ID NO: 70756 - DNA, 717 bp, Saccharophagus degradans 2-40
  CDS (1)..(717): transl_table=11
atgagacagatagttctcgataccgagacaacgggcctagagccaagccaaggccaccgaattattgagatagggtgtgttgagctaataaatcgaaagcttacgggccgtcattatcaccagtacattaaacctgaacgggaaattgatgaaggcgcaattgaagttcacggcattaccaacgaatttctagcagacaaaccggtttttaaagatatagccgatgagtttatggcgtttgttgatggtgcagaactagtcattcacaacgcaccgttcgatgtgggctttctaaatcacgaatttaaccttctagggcgtggcagcacagttataaacgaccgctgttctattctcgatacgctcgcactagcaagaaacaagcaccctgggcaaaagaacaacctggatgccctgtgtaagcgttacggcgcagataactccgcacgagaccttcacggcgctttgctcgatgctgaaattctagccgatgtttacctgttaatgaccggtgggcaaaccaaccttgccctaggtggtgcgggttcgtctagtggcatggacgacggtggtgaagagcttgtacgtgtaagtgccgatcgcaaaccgctccccattataagagcgtctgcagaagagctggctttacacgagaaaaagttggctgaaatagacaaggcttcaggcggcgaatgcctctggctcaagcagtcataa

SEQ ID NO: 70757 - protein, 238 aa, Saccharophagus degradans 2-40
MRQIVLDTETTGLEPSQGHRIIEIGCVELINRKLTGRHYHQYIKPEREIDEGAIEVHGITNEFLADKPVFKDIADEFMAFVDGAELVIHNAPFDVGFLNHEFNLLGRGSTVINDRCSILDTLALARNKHPGQKNNLDALCKRYGADNSARDLHGALLDAEILADVYLLMTGGQTNLALGGAGSSSGMDDGGEELVRVSADRKPLPIIRASAEELALHEKKLAEIDKASGGECLWLKQS

SEQ ID NO: 70758 - DNA, 696 bp, Methylobacillus flagellatus KT
  CDS (1)..(696): transl_table=11
atgagtatgcggcaaatttttctggatactgaaaccactgggctttatcacgctcaagggcatcgcattattgaaattgccggggttgagctcgtcaaccgcaggctgaccaataaccacttccatgtctacctcaacccggatcgtgaaattgatgaggcggcgcaggaggttcatggcatcacgctggaattcctgcaggacaagccgcgctttgccgatatcgtcgatgagttcctgcaattcgtttcaggggcagatctgattatccacaatgcaccgtttgatatcggcttcctcaatgccgagctcaatagggtggggcggcaaaacatcgaacatagcgtgcttgaaattatcgacaccctgaaaatggccaaggaaatgcggcctgggcaacgcaacaatctcgatgcgttgtgcaggcactacggcatagacaattcctcacgtaccctgcatggcgccttgctggatgcagagttgcttgctgatgtctacatggcgatgacccgcgggcaggaaagcctgatgattgatatgctggatcaggggccaatagagggtagtggagagatcaggttgacgcgcagcaagccattactggtcttgaccgccagcgaggccgagctcgcagctcatgaagaatatctgcaggctatgagcaagagtggcgcctgcgtttggccccagtga

SEQ ID NO: 70759 - protein, 231 aa, Methylobacillus flagellatus KT
MSMRQIFLDTETTGLYHAQGHRIIEIAGVELVNRRLTNNHFHVYLNPDREIDEAAQEVHGITLEFLQDKPRFADIVDEFLQFVSGADLIIHNAPFDIGFLNAELNRVGRQNIEHSVLEIIDTLKMAKEMRPGQRNNLDALCRHYGIDNSSRTLHGALLDAELLADVYMAMTRGQESLMIDMLDQGPIEGSGEIRLTRSKPLLVLTASEAELAAHEEYLQAMSKSGACVWPQ

SEQ ID NO: 70760 - DNA, 735 bp, Burkholderia xenovorans LB400
  CDS (1)..(735): transl_table=11
atgcgtcaactcatcctcgataccgaaaccaccggcctgaatgcccgcaccggcgaccggattctcgaactcggctgtgtcgagctggtgaaccgccggctcaccggcaacaacctgcacttctatatcaacccggaacgcgacagcgatccgggcgcactggccgtgcacggcctgaccactgaattcctgagcgacaagccgaagttcggcgagatcgccgaccagttccgcgacttcattcagggcgcggacctgatcattcacaacgcgccgttcgacatcggctttctggatgtcgaattcgcgttgctgggcttgccgccggtgagtacctactgcggcgaaatcatcgatacgctggcgcgcgccaagcagatgttccccggcaaacgcaattcactcgacgcactgtgcgatcgtttcggcatcagcaacgcgcaccgcacgctgcacggcgcgctgctcgactcggaactgctcgccgaagtctatctggcgatgacgcgcggccaggaaagcctcgtcatcgacatgctcggcgaatcgcacgccggcggcgatgcgcgcgcaccgcgtgtcgcaatcgattcgctggatctggtcgtcatcaccgccagcgacgacgaacttgccgcacaccaggcgctgctcgacggtctcgacaaggcgatcaagggcacaagcgtgtggcgcctcgaaccggcgccggccgcggatgagcagaccgcttaa

SEQ ID NO: 70761 - protein, 244 aa, Burkholderia xenovorans LB400
MRQLILDTETTGLNARTGDRILELGCVELVNRRLTGNNLHFYINPERDSDPGALAVHGLTTEFLSDKPKFGEIADQFRDFIQGADLIIHNAPFDIGFLDVEFALLGLPPVSTYCGEIIDTLARAKQMFPGKRNSLDALCDRFGISNAHRTLHGALLDSELLAEVYLAMTRGQESLVIDMLGESHAGGDARAPRVAIDSLDLVVITASDDELAAHQALLDGLDKAIKGTSVWRLEPAPAADEQTA

SEQ ID NO: 70762 - DNA, 726 bp, Ralstonia metallidurans CH34
  CDS (1)..(726): transl_table=11
atgcgacaaatcgttctcgataccgaaaccaccggccttaatcacgcgacaggcgaccgactgatcgaaatcggctgcgtggaactggtgaatcgccgcctgacaggccgccacctccacttctacgtcaatccagagcgcgacatccatgaggatgccatcgcagtgcacgggatcacgctcgatttcctggccgacaagcccaagttcgccgagatcgtcaacgacgtccgcgacttcgtgcaggacgccgaactgatcatccacaacgcgcccttcgaccttggcttcctggacatggagttccagcgcctggacctgccgccgttccgccagcacgccagcaacgtgatcgacacgctgcgtgaagcccgccagatgttcccgggcaagcgcaactcgctggatgcgctgtgcgaccgacttggcgtcagcaactcccatcgcacgctgcacggcgcactgctcgatgccgaactgctcgccgaggtctacctggcgatgacgcgcggccagaactcactggtcatcgacatgctcgacggcgccgccacggacggcgagacgcgtagcaccgccgacctgtccgccatgacgctgcccgtgctattggcctccgaggcagaaatctcggcgcacatgggcgtgctcaaggaactcgacaaggcaagtggcggcaagacggtctggcaggaagcctcccctgccgaagccgccactcagtag

SEQ ID NO: 70763 - protein, 241 aa, Ralstonia metallidurans CH34
MRQIVLDTETTGLNHATGDRLIEIGCVELVNRRLTGRHLHFYVNPERDIHEDAIAVHGITLDFLADKPKFAEIVNDVRDFVQDAELIIHNAPFDLGFLDMEFQRLDLPPFRQHASNVIDTLREARQMFPGKRNSLDALCDRLGVSNSHRTLHGALLDAELLAEVYLAMTRGQNSLVIDMLDGAATDGETRSTADLSAMTLPVLLASEAEISAHMGVLKELDKASGGKTVWQEASPAEAATQ

SEQ ID NO: 70764 - DNA, 732 bp, Silicibacter sp. TM1040
  CDS (1)..(732): transl_table=11
atgcgtgaaatcgtactcgatacggaaaccacaggctttgacccgttttctggcgaccgaattgtcgaaatcggggctgtggagctcctgaatcatatgccaaccggtgagacattccacgtctacatcaacccgcagcgatcgatgccgcacgaggcctttggcgtgcatggtattggtcccgatctgttggaaccaccgcaaccgcctgcccccggtcaggtgatcctgaaggacaagccactctttgccgaggtaggccaggcgttcctggactttgtgcgtgattcaaagatggtcattcacaatgccagctttgatatgaagttcctgaacgcggagcttgggtggatgaacctgccgcagcttccgatggatcaggctattgatactctggccatggcgcgcaagcgatttcccggatctccggcaacgctggatgcgctatgccgacgctttgggatcgacaattccaaccggacgctgcatggcgcgctcttggactccgagatcctcgcagatgtgtacctcgagctgatcggaggccggcagccggattttgggctttcagcacaatcaagcggtggacaaaacgcagttgataccaattggcgccccgcgccgcgtgagacgcccctgccctctcggctgacggccgaggaaaaagcggcccacgacgagtttgtgggcaaacttggcgaggatgctttgtgggctgttacctcggaatga

SEQ ID NO: 70765 - protein, 243 aa, Silicibacter sp. TM1040
MREIVLDTETTGFDPFSGDRIVEIGAVELLNHMPTGETFHVYINPQRSMPHEAFGVHGIGPDLLEPPQPPAPGQVILKDKPLFAEVGQAFLDFVRDSKMVIHNASFDMKFLNAELGWMNLPQLPMDQAIDTLAMARKRFPGSPATLDALCRRFGIDNSNRTLHGALLDSEILADVYLELIGGRQPDFGLSAQSSGGQNAVDTNWRPAPRETPLPSRLTAEEKAAHDEFVGKLGEDALWAVTSE

SEQ ID NO: 70766 - DNA, 711 bp, Magnetospirillum magnetotacticum MS-1
  CDS (1)..(711)
atgctgcgcgagatcgtcctcgataccgagaccaccggcacggatgccaagaatggcgaccggctgatcgaaatcggctgcgtcgagctgatcaaccacgtccagaccggcgcctactaccaccaactcatcaacccgcagcggccggtttccgagggagccttcgcggtccacggcatctcggacgcgatgctggccgacaagccggtcttcgccgacgtggtggacgccttcgtcgccttctgcggcgatgcgcggctggtgatccacaacgcgccgttcgatgtcggcttcctcaacatggagttcgccaagctcgggccggccgctccgccgctcatcgtgctggaggacgtggtcgacaccctgctgctcgcccgccgcaagcatccgggcgcggccaacaatctcgacgccctgtgcaaccgctacggcgtcgatacgacccgccgggtcaagcacggcgccctcctcgacgcgcagatcctggccgaggtctatgtcgaactcctcggcggcaagcagaccagcctgggtctcagcatcgccgagccggctgggagcgtggcggtggaagcggtggccgattcgggtccgattgccccgcgcgcgatgcgcagccggctgacggaggatgagcgcctgcggcatgtcagctttgtcgagagtctgggaacaaacgccgtctggcgcgactatctggagccgtga

SEQ ID NO: 70767 - protein, 236 aa, Magnetospirillum magnetotacticum MS-1
MLREIVLDTETTGTDAKNGDRLIEIGCVELINHVQTGAYYHQLINPQRPVSEGAFAVHGISDAMLADKPVFADVVDAFVAFCGDARLVIHNAPFDVGFLNMEFAKLGPAAPPLIVLEDVVDTLLLARRKHPGAANNLDALCNRYGVDTTRRVKHGALLDAQILAEVYVELLGGKQTSLGLSIAEPAGSVAVEAVADSGPIAPRAMRSRLTEDERLRHVSFVESLGTNAVWRDYLEP

SEQ ID NO: 70768 - DNA, 693 bp, Magnetospirillum magnetotacticum MS-1
  CDS (1)..(693)
atgcgcgagatcgtgcttgatacggaaacgaccggctttgatccgttgagcggccaccgactggtggaaatcggctgtgtcgagctgttcaatcacctgcccaccggcgaggtgtttcaccgctactgcaaccccgagcgcgacatgccggaagaggccttcaaggtgcacggcctgtcggtggagttcctgtcggacaagccgctcttcgccgagatcgtcgccgactttctggagttcatcggcgatgcgccgctggtcatccacaacgctgaattcgacatgcgctttatcaatgccgaactggcgcggctgggctttcccgctttgcccatgagccggtccatcgacacggtgatgatggcgcgcaagaagtttcccggcgcccaggccaatctggatgcgctgtgccgccgcttcgagatcgacaacacgcaccgcaccaagcacggggcattgctggattccgaattgctggccgaagtctatctgcagctcatcggcgggcgtcagccgggcttggaactgggcggcggcaagggcaatggcgctggcagcgccgccagtgcctcgacccaagaggtgaagcgggatttccgcgagccccggccccacggaccgaccgaggaggaaaccgccgctcacacggccttcgtggccaagctcaagaacgccgtgtggctgcgggagtag

SEQ ID NO: 70769 - protein, 230 aa, Magnetospirillum magnetotacticum MS-1
MREIVLDTETTGFDPLSGHRLVEIGCVELFNHLPTGEVFHRYCNPERDMPEEAFKVHGLSVEFLSDKPLFAEIVADFLEFIGDAPLVIHNAEFDMRFINAELARLGFPALPMSRSIDTVMMARKKFPGAQANLDALCRRFEIDNTHRTKHGALLDSELLAEVYLQLIGGRQPGLELGGGKGNGAGSAASASTQEVKRDFREPRPHGPTEEETAAHTAFVAKLKNAVWLRE

SEQ ID NO: 70770 - DNA, 759 bp, Haemophilus somnus 129PT
  CDS (1)..(759)
atgacattagaaatcacacaaaatcgccaaattatcctagatacggaaacgaccggaatgaacgaattcggtgcacattatgaggggcattgtattattgaaatcggtgcggttgaaatgatcaatcgtcgctacacaggaagaaaactccatctttacataaaaccggatcgtctcgttgatcctgaagcaattaaagtacatggtattactgatgaaatgctggcagataaaccggatttttcagctattgcacaggaatttattgattttatcaaaggggctgaactcattattcacaatgcacctttcgatatcggttttatggattatgagtttaaaaaacacaatttcaatatcaatacagcggatatttgcttaattaccgacacgttacaaatggctcgtcaaatgtatccaggaaagcgtaatagtttagatgcactttgtgacagattaaatattgataacagtaaacgaacattgcacggggcattacttgatgctgaaattttaggtgatgtttatttagccatgacaggggggcaaaccagtttatttggtgatgaagaacatacgccgattataacgctggaagaaaatattcatcaacatactaccaatactcataatttcaaattacttttacccacagaagaagaaaaactggctcaccaagattatctaaaattgctaaaccaaaaaagcaaagaaaattgcttatggtttaagcgaaatacaaaagaaacgatgcattaa

SEQ ID NO: 70771 - protein, 252 aa, Haemophilus somnus 129PT
MTLEITQNRQIILDTETTGMNEFGAHYEGHCIIEIGAVEMINRRYTGRKLHLYIKPDRLVDPEAIKVHGITDEMLADKPDFSAIAQEFIDFIKGAELIIHNAPFDIGFMDYEFKKHNFNINTADICLITDTLQMARQMYPGKRNSLDALCDRLNIDNSKRTLHGALLDAEILGDVYLAMTGGQTSLFGDEEHTPIITLEENIHQHTTNTHNFKLLLPTEEEKLAHQDYLKLLNQKSKENCLWFKRNTKETMH

SEQ ID NO: 70772 - DNA, 774 bp, Actinobacillus pleuropneumoniae serovar 1 str. 4074
  CDS (1)..(774)
atgagtgaacaaccgatagtaagacaggtggtgctggataccgaaacaaccggtatgagttttagcggaccaccgcaaattggacataatattattgaaatcggtgcggtcgaagtgattaatcgtcgcttaaccggccgtacttttcacgtctatattaaaccgccgcgagaagtggatgaagaggcgattaaagttcacggcattaccaatgagtttttgcaagataagcctgtgtttgccgaagttgcggacgaatttattgaatttattaaaggtgcagagctaatcattcataatgcccccttcgacgtggcatttatggatcaagagttttcttatttgggaaacccaccgccgaagacggctgaaatgtgcagtgtgaccgatagtcttgcggtcgctcgaaaaatgtacccgggcaagcgtaataacttagatgcattgtgcgaccgtttaggcattgataacagcaagcgtgtacttcacggggcgttactggatgcggagattctggctgatgtattcttgatgatgactggcggacagctggcgttattaggcgaagaagatgcaaccgctactcatgaaaatgttgcggatctcggtttaggtacgataacgaagtttgaaacaagcggtttaattgtgttatctctgagtgaagaagagcaaacggcacacgaagaatatctcaaactgattgataaaaaatctaaggggaattgtatttggatgcgctcgaatgaaatggaatcggagcaaattcactaa

SEQ ID NO: 70773 - protein, 257 aa, Actinobacillus pleuropneumoniae serovar 1 str. 4074
MSEQPIVRQVVLDTETTGMSFSGPPQIGHNIIEIGAVEVINRRLTGRTFHVYIKPPREVDEEAIKVHGITNEFLQDKPVFAEVADEFIEFIKGAELIIHNAPFDVAFMDQEFSYLGNPPPKTAEMCSVTDSLAVARKMYPGKRNNLDALCDRLGIDNSKRVLHGALLDAEILADVFLMMTGGQLALLGEEDATATHENVADLGLGTITKFETSGLIVLSLSEEEQTAHEEYLKLIDKKSKGNCIWMRSNEMESEQIH

SEQ ID NO: 70774 - DNA, 741 bp, Pseudomonas aeruginosa UCBPP-PA14
  CDS (1)..(741)
atgcgtagcgtcgtactggataccgaaaccaccggcatgccggtgaccgatggtcaccggatcatcgagatcggctgtgtcgagctggaggggcgccgcctgaccggtcgccacttccacgtctacctgcaacccgatcgcgaggtcgacgaaggggcgatcgccgtccacggcatcaccaacgaatacctgaaggacaagccgcgcttccgcgaggtcgccaacgatttcttcgagttcatccgcggcgcccaactgatcatccataacgcggcgttcgatatcggcttcatcaacaacgagttcgccctgctgggccagcaggaccgctcggacgtgagcgagtactgctcggtgctggataccctgctgatggcccgcgagcgccatccgggtcagcgcaacaacctcgatgcgttgtgcaagcgctacggcgtggacaactccggccgcgacctgcacggcgcgttgctcgacgccgagatcctcgccgacgtctacctggcgatgaccggtggccagaccagcctgtcgctggccggcagcggcgcggaaggcgacggcagcggccggccgatggtcagcccgatccgtcggctcgatccggcgcgggtcgccaccccggtgctgcgcgccaacgccgaagagctggctgcgcatgcggcgcggctggcggtgatcgagaagtcggcaggtggtccgtcgctctgggcgcaactggaagcgccggtcggcgaatag

SEQ ID NO: 70775 - protein, 246 aa, Pseudomonas aeruginosa UCBPP-PA14
MRSVVLDTETTGMPVTDGHRIIEIGCVELEGRRLTGRHFHVYLQPDREVDEGAIAVHGITNEYLKDKPRFREVANDFFEFIRGAQLIIHNAAFDIGFINNEFALLGQQDRSDVSEYCSVLDTLLMARERHPGQRNNLDALCKRYGVDNSGRDLHGALLDAEILADVYLAMTGGQTSLSLAGSGAEGDGSGRPMVSPIRRLDPARVATPVLRANAEELAAHAARLAVIEKSAGGPSLWAQLEAPVGE

SEQ ID NO: 70776 - DNA, 690 bp, Rickettsia sibirica 246
  CDS (1)..(690): transl_table=11
atgtcgagtttaagagaaataattttagataccgagactacgggacttgacccacgacaaggtcatcgaatcgttgagatcggtgctattgagatggtaaataaggtattaacaggcaggaattttcatttttatattaatcctgagcgagatatgccgtttgaggcttatagaattcatggcatatccggcgaatttttaaaagacaagcctctatttcatacaatagccgatgattttttagagtttatttcagatagcaaactgattattcataatgctcctttcgatattaaatttctaaatcacgaattatcattattaaaaagaaccgacattaaactcttggaactagcaaatactattgatactttagtaatggctagaagcatatttccaggctcaaaatataatcttgatgcattatgtaaaagatttaaagttgataattcaggtaggcagcttcacggagctttgaaagatgccgcattacttgcagaagtatatgtagagttaatgggcggtagacaatccgcttttaaaatggttgataaatctgccgtaataaataatttagcaactaatcaagtaaataacaaaacagagcaaactactattgttattaaacctacaaaagaagagctgcaaaaacataaagagtttctcagtaggattttaaaaactgcttag

SEQ ID NO: 70777 - protein, 229 aa, Rickettsia sibirica 246
MSSLREIILDTETTGLDPRQGHRIVEIGAIEMVNKVLTGRNFHFYINPERDMPFEAYRIHGISGEFLKDKPLFHTIADDFLEFISDSKLIIHNAPFDIKFLNHELSLLKRTDIKLLELANTIDTLVMARSIFPGSKYNLDALCKRFKVDNSGRQLHGALKDAALLAEVYVELMGGRQSAFKMVDKSAVINNLATNQVNNKTEQTTIVIKPTKEELQKHKEFLSRILKTA

SEQ ID NO: 70778 - DNA, 690 bp, Rickettsia rickettsii
  CDS (1)..(690)
atgtcgagtttaagagaaataattttagataccgagactacgggacttgacccacaacaaggtcatcgaatcgttgagatcggtgctattgagatggtaaataaggtattaacaggcaggaattttcatttttatattaatcccgagcgagatatgccgtttgaggcttatagaattcatggcatatccggcgaatttttaaaagacaagcctctatttcatacaatagccgatgattttttagagtttatttcagatagcaaactgattattcataatgctcctttcgatattaaatttctaaatcatgaattatcattattaaaaagaaccgacattaaactcttggaactagcaaatactattgatactttagtaatggctagaagcatatttccaggctcaaaatataatcttgatgcattatgtaaaagatttaaagttgataattcaggtaggcagcttcacggagctttgaaagatgccgcattacttgcagaagtatatgtagagttaatgggcggtagacaatccgcttttaaaatggttgataaatctgccgtaataaataatttagcaactaatcaagtaaataacaaaacagaacaaactactattgttattaaacctacaaaagaagagctgcaaaaacataaagagtttctcagtaggattttaaaaactgcttag

SEQ ID NO: 70779 - protein, 229 aa, Rickettsia rickettsii
MSSLREIILDTETTGLDPQQGHRIVEIGAIEMVNKVLTGRNFHFYINPERDMPFEAYRIHGISGEFLKDKPLFHTIADDFLEFISDSKLIIHNAPFDIKFLNHELSLLKRTDIKLLELANTIDTLVMARSIFPGSKYNLDALCKRFKVDNSGRQLHGALKDAALLAEVYVELMGGRQSAFKMVDKSAVINNLATNQVNNKTEQTTIVIKPTKEELQKHKEFLSRILKTA

SEQ ID NO: 70780 - DNA, 768 bp, Haemophilus influenzae R2846
  CDS (1)..(768)
atgattaatcccaatcgccaaattgtgttagatactgaaactacaggtatgagtcagctcggtgcgcattatgaaggacactgcattattgaaattggtgcagttgaattaataaatcgtcgttacacaggtaataatttccatatttatattaagccagatcgccccgttgatcctgatgcgattaaagttcatggtattactgatgaaatgttagcggataaaccagaattcaaagacgtagcccaagattttttggattatattaatggtgcggaattgcttattcacaatgcgccctttgacgttggatttatggattatgaatttcgtaaacttaacctcaatgtgaaaactgacgatatttgtttggtgacagatacgctacaaatggctcgtcagatgtatcctggaaaacgcaataatttggatgcactttgtgatcgtttaggtattgataatagcaaacgtactttgcacggtgcgttactggatgccgagatcttggcggatgtttatttgatgatgacgggagggcaaacaaatttattcgatgaagaatctgttgagtctgaagttatccgtgttgtgcaagaaaaaacggcggaagaaataaaaagtgcggtagatttttcgcacaatttaaaattaattcaacctactaatgatgagttacaagcgcatttagaattcttaaagatgatgaataaaaaaagtggaaataattgcctttgggaaaaacgctttggcaataataatgtgcattaa

SEQ ID NO: 70781 - protein, 255 aa, Haemophilus influenzae R2846
MINPNRQIVLDTETTGMSQLGAHYEGHCIIEIGAVELINRRYTGNNFHIYIKPDRPVDPDAIKVHGITDEMLADKPEFKDVAQDFLDYINGAELLIHNAPFDVGFMDYEFRKLNLNVKTDDICLVTDTLQMARQMYPGKRNNLDALCDRLGIDNSKRTLHGALLDAEILADVYLMMTGGQTNLFDEESVESEVIRVVQEKTAEEIKSAVDFSHNLKLIQPTNDELQAHLEFLKMMNKKSGNNCLWEKRFGNNNVH

SEQ ID NO: 70782 - DNA, 705 bp, Rubrivivax gelatinosus PM1
  CDS (1)..(705)
atgagccgccagatcttcctcgacaccgagaccaccggcctaagcccggagaacggcgaccgcatcatcgagatcggttgcgtggagatgctcagccgccgcctgagcggcaacaaccggcacttctacctgaaccccgagcgtcgtaatcacgaggatgccgtgaagatccacggcctgaccgacgagttcctggcggacaagcccaagttcgcggtcgttgccgatgagctgatggagtacttggctggcgccgagatcatcatccacaacgcggccttcgacgtcggcttcctcgacgcggagctgaagcgcctgcagcggccccgcttcgccgagcaggtgggcgcggtgaccgacagcctgacgatggcgcgcgagatgttccctggcaagtccaactcgctcgacgcactgtgcaagcgcctcgaggtcgacaacgccagccgcaccttgcacggcgcgctgcttgacgcagggctgctcgcggaggtgtatatccgcatgacgcgaggccagaactcgttggtcatcgatgccggcgcagcgtcaggcggggcgatcgccgtcgcggacatcgacctgcggcagttcgctctgcccgtcatcgaacccagcgacgacgagcgtcaagcgcacgaggccgtgctcgcagaactcgacaaggtttccggcggcaagacgctgtggcgcgccatggcataa

SEQ ID NO: 70783 - protein, 234 aa, Rubrivivax gelatinosus PM1
MSRQIFLDTETTGLSPENGDRIIEIGCVEMLSRRLSGNNRHFYLNPERRNHEDAVKIHGLTDEFLADKPKFAVVADELMEYLAGAEIIIHNAAFDVGFLDAELKRLQRPRFAEQVGAVTDSLTMAREMFPGKSNSLDALCKRLEVDNASRTLHGALLDAGLLAEVYIRMTRGQNSLVIDAGAASGGAIAVADIDLRQFALPVIEPSDDERQAHEAVLAELDKVSGGKTLWRAMA

SEQ ID NO: 70784 - DNA, 690 bp, Rickettsia akari str. Hartford
  CDS (1)..(690)
atgtcaagtttaagagaaataattttagataccgaaactacgggacttgacccacgacaaggtcaccgcatcgttgaaattgctgcaattgaaatgatgaataaggtgttaacaggtaggaattttcatttttatattaatcctgagcgagacattccgtttgatgcgtatagaattcacggtatttccggtgagtttttaaaggacaagcctttgtttcacacaatagccgatgattttttagaatttattgcagatagcaagcttgttattcataatgctccgttcgatattaaatttctaaatcacgaattatcattattaaaaagagcagaaatcaaacttttagaactgtccaatgcgatagacactttagttatggctagaagtatgtttccaggctcaaaatataatcttgatgcattatgtaaaagatttaaagttgataattcaggtaggcagcttcacggggctttgaaagatgcggcattacttgcagaagtatatgtggaactaacgggtggtagacaatcctcttttaaaatggttgataaatctgctggaataaataatttagcaattaatcaagtaaatagcaaaacagagcaagctagtattgttattaaacctacaaaagaagagctgcaaaaacataaagagtttcttagtagtattttaaaaactgcttag

SEQ ID NO: 70785 - protein, 229 aa, Rickettsia akari str. Hartford
MSSLREIILDTETTGLDPRQGHRIVEIAAIEMMNKVLTGRNFHFYINPERDIPFDAYRIHGISGEFLKDKPLFHTIADDFLEFIADSKLVIHNAPFDIKFLNHELSLLKRAEIKLLELSNAIDTLVMARSMFPGSKYNLDALCKRFKVDNSGRQLHGALKDAALLAEVYVELTGGRQSSFKMVDKSAGINNLAINQVNSKTEQASIVIKPTKEELQKHKEFLSSILKTA

SEQ ID NO: 70786 - DNA, 735 bp, Burkholderia vietnamiensis G4
  CDS (1)..(735): transl_table=11
atgcgccagatcattctcgataccgaaaccaccggcctcaatccccgctcgggcgatcgcctgatcgaaatcggctgcgtggagctgctgaaccggcggctcaccggcaacaacctgcacatctacgtgaaccccgagcgcgacagcgatccgggcgcgctggccgtgcacgggctgaccaccgagtttctgagcgacaagccgaagttcgcggaagtcgccgaccagatccgcgacttcgtgaagggcgcggaactgatcatccacaacgcaccgttcgacctcgggttcctcgatgccgaattcgcgcggctcggcctgccgccgttcatcgagcattgcgacggcgtgatcgacacgctggccgaggccaagcagatgttccccggcaagcgcaattcgctcgacgcgctgtgcgaccggttcggcatcagcaacgcgcaccgcacgctgcacggcgcactgctcgactcggagctgctcgccgaggtctatctcgcgatgacgcgcggccaggacagcctcgtgatcgacatgctcgacgacgcaggcgccgacggcggcacggcgaacggccagcgcatctcgctcgcgtcgctcgacctgccggtcgtcgcggccagcgacgacgagctcgccgcgcaccaggcgcagctcgacgagttggacaagtcggtcaagggcacctgcgtctggcgcacgtccgccgaagtggacgccgtcgaagcggcctga

SEQ ID NO: 70787 - protein, 244 aa, Burkholderia vietnamiensis G4
MRQIILDTETTGLNPRSGDRLIEIGCVELLNRRLTGNNLHIYVNPERDSDPGALAVHGLTTEFLSDKPKFAEVADQIRDFVKGAELIIHNAPFDLGFLDAEFARLGLPPFIEHCDGVIDTLAEAKQMFPGKRNSLDALCDRFGISNAHRTLHGALLDSELLAEVYLAMTRGQDSLVIDMLDDAGADGGTANGQRISLASLDLPVVAASDDELAAHQAQLDELDKSVKGTCVWRTSAEVDAVEAA

SEQ ID NO: 70788 - DNA, 729 bp, Mesorhizobium sp. BNC1
  CDS (1)..(729): transl_table=11
atgcgcgagatcatcttcgatacggaaacgacgggcctggatccgcgcgaggacagggttatcgagctcggctgcgttgagctggcaaaccgcttccccaccgggcgaacgctacattatttcatcaacccgcagggccgctccgttcatcccgatgcccaggctgtgcatggcatttccgatgccgaccttgccggtaagcccgttttcgccgagattcttgatgagtttcttgagttcatcgacggcgcgaagcttgtcgcccataatgccaatttcgacatcggtttcatcaatgccgagtttcaaagggtgggtcagccctatatagatccggcgcgcgtgatcgatacgttggcaattgcccggcgaaagcatcccatggggccgaactcgctcgatgcgctctgccggcgttacggaattgacaattcccatcgcaccaagcacggcgcgcttctggacgccgaactcctggccgaggtttacattgaattggccggcggcaagcaggccagttttgggctcgagattgcaacgcaaggcgttgcagaagaaacaagcagcagcgtcattgtcgcactcccgccccggccacgcccgcttcgttcgcggcttacccccgaggaacaacaagcccatgaagcgctcgttgccggtatcggcgaaaatgcgctctggcggaagctgatgcctgcggaagccgctgagcgcgtggaaactgcttaa

SEQ ID NO: 70789 - protein, 242 aa, Mesorhizobium sp. BNC1
MREIIFDTETTGLDPREDRVIELGCVELANRFPTGRTLHYFINPQGRSVHPDAQAVHGISDADLAGKPVFAEILDEFLEFIDGAKLVAHNANFDIGFINAEFQRVGQPYIDPARVIDTLAIARRKHPMGPNSLDALCRRYGIDNSHRTKHGALLDAELLAEVYIELAGGKQASFGLEIATQGVAEETSSSVIVALPPRPRPLRSRLTPEEQQAHEALVAGIGENALWRKLMPAEAAERVETA

SEQ ID NO: 70790 - DNA, 720 bp, Xylella fastidiosa Dixon
  CDS (1)..(720): transl_table=11
atgaggaataagaagcgtcagattgttcttgatactgagaccactggcctggaatggagcaaggggaaccgcattgtggagatcggtgcggtcgaactgcttgatcgccgactcagtggggacaaatttcatcgttatctcaagcctgatgtgtcgtttgagtccggtgcccaggaagtaacggggctgacgatggagtttctagcggacaagccagagttcagcatgattgccgatgagtttttggcttatatcaatggtgccgaactgattattcataatgcggcgttcgatctgggattccttgattacgagttatcgcggttgggttcgcagtacgggaaaatcacagatcgtgccagcgtgcttgacactttggtgatggctcgggagcgttatccgggtcagcgtaattcactggatgcattatgtaagcgtcttggtgtggataacgcccaccgtcagttacatggtgcattacttgacgcgcagatattggccgatgtttatatcgcgttgacctgtggacaagaggagattggttttgcgttgcctgagagcagctgtggtggtgtcgatgccgctagcgcggcatttatgccggatgtgttgttaacacgtccatgtgtggtggtgtcgcaatccgaactggaggcgcatgaggcgcgtttggccaagttacgtaagatcgctggtcatgtgctgtgggatgcgatatag

SEQ ID NO: 70791 - protein, 239 aa, Xylella fastidiosa Dixon
MRNKKRQIVLDTETTGLEWSKGNRIVEIGAVELLDRRLSGDKFHRYLKPDVSFESGAQEVTGLTMEFLADKPEFSMIADEFLAYINGAELIIHNAAFDLGFLDYELSRLGSQYGKITDRASVLDTLVMARERYPGQRNSLDALCKRLGVDNAHRQLHGALLDAQILADVYIALTCGQEEIGFALPESSCGGVDAASAAFMPDVLLTRPCVVVSQSELEAHEARLAKLRKIAGHVLWDAI

SEQ ID NO: 70792 - DNA, 732 bp, Alkalilimnicola ehrlichei MLHE-1
  CDS (1)..(732): transl_table=11
atgaggcagatcgtgctggatactgagaccaccggtctggagtggagtcagggcgatcgggtgatcgagatcggctgcgtggaactggtggaccgccggcccaccggcaataacttccaccagtacctgaaccccgatcgcgaggtgccccaggaggcggtggaggtgcacggcatcaccaacgactttctggccgacaagccgcgctttcacgaggtggcggagcgctttgtcgagtacatccggggcagcgagttggtgatccacaacgccgccttcgacgtcggcttcctggactacgaactcagccgtctgggccgtggctggggccgggtggaggactttgcctcggtgctcgacaccctgctgttggcccggcaacgtcaccccggccagcgcaactcgctggatgccctgtgcaagcgctacgacgtggacaatacccagcgtgaactgcacggcgcgttgctcgatgcccgcatcctggccgacgtttatctggcgatgaccggcggccagaaggccctgttcaccctggacgaggaggaggctcaggcccacgaaggggagggcggtgggatacgccggctgccgtcggatcggccccgccttgcagtggtgcgggccggggaggccgagcgccgggcccatgaggcgctgttggaccgtatcgacaaggcctccggggggggttgccgctggcgccggccggaggtggcgggtgatgcctga

SEQ ID NO: 70793 - protein, 243 aa, Alkalilimnicola ehrlichei MLHE-1
MRQIVLDTETTGLEWSQGDRVIEIGCVELVDRRPTGNNFHQYLNPDREVPQEAVEVHGITNDFLADKPRFHEVAERFVEYIRGSELVIHNAAFDVGFLDYELSRLGRGWGRVEDFASVLDTLLLARQRHPGQRNSLDALCKRYDVDNTQRELHGALLDARILADVYLAMTGGQKALFTLDEEEAQAHEGEGGGIRRLPSDRPRLAVVRAGEAERRAHEALLDRIDKASGGGCRWRRPEVAGDA

SEQ ID NO: 70794 - DNA, 687 bp, Sulfitobacter sp. EE-36
  CDS (1)..(687): transl_table=11
atgcgtgagatcgtactggatacggaaaccaccggattcgaccctgaaagcggcgataggatcgttgaaatcggtgcggttgaactgatgggtcacgtggcgaccggcaatacctatcaccaatacatcaatcccgaacgcagcatgcccgccgaagccttcgaggtgcacgggctgggcgacgactttttgcgcgacaaacccaagtttgcgcagatcgggcaggattttctggatttcatcggtgattcaaagctggtgatccacaacgccgccttcgatatcaagtttctgaacgcggaattgaaatggatggggctgccccagatcccgtgggaacaggcgcttgatacgctggccatcgcgcgcaaacgctttccgggctcgcccgcgtcgctggatgcgctgtgccgccgctttggcatcgacaacacgtcgcggacgctccacggtgctttgcttgacagtgaaattctggcggatgtctatctagagctgatcggcgggcggcaaccggacttcggcctgtcgaccaaaccggaaaagaaagagggcgacaccacccccgattggacgccaaaaccgcgcccgacgcccctgccctcgcggattactccgcaagaggccgccgcccataccgaatttgtcgataaactgggcgacagcgctgtctggaagacgctttag

SEQ ID NO: 70795 - protein, 228 aa, Sulfitobacter sp. EE-36
MREIVLDTETTGFDPESGDRIVEIGAVELMGHVATGNTYHQYINPERSMPAEAFEVHGLGDDFLRDKPKFAQIGQDFLDFIGDSKLVIHNAAFDIKFLNAELKWMGLPQIPWEQALDTLAIARKRFPGSPASLDALCRRFGIDNTSRTLHGALLDSEILADVYLELIGGRQPDFGLSTKPEKKEGDTTPDWTPKPRPTPLPSRITPQEAAAHTEFVDKLGDSAVWKTL

SEQ ID NO: 70796 - DNA, 693 bp, Oceanicola batsensis HTCC2597
  CDS (1)..(693): transl_table=11
atgcgtgagatcgttctcgacacggaaacgacgggattcgaccccgaacagggcgaccggatcgtcgagatcggggccgtcgaactgtggaatcacgtgcccaccggcgagacgtaccacgtctacatcaaccctgaacggtccatgccgcaggaggcgtttgaggttcacggcctcggcgacgacttcctgcgcgacaagcccgtgttccgtgacgtggcgcggggcttcgtcgaattcgtcaaggatgccaagttggtgatccataacgccagcttcgacatgaagttcatcaacgccgaactcggctggctgaacatcccggccatcccctgggatcaggccatcgacacgctggcgatcgcgcggcagcgctttcccggctcgccggcttctctcgatgcgctgtgtcgccggttcggcatcgacaattccgcccgcacgctgcacggcgcacttctcgactccgagatcctcgccgaggtttatctggaactgatcggggggaggcagccggatttcgcgctctcggcctcaaccggcacgcagaccgggacggatacggcggactggcggcccaagccccgcccgacgcccctgccgccgcggatcacggcagaggaagccgccgcccatgccgaattcgtcgaaaggctgggcgacggcgctctctggaaaagctatcaggcctga

SEQ ID NO: 70797 - protein, 230 aa, Oceanicola batsensis HTCC2597
MREIVLDTETTGFDPEQGDRIVEIGAVELWNHVPTGETYHVYINPERSMPQEAFEVHGLGDDFLRDKPVFRDVARGFVEFVKDAKLVIHNASFDMKFINAELGWLNIPAIPWDQAIDTLAIARQRFPGSPASLDALCRRFGIDNSARTLHGALLDSEILAEVYLELIGGRQPDFALSASTGTQTGTDTADWRPKPRPTPLPPRITAEEAAAHAEFVERLGDGALWKSYQA

SEQ ID NO: 70798 - DNA, 759 bp, Pseudoalteromonas tunicata D2
  CDS (1)..(759): transl_table=11
atgaaaataaccttatcaaaatatcagaatcaagcagcaggtgatatggatcatagacaaatagtattagataccgaaacaacgggtattgaccctaagcttgggcatcgcataatcgaaattggttgtgttgagcttattaatcgccgttttacaggtaataattttcatgtttatatcaacccagagcgggatatcgaagatgaagctatcgatgtccatggtataaccaatcaatttttacgtgataaacctaaatttcatcatatagcccaagagttttttgattatattcaaggagctgaactggtgattcataatgcggcgtttgacgtcggctttatggacagtgagtttcagcgcttaagaacgggttatccaaaaacagcacaattttgccaagtgctcgatactcttaaaatggcaagggagttacatcccggtcagaaaaataacttagatgcattatgtcgtcgctacaatatagataacggcaaacgaaccatgcatggcgcattactggattcggaaatcctcagtgatgtgtatctggcgatgactggtggccaagttagcttaaatttaaatacccaaactgtgggtgaagaaaatgcgcaaaaacaaggtgagatcattcggttaaattcagatcgtgcgccgcttaatattgtttatgccacagctgatgaaaatcaagcgcatattgaacgtcttgcattagtagagaaaaaaagtagccaatgcctttggttggtctaa

SEQ ID NO: 70799 - protein, 252 aa, Pseudoalteromonas tunicata D2
MKITLSKYQNQAAGDMDHRQIVLDTETTGIDPKLGHRIIEIGCVELINRRFTGNNFHVYINPERDIEDEAIDVHGITNQFLRDKPKFHHIAQEFFDYIQGAELVIHNAAFDVGFMDSEFQRLRTGYPKTAQFCQVLDTLKMARELHPGQKNNLDALCRRYNIDNGKRTMHGALLDSEILSDVYLAMTGGQVSLNLNTQTVGEENAQKQGEIIRLNSDRAPLNIVYATADENQAHIERLALVEKKSSQCLWLV

SEQ ID NO: 70800 - DNA, 726 bp, Photobacterium sp. SKA34
  CDS (1)..(726): transl_table=11
atgaaagccactaaccaacgcattattgtatttgatacagaaaccaccggtatgaatatgacgggcccgcattatgaagggcatcgtattgttgaaattggtgcggttgaaatcattaaccgtaaattaaccggtaaaacattccatgtttatatcaagcccgatcgcccgatagatcctgaagcaattgatgttcacggtattactgatgagttcttaatcggtaagccgagctatgctgacatccatcaagagtttatcgactttattgatggcgcagagctggtggctcataacgcatcgtttgatattggctttatggattatgaattccagttaatgggatctgatcttaagaaaacggaagatatctgcaaagtaacggataccttggaaatggcaaaacgcctctttcctggtaaacgtaataaccttgatattctttgttcacgttatggcatagataactcgcatcgaacgctccacggggctttgctcgatgccgagatccttgctgatgtttatttaatgatgacgggtggtcaaacatcattgaaattaagtggcgataacgaaggagatagtgagaaagaatttgcgataaagcgtttggtcggtgaaagaaaagggctaaaggttatctgtgcttctgccgatgaattagtttcacatgaagaaagactcgatttgatcggtaaaaaagctgacgttctttggcgtctgtag

SEQ ID NO: 70801 - protein, 241 aa, Photobacterium sp. SKA34
MKATNQRIIVFDTETTGMNMTGPHYEGHRIVEIGAVEIINRKLTGKTFHVYIKPDRPIDPEAIDVHGITDEFLIGKPSYADIHQEFIDFIDGAELVAHNASFDIGFMDYEFQLMGSDLKKTEDICKVTDTLEMAKRLFPGKRNNLDILCSRYGIDNSHRTLHGALLDAEILADVYLMMTGGQTSLKLSGDNEGDSEKEFAIKRLVGERKGLKVICASADELVSHEERLDLIGKKADVLWRL

SEQ ID NO: 70802 - DNA, 711 bp, Oceanospirillum sp. MED92
  CDS (1)..(711): transl_table=11
atgagacagatagtgcttgatacagagacgacaggtcttgagccatcagaagggcataatattatcgagatcggctgcgttgagatgtttaatcgccgcctgactggaaaaacctaccatcaatacattaaacccgatcgggatgttgatgctgaagccattcaggttcacggtatcacaaacgagttccttgaagacaaacccaaatttcatgaagttatggaagagttcgtcgagtttgtgcgtggagctgagctgatcattcacaacgcagcatttgatattggcttcctggataccgaattggatcgtaatggttatccggagcggatggaaaatttcagtctggtcaccgattcacttaagctggcaaggaagaagcatcccgggcaaaagaataacctggatgcgctttgtaatcgttacggaatcaataactctcaccgtgagctgcacggggcattacttgactccgaaattctggcggatgtttatctggccctaaccggtggtcagactaatttgtcactcgcaggtgagggggacgatggggaaggtgctggtgcggtgatcaagcgtttgtccggcgctgatgatctgcctttggtgcaaatttcggaaaatgaccaacaagagcatgataaatttctcaaaatgctcgataaaaaaagtggtggtgaatgtctctggttagctgaagctgagtcgtga

SEQ ID NO: 70803 - protein, 236 aa, Oceanospirillum sp. MED92
MRQIVLDTETTGLEPSEGHNIIEIGCVEMFNRRLTGKTYHQYIKPDRDVDAEAIQVHGITNEFLEDKPKFHEVMEEFVEFVRGAELIIHNAAFDIGFLDTELDRNGYPERMENFSLVTDSLKLARKKHPGQKNNLDALCNRYGINNSHRELHGALLDSEILADVYLALTGGQTNLSLAGEGDDGEGAGAVIKRLSGADDLPLVQISENDQQEHDKFLKMLDKKSGGECLWLAEAES

SEQ ID NO: 70804 - DNA, 723 bp, Xanthobacter autotrophicus Py2
  CDS (1)..(723): transl_table=11
atgcgcgagatcgtgctcgacaccgagaccaccggccttgaagcctatggcggcgaccgcctcgtggagatcggctgcgtggagatggtcaaccgcattctcaccggcacggtgttccacgtctatatcaaccccgagcgcgacatgccggtggaggcgttcaacgtccatggcctgtcagccgaattcttgtccgacaagccgaaattcaaggacgttgccgacgaattcctgaatttcatcgccgaagatactttggtgatccacaatgcggcgttcgatatcggcttcctgaatgcggagctggagcgcctcggccgccccaccatcgcccgtgaccgggtggtggacacccttgcgctggcgcgacgcaagcatcccggcggcggcaaccgcctcgacgatctgatgaaccgctacggcatcgacagctcacgccgcgtgaagcacggggcgttgctggatgccgagcttctggccgaggtctatggcgagctgctcggcggcaagcaggccagcctcatcggcctagtggaggacacgagcgaggcgccccgtcttgtggtcgccgcagccgcggcccatccccgccccgtcccactcgccccgcgcctgactgctgccgaagcggaagcccatgcggccttcatcgccagcatgggcgagaaggcgctctggctgaaatatgccgacgtgcccgaggcggataagacgggcagctga

SEQ ID NO: 70805 - protein, 240 aa, Xanthobacter autotrophicus Py2
MREIVLDTETTGLEAYGGDRLVEIGCVEMVNRILTGTVFHVYINPERDMPVEAFNVHGLSAEFLSDKPKFKDVADEFLNFIAEDTLVIHNAAFDIGFLNAELERLGRPTIARDRVVDTLALARRKHPGGGNRLDDLMNRYGIDSSRRVKHGALLDAELLAEVYGELLGGKQASLIGLVEDTSEAPRLVVAAAAAHPRPVPLAPRLTAAEAEAHAAFIASMGEKALWLKYADVPEADKTGS

SEQ ID NO: 70806 - DNA, 720 bp, marine gamma proteobacterium HTCC2207
  CDS (1)..(720): transl_table=11
atgagacagattgtcctcgatacagagactaccggattagaaacgtcacaggatcaccgtattattgagatcggctgtgttgagctggtcgggcgcaagcttaccggcagacattatcatcagtacgtcaacccgcagcgtaaggtggatgttggcgctatggaagtgcacggcataacggatcaatttctcgaggataagccactgtttgaaactgtcgctcgggaattcctagagttcgtcgacggtgccgacctagttattcataacgccccctttgatgttggttttatcaatcatgaaattgccaagctcaatggtgcctatcaggcaattgagagcggctgtcgtatcattgatactctggccctggcgcgacaaaagcacccggggcaaaagaacaacctagacgccctgtgtaaacgttatggcgtcgataactctcagcgagatctccacggcgcactcttggatgcggagattctggctgacgtctatctgctgatgaccggtgggcaggtgaatctcaatatcagtggtcaacaggcctctgacggcgggcaagataatagccgcagtggcatccgtcgtcttgcgcaggatcgtcaacccctgcgcgtcgtcactgccagtcgagaagagatagaacgccaccaacaaaaactcgaagcgattaataaaagcagtggcaactgtctgtggatgagcagcggcgactga

SEQ ID NO: 70807 - protein, 239 aa, marine gamma proteobacterium HTCC2207
MRQIVLDTETTGLETSQDHRIIEIGCVELVGRKLTGRHYHQYVNPQRKVDVGAMEVHGITDQFLEDKPLFETVAREFLEFVDGADLVIHNAPFDVGFINHEIAKLNGAYQAIESGCRIIDTLALARQKHPGQKNNLDALCKRYGVDNSQRDLHGALLDAEILADVYLLMTGGQVNLNISGQQASDGGQDNSRSGIRRLAQDRQPLRVVTASREEIERHQQKLEAINKSSGNCLWMSSGD

SEQ ID NO: 70808 - DNA, 708 bp, Rickettsiella grylli
  CDS (1)..(708)
atgcgtcaaattattttagatactgagactaccggtagagacattaataacgggcatcgaatcatcgaaataggttgtttagaattaatcgatcgacagctcacaaaaagacagtttcattgctatcttaatccaggacgtgacagcgatccgggtgcatttgctattcatggtttaagtactgaatttcttatggataaacccgtatttacaaccattgctgatgaattactcaattttattaaagattcacaactcattattcacaatgccccgtttgatttagcttttttagagtatgagttaacgctcactaaaaaaaaatataaaaaaatgaccgattattgtcagatattagatagccttctccttgcacgtcagttacatcctggccaacgtaatagcttagatgcactgtgtaagcgttataacattgaccattcaaaacgagataaacacggcgctttattagatgccgaattacttgcccgcgtttatcttgccatgacgggtggtcaaacccatttatttaacgaaccgaaaccactgactattcaaacgcatgcccgacaaaaaaaaaccacagaggcgactacactacctattatttatgccacttgtgaagagttaacggctcataaaaattatttaaaccatatttattcactttccgggcagtgtaaatggcttcattactcgaaggaataa

SEQ ID NO: 70809 - protein, 235 aa, Rickettsiella grylli
MRQIILDTETTGRDINNGHRIIEIGCLELIDRQLTKRQFHCYLNPGRDSDPGAFAIHGLSTEFLMDKPVFTTIADELLNFIKDSQLIIHNAPFDLAFLEYELTLTKKKYKKMTDYCQILDSLLLARQLHPGQRNSLDALCKRYNIDHSKRDKHGALLDAELLARVYLAMTGGQTHLFNEPKPLTIQTHARQKKTTEATTLPIIYATCEELTAHKNYLNHIYSLSGQCKWLHYSKE

SEQ ID NO: 70810 - DNA, 714 bp, Oceanobacter sp. RED65
  CDS (1)..(714): transl_table=11
atgaggcaagttgtactagatacagaaacaacgggtattggtgatggtcaccgaattattgaaatagggtgtgttgagcttgttggtcgaaagctgaccggccgtcattatcatcaatatataaacccgcaacgggaagtggatcccgaggctatggaagttcatggcattaccgatgagtttcttgccgacaagccagttttcgcacaggtggcgaacgagtttctagacttcataaatggagcggaactggtgatccataatgcaccattcgacgtcggcttcatggatatggagtttgcaaaactatctaatttccctaaaaccgctgaagtctgtggtgtattagatacgctgacactggcacgcaagatgtatcctggccagcgcaatagtttggatgctctgtgtcgccgcctgggtatcgataatagccaccgagagctccatggcgccttgctcgactcggaaattttggccgacgtatatctactgatgacaggtggtcagactgcgctgtctttagctagtgaggatgcttctacggaagggtcacatgagttgtctgtcaaagtattggtggatcaatctcaggtagcaaacttgccatcttggggggttacggacgacgaagcgcgtcaacaccaagaataccttgagctgctggcgacaaaagcagaaaaagtaaactggtcagctcatactgaatcgtga

SEQ ID NO: 70811 - protein, 237 aa, Oceanobacter sp. RED65
MRQVVLDTETTGIGDGHRIIEIGCVELVGRKLTGRHYHQYINPQREVDPEAMEVHGITDEFLADKPVFAQVANEFLDFINGAELVIHNAPFDVGFMDMEFAKLSNFPKTAEVCGVLDTLTLARKMYPGQRNSLDALCRRLGIDNSHRELHGALLDSEILADVYLLMTGGQTALSLASEDASTEGSHELSVKVLVDQSQVANLPSWGVTDDEARQHQEYLELLATKAEKVNWSAHTES

SEQ ID NO: 70812 - DNA, 747 bp, Photorhabdus luminescens
  CDS (1)..(747): transl_table=11
atgagcacggcaattacacgacaagttgttcttgataccgaaactaccggtatgaataaattaggtgttcactatgaagggcacaaaattattgaaattggggctgtggaggttgttaaccgtcgtttaaccggccgccattttcatgtctatattcagccggatagattggtcgatcctgaagcatttgaagtgcatgggatcagtgatgaatttttgcaggataaaccgctgtttgctgatgttgcagatgagtttgttgaatttattcgcggcgctgaattgatcatccataacgctcccttcgatatcggctttatcgattatgagtttggcaagctggatcgtgatattccgccaactgcggatttctgcaagattactgatagcttacaacttgcaagagggttatttccggggaaaagaaataaccttgatgcgctatgtgatcgttatgatatagacaattctaaacgaaccttgcatggcgcgttgctcgatgccgagatattggctgatgtctatttgataatgacaggcggtcagacttctcttgctttttcaatggaaggggaaattgctggtggtgcgaatgtttctgaaatacagcgtgttacccggtctcaaacggcattgaaagttgtttatgcaacggatgaagaactcgcggctcacgaatccagattggatttagttgagaagaagggcgggagctgtttatggcgtataagttctgaacagagttaa

SEQ ID NO: 70813 - protein, 248 aa, Photorhabdus luminescens
MSTAITRQVVLDTETTGMNKLGVHYEGHKIIEIGAVEVVNRRLTGRHFHVYIQPDRLVDPEAFEVHGISDEFLQDKPLFADVADEFVEFIRGAELIIHNAPFDIGFIDYEFGKLDRDIPPTADFCKITDSLQLARGLFPGKRNNLDALCDRYDIDNSKRTLHGALLDAEILADVYLIMTGGQTSLAFSMEGEIAGGANVSEIQRVTRSQTALKVVYATDEELAAHESRLDLVEKKGGSCLWRISSEQS

SEQ ID NO: 70814 - DNA, 696 bp, uncultured proteobacterium
  CDS (1)..(696): transl_table=11
atgcgtgaaattgttttggatacagaaaccactgggttcgagccaagcgaaggggatcggattgttgaaattggcgcggttgagttgttcaaccatttgccaactggccgcacgtatcaccaatacattaatccagaacgcaatatgccggaggctgcgtttaatgtgcatggtctgagcgaagaattcctgtcggataagcctattttcaagaacattgcccaagaatttattgatttcattgcggactccaagcttgtcatacacaatgcatctttcgacatgaaatttttgaatgcagaacttgggtgggtcaatcggccagctttgccaaacgatcaaaccattgatactcttgcgattgcacgccgtaaattccctggctcgcccgcttcgttggatgctttatgccgcaggttcggcattgataattcctctcgaacactgcatggggcattgttggactctgaaatcttggcagaagtttatttagagctggttggtggccggcagccagatttggttttgtccggcccagaggtcaaaacatccaccgatggctcacaatcccccgattggcgccccgcgcctcggccaaaacccttggcatcccggctgtcagacaaagaaaaagcggcgcatgaaacattcatcgccgctttgggatctgatgcactttggacaaaagagacttag

SEQ ID NO: 70815 - protein, 231 aa, uncultured proteobacterium
MREIVLDTETTGFEPSEGDRIVEIGAVELFNHLPTGRTYHQYINPERNMPEAAFNVHGLSEEFLSDKPIFKNIAQEFIDFIADSKLVIHNASFDMKFLNAELGWVNRPALPNDQTIDTLAIARRKFPGSPASLDALCRRFGIDNSSRTLHGALLDSEILAEVYLELVGGRQPDLVLSGPEVKTSTDGSQSPDWRPAPRPKPLASRLSDKEKAAHETFIAALGSDALWTKET

SEQ ID NO: 70816 - DNA, 714 bp, Buchnera aphidicola subsp
  CDS (1)..(714): transl_table=11
atgaatagaaaaagaacaattatattagatacagaaacaacaggtataaatcaaacaagtcttcctcatataaaccatagaattatagaaataggagctgttgaaatcattgatcgttgtttcacaggaaataattttcatgtatatattcaacccggcagatcaatagagtctggagcattaaaagttcatggtattactaataaatttttattagataaacctatttttaaagatattgctgattcatttttaaattatattaaaaattctatattagttattcataatgcttcgttcgatgtaggatttataaatcaagaactagaaatattaaataagaaaatcaaaattaatacattttgttctattattgatacattaaaaattgcccgggaattatttcctggaaaaaaaaatacattagatgctttatgtacacgttataagataaataaatctcatagaaatctacatagtgcgatagtagactcttatcttttaggtaaattgtatcttttaatgactggcggtcaagattctttgttttctgataatacaattaattataaagaaaattttaaaaaattgaaaaaaaatattcaattaaaaaataatactttaaggatattacatcctacactaaaagaaaatgatttacatgaaaaatatctacaatacatgaaagataaaagtacatgtttatggaattaa

SEQ ID NO: 70817 - protein, 237 aa, Buchnera aphidicola subsp
MNRKRTIILDTETTGINQTSLPHINHRIIEIGAVEIIDRCFTGNNFHVYIQPGRSIESGALKVHGITNKFLLDKPIFKDIADSFLNYIKNSILVIHNASFDVGFINQELEILNKKIKINTFCSIIDTLKIARELFPGKKNTLDALCTRYKINKSHRNLHSAIVDSYLLGKLYLLMTGGQDSLFSDNTINYKENFKKLKKNIQLKNNTLRILHPTLKENDLHEKYLQYMKDKSTCLWN

SEQ ID NO: 70818 - DNA, 702 bp, Buchnera aphidicola subsp
  CDS (1)..(702): transl_table=11
atgaataatacacaaagaataattgttttagatactgaaacaacaggaatgaatagtgtaggtccaccttatcttaatcatagaattattgaaattggtgccattgaaataattaatcgtcgttttacagggaaaaaatttcatacttatattaaacctaatagattgatagaatctgacgcttcaaaaattcatggtattactgatgattttttatcagataaaccatcttttaaagacatagctaaagatttttttaattatataaaaaattcagaattaataattcataatgcatcttttgatgtaggtttcataaatcaagaattttcaatgttaactaaaaaaatacaagatatatcaaatttttgtaatattatagatacattaaagatagctagaaaattatttcctggtaaaaaaaataccttagacgcattatgtatgcgttataaaataaaaaattctcatagagttttacatggtgctattttagatgcttttctattaggtaaattatatcttttaatgactagtggtcaagaatcaattatatttaataaaaatatccaaaatgaaagaaattttagatatattaaaaaatcaataacaaaaaaacatcgttttttaaaaataataaaagcaaataaaacagaattaaaacttcataatgaatatttaaaatttttaaaagaaaaataa

SEQ ID NO: 70819 - protein, 233 aa, Buchnera aphidicola subsp
MNNTQRIIVLDTETTGMNSVGPPYLNHRIIEIGAIEIINRRFTGKKFHTYIKPNRLIESDASKIHGITDDFLSDKPSFKDIAKDFFNYIKNSELIIHNASFDVGFINQEFSMLTKKIQDISNFCNIIDTLKIARKLFPGKKNTLDALCMRYKIKNSHRVLHGAILDAFLLGKLYLLMTSGQESIIFNKNIQNERNFRYIKKSITKKHRFLKIIKANKTELKLHNEYLKFLKEK

SEQ ID NO: 70820 - DNA, 738 bp, Buchnera aphidicola subsp
  CDS (1)..(738): transl_table=11
atgaaaaaatatgatagaaaaattgttttagacattgaaactactggtatgaatcctgctgggtgtttttataaaaatcacaaaattattgaaattggagctgtggaaatgataaataacgtttttactggtaataattttcacagttatattcaacccaatagattaattgataaacaatcttttaaaattcatggaataacagataactttttattagataaaccaaaatttcatgaaatttcagtaaagtttttagaatatattacaaattctgatttaattattcataatgcaaaatttgacgtaggttttataaattatgagttaaatatgatcaatagtgacaaacgaaaaatatctgattattgtaatgttgttgatactttgccattagctagacaattatttccaggaaaaaaaaatagcttagatgctttatgtaatcgatataaaataaatgttagtcatcgagatttccatagtgcgttaattgatgcaaaattattagctaaagtatatacatttatgactagttttcaacagtcaatttcaatttttgataaaaatagtaatttgaattctattcaaaaaaatgcaaaactagattctagagttccttttcgatcaacattattactagcaactaaagatgaacttcaacagcacatgaaatatttaaaatatgtaaaacaagaaacaggaaattgtgtttggcttgaagataaatataattaa

SEQ ID NO: 70821 - protein, 245 aa, Buchnera aphidicola subsp
MKKYDRKIVLDIETTGMNPAGCFYKNHKIIEIGAVEMINNVFTGNNFHSYIQPNRLIDKQSFKIHGITDNFLLDKPKFHEISVKFLEYITNSDLIIHNAKFDVGFINYELNMINSDKRKISDYCNVVDTLPLARQLFPGKKNSLDALCNRYKINVSHRDFHSALIDAKLLAKVYTFMTSFQQSISIFDKNSNLNSIQKNAKLDSRVPFRSTLLLATKDELQQHMKYLKYVKQETGNCVWLEDKYN

SEQ ID NO: 70822 - DNA, 732 bp, Escherichia coli; identical to SEQ ID NO: 70640
  CDS (1)..(732): transl_table=11

SEQ ID NO: 70823 - protein, 243 aa, Escherichia coli; identical to SEQ ID NO: 70641

SEQ ID NO: 70824 - DNA, 771 bp, Haemophilus influenzae
  CDS (1)..(771): n is a, c, g, or t
atgattaatcccaatcgccaaattgtattagatactgaaactacaggtatgaatcagcttggcgcgcattatgaaggacactgcattattgaaattggtgcagttgaattaataaatcgtcgttacacaggtaataattrtcatatttatattaagccagatcgccccgntgatcctgatgcgattaaagttcatggaattactgatgaaatgttagcggataaacctgaattcaaagaagttgcccaagattttttggattatattaatggcgcagaattgcttattcacaatgccccctttgacgttggatttatggattatgaatttcgtaaacttaacctcaatgtgaaaactgacgatatttgtttggtgacagatacgctacaaatggcgcgtcagatgtatcctggaaaacgcaataatttggatgcactttgtgatcgtttaggtattgataatagcaaacgtactttgcacggtgcgttactggatgccgagatcttggcggatgtttatttgatgatgacgggagggcaaacaaatttattcgatgaagaagaatctgttgagtctggagttatccgtgttatgcaagaaaaaacggcggaagaaataaaaagtgcggtagatttttcgcacaatttgaaattacttcaacctactaatgatgagctacaagcgcatttagaattcttaaagatgatgaataaaaaaagtggaaataattgcctttgggataaacgttttggcaataataatgtgcattaa

SEQ ID NO: 70825 - protein, 256 aa, Haemophilus influenzae
  misc_feature <47>..<47>: The Xaa at location 47 stands for Cys, or Tyr.
  misc_feature <57>..<57>: The Xaa at location 57 stands for Ala, Asp, Gly, or Val.
MINPNRQIVLDTETTGMNQLGAHYEGHCIIEIGAVELINRRYTGNNXHIYIKPDRPXDPDAIKVHGITDEMLADKPEFKEVAQDFLDYINGAELLIHNAPFDVGFMDYEFRKLNLNVKTDDICLVTDTLQMARQMYPGKRNNLDALCDRLGIDNSKRTLHGALLDAEILADVYLMMTGGQTNLFDEEESVESGVIRVMQEKTAEEIKSAVDFSHNLKLLQPTNDELQAHLEFLKMMNKKSGNNCLWDKRFGNNNVH

SEQ ID NO: 70826 - DNA, 762 bp, Pasteurella multocida
  CDS (1)..(762): transl_table=11
atgaccccagtgaatcaaccgactcgccaaattgtactggataccgaaacaacggggatgaaccaatttggtgcacattatgaagggcattgtattattgaaattggtgcggttgagatgatcaatcgtcgcctcacgggcaataatttccatatttatatcaaaccgaatcgccccgtcgatcccgatgcgatcaaagtacacggtatcaccgatgaaatgttggctgataaacccatgtttaatgaagtcgcccagcaatttattgattatattcaaggggcggaattgctgatccataatgcgcccttcgacgtgggctttatggattatgagtttaaaaaactgaatttaaacatcaatactgatgcgatttgtatggtgactgataccctacaaatggcacgccaaatgtaccccggtaaacgtaatagcttagatgccctttgcgatcgtttaggcattgataacagcaaacgaaccctacacggcgcgttactggatgcggagatcttagcggatgtgtacctcacgatgacagggggacaaaccagtttatttgatgaaaatgaaccagaaattgctgttgtcgccgtccaagaacaaatccaaagtgcggtggctttttcacaagacttaaaacgcctgcaacccaatgccgatgaactacaagcccatctcgattacctcctcttacttaataaaaagagcaaaggcaattgcttatgggaaaagcgtttagcggaattgaaaacacattaa

SEQ ID NO: 70827 - protein, 253 aa, Pasteurella multocida
MTPVNQPTRQIVLDTETTGMNQFGAHYEGHCIIEIGAVEMINRRLTGNNFHIYIKPNRPVDPDAIKVHGITDEMLADKPMFNEVAQQFIDYIQGAELLIHNAPFDVGFMDYEFKKLNLNINTDAICMVTDTLQMARQMYPGKRNSLDALCDRLGIDNSKRTLHGALLDAEILADVYLTMTGGQTSLFDENEPEIAVVAVQEQIQSAVAFSQDLKRLQPNADELQAHLDYLLLLNKKSKGNCLWEKRLAELKTH

SEQ ID NO: 70828 - DNA, 693 bp, Rickettsia conorii
  CDS (1)..(693): transl_table=11
atgtcgagtttaagagaaataattttagataccgagactacgggacttgacccacgacaaggtcatcgaatcgttgagatcggtgctattgaaatggtaaataaggtattaacaggcaggaattttcatttttatattaatcctgagcgagatatgccgtttgaggcttatagaattcatggtatatccggcgaatttttaaaagacaagcctctatttcatacaatagccgatgattttttagagtttatttcagatagcaaactgattattcataatgctcctttcgatattaaatttctaaatcacgaattatcattattaaaaagaaccgacattaaactcttggaactagcaaatactattgatactttagtaatggctagaagcatatttccaggctcaaaatataatcttgatgcattatgtaaaagatttaaagttgataattcaggtaggcagcttcacggagctttgaaagatgccgcattacttgcagaagtatatgtagaattaatgggcggtagacaatccgcctttaaaatggttgataaatctgccgtaataaataatttagcaactaatcaagtaaataacaaaacagagcaaactactattgttattaaacctacaaaagaagaactgcaaaaacataaagagtttctcagtaggattttaaaaactgcttattaa

SEQ ID NO: 70829 - protein, 230 aa, Rickettsia conorii
MSSLREIILDTETTGLDPRQGHRIVEIGAIEMVNKVLTGRNFHFYINPERDMPFEAYRIHGISGEFLKDKPLFHTIADDFLEFISDSKLIIHNAPFDIKFLNHELSLLKRTDIKLLELANTIDTLVMARSIFPGSKYNLDALCKRFKVDNSGRQLHGALKDAALLAEVYVELMGGRQSAFKMVDKSAVINNLATNQVNNKTEQTTIVIKPTKEELQKHKEFLSRILKTAY

SEQ ID NO: 70830 - DNA, 690 bp, Rickettsia prowazekii
  CDS (1)..(690): transl_table=11
atgtcgagtttaagagaaataattttagatactgaaactacgggacttgatccacaacaaggtcatcgaattgttgagatcggtgcaattgagatggtaaataaggtattaacaggcaagcattttcatttttatattaatcctgaacgcgatatgccttttgaggcttataagattcacggtatctcaggagaatttttaaaagataaacctctgtttaagacaatagccaatgattttttaaagtttatagcagatagtacacttattattcataatgctcctttcgatattaaatttctaaatcatgaattatctttattaaagagaaccgaaattaaatttttggaactaacgaatactatagatactctagttatggcaaggaatatgtttcctggagcaagatatagtcttgatgcattatgtaaaagatttaaagttgataattcaggtaggcaacttcatggagctttaaaagatgcagcattacttgcagaagtgtatgttgcactaacaggaggtagacaatctacttttaagatgattaataaacctgatgaaataaacaacttggcagttaagtgtgtagatgtccagcaaataaaaagaggtattgttgttaagcctactaaagaagaattacaaaaacataaagagttcatagataagattttaatacaggcttaa

SEQ ID NO: 70831 - protein, 229 aa, Rickettsia prowazekii
MSSLREIILDTETTGLDPQQGHRIVEIGAIEMVNKVLTGKHFHFYINPERDMPFEAYKIHGISGEFLKDKPLFKTIANDFLKFIADSTLIIHNAPFDIKFLNHELSLLKRTEIKFLELTNTIDTLVMARNMFPGARYSLDALCKRFKVDNSGRQLHGALKDAALLAEVYVALTGGRQSTFKMINKPDEINNLAVKCVDVQQIKRGIVVKPTKEELQKHKEFIDKILIQA

SEQ ID NO: 70832 - DNA, 732 bp, Salmonella typhi
  CDS (1)..(732): transl_table=11
atgagcactgcaattacacgacagattgtcctcgataccgaaaccaccggtatgaaccagataggcgcgcactatgaaggtcacaagattattgagatcggtgcggttgaggtgataaaccgtcgtctgaccggcaacaattttcatgtttacctgaagccggatcggctggtggatccggaagcgtttggcgtacacggtattgccgatgagtttctgctggataagccggtttttgctgatgtggtcgatgagtttctcgattatatccgcggcgcggagctggtcatccataacgcatcgttcgatatcggctttatggattatgagtttggtctgcttaaacgcgatattcctaaaaccaatactttctgcaaagttaccgatagcctggcgttggcgcggaaaatgttccccggcaagcgtaacagccttgatgcgctgtgttcgcgttatgagatagataatagcaaacgtactttgcacggcgcattgctcgatgcccagatccttgccgaagtgtatctggcgatgacgggcggacaaacgtccatgacgtttgcgatggaaggagagacgcaacggcagcaaggtgaagcgaccattcagcgaatcgttcgccaggccagccggttacgggtcgtttttgcctctgaggaagagctggctgcgcatgaatcgcggcttgatctggtgcagaaaaagggcggaagttgcctttggcgggcataa

SEQ ID NO: 70833 - protein, 243 aa, Salmonella typhi
MSTAITRQIVLDTETTGMNQIGAHYEGHKIIEIGAVEVINRRLTGNNFHVYLKPDRLVDPEAFGVHGIADEFLLDKPVFADVVDEFLDYIRGAELVIHNASFDIGFMDYEFGLLKRDIPKTNTFCKVTDSLALARKMFPGKRNSLDALCSRYEIDNSKRTLHGALLDAQILAEVYLAMTGGQTSMTFAMEGETQRQQGEATIQRIVRQASRLRVVFASEEELAAHESRLDLVQKKGGSCLWRA

SEQ ID NO: 70834 - DNA, 23 bp, Artificial sequence
  primer
atgagcactgcaattacacgcca

SEQ ID NO: 70835 - DNA, 23 bp, Artificial sequence
  primer
ttatgctcgccagaggcaacttc

SEQ ID NO: 70836 - protein, 287 aa, Artificial sequence
  consensus sequence
  Variant (2)..(2): Xaa in position 2 is any amino acid
  Variant (4)..(4): Xaa in position 4 is any amino acid
  Variant (12)..(14): Xaa in position 12 to 14 is any amino acid
  Variant (15)..(21): Xaa in position 15 to 21 is any or no amino acid
  Variant (23)..(23): Xaa in position 23 is any amino acid
  Variant (25)..(26): Xaa in position 25 to 26 is any amino acid
  Variant (30)..(31): Xaa in position 30 to 31 is any amino acid
  Variant (33)..(35): Xaa in position 33 to 35 is any amino acid
  Variant (37)..(38): Xaa in position 37 to 38 is any amino acid
  Variant (41)..(43): Xaa in position 41 to 43 is any amino acid
  Variant (45)..(45): Xaa in position 45 is any amino acid
  Variant (47)..(48): Xaa in position 47 to 48 is any amino acid
  Variant (50)..(50): Xaa in position 50 is any amino acid
  Variant (51)..(51): Xaa in position 51 is any or no amino acid
  Variant (53)..(57): Xaa in position 53 to 57 is any amino acid
  Variant (59)..(60): Xaa in position 59 to 60 is any amino acid
  Variant (64)..(67): Xaa in position 64 to 67 is any amino acid
  Variant (70)..(70): Xaa in position 70 is any amino acid
  Variant (71)..(83): Xaa in position 71 to 83 is any or no amino acid
  Variant (86)..(87): Xaa in position 86 to 87 is any amino acid
  Variant (89)..(89): Xaa in position 89 is any amino acid
  Variant (91)..(96): Xaa in position 91 to 96 is any amino acid
  Variant (98)..(105): Xaa in position 98 to 105 is any amino acid
  Variant (107)..(107): Xaa in position 107 is any amino acid
  Variant (112)..(112): Xaa in position 112 is any amino acid
  Variant (115)..(116): Xaa in position 115 to 116 is any amino acid
  Variant (118)..(120): Xaa in position 118 to 120 is any amino acid
  Variant (122)..(136): Xaa in position 122 to 136 is any amino acid
  Variant (137)..(141): Xaa in position 137 to 141 is any or no amino acid
  Variant (145)..(146): Xaa in position 145 to 146 is any amino acid
  Variant (149)..(151): Xaa in position 149 to 151 is any amino acid
  Variant (154)..(155): Xaa in position 154 to 155 is any amino acid
  Variant (157)..(157): Xaa in position 157 is any amino acid
  Variant (163)..(163): Xaa in position 163 is any amino acid
  Variant (165)..(167): Xaa in position 165 to 167 is any amino acid
  Variant (170)..(171): Xaa in position 170 to 171 is any amino acid
  Variant (173)..(173): Xaa in position 173 is any amino acid
  Variant (181)..(183): Xaa in position 181 to 183 is any amino acid
  Variant (186)..(186): Xaa in position 186 is any amino acid
  Variant (189)..(193): Xaa in position 189 to 193 is any amino acid
  Variant (195)..(228): Xaa in position 195 to 228 is any amino acid
  Variant (229)..(265): Xaa in position 229 to 265 is any or no amino acid
  Variant (267)..(269): Xaa in position 267 to 269 is any amino acid
  Variant (271)..(281): Xaa in position 271 to 281 is any amino acid
  Variant (282)..(286): Xaa in position 282 to 286 is any or no amino acid
RXIXLDTETTGXXXXXXXXXXGXRXXEIGXXEXXXRXXTGXXXHXYXXPXXRXXXXXAXXVHGXXXXFLXXXXXXXXXXXXXXDKXXPXFXXXXXXFXXXXXXXXLXIHNAXFDXXFXXXEXXXXXXXXXXXXXXXXXXXXDTLXXARXXXPGXXNXLDALCXRXXXDNXXRXLHGALLDXXXLAXVYXXXXXGXXXXXXXXXXXXXXXXXXXXXXXXXXXXXXXXXXXXXXXXXXXXXXXXXXXXXXXXXXXXXXXXXXXXXXXEXXXHXXXXXXXXXXXXXXXXW

SEQ ID NO: 70837 - protein, 52 aa, Artificial sequence
  protein pattern
  Variant (2)..(2): Xaa in position 2 is Ser or Thr
  Variant (4)..(5): Xaa in position 4 to 5 is any or no amino acid
  Variant (7)..(10): Xaa in position 7 to 10 is any amino acid
  Variant (11)..(12): Xaa in position 11 to 12 is any or no amino acid
  Variant (15)..(18): Xaa in position 15 to 18 is any amino acid
  Variant (21)..(21): Xaa in position 21 is any amino acid
  Variant (24)..(24): Xaa in position 24 is any amino acid
  Variant (26)..(27): Xaa in position 26 to 27 is any amino acid
  Variant (28)..(28): Xaa in position 28 is Ile or Val
  Variant (29)..(29): Xaa in position 29 is Asp, Asn or Ser
  Variant (30)..(32): Xaa in position 30 to 32 is any amino acid
  Variant (34)..(35): Xaa in position 34 to 35 is any amino acid
  Variant (40)..(40): Xaa in position 40 is any amino acid
  Variant (42)..(42): Xaa in position 42 is Ala, Cys, Ser or Thr
  Variant (43)..(43): Xaa in position 43 is any amino acid
  Variant (44)..(44): Xaa in position 44 is Ile or Leu
  Variant (46)..(46): Xaa in position 46 is Ala, Gly or Ser
  Variant (47)..(47): Xaa in position 47 is any amino acid
  Variant (49)..(49): Xaa in position 49 is Phe, Trp or Tyr
  Variant (50)..(50): Xaa in position 50 is Ile, Leu or Val
  Variant (51)..(51): Xaa in position 51 is any amino acid
  Variant (52)..(52): Xaa in position 52 is Leu or Met
DXLXXAXXXXXXPGXXXXLDXLCXRXXXXXXXRXXHGALXDXXXLXXVXXXX

SEQ ID NO: 70838 - protein, 25 aa, Artificial sequence
  protein pattern
  Variant (2)..(2): Xaa in position 2 is Phe or Ile
  Variant (3)..(3): Xaa in position 3 is Ala or Gly
  Variant (4)..(4): Xaa in position 4 is Ala, Cys or Gly
  Variant (5)..(5): Xaa in position 5 is Ile, Leu or Val
  Variant (7)..(7): Xaa in position 7 is Ile, Leu, Met or Val
  Variant (8)..(8): Xaa in position 8 is any amino acid
  Variant (9)..(9): Xaa in position 9 is Asp, Gly or Asn
  Variant (10)..(12): Xaa in position 10 to 12 is any amino acid
  Variant (13)..(13): Xaa in position 13 is Ser or Thr
  Variant (14)..(17): Xaa in position 14 to 17 is any amino acid
  Variant (19)..(19): Xaa in position 19 is any amino acid
  Variant (21)..(22): Xaa in position 21 to 22 is any amino acid
  Variant (24)..(24): Xaa in position 24 is any amino acid
EXXXXEXXXXXXXXXXXHXYXXPXR

SEQ ID NO: 70839 - protein, 30 aa, Artificial sequence
  protein pattern
  Variant (2)..(2): Xaa in position 2 is any amino acid
  Variant (4)..(5): Xaa in position 4 to 5 is any amino acid
  Variant (6)..(6): Xaa in position 6 is Ile or Val
  Variant (7)..(9): Xaa in position 7 to 9 is any amino acid
  Variant (10)..(10): Xaa in position 10 is Phe, Ile, Leu or Val
  Variant (11)..(12): Xaa in position 11 to 12 is any amino acid
  Variant (13)..(13): Xaa in position 13 is Phe or Tyr
  Variant (14)..(15): Xaa in position 14 to 15 is any amino acid
  Variant (16)..(16): Xaa in position 16 is Asp, Glu, Gly or Asn
  Variant (17)..(17): Xaa in position 17 is Ala, Asp or Ser
  Variant (18)..(18): Xaa in position 18 is any amino acid
  Variant (20)..(20): Xaa in position 20 is Ile, Leu or Val
  Variant (25)..(25): Xaa in position 25 is any amino acid
  Variant (28)..(28): Xaa in position 28 is Ile, Leu, Met or Val
  Variant (29)..(29): Xaa in position 29 is any amino acid
PXFXXXXXXXXXXXXXXXLXIHNAXFDXXF

SEQ ID NO: 70840 - protein, 11 aa, Artificial sequence
  protein pattern
  Variant (2)..(2): Xaa in position 2 is Glu, Gln or Ser
  Variant (3)..(3): Xaa in position 3 is Ile, Leu or Val
  Variant (4)..(4): Xaa in position 4 is Phe, Ile, Leu or Val
RXXXLDTETTG

SEQ ID NO: 70841 - protein, 15 aa, Artificial sequence
  protein pattern
  Variant (2)..(3): Xaa in position 2 to 3 is any amino acid
  Variant (4)..(4): Xaa in position 4 is Ile or Val
  Variant (7)..(7): Xaa in position 7 is Ile or Leu
  Variant (8)..(8): Xaa in position 8 is Ala, Ser or Thr
  Variant (9)..(9): Xaa in position 9 is any amino acid
  Variant (10)..(10): Xaa in position 10 is Ala, Asp, Glu or Gln
  Variant (11)..(11): Xaa in position 11 is any amino acid
  Variant (13)..(13): Xaa in position 13 is any amino acid
  Variant (14)..(14): Xaa in position 14 is Asp, Glu, Gly or Thr
AXXXHGXXXXXLXXK

SEQ ID NO: 70842 - DNA, 525 bp, Escherichia coli
  CDS (1)..(525)
atgacacaacctctttttctgatcgggcctcggggctgtggtaaaacaacggtcggaatggcccttgccgattcgcttaaccgtcggtttgtcgataccgatcagtggttgcaatcacagctcaatatgacggtcgcggagatcgtcgaaagggaagagtgggcgggatttcgcgccagagaaacggcggcgctggaagcggtaactgcgccatccaccgttatcgctacaggcggcggcattattctgacggaatttaatcgtcacttcatgcaaaataacgggatcgtggtttatttgtgtgcgccagtatcagtcctggttaaccgactgcaagctgcaccggaagaagatttacggccaaccttaacgggaaaaccgctgagcgaagaagttcaggaagtgctggaagaacgcgatgcgctatatcgcgaagttgcgcatattatcatcgacgcaacaaacgaacccagccaggtgatttctgaaattcgcagcgccctggcacagacgatcaattgttga

SEQ ID NO: 70843 - protein, 174 aa, Escherichia coli; identical to SEQ ID NO: 2060

SEQ ID NO: 70844 - DNA, 543 bp, Methylophilus methylotrophus
  CDS (1)..(543)
atgggtgcgcaaataccaaacaacatttttttgatcggattgatgggagcgggcaagaccaccgttggcaaattgatcgccaagaatttaggcaagaccttttacgataccgatcatgtgattgagcagcggactggcgtcaagatcccgaccatttttgagctggaaggcgaagcggggtttcgcaagcgtgaaacgtctacgctggaagagctggcacagcaggataatattgtcctggccacgggtggtggtgccatcatcgctcctgaaaaccgggaaatactcaagaaatatggctatgtgatttacctgcgggcaaatgtgaatgagctgtatctgcgtacccgcaatgataaaaatcgtcccttgttgcagaatgtagatgtcaaagccaggctggaacaattgttccatgcgcgcaatccactttataccgaaaccgcaaacctcattgtggataccgggcatcagccggtagcggtcattatccagaaaattgaaaacgccctgaaagcgttggagtcatcatgcaaaccttga

SEQ ID NO: 70845 - protein, 180 aa, Methylophilus methylotrophus
MGAQIPNNIFLIGLMGAGKTTVGKLIAKNLGKTFYDTDHVIEQRTGVKIPTIFELEGEAGFRKRETSTLEELAQQDNIVLATGGGAIIAPENREILKKYGYVIYLRANVNELYLRTRNDKNRPLLQNVDVKARLEQLFHARNPLYTETANLIVDTGHQPVAVIIQKIENALKALESSCKP

SEQ ID NO: 70846 - DNA, 912 bp, Arabidopsis thaliana
  CDS (1)..(912)
atggaagcagctattactcagaggattcagtacccatcatgggttgattgtagaaaagttgagtgtaagccgcagcgtggttcattgcggtattctcagcaggttaaggtagatagaaggtttagaggtctttctttggctcgcttgcaacctgaaagaagaaatgatcaacgaagagcagtttctccagcggtttcctgttctgataacaattcctcagcgttgttggagactggaagtgtttatccatttgatgaagatattctcaagagaaaagcagaagaggttaaaccgtatttgaatggacgatctatgtaccttgtcggaatgatgggttctgggaaaacaactgtgggaaagttaatgtccaaagtgctcggttatacgttctttgactgcgacactttgattgaacaggcgatgaatggaacttctgttgcagagatatttgttcatcacggagagaatttttttagaggaaaggagaccgatgcgcttaagaagctctcttcgaggtatcaagttgttgtttccacaggtggaggtgcagttataagacccattaactggaagtatatgcataaaggaatcagcatttggctagatgtgcctctagaagcattagcccatagaatcgctgctgttggaactgattcacgaccactgctacacgatgaatcaggagatgcatactcagtggctttcaaacgtctctcggctatttgggacgagcgcggtgaagcatacacaaacgcaaatgccagagtctccttagaaaatattgcagcaaagcgtggctataaaaatgtctcagatctcacaccaactgaaattgctatcgaggccttcgagcaagttctgagctttctagagaaagaagaaactatggagatcccagacggcgacctctaa

SEQ ID NO: 70847 - protein, 303 aa, Arabidopsis thaliana
MEAAITQRIQYPSWVDCRKVECKPQRGSLRYSQQVKVDRRFRGLSLARLQPERRNDQRRAVSPAVSCSDNNSSALLETGSVYPFDEDILKRKAEEVKPYLNGRSMYLVGMMGSGKTTVGKLMSKVLGYTFFDCDTLIEQAMNGTSVAEIFVHHGENFFRGKETDALKKLSSRYQVVVSTGGGAVIRPINWKYMHKGISIWLDVPLEALAHRIAAVGTDSRPLLHDESGDAYSVAFKRLSAIWDERGEAYTNANARVSLENIAAKRGYKNVSDLTPTEIAIEAFEQVLSFLEKEETMEIPDGDL

SEQ ID NO: 70848 - DNA, 723 bp, Escherichia coli O157:H7 EDL933
  CDS (1)..(723): transl_table=11
gtggtagcaaggcagcgcgcttgcagcgaccagatatgcagagggatgggtgatttattcagttgccaaacccgctggagtattgagataattttcagtctgactctcgcaatatcttatgaggtttcagttcatgtcctgcggagctctctgagcgaagcgggtttatcattaacgaatagtcttagtagtaccgaaaaaatggcagagaaacgcaatatctttctggttgggcctatgggtgccggaaaaagcactattgggcgccagttagctcaacaactcaatatggaattttacgattccgatcaagagattgagaaacgaaccggagctgatgtgggctgggttttcgatttagaaggcgaagaaggcttccgcgatcgcgaagaaaaggtcatcaatgagttgaccgagaaacagggtattgtgctggctactggcggcggctctgtgaaatcccgtgaaacgcgtaaccgtctttccgctcgtggcgttgtcgtttatcttgaaacgacgatcgaaaagcaacttgcacgcacgcagcgtgataaaaaacgcccgttgctgcacgttgaaacaccgccgcgtgaagttctggaagcgttggccaatgaacgcaatccgctgtatgaagagattgccgacgtgaccattcgtactgatgatcaaagcgctaaagtggttgcaaaccagattattcacatgctggaaagcaactaa

SEQ ID NO: 70849 - protein, 240 aa, Escherichia coli O157:H7 EDL933
MVARQRACSDQICRGMGDLFSCQTRWSIEIIFSLTLAISYEVSVHVLRSSLSEAGLSLTNSLSSTEKMAEKRNIFLVGPMGAGKSTIGRQLAQQLNMEFYDSDQEIEKRTGADVGWVFDLEGEEGFRDREEKVINELTEKQGIVLATGGGSVKSRETRNRLSARGVVVYLETTIEKQLARTQRDKKRPLLHVETPPREVLEALANERNPLYEEIADVTIRTDDQSAKVVANQIIHMLESN

SEQ ID NO: 70850 - DNA, 501 bp, Agrobacterium tumefaciens str. C58
  CDS (1)..(501): transl_table=11
gtggggctgatgggggctggaaagtcggcggtgggccgcatggtcgcccagcagctcaaggtgcctttcattgatacggatgtcgaaatcgagcgcgtatcgcgcatgacgatatcggagcttttcgccacctatggcgaggaggaattccgggcgctggaaacgcgggtcatcaagcggttgatgcgcggcggtcccaaggtcgtctccacgggcggcggcgcatttatcaacgacactacccgaggccatatcaggcgcggcggcatttcgctgtggctgaaggccgatctcgaggttctgtgggagagggtcaacaagcgcgaccaccgcccgcttctcaagactgaaaaccccaaggcaacgctcgctgccctgatggagaaacgttatccgatctatgcggaggcggacgtcaccatcgaatcccgtgatgtccgcaaggagatcatcgcgaccgaagtgctgacggctttagccggccttaaacagaaagactga

SEQ ID NO: 70851 - protein, 166 aa, Agrobacterium tumefaciens str. C58; identical to SEQ ID NO: 2056

SEQ ID NO: 70852 - DNA, 492 bp, Agrobacterium tumefaciens str. C58
  CDS (1)..(492): transl_table=11
atgggggctggaaagtcggcggtgggccgcatggtcgcccagcagctcaaggtgcctttcattgatacggatgtcgaaatcgagcgcgtatcgcgcatgacgatatcggagcttttcgccacctatggcgaggaggaattccgggcgctggaaacgcgggtcatcaagcggttgatgcgcggcggtcccaaggtcgtctccacgggcggcggcgcatttatcaacgacactacccgaggccatatcaggcgcggcggcatttcgctgtggctgaaggccgatctcgaggttctgtgggagagggtcaacaagcgcgaccaccgcccgcttctcaagactgaaaaccccaaggcaacgctcgctgccctgatggagaaacgttatccgatctatgcggaggcggacgtcaccatcgaatcccgtgatgtccgcaaggagatcatcgcgaccgaagtgctgacggctttagccggccttaaacagaaagactga

SEQ ID NO: 70853 - protein, 163 aa, Agrobacterium tumefaciens str. C58
MGAGKSAVGRMVAQQLKVPFIDTDVEIERVSRMTISELFATYGEEEFRALETRVIKRLMRGGPKVVSTGGGAFINDTTRGHIRRGGISLWLKADLEVLWERVNKRDHRPLLKTENPKATLAALMEKRYPIYAEADVTIESRDVRKEIIATEVLTALAGLKQKD

SEQ ID NO: 70854 - DNA, 573 bp, Corynebacterium glutamicum ATCC 13032
  CDS (1)..(573): transl_table=11
atggagcgtaatgaagtgaatgatcaaattcacttagatcatcaatcagatgacacctctgaatgctcctgcccgatcgtggttcttgtgggtttgccaggagctggaaaatccaccattggacgtcgattagcgcgcgccttaaacactgaactcgtcgactccgacgaactgattgagcgcgccaccggaaaagcctgtggcgccgtgttcagcgagctcggcgagccagccttccgcgagctcgaggccatccacgtggccgaagcactgaaatcctccggagtggtgagcttgggaggcggatctgtgctgacagaatccacccgtgaactgctcaaaggccaggacgtggtctggatcgacgtgccagtagaagaaggcatcaggcgcaccgcaaacgagcgttcccgccccgtgctgcaagccgccgaccccgccgagcactaccgcaacctggtgaaagtgcgcaccccgttgtacgaagaggtggcaacctaccgacttcgcaccaacaaccgcagcccccagcaagtggtggcagcagtgttgcatcatctagaaatcgattaa

SEQ ID NO: 70855 - protein, 190 aa, Corynebacterium glutamicum ATCC 13032; identical to SEQ ID NO: 2070

SEQ ID NO: 70856 - DNA, 471 bp, Bacillus cereus ATCC 14579; identical to SEQ ID NO: 2133
  CDS (1)..(471): transl_table=11

SEQ ID NO: 70857 - protein, 156 aa, Bacillus cereus ATCC 14579; identical to SEQ ID NO: 2134

SEQ ID NO: 70858 - DNA, 498 bp, Bacillus anthracis str. Ames; identical to SEQ ID NO: 2135
  CDS (1)..(498): transl_table=11

SEQ ID NO: 70859 - protein, 165 aa, Bacillus anthracis str. Ames; identical to SEQ ID NO: 2136

SEQ ID NO: 70860 - DNA, 915 bp, Arabidopsis thaliana
  CDS (1)..(915)
atggaagcagctattactcagaggattcagtacccatcatgggttgattgtagaaaagttgagtgtaagccgcagcgtggttcattgcggtattctcagcaggttaaggtagatagaaggtttagaggtctttctttggctcgcttgcaacctgaaagaagaaatgatcaacgaagagcagtttctccagcggtttcctgttctgataacaattcctcaggtgcgttgttggagactggaagtgtttatccatttgatgaagatattctcaagagaaaagcagaagaggttaaaccgtatttgaatggacgatctatgtaccttgtcggaatgatgggttctgggaaaacaactgtgggaaagttaatgtccaaagtgctcggttatacgttctttgactgcgacactttgattgaacaggcgatgaatggaacttctgttgcagagatatttgttcatcacggagagaatttttttagaggaaaggagaccgatgcgcttaagaagctctcttcgaggtatcaagttgttgtttccacaggtggaggtgcagttataagacccattaactggaagtatatgcataaaggaatcagcatttggctagatgtgcctctagaagcattagcccatagaatcgctgctgttggaactgattcacgaccactgctacacgatgaatcaggagatgcatactcagtggctttcaaacgtctctcggctatttgggacgagcgcggtgaagcatacacaaacgcaaatgccagagtctccttagaaaatattgcagcaaagcgtggctataaaaatgtctcagatctcacaccaactgaaattgctatcgaggccttcgagcaagttctgagctttctagagaaagaagaaactatggagatcccagacggcgacctctaa

SEQ ID NO: 70861 - protein, 304 aa, Arabidopsis thaliana
MEAAITQRIQYPSWVDCRKVECKPQRGSLRYSQQVKVDRRFRGLSLARLQPERRNDQRRAVSPAVSCSDNNSSGALLETGSVYPFDEDILKRKAEEVKPYLNGRSMYLVGMMGSGKTTVGKLMSKVLGYTFFDCDTLIEQAMNGTSVAEIFVHHGENFFRGKETDALKKLSSRYQVVVSTGGGAVIRPINWKYMHKGISIWLDVPLEALAHRIAAVGTDSRPLLHDESGDAYSVAFKRLSAIWDERGEAYTNANARVSLENIAAKRGYKNVSDLTPTEIAIEAFEQVLSFLEKEETMEIPDGDL

SEQ ID NO: 70862 - DNA, 513 bp, Bacillus cereus ATCC 10987
  CDS (1)..(513): transl_table=11
ttgagaggaacgaaaatgaaatctatatacataaccggctatatgggagcagggaaaacaacaattggaaaagcgttaagtaaagaacttcacatggatgttatagatacagatcaaaaaattgaagagaagcaagagaaggagattcgtgatatttttgccgaagaaggtgaaatgacttttcgggaatatgaaagtgagatgttacgttcactacctgttgaaaatgtaatcattacaactggcggcggaatcattgagcgagaggaaaaccgaaagtggatgaaggaaaatggcactgtcgtgtatttatattgtgatccacacgtaattgcagagaggcttcgtgaagatacgacacgtccactatttcagaagaaagatatagatgcatttgtaatgaaattcgaatcgcgccgagcttattatgaagaggctcatattcatattgatacgacgaataagtctgtaaagcaaattatgaatgaattaaaagaaaagattaatggataa

SEQ ID NO: 70863 - protein, 170 aa, Bacillus cereus ATCC 10987; identical to SEQ ID NO: 2100

SEQ ID NO: 70864 - DNA, 864 bp, Oryza sativa (japonica cultivar-group); identical to SEQ ID NO: 2131
  CDS (1)..(864)

SEQ ID NO: 70865 - protein, 287 aa, Oryza sativa (japonica cultivar-group); identical to SEQ ID NO: 2132

SEQ ID NO: 70866 - DNA, 498 bp, Bacillus thuringiensis serovar konkukian str. 97-27
  CDS (1)..(498): transl_table=11
atgaaatctatatacataaccggttatatgggagctgggaaaacaacaattggaaaagcgttaagtaaagaacttcatatggatgttgtagatacagatcaaaaaattgaagagaagcaagagaaggcaattcttgatatttttgccgaagaaggtgaaatggcttttcgagaatatgaaagtgagatgttacgttcattacccgttcgtaatgcaattattacaactggcggcggaatcattgagcgagaggaaaaccgaaagtggatgaaggaaaatggaattgtcgtgtatttatattgcgatccacatgtaattgcagagaggcttcgtgaagatacgacacgtccactatttcagaagaaagatatagatgcatttgtaacgaaatttgaatcgcgccgagcttattatgaagaggctcatattcatattgatacgacgaataagtctgtaaagcaaattatgaatgaattaaaagaaaagattaatgaataa

SEQ ID NO: 70867 - protein, 165 aa, Bacillus thuringiensis serovar konkukian str. 97-27
MKSIYITGYMGAGKTTIGKALSKELHMDVVDTDQKIEEKQEKAILDIFAEEGEMAFREYESEMLRSLPVRNAIITTGGGIIEREENRKWMKENGIVVYLYCDPHVIAERLREDTTRPLFQKKDIDAFVTKFESRRAYYEEAHIHIDTTNKSVKQIMNELKEKINE

SEQ ID NO: 70868 - DNA, 519 bp, Desulfotalea psychrophila LSv54
  CDS (1)..(519): transl_table=11
atgatttttcttgttggttatagggcagttggcaagacaaccctggggaaaaagctcgccagggaaataggcgctgactttgttgatcttgatcggtatatctgtgaggcagcggggagaacggttgaggagatagtggcagttgaaggttggcaggggtttcgcctgcgtgaacgggaggcaatgcttgccgttgctgctgaggagaggcatcttgtggtggccacgggtggtggggcagttcttcaccaggatctttggcctatgttgaaaaaaaaggggtttgttgtctggcttacagcagaacaggggacattatgtaaaaggctttcgcgcagggctcaggatcccggtcgtccctcactaactgggcaagagatgagtgcagaggtggagaaggttttaagggagcgcctgcctctctatgatgctgttgccgatgtttctgtggcgacggatcgactatcaatagttgatgccatcgagcaggttcttgattattataggaaaactatttga

SEQ ID NO: 70869 - protein, 172 aa, Desulfotalea psychrophila LSv54
MIFLVGYRAVGKTTLGKKLAREIGADFVDLDRYICEAAGRTVEEIVAVEGWQGFRLREREAMLAVAAEERHLVVATGGGAVLHQDLWPMLKKKGFVVWLTAEQGTLCKRLSRRAQDPGRPSLTGQEMSAEVEKVLRERLPLYDAVADVSVATDRLSIVDAIEQVLDYYRKTI

SEQ ID NO: 70870 - DNA, 498 bp, Bacillus cereus E33L
  CDS (1)..(498): transl_table=11
atgaaatctatatacataaccggttatatgggagctgggaaaacaacaattggaaaagcattaagtaaagaacttcatatggatgttgtagatacagatcaaaaaattgaagagaagcaagagaaggagattcgtgatatttttgccgaagaaggtgaaatggcttttcgggaatatgaaagtaagatgttacgttcactacctgttgaaaatgtaatcattacaactggcggcggaatcattgagcgagaggaaaaccgaaagtggatgaaggaaaatggaattgtcgtgtatttatattgcgatccacatgtaattgcagaaaggcttcgtgaagatacgacacgtccactatttcagaagaaagatatagatgcatttgtaacgaaattcgaatcgcgccgagcttattatgaagaggctcatattcatatcgatacgacgaataagtctgtaaagcaaattatgaatgaattaaaagaaaagattaatgaataa

SEQ ID NO: 70871 - protein, 165 aa, Bacillus cereus E33L
MKSIYITGYMGAGKTTIGKALSKELHMDVVDTDQKIEEKQEKEIRDIFAEEGEMAFREYESKMLRSLPVENVIITTGGGIIEREENRKWMKENGIVVYLYCDPHVIAERLREDTTRPLFQKKDIDAFVTKFESRRAYYEEAHIHIDTTNKSVKQIMNELKEKINE

SEQ ID NO: 70872 - DNA, 534 bp, Burkholderia mallei ATCC 23344
  CDS (1)..(534): transl_table=11
gtgaacgtaattttcgtcgggctcatgggggcgggtaagaccaccgtgggccgggcggtcgcgcgccggctcgacagacccttcttcgattcggatcacgagatcgaggcgcgcaccggcgcgcgcattccggtcatcttcgaactcgagggcgaagcgggcttccgtgaccgcgaggcgcagatgatcgccgagctcacgcagcgcgagaacatcgtgctggcgacgggcggcggcgcgatcctgcgccccgagaaccgcaagctgcttcacgaacggggcctcgtcgtctatctgcgcgcgaatccgcacgatctctggctgcgcacccgcaaggacaagaatcgcccgctgttgcagaccgacgatccgaaagccaagctcgaagcgctgtacgaagcgcgcgatccgctctaccgcgaatgcgcgcacttcgtcatcgaaaccgggcggccgtccgtcaacgggctcgtcaacatggtgctgatgcagctcgaaatggcgggcatcgtcgccaagccactccaagcatga

SEQ ID NO: 70873 - protein, 177 aa, Burkholderia mallei ATCC 23344
MNVIFVGLMGAGKTTVGRAVARRLDRPFFDSDHEIEARTGARIPVIFELEGEAGFRDREAQMIAELTQRENIVLATGGGAILRPENRKLLHERGLVVYLRANPHDLWLRTRKDKNRPLLQTDDPKAKLEALYEARDPLYRECAHFVIETGRPSVNGLVNMVLMQLEMAGIVAKPLQA

SEQ ID NO: 70874 - DNA, 558 bp, Corynebacterium glutamicum ATCC 13032
  CDS (1)..(558): transl_table=11
gtgaatgatcaaattcacttagatcatcaatcagatgacacctctgaatgctcctgcccgatcgtggttcttgtgggtttgccaggagctggaaaatccaccattggacgtcgattagcgcgcgccttaaacactgaactcgtcgactccgacgaactgattgagcgcgccaccggaaaagcctgtggcgccgtgttcagcgagctcggcgagccagccttccgcgagctcgaggccatccacgtggccgaagcactgaaatcctccggagtggtgagcttgggaggcggatctgtgctgacagaatccacccgtgaactgctcaaaggccaggacgtggtctggatcgacgtgccagtagaagaaggcatcaggcgcaccgcaaacgagcgttcccgccccgtgctgcaagccgccgaccccgccgagcactaccgcaacctggtgaaagtgcgcaccccgttgtacgaagaggtggcaacctaccgacttcgcaccaacaaccgcagcccccagcaagtggtggcagcagtgttgcatcatctagaaatcgattaa

SEQ ID NO: 70875 - protein, 185 aa, Corynebacterium glutamicum ATCC 13032
MNDQIHLDHQSDDTSECSCPIVVLVGLPGAGKSTIGRRLARALNTELVDSDELIERATGKACGAVFSELGEPAFRELEAIHVAEALKSSGVVSLGGGSVLTESTRELLKGQDVVWIDVPVEEGIRRTANERSRPVLQAADPAEHYRNLVKVRTPLYEEVATYRLRTNNRSPQQVVAAVLHHLEID

SEQ ID NO: 70876 - DNA, 1590 bp, Carboxydothermus hydrogenoformans Z-2901
  CDS (1)..(1590): transl_table=11
atgaacatcattttagtgggactaccgggggctggcaaaacacatataggtcggattttagcgaggaaattaaaaaggaattttgtggatcttgaccggaagattgaagaagagacgggacttacgattaaagaaatatttgcccgtttcggtgagcgctatttccgccgtttggaagtaaagaaactacaggaactttttaaacttcataatgcggtgattgccaccggtgggggaacggtagaacgaatggatgcgagaagaaagttaaaaaatcttggcttagtggtttatttaaaggcgtccccggaagttataatccggcgtcttattaatttagaaaatagaccaatacttacccagggggaccctttagaaaagctttcggagctttaccgtcgccgggataagttttaccgggaagtttccgatgtagcaattaataccgaaggtaaagactcaggcgaggtcgttgacgcgatcctaaaatccctgactattgatggtttacggtttccccggaaactttacattaatttggctgaaaatagttatccggtatattttggcgaaaaagtggcgttaaaagcgggtgagtttttaaaagaaaaagttaccgggaaaaagattttaattgtttcccaggaaaatatctttggtttatatggcaaaactttagaagaaagtttaacaaaggaaggttttaaaaccgacgttttttttcttccccagggggaagttgcaaaatctatggaatatattgtgaagctttacgataaagccatagagtttggactacgccgccatgataccgttatggcctttgggggaggagtagtaggagatgctactggattttttgccgcaacctatttgcggggaatcaattttgtccaggtaccgacaactcttctttctatggtggatagcagtgtaggggggaaagtggggattaaccttccccaagggaaaaacctggtaggagccttttaccagccaaaagtagtgttaatagatactacttacctaaaaactcttcccagaagagaagtgctggcgggattggctgaaatttataaagcgtttttaattgctgaagaaagccttgtcgggtggctttccggattaaacctggataagctccgtccaagggattggcaaaggattatcaaggcggcggtaaaaataaaagcaaaggttgtatccctcgatgaacgggaagaagggttacgggcggtattaaatttaggccacaccataggccatgcgatagaaggtgtaaacgggttttccggtattcttcacggcgaagcggtagctctgggaatattatgggaagccaagctctctaaagatttaggatatttaagggaggaggaatgggaaaaaatacgggagtttatcgagaaaaattatgcttacttaaaactatccttaaatcccgatagcttacttgtttttatggataaagataaaaaaaatcgggaagatatcgcttttatgcttttaaagaagattggtgaatacccggaaaatgttgaaataaagagagaatggttacaaaagtggttaacgttgaatttttcttaa

SEQ ID NO: 70877 - protein, 529 aa, Carboxydothermus hydrogenoformans Z-2901
MNIILVGLPGAGKTHIGRILARKLKRNFVDLDRKIEEETGLTIKEIFARFGERYFRRLEVKKLQELFKLHNAVIATGGGTVERMDARRKLKNLGLVVYLKASPEVIIRRLINLENRPILTQGDPLEKLSELYRRRDKFYREVSDVAINTEGKDSGEVVDAILKSLTIDGLRFPRKLYINLAENSYPVYFGEKVALKAGEFLKEKVTGKKILIVSQENIFGLYGKTLEESLTKEGFKTDVFFLPQGEVAKSMEYIVKLYDKAIEFGLRRHDTVMAFGGGVVGDATGFFAATYLRGINFVQVPTTLLSMVDSSVGGKVGINLPQGKNLVGAFYQPKVVLIDTTYLKTLPRREVLAGLAEIYKAFLIAEESLVGWLSGLNLDKLRPRDWQRIIKAAVKIKAKVVSLDEREEGLRAVLNLGHTIGHAIEGVNGFSGILHGEAVALGILWEAKLSKDLGYLREEEWEKIREFIEKNYAYLKLSLNPDSLLVFMDKDKKNREDIAFMLLKKIGEYPENVEIKREWLQKWLTLNFS

SEQ ID NO: 70878 - DNA, 600 bp, Burkholderia thailandensis E264
  CDS (1)..(600): transl_table=11
ttgccagtaagctgcgcgacacactcattgaagcagaggaagccgttgcaagcgcgggacccacacgtgaacgtaattttcgtcgggctcatgggggcgggtaagaccaccgtgggccgggcggtcgcgcgccggctcgacagacccttcttcgattcggatcacgagatcgaggcgcgcaccggcgcgcgcattccggtcatcttcgaactcgagggcgaatccggcttccgcgatcgcgaggcgcagatgatcgccgagctcacgcaacgcgagaacatcgtgcttgcgacgggcggcggcgcaatcctgcgccccgagaatcgcaagctgcttcacgaacgcggccttgtcgtctatctgcgcgcgaatccgcacgatctttggctgcgcacccgcaaggacaagaaccgcccgttgttgcaaaccgacgatccgaaagccaagctcgaagcgctgtacgaagcgcgcgacccgctctaccgcgaatgcgcgcacttcgtcatcgagaccggccggccatccgtcaacgggctcgtcaacatggtgctgatgcagctcgaaatggcgggcatcgtcgccaagccactacaagcatga

SEQ ID NO: 70879 - protein, 199 aa, Burkholderia thailandensis E264
MPVSCATHSLKQRKPLQARDPHVNVIFVGLMGAGKTTVGRAVARRLDRPFFDSDHEIEARTGARIPVIFELEGESGFRDREAQMIAELTQRENIVLATGGGAILRPENRKLLHERGLVVYLRANPHDLWLRTRKDKNRPLLQTDDPKAKLEALYEARDPLYRECAHFVIETGRPSVNGLVNMVLMQLEMAGIVAKPLQA

SEQ ID NO: 70880 - DNA, 651 bp, Novosphingobium aromaticivorans DSM 12444
  CDS (1)..(651): transl_table=11
atgcccccatcagcaatacctcaggcgatacttgcaacgggcactagcgcaagtataggcggcgcggcaatggaacatgatgcggcccttctcagttcgtcggaaatcgaccgcatcgggcgaaggatcggccgtccgctggtccttgtcggcatgatgggcgtgggcaagaccacggtgggccgcaagcttgcctcactgcttcacgttccgttcgtcgatgccgacgaagagatcgagcgtgccgcgcacatgcccatccccgaaatcttcgccacctatggcgagccgtatttccgcgacggagagcgacgggtgatcgcgcggctcatgggcacgggccgcaacacggaccggaaggtcctttcaaccggcggcggcgcgttctgcgaccccgcaacccgcgccctgatcctcgagcgtggcattgccgtctggctggacagcgacgtcgataccctggtcgagcgggtgggccgcaaggacaaccgtcccttgctgaaaacgggcaatccgcgcgagatccttacccgcctgaaggacgagcgcgagccgttctatgcgcaagcgccgatccacatgaccagcggggcgcaaccgcaccaagtcacggcaagcaagatattgagggcaatcgatcaatggctgtaa

SEQ ID NO: 70881 - protein, 216 aa, Novosphingobium aromaticivorans DSM 12444
MPPSAIPQAILATGTSASIGGAAMEHDAALLSSSEIDRIGRRIGRPLVLVGMMGVGKTTVGRKLASLLHVPFVDADEEIERAAHMPIPEIFATYGEPYFRDGERRVIARLMGTGRNTDRKVLSTGGGAFCDPATRALILERGIAVWLDSDVDTLVERVGRKDNRPLLKTGNPREILTRLKDEREPFYAQAPIHMTSGAQPHQVTASKILRAIDQWL

SEQ ID NO: 70882 - DNA, 510 bp, Saccharophagus degradans 2-40
  CDS (1)..(510): transl_table=11
gtgattgataacgttgtattggtcggccccatgggggccggcaaatctaccatcggtaggttattagctgcccgtcttgcatttcatttctatgacacagattcggtaatcgaggagcgcactggtgcggacattccttggatcttcgacgtagagggtgaggaagggtttcgtgcacgtgaatctgcagttttgggtgagcttgtgcattcctcaggtgctgtcatcgcaaccggcggtggtataataatgcgtgaagttaatcgtgaaatgctgtctcaagcaggtgctgtggtttacttgactgcaagtattgatcagctcgtagagcgcacatgtaaagataaaaaaaggcctcttctccaagtggctgacccgcgcgcaaaaattattgagcttataaaattgcgcgaccccctttatagggaggtggcaacgtgtgtggttgaaactgatgggcgctcccctcgtttcgttgttcagcatattgctgaactgctgaatgcctaa

SEQ ID NO: 70883 - protein, 169 aa, Saccharophagus degradans 2-40
MIDNVVLVGPMGAGKSTIGRLLAARLAFHFYDTDSVIEERTGADIPWIFDVEGEEGFRARESAVLGELVHSSGAVIATGGGIIMREVNREMLSQAGAVVYLTASIDQLVERTCKDKKRPLLQVADPRAKIIELIKLRDPLYREVATCVVETDGRSPRFVVQHIAELLNA

SEQ ID NO: 70884 - DNA, 513 bp, Methylobacillus flagellatus KT
  CDS (1)..(513): transl_table=11
atggcagcaaatattttcttcgtcgggttgatgggggcaggcaagaccaccataggccgtattattgccaaacacctcaacaaggccttttacgatagcgatcatgaaatcgaacgccgaacaggtgtcagcattcctgtcattttcgagctggaaaaagaggacggcttccgtaagcgcgaggccgcagtgatagaggagctcagccacatgcaggacattgtcctcgccacagggggcggagcggttttattgcccgagaaccgcaagcacctcatggaaaatggtacagtgatctacctgcgtgccaatgtgaatgagctctggcaccgcacccgcaacgacaagcaccgcccgttgctgcaaaacgacaacccgcgccagaggctggaacacttgttcgcccagcgtgatcccttgtaccgtgaagtggcgtccattatcgtggataccggcggacagccggtaaatgccatcgtgcaccagatcgaacagaaacttttatccttatga

SEQ ID NO: 70885 - protein, 170 aa, Methylobacillus flagellatus KT
MAANIFFVGLMGAGKTTIGRIIAKHLNKAFYDSDHEIERRTGVSIPVIFELEKEDGFRKREAAVIEELSHMQDIVLATGGGAVLLPENRKHLMENGTVIYLRANVNELWHRTRNDKHRPLLQNDNPRQRLEHLFAQRDPLYREVASIIVDTGGQPVNAIVHQIEQKLLSL

SEQ ID NO: 70886 - DNA, 552 bp, Burkholderia xenovorans LB400
  CDS (1)..(552): transl_table=11
ttgcaagcgcgggacgcacacgccaatgtattttttgtagggctcatgggggcaggaaaaaccaccgtgggccgggccattgcgcgccgtctcgatcgtcccttcttcgattccgaccatgaaatcgaggcacgcacgggcgcgcgcatccctgtgatcttcgagctggagggtgaagcgggctttcgcgagcgcgaggcgaacgtgatttccgagctcaccgcgcgcgaaaatatcgtgctcgcgaccggcggcggcgcggtgctgcggccggaaaaccgcgaggcgctgcgaaatcgcggagtcgtgatttatttgcgcgccaatccgcacgacctgtggctgcgcacccgccgcgacaagaatcgcccgcttttgcagaccgaagaccccaaagcgcgtctcgaagccctctacgaagtgcgcgacccgttatatcgggagtgcgcgcatttcgtgatcgaaactggccggccttcggtcaacggactcgtcaacatggttctgatgcagctcgagatggccggcgtcgccaaacttcctgcgtcataa

SEQ ID NO: 70887 - protein, 183 aa, Burkholderia xenovorans LB400
MQARDAHANVFFVGLMGAGKTTVGRAIARRLDRPFFDSDHEIEARTGARIPVIFELEGEAGFREREANVISELTARENIVLATGGGAVLRPENREALRNRGVVIYLRANPHDLWLRTRRDKNRPLLQTEDPKARLEALYEVRDPLYRECAHFVIETGRPSVNGLVNMVLMQLEMAGVAKLPAS

SEQ ID NO: 70888 - DNA, 690 bp, Ralstonia metallidurans CH34
  CDS (1)..(690): transl_table=11
atgatgcacaatggcgtatgcatcacgccccttgcgggttcccggcctgacgcgggtgcccgccgccttatcgtgcaagacctcagtccagtgacagccaatcgcccgaatatcttctttgttggcctgatgggcgccggcaagaccaccgtcggccgcaccgtggcccgtcgtctcaactatccgttcttcgattccgatcatgaacttgaggcgcgctgcggcgtacgaattccgataattttcgagcatgagggcgaagcggggttccgcgatcgcgaggcccaggtgattgccgagctgaccgggcgcagtggcatcgttctggccacaggcggcggcgcggtgctccgcgaggtcaaccgcgcggcgttgaaggccaatggcactgtggtctatctgcgcgccagcccgcacgatctgtggctgcgcacgcggcatgaccgtaaccgaccgctcctgcagacggaggatccgaagggtcgcctcgaggcactctatgccgagcgcgatccgctctatcgcgaggtggcggacttcattatcgaaaccggcaagccgaccgtggcgcagcttgctaatatggttcttatgcaacttgaaatggccggctttgtgtttccgcccgcggaaatcgtgcccgaatctgccgaggatggtgggccgccggcgcaggacacccattcatga

SEQ ID NO: 70889 - protein, 229 aa, Ralstonia metallidurans CH34
MMHNGVCITPLAGSRPDAGARRLIVQDLSPVTANRPNIFFVGLMGAGKTTVGRTVARRLNYPFFDSDHELEARCGVRIPIIFEHEGEAGFRDREAQVIAELTGRSGIVLATGGGAVLREVNRAALKANGTVVYLRASPHDLWLRTRHDRNRPLLQTEDPKGRLEALYAERDPLYREVADFIIETGKPTVAQLANMVLMQLEMAGFVFPPAEIVPESAEDGGPPAQDTHS

SEQ ID NO: 70890 - DNA, 591 bp, Ralstonia metallidurans CH34
  CDS (1)..(591): transl_table=11
gtgctaccgttcggaggtaccagtgtccagcgcgcgatcttggatcagcaaacctccggagacaatctcttcttcatcggcttcatgggcgccggcaagacgacgatcgggcgcgccgtggcgcacgagctcggccgcccgttcttcgacaccgaccacgagatcgagacgcgctgcggtgtgcggatcgccacgatcttcgagctcgagggcgaggaaggcttccgccagcgcgagtcgcgcgtcctggatgaactgacgcagcgcagcgggatcgtgctggccaccggcgggggcgcggtactgcgtccggagaaccgcgccatgctgcgtgcgcgcggccaagtggtctacctcgacgcctcgctgcccgagatctggcgccgcacgcggcgcaaccgcaaccgtccgctgctgcagaccgacaatccgcgcgcgcggctcgaggcgctgttttgcgaacgcgacccgctgtaccgggaaattgcccacatcgtcatgccagcccatggtggcagcattgcccaggctgtcgccaatgtcctggcacggttggaccttgcgcctcccgatccattcccccacgcatga

SEQ ID NO: 70891 - protein, 196 aa, Ralstonia metallidurans CH34
MLPFGGTSVQRAILDQQTSGDNLFFIGFMGAGKTTIGRAVAHELGRPFFDTDHEIETRCGVRIATIFELEGEEGFRQRESRVLDELTQRSGIVLATGGGAVLRPENRAMLRARGQVVYLDASLPEIWRRTRRNRNRPLLQTDNPRARLEALFCERDPLYREIAHIVMPAHGGSIAQAVANVLARLDLAPPDPFPHA

SEQ ID NO: 70892 - DNA, 498 bp, Bacillus cereus G9241
  CDS (1)..(498): transl_table=11
atgaaatctatatacataaccggttatatgggagctgggaaaacaacaattggaaaagcattaagtaaagaacttcatatggatgttgtagatacagatcaaaagattgaagagaagcagggaaaagcaattcgtgatatttttgccgaagaaggtgaaatggcttttcgggaatatgaaagtgagatgttacgttcactacccgttcgtaatgcaattattacaactggcggcggaatcattgagcgagaggaaaaccgaaaatggatgaaggaaaatggaactgtcgtgtatttatattgtgatccacatgtaattgcagaaaggcttcgtgaagatacgacacgtccactatttcagaagaaagatatagatgcatttgtaacgaaattcgaatcgcgccgagcttattatgaagaggctcctattcatatcgatacgacgaataagtctgtaaagcaaattatgaatgaattaaaagaaaagattaatgaataa

SEQ ID NO: 70893 - protein, 165 aa, Bacillus cereus G9241
MKSIYITGYMGAGKTTIGKALSKELHMDVVDTDQKIEEKQGKAIRDIFAEEGEMAFREYESEMLRSLPVRNAIITTGGGIIEREENRKWMKENGTVVYLYCDPHVIAERLREDTTRPLFQKKDIDAFVTKFESRRAYYEEAPIHIDTTNKSVKQIMNELKEKINE

SEQ ID NO: 70894 - DNA, 471 bp, Bacillus anthracis str. A2012
  CDS (1)..(471)
atgggagctgggaaaacaacaattggaaaagcattaagtaaagaacttcatatggatgttgtagatacagatcaaaaaattgaagagaagcagggaaaagtaattcgtgatatttttgccgaagaaggtgaaatggcttttcgggaatatgaaagtgaaatgttatgttcactacctgttgataatgtaatcattacaactggcggcggaatcgttgagcgagaggaaaaccgaaaatggatgaaggaaaatggaactgtcgtgtatttatattgtgatccacatgtaattgcagaaaggcttcgtgaagatacgacacgtccactatttcagaagaaagatatagatgcatttgtaacgaaattcgaatcgcgccgagcttattatgaagaggctcatattcatatcgatacgacgaataagtctgtaaagcaaattatgaatgaattaaaagaaaagattaatgaataa

SEQ ID NO: 70895 - protein, 156 aa, Bacillus anthracis str. A2012
MGAGKTTIGKALSKELHMDVVDTDQKIEEKQGKVIRDIFAEEGEMAFREYESEMLCSLPVDNVIITTGGGIVEREENRKWMKENGTVVYLYCDPHVIAERLREDTTRPLFQKKDIDAFVTKFESRRAYYEEAHIHIDTTNKSVKQIMNELKEKINE

SEQ ID NO: 70896 - DNA, 555 bp, Burkholderia vietnamiensis G4
  CDS (1)..(555): transl_table=11
ttgcaagcgcgggacccacacgcaaacgtatttttcgtcggccttatgggagcgggtaagaccaccgtgggccgtgcggtcgcgcgccggctcgacaggacgttcttcgactccgaccacgaaatcgaggcccgcacgggcgcccgcatcccggtgatcttcgagatggagggcgaggccggctttcgcgaccgcgaatcgcaggtgatcgccgagctgacgcagcgcgagaacatcgtgctggcgaccggcggcggcgcggtgctgcgcgccgaaaatcgcgaatgcctcaaaaaccacggcatcgtcatctatctgcgcgccaatccgcacgatctgtggctgcgcacgcgcaaggacaagaaccgcccgctgttgcagaccgacgatccgaaagcccgcctcgaagcgctgtacgaagcgcgcgacccgctgtaccgcgaatgcgcggatttcatcatcgagacgggccgcccgtcggtcaacggcctcgtcaacatggtgctgatgcaactcgaactcgcaggcgtcatcgccaagccgctacaagcatga

SEQ ID NO: 70897 - protein, 184 aa, Burkholderia vietnamiensis G4
MQARDPHANVFFVGLMGAGKTTVGRAVARRLDRTFFDSDHEIEARTGARIPVIFEMEGEAGFRDRESQVIAELTQRENIVLATGGGAVLRAENRECLKNHGIVIYLRANPHDLWLRTRKDKNRPLLQTDDPKARLEALYEARDPLYRECADFIIETGRPSVNGLVNMVLMQLELAGVIAKPLQA

SEQ ID NO: 70898 - DNA, 555 bp, Trichodesmium erythraeum IMS101
  CDS (1)..(555): transl_table=11
atggatattagtaataggaaattattacagggagtaaatctttatctagtggggatgatgggtgctggtaaaacaactgtgggacatttactagcccaacacttaggatatagttttcttgatacagataatttaattactcaagctgctggcaagtcaattaacgaaatttttgccactgaaggtgaagcagcttttcgggagttggaaacaaacatattatcagaaatatctagttacaaaaatttgactattgctacaggtggtggtatagttataagtcgatttaactggagttatttacggcatggcatagtagtttggttagatgtgccagtagaagttttatatagtcgcttgcaaggcgatcagactagacctttaattcaaaatagtaaccctttagctagacttcaggctattttagaggaaagaagaccgttttataattgtgcagatgttcatgttaatgttgatattcaagatacacctcaacaagtgacaattttaaccttggaagaaataaaaaaagtgctaaagtcatctcagaggtag

SEQ ID NO: 70899 - protein, 184 aa, Trichodesmium erythraeum IMS101
MDISNRKLLQGVNLYLVGMMGAGKTTVGHLLAQHLGYSFLDTDNLITQAAGKSINEIFATEGEAAFRELETNILSEISSYKNLTIATGGGIVISRFNWSYLRHGIVVWLDVPVEVLYSRLQGDQTRPLIQNSNPLARLQAILEERRPFYNCADVHVNVDIQDTPQQVTILTLEEIKKVLKSSQR

SEQ ID NO: 70900 - DNA, 540 bp, Alkalilimnicola ehrlichei MLHE-1
  CDS (1)..(540): transl_table=11
atgaaccatccaccccgcatctacctcatcggccccatgggcgccggcaagagcacggtgggccgccggctggcggacgcactgggcctgcccttcgaggacagcgaccgctacatcgtcgagcggaccggcgtggacatccccacgatcttcgacatcgagggcgaggcgggctttcgcaagcgtgagcacgacgccatccgcaccctcaccgagcgggaggaactggtcctcgccaccggtggcggtgtggtgaccacccccgccaaccgcgacctgctgggtgcccgcggcatcgtggtctacctttacaccccggtggagacccaactggcgcgcaccggcaaggaccgcaaccgcccgctgctgcagaccgaggacccgcgggcccgcctggaggcactgatggtcgagcgcgacccgctctaccgggcgatcgccgacatcatcatcgatacccgcggcggcacggtgaaatcggtggcgcggcgggtgctcaaggcgctggaggagcccgccggccaggagacccaaccatga

SEQ ID NO: 70901 - protein, 179 aa, Alkalilimnicola ehrlichei MLHE-1
MNHPPRIYLIGPMGAGKSTVGRRLADALGLPFEDSDRYIVERTGVDIPTIFDIEGEAGFRKREHDAIRTLTEREELVLATGGGVVTTPANRDLLGARGIVVYLYTPVETQLARTGKDRNRPLLQTEDPRARLEALMVERDPLYRAIADIIIDTRGGTVKSVARRVLKALEEPAGQETQP

SEQ ID NO: 70902 - DNA, 519 bp, Pseudoalteromonas tunicata D2
  CDS (1)..(519): transl_table=11
atggctgaaaaacgtaatatatttctagtgggccctatgggtgcaggtaaaagcaccattggtcgtcatttagcagatcaacttcaccttgagtttttcgactctgatcaagagatcgaacgtcgcacgggtgctgatattgcttgggttttcgatatcgaaggtgaagaaggctttcgacgtcgtgaagagacagtaatttctgatttaactgaaatgcagggtatcgtattagcaactggcggtggttcagtgcttagtaaagatgtccgtaataagttgtcagcacgtggtattgtagtttatttggaaactccaatcgaaaaacaagtggctcgtacgcaaagagacaaaaaacgtcctctattgcaaactgaggaagatccgaaagaggttcttgaacgcttatctgaagaacgtgtacctttatacgaagaagtttcagatatagttgttcgcactgatgaacaaagtgctaaagtagtagccaacttgattatagaaaaactcgacttttaa

SEQ ID NO: 70903 - protein, 172 aa, Pseudoalteromonas tunicata D2
MAEKRNIFLVGPMGAGKSTIGRHLADQLHLEFFDSDQEIERRTGADIAWVFDIEGEEGFRRREETVISDLTEMQGIVLATGGGSVLSKDVRNKLSARGIVVYLETPIEKQVARTQRDKKRPLLQTEEDPKEVLERLSEERVPLYEEVSDIVVRTDEQSAKVVANLIIEKLDF

SEQ ID NO: 70904 - DNA, 519 bp, marine gamma proteobacterium HTCC2207
  CDS (1)..(519): transl_table=11
atgaaatcacaacatatttttctcgttggccccatgggtgccggcaaaactactataggaaaacacctggcaggattgctggggacagcctttattgatgtggattctgaaattgaggcccgagctggagccgatattcaatggatattcgatatggaaggtgaggccggttttcgcgagcgtgagagcaaggtgctaatcgatctggtggcggacaaacagccaaaagtcatagccaccgggggtggaattattctcagcggtgataatcgtggaatccttcagtccagtggcttagtcgtttacctctctgccaccttcgagcagctagtcgagcgcaccaagcgagataaaacccgaccgttgctgcaggttgatgatcgtgaagcagtgattaagcagcttatcgaaactcgcagtccgctataccaccaggtcgctgatctggtatttccttcagggtccacacagcccctcaagttggcaaagaaactggctgaagctgtttctgccctatga

SEQ ID NO: 70905 - protein, 172 aa, marine gamma proteobacterium HTCC2207
MKSQHIFLVGPMGAGKTTIGKHLAGLLGTAFIDVDSEIEARAGADIQWIFDMEGEAGFRERESKVLIDLVADKQPKVIATGGGIILSGDNRGILQSSGLVVYLSATFEQLVERTKRDKTRPLLQVDDREAVIKQLIETRSPLYHQVADLVFPSGSTQPLKLAKKLAEAVSAL

SEQ ID NO: 70906 - DNA, 564 bp, delta proteobacterium MLMS-1
  CDS (1)..(564): transl_table=11
atgagcaacgaggcagcagccggcgatgaccggccgtggcggaaaatatttttgatcggctaccgggcctgcggcaagagcgtggtggggcggcaactggccaccgagctgggctggcagtacctggactgtgaccgggaactgagccagcgggccggctgctccatcaacgacctggtggccagcgccggttggcaagagttccgcgcccgggagcggcaactgctgggcgagctgatcccccgccgggaactggtggtggccaccggcggcggggccgtgctgcaccaggaactctggccggccctgcggcaaagcggactggtggtctggctcaccgccgaaccggccaccatcgcccggcggctggcggccgacccggtcagccagagccagcgcccccccctcaccgatcaggggttgctggcggagatcaccacggtcctggaccagcgccaggccctgtaccaacaggccgcccacctgcagatcgccaccgaccaactggcgccgtcggccatcgtccaccagattatcgcccacctgcccgctaccgctgcctga

SEQ ID NO: 70907 - protein, 187 aa, delta proteobacterium MLMS-1
MSNEAAAGDDRPWRKIFLIGYRACGKSVVGRQLATELGWQYLDCDRELSQRAGCSINDLVASAGWQEFRARERQLLGELIPRRELVVATGGGAVLHQELWPALRQSGLVVWLTAEPATIARRLAADPVSQSQRPPLTDQGLLAEITTVLDQRQALYQQAAHLQIATDQLAPSAIVHQIIAHLPATAA

SEQ ID NO: 70908 - DNA, 564 bp, delta proteobacterium MLMS-1
  CDS (1)..(564): transl_table=11
atgagcaacgaggcagcagccggcgatgaccggccgtggcggaaaatatttttgatcggctaccgggcctgcggcaagagcgtggtggggcggcaactggccaccgagctgggctggcagtacctggactgtgaccgggaactgagccagcgggccggctgctccatcaacgacctggtggccagcgccggttggcaagagttccgcgcccgggagcggcaactgctgggcgagctgatcccccgccaggaactggtggtggccaccggcggcggggccgttctgcaccaggaactctggccggccctgcggcaaagcggactggtggtctggctcaccgccgaaccggccaccatcgcccggcggctggcggccgacccggtcagccagagccagcgcccccccctcaccgatcaggggttgctggcggagatcaccacggtcctggaccagcgccaggccctgtaccaacaggccgcccacctgcagatcgccaccgaccaactggcgccgtcggccatcgttcaccagattatcgcccacctgcccgccaccgctgcctga

SEQ ID NO: 70909 - protein, 187 aa, delta proteobacterium MLMS-1
MSNEAAAGDDRPWRKIFLIGYRACGKSVVGRQLATELGWQYLDCDRELSQRAGCSINDLVASAGWQEFRARERQLLGELIPRQELVVATGGGAVLHQELWPALRQSGLVVWLTAEPATIARRLAADPVSQSQRPPLTDQGLLAEITTVLDQRQALYQQAAHLQIATDQLAPSAIVHQIIAHLPATAA

SEQ ID NO: 70910 - DNA, 528 bp, Oceanobacter sp. RED65
  CDS (1)..(528): transl_table=11
atgttaaagcaaaacgtatatctggttggacctatgggggctgggaaaagcaccataggtcgacttttatctcaagagctcaagctggagttcattgacagcgacaaagaaattgaagatcgctgtggctgtaacattccttggatatttgatgttgagggagagcagggttttcgtgatcgtgagtcccaagcgattgatgatattacccagcagtctggtattcttctagcgactggcggcggagctgttaatcgtccggaaaatcgccaacatttgtccgcaagaggcacagtcgtctatctttgcacgtcggttgagcagcaattggcgcgcacagaaaaggataaaaaccgccctttgttgcaaaggccgaatcctaaaaaagttcttcaggaattaatggtacagcgagaccctctatatcgtgaggtcgctgacattattgttcataccgatgaaagcaatcctaagctggttgttcaagaaataatcgataaacttcaagaattaaacgtagtcctttga

SEQ ID NO: 70911 - protein, 175 aa, Oceanobacter sp. RED65
MLKQNVYLVGPMGAGKSTIGRLLSQELKLEFIDSDKEIEDRCGCNIPWIFDVEGEQGFRDRESQAIDDITQQSGILLATGGGAVNRPENRQHLSARGTVVYLCTSVEQQLARTEKDKNRPLLQRPNPKKVLQELMVQRDPLYREVADIIVHTDESNPKLVVQEIIDKLQELNVVL

SEQ ID NO: 70912 - DNA, 909 bp, Fagus sylvatica
  CDS (1)..(909)
atggacggtaaagttgcaaatggtttggtggtttcgccgcggatcggttcggagagattcgcgaggagaacctgtggttccgtacgggtttctcggcgattcagagagcaagataggcttccggtgctagtctctgctcagcttcaggataaaacaaggaattcgaattggcacaaaacggcgtcattggaggtttcctgttcttataagaactttccagcttcagttttggaatctggaggtattcatgctccttttgatgatgctctgattttgaagaataagtcacaagagatcgagccatatttaagtggacgctgtatatatcttgttggcatgatgggatctggaaaaacaacagtgggcaaggttttgtcacaagtacttagctatgccttttttgatagtgacacgttggtggagcaggatgttgatgcaaattctgttgctgaaatattcaatctctatggagagggcttcttcagagataaggagactgaggtactgcgaaagctgtctttgatgcatcgacttgttgtttctactggtggaggtgcagttgttcggcccatcaactggaaatatatgcagaaggggataagtgtctggttagatgttcctttggaagccttggctcgtagaattgcagctgtaggaactggttctcgcccccttttgcatcatgattcgggtgatgcatacacaaagactttcatgcgcctgacttctcttatggaggagaggagtgaagcatatgcaaatgcaaatgcgcgggtttccttggaagacgttgcagctaaactaggacacagagatgtgtccaatctcacgcccactgccatagcaattgaggcacttgaacaaatcgagggctttctaaaggaagagaatggagattttgcattgtag

SEQ ID NO: 70913 - protein, 302 aa, Fagus sylvatica
MDGKVANGLVVSPRIGSERFARRTCGSVRVSRRFREQDRLPVLVSAQLQDKTRNSNWHKTASLEVSCSYKNFPASVLESGGIHAPFDDALILKNKSQEIEPYLSGRCIYLVGMMGSGKTTVGKVLSQVLSYAFFDSDTLVEQDVDANSVAEIFNLYGEGFFRDKETEVLRKLSLMHRLVVSTGGGAVVRPINWKYMQKGISVWLDVPLEALARRIAAVGTGSRPLLHHDSGDAYTKTFMRLTSLMEERSEAYANANARVSLEDVAAKLGHRDVSNLTPTAIAIEALEQIEGFLKEENGDFAL

SEQ ID NO: 70914 - DNA, 912 bp, Arabidopsis thaliana
  CDS (1)..(912)
atggaagcagctattactcagaggattcagtacccatcatgggttgattgtagaaaagttgagtgtaagccgcagcgtggttcattgcggtattctcagcaggttaaggtagatagaaggtttagaggtctttctttggctcgcttgcaacctgaaagaagaaatgatcaacgaagagcagtttctccagcggtttcctgttctgataacaattcctcagcgttgttggagactggaagtgtttatccatttgatgaagatattctcaagagaaaagcagaagaggttaaaccgtatttgaatggacgatctatgtaccttgtcggaatgatgggttctgggaaaacaactgtgggaaagttaatgtccaaagtgctcggttatacgttctttgactgcgacactttgattgaacaggcgatgaatggaacttctgttgcagagatatttgttcatcacggagagaatttttttagaggaaaggagaccgatgcgcttaagaagctctcttcgaggtatcaagttgttgtttccacaggtggaggtgcagttataagacccattaactggaagtatatgcataaaggaatcagcatttggctagatgtgcctctagaagcattagcccatagaatcgctgctgttggaactgattcacgaccactgctacacgatgaatcaggaaatgcatactcagtggctttcaaacgtctctcggctatttgggacgagcgcggtgaagcatacacaaacgcaaatgccagagtctccttagaaaatattgcagcaaagcgtggctataaaaatgtctcagatctcacaccaactgaaattgctatcgaggccttcgagcaagttctgagctttctagagaaagaagaaactatggagatcccagacggcgacctctaa

SEQ ID NO: 70915 - protein, 303 aa, Arabidopsis thaliana; identical to SEQ ID NO: 2172

SEQ ID NO: 70916 - DNA, 4722 bp, Schizosaccharomyces pombe; identical to SEQ ID NO: 22409
  CDS (1)..(4722)

SEQ ID NO: 70917 - protein, 1573 aa, Schizosaccharomyces pombe; identical to SEQ ID NO: 22410

SEQ ID NO: 70918 - DNA, 4767 bp, Saccharomyces cerevisiae; identical to SEQ ID NO: 22343
  CDS (1)..(4767)

SEQ ID NO: 70919 - protein, 1588 aa, Saccharomyces cerevisiae; identical to SEQ ID NO: 22344

SEQ ID NO: 70920 - DNA, 543 bp, Acinetobacter sp
  CDS (1)..(543): transl_table=11
ttgccaagcaaagagtttgacaccctgccaaatatttatttggtagggcccatgggagcaggaaagacaacagtcggtcgacatttagcagagttgttagggcgtgagtttctagacagtgatcatgaaattgagcgtagaacaggtgcaaccatcccatggatttttgaaaaagagggtgaaatcggatttagaagtcgggaaaccattgtgctggatgatttaacatctcgacgggatttagtgttagcaacaggtggtggggtggtaacacaaccagccaaccggagctatttaaaaacacgaggtgttgttgtttatttatacacgcctgttgagcttcagttacagcgtacctatcgtgataaaaatagacctttattacaggttgaaaaccctgaacagcgtcttcgtgatttattaaagttaagagatcctttatatcgcgatgttgcacatcatattatcgaaacaaatcaaggtgctgcccgagagctggctcagcaaattttacgtgtgattttaagttctggatcacattaa

SEQ ID NO: 70921 - protein, 180 aa, Acinetobacter sp; identical to SEQ ID NO: 2076

SEQ ID NO: 70922 - DNA, 879 bp, Arabidopsis thaliana
  CDS (1)..(879)
atggaagcagctattactcagaggattcagtacccatcatgggttgattgtagaaaagttgagtgtaagccgcagcgtggttcattgcggtattctcagcaggttaaggtagatagaaggtttagaggtctttctttggctcgcttgcaacctgaaagaagaaatgatcaacgaagagcagtttctccagcggtttcctgttctgataacaattcctcagcgttgttggagactggaagtgtttatccatttgatgaagatattctcaagagaaaagcagaagaggttaaaccgtatttgaatggacgatctatgtaccttgtcggaatgatgggttctgggaaaacaactgtgggaaagttaatgtccaaagtgctcggttatacgttctttgactgcgacactttgattgaacaggcgatgaatggaacttctgttgcagagatatttgttcatcacggagagaatttttttagaggaaaggagaccgatgcgcttaagaagctctcttcgaggtatcaagttgttgtttccacaggtggaggtgcagttataagacccattaactggaagtatatgcataaaggaatcagcatttggctagatgtgcctctagaagcattagcccatagaatcgctgctgttggaactgattcacgaccactgctacacgatgaatcaggagatgcatactcagtggctttcaaacgtctctcggctatttgggacgagcgcggtgaagcatacacaaacgcaaatgccagagtctccttagaaaatattgcagcaaagcgtggctataaaaatgtctcagatctcacaccaactgaaattgctatcgaggtaagccaggtcctttctcagttacttcatcattaa

SEQ ID NO: 70923 - protein, 292 aa, Arabidopsis thaliana
MEAAITQRIQYPSWVDCRKVECKPQRGSLRYSQQVKVDRRFRGLSLARLQPERRNDQRRAVSPAVSCSDNNSSALLETGSVYPFDEDILKRKAEEVKPYLNGRSMYLVGMMGSGKTTVGKLMSKVLGYTFFDCDTLIEQAMNGTSVAEIFVHHGENFFRGKETDALKKLSSRYQVVVSTGGGAVIRPINWKYMHKGISIWLDVPLEALAHRIAAVGTDSRPLLHDESGDAYSVAFKRLSAIWDERGEAYTNANARVSLENIAAKRGYKNVSDLTPTEIAIEVSQVLSQLLHH

SEQ ID NO: 70924 - DNA, 528 bp, Azoarcus sp
  CDS (1)..(528): transl_table=11
gtgttagtcgttctcgtgggcatgatgggtgccggaaagaccacagtaggacgcgagtatgcgaagcggcatcagatgcgctttgtggactgcgaccacgaaatcgaggctcgcaccggcgtgaaggtcccgaccatcttcgaaatcgagggagaagcgggcttccggcgtcgcgagagccagctcctcgacgaactcacccatgagacgggactggtcctggcgaccggcggcggagtcgtgctcgatccggcgaaccgtgccgttctggcggcgcgcggcatcgtcgtatacctgaacgtgccgacgcaagtgctgtgggaacgcacgcgcaacgaccgcaaccggccgctgctgcaggtgtcgaacccgcgcgagcgcatcgagagcctgtatcgcgaacgggatccgctgtatcgtgaagtcgccgacatcatcgtcgatggcgggcgcggcaacccgggcggaatggtcaggcaggtcgagaaagcgatccagaatttccacaagaaaacatgcgaacactga

SEQ ID NO: 70925 - protein, 175 aa, Azoarcus sp
MLVVLVGMMGAGKTTVGREYAKRHQMRFVDCDHEIEARTGVKVPTIFEIEGEAGFRRRESQLLDELTHETGLVLATGGGVVLDPANRAVLAARGIVVYLNVPTQVLWERTRNDRNRPLLQVSNPRERIESLYRERDPLYREVADIIVDGGRGNPGGMVRQVEKAIQNFHKKTCEH

SEQ ID NO: 70926 - DNA, 561 bp, Bacillus subtilis; identical to SEQ ID NO: 2057
  CDS (1)..(561): transl_table=11

SEQ ID NO: 70927 - protein, 186 aa, Bacillus subtilis; identical to SEQ ID NO: 2058

SEQ ID NO: 70928 - DNA, 636 bp, Bordetella bronchiseptica; identical to SEQ ID NO: 2129
  CDS (1)..(636): transl_table=11

SEQ ID NO: 70929 - protein, 211 aa, Bordetella bronchiseptica; identical to SEQ ID NO: 2130

SEQ ID NO: 70930 - DNA, 636 bp, Bordetella parapertussis
  CDS (1)..(636): transl_table=11
atgaatgcttccgctaatttatgcgcggcgtccgccaacgacccgcaaccgggcgaccaggaggccgcccaccctgtagcctgcgccggtgacgagccggcggcgttcctgccgcacgacctgccgatctttctggtggggatgatgggcgccggcaagaccaccatagggcgaggcctggcgcgtgcgctgaggcgcgaattcatcgatctcgaccatgagttggaggcgcgttgcggcgtgcgggttccggtcatcttcgaaatcgaaggcgaagccgggtttcgccggcgggaagctgccgcattgcaagagtgtacccaacgccggcagataattcttgccaccggcgggggcgcggtgctggccgcggagaaccggcaggccctgcgcgagcgcggcatcgtgatctacctgcgcgccagcgtggaagagctgttccggcgcaccagccgcgatcgcaaccgccccttgctggccaccgccgatccgcgcgctaccctgcgcgagctgatggtggcgcgcgaaccgctgtataacgaggtggccgatctggtcatcgataccggcagcatgcccatcgccacgctggtgaagtccctgctgcccaagctgcaagcctacgagaagaaataa

SEQ ID NO: 70931 - protein, 211 aa, Bordetella parapertussis
MNASANLCAASANDPQPGDQEAAHPVACAGDEPAAFLPHDLPIFLVGMMGAGKTTIGRGLARALRREFIDLDHELEARCGVRVPVIFEIEGEAGFRRREAAALQECTQRRQIILATGGGAVLAAENRQALRERGIVIYLRASVEELFRRTSRDRNRPLLATADPRATLRELMVAREPLYNEVADLVIDTGSMPIATLVKSLLPKLQAYEKK

SEQ ID NO: 70932 - DNA, 555 bp, Burkholderia sp
  CDS (1)..(555): transl_table=11
ttgcaagcgcgggacccacatgcaaacgtatttttcgtcggccttatgggagcgggtaagaccaccgtgggccgtgcggtcgcgcgtcgtctcgacaggacgttcttcgactccgaccacgaaatcgaggcccgtacgggcgcgcgcatcccggtgatcttcgagatggagggcgaggccgggtttcgcgatcgcgaaacgcaggtgatcaccgatctcacgcagcgcgagaatatcgtgctcgcgacgggcggcggcgcggtgctgcgcccggaaaaccgcgactgtctgaaaaacaacggcatcgtcgtctacctgcgcgccaatccgcacgatctgtggctgcgtacccgcaaggacaagaaccgcccgctgctgcagaccgaagatccgaaggggcgtctcgaagcgctgtacgaggtacgagacccgctgtaccgcgaatgcgcggatttcgtcatcgagaccggccgtccgtcggtcaacggtctcgtcaacatggtgctgatgcaactcgaactggccggcgtcatcgccaagccgctacaagcatga

SEQ ID NO: 70933 - protein, 184 aa, Burkholderia sp
MQARDPHANVFFVGLMGAGKTTVGRAVARRLDRTFFDSDHEIEARTGARIPVIFEMEGEAGFRDRETQVITDLTQRENIVLATGGGAVLRPENRDCLKNNGIVVYLRANPHDLWLRTRKDKNRPLLQTEDPKGRLEALYEVRDPLYRECADFVIETGRPSVNGLVNMVLMQLELAGVIAKPLQA

SEQ ID NO: 70934 - DNA, 555 bp, Chromobacterium violaceum; identical to SEQ ID NO: 2115
  CDS (1)..(555): transl_table=11

SEQ ID NO: 70935 - protein, 184 aa, Chromobacterium violaceum; identical to SEQ ID NO: 2116

SEQ ID NO: 70936 - DNA, 519 bp, Colwellia psychrerythraea
  CDS (1)..(519): transl_table=11
atggcagaaaaacgtaacatattccttataggccctatgggtgctggtaaaagcactatcggtagagaaatagcagaccgattacatcttgagttttttgactctgaccaagaaatagagcgccgcacaggagcagatattgcttgggtttttgatcttgaaggtgaagaaggtttccgcaaaagagaagaaacggtcattgaggacctaagtgaaaagcacggtattgtgttagctaccggcggtggttcagttattagcactaatgttcgtaatcacttatctgctcgcggtattgttgtatatcttgaaacaacaatcgataaacaagtcgctcgtacccaaagagaccgtcgtcgaccacttctacaaacatcagaagagccgcgtacagttttagaaaatttagctgttgaacgtaatccgctttatgaagatatcgctgatattatagtgcaaaccgatgatcaaagcgccaaagttgtcgctcataagattatcgagcgtctcgacttttaa

SEQ ID NO: 70937 - protein, 172 aa, Colwellia psychrerythraea
MAEKRNIFLIGPMGAGKSTIGREIADRLHLEFFDSDQEIERRTGADIAWVFDLEGEEGFRKREETVIEDLSEKHGIVLATGGGSVISTNVRNHLSARGIVVYLETTIDKQVARTQRDRRRPLLQTSEEPRTVLENLAVERNPLYEDIADIIVQTDDQSAKVVAHKIIERLDF

SEQ ID NO: 70938 - DNA, 510 bp, Corynebacterium glutamicum
  CDS (1)..(510): transl_table=11
atgctcctgccgatcgtggttcttgtgggtttgccaggagctggaaaatccaccattggacgtcgattagcgcgcgccttaaacactgaactcgtcgactccgacgaactgattgagcgcgccaccggaaaagcctgtggcgccgtgttcagcgagctcggcgagccagccttccgcgagctcgaggccatccacgtggccgaagcactgaaatcctccggagtggtgagcttgggaggcggatctgtgctgacagaatccacccgtgaactgctcaaaggccaggacgtggtctggatcgacgtgccagtagaagaaggcatcaggcgcaccgcaaacgagcgttcccgccccgtgctgcaagccgccgaccccgccgagcactaccgcaacctggtgaaagtgcgcaccccgttgtacgaagaggtggcaacctaccgacttcgcaccaacaaccgcagcccccagcaagtggtggcagcagtgttgcatcatctagaaatcgattaa

SEQ ID NO: 70939 - protein, 169 aa, Corynebacterium glutamicum
MLLPIVVLVGLPGAGKSTIGRRLARALNTELVDSDELIERATGKACGAVFSELGEPAFRELEAIHVAEALKSSGVVSLGGGSVLTESTRELLKGQDVVWIDVPVEEGIRRTANERSRPVLQAADPAEHYRNLVKVRTPLYEEVATYRLRTNNRSPQQVVAAVLHHLEID

SEQ ID NO: 70940 - DNA, 543 bp, Desulfovibrio desulfuricans
  CDS (1)..(543): transl_table=11
atgcgcggtgcaggcggaggtaggatggagcgtatttttctgatcggggcgcgggccagcggcaaaacgacggcgggccgtattctggcggaaaaactgggctggcggtgtgctgataccgatgagatggtgcagcgcagggcagggtgcagcattgcggacatggtggcccgcgacgggtggccggtgttccgtgaggcggaagccggggcgctgcaggcggcgtgtgcgctgacacgggtggtggtctctaccggcggcggcatggtgctgcgcgcggataaccgcgcggcgctgcgcgaggggggcattgtgttttatctgtgcgctcctgcggctgttctggcatccagactggtgctggaccctgtggtctcgcagcggccttcgctgacaggggggaaccctgcggccgagattgccgccgtgctggcggaacgcgataccctgtaccgcgagacggcgcatcatgtggtggatgcctgtcagcctgccgcagcggttgccggacagatgctgcggctgctggctgccgcgggatga

SEQ ID NO: 70941 - protein, 180 aa, Desulfovibrio desulfuricans
MRGAGGGRMERIFLIGARASGKTTAGRILAEKLGWRCADTDEMVQRRAGCSIADMVARDGWPVFREAEAGALQAACALTRVVVSTGGGMVLRADNRAALREGGIVFYLCAPAAVLASRLVLDPVVSQRPSLTGGNPAAEIAAVLAERDTLYRETAHHVVDACQPAAAVAGQMLRLLAAAG

SEQ ID NO: 70942 - DNA, 528 bp, Desulfovibrio vulgaris; identical to SEQ ID NO: 2095
  CDS (1)..(528): transl_table=11

SEQ ID NO: 70943 - protein, 175 aa, Desulfovibrio vulgaris; identical to SEQ ID NO: 2096

SEQ ID NO: 70944 - DNA, 522 bp, Erwinia carotovora subsp; identical to SEQ ID NO: 2071
  CDS (1)..(522): transl_table=11

SEQ ID NO: 70945 - protein, 173 aa, Erwinia carotovora subsp; identical to SEQ ID NO: 2072

SEQ ID NO: 70946 - DNA, 678 bp, Frankia sp
  CDS (1)..(678): transl_table=11
gtgggggagccggcgacggacgcgtggacggggccgatggcctggacggggccgatggtggtgctggtcggagcgcccggagcggggaagacgacggtgggcacccagctggcgcggcggtggggggtgggtttccgcgacaccgacgccgacatcgaggcggcgctcggcaccaccgtcgcggacatctttctcgatcatggtgaggagtacttccggctggccgagcgccgggcggtggcggccgcgctcgcggatcaccggggggtcctggcccttggcgggggagcggtgctcgacgccgagaaccggaccctgctggccgggcaccgggtcgtctatcttgaggtgggagtttccgacgcggtgcggcgggtgggcctcgcccgggaccgtccactgctggtcgaggggccccgcacgcggctcgccgccctgctcagggcgcgccggccgctctacgccgaggtggcgacggtggtcatcgacaccgcggggcacgagccggacgaggtgaccgacctgctggcggcggccctgggcccgctgctcgcggggggcagcgaaccggacgaggcggcggacgccgcggggggcagcgaaccggacgaggcggcggacgccgcggggggcagcgaaccggacgaggcggcggacgccgcggggggcaaacggtga

SEQ ID NO: 70947 - protein, 225 aa, Frankia sp
MGEPATDAWTGPMAWTGPMVVLVGAPGAGKTTVGTQLARRWGVGFRDTDADIEAALGTTVADIFLDHGEEYFRLAERRAVAAALADHRGVLALGGGAVLDAENRTLLAGHRVVYLEVGVSDAVRRVGLARDRPLLVEGPRTRLAALLRARRPLYAEVATVVIDTAGHEPDEVTDLLAAALGPLLAGGSEPDEAADAAGGSEPDEAADAAGGSEPDEAADAAGGKR

SEQ ID NO: 70948 - DNA, 534 bp, Gloeobacter violaceus; identical to SEQ ID NO: 2113
  CDS (1)..(534): transl_table=11

SEQ ID NO: 70949 - protein, 177 aa, Gloeobacter violaceus; identical to SEQ ID NO: 2114

SEQ ID NO: 70950 - DNA, 540 bp, Methylococcus capsulatus
  CDS (1)..(540): transl_table=11
atgcgaaaccgtcgaaacatcttcctgatcggcccgatgggagcgggcaagaccaccgtgggacgtctgctcgcccgtgccctggggatggagttctgggacagcgacaaggaaatcgaacgccggaccggcgtcacggtgccgatgattttcgaatacgagggcgaggccggattccggcgccgcgaatcggaagtcatcgccgatctcacgggcaaggaaaggatcgtgctggccaccggcggcggttcggtgctggcagcggagaaccgggagcatctggcggcacgggggctggtaatttacctgcagtgttcggtccagaagcagttggagaggacgcacaaggacatgaaccggcccttgttgcagacggagaatcccaggcaaaggctggaagaactgctgcgggtgagggatcccatctaccgcgagcttgccgactacgtcgtcgataccggccagcattcgagccgcagtgccgtgcgccggatcatcaacgcctacgagaaatccggaaccagactgcggacggaatga

SEQ ID NO: 70951 - protein, 179 aa, Methylococcus capsulatus
MRNRRNIFLIGPMGAGKTTVGRLLARALGMEFWDSDKEIERRTGVTVPMIFEYEGEAGFRRRESEVIADLTGKERIVLATGGGSVLAAENREHLAARGLVIYLQCSVQKQLERTHKDMNRPLLQTENPRQRLEELLRVRDPIYRELADYVVDTGQHSSRSAVRRIINAYEKSGTRLRTE

SEQ ID NO: 70952 - DNA, 522 bp, Moorella thermoacetica
  CDS (1)..(522): transl_table=11
atgccggggaacatcgtcctgatcggttttatgggcagcggtaagacgaccgtcggccggctcctggcccgggatctggggtggagcttcctggacaccgataccatggttgaggaacgcttgggcctgcccgtaaaagagatctttgcccgggaaggggaggagtttttccgggaagtagaaaaagaagccgtcgcccgggtggcgaccgcccggcaggcagttattgccaccggcgggggggcggtcctttgcggggtcaacgtcaagttgctgcgggagggcaacaaggtcgtctggcttcaggtgcggccggagacggccctcaaacgggccgggctggacgacagccgtcccctactccaggggcgggaaccacgggacatcgccgccctcctccggcgccgggagccctattatgccttcgctgatatctatatcgataccgacggtaaggaggcggccgccgtggcgcgggaaataaaggaggctttaaaggcgtggctggagagcttaacgtag

SEQ ID NO: 70953 - protein, 173 aa, Moorella thermoacetica
MPGNIVLIGFMGSGKTTVGRLLARDLGWSFLDTDTMVEERLGLPVKEIFAREGEEFFREVEKEAVARVATARQAVIATGGGAVLCGVNVKLLREGNKVVWLQVRPETALKRAGLDDSRPLLQGREPRDIAALLRRREPYYAFADIYIDTDGKEAAAVAREIKEALKAWLESLT

SEQ ID NO: 70954 - DNA, 636 bp, Nitrosomonas europaea; identical to SEQ ID NO: 2141
  CDS (1)..(636): transl_table=11

SEQ ID NO: 70955 - protein, 211 aa, Nitrosomonas europaea; identical to SEQ ID NO: 2142

SEQ ID NO: 70956 - DNA, 519 bp, Pseudomonas syringae pv
  CDS (1)..(519): transl_table=11
gtgcgaaatttaatacttgtggggccgatgggtgctggcaaaagcaccatcggccgtttgcttgccaaagagttgcgactgccgttcaaggattccgacaaggaaatcgagttgcgcacgggcgccaatatcccgtggatcttcgacaaggaaggcgagccgggtttccgtgagcgcgagcaggccatgattgccgagctgtgcgaagccgatggcctggttctggccaccggtggcggtgccgtcatgcgcggtgaaaaccgtcaggcgttgcgtgccggtgggcgcgtggtgtatctgcatgcttccatagaacagcaggtcgggcgcaccgcgcgtgaccgaaatcgtcctttgttgcgtaccgctgatccggcccgggtgctgagcgaattgctggctatccgcgacccgctttatcgggaaatcgccgacgtggtgattgaaaccgatgagcggccaccccgaatggtggttctcgagatattggcgcgccttgcagagcttcctccccgttaa

SEQ ID NO: 70957 - protein, 172 aa, Pseudomonas syringae pv
MRNLILVGPMGAGKSTIGRLLAKELRLPFKDSDKEIELRTGANIPWIFDKEGEPGFREREQAMIAELCEADGLVLATGGGAVMRGENRQALRAGGRVVYLHASIEQQVGRTARDRNRPLLRTADPARVLSELLAIRDPLYREIADVVIETDERPPRMVVLEILARLAELPPR

SEQ ID NO: 70958 - DNA, 519 bp, Pseudomonas fluorescens
  CDS (1)..(519): transl_table=11
gtgcgaaatttgattcttgtaggaccgatgggggctggaaaaagcaccatcggccgattactggccaaagagctgcgcctgccgttcaaggattccgacaaggaaattgaactgcgtacgggcgccaatatcccgtggatcttcgacaaggaaggcgagcccggctttcgtgaccgtgagcaagcgatgatcgccgagctgtgcgcgttcgacggcgtggtgctggcgaccggcggcggcgcggtgatgcgcgatgccaaccgcaaggccctgcacgagggcgggcgggtggtgtatctgcacgcctccgtcgagcagcaggtcggacgcacctctcgcgaccgcaaccggccgttgctgcgcaccgccaatccggagaaaactctgcgcgacctgctggcgatccgtgatccgctctatcgggaaatcgccgatctggtggtagaaaccgacgagcggccaccgcgcatggtcgtgctcgatattctcgaccgcctggcgcagcttccgccccgttaa

SEQ ID NO: 70959 - protein, 172 aa, Pseudomonas fluorescens
MRNLILVGPMGAGKSTIGRLLAKELRLPFKDSDKEIELRTGANIPWIFDKEGEPGFRDREQAMIAELCAFDGVVLATGGGAVMRDANRKALHEGGRVVYLHASVEQQVGRTSRDRNRPLLRTANPEKTLRDLLAIRDPLYREIADLVVETDERPPRMVVLDILDRLAQLPPR

SEQ ID NO: 70960 - DNA, 519 bp, Pseudomonas putida
  CDS (1)..(519): transl_table=11
gtgcgaaatttgatacttgtggggcccatgggcgctggtaaaagcaccatcggacgcctgttggccaaagagctgcgcctgctgttcaaggattccgacaaggaaatcgaactgcgatgcggcgcgaacatcccgtggatattcgacaaggaaggcgagccgggtttccgtgatcgcgagcaagcgatgattgccgagttgtgcgcgctcgacggtgtggtgctggccaccggcggtggcgcggtgatgcgcgaagccaaccggcaggcgctgcatcagggtggccgggtgatctacctgcatgcttcggtcgagcagcaagtcggccgcaccgcgcgcgaccgcaatcgcccgctgctgcgcacggccaatcccgaggcgaccttgcgcaccttgctggaaacccgcgacccgctctaccgcgagatcgccgacctggtggttgaaaccgacgagcggccaccacgcatggtggtgatcgatattctcgagcgcttgcagcagttgccgccccgttaa

SEQ ID NO: 70961 - protein, 172 aa, Pseudomonas putida; identical to SEQ ID NO: 2222

SEQ ID NO: 70962 - DNA, 519 bp, Pseudomonas syringae pv
  CDS (1)..(519): transl_table=11
gtgcgaaatttaatacttgtggggccgatgggtgctggcaaaagcaccatcggccgcttgcttgccaaagagttgcgactgccgttcaaggattccgacaaggaaatcgagctgcgcacgggcgccaacatcccctggatcttcgacaaggagggcgaaccgggtttccgggagcgcgagcaggccatgattgccgagttgtgcgaagccgatggcgtggttctggccactggcggcggcgcagtcatgcgcactgaaaaccgtcaggcgctgcgtgccggtgggcgtgtggtgtatctgcatgcctctatcgaacagcaggtcgggcgcaccgcgcgtgaccgaaatcgtcctttgttgcgtactgccgatccggcccgggtgctgagcgaattgctggccatccgcgacccgctgtatcgggaaatcgccgacgtggtgatcgaaaccgatgagcggccaccccgaatggtggttctcgagatactggcgcgccttgcagagcttcctccccgttaa

SEQ ID NO: 70963 - protein, 172 aa, Pseudomonas syringae pv; identical to SEQ ID NO: 2224

SEQ ID NO: 70964 - DNA, 519 bp, Pseudomonas syringae pv
  CDS (1)..(519): transl_table=11
gtgcgaaatttaatacttgtggggccgatgggtgctggcaagagcaccatcggccgtttgcttgccaaagaattgcgactgccgttcaaggattccgacaaggaaatcgagctgcgtacgggcgccaatattccctggatcttcgacaaagaaggcgaaccgggttttcgtgatcgcgagcaggccatgattgccgagctgtgcgccgccgatggcgtggttctggcgaccggcggtggtgcggtcatgcgcagcgaaaatcgccatgcactgcgcgccggcgggcgcgtggtttatctgcacgcctcgatcgagcaacaggtggggcgcaccgcgcgtgatcgcaatcggcctttgctgcgtaccgccgatcctgcccgggtactgagcgagttgctggccatccgtgacccgttttatcgggaaatcgccgatatagtgattgaaaccgatgagcggccgccccgaatggtggttcttgagatactggcgcgactggcagagcttcctccccgttaa

SEQ ID NO: 70965 - protein, 172 aa, Pseudomonas syringae pv
MRNLILVGPMGAGKSTIGRLLAKELRLPFKDSDKEIELRTGANIPWIFDKEGEPGFRDREQAMIAELCAADGVVLATGGGAVMRSENRHALRAGGRVVYLHASIEQQVGRTARDRNRPLLRTADPARVLSELLAIRDPFYREIADIVIETDERPPRMVVLEILARLAELPPR

SEQ ID NO: 70966 - DNA, 579 bp, Ralstonia eutropha
  CDS (1)..(579): transl_table=11
atggagaccggccgtcccaacctcttcttcgtcggcttgatgggcgccggcaagactaccgtgggccggacggtcgcgcggcgcctgcactatccgttttttgattccgaccacgagctggaagcgcactgcggcgtgcgcatcccggtgattttcgagcacgagggcgaagaaggtttccgcgaccgcgaggccgccatgatccgtgaactcaccggccgcagcggcattgtgcttgccacaggcggcggcgcggtgctgcggcccgaaaaccgcgaactgctcaaatcacgcggcactgtggtctacctgcgcgccagcccgcacgacctgtggctgcgcacccgtcacgaccgcaaccgcccgctgctgcagaccgaggatccgaagggcaagctcgaagcgctctatggcgcgcgcgacccgctttaccgcgaggtggccgatttcatcatcgagaccggcaagccctcggtggcacagcttgctaatatggtgctgatgcagctggaaatggccggtttccgcatcgacaccgccgccgcgtcggaccagccggccaacgatacgcattcatga

SEQ ID NO: 70967 - protein, 192 aa, Ralstonia eutropha
METGRPNLFFVGLMGAGKTTVGRTVARRLHYPFFDSDHELEAHCGVRIPVIFEHEGEEGFRDREAAMIRELTGRSGIVLATGGGAVLRPENRELLKSRGTVVYLRASPHDLWLRTRHDRNRPLLQTEDPKGKLEALYGARDPLYREVADFIIETGKPSVAQLANMVLMQLEMAGFRIDTAAASDQPANDTHS

SEQ ID NO: 70968 - DNA, 579 bp, Rhizobium meliloti; identical to SEQ ID NO: 2195
  CDS (1)..(579): transl_table=11

SEQ ID NO: 70969 - protein, 192 aa, Rhizobium meliloti; identical to SEQ ID NO: 2196

SEQ ID NO: 70970 - DNA, 564 bp, Rhodopirellula baltica; identical to SEQ ID NO: 2119
  CDS (1)..(564): transl_table=11

SEQ ID NO: 70971 - protein, 187 aa, Rhodopirellula baltica; identical to SEQ ID NO: 2120

SEQ ID NO: 70972 - DNA, 588 bp, Silicibacter pomeroyi
  CDS (1)..(588): transl_table=11
atgagcaaaattgagcataactcggccaaaacaatagatggtggcgctgccgcgctgcacaagaccgtcgtcatggttggcatgatgggggcgggtaaaaccgccgtgggccgggccctggcacagcgtctgggcgtgccctttctggacagcgacgccgagatcgaaagcgccgcaaacatgtcgatccccgagattttcgagcgtgatggcgaggcgttctttcgcgaccgcgaaagccgggtcatcgcccgcctgctcgagggcgcgccctgtgtgctctccaccggcggcggcgcctttctggccgaggcgaatcgccggatgatttccgaacatggcgtgtcggtctggctcaaggccgatctgacggtgctgtggaaccgggtccggcacaaggacacccgcccgctgctgcgcaccgccgatccgcgtgcgaccttgcgcgcgctttatgaggcgcgggtgccgctttattccgaggccgatctctgcgtgatttccgatggcgagacctcgatcgagcagatggttgaccgggtgatcgcggcgctggcaacgcgcaaggatgtattggaactgagctga

SEQ ID NO: 70973 - protein, 195 aa, Silicibacter pomeroyi
MSKIEHNSAKTIDGGAAALHKTVVMVGMMGAGKTAVGRALAQRLGVPFLDSDAEIESAANMSIPEIFERDGEAFFRDRESRVIARLLEGAPCVLSTGGGAFLAEANRRMISEHGVSVWLKADLTVLWNRVRHKDTRPLLRTADPRATLRALYEARVPLYSEADLCVISDGETSIEQMVDRVIAALATRKDVLELS

SEQ ID NO: 70974 - DNA, 516 bp, Streptomyces avermitilis
  CDS (1)..(516): transl_table=11
gtgaccgttccgcgcgtcgtcctcgtcggccccatgggcgtcggcaagtccacggtgggcgcgctcgtcgccgagcggctcggctgcgcctaccgggacacggacgacgacatcgtgaccgccgagggccgcaccatcgccgacatcttcgtcgacgagggcgagccggtcttccgtgccatcgagaagcgggcggtgcacacggcgctcgccgagcacgacggcgtactggcgctcggcggcggcgcgatcctcgacgcggacacccgcgcgctgctcgccgggcaccgtgtcgtctacctctcgatggaggtcgacgaggccgtcaagcgcaccggcctcaacgcggcccggccgctgctcgccgtcaacccgcgccggcagtggcgggagctgatggaggcgcgccgccacctgtacaccgaagtcgcccgcgcggtggtcgccaccgacggccgcggccccgaagaggtcgcccaagccgtcctcgacgcactggagttgaaggaagcatga

SEQ ID NO: 70975 - protein, 171 aa, Streptomyces avermitilis; identical to SEQ ID NO: 2140

SEQ ID NO: 70976 - DNA, 516 bp, Streptomyces coelicolor; identical to SEQ ID NO: 2201
  CDS (1)..(516): transl_table=11

SEQ ID NO: 70977 - protein, 171 aa, Streptomyces coelicolor; identical to SEQ ID NO: 2202

SEQ ID NO: 70978 - DNA, 525 bp, Symbiobacterium thermophilum
  CDS (1)..(525): transl_table=11
gtgaacatcgttctcgtgggactcatgggatccggcaagacggctgtgggccggctcctggccgagcggctgggccggcccttcgtggacacggacaggctcgtggaggcggacgccggccgcaccgtcgccgacatcttcgccgcagagggcgaggaggggttccgccgccgggaggcggaggtggtggcgcgggcggccgccggcgacaaccaggtgatcgcgaccgggggcggcgccgtgctgcggacggagaaccgggaggcgctgcgccgcacggggttcgtgatctggctggatgcggagccggaaacgctgtatgaccgggcccgcgggcaggggctgcaccgccggccgctgctcagcggccctgatccgctggggcggctgcgggcgctggcggccgcgcgccggccgttctacgcccaggccgcccacgtgcggatctgtacggaccgtcgttcgctgcaggacgtcgtggcagagatcatggaaaagctacaggaaaggggagagcgcgggtga

SEQ ID NO: 70979 - protein, 174 aa, Symbiobacterium thermophilum
MNIVLVGLMGSGKTAVGRLLAERLGRPFVDTDRLVEADAGRTVADIFAAEGEEGFRRREAEVVARAAAGDNQVIATGGGAVLRTENREALRRTGFVIWLDAEPETLYDRARGQGLHRRPLLSGPDPLGRLRALAAARRPFYAQAAHVRICTDRRSLQDVVAEIMEKLQERGERG

SEQ ID NO: 70980 - DNA, 588 bp, Syntrophus aciditrophicus
  CDS (1)..(588): transl_table=11
atgattcgaatgaccgagaccgagaatgacgaccggaacattatcctcatcggctatcggggaacaggcaaaacttctgtcggacaggaacttgccagaagactgcaccggccttttcatgataccgatgtcctgatcgaaaagcgggaaggacgatccattcgggatatggttgccagggaaggctgggcctttttccgggagagggaaagagcggcgatttcatctctggacggattgcgtcgttgcgttctggcgacagggggcggcgcggtgctggatccgaaaaatgccgaggtgttgaaatctctggggtgggtcgtcctgctgacggcttcggaagagattattgtccgacggatattgaacgatcccgcaagccgggaacaaagaccgtccttttcgggtaaggcttcgactgaaatatctgaagagactatgagaaaagaaacgacggagattctgaagcagcgcatgcccatatatagagtgctggcggatcagattattgacacctctcagatatcgactgcggaaattgtcgatgaaattctgcgccgatttcagtcacaaaggttcaatgtttaa

SEQ ID NO: 70981 - protein, 195 aa, Syntrophus aciditrophicus
MIRMTETENDDRNIILIGYRGTGKTSVGQELARRLHRPFHDTDVLIEKREGRSIRDMVAREGWAFFRERERAAISSLDGLRRCVLATGGGAVLDPKNAEVLKSLGWVVLLTASEEIIVRRILNDPASREQRPSFSGKASTEISEETMRKETTEILKQRMPIYRVLADQIIDTSQISTAEIVDEILRRFQSQRFNV

SEQ ID NO: 70982 - DNA, 552 bp, Thiobacillus denitrificans
  CDS (1)..(552): transl_table=11
atgagcaagcgcgacaatctttacctcgtgggcctgatgggcgccggcaagacgacggtcgggcgcctgctcgcgaagcactacggctgcacgttctacgattccgaccacgagatcgaagcgcgcacgggcgtgaagattcccgtcatattcgagatcgagggcgaggccggcttccgcaggcgcgaggaagcggtcatcgctgaactcacgacgctttccggaatcgtcctcgcgactggcggcggcgccgtcctgtcgcctgccaaccgcgaacacctgcgcaccaacggcctggtgatctacctgcgcggatcgcccgaacagctgtgcgagcggactcggaacgatcgcaatcggccgctgctgcaaaccgggaacccgctcgccaagctgcgcgagctgtatcagcagcgcgatccgatctatcgcgagctcgccgacgtgacggtcgacactgcgcgtcaaagcgtcgccggaatgacgcgcgtgctttacggcaagctcgacctgctcaaaggggaggcgacgtcgttcgacccggcgggctga

SEQ ID NO: 70983 - protein, 183 aa, Thiobacillus denitrificans
MSKRDNLYLVGLMGAGKTTVGRLLAKHYGCTFYDSDHEIEARTGVKIPVIFEIEGEAGFRRREEAVIAELTTLSGIVLATGGGAVLSPANREHLRTNGLVIYLRGSPEQLCERTRNDRNRPLLQTGNPLAKLRELYQQRDPIYRELADVTVDTARQSVAGMTRVLYGKLDLLKGEATSFDPAG

SEQ ID NO: 70984 - DNA, 552 bp, Thiobacillus denitrificans; identical to SEQ ID NO: 70982
  CDS (1)..(552): transl_table=11

SEQ ID NO: 70985 - protein, 183 aa, Thiobacillus denitrificans; identical to SEQ ID NO: 70983

SEQ ID NO: 70986 - DNA, 522 bp, Erwinia chrysanthemi; identical to SEQ ID NO: 2061
  CDS (1)..(522): transl_table=11

SEQ ID NO: 70987 - protein, 173 aa, Erwinia chrysanthemi; identical to SEQ ID NO: 2062

SEQ ID NO: 70988 - DNA, 522 bp, Erwinia carotovora subsp; identical to SEQ ID NO: 2073
  CDS (1)..(522): transl_table=11

SEQ ID NO: 70989 - protein, 173 aa, Erwinia carotovora subsp; identical to SEQ ID NO: 2074

SEQ ID NO: 70990 - DNA, 525 bp, Photorhabdus luminescens subsp
  CDS (1)..(525): transl_table=11
gtgaaccaaatattgtttattgtaggtgcacgtggggcaggaaaaacgacggttggaaaattattagccaatgaattatcgtacacatttattgacactgatcaccatatccaacaaaccagtaatatgaccattgcggatattgttaaccagcaaggatggcaacaatttcggcaattagaaagccaagctttacaacaagttactcaaattaatcgcgttatttctactggaggaggtatcattctttccgctgaaaatcgccaatatatgcgacaaaatggcacggtgatttatcttcaagcttcagcgagcattttggctgagcgattaatgcagcaaccagaaagtacccaacgtcctagtttgacgggaaaatctattgttgaagaaatggaagaagtgcttgccgccagagaaaatctctattgtgaatgtgcgaaccatattattaatgcgcacctttcaccggaaaaaattacaacttatgtgaaagagattatgttctctggaatagtttcctga

SEQ ID NO: 70991 - protein, 174 aa, Photorhabdus luminescens subsp; identical to SEQ ID NO: 2112

SEQ ID NO: 70992 - DNA, 546 bp, Salmonella choleraesuis
  CDS (1)..(546): transl_table=11
atgatgcaacctctttatcttgttggcccgcggggctgtgggaaaaccaccatcggtatggcgctggcgcaggcaaccggtttccggtttgcagataccgaccgctggctgcaatcgcacgtgcagatgagcgtcgctgatatcgttgaaaaagaaggctggggagggttccgcgcccgggaaaccgcggccctggaggcggtaagcgcgccttcgactgtcgtggcgacgggaggcggtattattctcacggattataaccgacgttatatgcaccgtgttggcgtagtgatttatctgtgcgcgccggtatccacgctggttaatcggcttgaggctgaacctgaagcggatctgcgcccgaccctcaccggcaagccgttgagcgaagaggttcgggaagtgcttgagcagcgtgacgcgttgtatcgcgaaacggcgcattacattattgacgcgacgaaagcgccggcccaggtcgtttctgaaattattgcggcgctgccgccgtcgacgcaacggttacagggagatgtctatacttaa

SEQ ID NO: 70993 - protein, 181 aa, Salmonella choleraesuis
MMQPLYLVGPRGCGKTTIGMALAQATGFRFADTDRWLQSHVQMSVADIVEKEGWGGFRARETAALEAVSAPSTVVATGGGIILTDYNRRYMHRVGVVIYLCAPVSTLVNRLEAEPEADLRPTLTGKPLSEEVREVLEQRDALYRETAHYIIDATKAPAQVVSEIIAALPPSTQRLQGDVYT

SEQ ID NO: 70994 - DNA, 546 bp, Salmonella paratyphi
  CDS (1)..(546): transl_table=11
atgatgcaacctctttatcttgttggcccgcggggctgtgggaaaaccaccatcggtatggcgctggcgcaggcaaccggtttccggtttgcggataccgaccgctggctgcaatcgcacgtgcagatgagcgtcgctgatatcgttgaaaaagaaggctggggagggttccgcgcccgggaaaccgcggctctggaagcggtaagcgcgccttcgactgtcgtggcgacaggaggcggtattattctcacggagtataaccgacgttatatgcaccgtgttggcgtagtgatttatctgtgcgcgccggtatccacgctggttaaccggcttgaggctgaacctgaagcggatctgcgcccgaccctcaccggcaagccgttgagcgaagaggttcgggaagtgcttgagcagcgtgacgcgttgtatcgcgaaacggcgcattacattattgacgcgacgaaagcgccggcccaggtcgtttctgaaattattgcggcgctgccgccgtcgacgcaacggttacagggagatgtctatacttaa

SEQ ID NO: 70995 - protein, 181 aa, Salmonella paratyphi; identical to SEQ ID NO: 2010

SEQ ID NO: 70996 - DNA, 525 bp, Yersinia pestis; identical to SEQ ID NO: 2017
  CDS (1)..(525): transl_table=11

SEQ ID NO: 70997 - protein, 174 aa, Yersinia pestis; identical to SEQ ID NO: 2018

SEQ ID NO: 70998 - DNA, 525 bp, Yersinia pseudotuberculosis
  CDS (1)..(525): transl_table=11
atgacacaaactatcttcatggtaggcgcgcgcggtgcgggtaagaccactattgggaaggcattggcgcaggcattggggtatcggtttgttgatacagatctatttatgcaacaaacctcacaaatgaccgtggctgaagttgttgagagtgaaggttgggatggttttcgtctacgtgaaagcatggcactacaggcagtaacggcacctaaaacagtcattgccactggtggtggtgcggtactgtccagtgaaaaccgtgcattcatgcgtgatcatgggcgagttatttatctgcgggcatcagcagccgtattggcaaagcggctagcagaagatcctgaagaggctcagcggccaagtttaaccggtaaacccatcgttgaagaaatgctggatgtgttggctagccgtgaagcattgtatcaggacgtcgcccatcatgtacttgatggaacgcaaactccgtcgctggttgtcgaacaaattttacagatgttgactggtgagatggtcaaataa

SEQ ID NO: 70999 - protein, 174 aa, Yersinia pseudotuberculosis
MTQTIFMVGARGAGKTTIGKALAQALGYRFVDTDLFMQQTSQMTVAEVVESEGWDGFRLRESMALQAVTAPKTVIATGGGAVLSSENRAFMRDHGRVIYLRASAAVLAKRLAEDPEEAQRPSLTGKPIVEEMLDVLASREALYQDVAHHVLDGTQTPSLVVEQILQMLTGEMVK

SEQ ID NO: 71000 - DNA, 25 bp, Artificial sequence
  primer
atgacacaacctctttttctgatcg

SEQ ID NO: 71001 - DNA, 25 bp, Artificial sequence
  primer
ttaacaattgatcgtctgtgccagg

SEQ ID NO: 71002 - protein, 154 aa, Artificial sequence
  consensus sequence
  Variant (2)..(3): Xaa in position 2 to 3 is any amino acid
  Variant (5)..(5): Xaa in position 5 is any amino acid
  Variant (8)..(8): Xaa in position 8 is any amino acid
  Variant (10)..(10): Xaa in position 10 is any amino acid
  Variant (12)..(14): Xaa in position 12 to 14 is any amino acid
  Variant (16)..(17): Xaa in position 16 to 17 is any amino acid
  Variant (19)..(23): Xaa in position 19 to 23 is any amino acid
  Variant (25)..(25): Xaa in position 25 is any amino acid
  Variant (27)..(44): Xaa in position 27 to 44 is any amino acid
  Variant (45)..(45): Xaa in position 45 is any or no amino acid
  Variant (47)..(49): Xaa in position 47 to 49 is any amino acid
  Variant (52)..(53): Xaa in position 52 to 53 is any amino acid
  Variant (55)..(66): Xaa in position 55 to 66 is any amino acid
  Variant (67)..(71): Xaa in position 67 to 71 is any or no amino acid
  Variant (73)..(74): Xaa in position 73 to 74 is any amino acid
  Variant (79)..(85): Xaa in position 79 to 85 is any amino acid
  Variant (87)..(91): Xaa in position 87 to 91 is any amino acid
  Variant (92)..(96): Xaa in position 92 to 96 is any or no amino acid
  Variant (98)..(98): Xaa in position 98 is any amino acid
  Variant (100)..(101): Xaa in position 100 to 101 is any amino acid
  Variant (103)..(111): Xaa in position 103 to 111 is any amino acid
  Variant (113)..(118): Xaa in position 113 to 118 is any amino acid
  Variant (119)..(122): Xaa in position 119 to 122 is any or no amino acid
  Variant (125)..(125): Xaa in position 125 is any amino acid
  Variant (127)..(136): Xaa in position 127 to 136 is any amino acid
  Variant (137)..(149): Xaa in position 137 to 149 is any or no amino acid
  Variant (151)..(153): Xaa in position 151 to 153 is any amino acid
GXXGXGKXTXGXXXAXXLXXXXXDXDXXXXXXXXXXXXXXXXXXXGXXXFRXXEXXXXXXXXXXXXXXXXXVXXTGGGXXXXXXXRXXXXXXXXXXGXVXXLXXXXXXXXXRXXXXXXXXXXRPXLXXXXXXXXXXXXXXXXXXXXXXXRXXXY

SEQ ID NO: 71003 - protein, 11 aa, Artificial sequence
  protein pattern
  Variant (2)..(3): Xaa in position 2 to 3 is any amino acid
  Variant (5)..(5): Xaa in position 5 is Ala, Cys, Ser or Val
  Variant (8)..(8): Xaa in position 8 is Ser or Thr
  Variant (10)..(10): Xaa in position 10 is Ile, Leu or Val
  Variant (11)..(11): Xaa in position 11 is Ala or Gly
GXXGXGKXTXX

SEQ ID NO: 71004 - DNA, 1206 bp, Escherichia coli K12
  CDS (1)..(1206): transl_table=11
atgtcatggcagcaattcaaacacgcctggttgattaaattctgggcccccatccctgcggtcatcgcggcgggtattctctctacttactattttggcattactggcaccttttgggctgtcacgggtgaatttacccgttggggcggccagctcctgcaactgttcggcgtccatgctgaagagtggggttactttaaaattatccatctggaaggatcgccattaacccgcatcgacgggatgatgatcctcggtatgtttggcggctgctttgccgcagcgctgtgggccaacaatgtcaaactgcgaatgccgcgcagccgtatccgcattatgcaggccatcattggcggcattatcgccggttttggcgcgcgtctggcaatgggctgtaacctggcggcgttctttaccggtattcctcagttctcgctgcatgcctggttctttgccatcgccactgccattggttcatggtttggcgcgcgctttaccctgctgcccatcttccgtattcccgtgaaaatgcagaaagtttctgccgcctcaccgctgacgcaaaaaccggatcaggcgcggcgtcgttttcgtctcgggatgctggtctttttcggcatgctgggctgggcgctgctcacagcgatgaaccaacccaaactggggctggcaatgctgtttggcgtcggctttggtttactgattgaacgtgcgcaaatctgctttacttcagcgttccgcgatatgtggatcaccggacgtacccatatggcgaaagcaatcattatcggtatggcggtgagtgccatcgggatcttcagttacgtacagttaggcgttgaacccaaaatcatgtgggcgggaccaaacgcggtaattggtggtttactgtttggttttggcatcgtgctggctggcggctgcgaaaccggctggatgtaccgcgcggtagaaggccaggtgcactactggtgggtcggtctgggcaatgtgatcggctcaacgattctggcgtattactgggatgatttcgctccggcgctggccaccgactgggacaaaatcaacctgctgaaaacctttggtccgatgggtggcctgctggtgacatatttgctgttgtttgctgcgctgatgttgattatcggctgggaaaaacgcttcttccgccgtgcggcaccgcagactgctaaggagatcgcatga

SEQ ID NO: 71005 - protein, 401 aa, Escherichia coli K12
MSWQQFKHAWLIKFWAPIPAVIAAGILSTYYFGITGTFWAVTGEFTRWGGQLLQLFGVHAEEWGYFKIIHLEGSPLTRIDGMMILGMFGGCFAAALWANNVKLRMPRSRIRIMQAIIGGIIAGFGARLAMGCNLAAFFTGIPQFSLHAWFFAIATAIGSWFGARFTLLPIFRIPVKMQKVSAASPLTQKPDQARRRFRLGMLVFFGMLGWALLTAMNQPKLGLAMLFGVGFGLLIERAQICFTSAFRDMWITGRTHMAKAIIIGMAVSAIGIFSYVQLGVEPKIMWAGPNAVIGGLLFGFGIVLAGGCETGWMYRAVEGQVHYWWVGLGNVIGSTILAYYWDDFAPALATDWDKINLLKTFGPMGGLLVTYLLLFAALMLIIGWEKRFFRRAAPQTAKEIA

SEQ ID NO: 71006 - DNA, 1209 bp, Campylobacter jejuni
  CDS (1)..(1209)
ttgaattcttttaaacaaaaatatttaatcaatttttgggacaattcccgttctatgattgcacttggaattttaagtgcagtgtattttgggatttttggtggcgtttgggctgttactggagaaatgacacgttggggtggcgagtttttagagcttttaggtatgaatttagatggatattcttattaccaaaagcaaaatttaaatggaacccctttaacaagaactgatggtattatgctcataggtatgtttataggttgtttagtagccgcacttttagctaacaaagtcaaatttcgtctacctgctagcaatataagaatttttcaagcaatagtaggtggaattctttcaggatatggagcaagacttgcatttggatgcaatttagctaatttttttacaggtttaccttatttttctttacacacttggctttttactgtttttatggttttaggaatttatctaggagtgaaaatttgcaacacttccttttttaaacctaaagctaaattagaacgtgtaaataaagaaaacttgccgttaaacaagcaaagtttgcgtacaaaattatattttaacttaggcatattgcttttcatagcctttttagtttgggtgttttatcttgtttttacaaatggcaatatcagcacacaaaacaaacaaagtcttctagctttagcactgatttttggttttgtttttggctttgttatttctagagggcaaatttgttttacttcttgctttagagatttatttttatttggtagagataatgctataaaaggcgcattaatcggtatgattatcgcctctttaatcgcttttgcttttatcttgcaaggtcatactagcaaactcatagaactttctcctgctgtagctgtgggagcatttttgtttggttttggtatagtttttgccggaggttgcgagtgtggttggacttatcgtgcctttgaaggacaaagtcattttataatagtaggaattgcaaatataataggaactatgattttagctttaagttataactttttaccaaaagcttttaaagaaggtataaaaatcaatcttttaactgaatttggcaatttaaatggattttttatcaaccttattttattcatcttaatgtttgtttttgtagtattttacaaaaaacacttttttaaaaatcaacttaaaggataa

SEQ ID NO: 71007 - protein, 402 aa, Campylobacter jejuni
LNSFKQKYLINFWDNSRSMIALGILSAVYFGIFGGVWAVTGEMTRWGGEFLELLGMNLDGYSYYQKQNLNGTPLTRTDGIMLIGMFIGCLVAALLANKVKFRLPASNIRIFQAIVGGILSGYGARLAFGCNLANFFTGLPYFSLHTWLFTVFMVLGIYLGVKICNTSFFKPKAKLERVNKENLPLNKQSLRTKLYFNLGILLFIAFLVWVFYLVFTNGNISTQNKQSLLALALIFGFVFGFVISRGQICFTSCFRDLFLFGRDNAIKGALIGMIIASLIAFAFILQGHTSKLIELSPAVAVGAFLFGFGIVFAGGCECGWTYRAFEGQSHFIIVGIANIIGTMILALSYNFLPKAFKEGIKINLLTEFGNLNGFFINLILFILMFVFVVFYKKHFFKNQLKG

SEQ ID NO: 71008 - DNA, 1227 bp, Pseudomonas aeruginosa PAO1
  CDS (1)..(1227): transl_table=11
atgtctgccttcaatgcgtttcgccaacgctacctggtgaggttctggtcgccgctgccggcgctggtcgccctcggcgtcgcctccgcctactacttcgcgctcaccggcaccttctgggcggtgaccggcgaattcacccgctggggcggccacgtgctgtcctggttcggctaccagccacaggactggagctacttcaggctgatcggccttcaaggcacgccgctggaccggatcgacggagtgatgatcatcggcatgttcctcggcgccctgtgctgcgccctctgggccggcaacgtcagcctgcgctggccgaccagcaaacgtcgcctgctgcagggcctggtcggcggtatcgtcgccggcttcggcgcgcgcctggcgatgggctgcaacctggcggcgttcttcaccggtatcccgatgttttccctgcacgcctgggccttcatgttcgccaccgtcggcggcgcctggatcggcgtgaagatcagcctgctgccgttcctgcgcacaccgctgaaagtcggcgccacggccagcgccctgcccagcgccgaaagcctggcccgacgcgcacgcctgcaggcccgcctgggcctggcggtgctggcgctcgccgcgctgttcgccgcctggcgcttcgaggtatcgctggtgctgggcatggcctgcctgttcggcctgctgttcggcggcctgatcgagcgcgcgcagatctgcttcaccagcgccgcacgggacctctggaccaccggccggacccgcgccgccttcggcatcctgctcggcatggcggccgcctgcatcggtaccttcgccgcgatccgcctgggcgtcgcgccgaagatcttctggatgggcccgaatgcgatcatcggcggcattctcttcggcatcggcatcgtcctcgccggcggttgcgagaccggctggatgtaccgctcgatggagggccaggtgcacttctgggtggtcggcatcggcaacgtcatcggcggaaccctggtggcgatcttttgggaccagttgggcacccgcctcgccctgccctatcccaagctcaacctgctggaaagcttcgggcccggcaacggcctgctattgaccttcgccggcctggccctgtgcctgctgctggtgcaactgaacgcctcccgattcacccgaccgcggaaaccgaaccatgagccagaccgacaaaccgaccctgtcgcttga

SEQ ID NO: 71009 - protein, 408 aa, Pseudomonas aeruginosa PAO1
MSAFNAFRQRYLVRFWSPLPALVALGVASAYYFALTGTFWAVTGEFTRWGGHVLSWFGYQPQDWSYFRLIGLQGTPLDRIDGVMIIGMFLGALCCALWAGNVSLRWPTSKRRLLQGLVGGIVAGFGARLAMGCNLAAFFTGIPMFSLHAWAFMFATVGGAWIGVKISLLPFLRTPLKVGATASALPSAESLARRARLQARLGLAVLALAALFAAWRFEVSLVLGMACLFGLLFGGLIERAQICFTSAARDLWTTGRTRAAFGILLGMAAACIGTFAAIRLGVAPKIFWMGPNAIIGGILFGIGIVLAGGCETGWMYRSMEGQVHFWVVGIGNVIGGTLVAIFWDQLGTRLALPYPKLNLLESFGPGNGLLLTFAGLALCLLLVQLNASRFTRPRKPNHEPDRQTDPVA

SEQ ID NO: 71010 - DNA, 1209 bp, Campylobacter jejuni subsp. jejuni NCTC 11168; identical to SEQ ID NO: 71006
  CDS (1)..(1209): transl_table=11

SEQ ID NO: 71011 - protein, 402 aa, Campylobacter jejuni subsp. jejuni NCTC 11168
MNSFKQKYLINFWDNSRSMIALGILSAVYFGIFGGVWAVTGEMTRWGGEFLELLGMNLDGYSYYQKQNLNGTPLTRTDGIMLIGMFIGCLVAALLANKVKFRLPASNIRIFQAIVGGILSGYGARLAFGCNLANFFTGLPYFSLHTWLFTVFMVLGIYLGVKICNTSFFKPKAKLERVNKENLPLNKQSLRTKLYFNLGILLFIAFLVWVFYLVFTNGNISTQNKQSLLALALIFGFVFGFVISRGQICFTSCFRDLFLFGRDNAIKGALIGMIIASLIAFAFILQGHTSKLIELSPAVAVGAFLFGFGIVFAGGCECGWTYRAFEGQSHFIIVGIANIIGTMILALSYNFLPKAFKEGIKINLLTEFGNLNGFFINLILFILMFVFVVFYKKHFFKNQLKG

SEQ ID NO: 71012 - DNA, 1266 bp, Salmonella enterica subsp. enterica serovar Typhi str. CT18
  CDS (1)..(1266): transl_table=11
gtgatcggtgtagtatgcgcacttcttgtttcacaccttctgagttcagaggctaaacacatgtcatggcaacacttcaagcaaacctggttaattaaattctgggcgccggcccctgcggtgatcgcagccggtattctctctacctactattttggcatcaccggcacgttttgggccgtgacgggcgaatttacccgctggggcgggcaaattttgcagctttttggcgttcatgccgaacagtggggctactacaagctgattcatctggaaggtacgccgctgacgcgtatcgacggcatgatgatcctcggcatgttcggcggctgtttcgccgcggcgctgtgggccaacaacgtaaaactgcgtatgccgcgcagccgaatccgtatcgtacaggcggtggtcggaggcatgatcgctggcttcggcgcgcgtctggcgatggggtgtaacctggccgccttttttaccgggatcccgcagttctccctacacgcgtggttctttgcgctggcgaccgctatcggttcctggttcggcgcccgctttacgttgctgccgatatttcgcataccggtgaaaatgcaaaaggtctccgcggcttcgccactgacgcagaaaccggatcaggcaagacggcgtttcaggctcggtatgctggtctttatcggcatgattggctgggcgttattaacggcaatgcatcagccgaaactggggctggcgatgctgttcggcgtcgggtttgggctgctgatcgagcgcgcgcaaatctgctttacctcggcctttcgcgatctgtggatctccggacgcgcccatatggcgaaagcgattatttttggcatggcggtcagcgccattggtattttcagctacgtgcagttgggcgttgcacctaaaattatgtgggctggcccgaatgcggtcattggcggactgctgttcggttttggcatcgtgctggcgggcggctgcgaaaccggctggatgtaccgcgccgtagaagtccaggtgcattactggtgggtgggcctcggcaatgtcatcggttcgaccatcctggcttactactgggatgatttcgcgcccgcgctggcgaccagttgggataaagttaacctgctgaatacctttggtccgctggggggtctgctggtcacctatctgttgttatttaccgcgctgatgttaatcatcggctgggaaaaacgttttttccgccgtgcggggctgacgcctgctaaggaatctgtatga

SEQ ID NO: 71013 - protein, 421 aa, Salmonella enterica subsp. enterica serovar Typhi str. CT18
MIGVVCALLVSHLLSSEAKHMSWQHFKQTWLIKFWAPAPAVIAAGILSTYYFGITGTFWAVTGEFTRWGGQILQLFGVHAEQWGYYKLIHLEGTPLTRIDGMMILGMFGGCFAAALWANNVKLRMPRSRIRIVQAVVGGMIAGFGARLAMGCNLAAFFTGIPQFSLHAWFFALATAIGSWFGARFTLLPIFRIPVKMQKVSAASPLTQKPDQARRRFRLGMLVFIGMIGWALLTAMHQPKLGLAMLFGVGFGLLIERAQICFTSAFRDLWISGRAHMAKAIIFGMAVSAIGIFSYVQLGVAPKIMWAGPNAVIGGLLFGFGIVLAGGCETGWMYRAVEVQVHYWWVGLGNVIGSTILAYYWDDFAPALATSWDKVNLLNTFGPLGGLLVTYLLLFTALMLIIGWEKRFFRRAGLTPAKESV

SEQ ID NO: 71014 - DNA, 1266 bp, Salmonella typhimurium LT2
  CDS (1)..(1266): transl_table=11
gtgatcggtgtagtatgcgcacttcttgtttcacaccttctgagttcagaggctaaacacatgtcatggcaacacttcaagcaaacctggttaattaaattctgggcgccggcccctgcggtgatcgcagccggtattctctctacctactattttggcatcaccggcacgttttgggccgtgacgggcgaatttacccgctggggcgggcaaattttgcagctttttggcgttcatgccgaacagtggggctactacaagctgattcatctggaaggtacgccgctgacgcgtatcgacggcatgatgatcctcggcatgttcggcggctgtttcgccgcggcgctgtgggccaacaacgtaaaactgcgtatgccgcgcagccgaatccgtatcgtacaggcggtggccggaggcattatcgctggcttcggcgcgcgtctggcgatggggtgtaacctggccgccttttttaccgggatcccgcagttctccctacacgcgtggttctttgcgctggcgaccgctatcggctcctggttcggcgcccgctttacgttgctgccgatatttcgcataccggtgaaaatgcagaaggtctccgcggcttcgccactgacgcagaaaccggatcaggcaagacggcgtttcaggctcggtatgctggtctttatcggcatgattggctgggcgttattaacggcaatgcatcagccgaaactggggctggcgatgctgttcggcgtcgggtttgggctgctgatcgaacgcgcgcaaatctgctttacctcggcctttcgcgatctgtggatctccggacgcgcccatatggcgaaagcgattattttcggcatggcggtcagcgccattggtattttcagctacgtgcagttgggcgttgcacctaaaattatgtgggctggcccgaatgcggtcattggcggactgctgttcggttttggcatcgtgctggcgggcggctgcgaaaccggctggatgtaccgcgccgtagaaggccaggtgcattactggtgggtaggcctcggcaatgtcatcggttcgaccatcctggcttactactgggatgatttcgcgcccgcgctggcgaccagttgggataaagttaacctgctgaatacctttggtccgctgggcggtctgctggtcacctatctgttgttatttaccgcgctgatgttaatcatcggctgggaaaaacgttttttccgccgtgcggggctgacgcctgctaaggaatctgtatga

SEQ ID NO: 71015 - protein, 421 aa, Salmonella typhimurium LT2
MIGVVCALLVSHLLSSEAKHMSWQHFKQTWLIKFWAPAPAVIAAGILSTYYFGITGTFWAVTGEFTRWGGQILQLFGVHAEQWGYYKLIHLEGTPLTRIDGMMILGMFGGCFAAALWANNVKLRMPRSRIRIVQAVAGGIIAGFGARLAMGCNLAAFFTGIPQFSLHAWFFALATAIGSWFGARFTLLPIFRIPVKMQKVSAASPLTQKPDQARRRFRLGMLVFIGMIGWALLTAMHQPKLGLAMLFGVGFGLLIERAQICFTSAFRDLWISGRAHMAKAIIFGMAVSAIGIFSYVQLGVAPKIMWAGPNAVIGGLLFGFGIVLAGGCETGWMYRAVEGQVHYWWVGLGNVIGSTILAYYWDDFAPALATSWDKVNLLNTFGPLGGLLVTYLLLFTALMLIIGWEKRFFRRAGLTPAKESV

SEQ ID NO: 71016 - DNA, 1215 bp, Yersinia pestis KIM
  CDS (1)..(1215): transl_table=11
atgagctggcccgagtttaaatctcaatatctggtgcgcttttgggcacctttacctgcggttattgctgccggtatcttagcgacctattactttggtttgactggcacgttctgggcggtcactggtgagtttactcgctgggggggccatattatgcaattgtttggtgcgcagccacaggagtggggctattttaaagtgatcggtctggaaggaacgccactggatcgtatcgatggcatgatgattatcggtatgttcgccggttgtatcgctgcggcactctgggctaacaatattaagttacgtaagccgcaacacactatccgcattgcacaggcgctggtggggggcataattgctggttttggtgcccgtctggcgatggggtgcaatttagccgccttctttaccggcattccgcaattttcactgcacgcgtggttttttgcactagcgacggcagcgggctcttactttggggccaaatttacgctgctccccctgttccgcattccgattaaactacaaaaagtgactgccgcctcaccactgacgcagcacccagccagagcggcacgccgtttccgtctgggaatggtggtcttggttctggcgcttggctggtccctgattgagttgttccgtcagcctaaattggggattgccatgctgtgcgggattggctttgggctcctgattgaacgtgctcagatttgctttacctccgcttttcgtgacttgtggataaccgggcgcacccatatggctaaggccattattctaggaatggcggtcagtactctcggcattttcagctacgtccagctgggcgtcgaacctaaaattctgtgggctgggccaaatgcggtaataggtggtttactgtttggttttggtatcgtgctggcgggtggctgtgaaaccggttggatgtaccgtgcggtggaagggcaaattcattattggtgggtgggattgggcaatattatcggcgcaactctcttggcctactactgggacgatttcgcccctgcgttggcgaccaattacgataaagttaacctgttggagacgttcggaccgatgggcgggttgctggtgacttacctaatgttggcactagcatttgccgccatgctgtggtgggagaagcgtttctttcgcaaacaaaaagcgacaacctcggccctgattaaggaatccttatga

SEQ ID NO: 71017 - protein, 404 aa, Yersinia pestis KIM
MSWPEFKSQYLVRFWAPLPAVIAAGILATYYFGLTGTFWAVTGEFTRWGGHIMQLFGAQPQEWGYFKVIGLEGTPLDRIDGMMIIGMFAGCIAAALWANNIKLRKPQHTIRIAQALVGGIIAGFGARLAMGCNLAAFFTGIPQFSLHAWFFALATAAGSYFGAKFTLLPLFRIPIKLQKVTAASPLTQHPARAARRFRLGMVVLVLALGWSLIELFRQPKLGIAMLCGIGFGLLIERAQICFTSAFRDLWITGRTHMAKAIILGMAVSTLGIFSYVQLGVEPKILWAGPNAVIGGLLFGFGIVLAGGCETGWMYRAVEGQIHYWWVGLGNIIGATLLAYYWDDFAPALATNYDKVNLLETFGPMGGLLVTYLMLALAFAAMLWWEKRFFRKQKATTSALIKESL

SEQ ID NO: 71018 - DNA, 1206 bp, Shigella flexneri 2a str. 301
  CDS (1)..(1206): transl_table=11
atgtcatggcagcaattcaaacacgcctggttgattaaattctgggcacccatccctgcggtcatcgcggcgggtattctctccacttactattttggcattactggcaccttttgggctgtcacgggtgaatttacccgttggggcggtcagctcctgcagctgtttggcgtccatgctgaagagtggggttattttaaaattatccatctggaaggatcgccattaacccggatcgacggcatgatgatcctcggtatgtttggcggctgctttgctgctgcgctgtgggccaacaatgtcaaactacgcatgccacgcagccgtatccgcattatgcaggccatcattggcggcattatcgccggttttggcgcgcgtctggcaatgggctgtaacctggcggcgttctttaccggcattcctcagttctcgctgcatgcctggttctttgccatcgccactgccattggttcatggtttggcgcgcgctttaccctgctgcccatcttccgtattcccgtgaaaatgcagaaagtttctgccgcctcaccgctgacgcaaaaaccggatcaggcgcggcgtcgttttcgtctcgggatgctggtctttttcggcatgctgggctgggcgctgctcacggcgatgaaccaaccaaaactggggctggcaatgctgtttggcgtcggctttggtttactgattgaacgtgcgcaaatctgctttacttcggcgttccgcgatatgtggatcaccggacgtacccatatggcgaaagcaatcattatcggtatggcggtgagtgccatcgggatcttcagttacgtacagttaggcgttgaacctaaaatcatgtgggcgggaccaaatgcggtaattggtggtttactttttggttttggcatcgtgctggcaggcggctgcgaaaccggctggatgtaccgcgcggtagaaggccaggtgcactactggtgggtcggtctgggcaacgtgatcggctcaacgattctggcgtattactgggatgatttcgctccggcgctggccaccgactgggacaaaatcaacctgctgaaaacttttggtccgatgggaggcctgctggtgacatatttgctgctgtttgctgcgctgatgttgattatcggctgggaaaaacgcttcttccgccgtgaggcaccgcagactgctaaggagatcgcatga

SEQ ID NO: 71019 - protein, 401 aa, Shigella flexneri 2a str. 301
MSWQQFKHAWLIKFWAPIPAVIAAGILSTYYFGITGTFWAVTGEFTRWGGQLLQLFGVHAEEWGYFKIIHLEGSPLTRIDGMMILGMFGGCFAAALWANNVKLRMPRSRIRIMQAIIGGIIAGFGARLAMGCNLAAFFTGIPQFSLHAWFFAIATAIGSWFGARFTLLPIFRIPVKMQKVSAASPLTQKPDQARRRFRLGMLVFFGMLGWALLTAMNQPKLGLAMLFGVGFGLLIERAQICFTSAFRDMWITGRTHMAKAIIIGMAVSAIGIFSYVQLGVEPKIMWAGPNAVIGGLLFGFGIVLAGGCETGWMYRAVEGQVHYWWVGLGNVIGSTILAYYWDDFAPALATDWDKINLLKTFGPMGGLLVTYLLLFAALMLIIGWEKRFFRREAPQTAKEIA

SEQ ID NO: 71020 - DNA, 1215 bp, Shewanella oneidensis MR-1
  CDS (1)..(1215): transl_table=11
atgacatggcaacaatttaaacaacaatatttggttcgtttttgggctcctatgcctgcggtcatcgccgccggtatcctttctacttactattttggcttaacaggcaccttctgggccgtcacgggggaatttactcgctggggtgggcatttgctgcaattggtgggcgccaaccctgaaacttggggttatttcaaggtgataggtttgcaaggctctcccttagaccgtatcgacggcatgatgatcatcggtatgtttggtggttgtattgcggcggcgctctgggccaataacgttaaactgcgtatgccacagagccgtatccgcatcgctcaggcgttaattggcggcattattgccggctttggcgctcgcttggcgatgggctgtaacttagcggctttctttactggtattccgcagttttccttacacgcatggttttttgccctcgcgacggcggcgggttcgtactttggtgcgcgctttacgctattacccatgttccgcattccggtgaaattgaagaaagtcgataaagcgtcttcggtcaaacaggatgaaaaccaagccagactgcgttttcgcatcggcatgttagtgttcgcagccattattggttggggattattaaccatgttcaatgcgcctaagctgggtatcgccatgctctgcggtgtgggttttggtctgttgattgagcgggcgcaaatctgctttacctcggcatttcgcgatatgtggatcaccggacgcacccatatggccaaggcgattattctcggtatggcggtgagtgccatcgggatttatagctatgtgcaattaggtgtgccacccaaaatcatgtgggctggtccgaatgcggtgattggtggcctgttgtttggatttggcattgtactggctggtggctgtgagacaggttggatgtaccgtgccgttgaaggtcaagtacatttctggtgggttggcttaggtaacgtgctcggttcaaccctgctggcctattactgggatgacttggctcaacccttagcgaccaactgggacaaggttaacctgctcaccagctttggcgataaaggtggcttattagtgacctatttgctgctggcattgtcgtttgcggccatgttgctgtgggaaaaacgtttctttgcccgtaaggcaaagcgggatgaacaattgatcgcggaggcggcgtaa

SEQ ID NO: 71021 - protein, 404 aa, Shewanella oneidensis MR-1
MTWQQFKQQYLVRFWAPMPAVIAAGILSTYYFGLTGTFWAVTGEFTRWGGHLLQLVGANPETWGYFKVIGLQGSPLDRIDGMMIIGMFGGCIAAALWANNVKLRMPQSRIRIAQALIGGIIAGFGARLAMGCNLAAFFTGIPQFSLHAWFFALATAAGSYFGARFTLLPMFRIPVKLKKVDKASSVKQDENQARLRFRIGMLVFAAIIGWGLLTMFNAPKLGIAMLCGVGFGLLIERAQICFTSAFRDMWITGRTHMAKAIILGMAVSAIGIYSYVQLGVPPKIMWAGPNAVIGGLLFGFGIVLAGGCETGWMYRAVEGQVHFWWVGLGNVLGSTLLAYYWDDLAQPLATNWDKVNLLTSFGDKGGLLVTYLLLALSFAAMLLWEKRFFARKAKRDEQLIAEAA

SEQ ID NO: 71022 - DNA, 1239 bp, Escherichia coli CFT073
  CDS (1)..(1239): transl_table=11
gtgtcaaaccttctgagttcagaggctacattcatgtcatggcagcaattcaaacacgcctggttgattaaattctgggcacccatccctgcggtcatcgcggcgggtattctctccacttactattttggcatcactggcacattttgggcagtcacgggtgaatttacccgttggggcggtcagctcctgcagttgttcggcgtccatgctgaagagtggggttattttaaaattatccatctggaaggatcgccattaacccgcatcgacggaatgatgatcctcggtatgtttggcggctgttttgccgcagcgctgtgggccaacaatgtcaaactgcgcatgccgcgcagccgtatccgcattatgcaggccatcattggcggtattatcgccggttttggcgcacgtctggcaatgggctgtaacctggcggcgttctttaccggaattccacagttctcgctgcacgcctggttctttgccatcgccactgccattggttcatggtttggcgcgcgctttaccctgctgcccatcttccgtattcccgtgaaaatgcagaaagtttctgccgcctcaccgctgacgcaaaaaccggatcaggcgcggcgtcgttttcgtctcgggatgctggtctttttcggcatgctgggctgggcgctgctcacggcgatgaaccaacccaaactggggctggcaatgctgtttggcgtcggctttggtttactgattgaacgtgcgcaaatctgctttacttcggcgttccgcgatatgtggatcaccggacgtacccatatggcgaaagcaatcattatcggtatggcggtaagtgccatcgggatcttcagttacgtacagttaggcgttgaacccaaaatcatgtgggcgggaccaaacgcggtaattggtggtttactgtttggttttggcatcgtgctggcaggcggctgcgaaaccggctggatgtaccgcgcggtagaaggccaggtgcactactggtgggtcggtctgggcaacgtgatcggctcaacgattctggcgtattactgggatgatttcgctccggcgctggccaccgactgggacaaaatcaacctgctgaaaacctttggtccgatgggtggcctgctggtgacatatttgctgttgtttgcagctctaatgttgattatcggctgggaaaaacgcttcttccgccgtgcggcaccgcagattgctaaggagatcgcatga

SEQ ID NO: 71023 - protein, 412 aa, Escherichia coli CFT073
MSNLLSSEATFMSWQQFKHAWLIKFWAPIPAVIAAGILSTYYFGITGTFWAVTGEFTRWGGQLLQLFGVHAEEWGYFKIIHLEGSPLTRIDGMMILGMFGGCFAAALWANNVKLRMPRSRIRIMQAIIGGIIAGFGARLAMGCNLAAFFTGIPQFSLHAWFFAIATAIGSWFGARFTLLPIFRIPVKMQKVSAASPLTQKPDQARRRFRLGMLVFFGMLGWALLTAMNQPKLGLAMLFGVGFGLLIERAQICFTSAFRDMWITGRTHMAKAIIIGMAVSAIGIFSYVQLGVEPKIMWAGPNAVIGGLLFGFGIVLAGGCETGWMYRAVEGQVHYWWVGLGNVIGSTILAYYWDDFAPALATDWDKINLLKTFGPMGGLLVTYLLLFAALMLIIGWEKRFFRRAAPQIAKEIA

SEQ ID NO: 71024 - DNA, 1197 bp, Nitrosomonas europaea ATCC 19718
  CDS (1)..(1197): transl_table=11
atgtcccttgccgagtttcgtgcccagtatctggtgcgcttctggtctcccattccagcactgctggcactgggagtggcttccgcttattacttcgccattaccggtactttctgggctgtcactggcgaattcacccgctggggcgggcatattgccgcgctgctcggcttctccccgcagcaatggagttattttcaactgatcggcctgaacggctctccactcgaacgcatcgatggcgtcatgatcatcggcatgtttgccggtgcgttatgtgctgcgctgtgggctggcaatgtgcaactgcgctggccgaccagccggcgccggctggcgcagggactgatcggcggaatcatcgccggctttggcgcacgcctggcgatgggctgcaacctggcggccttcttcaccggtattccgatgttctcactgcacgcctgggccttcatgctgaccacggtaatcggtgcctggattggcgtaaaactctgcctgttaccgtttctgcgcacaccactgcgtctggatacggcacccagctcactattcgctgatactgccagcctggcgcgacgtgcccgcctgcaaaatcgccttggtctgctgattgccgtactggtgctgggttttgctgcctggcgctttgagacatcgctggttctgggcctggcagtactgttcggggtgtttttcggcgcggtgatcgagcgcgggcaaatctgttttaccagtgccgcgcgtgatttgtggactaccgggcgcacccgtatcgcctacggtattctgttaggcatggtggtagcctgcctcggtaccttcggcgcaattgccctgggcgcaacacccaaaatcttctggatgggccccaatgcagcccttggtggattgctgttcggtatcggtatcgtgctggccggtggttgcgaaaccggctggatgtaccgggcgatggaaggccaggtacatttctggatagttggtatcggcaacgtcatcggtggcacgctggtagccatcttctgggatgagctgggcggtacactggctctgccttatccgaaaatcaatctgctggagtacctgggagcaggcaccggcctgttactcagtctggccggcctgatgctggcgatgctgctggtatacctcaatgcccgacgttttgctgtcagagaaggccttgcacgatga

SEQ ID NO: 71025 - protein, 398 aa, Nitrosomonas europaea ATCC 19718
MSLAEFRAQYLVRFWSPIPALLALGVASAYYFAITGTFWAVTGEFTRWGGHIAALLGFSPQQWSYFQLIGLNGSPLERIDGVMIIGMFAGALCAALWAGNVQLRWPTSRRRLAQGLIGGIIAGFGARLAMGCNLAAFFTGIPMFSLHAWAFMLTTVIGAWIGVKLCLLPFLRTPLRLDTAPSSLFADTASLARRARLQNRLGLLIAVLVLGFAAWRFETSLVLGLAVLFGVFFGAVIERGQICFTSAARDLWTTGRTRIAYGILLGMVVACLGTFGAIALGATPKIFWMGPNAALGGLLFGIGIVLAGGCETGWMYRAMEGQVHFWIVGIGNVIGGTLVAIFWDELGGTLALPYPKINLLEYLGAGTGLLLSLAGLMLAMLLVYLNARRFAVREGLAR

SEQ ID NO: 71026 - DNA, 1227 bp, Helicobacter hepaticus ATCC 51449
  CDS (1)..(1227): transl_table=11
atgtttgaggatttcaagcaaagattcctagtcaaattttggtcgcctatgcccgcgattatcgcacttggcgtaatggctgcttattattttggtttgactgggacttattgggctgttacaggtgaatttacgcgttggggcggacatattatgaatcttttgggtgtggatacaagcacttggggttattttaagattctaggtttgcaaggaacaccgctagatagggtagatggcgtgatgattattggaatgtttacaggggcgtttgccgctgcggcaatggcaaataatgtcaagtttcgtttgcctcaaagcaatattagaatcgctcaagcccttatcggtgggattattgcaggatttggtgcgaggattggtatgggttgtaatttggcgagtttctttacggggattccacaatttagcttgcacgcgtggttttttacgattatgacgcttgttggtgtgtggctaggcacaaaggttgttttactctcactttttcgctctcatacaaagctagagaaagtcagtgcgcaaaaagacattggaaatagcaaagaaaatcagagtagggcaaaactcctttttgcacttggtgttttggtattagttggaattggcgtttgggtagcgtatctaatggcgtatggcaatattccagagggtaagaagattccgattttagcacttgcagttgtatttggtgtgggatttggctttatcatctcacgtgcgcagatttgctttacttctgcctttagggatttatttatcacagggcgtggatatatggcaagagcggtgattgttggaatgatggtttcaactattggcgtttttagttacattatgcttggacttccgcctaaaattatgtgggctgcgccaaatgcagtgattggcggattgctctttggctttggtattgtgattgcaggagggtgtgaatgtggctggatgtatcgcgcggttgaggggcaggtgcattattggattgtaggtgttggtaatgtcattggctctacgcttttggcagcgacttgggattattattctgtgccgcttgcgacaagcttccctaaaatcaatcttttagaatcctttggtaattatggcggcttggtggtaagctatgtgctgctttttgcattccttgcctttgtgctgtttcttgagcggcgatattttgccaaaaataaacgatttgaacgcgcataa

SEQ ID NO: 71027 - protein, 408 aa, Helicobacter hepaticus ATCC 51449
MFEDFKQRFLVKFWSPMPAIIALGVMAAYYFGLTGTYWAVTGEFTRWGGHIMNLLGVDTSTWGYFKILGLQGTPLDRVDGVMIIGMFTGAFAAAAMANNVKFRLPQSNIRIAQALIGGIIAGFGARIGMGCNLASFFTGIPQFSLHAWFFTIMTLVGVWLGTKVVLLSLFRSHTKLEKVSAQKDIGNSKENQSRAKLLFALGVLVLVGIGVWVAYLMAYGNIPEGKKIPILALAVVFGVGFGFIISRAQICFTSAFRDLFITGRGYMARAVIVGMMVSTIGVFSYIMLGLPPKIMWAAPNAVIGGLLFGFGIVIAGGCECGWMYRAVEGQVHYWIVGVGNVIGSTLLAATWDYYSVPLATSFPKINLLESFGNYGGLVVSYVLLFAFLAFVLFLERRYFAKNKRFERA

SEQ ID NO: 71028 - DNA, 1209 bp, Campylobacter jejuni RM1221
  CDS (1)..(1209): transl_table=11
ttgaattcttttaaacaaaaatatttaatcaatttttgggacaattcccgttctatgattgcacttggaattttaagtgcagtgtattttgggatttttggtggcgtttgggctgttactggagaaatgacacgttggggtggcgagtttttagagcttttaggtatgaatttagatggatattcttattaccaaaagcaaaatttaaatggaacccctttaacaagaactgatggtattatgctcataggtatgtttataggttgtttagtagccgcacttttagctaacaaagtcaaatttcgtctacctgctagcaatataagaatttttcaagcaatagtaggtggaattctttcaggatatggagcaagacttgcatttggatgcaatttagctaatttttttacaggtttaccttatttttctttacacacttggctttttactgtttttatggttttaggaatttatctaggagtgaaaatttgcaacacttccttttttaaacctaaagctaaattagaacgtgtaaataaagaaaacttgccgttaaacaagcaaagtttgcgtacaaaattatattttaacttaggcatattgcttttcatagcctttttagtttgggtgttttatcttgtttttacaaatggcaatatcagcacacaaaacaaacaaagtcttctagctttagcactgatttttggttttgtttttggctttgttatttctagagggcaaatttgttttacttcttgctttagagatttatttttatttggtagagataatgctataaaaggcgcattaatcggtatgattatcgcctctttaatcgcttttgcttttatcttgcagggtcatactagtaaactcatagaactttctcctgctgtagctgtgggagcatttttgtttggttttggtatagtttttgccggaggttgcgagtgtggttggacttatcgtgcctttgaaggacaaagtcattttataatagtaggaattgcaaatataataggaactatgattttagctttaagttatgactttttaccaaaagcttttaaagaaggtataaaaatcaatcttttaactgaatttggcaatttaaatggattttttatcaaccttattttattcatcttaatgtttgtttttgtagtattttacaaaaaacacttttttaaaaatcaacttaaaggataa

SEQ ID NO: 71029 - protein, 402 aa, Campylobacter jejuni RM1221
MNSFKQKYLINFWDNSRSMIALGILSAVYFGIFGGVWAVTGEMTRWGGEFLELLGMNLDGYSYYQKQNLNGTPLTRTDGIMLIGMFIGCLVAALLANKVKFRLPASNIRIFQAIVGGILSGYGARLAFGCNLANFFTGLPYFSLHTWLFTVFMVLGIYLGVKICNTSFFKPKAKLERVNKENLPLNKQSLRTKLYFNLGILLFIAFLVWVFYLVFTNGNISTQNKQSLLALALIFGFVFGFVISRGQICFTSCFRDLFLFGRDNAIKGALIGMIIASLIAFAFILQGHTSKLIELSPAVAVGAFLFGFGIVFAGGCECGWTYRAFEGQSHFIIVGIANIIGTMILALSYDFLPKAFKEGIKINLLTEFGNLNGFFINLILFILMFVFVVFYKKHFFKNQLKG

SEQ ID NO: 71030 - DNA, 1212 bp, Carboxydothermus hydrogenoformans Z-2901
  CDS (1)..(1212): transl_table=11
atgggcgaaattatcaaaagctattaccagaaagtaattgcggaattttgggaccaaaagactgcggtcgtacttctgggcattttaagcggcctttactttggaacagtgggcgtagtctgggcggtaaccggagaatttacccgctggggggcaagttttcttaaattaatcggagtggacttatctccttatacttatttaaaaatcatcaaatataaaggtaccgttttaacccggatagacggggtaatggtgctgggaatgtttgcgggagccttgattgcagctcttttcgggcaaaattttaaacttagaattcctactgctaaaagggtgctccaggctttaattggcggtataattgctggctttggtacccgtcttgctatgggctgtaacttggctgccctttttaccggaatacctcaattttcccttcatacctggttttttaccctgggaacaatttttggtacctatattggaataaaaattaccctctctccttattttcggggagagcccaaactggtcaaagcttcggaatttaatgcgggaaatttaaaggcaaatacccagatccaaccctttttgggctggcttggacttattgtttttgccggaattttattgtcccggccggaaatgccgaataatttaaaacttgctaccgtttttggctttgcctttggctttttaattcaaaaggggcaggtctgctttacctcagccttccgggatttatggttggttggacgcacgactacgctaaaggctctggtctggggtatggcggtgcagatgcttctgacagcggcttttatcgccaagggaacgcctgccaaagttctctgggccggtcccaatgcgttaattggtggccttttatttggtattgggattgttattgccggaggatgtgagaccggctggatgtaccgatcaatggaaggccaggttcacttctggtttgtagggttgggcaatgtgattggggcaacaatcttgttcctggtgtgggataagggggtttataaatacttagccgagccgtttccgaagtttagcttgatagaacattttggttacttaccggcctttatattgactggattattccttttagggctgtacttatgggcggatttacgggaagcaagcggcaggtcaatgataaaaaataagaccatgtcggtgaggagggtgtaa

SEQ ID NO: 71031 - protein, 403 aa, Carboxydothermus hydrogenoformans Z-2901
MGEIIKSYYQKVIAEFWDQKTAVVLLGILSGLYFGTVGVVWAVTGEFTRWGASFLKLIGVDLSPYTYLKIIKYKGTVLTRIDGVMVLGMFAGALIAALFGQNFKLRIPTAKRVLQALIGGIIAGFGTRLAMGCNLAALFTGIPQFSLHTWFFTLGTIFGTYIGIKITLSPYFRGEPKLVKASEFNAGNLKANTQIQPFLGWLGLIVFAGILLSRPEMPNNLKLATVFGFAFGFLIQKGQVCFTSAFRDLWLVGRTTTLKALVWGMAVQMLLTAAFIAKGTPAKVLWAGPNALIGGLLFGIGIVIAGGCETGWMYRSMEGQVHFWFVGLGNVIGATILFLVWDKGVYKYLAEPFPKFSLIEHFGYLPAFILTGLFLLGLYLWADLREASGRSMIKNKTMSVRRV

SEQ ID NO: 71032 - DNA, 1221 bp, Actinobacillus pleuropneumoniae serovar 1 str. 4074
  CDS (1)..(1221)
atgttagaaatttggcaacaattcaaacagacctatcttattaaattttggaatcccgttcctgccgttatcgcagccggtattctttccgcttattatttcggcctaaccggtacttattgggcggtaaccggtgaatttacccgttggggcggcgaaattttacaattattaggcgttgatgtttcaggctggggatatttcaatttcatcagcttagacggaacgattttaaaccgtatcgacggtttaatgattctcggcatgttcgccggctgtatcgccgccgcactttgggcgaataatatgaaaattcggatgccgcaaaataaaatccgtattcttcaagcgttaatcggcggagcgttagccggcttcggcgcacgtctggcgatgggttgtaatctcgcctctctgtttaccggtattccgcaattttctatgcacgcttggtatttcacgcttgctaccgcaatcgggacttacgccggggtaaaattcactttgctgccgatgttccgcccgccgcttaaattgaaaaagggtgcaggaaaagtggaagcaagtaatccgaagcaggcacaatttcgcttttggattggtgttgccgtctttactgcttggacaatcgcttcaatctatgtcttgcaatattcgattaaattgggttttgcgatgttattcggactcggcttcggtttattgatcgaacgagcgcaaatttgctttacttccgccttccgtgatctctgggtttcaggtcgttcgcatatgggcaaagcgattatttacgggatgttaatcggtacgatttgcgtattcagttacattcaattaggcatggaacctaaaattatgtgggcggggccgaatgcgattatcggcggtttattattcggcttcggtatcgtattagccggcggttgtgaaaccgggtggatgtatcgtgcaatggaaggacaagtacattttatgtgggtgggcgtcggtaatgttatcggttctaccttacttgcttacctttgggatgatctcgctccggtacttgctttagattatgaaaaaattaacctattaaaatcattcggtccggttagcggcttattgattaactatgccttaatgattgcctgccttatctttatcgtatggtgggaaaaacgctttattcgcaaagcgaaagtaagagtggcggcgaccaatacttataccattaactaa

SEQ ID NO: 71033 - protein, 406 aa, Actinobacillus pleuropneumoniae serovar 1 str. 4074
MLEIWQQFKQTYLIKFWNPVPAVIAAGILSAYYFGLTGTYWAVTGEFTRWGGEILQLLGVDVSGWGYFNFISLDGTILNRIDGLMILGMFAGCIAAALWANNMKIRMPQNKIRILQALIGGALAGFGARLAMGCNLASLFTGIPQFSMHAWYFTLATAIGTYAGVKFTLLPMFRPPLKLKKGAGKVEASNPKQAQFRFWIGVAVFTAWTIASIYVLQYSIKLGFAMLFGLGFGLLIERAQICFTSAFRDLWVSGRSHMGKAIIYGMLIGTICVFSYIQLGMEPKIMWAGPNAIIGGLLFGFGIVLAGGCETGWMYRAMEGQVHFMWVGVGNVIGSTLLAYLWDDLAPVLALDYEKINLLKSFGPVSGLLINYALMIACLIFIVWWEKRFIRKAKVRVAATNTYTIN

SEQ ID NO: 71034 - DNA, 1227 bp, Pseudomonas aeruginosa UCBPP-PA14
  CDS (1)..(1227)
atgtctgccctcaatgcgtttcgccaacgctacctggtgaggttctggtcgccgctgccggcgctggtcgccctcggcgtcgcctccgcctactacttcgcgctcaccggcaccttctgggcggtgaccggcgaattcacccgctggggcggccacgtgctgtcctggttcggctaccagccacaggactggagctacttcaggctgatcggccttcaaggcacgccgctggaccggatcgacggagtgatgatcatcggcatgttcctcggcgccctgtgctgcgccctctgggccggcaacgtcagcctgcgctggccgaccagcaaacgtcgcctgctgcagggcctggtcggcggtatcgtcgccggcttcggcgcacgcctggcgatgggctgcaacctggcggcgttcttcaccggtatcccgatgttttccctgcacgcctgggccttcatgttcgccaccgtcggcggcgcctggatcggcgtgaagatcagcctgctgccgttcctgcgcacgccgctgaaagtcggcgccacggccagcgccctgcccagcgccgaaagcctggcccgacgcgcacgcctgcaggcccgcctgggcctggcggtgctggcgctcgccgcgctgttcgccgcctggcgcttcgaggtatcgctggtgctgggcatggcctgcctgttcggcctgctgttcggcggcctgatcgagcgcgcgcagatctgcttcaccagcgccgcacgggacctctggaccacaggccggacccgcgccgccttcggcatcctgctcggcatggcggccgcctgcatcggtaccttcgccgtgatccgcctgggcgtcgcgccgaagatcttctggatgggcccgaatgcgatcatcggcggcattctcttcggcatcggcatcgtcctcgccggcggttgcgagaccggctggatgtaccgctcgatggagggccagctgcacttctgggtggtcggcatcggcaacgtcatcggcggaaccctggtggcaatcttttgggaccagttgggtacccgcctcgccctgccctatcccaagctcgacctgctggaaagcttcgggcccggcaacggcctgctgttgaccttcgccggcctggccctgtgcctgttgctggtgcaactgaacgcctcccgattcacccgaccgcggaaaccgaaccatgagccagcccgacaaaccgaccctgtcgcttga

SEQ ID NO: 71035 - protein, 408 aa, Pseudomonas aeruginosa UCBPP-PA14
MSALNAFRQRYLVRFWSPLPALVALGVASAYYFALTGTFWAVTGEFTRWGGHVLSWFGYQPQDWSYFRLIGLQGTPLDRIDGVMIIGMFLGALCCALWAGNVSLRWPTSKRRLLQGLVGGIVAGFGARLAMGCNLAAFFTGIPMFSLHAWAFMFATVGGAWIGVKISLLPFLRTPLKVGATASALPSAESLARRARLQARLGLAVLALAALFAAWRFEVSLVLGMACLFGLLFGGLIERAQICFTSAARDLWTTGRTRAAFGILLGMAAACIGTFAVIRLGVAPKIFWMGPNAIIGGILFGIGIVLAGGCETGWMYRSMEGQLHFWVVGIGNVIGGTLVAIFWDQLGTRLALPYPKLDLLESFGPGNGLLLTFAGLALCLLLVQLNASRFTRPRKPNHEPARQTDPVA

SEQ ID NO: 71036 - DNA, 1215 bp, Shewanella sp. ANA-3
  CDS (1)..(1215): transl_table=11
atgacatggcaagaatttaaacaacaatatttagtccgtttttgggcacctatgcctgcggttatcgccgccggtatcctttctacttactattttgggttaactggtactttttgggctgttacgggggaatttacgcgctggggcgggcacttactgcaattggttggtgcaaatcctgaaacttggggttatttcaaggtgattggtttacagggttctcccttagaccgtatcgacggcatgatgatcatcggcatgtttggtggttgtattgcggcggcgctgtgggcgaataacgtcaaactgcgtatgccacagagccgtatccgcatcgctcaggcgttaatcggcggcattattgctggctttggggcgcgcttggcgatgggctgtaacttagcagccttcttcactgggattccgcagttttccttacatgcgtggttttttgccctggcgacggctgcgggttcttactttggtgcgcgctttacgctactgcctatgtttcgcattccggtgaaattgaagaaagtcgataaggcgacctcggttaaacaggatgaaaaccaagcgagacgacgttttcgtatcggcatgttagtgttcgcggccattatcggctggggattactgacaatgttcaatgcgcctaagctgggtatcgctatgctctgcggtgtgggttttggtctgttgattgagcgggcacaaatctgctttacctcggcatttcgtgatatgtggatcaccgggcgcacccatatggccaaggcaattattctcggtatggcggtgagtgccatcgggatttatagctatgtgcaattaggtgtgccgcccaaaatcatgtgggccggcccgaatgcggtgattggtggcctgctgtttggatttggcattgtactggcgggtggttgtgagacgggttggatgtatcgcgccgtcgaaggccaagtgcatttctggtgggttggtttaggtaacgtactgggttcaaccctgctggcctattactgggatgatttagcccagccattagccacaagttgggacaaggttaacttgctttcaagctttggtgataagggcggtttattgctgacttatctgctgctggcgctgtcgtttgcggccatgttgctgtgggaaaaacgtttctttgcccgtaaagcgaagcgggatgaacaattgatcgcggaggcggcgtaa

SEQ ID NO: 71037 - protein, 404 aa, Shewanella sp. ANA-3
MTWQEFKQQYLVRFWAPMPAVIAAGILSTYYFGLTGTFWAVTGEFTRWGGHLLQLVGANPETWGYFKVIGLQGSPLDRIDGMMIIGMFGGCIAAALWANNVKLRMPQSRIRIAQALIGGIIAGFGARLAMGCNLAAFFTGIPQFSLHAWFFALATAAGSYFGARFTLLPMFRIPVKLKKVDKATSVKQDENQARRRFRIGMLVFAAIIGWGLLTMFNAPKLGIAMLCGVGFGLLIERAQICFTSAFRDMWITGRTHMAKAIILGMAVSAIGIYSYVQLGVPPKIMWAGPNAVIGGLLFGFGIVLAGGCETGWMYRAVEGQVHFWWVGLGNVLGSTLLAYYWDDLAQPLATSWDKVNLLSSFGDKGGLLLTYLLLALSFAAMLLWEKRFFARKAKRDEQLIAEAA

SEQ ID NO: 71038 - DNA, 1215 bp, Shewanella sp. MR-7
  CDS (1)..(1215): transl_table=11
atgacatggcaacaatttaaactacaatatttagtccgtttttgggcacctatgcctgcggttatcgccgccggtatcctttctacttactattttgggttaactggcactttttgggctgttacgggggaatttacgcgctggggcgggcacttactgcaactggtaggggcaaatcctgagacttggggttatttcaaggtgataggtttacagggctcgcccttagaccgcatcgacggcatgatgatcatcggcatgtttggtggttgtattgcggcggcgctgtgggcgaataacgtcaaactgcgtatgccacagagccgtatccgcatcgctcaggcgttaatcggcggcattattgcgggctttggtgcgcgtttggcgatgggctgtaacttagcggccttctttaccgggatcccgcagttttccttacacgcatggttttttgccctcgcgacggcggcgggctcttactttggcgcgcgttttaccctgctgcctatgtttcgcattccagtgaaattgaagaaagtcgataaggcgacgtcggttaaacaggatgaaaaccaagccagacggcgttttcgtatcggcatgttagtgtttgcggccattatcggctggggattactgactatgtttaatgcgcctaagctgggtatcgccatgctctgcggcgtgggttttggtctgctaattgagcgggcgcaaatctgctttacctcggcatttcgcgatatgtggatcaccggacgcacccatatggccaaggcgattattctcggtatggcggtgagtgccatcgggatttatagctatgtgcaattaggtgtgccgcccaaaatcatgtgggctggcccgaatgcggtgattggtggtctgctgtttggctttggcattgtgctagcgggcggttgtgagacgggttggatgtatcgcgccgtcgaaggccaagtgcatttctggtgggttggtttaggcaacgtgctgggttcaactctactggcctattactgggatgatttagcccagccattagccacaagttggggcaaggttaacttgctttcaagctttggtgataagggcggtttattgctgacctatctgctgctggcgctgtcgtttgcggccatgttgctgtgggaaaaacgtttctttgcccgtaaggcgaagcgggatgaacaactgatcgtggaggcggcgtaa

SEQ ID NO: 71039 - protein, 404 aa, Shewanella sp. MR-7
MTWQQFKLQYLVRFWAPMPAVIAAGILSTYYFGLTGTFWAVTGEFTRWGGHLLQLVGANPETWGYFKVIGLQGSPLDRIDGMMIIGMFGGCIAAALWANNVKLRMPQSRIRIAQALIGGIIAGFGARLAMGCNLAAFFTGIPQFSLHAWFFALATAAGSYFGARFTLLPMFRIPVKLKKVDKATSVKQDENQARRRFRIGMLVFAAIIGWGLLTMFNAPKLGIAMLCGVGFGLLIERAQICFTSAFRDMWITGRTHMAKAIILGMAVSAIGIYSYVQLGVPPKIMWAGPNAVIGGLLFGFGIVLAGGCETGWMYRAVEGQVHFWWVGLGNVLGSTLLAYYWDDLAQPLATSWGKVNLLSSFGDKGGLLLTYLLLALSFAAMLLWEKRFFARKAKRDEQLIVEAA

SEQ ID NO: 71040 - DNA, 1215 bp, Shewanella sp. MR-4
  CDS (1)..(1215): transl_table=11
atgacatggcaacaatttaaacaacaatatttagtccgtttttgggctcctatgcctgcggttatcgccgccggtatcctttctacttactattttgggttaactggcactttttgggctgtcacgggggaatttacgcgctggggcgggcacttactgcaactggtgggtgctaatcctgagacttggggttatttcaaggtgataggtttacagggctctcccttagaccgcatcgacggcatgatgatcatcggcatgtttggtggttgtattgcggcggcgctgtgggcgaataacgttaagctgcgtatgccacagagccgtatccgcatcgctcaggcacttatcggcggcattattgcgggctttggtgcgcgtttggcgatgggctgtaacttagcggccttcttcaccggtattccgcagttttccttacacgcatggttttttgccctcgcgacggcggcgggctcttactttggcgcgcgttttacgctactgcccatgttccgcattccagtgaaattgaagaaagtcgataaggcgacgtcggttaaacaggatgaaaaccaagccagacggcgttttcgcatcggcatgttagtgttcgcggccattattggttggggattactgaccatgttcaacgcgcctaaattgggtatcgccatgctctgtggcgtgggtttcggcctgttgattgagcgggcgcaaatctgctttacctcggcatttcgcgatatgtggatcaccggacgcacccatatggccaaggcgattattctcggtatggcggtgagtgccatcgggatttatagctatgtgcaattaggtgtgccgcccaaaatcatgtgggctggcccgaatgcggtgattggtggcctgctgtttggctttggcattgtgctggcaggtggttgtgagacgggttggatgtatcgcgccgtcgaaggccaagtgcatttctggtgggttggtttaggcaacgtgctgggttcaaccctgctggcctattactgggatgatttagcccagccattagccacaagttgggacaaggttaacctgctctctagctttggcgataagggcggtttattgctgacctatctgctgctggcgctgtcgtttgcggccatgttgctgtgggaaaaacgtttctttgcccgtaaggcgaagcgggatgaacaactgatcgcggaggcggcgtaa

SEQ ID NO: 71041 - protein, 404 aa, Shewanella sp. MR-4
MTWQQFKQQYLVRFWAPMPAVIAAGILSTYYFGLTGTFWAVTGEFTRWGGHLLQLVGANPETWGYFKVIGLQGSPLDRIDGMMIIGMFGGCIAAALWANNVKLRMPQSRIRIAQALIGGIIAGFGARLAMGCNLAAFFTGIPQFSLHAWFFALATAAGSYFGARFTLLPMFRIPVKLKKVDKATSVKQDENQARRRFRIGMLVFAAIIGWGLLTMFNAPKLGIAMLCGVGFGLLIERAQICFTSAFRDMWITGRTHMAKAIILGMAVSAIGIYSYVQLGVPPKIMWAGPNAVIGGLLFGFGIVLAGGCETGWMYRAVEGQVHFWWVGLGNVLGSTLLAYYWDDLAQPLATSWDKVNLLSSFGDKGGLLLTYLLLALSFAAMLLWEKRFFARKAKRDEQLIAEAA

SEQ ID NO: 71042 - DNA, 1155 bp, Campylobacter jejuni
  CDS (1)..(1155): transl_table=11
atgattgcacttggaattttaagcgcagtgtattttgggatttttggtggcgtttgggctgttactggagaaatgacgcgttggggcggtgaatttttagaacttttaggtatgaatttagatggatattcttattaccaaaagcaaaatttaaatggaacccctttaacaagaactgatggtattatgctcataggtatgtttataggttgtttagtagccgcacttttagctaacaaagtcaaatttcgtctacctgctagcaatataagaatttttcaagcaatagtaggtggaattctttcaggatatggagcaagacttgcatttggatgcaatttagctaatttttttacaggtttaccttatttttctttacacacttggctttttactgtttttatggttttaggaatttatctaggagtaaaaatttgcaacacttccttttttaaacctaaagctaaattagaacgggtaaataaagaaaacttgccgctaaacaagcaaagtttgcgtacaaaactatattttaacttaggcatattgcttttcatggcctttttagtttgggtgttttatcttgtttttacaaatggcaatatcagcacacaaaacaaacaaagtcttctagctttagcactgatttttggttttgtttttggctttattatttctagaggacaaatttgttttacttcttgctttagagatttatttttatttggtagagataatgctataaaaggcgcattaattggcatgattatcgcttctttaatcgcttttgcttttatcttgcaaggtcatactagcaaactcatagaactttctcctgctgtagctgtgggagcatttttgtttggttttggcatagtttttgccggaggttgtgagtgtggttgggcttatcgtgcctttgaagggcaaagtcattttatgatagtaggaattgcaaatataataggaactatgattttagccttaagttatgactttttaccaaaggctcttaaagaaggtgtaaaaatcaatcttttaactgaatttggaaatttaaatggattttttatcaaccttattttattcatcttaatgtttgcttttgtggtattttataaaaaacacttctttaaaaatcaacttaaaggataa

SEQ ID NO: 71043 - protein, 384 aa, Campylobacter jejuni
MIALGILSAVYFGIFGGVWAVTGEMTRWGGEFLELLGMNLDGYSYYQKQNLNGTPLTRTDGIMLIGMFIGCLVAALLANKVKFRLPASNIRIFQAIVGGILSGYGARLAFGCNLANFFTGLPYFSLHTWLFTVFMVLGIYLGVKICNTSFFKPKAKLERVNKENLPLNKQSLRTKLYFNLGILLFMAFLVWVFYLVFTNGNISTQNKQSLLALALIFGFVFGFIISRGQICFTSCFRDLFLFGRDNAIKGALIGMIIASLIAFAFILQGHTSKLIELSPAVAVGAFLFGFGIVFAGGCECGWAYRAFEGQSHFMIVGIANIIGTMILALSYDFLPKALKEGVKINLLTEFGNLNGFFINLILFILMFAFVVFYKKHFFKNQLKG

SEQ ID NO: 71044 - DNA, 1206 bp, Salmonella typhimurium
  CDS (1)..(1206): transl_table=11
atgtcatggcaacacttcaagcaaacctggttaattaaattctgggcgccggcccctgcggtgatcgcagccggtattctctctacctactattttggcatcaccggcacgttttgggccgtgacgggcgaatttacccgctggggcgggcaaattttgcagctttttggcgttcatgccgaacagtggggctactacaagctgattcatctggaaggtacgccgctgacgcgtatcgacggcatgatgatcctcggcatgttcggcggctgtttcgccgcggcgctgtgggccaacaacgtaaaactgcgtatgccgcgcagccgaatccgtatcgtacaggcggtggccggaggcattatcgctggcttcggcgcgcgtctggcgatggggtgtaacctggccgccttttttaccgggatcccgcagttctccctacacgcgtggttctttgcgctggcgaccgctatcggctcctggttcggcgcccgctttacgttgctgccgatatttcgcataccggtgaaaatgcagaaggtctccgcggcttcgccactgacgcagaaaccggatcaggcaagacggcgtttcaggctcggtatgctggtctttatcggcatgattggctgggcgttattaacggcaatgcatcagccgaaactggggctggcgatgctgttcggcgtcgggtttgggctgctgatcgaacgcgcgcaaatctgctttacctcggcctttcgcgatctgtggatctccggacgcgcccatatggcgaaagcgattattttcggcatggcggtcagcgccattggtattttcagctacgtgcagttgggcgttgcacctaaaattatgtgggctggcccgaatgcggtcattggcggactgctgttcggttttggcatcgtgctggcgggcggctgcgaaaccggctggatgtaccgcgccgtagaaggccaggtgcattactggtgggtaggcctcggcaatgtcatcggttcgaccatcctggcttactactgggatgatttcgcgcccgcgctggcgaccagttgggataaagttaacctgctgaatacctttggtccgctgggcggtctgctggtcacctatctgttgttatttaccgcgctgatgttaatcatcggctgggaaaaacgttttttccgccgtgcggggctgacgcctgctaaggaatctgtatga

SEQ ID NO: 71045 - protein, 401 aa, Salmonella typhimurium
MSWQHFKQTWLIKFWAPAPAVIAAGILSTYYFGITGTFWAVTGEFTRWGGQILQLFGVHAEQWGYYKLIHLEGTPLTRIDGMMILGMFGGCFAAALWANNVKLRMPRSRIRIVQAVAGGIIAGFGARLAMGCNLAAFFTGIPQFSLHAWFFALATAIGSWFGARFTLLPIFRIPVKMQKVSAASPLTQKPDQARRRFRLGMLVFIGMIGWALLTAMHQPKLGLAMLFGVGFGLLIERAQICFTSAFRDLWISGRAHMAKAIIFGMAVSAIGIFSYVQLGVAPKIMWAGPNAVIGGLLFGFGIVLAGGCETGWMYRAVEGQVHYWWVGLGNVIGSTILAYYWDDFAPALATSWDKVNLLNTFGPLGGLLVTYLLLFTALMLIIGWEKRFFRRAGLTPAKESV

SEQ ID NO: 71046 - DNA, 23 bp, Artificial sequence
  primer
atgtcatggcagcaattcaaaca

SEQ ID NO: 71047 - DNA, 25 bp, Artificial sequence
  primer
ttatgcgatctccttagcagtctgc

SEQ ID NO: 71048 - protein, 396 aa, Artificial sequence
  consensus sequence
  Variant (2)..(5): Xaa in position 2 to 5 is any amino acid
  Variant (7)..(8): Xaa in position 7 to 8 is any amino acid
  Variant (11)..(14): Xaa in position 11 to 14 is any amino acid
  Variant (16)..(16): Xaa in position 16 is any amino acid
  Variant (19)..(19): Xaa in position 19 is any amino acid
  Variant (24)..(25): Xaa in position 24 to 25 is any amino acid
  Variant (29)..(30): Xaa in position 29 to 30 is any amino acid
  Variant (32)..(33): Xaa in position 32 to 33 is any amino acid
  Variant (46)..(47): Xaa in position 46 to 47 is any amino acid
  Variant (49)..(49): Xaa in position 49 is any amino acid
  Variant (51)..(51): Xaa in position 51 is any amino acid
  Variant (53)..(59): Xaa in position 53 to 59 is any amino acid
  Variant (61)..(65): Xaa in position 61 to 65 is any amino acid
  Variant (67)..(67): Xaa in position 67 is any amino acid
  Variant (69)..(69): Xaa in position 69 is any amino acid
  Variant (72)..(72): Xaa in position 72 is any amino acid
  Variant (74)..(74): Xaa in position 74 is any amino acid
  Variant (77)..(77): Xaa in position 77 is any amino acid
  Variant (79)..(80): Xaa in position 79 to 80 is any amino acid
  Variant (84)..(84): Xaa in position 84 is any amino acid
  Variant (86)..(88): Xaa in position 86 to 88 is any amino acid
  Variant (92)..(92): Xaa in position 92 is any amino acid
  Variant (98)..(98): Xaa in position 98 is any amino acid
  Variant (100)..(100): Xaa in position 100 is any amino acid
  Variant (102)..(102): Xaa in position 102 is any amino acid
  Variant (104)..(104): Xaa in position 104 is any amino acid
  Variant (108)..(108): Xaa in position 108 is any amino acid
  Variant (111)..(112): Xaa in position 111 to 112 is any amino acid
  Variant (116)..(116): Xaa in position 116 is any amino acid
  Variant (131)..(131): Xaa in position 131 is any amino acid
  Variant (138)..(138): Xaa in position 138 is any amino acid
  Variant (143)..(143): Xaa in position 143 is any amino acid
  Variant (145)..(145): Xaa in position 145 is any amino acid
  Variant (147)..(149): Xaa in position 147 to 149 is any amino acid
  Variant (151)..(152): Xaa in position 151 to 152 is any amino acid
  Variant (154)..(156): Xaa in position 154 to 156 is any amino acid
  Variant (158)..(161): Xaa in position 158 to 161 is any amino acid
  Variant (163)..(165): Xaa in position 163 to 165 is any amino acid
  Variant (168)..(170): Xaa in position 168 to 170 is any amino acid
  Variant (172)..(190): Xaa in position 172 to 190 is any amino acid
  Variant (191)..(194): Xaa in position 191 to 194 is any or no amino acid
  Variant (196)..(197): Xaa in position 196 to 197 is any amino acid
  Variant (199)..(199): Xaa in position 199 is any amino acid
  Variant (201)..(218): Xaa in position 201 to 218 is any amino acid
  Variant (219)..(227): Xaa in position 219 to 227 is any or no amino acid
  Variant (229)..(230): Xaa in position 229 to 230 is any amino acid
  Variant (232)..(234): Xaa in position 232 to 234 is any amino acid
  Variant (236)..(237): Xaa in position 236 to 237 is any amino acid
  Variant (240)..(241): Xaa in position 240 to 241 is any amino acid
  Variant (243)..(243): Xaa in position 243 is any amino acid
  Variant (245)..(245): Xaa in position 245 is any amino acid
  Variant (256)..(259): Xaa in position 256 to 259 is any amino acid
  Variant (262)..(265): Xaa in position 262 to 265 is any amino acid
  Variant (267)..(270): Xaa in position 267 to 270 is any amino acid
  Variant (273)..(285): Xaa in position 273 to 285 is any amino acid
  Variant (287)..(289): Xaa in position 287 to 289 is any amino acid
  Variant (291)..(292): Xaa in position 291 to 292 is any amino acid
  Variant (294)..(295): Xaa in position 294 to 295 is any amino acid
  Variant (299)..(300): Xaa in position 299 to 300 is any amino acid
  Variant (303)..(303): Xaa in position 303 is any amino acid
  Variant (311)..(311): Xaa in position 311 is any amino acid
  Variant (317)..(317): Xaa in position 317 is any amino acid
  Variant (324)..(324): Xaa in position 324 is any amino acid
  Variant (328)..(328): Xaa in position 328 is any amino acid
  Variant (330)..(332): Xaa in position 330 to 332 is any amino acid
  Variant (335)..(335): Xaa in position 335 is any amino acid
  Variant (338)..(338): Xaa in position 338 is any amino acid
  Variant (341)..(341): Xaa in position 341 is any amino acid
  Variant (343)..(343): Xaa in position 343 is any amino acid
  Variant (346)..(347): Xaa in position 346 to 347 is any amino acid
  Variant (350)..(353): Xaa in position 350 to 353 is any amino acid
  Variant (354)..(355): Xaa in position 354 to 355 is any or no amino acid
  Variant (358)..(361): Xaa in position 358 to 361 is any amino acid
  Variant (363)..(363): Xaa in position 363 is any amino acid
  Variant (367)..(368): Xaa in position 367 to 368 is any amino acid
  Variant (371)..(373): Xaa in position 371 to 373 is any amino acid
  Variant (375)..(395): Xaa in position 375 to 395 is any amino acid
FXXXXLXXFWXXXXAXIAXGILSXXYFGXXGXXWAVTGEFTRWGGXXLXLXGXXXXXXXYXXXXXLXGXPLXRXDGXMXXGMFXGXXXAALXANNVKXRXPXSXIRIXQAXXGGIXAGFGARLAMGCNLAXFFTGIPXFSLHXWXFXXXTXXGXXXGXXXXLXXXFRXXXKXXXXXXXXXXXXXXXXXXXXXXXFXXGXLXXXXXXXXXXXXXXXXXXXXXXXXXXXLXXAXXXGXXFGXXIXRXQICFTSAFRDXXXXGRXXXXKXXXXGMXXXXXXXXXXXXXGXXXKXXWXXPNAXXGGXLFGFGIVXAGGCEXGWMYRAXEGQXHXXXVGXGNXIGXTXLAXXWDXXXXXXLAXXXXKXNLLXXFGXXXGXXXXXXXXXXXXXXXXXXXXXF

SEQ ID NO: 71049 - protein, 58 aa, Artificial sequence
  protein pattern
  Variant (2)..(3): Xaa in position 2 to 3 is any amino acid
  Variant (7)..(7): Xaa in position 7 is Ala, Ile, Leu or Val
  Variant (8)..(8): Xaa in position 8 is Ile or Leu
  Variant (11)..(11): Xaa in position 11 is any or no amino acid
  Variant (13)..(13): Xaa in position 13 is any or no amino acid
  Variant (16)..(16): Xaa in position 16 is Phe or Ile
  Variant (20)..(20): Xaa in position 20 is Ile or Leu
  Variant (26)..(26): Xaa in position 26 is Cys or Thr
  Variant (32)..(32): Xaa in position 32 is Ala or Ser
  Variant (33)..(33): Xaa in position 33 is Met or Val
  Variant (35)..(35): Xaa in position 35 is Gly or Val
  Variant (37)..(37): Xaa in position 37 is Ile, Leu or Val
  Variant (39)..(39): Xaa in position 39 is Phe or Tyr
  Variant (40)..(41): Xaa in position 40 to 41 is any amino acid
  Variant (44)..(44): Xaa in position 44 is Ile, Leu or Val
  Variant (47)..(47): Xaa in position 47 is Ile or Val
  Variant (48)..(48): Xaa in position 48 is Ile or Leu
  Variant (50)..(50): Xaa in position 50 is Ala, Gly or Ser
  Variant (52)..(52): Xaa in position 52 is Ile or Leu
  Variant (53)..(53): Xaa in position 53 is Leu or Val
  Variant (54)..(56): Xaa in position 54 to 56 is any amino acid
WXXPNAXXGGXLXFGXGIVXAGGCEXGWMYRXXEXQXHXXXVGXGNXXGXTXXXXXWD

SEQ ID NO: 71050 - protein, 40 aa, Artificial sequence
  protein pattern
  Variant (4)..(4): Xaa in position 4 is any amino acid
  Variant (7)..(7): Xaa in position 7 is Ile, Leu or Val
  Variant (8)..(8): Xaa in position 8 is Ala, Ile or Val
  Variant (11)..(11): Xaa in position 11 is any amino acid
  Variant (12)..(12): Xaa in position 12 is Ile or Leu
  Variant (13)..(13): Xaa in position 13 is Ala or Ser
  Variant (15)..(15): Xaa in position 15 is Phe or Tyr
  Variant (19)..(19): Xaa in position 19 is Ile or Leu
  Variant (20)..(20): Xaa in position 20 is Ala or Gly
  Variant (21)..(21): Xaa in position 21 is Phe or Met
  Variant (27)..(27): Xaa in position 27 is Ala, Asn or Ser
  Variant (28)..(28): Xaa in position 28 is Phe or Leu
  Variant (32)..(32): Xaa in position 32 is Ile or Leu
  Variant (34)..(34): Xaa in position 34 is any amino acid
  Variant (37)..(37): Xaa in position 37 is Leu or Met
  Variant (39)..(39): Xaa in position 39 is Ala or Thr
IRIXQAXXGGXXXGXGARXXXGCNLAXXFTGXPXFSXHXW

SEQ ID NO: 71051 - protein, 61 aa, Artificial sequence
  protein pattern
  Variant (2)..(2): Xaa in position 2 is Ala or Thr
  Variant (3)..(3): Xaa in position 3 is any amino acid
  Variant (6)..(6): Xaa in position 6 is Ala or Gly
  Variant (7)..(7): Xaa in position 7 is Ile or Leu
  Variant (8)..(8): Xaa in position 8 is any amino acid
  Variant (10)..(10): Xaa in position 10 is Gly or Thr
  Variant (11)..(11): Xaa in position 11 is any amino acid
  Variant (18)..(18): Xaa in position 18 is Phe or Met
  Variant (24)..(24): Xaa in position 24 is any amino acid
  Variant (25)..(25): Xaa in position 25 is any or no amino acid
  Variant (27)..(29): Xaa in position 27 to 29 is any amino acid
  Variant (30)..(30): Xaa in position 30 is any or no amino acid
  Variant (32)..(33): Xaa in position 32 to 33 is any amino acid
  Variant (34)..(34): Xaa in position 34 is Ala, Leu, Pro or Val
  Variant (35)..(35): Xaa in position 35 is Asp, Glu, Gln or Ser
  Variant (36)..(36): Xaa in position 36 is Asp, Glu, Gly, Gln or Thr
  Variant (37)..(37): Xaa in position 37 is Trp or Tyr
  Variant (38)..(38): Xaa in position 38 is Gly or Ser
  Variant (40)..(40): Xaa in position 40 is Phe or Tyr
  Variant (41)..(44): Xaa in position 41 to 44 is any amino acid
  Variant (46)..(46): Xaa in position 46 is Asp, Glu, Asn or Gln
  Variant (48)..(48): Xaa in position 48 is Ser or Thr
  Variant (49)..(49): Xaa in position 49 is Ile or Pro
  Variant (51)..(51): Xaa in position 51 is Asp, Asn or Thr
  Variant (53)..(53): Xaa in position 53 is any amino acid
  Variant (56)..(56): Xaa in position 56 is any or no amino acid
  Variant (58)..(58): Xaa in position 58 is Ile, Leu or Met
  Variant (59)..(59): Xaa in position 59 is Ile or Leu
SXXYFXXXGXXWAVTGEXTRWGGXXLXXXXGXXXXXXXYXXXXXLXGXXLXRXDGXMXXGM

SEQ ID NO: 71052 - protein, 55 aa, Artificial sequence
  protein pattern
  Variant (3)..(4): Xaa in position 3 to 4 is any or no amino acid
  Variant (6)..(6): Xaa in position 6 is Phe or Leu
  Variant (7)..(7): Xaa in position 7 is Ile, Leu or Val
  Variant (9)..(9): Xaa in position 9 is Glu or Ser
  Variant (11)..(11): Xaa in position 11 is Ala or Gly
  Variant (18)..(18): Xaa in position 18 is Ala or Cys
  Variant (22)..(22): Xaa in position 22 is Leu or Met
  Variant (23)..(23): Xaa in position 23 is Phe or Trp
  Variant (24)..(24): Xaa in position 24 is Ile, Leu or Val
  Variant (25)..(25): Xaa in position 25 is any amino acid
  Variant (28)..(28): Xaa in position 28 is Ala, Asp, Gly, Ser or Thr
  Variant (29)..(30): Xaa in position 29 to 30 is any amino acid
  Variant (31)..(31): Xaa in position 31 is Ala, Gly or Ile
  Variant (32)..(32): Xaa in position 32 is Lys or Arg
  Variant (33)..(33): Xaa in position 33 is Ala or Gly
  Variant (34)..(34): Xaa in position 34 is Ala, Ile or Val
  Variant (35)..(35): Xaa in position 35 is Ile or Leu
  Variant (36)..(36): Xaa in position 36 is any amino acid
  Variant (39)..(39): Xaa in position 39 is any amino acid
  Variant (40)..(40): Xaa in position 40 is Ile or Val
  Variant (41)..(41): Xaa in position 41 is Ala, Gly or Ser
  Variant (42)..(42): Xaa in position 42 is Ala, Ser or Thr
  Variant (43)..(43): Xaa in position 43 is Ile or Leu
  Variant (44)..(44): Xaa in position 44 is any amino acid
  Variant (45)..(45): Xaa in position 45 is Ala, Ile or Val
  Variant (46)..(46): Xaa in position 46 is Phe or Tyr
  Variant (47)..(47): Xaa in position 47 is Ala or Ser
  Variant (48)..(48): Xaa in position 48 is Phe or Tyr
  Variant (49)..(49): Xaa in position 49 is Ile or Val
  Variant (50)..(51): Xaa in position 50 to 51 is any amino acid
  Variant (53)..(54): Xaa in position 53 to 54 is any amino acid
  Variant (55)..(55): Xaa in position 55 is Pro or Ser
GFXXGXXIXRXQICFTSXFRDXXXXGRXXXXXXXXXGMXXXXXXXXXXXXXGXXX

SEQ ID NO: 71053 - protein, 29 aa, Artificial sequence
  protein pattern
  Variant (2)..(4): Xaa in position 2 to 4 is any amino acid
  Variant (5)..(5): Xaa in position 5 is any or no amino acid
  Variant (7)..(7): Xaa in position 7 is Ala, Ile, Leu or Val
  Variant (8)..(8): Xaa in position 8 is any amino acid
  Variant (10)..(10): Xaa in position 10 is Ala, Ser, Thr or Val
  Variant (11)..(11): Xaa in position 11 is Trp or Tyr
  Variant (12)..(12): Xaa in position 12 is any amino acid
  Variant (14)..(14): Xaa in position 14 is any amino acid
  Variant (15)..(15): Xaa in position 15 is Lys or Arg
  Variant (16)..(16): Xaa in position 16 is Phe, Ile, Leu or Val
  Variant (17)..(17): Xaa in position 17 is Cys, Ser, Thr or Val
  Variant (19)..(20): Xaa in position 19 to 20 is any amino acid
  Variant (21)..(21): Xaa in position 21 is any or no amino acid
  Variant (23)..(23): Xaa in position 23 is any or no amino acid
  Variant (25)..(27): Xaa in position 25 to 27 is any amino acid
  Variant (28)..(28): Xaa in position 28 is Lys or Arg
  Variant (29)..(29): Xaa in position 29 is Leu, Met or Val
FXXXXTXXGXXXGXXXXLXXXFXRXXXXX

SEQ ID NO: 71054 - protein, 30 aa, Artificial sequence
  protein pattern
  Variant (2)..(2): Xaa in position 2 is any amino acid
  Variant (3)..(3): Xaa in position 3 is any or no amino acid
  Variant (5)..(8): Xaa in position 5 to 8 is any amino acid
  Variant (9)..(9): Xaa in position 9 is any or no amino acid
  Variant (11)..(11): Xaa in position 11 is Ile or Val
  Variant (15)..(15): Xaa in position 15 is any amino acid
  Variant (16)..(16): Xaa in position 16 is Glu, Ser or Thr
  Variant (19)..(20): Xaa in position 19 to 20 is any amino acid
  Variant (21)..(21): Xaa in position 21 is any or no amino acid
  Variant (23)..(23): Xaa in position 23 is any amino acid
  Variant (24)..(24): Xaa in position 24 is Phe, Leu or Val
  Variant (25)..(25): Xaa in position 25 is Ile, Leu or Val
  Variant (26)..(26): Xaa in position 26 is Asn, Ser, Thr or Val
  Variant (27)..(28): Xaa in position 27 to 28 is any amino acid
  Variant (30)..(30): Xaa in position 30 is Phe, Leu or Met
PXXAXXXXXKXNLLXXFGXXXGXXXXXXLX

SEQ ID NO: 71055 - protein, 22 aa, Artificial sequence
  protein pattern
  Variant (2)..(2): Xaa in position 2 is Ala, Gly, Ile or Leu
  Variant (4)..(4): Xaa in position 4 is Ala or Cys
  Variant (5)..(5): Xaa in position 5 is Phe, Ile or Leu
  Variant (6)..(6): Xaa in position 6 is Ala, Cys or Val
  Variant (7)..(7): Xaa in position 7 is Ala or Cys
  Variant (10)..(10): Xaa in position 10 is any amino acid
  Variant (12)..(12): Xaa in position 12 is any or no amino acid
  Variant (14)..(14): Xaa in position 14 is any or no amino acid
  Variant (16)..(16): Xaa in position 16 is any amino acid
  Variant (17)..(17): Xaa in position 17 is Phe or Leu
  Variant (19)..(19): Xaa in position 19 is any amino acid
  Variant (21)..(21): Xaa in position 21 is any amino acid
FXGXXXXALXAXNXVXXRXPXS

SEQ ID NO: 71056 - protein, 19 aa, Artificial sequence
  protein pattern
  Variant (2)..(3): Xaa in position 2 to 3 is any amino acid
  Variant (4)..(6): Xaa in position 4 to 6 is any or no amino acid
  Variant (8)..(8): Xaa in position 8 is Ile or Val
  Variant (9)..(9): Xaa in position 9 is any amino acid
  Variant (12)..(12): Xaa in position 12 is Ala, Asp, Asn or Ser
  Variant (13)..(13): Xaa in position 13 is Asn or Pro
  Variant (14)..(15): Xaa in position 14 to 15 is any amino acid
  Variant (16)..(16): Xaa in position 16 is Ala or Ser
  Variant (17)..(17): Xaa in position 17 is Ile, Leu, Met or Val
  Variant (18)..(18): Xaa in position 18 is Ile or Val
QXXXXXLXXFWXXXXXXXA

SEQ ID NO: 71057 - DNA, 1470 bp, Escherichia coli K12; identical to SEQ ID NO: 17135
  CDS (1)..(1470): transl_table=11

SEQ ID NO: 71058 - protein, 489 aa, Escherichia coli K12; identical to SEQ ID NO: 17136

SEQ ID NO: 71059 - DNA, 1494 bp, Staphylococcus aureus
  CDS (1)..(1494)
atgtcaaaagttcaaaatgaaagtaacaatgttgtcaaaaggggacttaaagatcgtcatatttctatgattgcgattgggggttgtattggtacaggtttatttgtaacttctggtggagcaattcatgatgcaggtgctttgggagcattaataggatacgcaattatcggaataatggtatttttcttaatgacgtcacttggcgaaatggctacttatttgccagtatcaggttcatttagtacatatgctacaagatttgttgatccatctttagggtttgcgcttggttggaactattggtttaactgggtagtaactgtagcagcagatattacgattgcagcacaagtcattcaatattggacaccattgcaaggcatacccgcttgggcgtggagtgcattgttcttagttataatttttagtctgaattctttatcggttcgtgtctatggtgaaagtgaatattggcttgcattaataaaggttgttacagttatcgtttttattgctattggtttattaacgattgtaggaattatgggtggacattttgtaggatttgaaatatttaataaaggtgaaggacctattttaggtggcaacctaggaggaagtttgttatcaattctaggtgtattcttaatcgctggtttctcattccaaggtactgagttaattggtattacggctggtgaatcagaaaatcctgaacgtgctgtgccgaaagcgattaaacaagtattctggagaattgtattattttacattttagccatttttgttatcggtatgttaattccttatgatagtagtgcattaatgggaggcggtaatgacgttgcaacctctccgttaacgctagttttcaaaaatgcaggatttgcttttgcagcctcatttatgaatgctgttatcttaacatcagttttatcagcaggaaactctggaatgtatgcctcaacgcgtatgctttattcaatgagtaaagataaattggcgtttgaaacatttgggaaaacaaataaaaatggtgtgccatatatgtctttattagtaactgcaattattgtagtcatcatatttgtggtacaaagtgttacagaaggtgcttatcaatatatcgttgctgcaagtgggttaactggctttattgcctgggtaggtatcgcagtgagtcattatcgatttagaagagcatttgataaacaaaattatgataaatctaaattgaaatatacagctaaattgtttccgttcggacctatttttgcagcaatcttatgtattgttgtaatcatcggtcaagatgtggactttattaaaacaggagattttaattttagccgcttcctaattacgtatatgggaattccagtatttttagcattctttatttatcataagcttcgatataaaacgaaaaaaattccattagaacaagtagatttacgtcaagacgtatcaatggatgaaataaaaggttaa

SEQ ID NO: 71060 - protein, 497 aa, Staphylococcus aureus
MSKVQNESNNVVKRGLKDRHISMIAIGGCIGTGLFVTSGGAIHDAGALGALIGYAIIGIMVFFLMTSLGEMATYLPVSGSFSTYATRFVDPSLGFALGWNYWFNWVVTVAADITIAAQVIQYWTPLQGIPAWAWSALFLVIIFSLNSLSVRVYGESEYWLALIKVVTVIVFIAIGLLTIVGIMGGHFVGFEIFNKGEGPILGGNLGGSLLSILGVFLIAGFSFQGTELIGITAGESENPERAVPKAIKQVFWRIVLFYILAIFVIGMLIPYDSSALMGGGNDVATSPLTLVFKNAGFAFAASFMNAVILTSVLSAGNSGMYASTRMLYSMSKDKLAFETFGKTNKNGVPYMSLLVTAIIVVIIFVVQSVTEGAYQYIVAASGLTGFIAWVGIAVSHYRFRRAFDKQNYDKSKLKYTAKLFPFGPIFAAILCIVVIIGQDVDFIKTGDFNFSRFLITYMGIPVFLAFFIYHKLRYKTKKIPLEQVDLRQDVSMDEIKG

SEQ ID NO: 71061 - DNA, 1470 bp, Salmonella typhi
  CDS (1)..(1470)
  misc_feature <991>..<991>: n is a, c, g, or t
  misc_feature <992>..<992>: n is a, c, g, or t
  misc_feature <993>..<993>: n is a, c, g, or t
  misc_feature <1252>..<1252>: n is a, c, g, or t
atgggttccaaaactaaaaccacagaagcgcccgcgctacgtcgcgaattaaaggcgcgtcacctgacgatgattgccattggcggctccatcgggacaggtcttttcgttgcatctggtgcgacaatttctctggcggggccaggcggcgcgctgttttcttatattctgattggtttgatggtctacttcctgatgaccagtcttggcgagctggcggcctatatgccggtatctggctcgtttgcgacatatggtcagaactatgtggaagaaggctttggtttcgcgctgggctggaactactggtacaactgggcggtgactatcgctgttgacctggttgccgcacaattggtgatgggctggtggttcccggacacgccgggctggatctggagcgcgctattcctctgcgtcattttcttgctgaactacatttctgtacgcggttttggcgaggcggagtactggttctcgttaattaaagtcgcgaccgttattatcttcatcatcgttggcgtagcgatgattatcggcatctttaaaggtgtcgagccggtcggctggagcaactggacgacgggcgatgcgcctttcgctggcggttttgcggcaatgattggcgtcgcgatgatcgtgggcttctctttccagggaactgagctgattggtattgccgccggggaatctgaaaacccggagaagaatattccgcgcgcggtgcgtcaggtgttctggcgtattctgctgttttatgttttcgcgattttgattatcagcctgatcattccttataccgatccaaacctgctgcgtaacgacgtcaaagacattagcgtcagtccgtttaccttagtgttccagcatgcgggcttgttgtctgcggcggcgataatgaatgcggttatcctgacggcggtactgtctgcgggtaactccgggatgtatgcctcgacccgtatgctctacaccctggcctgtgacggtnnngccccgcgtatttttgcgaaattgtcccgcggcggcgtaccgcgcaatgcgctttatgccaccaccgtgattgccggtctttgctttttgacctcaatgttcggcaaccagacggtctatctgtggctgttgaacacctccggtatgacgggcttcatcgcctggctggggattgccattagccattatcgcttccgtcgcggttacgtgttacaagggtatgatgtgaatgatttgccgtaccgttccgggttcttcncgctggggccgattttcgcctttgtactgtgcctgattattacgttggggcagaactatgaagcgttcctgaaagataccatcgactggggcggcgtcgcggcgacctatatcggtattccgctgttcctgcttatctggttcggctacaagctgataaaaggcacgcatttcgtgcgctatagcgaaatgcacttcccggaacgcgttaaaaagtaa

SEQ ID NO: 71062 - protein, 489 aa, Salmonella typhi
  misc_feature <331>..<331>: The Xaa at location 331 stands for    , Ala, Arg, Asn, Asp, Cys, Gln, Glu, Gly, His, Ile, Leu, Lys, M et, Phe, Pro, Ser, Thr, Trp, Tyr, or Val.
  misc_feature <418>..<418>: The Xaa at location 418 stands for Ala, Pro, Ser, or Thr.
MGSKTKTTEAPALRRELKARHLTMIAIGGSIGTGLFVASGATISLAGPGGALFSYILIGLMVYFLMTSLGELAAYMPVSGSFATYGQNYVEEGFGFALGWNYWYNWAVTIAVDLVAAQLVMGWWFPDTPGWIWSALFLCVIFLLNYISVRGFGEAEYWFSLIKVATVIIFIIVGVAMIIGIFKGVEPVGWSNWTTGDAPFAGGFAAMIGVAMIVGFSFQGTELIGIAAGESENPEKNIPRAVRQVFWRILLFYVFAILIISLIIPYTDPNLLRNDVKDISVSPFTLVFQHAGLLSAAAIMNAVILTAVLSAGNSGMYASTRMLYTLACDGXAPRIFAKLSRGGVPRNALYATTVIAGLCFLTSMFGNQTVYLWLLNTSGMTGFIAWLGIAISHYRFRRGYVLQGYDVNDLPYRSGFFXLGPIFAFVLCLIITLGQNYEAFLKDTIDWGGVAATYIGIPLFLLIWFGYKLIKGTHFVRYSEMHFPERVKK

SEQ ID NO: 71063 - DNA, 1521 bp, Lactococcus lactis; IL1403; identical to SEQ ID NO: 17143
  CDS (1)..(1521)

SEQ ID NO: 71064 - protein, 506 aa, Lactococcus lactis; IL1403
LSLSQTSRCRINFIRERILENSSNSTTETQVKRGLKSRHVSMIALGGTIGTGLFLTSGDVIHTAGPFGALTAYVLIGAMVYFLMTSLGEMATYLPTSGSFSDYGTRYVDPAFGFALGWNYWLNWAITVAVDLTAVALCIKFWLPDVPSWIFSLIALIIVFAINALSVKTFGETEYWLSAIKITVVVLFLIIGFLSIFGIMGGHIDVAKNLSVGNHGFVGGLGSFTTGGGILGVLLVAGFSFQGTELLGITAGEAENPEKSIPKAMNSIFWRILVFYILSIFVMAAIIPFTDPHLVGGNSAAQSPFTIVFERVGLSIAASIMNAVVLTSVVSAANSGMYASTRMLYSLAKDGGAPKIFSKTSKNGIPFIALLATTAIALLTFLTSIYGVSFFTFLVSASGLTGFIAWIGIAISHFRFRRAYVAQGKDVKKLPYHAKLFPFGPILALIMTVLVTLGQDPMLLFGKTWVQGVIMYAAIPLFFILYLGYKFKNKTKLIPLKEVDLSRHKD

SEQ ID NO: 71065 - DNA, 1464 bp, Pseudomonas aeruginosa PAO1; identical to SEQ ID NO: 17137
  CDS (1)..(1464): transl_table=11

SEQ ID NO: 71066 - protein, 487 aa, Pseudomonas aeruginosa PAO1; identical to SEQ ID NO: 17138

SEQ ID NO: 71067 - DNA, 1521 bp, Lactococcus lactis subsp. lactis Il1403; identical to SEQ ID NO: 17143
  CDS (1)..(1521): transl_table=11

SEQ ID NO: 71068 - protein, 506 aa, Lactococcus lactis subsp. lactis Il1403; identical to SEQ ID NO: 17144

SEQ ID NO: 71069 - DNA, 1470 bp, Clostridium acetobutylicum ATCC 824; identical to SEQ ID NO: 17145
  CDS (1)..(1470): transl_table=11

SEQ ID NO: 71070 - protein, 489 aa, Clostridium acetobutylicum ATCC 824; identical to SEQ ID NO: 17146

SEQ ID NO: 71071 - DNA, 1476 bp, Clostridium acetobutylicum ATCC 824; identical to SEQ ID NO: 17147
  CDS (1)..(1476): transl_table=11

SEQ ID NO: 71072 - protein, 491 aa, Clostridium acetobutylicum ATCC 824; identical to SEQ ID NO: 17148

SEQ ID NO: 71073 - DNA, 1494 bp, Staphylococcus aureus subsp. aureus Mu50; identical to SEQ ID NO: 17151
  CDS (1)..(1494): transl_table=11

SEQ ID NO: 71074 - protein, 497 aa, Staphylococcus aureus subsp. aureus Mu50; identical to SEQ ID NO: 17152

SEQ ID NO: 71075 - DNA, 1470 bp, Salmonella enterica subsp. enterica serovar Typhi str. CT18; identical to SEQ ID NO: 17189
  CDS (1)..(1470): transl_table=11

SEQ ID NO: 71076 - protein, 489 aa, Salmonella enterica subsp. enterica serovar Typhi str. CT18; identical to SEQ ID NO: 17190

SEQ ID NO: 71077 - DNA, 1470 bp, Salmonella typhimurium LT2
  CDS (1)..(1470): transl_table=11
atgggttccaaaactaaaaccacagaagcgcccgcgctacgtcgcgaattaaaggcgcgtcacctgacgatgattgccattggcggctccatcgggacaggtcttttcgttgcatctggtgcgacaatttctcaggcggggccaggcggcgcgctgttttcttatattctgattggtttgatggtctacttcctgatgaccagtcttggcgagctggcggcctatatgccagtatctggctcgtttgcgacatatggtcagaactatgtggaagaaggctttggtttcgcgctgggctggaactactggtacaactgggcggtgactatcgctgttgacctggttgccgcgcaattggtgatgggctggtggttcccggacacgccgggctggatctggagcgcgctattcctctgtgtcattttcttgctgaactacatttctgtacgcggttttggcgaggcggagtactggttctcgttaattaaagtcgcgaccgttattatcttcatcatcgttggcgtagcgatgattatcggcatttttaaaggtgtcgagccggtcggctggagcaactggacgacgggcgatgcgcctttcgctggcggttttgcggcaatgattggcgtcgcgatgatcgtgggcttctctttccagggaactgagctgattggtattgccgccggggaatctgaaaacccggagaagaatattccacgcgcggtgcgtcaggtgttctggcgtattctgctgttttatgttttcgcgattttgattatcagcctgatcattccttataccgatccaaacctgctgcgtaacgacgtcaaagacattagcgtcagtccgtttaccttagtgttccagcatgcgggcttgttgtctgcggcggcgataatgaatgcggttatcctgacggcggtactgtctgcgggtaactccgggatgtatgcctcgacccgtatgctctacaccctggcctgtgacggtaaggccccgcgtatttttgcgaaattgtcccgcggcggcgtaccgcgcaatgcgctttatgccaccaccgtgattgccggtctttgctttttgacctcaatgtttggcaaccagacggtctatctgtggctgttaaacacctccggtatgacgggcttcatcgcctggctggggattgccattagccattatcgcttccgtcgcggttacgtgttacaagggtatgatgtgaatgatttgccgtaccgttccgggttcttcccgctggggccgattttcgcctttgtactgtgcctgattattacgttggggcagaactatgaagcgttcctgaaagataccatcgactggggcggcgtcgcggcgacctatatcggtattccgctgttcctgcttatctggttcggctacaagctgataaaaggtacgcatttcgtgcgctatagcgaaatgcacttcccggaacgcgttaaaaagtaa

SEQ ID NO: 71078 - protein, 489 aa, Salmonella typhimurium LT2; identical to SEQ ID NO: 17290

SEQ ID NO: 71079 - DNA, 1461 bp, Listeria monocytogenes EGD-e; identical to SEQ ID NO: 17157
  CDS (1)..(1461): transl_table=11

SEQ ID NO: 71080 - protein, 486 aa, Listeria monocytogenes EGD-e; identical to SEQ ID NO: 17158

SEQ ID NO: 71081 - DNA, 1461 bp, Listeria innocua Clip11262; identical to SEQ ID NO: 17159
  CDS (1)..(1461): transl_table=11

SEQ ID NO: 71082 - protein, 486 aa, Listeria innocua Clip11262; identical to SEQ ID NO: 17160

SEQ ID NO: 71083 - DNA, 1530 bp, Ralstonia solanacearum GMI1000; identical to SEQ ID NO: 17161
  CDS (1)..(1530): transl_table=11

SEQ ID NO: 71084 - protein, 509 aa, Ralstonia solanacearum GMI1000; identical to SEQ ID NO: 17162

SEQ ID NO: 71085 - DNA, 1539 bp, Ralstonia solanacearum GMI1000; identical to SEQ ID NO: 17163
  CDS (1)..(1539): transl_table=11

SEQ ID NO: 71086 - protein, 512 aa, Ralstonia solanacearum GMI1000; identical to SEQ ID NO: 17164

SEQ ID NO: 71087 - DNA, 1470 bp, Clostridium perfringens str. 13; identical to SEQ ID NO: 17165
  CDS (1)..(1470): transl_table=11

SEQ ID NO: 71088 - protein, 489 aa, Clostridium perfringens str. 13; identical to SEQ ID NO: 17166

SEQ ID NO: 71089 - DNA, 1512 bp, Yersinia pestis KIM
  CDS (1)..(1512): transl_table=11
atgactcagcaaaatactaaaatcccagcgcagcagggtgcacagcgcttacgccgggagcttaaatcgcggcatttagccatgattgctatcggtggttctattggtaccggtttatttgttgcctctggtgcaacggtatcgcaagccggtccagggggggcattgctctcctacgcattgattggcttgatggtttacttcctgatgaccagcttgggagaattggctgcgttcatgccagtttcaggctcattctctacttatggttctaaatatgtcgaggaaggctttggctttgccctaggttggaactactggtacaactgggcggtaaccatcgcagttgacttggtagccgcacagttagtgatgaactactggttcccggacgcgcccggttggatctggagtgctttattcctgggcctgatgttcttactgaactacatctcagtgaaaggtttcggtgaagcggaatattggttctcgctgattaaagtgacaaccgtggttatcttcatcatcgttggtgtcatgatgatcaccggtatcatgaaagggggcgaaacggcgggttggcataactggactatcggtgatgcaccatttgctggtggtttctctgccatgattggggtggccatgatcgtcggcttctccttccaagggactgaattgattggtattgcggctggggaatccaaagatccaggcaaaaatattccaaaggcaattcgcaaagtgttctggcgtattctgttgttctatatcttcgctattctgattattagcctgattattccgtataccgatcccagtttgttacgcaacgatgtgaaagatatcagcgtcagcccgttcacactggtattccagaatgcgggtctgttatcagcagcggcagtgatgaatgcggttattttgaccgctgttttatcggcgggtaactcggggatgtatgcctcgacccgtatgctgtttaccttagcctctgaaggcaaagcaccgcgtattttcgccaagttatctaagggcggtgtccctcgtaatgcgctgtatgccacgacagtcgttgcaggtttgtgcttcctgagctccatgtttggtaaccaaactgtgtatttgtggttactgaatacctcggggatgactgggtttatcgcctggttgggtattgccatcagccactaccgcttccgtcggggctatatgatgcagggccgtgacttgaacgacttaccgtatcagtctggtttcttccctctggggccaatttttgccttcgtcctgtgtctaatcatcacgttaggccagaattatcaggcattcctgcaagaccgtattgattggtatggcgtgacggcaacctatattggtattccattgttcctggtgatttggtttggctataagctcagccgtggtacccgggtagtgaaataccaagagatggaattcccaaaatggcgtgatgagagtgaagagcatcagaaaccgacaagtcggtga

SEQ ID NO: 71090 - protein, 503 aa, Yersinia pestis KIM; identical to SEQ ID NO: 17270

SEQ ID NO: 71091 - DNA, 1470 bp, Shigella flexneri 2a str. 301
  CDS (1)..(1470): transl_table=11
atgggttccgaaactaaaactacagaagcgccgggcttacgccgtgaattaaaggcgcgtcacctgacgatgattgccattggcggttccatcggtacaggtctttttgttgcctctggcgcaacgatttctcaggcaggtccgggcggggcattgctctcgtatatgctgattggcctgatggtttacttcctgatgaccagtctcggtgaattggctgcatatatgccggtttccggttcgtttgccacttacggtcagaactatgttgaagaaggctttggcttcgcgctgggctggaactactggtacaactgggcggtgactattgccgttgacctggttgcagcacagctggtcatgagctggtggttcccggatacaccgggctggatctggagtgcgttgttcctcggcgttatcttcctgttgaactacatctctgttcgcggctttggtgaagcggaatactggttctcactgatcaaagtcacgacagttattgtctttatcatcgttggcgtgctgatgattatcggtatcttcaaaggcgcgcagcctgcgggctggagcaactggacaatcggcgaagcgccgtttgctggtggttttgcggcgatgatcggcgtagctatgattgtcggcttctctttccagggaaccgagctgatcggtattgctgcaggcgagtccgaagatccggcgaaaaacattccacgcgcggtacgtcaggtattctggcgaatcctgttgttctatgtgttcgcgatcctgattatcagcctgattattccgtataccgatccgagcctgctgcgtaacgatgttaaagacatcagcgtcagtccgttcaccctggtgttccagcacgcgggtctgctctctgcggcggcggtgatgaacgcagttattctgacggcggtgctgtcagcaggtaactccggtatgtatgcgtctactcgtatgctgtacaccctggcgtgtgacggtaaagcgccgcgcattttcgctaaattgtcgcgtggtggcgtgccgcgtaatgcgctgtatgcgacgacggtgattgccggtttgtgcttcctgacctccatgtttggcaaccagacggtatacctgtggctgctgaacacctccgggatgacgggttttatcgcctggctggggattgccattagccactatcgcttccgtcgcggttacgtattgcagggacacgacattaacgatctgccgtaccgttcaggtttcttcccactggggccgatcttcgcattcattctgtgtctgattatcactttgggccagaactacgaagcgttcctgaaagataccattgactggggcggcgtagcggcaacgtatattggtatcccgctgttcctgattatttggttcggctacaagctgattaaaggaactcacttcgtacgctacagcgaaatgaagttcccgcagaacgataagaaataa

SEQ ID NO: 71092 - protein, 489 aa, Shigella flexneri 2a str. 301
MGSETKTTEAPGLRRELKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGFSFQGTELIGIAAGESEDPAKNIPRAVRQVFWRILLFYVFAILIISLIIPYTDPSLLRNDVKDISVSPFTLVFQHAGLLSAAAVMNAVILTAVLSAGNSGMYASTRMLYTLACDGKAPRIFAKLSRGGVPRNALYATTVIAGLCFLTSMFGNQTVYLWLLNTSGMTGFIAWLGIAISHYRFRRGYVLQGHDINDLPYRSGFFPLGPIFAFILCLIITLGQNYEAFLKDTIDWGGVAATYIGIPLFLIIWFGYKLIKGTHFVRYSEMKFPQNDKK

SEQ ID NO: 71093 - DNA, 1452 bp, Lactobacillus plantarum WCFS1; identical to SEQ ID NO: 17185
  CDS (1)..(1452): transl_table=11

SEQ ID NO: 71094 - protein, 483 aa, Lactobacillus plantarum WCFS1; identical to SEQ ID NO: 17186

SEQ ID NO: 71095 - DNA, 1476 bp, Bacillus cereus ATCC 14579; identical to SEQ ID NO: 17197
  CDS (1)..(1476): transl_table=11

SEQ ID NO: 71096 - protein, 491 aa, Bacillus cereus ATCC 14579; identical to SEQ ID NO: 17198

SEQ ID NO: 71097 - DNA, 1467 bp, Bacillus anthracis str. Ames; identical to SEQ ID NO: 17237
  CDS (1)..(1467): transl_table=11

SEQ ID NO: 71098 - protein, 488 aa, Bacillus anthracis str. Ames; identical to SEQ ID NO: 17238

SEQ ID NO: 71099 - DNA, 1575 bp, Bordetella parapertussis 12822; identical to SEQ ID NO: 17199
  CDS (1)..(1575): transl_table=11

SEQ ID NO: 71100 - protein, 524 aa, Bordetella parapertussis 12822; identical to SEQ ID NO: 17200

SEQ ID NO: 71101 - DNA, 1575 bp, Bordetella bronchiseptica RB50; identical to SEQ ID NO: 17201
  CDS (1)..(1575): transl_table=11

SEQ ID NO: 71102 - protein, 524 aa, Bordetella bronchiseptica RB50; identical to SEQ ID NO: 17202

SEQ ID NO: 71103 - DNA, 1527 bp, Chromobacterium violaceum ATCC 12472; identical to SEQ ID NO: 17203
  CDS (1)..(1527): transl_table=11

SEQ ID NO: 71104 - protein, 508 aa, Chromobacterium violaceum ATCC 12472; identical to SEQ ID NO: 17204

SEQ ID NO: 71105 - DNA, 1482 bp, Photorhabdus luminescens subsp. laumondii TTO1; identical to SEQ ID NO: 17205
  CDS (1)..(1482): transl_table=11

SEQ ID NO: 71106 - protein, 493 aa, Photorhabdus luminescens subsp. laumondii TTO1; identical to SEQ ID NO: 17206

SEQ ID NO: 71107 - DNA, 1467 bp, Bacillus cereus ATCC 10987; identical to SEQ ID NO: 17215
  CDS (1)..(1467): transl_table=11

SEQ ID NO: 71108 - protein, 488 aa, Bacillus cereus ATCC 10987; identical to SEQ ID NO: 17216

SEQ ID NO: 71109 - DNA, 1461 bp, Listeria monocytogenes str. 4b F2365; identical to SEQ ID NO: 17233
  CDS (1)..(1461): transl_table=11

SEQ ID NO: 71110 - protein, 486 aa, Listeria monocytogenes str. 4b F2365; identical to SEQ ID NO: 17234

SEQ ID NO: 71111 - DNA, 1467 bp, Bacillus anthracis str. Sterne; identical to SEQ ID NO: 17243
  CDS (1)..(1467): transl_table=11

SEQ ID NO: 71112 - protein, 488 aa, Bacillus anthracis str. Sterne; identical to SEQ ID NO: 17244

SEQ ID NO: 71113 - DNA, 1467 bp, Bacillus thuringiensis serovar konkukian str. 97-27; identical to SEQ ID NO: 17249
  CDS (1)..(1467): transl_table=11

SEQ ID NO: 71114 - protein, 488 aa, Bacillus thuringiensis serovar konkukian str. 97-27; identical to SEQ ID NO: 17250

SEQ ID NO: 71115 - DNA, 1494 bp, Staphylococcus aureus subsp. aureus MRSA252; identical to SEQ ID NO: 17253
  CDS (1)..(1494): transl_table=11

SEQ ID NO: 71116 - protein, 497 aa, Staphylococcus aureus subsp. aureus MRSA252; identical to SEQ ID NO: 17254

SEQ ID NO: 71117 - DNA, 1464 bp, Acinetobacter sp. ADP1; identical to SEQ ID NO: 17259
  CDS (1)..(1464): transl_table=11

SEQ ID NO: 71118 - protein, 487 aa, Acinetobacter sp. ADP1; identical to SEQ ID NO: 17260

SEQ ID NO: 71119 - DNA, 1476 bp, Erwinia carotovora subsp. atroseptica SCRI1043; identical to SEQ ID NO: 17263
  CDS (1)..(1476): transl_table=11

SEQ ID NO: 71120 - protein, 491 aa, Erwinia carotovora subsp. atroseptica SCRI1043; identical to SEQ ID NO: 17264

SEQ ID NO: 71121 - DNA, 1425 bp, Propionibacterium acnes KPA171202; identical to SEQ ID NO: 17267
  CDS (1)..(1425): transl_table=11

SEQ ID NO: 71122 - protein, 474 aa, Propionibacterium acnes KPA171202; identical to SEQ ID NO: 17268

SEQ ID NO: 71123 - DNA, 1563 bp, Burkholderia mallei ATCC 23344; identical to SEQ ID NO: 17281
  CDS (1)..(1563): transl_table=11

SEQ ID NO: 71124 - protein, 520 aa, Burkholderia mallei ATCC 23344; identical to SEQ ID NO: 17282

SEQ ID NO: 71125 - DNA, 1503 bp, Staphylococcus epidermidis RP62A; identical to SEQ ID NO: 17295
  CDS (1)..(1503): transl_table=11

SEQ ID NO: 71126 - protein, 500 aa, Staphylococcus epidermidis RP62A; identical to SEQ ID NO: 17296

SEQ ID NO: 71127 - DNA, 1521 bp, Ralstonia eutropha JMP134; identical to SEQ ID NO: 17309
  CDS (1)..(1521): transl_table=11

SEQ ID NO: 71128 - protein, 506 aa, Ralstonia eutropha JMP134; identical to SEQ ID NO: 17310

SEQ ID NO: 71129 - DNA, 1581 bp, Burkholderia sp. 383
  CDS (1)..(1581): transl_table=11
atgcattcagatgcccgccccgattcaccccgtccgtccggctcgccgcccgcgaagccgacccttcaccgtgcactgcaggcacgccatctgcgaatgatcgcgatcggcggttcgatcggcacgggcctgttcgtcgcgtccggcgcgtcgatctcgcaggccggccccggcggcgcgatgctcgcgtacatggtgatcggcctgatggtctatttcctgatgacgagcctgggcgaaatggccgcgttcatgccggtgtcgggttcattcgcgacctacggcgcgaagttcgtcgacgaaggcttcggcttcgcgctcggctggaactactggtacagctgggccgtgacattggctgtggagctcgtcgccgggcagctcgtgatgaactactggttcccgcatgtgcccggcgtctggtggagcgcgctgttcctcacgctgatcttcgcgctcaacgcgctgtcggtacgcggttttggcgaagccgaatactggttcgcgctgatcaaggtgctgacggtgctcgcgttcgtcggcgtcggcctgctgatgatcttcgggatcatgcagggcggcccgagcgcgggctggggcaacttcacgatcggcgacgcgccgttcgccggcggctgggcgacgatgctcggcgtcgcgatgatcgcgggattctcgttccaaggcaccgaaatgatcggtgtcgcggccggcgaatcggaaaacccgcgcacgacgatcccgcgcgcggtgagccagatcttctggcgcatcctgctgttctacgtgttcgcgatcttcgtgatcggcgtgctgattccctataccgatccgagcctgctgaagagcgacgtgaccgacatcggcgtgagcccgttcacgctcgtgttccgccacgcgggcctcgcattcgcggccggcgtgatgaacgcggtgatcctgacggccgtgctgtcggccggcaactcgggcatgtacgcgtccacgcggatgctctacaacctcgcggtcgaaggccgtgcgccgaagatcttcgcgaagctgtcgcgcggcggcgtgccgcgcaatgcgctgtatgcgacgacggccgtcggcgcgctgtgtttcctcacgtcgctgtacggcgacaagaccgtgtacctgtggctgctgaacacgtcgggaatggccggcttcatcacgtggctcggcatcgcggtcagccactaccgcttccgcaagggcttcctgaagcagggctaccggctcgaccagctgccgtaccggtcgaagtggttcccgttcggcccgctgttcgcgttcgcgctgtgcgcggtcgtcgcgctcggccaggattaccaggcgttcttctccgacaagatcgactgggtcgccgtcgccgcgacctacatcggcctgccgttcttcctcgcgatctggctcggctacgcgctcgtgcgcaaatgccgcctcgtgcgctacgaagacatggagatcgcgccgtggatcgaacgcaacgcgacgcccgaacccgccccgcaggctgaaaccggctacgcaggctacgtcgcccgcccggccaacccgacgccgggcgcctga

SEQ ID NO: 71130 - protein, 526 aa, Burkholderia sp. 383
MHSDARPDSPRPSGSPPAKPTLHRALQARHLRMIAIGGSIGTGLFVASGASISQAGPGGAMLAYMVIGLMVYFLMTSLGEMAAFMPVSGSFATYGAKFVDEGFGFALGWNYWYSWAVTLAVELVAGQLVMNYWFPHVPGVWWSALFLTLIFALNALSVRGFGEAEYWFALIKVLTVLAFVGVGLLMIFGIMQGGPSAGWGNFTIGDAPFAGGWATMLGVAMIAGFSFQGTEMIGVAAGESENPRTTIPRAVSQIFWRILLFYVFAIFVIGVLIPYTDPSLLKSDVTDIGVSPFTLVFRHAGLAFAAGVMNAVILTAVLSAGNSGMYASTRMLYNLAVEGRAPKIFAKLSRGGVPRNALYATTAVGALCFLTSLYGDKTVYLWLLNTSGMAGFITWLGIAVSHYRFRKGFLKQGYRLDQLPYRSKWFPFGPLFAFALCAVVALGQDYQAFFSDKIDWVAVAATYIGLPFFLAIWLGYALVRKCRLVRYEDMEIAPWIERNATPEPAPQAETGYAGYVARPANPTPGA

SEQ ID NO: 71131 - DNA, 1533 bp, Burkholderia sp. 383
  CDS (1)..(1533): transl_table=11
atggatgcattgcaagcggcagcggagacggccgcaccgtccggaacggcgctgaagcgccgtctgcagggccgccacatcgcgatgattgcgatcggcggctcgatcggtacggggctgttcgtcgcgtcgggggcgtcggtcgcgcaggcggggccgggcggagcgatcgccgcgtatatcgcgatcgggctgatggtgtacttcgtcgtcacgggcctcggcgagatggccgcgctgatgccggtatcgggctcgtttgcgatctacggcgagaagtacgtcgacgaaggcttcggcgtcgcgcttggctggacctactggtacagctgggccgtgacgatcgcgatcgagctggtcgccgcgcagatcgtgatgcgctactggtttccgaccatacccggcatctggtggggcgcgggcttcctcgtgctgatcttcctgctgaacacgctgtcggtacgcggtttcggcgaatcggaatactggttctcgctgatcaaggtcgtcaccgtggtcgcgttcatcgcagccgggctgctgatcgcggccggcctgatcgggaacgggcatccggtcggcatgcgcaacttcacgacgggtgacgcgccgttcgtcggcggtgtgcacgcgatgatgagcgtcgcgctgatcgcgggcttctcgtttctcggcaccgagctggtcgggatcaccgccggtgaatcggaaaacccgcgcaagacgatcccgcgcgcggtgaagcagatcttctggcggatcatgctgttctacgtgttcgcgatcttcgtgatcggcctgctggtgccgtacaccgacccgaacctgctgaagagcgacgtgaccgacatcggcgtgagcccgttcacgctggtgttcagccatgcgggtttccggctcgcggctggcgcaatgaatctcgtgatcctgacggccgtgctgtcggccggcaattccggcacctacgcggccacgcggatgctgtacaacctcgcggcggaagggcgcgcgccggcgatgttcgcgacgctgtcgccgggcggcgtgccgcgcaatgcgctgtacgcgacgatggccgtcggcgggctgtgcttcctcacgtcgctgaccaacaaccagagcatctatctgtggctgctgaatacggtcggtatcacgggcttcatcgcgtggctcggcatcgcggtctgccattaccggttccgcaaggggttcctgaagcagggctacaggctcgatcagctgccgtaccgtgcgaaatggtttccgttcgggccgctgttcgcgatcgcgatctgcatcgtgatctcgctcgggcaggattaccaggcgttcttcgcggcccgcatcgactggatggaagtgctgtcgatctacgtgtggattccgctgttcgtcgcgatctggtgggcgtatcgccgtgcgcgcaagagccggctcgtgcgctacgaggagatggacatcgggccgtggctgacgcgttcggtcgaggccgtcgatgcgacggtcacgcagcacgggcagccgcactga

SEQ ID NO: 71132 - protein, 510 aa, Burkholderia sp. 383
MDALQAAAETAAPSGTALKRRLQGRHIAMIAIGGSIGTGLFVASGASVAQAGPGGAIAAYIAIGLMVYFVVTGLGEMAALMPVSGSFAIYGEKYVDEGFGVALGWTYWYSWAVTIAIELVAAQIVMRYWFPTIPGIWWGAGFLVLIFLLNTLSVRGFGESEYWFSLIKVVTVVAFIAAGLLIAAGLIGNGHPVGMRNFTTGDAPFVGGVHAMMSVALIAGFSFLGTELVGITAGESENPRKTIPRAVKQIFWRIMLFYVFAIFVIGLLVPYTDPNLLKSDVTDIGVSPFTLVFSHAGFRLAAGAMNLVILTAVLSAGNSGTYAATRMLYNLAAEGRAPAMFATLSPGGVPRNALYATMAVGGLCFLTSLTNNQSIYLWLLNTVGITGFIAWLGIAVCHYRFRKGFLKQGYRLDQLPYRAKWFPFGPLFAIAICIVISLGQDYQAFFAARIDWMEVLSIYVWIPLFVAIWWAYRRARKSRLVRYEEMDIGPWLTRSVEAVDATVTQHGQPH

SEQ ID NO: 71133 - DNA, 1536 bp, Burkholderia sp. 383
  CDS (1)..(1536): transl_table=11
atgtccgcaattccgaaatccgacccatccggttcgtcagcgaaccctcccaagcttcatcgcgcgctgaaggcgcgccacctgacgatgatcgccatcggcggctcgatcggcacgggcctgttcgtcgcgtccggcgcgtcgatctcgcaggccggccccggcggcgcgatggtcgcgtacatggcgatcggcctgatggtctacttcctgatgacgagcctcggcgaaatggccgcgttcatgccggtgtcgggttcgttcgcgacctacggcgcgaaatacgtcgacgaaggcttcggcttcgcgctcggctggaactactggtacaactgggccgtgacgatcgcggtggagctggtcgccgcgcagctcgtgatgcattactggtttcccgacgtgccgggcgtgtggtggagcgcggcgttcctcggcgtgatgttcctgctcaacgcgctgaccgtgcgcggctttggtgaagccgaatactggttcgcgctgatcaaggtcgtcaccgtggtcgcgttcatcggcgtcggcctgctgatgatcttcggcattctgaagggcgcgccgagcaacggctggggcaacctgacgatcggcgacgcaccgttcgcgggcggcctgccggcgctgatgggcgtcgcgatgatcgccggcttctcgttccagggcaccgagctgatcggcgtcgcggccggcgaatcggaaaacccgcgcacgacgatcccgcgcgcggtgcgccaggtgttctggcggatcctgctgttctacgtgttcgcgatcttcgtgatcggcgtgctgattccctataccgacccgaacctgctgaagacggacgtgaccgacatcggcgtgagcccgttcacgctcgtgttccgccacgcgggcctcgcctttgccgccggcgtgatgaacgcggtgatcctgacggccgtgctgtcggccggcaactcgggcatgtatgcgtccacgcggatgctctacaacctcgcaaccgaaggccgtgcaccgaagatcttcgcgaagctgtcgcgcggtggtgtgccgcgcaacgcgctgtacgcgacgacggccgtcggcgcgctgtgcttcttcacgtcgctgtacggcgacaagaccgtgtacctgtggctgctgaacacgtcggggatgacgggcttcatcgcgtggctcggcatcgcggtcagccactaccggttccgcaagggctacgtgaagcagggctactcgctcgaccagctgccgtaccagtcgaagtggttcccgttcggcccgctgttcgcgttcgtgctgtgtctcgtgatcgcgctcgggcaggactatcaggcattcctcgcgaaccggatcgactgggccggcgtggccgcgacctatgtcggcattccgctgttcctcgtcgtgtggctcggcttccggttcctgaagaagagccgcctggtgcgctacgaagacatggaaatcgcgccgtggatcgccgcgggccgcggtgcgcagcagcagccggtggcgaaccgcgaaaccgcgggctga

SEQ ID NO: 71134 - protein, 511 aa, Burkholderia sp. 383
MSAIPKSDPSGSSANPPKLHRALKARHLTMIAIGGSIGTGLFVASGASISQAGPGGAMVAYMAIGLMVYFLMTSLGEMAAFMPVSGSFATYGAKYVDEGFGFALGWNYWYNWAVTIAVELVAAQLVMHYWFPDVPGVWWSAAFLGVMFLLNALTVRGFGEAEYWFALIKVVTVVAFIGVGLLMIFGILKGAPSNGWGNLTIGDAPFAGGLPALMGVAMIAGFSFQGTELIGVAAGESENPRTTIPRAVRQVFWRILLFYVFAIFVIGVLIPYTDPNLLKTDVTDIGVSPFTLVFRHAGLAFAAGVMNAVILTAVLSAGNSGMYASTRMLYNLATEGRAPKIFAKLSRGGVPRNALYATTAVGALCFFTSLYGDKTVYLWLLNTSGMTGFIAWLGIAVSHYRFRKGYVKQGYSLDQLPYQSKWFPFGPLFAFVLCLVIALGQDYQAFLANRIDWAGVAATYVGIPLFLVVWLGFRFLKKSRLVRYEDMEIAPWIAAGRGAQQQPVANRETAG

SEQ ID NO: 71135 - DNA, 1563 bp, Burkholderia thailandensis E264
  CDS (1)..(1563): transl_table=11
atgtcaccacacccgaattccgacaactcaaccgcacaatcgaatcctcctcagctgcgccgcagcctgaaagcccgtcacctgacgatgatcgcgatcggcggctcgatcggcacgggcctgttcgtcgcgtccggcgcgtccatctcgcaggcgggccccggcggcgcggtgctcgcctatctgctgatcggcctgatggtctactgcctgatgatgagtctcggcgagatggccgcgttcatgccggtgtcgggctcgttcgcgacgtacggcgcgaaatacgtcgaggaaggcttcggcttcgcgctcggctggaactactggtacaactgggcggtgacgatcgcggtcgagctcgtcgccgcgcagctcgtcatgcattactggtttcccgacgtgccgggcgtctggtggagcgccgcgttcctcggcgtgatgttcctcctcaacgtgctgaccgtgcgcggcttcggcgaggccgaatactggttcgcgctcatcaaggtcgtcaccgtgctcgcattcatcggcgtcggcctgctgatgatcttcggcatcctgaagggcggcccgagcaacggctggagcaacttcacgatcggcgacgcgccgttcgcgggcggcttgcccgcgatgatgggcgtcgcgatgatcgccggcttctcgttccagggcaccgagctgatcggcgtggccgccggcgaatcggaaaacccgcgcacgacgattccgcgcgcggtgcgtcaggtgttctggcgcatcctgctgttctacgtgctcgcgatcttcgtgatcggcgtgctggttccctacaccgatccgaacctgctgaagagcgacgtgaccgacgtcggcgtgagcccgtttacgctcgtgttccgacacgcgggcctcgcgttcgccgccggcgtgatgaacgcggtgattctgaccgccgtgctgtcggcgggcaactcggggatgtacgcgtcgacgcggatgctccacaacctcgcgaccgaaggccgcgcgccgaagctgttcgcgaagctctcggcgggcggcgtgccgcgcaacgcactgtacgcgacgaccgcggtcggcgcgctgtgcttcctgtcgtcgctatacggcgacaagacggtgtatctgtggctgctgaacacatcggggatgacgggcttcatcgcgtggctcggcatcgcgctcagccactaccgtttccgcaagggctacgtgcgccagggcttctcggtcgaccagctgccgtatcagtcgaatctgtacccgtacggcccgatcttcgcgttcgcgctgtgcatcgtgatcgcgctcggccaggactatcaggcgttcctcgcgaacaagatcgactgggtcggcgtgctcgcgacctacgtcggcattccgctcttcctcgtcgtgtggctcggctatcggctcgtccacaagacgcgcttcgtcggttacgaagacatggacatcgcgtcgtgggtggccgagcacgagcgcgcggcggcgcacgaagcacgcgaagcggcggccattcgcgtgccgtcgagccccgaagcggcttcataa

SEQ ID NO: 71136 - protein, 520 aa, Burkholderia thailandensis E264
MSPHPNSDNSTAQSNPPQLRRSLKARHLTMIAIGGSIGTGLFVASGASISQAGPGGAVLAYLLIGLMVYCLMMSLGEMAAFMPVSGSFATYGAKYVEEGFGFALGWNYWYNWAVTIAVELVAAQLVMHYWFPDVPGVWWSAAFLGVMFLLNVLTVRGFGEAEYWFALIKVVTVLAFIGVGLLMIFGILKGGPSNGWSNFTIGDAPFAGGLPAMMGVAMIAGFSFQGTELIGVAAGESENPRTTIPRAVRQVFWRILLFYVLAIFVIGVLVPYTDPNLLKSDVTDVGVSPFTLVFRHAGLAFAAGVMNAVILTAVLSAGNSGMYASTRMLHNLATEGRAPKLFAKLSAGGVPRNALYATTAVGALCFLSSLYGDKTVYLWLLNTSGMTGFIAWLGIALSHYRFRKGYVRQGFSVDQLPYQSNLYPYGPIFAFALCIVIALGQDYQAFLANKIDWVGVLATYVGIPLFLVVWLGYRLVHKTRFVGYEDMDIASWVAEHERAAAHEAREAAAIRVPSSPEAAS

SEQ ID NO: 71137 - DNA, 1494 bp, Staphylococcus aureus subsp. aureus NCTC 8325
  CDS (1)..(1494): transl_table=11
atgtcaaaagttcaaaatgaaagtaacaatgttgtcaaaaggggacttaaagatcgtcatatttctatgattgcgattgggggttgtattggtacaggtttatttgtaacttctggtggagcaattcatgatgcaggtgctttgggtgcattaataggatacgcaattatcggaataatggtatttttcttaatgacgtcacttggcgaaatggctacgtatttgccagtatcaggttcatttagtacatatgctacaagatttgttgatccatctttagggtttgcgcttggttggaactattggtttaactgggtagtgactgtagcagcagatattacgattgcagcacaagtcattcaatattggacaccattgcaaggcatacccgcttgggcatggagtgcgttgttcttagttataatttttagtctgaattcgttatcagttcgcgtctatggtgaaagtgaatactggttggcattgataaaagtggttacagttattgttttcattgcaattggtttattaacgattgtcggaatcatgggtggtcatgttgtaggattcgaaatatttaataaaggtgaaggtccaattcttggtggcaacttaggaggaagtttgttatcaattctaggtgtattcttaatcgctggtttctcattccaaggtactgagttaattggtattacggctggtgaatcagaaaatcctgaacgtgctgtgccgaaagcaattaaacaagtattctggagaattttattattttacattttagccatttttgttatcggtatgttaattccttatgatagtagtgcattaatggggggtagtgataatgtagcaacgtctccattcacattagtgtttaaaaatgctggatttgcgtttgcagcatcatttatgaatgcagtcattttaacgtctgtgttatcagcaggtaactcaggtatgtatgcttcaactcgaatgctatattcaatgagtaaagataaattagcgtttgaagcatttggtaaaacaaataaaaacggtgtgccatatatgtcgttactcgttacagcaatcattgtagtgataattttcgtattacaaagccttacaaaaggtgcatacgaatatatcgttgcagcaagtggtttaactggttttattgcttgggtaggtatagcagtaagtcattatcgatttagaagagcatttgataaacaaaattatgacaaatctaaattaaaatatactgctaaattattcccattcggaccattatttgctggctttttatgtattgtagtaattattggtcaagatgttgactttattaaaacaggagattttaattttagtcgcttcttaattacgtatatgggaattccagtatttttagcattctttatttatcataagcttcgatataaaacgaaaaaaattccattagaacaagtagatttacgtcaagacgtgtcaatggatgaaataaaaggttaa

SEQ ID NO: 71138 - protein, 497 aa, Staphylococcus aureus subsp. aureus NCTC 8325; identical to SEQ ID NO: 17258

SEQ ID NO: 71139 - DNA, 1482 bp, Ralstonia metallidurans CH34
  CDS (1)..(1482): transl_table=11
atgtcccatccacacccccatcaacacccggtcgtcgagcacgacgacctgcaccgcaagctcaaggcccgccacctgacgatgatcgccctgggtggtgccatcggcaccggactgtttgtcgcctcgggcgcatccatcgcacagtccggccccggcggcgccctgctggcctactgcctgatcggcctgatggtgtactgcctgatgaccagccttggcgagctcgcggtgcacatgcccgtggcaggatcattcgtaacctacagcgccctctacgtcgacgagggctttggcttcgcacttggctggaactactggttcagcctggccgtgacaattgccgtcgaactgaccgcagcccagttggtcatgcagtattggttcccggaggtaccgggcatctactggagcgcgggctttctggcactgatgttcgcgctcaatgcgttctcggtgaagggcttcggcgaggccgagtactggttcgccatgatcaaggttgtaaccgtcgtcgttttcctgtgcgtgggcgtgctgatgatcctcggcatcctcaagggtgggccacaatcgggctggcacaacttcacgaccggcgaagccccattcgtcggtggcctccccgggctgttcgcggtggcgatgattgccggcttctcatttcaaggaaccgagacggtcggcgtggcggctggtgaagccgcggaccccggacgcacgattccgcgcgcgatccgacagacgttctggcgcatcctgctgttctatgtcgttgccatcctgatcattggcgtgctcattccgtataccgacccgaacctgcttcgcaatgacgtgaccgacgttggcgtcagcccgtttgcactggtattccagcacgctggcctggcttttgccgcggcgctgatgaacgccgtggtgctgaccgcgctgctctcggcggggacatcgagcatgtatgtttcgactcggattctctatggcttggcggtcagccagcgcgccccaagggctctagccaagctcaccccgaacggcgtgccattcaacgcgctgctggtgaccacgggcatcggcgcgctgtgcttcttcagttcgctgttcggcgacaaggccgtgtacctgtggctgctcaacacatcggcaatgaccggcttcttcgcgtggctcggtatcgccgtcagccactatcgtttccgcaagggtctgctgtaccagggctacaaggtcagcgatcttgcctaccgctctccgctctatccgttcggcccgatcttcgctggcgtgctgtgtctcgtcatcgtgggcggccagaactatcaggcattcactgacatccccggccgttggcaagagatcgtctcgacctacattggcgtgccagtcttcctggcgctatggctcggctaccgcatcgtacgcggcacgcgcatgatcgactacgaagacatgccgtttgaactggtaaagaaggactga

SEQ ID NO: 71140 - protein, 493 aa, Ralstonia metallidurans CH34
MSHPHPHQHPVVEHDDLHRKLKARHLTMIALGGAIGTGLFVASGASIAQSGPGGALLAYCLIGLMVYCLMTSLGELAVHMPVAGSFVTYSALYVDEGFGFALGWNYWFSLAVTIAVELTAAQLVMQYWFPEVPGIYWSAGFLALMFALNAFSVKGFGEAEYWFAMIKVVTVVVFLCVGVLMILGILKGGPQSGWHNFTTGEAPFVGGLPGLFAVAMIAGFSFQGTETVGVAAGEAADPGRTIPRAIRQTFWRILLFYVVAILIIGVLIPYTDPNLLRNDVTDVGVSPFALVFQHAGLAFAAALMNAVVLTALLSAGTSSMYVSTRILYGLAVSQRAPRALAKLTPNGVPFNALLVTTGIGALCFFSSLFGDKAVYLWLLNTSAMTGFFAWLGIAVSHYRFRKGLLYQGYKVSDLAYRSPLYPFGPIFAGVLCLVIVGGQNYQAFTDIPGRWQEIVSTYIGVPVFLALWLGYRIVRGTRMIDYEDMPFELVKKD

SEQ ID NO: 71141 - DNA, 1533 bp, Ralstonia metallidurans CH34
  CDS (1)..(1533): transl_table=11
atgtccaataccaatacaacaccagccgtccccgttcccggcctgcgccgcgaactgcgcgcgcgccatctgaccatgatcgccatcggcgggtcgattggcaccggactcttcgtcgcctcaggcgccacgatcgcccaggccggccccggcggcgcgctggccgcctacatcctgatcggcgcgatggtctacttcctgatgaccagcctgggcgaactggccgcgtacatgcccgtgtccgggtcctttgccacctatggcgcgctgtacgtcgacgagggcttcggtttcgcgcttggctggaactactggtacaactgggccgtcacgatcgccgtggagctggccgcggcgcagctcgtcatgcagtactggttccccgacacgccaggcgtgctatggagcgccctgttccttggcctcatgttcgcgctcaacgcgatctccgtgcgcggtttcggcgaagcggaatactggtgcgcgctgatcaaggtcctcacggtgatcgccttcatcgtcatcggtaccttgatgatcttcggcatcatgcgcggtgatttctcccacgcaggcggactggccaacctcaccaccggcgatgcgccgttcgtcggcggcctgcccgccatgatcggggtggcgatgatcgcgggcttctcgttccagggcaccgaactgatcggcgtggccgccggggaatccgacgagccggccaagaacatcccgcgcgcggtgcgtcaggtgttctggcgcatcctgctgttctacgtgctggcgatcctgatcatcggcatcctgattccgtacaccgaccccagcctgctcaagaccgacgtggaaaccgtaggcgtaagcccgttcacgctggtgttccgccatgcgggtcttgcgtttgccgcgggcgtgatgaacgccgtgatcctgactgccgtgctctcggccggcaattccggcatgtacgcgtccacgcggatgctctacaacctggccaccgagggccgcgcgccgcgtatcttcgcgcaactcacccgcaacggcgtgcccctggtcgcgctgctggccaccaccgccgtcggcggcctgtgcttcctgacgtcgctgttcgaaagcaagtcggtctacctgtggctgctgaacctgtcgggcatgaccggcttcattgcgtggctgggcatcgcggtgagccactaccggtttcgccggggcttcatggcgcagagcctcgacctgaaccgcctgccctatcgctcaccgttctttccttacgggccgatcttcgcgttcgtgctgtgcatgatcgtcacactcggccagaactaccaggccttcagcgaaggcaagatcgactgggtggccgtgacggccacctatgtgggcattccgatcttcctgctgatctggctcggctaccggctcgtgcgcaagtcgcgcttcgtgccgtatgccgaaatgaaattcccggccctgcctgagatcgaaaaggacgattcacccgtgacgcggcctctggccccggcatcggccgaatag

SEQ ID NO: 71142 - protein, 510 aa, Ralstonia metallidurans CH34
MSNTNTTPAVPVPGLRRELRARHLTMIAIGGSIGTGLFVASGATIAQAGPGGALAAYILIGAMVYFLMTSLGELAAYMPVSGSFATYGALYVDEGFGFALGWNYWYNWAVTIAVELAAAQLVMQYWFPDTPGVLWSALFLGLMFALNAISVRGFGEAEYWCALIKVLTVIAFIVIGTLMIFGIMRGDFSHAGGLANLTTGDAPFVGGLPAMIGVAMIAGFSFQGTELIGVAAGESDEPAKNIPRAVRQVFWRILLFYVLAILIIGILIPYTDPSLLKTDVETVGVSPFTLVFRHAGLAFAAGVMNAVILTAVLSAGNSGMYASTRMLYNLATEGRAPRIFAQLTRNGVPLVALLATTAVGGLCFLTSLFESKSVYLWLLNLSGMTGFIAWLGIAVSHYRFRRGFMAQSLDLNRLPYRSPFFPYGPIFAFVLCMIVTLGQNYQAFSEGKIDWVAVTATYVGIPIFLLIWLGYRLVRKSRFVPYAEMKFPALPEIEKDDSPVTRPLAPASAE

SEQ ID NO: 71143 - DNA, 1440 bp, Leuconostoc mesenteroides subsp. mesenteroides ATCC 8293
  CDS (1)..(1440)
atgtctgaacataaagggcacatacagcgtaatttaaaaacgcgccatgtgtcaatgattgcattaggtggttcaattggaacgggcttattcgtagcttcgggagccactgttgcgcaagcaggtcctctgggtgctattgtcgcttatttagctattggtgtgatggtttatttcttaatgacttcgctgggtgaaatggctacttattcaccaacttcaggttcattttccgactatgctggtaaatatgttgacccagcattgggatttgccatgggatggaactactggtttaattgggctataacattagctgtcgacattgtggcagttggcttggtggctgaattttggtttccaaatacaccagggtggatattttccgcgattgctttattacttatcttcttaattaatattttttcagttggaacttttggagaagctgagttctggttgtcgatgattaaggtagtaactattattgccttcttgattgttggtctggctactatttttggtgtaattcattctgacatcaatgtcatgaaaaacttgtcggtcggtaatcacggatttgttggtggacctcaagctatcttatcagtattcgttgttgctggattttcttttcaaggaactgagttaattggtattactgctggagaagcagaggatcctgataagtcagttcccaaggcgataaatcaagtgttttggcgtatcttattgttttatattctggcaatttttgtcatttccgctctggtttactataaagatccgcgcttgttgagttcttccacacaaaacattgcggtctcaccatttacaatcgtatttaaaaacgcaggaattgcttttgcggctagtttaatgaatgcagttatcttaacatcaattgtttcgtcagcaaattcaggttcatatgcttctacacgtatgttgtatgctatggcgcgtaaaggggatgcccctaaaatttttgccaagctttcaactagaggggttccagttgcagccttagtattaactactgcgattgggttattagcatttattgctaacaccaaagggggatcagttgcttatacttggctggtcaatgcttctgggttaactggattcatcgcttgggtcggcattgctatctctcattatcgcttccgaagagcttatgtggcgcaaggaaagagtctgtctgatttgaaatacaaggctaagtggttcccattcggtccactatttgcgctagtgatttctattggtgttattattggtcaggatccggacagttttgcccatctaaattgggaaaaaatatttgtgacctacttatcagttcctttgtttgtaatcttatacttttggtacaaggtttctcacaaaacgaagctaattgctctaaaagatgttgatctaaaacaatataaataa

SEQ ID NO: 71144 - protein, 479 aa, Leuconostoc mesenteroides subsp. mesenteroides ATCC 8293
MSEHKGHIQRNLKTRHVSMIALGGSIGTGLFVASGATVAQAGPLGAIVAYLAIGVMVYFLMTSLGEMATYSPTSGSFSDYAGKYVDPALGFAMGWNYWFNWAITLAVDIVAVGLVAEFWFPNTPGWIFSAIALLLIFLINIFSVGTFGEAEFWLSMIKVVTIIAFLIVGLATIFGVIHSDINVMKNLSVGNHGFVGGPQAILSVFVVAGFSFQGTELIGITAGEAEDPDKSVPKAINQVFWRILLFYILAIFVISALVYYKDPRLLSSSTQNIAVSPFTIVFKNAGIAFAASLMNAVILTSIVSSANSGSYASTRMLYAMARKGDAPKIFAKLSTRGVPVAALVLTTAIGLLAFIANTKGGSVAYTWLVNASGLTGFIAWVGIAISHYRFRRAYVAQGKSLSDLKYKAKWFPFGPLFALVISIGVIIGQDPDSFAHLNWEKIFVTYLSVPLFVILYFWYKVSHKTKLIALKDVDLKQYK

SEQ ID NO: 71145 - DNA, 1467 bp, Bacillus cereus G9241
  CDS (1)..(1467): transl_table=11
atgaatagcgcaacgaatcaaactacctctcaaacagaaactacaaaaggaaaaggtgaattaagacgcggtctaaaatcaaggcaccttacgatgatttctctcggcggtacaattggtaccggactatttcttgccagcggtggtgtcatccattcagctggacctggcggtgcattaattgcatacgccgcaattggaattatggtttacttcttaatgacaagcttagctgaactcgcagcttacatgcctgttactggatcttttagcacgtacgcaacaaaatttgttgatccatcacttggctttgcacttggctggaactattggtataactgggccattacaattgctgctgaactagcggctgtaacattaattatgaaattttggttccctgataccccttctcttatttggagcggattatgtttagctattattttccttttaaactacttatctgttaaagggtttggtgaatctgaatattggttcgcacttattaaagtagttactattattatctttttaattgtcggtttcatgatgattttcggaattatgggcggcgaaactgttggcttcaaaaacttcactgttgcagatgcaccatttaacggtggtatcatggcaattatcggagtatttatggcagctggtttctccttccaaggaactgaattacttggggtagctgctggtgaaacttctgatccagagcgtaatattccgaaagcaattcgttcaattttctggcgtattcttttattctatatccttgccattctcgttatcggtttattaattccttatacaactgaaagccttgcagcaagtgatgtaacagtaagtccatttacacttatttttgaaaaagcgggcgttgccttcgctgcttctgttatgaacgctgttattttaacggcagtactgtctgctggtaactctggtatgtatgcatcaactcgtatgctttgggatttagctcgccaaggaaaagcaccaaaattcttaggaaaattagatagccgcggtgtacctgttaacgcgttaatcgtaacgtcaattgtgggtagtatcgcattcattgcttctttattcggtgacggtgttgtatacatttggttattaaatgcatcaggaatgtctggctttatcgcttgggttggaatcgcaattagtcattatcgtttccgtaaagcatatattgcacaaggaaaagatttaaatgacttaccatatagagcaaaatggttcccgttcggaccaattttcgcatttgcactttgtatcatcgtaattttaggacaaaactacggcgcatttatgggtgaatcaatcgattggaacggcgtactcgtttcttacatcggtttaccactcttcttagtactatggttaggatataaatttacgaaaaaaacgaaagtgattccgcttgataaatgtgaactaaaataa

SEQ ID NO: 71146 - protein, 488 aa, Bacillus cereus G9241
MNSATNQTTSQTETTKGKGELRRGLKSRHLTMISLGGTIGTGLFLASGGVIHSAGPGGALIAYAAIGIMVYFLMTSLAELAAYMPVTGSFSTYATKFVDPSLGFALGWNYWYNWAITIAAELAAVTLIMKFWFPDTPSLIWSGLCLAIIFLLNYLSVKGFGESEYWFALIKVVTIIIFLIVGFMMIFGIMGGETVGFKNFTVADAPFNGGIMAIIGVFMAAGFSFQGTELLGVAAGETSDPERNIPKAIRSIFWRILLFYILAILVIGLLIPYTTESLAASDVTVSPFTLIFEKAGVAFAASVMNAVILTAVLSAGNSGMYASTRMLWDLARQGKAPKFLGKLDSRGVPVNALIVTSIVGSIAFIASLFGDGVVYIWLLNASGMSGFIAWVGIAISHYRFRKAYIAQGKDLNDLPYRAKWFPFGPIFAFALCIIVILGQNYGAFMGESIDWNGVLVSYIGLPLFLVLWLGYKFTKKTKVIPLDKCELK

SEQ ID NO: 71147 - DNA, 1452 bp, Pediococcus pentosaceus ATCC 25745
  CDS (1)..(1452)
atggcagaacaaggtggtagtcaggttaagcgtgccttaaagacgcgacatatttcaatgatttcactgggtggaagtattggtacaggactattcgtagccagtggatcggcaatctccactgcaggtcccggtggtgcattattagcttacgttgggatgggggtcatggtctatttcctcatgactagtttaggagaaatggcgacttatatgccggtttcgggttcgttttcaacgtacgcaactaaatacgttgatccagcctttggctttgcaatgggatggaattactggtttaactgggctattacggttgcagttgatattagtaccattgccttgattatgaaattctggtttcctcacgctccggggtggatctggagcctgttggcactagtgctagttttcttggtaaatgctttgacggttaaagcttttggtgagactgaatattggattgctttaattaagttagtcacggttattatatttttggtcgtaggagttttaaccattgttggaattatgggaggtaaagccacatatttagaaaactttgtgtatcataaagccccgtttgtgggtgggatccctgctattcttagtgttttcgttgtggctggtttctcgtttcaaggtacagaattgattggaattacagctggcgaatctgaaacacctgaaactagtgttccgaaggccattagccaagtattttggcgaattttactattttacatcttagcaatttttgtgattgcttgtatcatcccttatacaagccctaatttattaggatcatcagcccgtgatgtttccattagtccatttacccttgtgttccgtcgggcaggactagcaggagcagctggggtaatgaatgcggttattttgacctcagtactatcctcagctaattcggggatgtatgcctcgactagaatgttatattcgctttcgaaacaaggatttgctgccaaaatttttggtaaaacttcgaagcgaggaatcccatacctggccttacttggtacaactatcgtaggattgctaacctttatttccagtattatgggacctaaaatttatatatggttagttgctgccagtggactgactggctttgtggcttgggtcggtattgcgattgctcattggcggttccgtcgggcttttattaaacaaggacatgacgtgtcagaacttagatatcgtgcaaaatggttcccatttggaccactctttgcctttgttctcagtattattgtgattgcgggacaagatattcattccattgctaatttcgattggcaagcaattgggattacgtacatggcaattccgctattcattgtgttgtatacctattataaaattagatataaaacgaagttaataccgctggaagaaatcgatttatcgcgtccagatatcacgaaagaataa

SEQ ID NO: 71148 - protein, 483 aa, Pediococcus pentosaceus ATCC 25745
MAEQGGSQVKRALKTRHISMISLGGSIGTGLFVASGSAISTAGPGGALLAYVGMGVMVYFLMTSLGEMATYMPVSGSFSTYATKYVDPAFGFAMGWNYWFNWAITVAVDISTIALIMKFWFPHAPGWIWSLLALVLVFLVNALTVKAFGETEYWIALIKLVTVIIFLVVGVLTIVGIMGGKATYLENFVYHKAPFVGGIPAILSVFVVAGFSFQGTELIGITAGESETPETSVPKAISQVFWRILLFYILAIFVIACIIPYTSPNLLGSSARDVSISPFTLVFRRAGLAGAAGVMNAVILTSVLSSANSGMYASTRMLYSLSKQGFAAKIFGKTSKRGIPYLALLGTTIVGLLTFISSIMGPKIYIWLVAASGLTGFVAWVGIAIAHWRFRRAFIKQGHDVSELRYRAKWFPFGPLFAFVLSIIVIAGQDIHSIANFDWQAIGITYMAIPLFIVLYTYYKIRYKTKLIPLEEIDLSRPDITKE

SEQ ID NO: 71149 - DNA, 1581 bp, Burkholderia vietnamiensis G4
  CDS (1)..(1581): transl_table=11
atgcgccggccctggatgccggctcgctcaacgttcgtctcgtttatgtctgcaatcccgaattccgacccacccggttcgcccgcgaaccctcccacgcttcatcgcgcgctcaaggcgcgccatctgacgatgatcgccatcggcggctcgatcggcacgggcctgttcgtcgcgtccggcgcgtcgatctcgcaggccggccccggcggcgcgatggtcgcgtacatgctgatcggcctgatggtctacttcctgatgacgagcctcggcgaaatggccgcgttcatgccggtgtcgggctcgttcgcgacctacggcgcgaaatacgtcgatgaaggtttcggcttcgcgctcggctggaactactggtacaactgggcggtgacgatcgcggtcgaactcgtcgccgcgcagctcgtgatgcactactggttcccggacgtgccgggcgtgtggtggagcgccgcgttcctcgcggtgatgttcctgctcaacgcgctgacggtgcgcggctttggcgaggccgaatactggttcgcgctgatcaaggtcgtcacggtgctcgcgttcatcggcgtcggcctgctgatgatcttcggcattctgaagggcgcgccggccaacggctggggcaacctgacgatcggcgatgcgccgttcgccggcggcttgccggcgctgatgggcgtcgcgatgatcgcgggcttctcgttccagggcaccgagctgatcggcgtcgcggccggcgaatcggagcatccgcgcacgacgatcccgcgtgcggtccgccaggtgttctggcgcatcctgctgttctacgtgctggcgatcttcgtgatcggcgtgctgattccgtacaccgacccgaacctgctgaagagcgacgtgaccgacatcggcgtgagtccgtttacgctcgtgttccgtcatgcgggcctcgcgttcgcggccggcgtgatgaacgcggtgatcctgacggccgtgctgtcggccggcaactcggggatgtatgcgtcgacgcgcatgctctacaacctcgcgaccgaaggccgcgcgccgaagctgttcgcgaagctgtcgccgggcggcgtgccgcgcaacgcgctgtacgcgacgaccgccgtcggcgcgctgtgcttcttcacgtcgctgtacggcgacaagaccgtctacctgtggctgctgaacacgtcgggcatgacgggcttcatcgcgtggctcgggatcgcgatcagccattaccggttccgcaagggttacgtgacgcagggctacagcatcgatcagctgccgtaccagtcgaagtggttcccgttcggcccgctgttcgcgttcgtgctgtgcatggtgatcgcgctcgggcaggactatcaggcgtttctcgcgaaccgcatcgactgggcgggcgtggccgccacctatgtcggcatcccgctgttcgtcgtcgtctggctcggctaccggctcatgaaccggagccgcttcgtgcgctacgaggacatggaaatcgcgccgtggatcgccgcgaaccgcggcggcgctgcgccgcgcgtcgagaaccgcgagacggccggctga

SEQ ID NO: 71150 - protein, 526 aa, Burkholderia vietnamiensis G4
MRRPWMPARSTFVSFMSAIPNSDPPGSPANPPTLHRALKARHLTMIAIGGSIGTGLFVASGASISQAGPGGAMVAYMLIGLMVYFLMTSLGEMAAFMPVSGSFATYGAKYVDEGFGFALGWNYWYNWAVTIAVELVAAQLVMHYWFPDVPGVWWSAAFLAVMFLLNALTVRGFGEAEYWFALIKVVTVLAFIGVGLLMIFGILKGAPANGWGNLTIGDAPFAGGLPALMGVAMIAGFSFQGTELIGVAAGESEHPRTTIPRAVRQVFWRILLFYVLAIFVIGVLIPYTDPNLLKSDVTDIGVSPFTLVFRHAGLAFAAGVMNAVILTAVLSAGNSGMYASTRMLYNLATEGRAPKLFAKLSPGGVPRNALYATTAVGALCFFTSLYGDKTVYLWLLNTSGMTGFIAWLGIAISHYRFRKGYVTQGYSIDQLPYQSKWFPFGPLFAFVLCMVIALGQDYQAFLANRIDWAGVAATYVGIPLFVVVWLGYRLMNRSRFVRYEDMEIAPWIAANRGGAAPRVENRETAG

SEQ ID NO: 71151 - DNA, 1632 bp, Exiguobacterium sibiricum 255-15
  CDS (1)..(1632): transl_table=11
atgacttgtggggagctatctttcacgacggtagaatggggcgcatccttttactatgttgcgttctcatcttccttctggaaggtgagggcgctttttgttttttcaaaaagtgtcctctcaaaaaatcttaacaagagagaagcgaatgagatgaatactttacaaccccaaagaaaactcgattcaaccgaagaaggactaaaacgcggtctgcaagcccgccacatgtcgatgatcgcgattggcggtgcgatcggaaccggcttattcattgcctccggtgcgtccgttgctgctgccggtcccggcggtgcattgttatcctatgccattgtcggactcatggtgtacttcctgatgaccagtcttggtgagatggcagcatatatgccggtcgccggttcattctcgacctacggcgcgaaattcgtcgacccgtcgtttggttttgcgttaggttggaactactggtacaactgggcggtcacgatcgctgtagaactcgttgcggcgcaaatcgtcatgagttactggttcccggatgttcccggattttacttcagtgctttgttcctgttattgatgatcggtttaaattacttctccgttaaaggtttcggggaagcggaatattggttcgcgatgatcaaagtagtcactgtcatcatcttcctgattgtcggtgtcgcgatgatcttcggtgtcttcacatctgaagcaccggtcggctttaaaaactttgcgttaggtgatgcgccgttcgtcggaggcatcccggccgtcatcggtatcatcctggttgccggtttcagtttccagggaacagaacttgtcggaatcgcagccggtgagtcggaagatccgaagaaaaacgttccgaaagccgtgaaacaagtcttttggcggattcttctgttttatgtgtttgcgattttcgtcatcggaatgttgattccgtacacaagcccgaacctcgtttcgaatgacattaccgatgtagcggtcagtccgtttacacttgtctttgaaaaagccggtcttgcgttctcggcagcattgatgaacgctgttatcctgacgtctgtcttatcggcaggaaactccggaatgtatgcgtcgacacggatgctgtatacgttggcacgccaaggtgatgcaccgaaattgttcgcacaagtctcaaaaaatggtgttccccgcaatgcgttgcttgcgaccggtgccatcggagcactttgcttcctgacatcgatgttcggcggtcaagtatatctgtggctgttgaatgcatcagggatgaccggtttcatcgcatggctcggtatcgcgatcagccactaccgtttccgcaaaggattccttgcgcaaggtcattcgctcagtgatttgccgtacgtggcacctgctttcccgtttggaccactctttgcgttcggactttgttttctcgtcatcgtcggtcaaaactacgccgcgttcctcgcggatcaaattgactgggtgggaattgccgcaacctatgtcggtatcccgttattccttgccttttggttaggtcataaatttaaaaaccggacatcggtcgttccttatgaagaaatggaattcccggagcatccgcgtccgtaa

SEQ ID NO: 71152 - protein, 543 aa, Exiguobacterium sibiricum 255-15
MTCGELSFTTVEWGASFYYVAFSSSFWKVRALFVFSKSVLSKNLNKREANEMNTLQPQRKLDSTEEGLKRGLQARHMSMIAIGGAIGTGLFIASGASVAAAGPGGALLSYAIVGLMVYFLMTSLGEMAAYMPVAGSFSTYGAKFVDPSFGFALGWNYWYNWAVTIAVELVAAQIVMSYWFPDVPGFYFSALFLLLMIGLNYFSVKGFGEAEYWFAMIKVVTVIIFLIVGVAMIFGVFTSEAPVGFKNFALGDAPFVGGIPAVIGIILVAGFSFQGTELVGIAAGESEDPKKNVPKAVKQVFWRILLFYVFAIFVIGMLIPYTSPNLVSNDITDVAVSPFTLVFEKAGLAFSAALMNAVILTSVLSAGNSGMYASTRMLYTLARQGDAPKLFAQVSKNGVPRNALLATGAIGALCFLTSMFGGQVYLWLLNASGMTGFIAWLGIAISHYRFRKGFLAQGHSLSDLPYVAPAFPFGPLFAFGLCFLVIVGQNYAAFLADQIDWVGIAATYVGIPLFLAFWLGHKFKNRTSVVPYEEMEFPEHPRP

SEQ ID NO: 71153 - DNA, 1716 bp, Aspergillus oryzae
  CDS (1)..(1716)
atggcggtccatgacattgagaaggggcccggtagggctcctcaagaagatgcgggtcagaaggctccgggatttgtaacagatcccctcggtagcaacactccatttgtcaatgcggataaactcgcccgtaatctttctgcacgtcaagttcagatgattgctatcggtggtactattggaactggtttattcttgggaacgggtaaagctctggccactggcggtccggcatctatgcttatcgcctacgccatttgcggtggtattgtctttgtgaccatgctttctttgggtgaaatggcttctttcatccctgtggcgggatctttctgcacttttgctggtcggtttgtggatgatgcgttagggttcgctcttacttggaattactggtttaatgatgcggtttccactgcgtctgatgttattgctctgcaactactgctgcaatactggacggataacttccccggatgggcaatcagtctgatattcctggttgttgttattgctttgaatatgttttccgtcaaggtttacggagagatcgagtattggctcagtctactcaaggttgtaactatcataatcttcattattctcgggattgtagtcaactgtggcggcaacactgaacaccaatatatcggaggcaaatatttctatgtcgatgatgcaccctttgttgacggtattggtggcttcgcatccgtcttcgttacagcttcatttgcctttggtggcaccgagtccattgcagttacggcgggtgaaaccaaggacccagcgaagaacatgcccaaggtggtccgcaacgtcttctggcgtatcattttattctacattgtgtctatcattattattggcctcaacgtaccatacaactatcctggtctgtcgaacggagacacggccaccagtccctttactctcgtcttccagcaggctggcagtgccgtcgcaggcagttttatcaatgctgtgcttatgactagcgtcatctctgcagcgaaccatgctttgtttgctggatccagactgctctattccttggccgttgacggatatgcaccccggtttttcggccatctgaatcgctttcagatcccctgggttgctgttttggcgacgtctgtgatcagtggcttatgcttcggcgccagttatatcggagctggccagttatggtcatggttacaaaatattgtcggagtttctaaccagatttcatgggtctgcattggagtggcatctctccgtttcagatctgctattcgccaccaaggccttgaacatctcctcccttacaagaactggacatacccagtcgggcctatcatcgccatctgcctcaacagtgttctcatcctcgtgcaaggctggaaatgcttcagtccacacttcaagggcgtcgactttgtttcctactacattgaaatccctgtcatgattgtgatgttcctggcctggaaattgttcaaacggacacggtttgttcatcgcggcgagatggacctgatcacggatcggtacaatcttatccacagcactggagtcgacgtgaatgactcaaacgaaggctcatcaaatatccacgacgataatgcacctcaagcagatgggtctagcaagaagaaattcttctcgtgggacccagaggacaagagcgtcctggggaggattaagcaggttggaatgtggttgttcttgtag

SEQ ID NO: 71154 - protein, 571 aa, Aspergillus oryzae
MAVHDIEKGPGRAPQEDAGQKAPGFVTDPLGSNTPFVNADKLARNLSARQVQMIAIGGTIGTGLFLGTGKALATGGPASMLIAYAICGGIVFVTMLSLGEMASFIPVAGSFCTFAGRFVDDALGFALTWNYWFNDAVSTASDVIALQLLLQYWTDNFPGWAISLIFLVVVIALNMFSVKVYGEIEYWLSLLKVVTIIIFIILGIVVNCGGNTEHQYIGGKYFYVDDAPFVDGIGGFASVFVTASFAFGGTESIAVTAGETKDPAKNMPKVVRNVFWRIILFYIVSIIIIGLNVPYNYPGLSNGDTATSPFTLVFQQAGSAVAGSFINAVLMTSVISAANHALFAGSRLLYSLAVDGYAPRFFGHLNRFQIPWVAVLATSVISGLCFGASYIGAGQLWSWLQNIVGVSNQISWVCIGVASLRFRSAIRHQGLEHLLPYKNWTYPVGPIIAICLNSVLILVQGWKCFSPHFKGVDFVSYYIEIPVMIVMFLAWKLFKRTRFVHRGEMDLITDRYNLIHSTGVDVNDSNEGSSNIHDDNAPQADGSSKKKFFSWDPEDKSVLGRIKQVGMWLFL

SEQ ID NO: 71155 - DNA, 1494 bp, Staphylococcus aureus; identical to SEQ ID NO: 17331
  CDS (1)..(1494): transl_table=11

SEQ ID NO: 71156 - protein, 497 aa, Staphylococcus aureus; identical to SEQ ID NO: 17332

SEQ ID NO: 71157 - DNA, 25 bp, Artificial sequence
  primer
atggtttccgaaactaaaaccacag

SEQ ID NO: 71158 - DNA, 25 bp, Artificial sequence
  primer
ttatttcttatcgttctgcgggaac

SEQ ID NO: 71159 - protein, 480 aa, Artificial sequence
  consensus sequence
  Variant (2)..(2): Xaa in position 2 is any amino acid
  Variant (4)..(5): Xaa in position 4 to 5 is any amino acid
  Variant (8)..(9): Xaa in position 8 to 9 is any amino acid
  Variant (13)..(13): Xaa in position 13 is any amino acid
  Variant (16)..(16): Xaa in position 16 is any amino acid
  Variant (23)..(23): Xaa in position 23 is any amino acid
  Variant (27)..(28): Xaa in position 27 to 28 is any amino acid
  Variant (30)..(31): Xaa in position 30 to 31 is any amino acid
  Variant (39)..(40): Xaa in position 39 to 40 is any amino acid
  Variant (42)..(43): Xaa in position 42 to 43 is any amino acid
  Variant (46)..(46): Xaa in position 46 is any amino acid
  Variant (58)..(58): Xaa in position 58 is any amino acid
  Variant (60)..(62): Xaa in position 60 to 62 is any amino acid
  Variant (65)..(65): Xaa in position 65 is any amino acid
  Variant (69)..(69): Xaa in position 69 is any amino acid
  Variant (72)..(75): Xaa in position 72 to 75 is any amino acid
  Variant (77)..(80): Xaa in position 77 to 80 is any amino acid
  Variant (90)..(90): Xaa in position 90 is any amino acid
  Variant (94)..(94): Xaa in position 94 is any amino acid
  Variant (96)..(96): Xaa in position 96 is any amino acid
  Variant (98)..(109): Xaa in position 98 to 109 is any amino acid
  Variant (111)..(111): Xaa in position 111 is any amino acid
  Variant (113)..(114): Xaa in position 113 to 114 is any amino acid
  Variant (115)..(116): Xaa in position 115 to 116 is any or no amino acid
  Variant (118)..(120): Xaa in position 118 to 120 is any amino acid
  Variant (123)..(125): Xaa in position 123 to 125 is any amino acid
  Variant (127)..(129): Xaa in position 127 to 129 is any amino acid
  Variant (131)..(131): Xaa in position 131 is any amino acid
  Variant (134)..(135): Xaa in position 134 to 135 is any amino acid
  Variant (138)..(140): Xaa in position 138 to 140 is any amino acid
  Variant (143)..(143): Xaa in position 143 is any amino acid
  Variant (147)..(149): Xaa in position 147 to 149 is any amino acid
  Variant (153)..(153): Xaa in position 153 is any amino acid
  Variant (155)..(157): Xaa in position 155 to 157 is any amino acid
  Variant (159)..(161): Xaa in position 159 to 161 is any amino acid
  Variant (163)..(165): Xaa in position 163 to 165 is any amino acid
  Variant (167)..(167): Xaa in position 167 is any amino acid
  Variant (170)..(171): Xaa in position 170 to 171 is any amino acid
  Variant (173)..(174): Xaa in position 173 to 174 is any amino acid
  Variant (175)..(178): Xaa in position 175 to 178 is any or no amino acid
  Variant (180)..(188): Xaa in position 180 to 188 is any amino acid
  Variant (189)..(193): Xaa in position 189 to 193 is any or no amino acid
  Variant (196)..(196): Xaa in position 196 is any amino acid
  Variant (199)..(203): Xaa in position 199 to 203 is any amino acid
  Variant (204)..(209): Xaa in position 204 to 209 is any or no amino acid
  Variant (212)..(215): Xaa in position 212 to 215 is any amino acid
  Variant (224)..(225): Xaa in position 224 to 225 is any amino acid
  Variant (227)..(228): Xaa in position 227 to 228 is any amino acid
  Variant (232)..(234): Xaa in position 232 to 234 is any amino acid
  Variant (236)..(239): Xaa in position 236 to 239 is any amino acid
  Variant (241)..(241): Xaa in position 241 is any amino acid
  Variant (243)..(246): Xaa in position 243 to 246 is any amino acid
  Variant (255)..(256): Xaa in position 255 to 256 is any amino acid
  Variant (259)..(260): Xaa in position 259 to 260 is any amino acid
  Variant (262)..(265): Xaa in position 262 to 265 is any amino acid
  Variant (268)..(269): Xaa in position 268 to 269 is any amino acid
  Variant (270)..(271): Xaa in position 270 to 271 is any or no amino acid
  Variant (273)..(277): Xaa in position 273 to 277 is any amino acid
  Variant (278)..(283): Xaa in position 278 to 283 is any or no amino acid
  Variant (291)..(292): Xaa in position 291 to 292 is any amino acid
  Variant (295)..(297): Xaa in position 295 to 297 is any amino acid
  Variant (300)..(301): Xaa in position 300 to 301 is any amino acid
  Variant (309)..(309): Xaa in position 309 is any amino acid
  Variant (326)..(328): Xaa in position 326 to 328 is any amino acid
  Variant (330)..(331): Xaa in position 330 to 331 is any amino acid
  Variant (333)..(333): Xaa in position 333 is any amino acid
  Variant (336)..(344): Xaa in position 336 to 344 is any amino acid
  Variant (348)..(349): Xaa in position 348 to 349 is any amino acid
  Variant (352)..(353): Xaa in position 352 to 353 is any amino acid
  Variant (355)..(361): Xaa in position 355 to 361 is any amino acid
  Variant (363)..(371): Xaa in position 363 to 371 is any amino acid
  Variant (372)..(373): Xaa in position 372 to 373 is any or no amino acid
  Variant (375)..(376): Xaa in position 375 to 376 is any amino acid
  Variant (378)..(380): Xaa in position 378 to 380 is any amino acid
  Variant (383)..(384): Xaa in position 383 to 384 is any amino acid
  Variant (390)..(390): Xaa in position 390 is any amino acid
  Variant (394)..(394): Xaa in position 394 is any amino acid
  Variant (401)..(405): Xaa in position 401 to 405 is any amino acid
  Variant (408)..(411): Xaa in position 408 to 411 is any amino acid
  Variant (412)..(412): Xaa in position 412 is any or no amino acid
  Variant (414)..(414): Xaa in position 414 is any amino acid
  Variant (416)..(419): Xaa in position 416 to 419 is any amino acid
  Variant (422)..(422): Xaa in position 422 is any amino acid
  Variant (425)..(425): Xaa in position 425 is any amino acid
  Variant (428)..(429): Xaa in position 428 to 429 is any amino acid
  Variant (432)..(436): Xaa in position 432 to 436 is any amino acid
  Variant (439)..(447): Xaa in position 439 to 447 is any amino acid
  Variant (448)..(453): Xaa in position 448 to 453 is any or no amino acid
  Variant (455)..(460): Xaa in position 455 to 460 is any amino acid
  Variant (462)..(464): Xaa in position 462 to 464 is any amino acid
  Variant (466)..(466): Xaa in position 466 is any amino acid
  Variant (468)..(479): Xaa in position 468 to 479 is any amino acid
RXLXXRHXXMIAXGGXIGTGLFXASGXXIXXAGPGGALXXYXXIGXMVYFLMTSLGEXAXXXPVXGSFXTYXXXXVXXXXGFALGWNYWXNWAXTXAXXXXXXXXXXXXWXPXXXXPXXXWSXXXLXXXFXLNXXSVXXXGEXEYWXXXIKVXTXXXFXXXGXXXIXGIXXGXXXXXXGXXXXXXXXXXXXXXPFXGGXXXXXXXXXXXGVXXXXGFSFQGTEXXGXXAGEXXXPXXXXPXAXXXXFWRILLFYXXAIXXIXXXXPYXXXXLXXXXXXXXXXXSPFTLVFXXAGXXXAAXXMNAVILTXVLSAGNSGMYASTRMLXXXAXXGXAPXXXXXXXXXGVPXXALXXTXXXXXXXFXXXXXXXXXXXYXXLXXXSGXXGFIAWXGIAXSHYRFRXXXXXQGXXXXXLXYXXXXFPXGPXFAXXLCXXXXXGQXXXXXXXXXXXXXXXWXXXXXXYXXXPXFXXXXXXXXXXXXT

SEQ ID NO: 71160 - protein, 61 aa, Artificial sequence
  protein pattern
  Variant (2)..(2): Xaa in position 2 is any amino acid
  Variant (3)..(3): Xaa in position 3 is Ala, Gly, Ile, Leu or Val
  Variant (4)..(4): Xaa in position 4 is Ile, Met or Val
  Variant (6)..(6): Xaa in position 6 is any amino acid
  Variant (7)..(7): Xaa in position 7 is Leu or Met
  Variant (8)..(8): Xaa in position 8 is Ile or Val
  Variant (9)..(9): Xaa in position 9 is Phe or Tyr
  Variant (16)..(16): Xaa in position 16 is Ala, Asp or Gly
  Variant (18)..(18): Xaa in position 18 is any amino acid
  Variant (19)..(19): Xaa in position 19 is any or no amino acid
  Variant (21)..(22): Xaa in position 21 to 22 is any amino acid
  Variant (23)..(23): Xaa in position 23 is any or no amino acid
  Variant (25)..(25): Xaa in position 25 is Asn, Thr or Val
  Variant (26)..(26): Xaa in position 26 is Ala, Pro, Ser or Thr
  Variant (28)..(28): Xaa in position 28 is Ala or Ser
  Variant (30)..(30): Xaa in position 30 is any amino acid
  Variant (31)..(31): Xaa in position 31 is Ala, Asp or Thr
  Variant (33)..(33): Xaa in position 33 is Ala or Gly
  Variant (34)..(34): Xaa in position 34 is Ala, Gly, Asn, Gln, Ser or Thr
  Variant (35)..(35): Xaa in position 35 is any amino acid
  Variant (36)..(36): Xaa in position 36 is Phe or Tyr
  Variant (38)..(38): Xaa in position 38 is Asp or Glu
  Variant (39)..(39): Xaa in position 39 is Asp, Glu or Pro
  Variant (40)..(40): Xaa in position 40 is Ala, Gly or Ser
  Variant (41)..(41): Xaa in position 41 is Phe or Leu
  Variant (45)..(45): Xaa in position 45 is any amino acid
  Variant (51)..(51): Xaa in position 51 is any amino acid
  Variant (52)..(52): Xaa in position 52 is Asn or Ser
  Variant (54)..(54): Xaa in position 54 is Ala or Val
  Variant (55)..(55): Xaa in position 55 is Ile or Val
  Variant (57)..(57): Xaa in position 57 is Ile, Leu or Val
  Variant (59)..(59): Xaa in position 59 is any amino acid
  Variant (60)..(60): Xaa in position 60 is Asp or Glu
  Variant (61)..(61): Xaa in position 61 is Ile, Leu or Val
YXXXGXXXXFLMTSLXEXXAXXXPXXGXFXXYXXXXVXXXXGFAXGWNYWXXWXXTXAXXX

SEQ ID NO: 71161 - protein, 58 aa, Artificial sequence
  protein pattern
  Variant (9)..(9): Xaa in position 9 is any amino acid
  Variant (10)..(10): Xaa in position 10 is Ile, Leu or Val
  Variant (12)..(12): Xaa in position 12 is any amino acid
  Variant (13)..(13): Xaa in position 13 is any or no amino acid
  Variant (15)..(15): Xaa in position 15 is any or no amino acid
  Variant (18)..(18): Xaa in position 18 is Ala, Ser or Thr
  Variant (19)..(20): Xaa in position 19 to 20 is any amino acid
  Variant (22)..(23): Xaa in position 22 to 23 is any amino acid
  Variant (24)..(24): Xaa in position 24 is Ala, Asn, Ser or Thr
  Variant (25)..(25): Xaa in position 25 is Ile, Leu or Val
  Variant (27)..(27): Xaa in position 27 is any amino acid
  Variant (29)..(29): Xaa in position 29 is Ile or Val
  Variant (30)..(32): Xaa in position 30 to 32 is any amino acid
  Variant (38)..(38): Xaa in position 38 is Leu or Met
  Variant (41)..(41): Xaa in position 41 is Ile, Met or Val
  Variant (42)..(42): Xaa in position 42 is Phe, Ile, Leu or Val
  Variant (43)..(43): Xaa in position 43 is Ala, Cys or Ser
  Variant (45)..(45): Xaa in position 45 is any amino acid
  Variant (46)..(46): Xaa in position 46 is Ile or Val
  Variant (48)..(48): Xaa in position 48 is Ala, Gly or Ser
  Variant (49)..(49): Xaa in position 49 is any amino acid
  Variant (50)..(50): Xaa in position 50 is Ile or Leu
  Variant (51)..(51): Xaa in position 51 is Ile, Leu or Val
  Variant (52)..(52): Xaa in position 52 is any amino acid
  Variant (53)..(53): Xaa in position 53 is His or Tyr
  Variant (54)..(54): Xaa in position 54 is any amino acid
  Variant (55)..(55): Xaa in position 55 is Asp, Asn, Ser or Thr
  Variant (56)..(57): Xaa in position 56 to 57 is any amino acid
GFSFQGTEXXGXXAXGEXXXPXXXXPXAXXXXFWRILXFYXXXIXXIXXXXXXXXXXL

SEQ ID NO: 71162 - protein, 55 aa, Artificial sequence
  protein pattern
  Variant (2)..(2): Xaa in position 2 is any amino acid
  Variant (5)..(5): Xaa in position 5 is Ile, Leu or Met
  Variant (6)..(6): Xaa in position 6 is Ile, Leu or Val
  Variant (8)..(10): Xaa in position 8 to 10 is any amino acid
  Variant (12)..(12): Xaa in position 12 is Phe, Ile, Leu or Val
  Variant (13)..(14): Xaa in position 13 to 14 is any amino acid
  Variant (17)..(17): Xaa in position 17 is Ala, Gly or Ser
  Variant (18)..(18): Xaa in position 18 is any amino acid
  Variant (21)..(21): Xaa in position 21 is Ala or Leu
  Variant (22)..(23): Xaa in position 22 to 23 is Ile or Val
  Variant (25)..(25): Xaa in position 25 is Ser or Thr
  Variant (26)..(26): Xaa in position 26 is Ala or Ser
  Variant (27)..(27): Xaa in position 27 is Ile or Val
  Variant (28)..(28): Xaa in position 28 is Leu or Val
  Variant (30)..(30): Xaa in position 30 is Ala, Cys or Ser
  Variant (31)..(31): Xaa in position 31 is Ala or Gly
  Variant (35)..(35): Xaa in position 35 is any amino acid
  Variant (37)..(37): Xaa in position 37 is Ala or Val
  Variant (38)..(38): Xaa in position 38 is Ala, Gly or Ser
  Variant (39)..(39): Xaa in position 39 is Ser or Thr
  Variant (42)..(42): Xaa in position 42 is Leu or Met
  Variant (43)..(43): Xaa in position 43 is Phe, His, Trp or Tyr
  Variant (44)..(44): Xaa in position 44 is Ala, Asp, Asn, Ser or Thr
  Variant (45)..(45): Xaa in position 45 is Leu or Met
  Variant (46)..(46): Xaa in position 46 is Ala or Ser
  Variant (47)..(50): Xaa in position 47 to 50 is any amino acid
  Variant (52)..(53): Xaa in position 52 to 53 is any amino acid
  Variant (54)..(54): Xaa in position 54 is any or no amino acid
SXFTXXFXXXGXXXAAXXMNXXXLXXXXSXXNSGXYXXXRMXXXXXXXXXAXXXF

SEQ ID NO: 71163 - protein, 31 aa, Artificial sequence
  protein pattern
  Variant (2)..(2): Xaa in position 2 is any amino acid
  Variant (3)..(3): Xaa in position 3 is Ala, Asn or Ser
  Variant (4)..(4): Xaa in position 4 is any amino acid
  Variant (5)..(5): Xaa in position 5 is Ser or Val
  Variant (6)..(6): Xaa in position 6 is Ala or Gly
  Variant (7)..(7): Xaa in position 7 is Ile, Leu, Met or Val
  Variant (8)..(8): Xaa in position 8 is Ala, Cys, Ser or Thr
  Variant (9)..(9): Xaa in position 9 is Cys, Gly or Thr
  Variant (11)..(11): Xaa in position 11 is Phe, Ile or Val
  Variant (12)..(12): Xaa in position 12 is Ala, Thr or Val
  Variant (14)..(14): Xaa in position 14 is Phe, Ile, Leu or Val
  Variant (18)..(18): Xaa in position 18 is Ile, Leu or Val
  Variant (19)..(19): Xaa in position 19 is Ala, Cys or Ser
  Variant (21)..(21): Xaa in position 21 is any amino acid
  Variant (25)..(25): Xaa in position 25 is Lys or Arg
  Variant (26)..(26): Xaa in position 26 is Ala or Gly
  Variant (27)..(27): Xaa in position 27 is any amino acid
  Variant (28)..(28): Xaa in position 28 is Ile, Leu, Met or Val
  Variant (29)..(29): Xaa in position 29 is any amino acid
  Variant (31)..(31): Xaa in position 31 is Gly or Ser
LXXXXXXXXFXXWXGIAXXHXRFRXXXXXQX

SEQ ID NO: 71164 - protein, 52 aa, Artificial sequence
  protein pattern
  Variant (3)..(3): Xaa in position 3 is any amino acid
  Variant (4)..(5): Xaa in position 4 to 5 is any or no amino acid
  Variant (7)..(9): Xaa in position 7 to 9 is any amino acid
  Variant (10)..(11): Xaa in position 10 to 11 is any or no amino acid
  Variant (13)..(13): Xaa in position 13 is any amino acid
  Variant (14)..(14): Xaa in position 14 is Ile, Leu or Val
  Variant (16)..(16): Xaa in position 16 is any amino acid
  Variant (17)..(17): Xaa in position 17 is Phe, Ile, Leu or Met
  Variant (18)..(18): Xaa in position 18 is Ser or Thr
  Variant (19)..(19): Xaa in position 19 is Ala or Val
  Variant (20)..(20): Xaa in position 20 is Lys or Arg
  Variant (21)..(21): Xaa in position 21 is Ala, Gly or Val
  Variant (22)..(22): Xaa in position 22 is Phe or Tyr
  Variant (25)..(25): Xaa in position 25 is Ala, Gly, Ser or Thr
  Variant (27)..(27): Xaa in position 27 is Phe or Tyr
  Variant (29)..(29): Xaa in position 29 is any amino acid
  Variant (30)..(30): Xaa in position 30 is Ala or Ser
  Variant (31)..(31): Xaa in position 31 is any amino acid
  Variant (32)..(32): Xaa in position 32 is Ile, Leu or Val
  Variant (34)..(34): Xaa in position 34 is Leu or Val
  Variant (35)..(35): Xaa in position 35 is any amino acid
  Variant (36)..(36): Xaa in position 36 is Ala or Thr
  Variant (37)..(37): Xaa in position 37 is Ile or Val
  Variant (38)..(38): Xaa in position 38 is Ile, Leu or Val
  Variant (39)..(39): Xaa in position 39 is any amino acid
  Variant (41)..(41): Xaa in position 41 is Ile, Leu or Val
  Variant (42)..(42): Xaa in position 42 is any amino acid
  Variant (43)..(43): Xaa in position 43 is Ile, Leu, Met or Val
  Variant (45)..(47): Xaa in position 45 to 47 is any amino acid
  Variant (49)..(50): Xaa in position 49 to 50 is any amino acid
  Variant (51)..(51): Xaa in position 51 is Ile or Val
  Variant (52)..(52): Xaa in position 52 is Phe, Ile, Leu or Met
WSXXXLXXXXXFXXNXXXXXXXGEXEXWXXXXKXXXXXXFXXXGXXXIXXXX

SEQ ID NO: 71165 - protein, 40 aa, Artificial sequence
  protein pattern
  Variant (2)..(2): Xaa in position 2 is any amino acid
  Variant (4)..(5): Xaa in position 4 to 5 is any or no amino acid
  Variant (7)..(8): Xaa in position 7 to 8 is any or no amino acid
  Variant (10)..(10): Xaa in position 10 is Ile, Leu, Met or Val
  Variant (11)..(11): Xaa in position 11 is any amino acid
  Variant (15)..(15): Xaa in position 15 is Ile, Leu, Met or Val
  Variant (18)..(18): Xaa in position 18 is Ala, Cys, Ser or Thr
  Variant (23)..(23): Xaa in position 23 is Ile or Leu
  Variant (25)..(25): Xaa in position 25 is Phe, Ile, Leu, Met or Val
  Variant (26)..(26): Xaa in position 26 is Ala or Thr
  Variant (27)..(27): Xaa in position 27 is any amino acid
  Variant (29)..(29): Xaa in position 29 is Ala, Asp, Gly, Asn or Ser
  Variant (30)..(30): Xaa in position 30 is Ala, Ser, Thr or Val
  Variant (31)..(31): Xaa in position 31 is Ile, Leu or Val
  Variant (32)..(33): Xaa in position 32 to 33 is any amino acid
  Variant (34)..(34): Xaa in position 34 is Ala or Ser
  Variant (36)..(36): Xaa in position 36 is Ala, Pro or Val
  Variant (37)..(37): Xaa in position 37 is any amino acid
  Variant (40)..(40): Xaa in position 40 is Phe, Ile, Leu, Met or Val
RXLXXRXXHXXMIAXGGXIGTGXFXXXGXXXXXXGXXGAX

SEQ ID NO: 71166 - protein, 27 aa, Artificial sequence
  protein pattern
  Variant (2)..(2): Xaa in position 2 is any amino acid
  Variant (3)..(3): Xaa in position 3 is Ala or Ser
  Variant (4)..(5): Xaa in position 4 to 5 is any amino acid
  Variant (6)..(6): Xaa in position 6 is Phe or Tyr
  Variant (8)..(8): Xaa in position 8 is any amino acid
  Variant (9)..(9): Xaa in position 9 is Ala or Gly
  Variant (11)..(11): Xaa in position 11 is any amino acid
  Variant (12)..(12): Xaa in position 12 is Phe, Ile, Leu or Val
  Variant (13)..(13): Xaa in position 13 is Ala or Val
  Variant (14)..(15): Xaa in position 14 to 15 is any amino acid
  Variant (18)..(18): Xaa in position 18 is any amino acid
  Variant (19)..(20): Xaa in position 19 to 20 is any or no amino acid
  Variant (22)..(22): Xaa in position 22 is any amino acid
  Variant (23)..(24): Xaa in position 23 to 24 is any or no amino acid
  Variant (27)..(27): Xaa in position 27 is Asp, Gly or Asn
YXXXXXPXXPXXXXXLCXXXIXXXGQX

SEQ ID NO: 71167 - protein, 19 aa, Artificial sequence
  protein pattern
  Variant (2)..(2): Xaa in position 2 is any amino acid
  Variant (3)..(9): Xaa in position 3 to 9 is any or no amino acid
  Variant (11)..(11): Xaa in position 11 is Ile, Met or Val
  Variant (12)..(12): Xaa in position 12 is Cys, Gly or Ser
  Variant (13)..(13): Xaa in position 13 is Ile, Leu or Val
  Variant (15)..(15): Xaa in position 15 is Phe, Ile, Leu or Val
  Variant (17)..(17): Xaa in position 17 is Phe, Ile, Leu or Val
  Variant (18)..(18): Xaa in position 18 is Ala, Gly, Ile, Leu or Val
  Variant (19)..(19): Xaa in position 19 is Phe, Ile, Leu or Val
IXXXXXXXXYXXXPXFXXX

SEQ ID NO: 71168 - protein, 10 aa, Artificial sequence
  protein pattern
  Variant (2)..(2): Xaa in position 2 is Ile or Val
  Variant (4)..(5): Xaa in position 4 to 5 is any amino acid
  Variant (8)..(8): Xaa in position 8 is any amino acid
  Variant (9)..(9): Xaa in position 9 is Ala, Gly or Val
GXPXXALXXT

SEQ ID NO: 71169 - protein, 15 aa, Artificial sequence
  protein pattern
  Variant (2)..(7): Xaa in position 2 to 7 is any amino acid
  Variant (8)..(8): Xaa in position 8 is Ala, Asp, Gly or Asn
  Variant (9)..(9): Xaa in position 9 is Asp, Glu or Gly
  Variant (10)..(10): Xaa in position 10 is Ala or Gly
  Variant (12)..(12): Xaa in position 12 is Phe or Ile
  Variant (13)..(13): Xaa in position 13 is any amino acid
GXXXXXXXXXPXXGG

SEQ ID NO: 71170 - DNA, 207 bp, Escherichia coli
  CDS (1)..(207)
atgaattttattcgacagggattaggcatcgccttacaaccagagttaacgctgaaaagcattgcaggtgaattgtgttccgttcctctcgaaccaactttctatcgacagatttcgttgctggctaaagaaaagccggtagaaggcagtccactgtttttactacaaatgtgcatggaacaattagtggcgattggaaaaatttga

SEQ ID NO: 71171 - protein, 68 aa, Escherichia coli
MNFIRQGLGIALQPELTLKSIAGELCSVPLEPTFYRQISLLAKEKPVEGSPLFLLQMCMEQLVAIGKI

SEQ ID NO: 71172 - DNA, 879 bp, Escherichia coli O157:H7 EDL933
  CDS (1)..(879): transl_table=11
atgactcttacccaaataaattctttactcgccgtgctggattacggtggctttactgaagccagcaagcgattgttcatgacgcagtcggcggtaagtcaggcaattgctgccctcgaacaagaacttggtgtgaatatactgttacgcgatcgccgtaaagctatacaactgaccacagcaggtcaccgcattgtgcaacatctgcgcgccattaatcgggaagttaacgcagtaaaagagatagccgagcaggaaaagcagaaccctcaaagaacgctgagacttggttgtttccccagcgtctgcgcctgtatcttaccggttgtgattcgctactttgaaattcatcatccgaatataaaaattattccttttgaggaaaatagcacagcgattattgattcgcttcagaatgaatccattgatgccggttttgttcattttccggtgagcggaatgtactccgtgcccatttatcaggataaattcaccgtagtgttaccgcccaaccatgctctggcaaaaaacagcactattacagtggaagaattaatgggtgaaccattaatcattagtaaaggacgctatgaattaagcattatggcactatttaaagaaaagaatattaccccacagataaaatatgaatttaatcacccggatacagcgatcagttttattcgacagggattaggcatcgccttattaccagagttaacgctgaaaaccattgcagatgaattgtgttccgttcctctcgaaccaaccttctatcgacagatttcgttgctggctaaagaaaagccggtagaaggcagtccactgtttttactacaaatgtgtacggaacaactagtggtgagtggaaaaatttga

SEQ ID NO: 71173 - protein, 292 aa, Escherichia coli O157:H7 EDL933
MTLTQINSLLAVLDYGGFTEASKRLFMTQSAVSQAIAALEQELGVNILLRDRRKAIQLTTAGHRIVQHLRAINREVNAVKEIAEQEKQNPQRTLRLGCFPSVCACILPVVIRYFEIHHPNIKIIPFEENSTAIIDSLQNESIDAGFVHFPVSGMYSVPIYQDKFTVVLPPNHALAKNSTITVEELMGEPLIISKGRYELSIMALFKEKNITPQIKYEFNHPDTAISFIRQGLGIALLPELTLKTIADELCSVPLEPTFYRQISLLAKEKPVEGSPLFLLQMCTEQLVVSGKI

SEQ ID NO: 71174 - DNA, 879 bp, Salmonella enterica subsp. enterica serovar Typhi str. CT18
  CDS (1)..(879): transl_table=11
atgacgctaacccaaatccatgccctgcttgccgtactggagtacggcggatttaccgaggccagcaaacggctatacatgacgcaatccgccgtcagccaggccatctccgcgcttgaggaggagctcggcgttgacatattgattcgtgagcgtcgtaaagagatcgagcttaccgccgccggtagccgcatcgtcaggcacttacgcgcgatccagcgcgacgtcaacgcggtaaaagagattgtcgaacaagaaaaaaagaacccggcccgtacgctacggattggctgttttcccagcgcctgcgcctgcattttacccggcgtcattcgctattttgaaagccatcatccaaatgtaaaaattatcccctatgaagagaacagtacggctattattgattcgctgcaggacggaagtattgatgccggtttcgttccttttccggtcaacggtatgtattgcgtccccatttaccgggataaattcaccgtagtggtgcctgaaaatcatcccctggcggccaatagtacagtaacggtcgaagaactgatggacgaaccacttattgtcagtaaaggtcgttatgaattaagtattatggcgttgtttaaagaaaagggtattgaaccgatatttaaatatgaatttaaccatcccgatactgcgctgaattttattcgccagggattaggtatcgccttattgccagaattaaccttaaaagccacgacaggaaaattatgctccgtggcgctggaacccaccttttatcgacaaatttcactgttagcaaaagaaccgccggtagaaggaagcccgctatttttattacaaaaatgtatggaaacactgaccgatgagggtttgctataa

SEQ ID NO: 71175 - protein, 292 aa, Salmonella enterica subsp. enterica serovar Typhi str. CT18
MTLTQIHALLAVLEYGGFTEASKRLYMTQSAVSQAISALEEELGVDILIRERRKEIELTAAGSRIVRHLRAIQRDVNAVKEIVEQEKKNPARTLRIGCFPSACACILPGVIRYFESHHPNVKIIPYEENSTAIIDSLQDGSIDAGFVPFPVNGMYCVPIYRDKFTVVVPENHPLAANSTVTVEELMDEPLIVSKGRYELSIMALFKEKGIEPIFKYEFNHPDTALNFIRQGLGIALLPELTLKATTGKLCSVALEPTFYRQISLLAKEPPVEGSPLFLLQKCMETLTDEGLL

SEQ ID NO: 71176 - DNA, 879 bp, Salmonella typhimurium LT2
  CDS (1)..(879): transl_table=11
atgacactaacccaaatccacgccctgcttgccgtactggagtacggcggatttaccgaggccagcaaacggctatacatgacgcaatccgccgtcagccaggccatctccgcgcttgaggaggagctcggcgttgacatattgattcgtgagcgtcgtaaagagatcgagcttaccgccgccggtagccgcatcgtcaggcacttacgcgcgatccagcgcgacgtcaacgcggtaaaagagattgccgaacaagaaaaaaagaacccggcccgtacgctacggattggctgttttcccagcgcctgcgcctgcattttacccggcgtcattcgctattttgaaagccatcatccaaatgtaaaaattatcccttatgaagagaacagtacggctattattgattcgctgcaggacggaagtattgatgccggtttcgttccttttccggtcaacggtatgtattgcgtccccatttaccgggataaattcaccgtagtggtgcctgaaaatcatcccctggcggccaatagtacggtaacggtcgaagaactgatggacgaaccacttattgtcagtaaaggtcgttatgaattaagcattatggcgttgtttaaagaaaagggtattgagccgatatttaaatatgaatttaaccatcccgatactgcgctgaattttattcgccagggattaggtatcgccttattgccagaattaaccttaaaagccacgacaggaaaattatgctccgtggcgctggaacccaccttttatcgacaaatttccctgttagcaaaagaaccgccggtagaaggaagtccgctatttttattacaaaaatgtatggaaacactgaccgatgaggggttgctataa

SEQ ID NO: 71177 - protein, 292 aa, Salmonella typhimurium LT2
MTLTQIHALLAVLEYGGFTEASKRLYMTQSAVSQAISALEEELGVDILIRERRKEIELTAAGSRIVRHLRAIQRDVNAVKEIAEQEKKNPARTLRIGCFPSACACILPGVIRYFESHHPNVKIIPYEENSTAIIDSLQDGSIDAGFVPFPVNGMYCVPIYRDKFTVVVPENHPLAANSTVTVEELMDEPLIVSKGRYELSIMALFKEKGIEPIFKYEFNHPDTALNFIRQGLGIALLPELTLKATTGKLCSVALEPTFYRQISLLAKEPPVEGSPLFLLQKCMETLTDEGLL

SEQ ID NO: 71178 - DNA, 207 bp, Shigella flexneri 2a str. 301
  CDS (1)..(207): transl_table=11
atgaattttattcgacagggattaggcatcgccttacaaccagagttaacgctgaaaagcattgcaggtgaattgtgttccgttcctcacgaaccaaccttctatcgacagatttcgttgctgactaaagaaaagccggtagaaggcagtccactgtttttactacaaatgtgcatggaacaattagtggcgattggaaaaatttga

SEQ ID NO: 71179 - protein, 68 aa, Shigella flexneri 2a str. 301
MNFIRQGLGIALQPELTLKSIAGELCSVPHEPTFYRQISLLTKEKPVEGSPLFLLQMCMEQLVAIGKI

SEQ ID NO: 71180 - DNA, 879 bp, Salmonella enterica subsp. enterica serovar Choleraesuis str
  CDS (1)..(879): transl_table=11
atgacactaacccaaatccacgccctgcttgccgtattggagtacggcggatttaccgaggccagcaaacggctatacatgacgcaatccgccgtcagccaggccatctccgcgcttgaggaggagctcggcgttgacatattgattcgtgagcgtcgtaaagagattgagcttaccgccgccggtagccgcatcgtcaggcacttacgcgcgatccagcgcgacgtcaacgcggtaaaagagattgccgaacaagaaaaaaagaacccggcccgtacgctacggattggctgttttcccagcgcctgcgcctgcattttacccggcgtcattcgctattttgaaagccatcatccaaatgtaaaaattatcccctatgaagagaacagtacggctattattgattcgctgcaggacggaagtattgatgccggtttcgttccttttccggtcaacggtatgtattgcgtccccatttaccgggataaattcaccgtagtggtgcctgaaaatcatcccctggcggccaatagtacagtaacggtcgaagaactgatggacgaaccacttattgtcagtaaaggtcgttatgaattaagcattatggcgttgtttaaagaaaagggtattgagccgatatttaaatatgaatttaaccatcccgatactgcgctgaattttattcgccagggattaggtatcgccttattgccagaattaaccttaaaagccacgacaggaaaattatgctccgtggcgctggaacccaccttttatcgacaaatttccctgttagcaaaaaaaccgccggtagaaggaagtccgctatttttattacaaaaatgtatggaaacactgaccgatgaggggttgctataa

SEQ ID NO: 71181 - protein, 292 aa, Salmonella enterica subsp. enterica serovar Choleraesuis str
MTLTQIHALLAVLEYGGFTEASKRLYMTQSAVSQAISALEEELGVDILIRERRKEIELTAAGSRIVRHLRAIQRDVNAVKEIAEQEKKNPARTLRIGCFPSACACILPGVIRYFESHHPNVKIIPYEENSTAIIDSLQDGSIDAGFVPFPVNGMYCVPIYRDKFTVVVPENHPLAANSTVTVEELMDEPLIVSKGRYELSIMALFKEKGIEPIFKYEFNHPDTALNFIRQGLGIALLPELTLKATTGKLCSVALEPTFYRQISLLAKKPPVEGSPLFLLQKCMETLTDEGLL

SEQ ID NO: 71182 - DNA, 654 bp, Shigella dysenteriae Sd197
  CDS (1)..(654): transl_table=11
gtgaacgctgtgaaagaaattgccgagcaggaaaaacataacccgaccagaacgctgcgcatcggctgctttcccagcgcctgcgcgtgtattttaccgggtattattcgctattttgaaacttatcatccgcagataaaaatcattccttacgaagagaacagcagtgaaattattgattcggtgcaaaacgaaactatcgatgccggttttgtccattttccggtgaccggaatgtattccgtcccggtatatcaggataaatttaccgtggtgctgccagatgctcatcccctggcaaaaaataacgctatatcggtggaagaactggtgggagaaccgctcattatcagtaaggggcgttatgaattaagcattatggcgttatttaaggaaaagaatattacgccggtcattaaatatgaatttaaccatccagatacggcaataagttttattcgccagggattaggaattgctctgttaccggagctgacgctgaaagccgtcgccggtgagttatgctctgtcccgctggagccgacgttttatcgacaaatttcattgctggtcaaagaggcgccggtagaaggcagcccattgtttttattgcaaatgtgtatggaaaccctggtggtcaaaggcatattgtga

SEQ ID NO: 71183 - protein, 217 aa, Shigella dysenteriae Sd197
MNAVKEIAEQEKHNPTRTLRIGCFPSACACILPGIIRYFETYHPQIKIIPYEENSSEIIDSVQNETIDAGFVHFPVTGMYSVPVYQDKFTVVLPDAHPLAKNNAISVEELVGEPLIISKGRYELSIMALFKEKNITPVIKYEFNHPDTAISFIRQGLGIALLPELTLKAVAGELCSVPLEPTFYRQISLLVKEAPVEGSPLFLLQMCMETLVVKGIL

SEQ ID NO: 71184 - DNA, 207 bp, Escherichia coli E24377A
  CDS (1)..(207)
atgaattttattcgacagggattaggcatcgccttacaaccagagttaacgctgaaaagcattgcaggtgaattgtgttccgttcctctcgaaccaactttctatcgacagatttcgttgctggctaaagaaaagccggtagaaggcagtccactgtttttactacaaacgtgtacggaacaactcgtggtgaatggaaaaatttga

SEQ ID NO: 71185 - protein, 68 aa, Escherichia coli E24377A
MNFIRQGLGIALQPELTLKSIAGELCSVPLEPTFYRQISLLAKEKPVEGSPLFLLQTCTEQLVVNGKI

SEQ ID NO: 71186 - DNA, 207 bp, Escherichia coli E22
  CDS (1)..(207)
atgaagtttattcgacagggattaggcatcgccttacaaccagagttaacgctgaaaagcattgcaggtgaattgtgttccgttcctcacgaaccaaccttctatcgacagatttcgttgttggctaaagaaaagccggtagaaggcagtccactgtttttactacaaacgtgtacggaacaactcgtggtgaatggaaaaatttga

SEQ ID NO: 71187 - protein, 68 aa, Escherichia coli E22
MKFIRQGLGIALQPELTLKSIAGELCSVPHEPTFYRQISLLAKEKPVEGSPLFLLQTCTEQLVVNGKI

SEQ ID NO: 71188 - DNA, 26 bp, Artificial sequence
  primer
atgaattttattcgacagggattagg

SEQ ID NO: 71189 - DNA, 28 bp, Artificial sequence
  primer
ttaaatttttccaatcgccactaattgt

SEQ ID NO: 71190 - protein, 64 aa, Artificial sequence
  consensus sequence
  Variant (11)..(11): Xaa in position 11 is any amino acid
  Variant (18)..(20): Xaa in position 18 to 20 is any amino acid
  Variant (22)..(22): Xaa in position 22 is any amino acid
  Variant (27)..(28): Xaa in position 27 to 28 is any amino acid
  Variant (40)..(40): Xaa in position 40 is any amino acid
  Variant (43)..(43): Xaa in position 43 is any amino acid
  Variant (55)..(55): Xaa in position 55 is any amino acid
  Variant (57)..(57): Xaa in position 57 is any amino acid
  Variant (59)..(59): Xaa in position 59 is any amino acid
  Variant (61)..(63): Xaa in position 61 to 63 is any amino acid
FIRQGLGIALXPELTLKXXXGXLCSVXXEPTFYRQISLLXKEXPVEGSPLFLLQXCXEXLXXXG

SEQ ID NO: 71191 - protein, 58 aa, Artificial sequence
  protein pattern
  Variant (10)..(10): Xaa in position 10 is any amino acid
  Variant (17)..(17): Xaa in position 17 is Ala or Ser
  Variant (18)..(18): Xaa in position 18 is any amino acid
  Variant (19)..(19): Xaa in position 19 is Ala or Thr
  Variant (21)..(21): Xaa in position 21 is Glu or Lys
  Variant (26)..(26): Xaa in position 26 is Ala or Pro
  Variant (27)..(27): Xaa in position 27 is any amino acid
  Variant (39)..(39): Xaa in position 39 is Ala, Thr or Val
  Variant (41)..(41): Xaa in position 41 is Glu or Lys
  Variant (42)..(42): Xaa in position 42 is any amino acid
  Variant (54)..(54): Xaa in position 54 is any amino acid
  Variant (56)..(56): Xaa in position 56 is any amino acid
  Variant (58)..(58): Xaa in position 58 is Gln or Thr
IRQGLGIALXPELTLKXXXGXLCSVXXEPTFYRQISLLXKXXPVEGSPLFLLQXCXEX

SEQ ID NO: 71192 - protein, 28 aa, Artificial sequence
  protein pattern
  Variant (2)..(2): Xaa in position 2 is any amino acid
  Variant (3)..(4): Xaa in position 3 to 4 is any or no amino acid
  Variant (6)..(7): Xaa in position 6 to 7 is any amino acid
  Variant (8)..(9): Xaa in position 8 to 9 is any or no amino acid
  Variant (11)..(11): Xaa in position 11 is Asp or Ser
  Variant (12)..(12): Xaa in position 12 is any amino acid
  Variant (14)..(14): Xaa in position 14 is Ala, Gln or Thr
  Variant (15)..(15): Xaa in position 15 is any amino acid
  Variant (16)..(16): Xaa in position 16 is Glu or Gly
  Variant (17)..(17): Xaa in position 17 is any amino acid
  Variant (18)..(18): Xaa in position 18 is Ile or Pro
  Variant (19)..(19): Xaa in position 19 is Asp or Val
  Variant (20)..(20): Xaa in position 20 is Ala or Glu
  Variant (22)..(22): Xaa in position 22 is any amino acid
  Variant (23)..(23): Xaa in position 23 is Pro or Val
  Variant (24)..(24): Xaa in position 24 is any amino acid
  Variant (26)..(26): Xaa in position 26 is Leu or Pro
  Variant (27)..(27): Xaa in position 27 is Leu or Val
  Variant (28)..(28): Xaa in position 28 is Asn, Gln or Ser
EXXXTXXXXIXXLXXXXXXXGXXXFXXX

SEQ ID NO: 71193 - protein, 8 aa, Artificial sequence
  protein pattern
  Variant (2)..(2): Xaa in position 2 is Ile or Pro
  Variant (3)..(3): Xaa in position 3 is Arg or Ser
  Variant (4)..(4): Xaa in position 4 is Ala or Gln
  Variant (5)..(5): Xaa in position 5 is Cys or Gly
  Variant (6)..(6): Xaa in position 6 is Ala or Leu
  Variant (7)..(7): Xaa in position 7 is Cys or Gly
FXXXXXXI

SEQ ID NO: 71194 - protein, 12 aa, Artificial sequence
  protein pattern
  Variant (2)..(2): Xaa in position 2 is any amino acid
  Variant (3)..(3): Xaa in position 3 is Glu or Gly
  Variant (5)..(5): Xaa in position 5 is Gly or Ser
  Variant (7)..(7): Xaa in position 7 is any or no amino acid
  Variant (10)..(11): Xaa in position 10 to 11 is any amino acid
RXXLXIXALXXE

SEQ ID NO: 71195 - protein, 28 aa, Artificial sequence
  protein pattern
  Variant (2)..(3): Xaa in position 2 to 3 is any amino acid
  Variant (4)..(4): Xaa in position 4 is any or no amino acid
  Variant (6)..(9): Xaa in position 6 to 9 is any or no amino acid
  Variant (11)..(11): Xaa in position 11 is Ile or Val
  Variant (12)..(12): Xaa in position 12 is Ala, Asp or Asn
  Variant (13)..(13): Xaa in position 13 is Ile or Leu
  Variant (14)..(14): Xaa in position 14 is any amino acid
  Variant (15)..(15): Xaa in position 15 is Ile, Leu or Pro
  Variant (16)..(16): Xaa in position 16 is Glu or Arg
  Variant (17)..(19): Xaa in position 17 to 19 is any amino acid
  Variant (21)..(21): Xaa in position 21 is Ala, Glu or Ser
  Variant (23)..(23): Xaa in position 23 is Ala, Glu or Gln
  Variant (24)..(24): Xaa in position 24 is Gly or Leu
  Variant (25)..(25): Xaa in position 25 is Glu or Thr
  Variant (26)..(26): Xaa in position 26 is any amino acid
  Variant (27)..(27): Xaa in position 27 is Ala or Cys
  Variant (28)..(28): Xaa in position 28 is Gly or Ser
IXXXLXXXXGXXXXXXXXXKXIXXXXXX

SEQ ID NO: 71196 - DNA, 1044 bp, Escherichia coli
  CDS (1)..(1044)
atgcgctatcgcattttccttctcttttttttcgctttgttgccgacgtctttggtgtgggcggcaccagcgcaacgggcgttttccgactggcaggtcacctgtaataaccaaaatttctgcgtggcgcgtaatacgggcgatcataatggactggtgatgaccctgagccgcagcgccggggcgcataccgatgccgttttacgtattgagcgcggcggattgaagtcgccggaggcgtcagaaggggagatagcgccacggctgctgttagatggcgagccgttggcgttaagtggtgacaagtggcggatttcaccatggttattagtaaccgatgatacggcaaccatcaccgcgtttttgcagatgattcaggaagggaaggcaatcaccttacgcgatggcgatcagaccatttctctgagtggcttaaaagcagcgttgttgtttattgatgctcagcaaaagcgcgttggcagtgaaaccgcgtggatcaagaaaggggacgaaccgccgctcagcgtaccgcccgcgcctgcgctgaaagaggtcgcggtggttaacccaacgccgacgccactctcactcgaagaacgcaacgatttgctggattatggaaactggcggatgaatggtctgcgctgctcgcttgatccattgcgtcgtgaggtgaatgtcactgcgctgactgatgataaagcgctgatgatgattagctgtgaggcaggggcctataacaccattgatttggcatggattgtgtcgcgtaaaaagccactagcttcgcgcccggttcggttgcgtttgccgttcaacaacggtcaggagacgaatgaactggaactgatgaacgcaacatttgatgagaaatcgcgtgaactggtgaccttagcgaaagggcgcggattaagcgattgtggcattcaggcgcgctggcgctttgacggtcagcgttttcgcctggtgcgttacgccgcagaacccacctgcgataactggcatgggccagacgcctggcccacgttgtggatcacccgttaa

SEQ ID NO: 71197 - protein, 347 aa, Escherichia coli
MRYRIFLLFFFALLPTSLVWAAPAQRAFSDWQVTCNNQNFCVARNTGDHNGLVMTLSRSAGAHTDAVLRIERGGLKSPEASEGEIAPRLLLDGEPLALSGDKWRISPWLLVTDDTATITAFLQMIQEGKAITLRDGDQTISLSGLKAALLFIDAQQKRVGSETAWIKKGDEPPLSVPPAPALKEVAVVNPTPTPLSLEERNDLLDYGNWRMNGLRCSLDPLRREVNVTALTDDKALMMISCEAGAYNTIDLAWIVSRKKPLASRPVRLRLPFNNGQETNELELMNATFDEKSRELVTLAKGRGLSDCGIQARWRFDGQRFRLVRYAAEPTCDNWHGPDAWPTLWITR

SEQ ID NO: 71198 - DNA, 1044 bp, Salmonella enterica subsp. enterica serovar Typhi str. CT18
  CDS (1)..(1044): transl_table=11
atgcgctaccgcgttattcttttttgtctgtttggcctgttgccggtccagctactgtgggctgcgccagcgcaacggactttttccgactggcaggtcacctgcaataaccaaaatttttgcgtagcgcgcaatactggcgaacatcatgggctggtgatgacattaagccgcagcgccggggcgcgtaccgatgcggtactgcgtatcgaccgcggcggtttggcgccgcccgacgctaaagaagccgcaattgcgcctcgcttattgctggatggcaaaccgctttcgttcgacagttcacactggcgcgtgtcgccctggcatctcatgaccggcgatcctgccaccatcaccgcatttttacagacgattcaggatgcgcaggccatcaccttaaaaaacggcgttcagacgctttcgctggcgggattaaaagcggcattactgtttatcgacgcgcaacaaaaacgtgtgggcagcgaaaccgcctggattgaaaaaggaaacgaaccgccgctcagcgtgcccccggcaccggcattaaaggggatcgccgttattaatccaacgcccgtaccgctgagtgaggaagaacgcgacgatctgctggactacgccgcatggcgggtaaacggcattcgttgttcgcttgacccgctgcgtcgcgagacgcaggtcagcgcgttgacggatgataaagcgttattgattgttaactgcgaagccggcgcctataacactattgatctcgcctgggtagtttcacgcaaaaaaacgctcgtctcgcgcgccgtacgtttgcggctgccgtttaatcgcggcgtcgaaagtaatgacatggagttgatgaacgccttctttgacgagaaaacgcgcgagctggtgacgttggcgaaagggcgggggttaaccgactgtggtatccagacgcgctggcgctatgatggcgatcgttttcgtctggtacgttatgccgaagaaccgagctgcgatagctggcacgggccggatgcctggcctacgctgtggatcacgcgttga

SEQ ID NO: 71199 - protein, 347 aa, Salmonella enterica subsp. enterica serovar Typhi str. CT18
MRYRVILFCLFGLLPVQLLWAAPAQRTFSDWQVTCNNQNFCVARNTGEHHGLVMTLSRSAGARTDAVLRIDRGGLAPPDAKEAAIAPRLLLDGKPLSFDSSHWRVSPWHLMTGDPATITAFLQTIQDAQAITLKNGVQTLSLAGLKAALLFIDAQQKRVGSETAWIEKGNEPPLSVPPAPALKGIAVINPTPVPLSEEERDDLLDYAAWRVNGIRCSLDPLRRETQVSALTDDKALLIVNCEAGAYNTIDLAWVVSRKKTLVSRAVRLRLPFNRGVESNDMELMNAFFDEKTRELVTLAKGRGLTDCGIQTRWRYDGDRFRLVRYAEEPSCDSWHGPDAWPTLWITR

SEQ ID NO: 71200 - DNA, 1044 bp, Salmonella typhimurium LT2
  CDS (1)..(1044): transl_table=11
atgcgctaccgcgttattcttttttgtctgtttggcctgttgccggtccagctactgtgggctgcgccagcgcaacggactttttccgactggcaggtcacctgcaataaccaaaatttttgcgtagcgcgcaatactggcgaacatcatgggctggtgatgacattaagccgcagcgccggggcgcgtaccgatgcggtactgcgtatcgaccgcggcggtttggcgccgcccgacgctaaagaagccgcaattgcgcctcgcttattgctggatggcaaaccgctttcgttcaacagtccacactggcgcgtgtcgccctggcatctcatgaccggcgatcctgccaccatcaccgcatttttacagacgattcaggatgcgcaggccatcaccttaaaaaacggcgttcagacgctttcgctggcgggattaaaagcggcattactgtttatcgacgcgcaacaaaaacgtgtgggcagcgaaaccgcctggattgaaaaaggaaacgaaccgccgctcagcgtgcccccggcaccggcattaaaggggatcgccgtgattaatccaacgcccgtaccgctgagtgaggaagaacgcgacgatctgctggactacgcagcatggcgggtaaacggcattcgttgttcgcttgacccgctgcgtcgcgagacgcaggtcagcgcgttgacggatgataaagcgttattgattgttaactgcgaagccggcgcctataacactattgatctcgcctgggtagtttcacgcaaaaaaacgctcgtctcgcgcgccgtacgtttgcggctgccgtttaatcgcggcgtcgaaagtaatgacatggagttgatgaacgtcttctttgacgagaaaacgcgcgagctggtgacgttggcgaaagggcgggggttaaccgactgcggtatccagacgcgctggcgttatgatggcgatcgttttcgtctggtgcgttatgccgaagaaccgagctgcgatagctggcacgggccggatgcctggcctacgctgtggatcacgcgttga

SEQ ID NO: 71201 - protein, 347 aa, Salmonella typhimurium LT2
MRYRVILFCLFGLLPVQLLWAAPAQRTFSDWQVTCNNQNFCVARNTGEHHGLVMTLSRSAGARTDAVLRIDRGGLAPPDAKEAAIAPRLLLDGKPLSFNSPHWRVSPWHLMTGDPATITAFLQTIQDAQAITLKNGVQTLSLAGLKAALLFIDAQQKRVGSETAWIEKGNEPPLSVPPAPALKGIAVINPTPVPLSEEERDDLLDYAAWRVNGIRCSLDPLRRETQVSALTDDKALLIVNCEAGAYNTIDLAWVVSRKKTLVSRAVRLRLPFNRGVESNDMELMNVFFDEKTRELVTLAKGRGLTDCGIQTRWRYDGDRFRLVRYAEEPSCDSWHGPDAWPTLWITR

SEQ ID NO: 71202 - DNA, 1044 bp, Shigella flexneri 2a str. 301
  CDS (1)..(1044): transl_table=11
atgcgctatcgcattttccttctcttttttttcgctttgttgccgacgtctttggtgtgggcggcaccagcgcaacgggcgttttccgactggcaggtcacctgtaataatcaaaatttttgtgtggcgcgcaatacgggcgatcataatggactggtgatgaccctgagccgcagcgctggggcgcataccgatgccgttttacgtattgagcgcggtgggttgaagtcgccggatgcgtctgaaggggagatagcgccacggctgctattagatggtgagccgttggcattaagtggtgacaagtggcggatttcaccatggttattagtaaccgatgatacggcaaccatcaccgcgtttttgcagataattcaggaagggaaggcgatcaccttacgcgacggcaatcagaccatttctctgagcggcttaaaagcggcgttgttgtttattgatgctcagcaaaagcgcgttggcagtgaaaccgcgtggatcaagaaaggggacgaaccgcctctcagcgtaccgcccgcgcctgcgctgaaagaggtcgcggtggttaacccaacgccgacgccactctcactcgaagaacgtaacgatttgctggattatggaaactggcggatgaatggtctgcgctgctcgcttgatccgttacgtcgtgaggtgaatgtcactgcgctgaccgatgataaagcactgatgatgattagctgtgaggcaggggcctataacaccattgatttggcatggattgtgtcgcgtaaaaagccgctagcctcgcgcccggttcggttgcgtttgccgttcaacaacggccaggagacgaatgaactggaactgatgaacgcaacatttgatgagaaatcgcgtgaactggtgaccttagcgaaagggcgcggattaagcgattgtggcattcaggcgcgctggcgctttgacggtcagcgttttcgcctggtgcgttacgccgcagaacctacctgcgataactggcatgggccagacgccaggcccacgttgtggatcacccgttaa

SEQ ID NO: 71203 - protein, 347 aa, Shigella flexneri 2a str. 301
MRYRIFLLFFFALLPTSLVWAAPAQRAFSDWQVTCNNQNFCVARNTGDHNGLVMTLSRSAGAHTDAVLRIERGGLKSPDASEGEIAPRLLLDGEPLALSGDKWRISPWLLVTDDTATITAFLQIIQEGKAITLRDGNQTISLSGLKAALLFIDAQQKRVGSETAWIKKGDEPPLSVPPAPALKEVAVVNPTPTPLSLEERNDLLDYGNWRMNGLRCSLDPLRREVNVTALTDDKALMMISCEAGAYNTIDLAWIVSRKKPLASRPVRLRLPFNNGQETNELELMNATFDEKSRELVTLAKGRGLSDCGIQARWRFDGQRFRLVRYAAEPTCDNWHGPDARPTLWITR

SEQ ID NO: 71204 - DNA, 1044 bp, Salmonella enterica subsp. enterica serovar Typhi Ty2
  CDS (1)..(1044): transl_table=11
atgcgctaccgcgttattcttttttgtctgtttggcctgttgccggtccagctactgtgggctgcgccagcgcaacggactttttccgactggcaggtcacctgcaataaccaaaatttttgcgtagcgcgcaatactggcgaacatcatgggctggtgatgacattaagccgcagcgccggggcgcgtaccgatgcggtactgcgtatcgaccgcggcggtttggcgccgcccgacgctaaagaagccgcaattgcgcctcgcttattgctggatggcaaaccgctttcgttcaacagttcacactggcgcgtgtcgccctggcatctcatgaccggcgatcctgccaccatcaccgcatttttacagacgattcaggatgcgcaggccatcaccttaaaaaacggcgttcagacgctttcgctggcgggattaaaagcggcattactgtttatcgacgcgcaacaaaaacgtgtgggcagcgaaaccgcctggattgaaaaaggaaacgaaccgccgctcagcgtgcccccggcaccggcattaaaggggatcgccgttattaatccaacgcccgtaccgctgagtgaggaagaacgcgacgatctgctggactacgccgcatggcgggtaaacggcattcgttgttcgcttgacccgctgcgtcgcgagacgcaggtcagcgcgttgacggatgataaagcgttattgattgttaactgcgaagccggcgcctataacactattgatctcgcctgggtagtttcacgcaaaaaaacgctcgtctcgcgcgccgtacgtttgcggctgccgtttaatcgcggcgtcgaaagtaatgacatggagttgatgaacgccttctttgacgagaaaacgcgcgagctggtgacgttggcgaaagggcgggggttaaccgactgtggtatccagacgcgctggcgctatgatggcgatcgttttcgtctggtacgttatgccgaagaaccgagctgcgatagctggcacgggccggatgcctggcctacgctgtggatcacgcgttga

SEQ ID NO: 71205 - protein, 347 aa, Salmonella enterica subsp. enterica serovar Typhi Ty2
MRYRVILFCLFGLLPVQLLWAAPAQRTFSDWQVTCNNQNFCVARNTGEHHGLVMTLSRSAGARTDAVLRIDRGGLAPPDAKEAAIAPRLLLDGKPLSFNSSHWRVSPWHLMTGDPATITAFLQTIQDAQAITLKNGVQTLSLAGLKAALLFIDAQQKRVGSETAWIEKGNEPPLSVPPAPALKGIAVINPTPVPLSEEERDDLLDYAAWRVNGIRCSLDPLRRETQVSALTDDKALLIVNCEAGAYNTIDLAWVVSRKKTLVSRAVRLRLPFNRGVESNDMELMNAFFDEKTRELVTLAKGRGLTDCGIQTRWRYDGDRFRLVRYAEEPSCDSWHGPDAWPTLWITR

SEQ ID NO: 71206 - DNA, 1149 bp, Burkholderia sp. 383
  CDS (1)..(1149): transl_table=11
atgtcgcaccgcctttcgctcgccatcgccgccctcctcgccgtttccccgatcgttgcccaggctcgcccgctcgcgcggccgccggtcgagcgcgatttcaagaactggtcggtcgtctgcgacaacggcaaccgttgcattgccgaaagccacgccgacgatatcgacgacgcacgcaccagcctcatcctgcgcgtgacgcgcgatgccggccccgatgcgcaagcctcgctcgacatttacgcctcggcgccgctggacctgcgcaccgcacgcgtggatggccgcccgttcgatgcaatggcggcccaatggcatgcgttcggcggcaaaccggatgacgacgaagcgcacccgttcaggatccggaccaacgatccggcaacggttgccgcatggctcaccgcatcgcgcaatgcgcaactgctgagcttcggcgatccggcgtcggcccaaaccgcccgcacgccgttgacgggattgaatgccgcgctgctgctgatcgacgacacgcagggccgtgtcggtaccgtcacggccctgctgcgcccgggcacccggcccgcgtcgtcggtgccggccgcgccggcattgccgcccgccgtcacgccggcaccggccgtcgcgaacctgtcagccgccgagcagcgcccgctcgtcgatgcagtgctcgcgaagttcggcggcgacgtgaagcaatgtgcggccgatgtcgaagacgaaatgccggcgagcgatcgcaggaaggcgtcgactgccgtcgcgatctccgccgacgaagcgctggtcgcaataccgtgccagaccagcagcatgtataaccacaccgacctgtggtatcgcgtgcgacgaactgcgccctactcgccgacggcgatgaatttcggcgagaacgcgaacgcggggctcgattcggcatcgttcgcgaacgaactgaccgaggccggctacgattccgccagcgcgacgctgtcgagcaaggtccggctgcgcagtgccggcgattgcggctcgaccgcatcgtggatcttcgacggccggcgcttcatgctcggcgatatcgccacgcacggcacgtgcaacggcctgttcgacgatcagtggccacgcctgtatcgacgggccgatgcggcaggaaaccgctga

SEQ ID NO: 71207 - protein, 382 aa, Burkholderia sp. 383
MSHRLSLAIAALLAVSPIVAQARPLARPPVERDFKNWSVVCDNGNRCIAESHADDIDDARTSLILRVTRDAGPDAQASLDIYASAPLDLRTARVDGRPFDAMAAQWHAFGGKPDDDEAHPFRIRTNDPATVAAWLTASRNAQLLSFGDPASAQTARTPLTGLNAALLLIDDTQGRVGTVTALLRPGTRPASSVPAAPALPPAVTPAPAVANLSAAEQRPLVDAVLAKFGGDVKQCAADVEDEMPASDRRKASTAVAISADEALVAIPCQTSSMYNHTDLWYRVRRTAPYSPTAMNFGENANAGLDSASFANELTEAGYDSASATLSSKVRLRSAGDCGSTASWIFDGRRFMLGDIATHGTCNGLFDDQWPRLYRRADAAGNR

SEQ ID NO: 71208 - DNA, 1086 bp, Burkholderia sp. 383
  CDS (1)..(1086): transl_table=11
atgaaaacgcgtgccattgcgctaaacgcggcgctcattgcgcttttcgccggcatagccgtcccgcttgtcgccaaggcaacgcctccccaggagaccagcgcggccagctacgacacctacaagtcgtggtgggtcgcgtgcgacaacggcctgacctgcgaagcgaagggtttcgcgagcggtggtgaagccagtgcggacctgcgcttcattcgggccgccgggccggacggctcgctcgaagcgcggctgcaggtcgtcactcatgccagtatcgatctcgatgatttgcgtgtagatggaaagccgctgcggttggacgcgtcggcctggagcgtgaacctcgactccaccaacgatatcgcgacgttgtcgacaaagcggccggcagccgtggcagccttcgtatcccggcttcgcaacggcgccaggctcgaggtcggttcggatacgaacgcttatgttcccctcgacggcctggccgccgccctgttgcgcatcgatgaccggcaggggcgcatcggcggtgttagcgcgttgatccgcaagggcctcgcgcccgcctcacaagtgacgcccgcaccttcactaccggtcgtaccggcacggaagatcgctgcgcagttgtccgatcaggaggaagcgcgcctgatcgcgcgcacgaaacgtatccaggacgccagcagctgcgaagagaatgcgtcggcgcatctcgaagaagccgcctatgcgctcgactcacggaatgcgctggtctttcttccctgcatcgcgggtgcctaccagggatcgtcggacgtgttcatcgcgccacgcaccggtggcggcgcaccgcagccgatcaagctggggggccctgtgggaggcgtgatggatccctcgctggtcgaaccacactttgacccggctaccggcaccctgtcgacttttgccaaggggcgcggtctggccgactgcggttttcaggccgaatggatctgggacggccgggcatttcagatttcggccgcgtcgcagcaggagacgtgcggcggtacggcaccgggcgactggcccacactctatcggtcgcgaaagaagtaa

SEQ ID NO: 71209 - protein, 361 aa, Burkholderia sp. 383
MKTRAIALNAALIALFAGIAVPLVAKATPPQETSAASYDTYKSWWVACDNGLTCEAKGFASGGEASADLRFIRAAGPDGSLEARLQVVTHASIDLDDLRVDGKPLRLDASAWSVNLDSTNDIATLSTKRPAAVAAFVSRLRNGARLEVGSDTNAYVPLDGLAAALLRIDDRQGRIGGVSALIRKGLAPASQVTPAPSLPVVPARKIAAQLSDQEEARLIARTKRIQDASSCEENASAHLEEAAYALDSRNALVFLPCIAGAYQGSSDVFIAPRTGGGAPQPIKLGGPVGGVMDPSLVEPHFDPATGTLSTFAKGRGLADCGFQAEWIWDGRAFQISAASQQETCGGTAPGDWPTLYRSRKK

SEQ ID NO: 71210 - DNA, 20 bp, Artificial sequence
  primer
atgcgctatcgcattttcct

SEQ ID NO: 71211 - DNA, 23 bp, Artificial sequence
  primer
ttaacgggtgatccacaacgtgg

SEQ ID NO: 71212 - protein, 374 aa, Artificial sequence
  consensus sequence
  Variant (2)..(8): Xaa in position 2 to 8 is any amino acid
  Variant (10)..(16): Xaa in position 10 to 16 is any amino acid
  Variant (18)..(19): Xaa in position 18 to 19 is any amino acid
  Variant (21)..(21): Xaa in position 21 is any amino acid
  Variant (22)..(27): Xaa in position 22 to 27 is any or no amino acid
  Variant (29)..(30): Xaa in position 29 to 30 is any amino acid
  Variant (32)..(32): Xaa in position 32 is any amino acid
  Variant (34)..(34): Xaa in position 34 is any amino acid
  Variant (36)..(36): Xaa in position 36 is any amino acid
  Variant (38)..(38): Xaa in position 38 is any amino acid
  Variant (40)..(40): Xaa in position 40 is any amino acid
  Variant (42)..(42): Xaa in position 42 is any amino acid
  Variant (44)..(54): Xaa in position 44 to 54 is any amino acid
  Variant (57)..(61): Xaa in position 57 to 61 is any amino acid
  Variant (63)..(64): Xaa in position 63 to 64 is any amino acid
  Variant (66)..(70): Xaa in position 66 to 70 is any amino acid
  Variant (71)..(71): Xaa in position 71 is any or no amino acid
  Variant (73)..(85): Xaa in position 73 to 85 is any amino acid
  Variant (87)..(88): Xaa in position 87 to 88 is any amino acid
  Variant (89)..(91): Xaa in position 89 to 91 is any or no amino acid
  Variant (94)..(94): Xaa in position 94 is any amino acid
  Variant (97)..(102): Xaa in position 97 to 102 is any amino acid
  Variant (104)..(106): Xaa in position 104 to 106 is any amino acid
  Variant (107)..(116): Xaa in position 107 to 116 is any or no amino acid
  Variant (118)..(119): Xaa in position 118 to 119 is any amino acid
  Variant (121)..(121): Xaa in position 121 is any amino acid
  Variant (123)..(123): Xaa in position 123 is any amino acid
  Variant (125)..(125): Xaa in position 125 is any amino acid
  Variant (128)..(129): Xaa in position 128 to 129 is any amino acid
  Variant (133)..(151): Xaa in position 133 to 151 is any amino acid
  Variant (152)..(155): Xaa in position 152 to 155 is any or no amino acid
  Variant (157)..(157): Xaa in position 157 is any amino acid
  Variant (160)..(160): Xaa in position 160 is any amino acid
  Variant (165)..(165): Xaa in position 165 is any amino acid
  Variant (168)..(169): Xaa in position 168 to 169 is any amino acid
  Variant (171)..(171): Xaa in position 171 is any amino acid
  Variant (175)..(176): Xaa in position 175 to 176 is any amino acid
  Variant (179)..(179): Xaa in position 179 is any amino acid
  Variant (181)..(181): Xaa in position 181 is any amino acid
  Variant (184)..(185): Xaa in position 184 to 185 is any amino acid
  Variant (187)..(188): Xaa in position 187 to 188 is any amino acid
  Variant (197)..(202): Xaa in position 197 to 202 is any amino acid
  Variant (203)..(203): Xaa in position 203 is any or no amino acid
  Variant (205)..(208): Xaa in position 205 to 208 is any amino acid
  Variant (211)..(212): Xaa in position 211 to 212 is any amino acid
  Variant (214)..(216): Xaa in position 214 to 216 is any amino acid
  Variant (218)..(218): Xaa in position 218 is any amino acid
  Variant (220)..(223): Xaa in position 220 to 223 is any amino acid
  Variant (224)..(226): Xaa in position 224 to 226 is any or no amino acid
  Variant (228)..(235): Xaa in position 228 to 235 is any amino acid
  Variant (236)..(245): Xaa in position 236 to 245 is any or no amino acid
  Variant (247)..(247): Xaa in position 247 is any amino acid
  Variant (249)..(252): Xaa in position 249 to 252 is any amino acid
  Variant (255)..(256): Xaa in position 255 to 256 is any amino acid
  Variant (258)..(258): Xaa in position 258 is any amino acid
  Variant (261)..(264): Xaa in position 261 to 264 is any amino acid
  Variant (266)..(266): Xaa in position 266 is any amino acid
  Variant (271)..(273): Xaa in position 271 to 273 is any amino acid
  Variant (274)..(274): Xaa in position 274 is any or no amino acid
  Variant (277)..(279): Xaa in position 277 to 279 is any amino acid
  Variant (281)..(281): Xaa in position 281 is any amino acid
  Variant (283)..(292): Xaa in position 283 to 292 is any amino acid
  Variant (294)..(295): Xaa in position 294 to 295 is any amino acid
  Variant (297)..(297): Xaa in position 297 is any amino acid
  Variant (299)..(299): Xaa in position 299 is any amino acid
  Variant (301)..(304): Xaa in position 301 to 304 is any amino acid
  Variant (305)..(308): Xaa in position 305 to 308 is any or no amino acid
  Variant (311)..(314): Xaa in position 311 to 314 is any amino acid
  Variant (317)..(321): Xaa in position 317 to 321 is any amino acid
  Variant (323)..(323): Xaa in position 323 is any amino acid
  Variant (325)..(325): Xaa in position 325 is any amino acid
  Variant (332)..(332): Xaa in position 332 is any amino acid
  Variant (336)..(336): Xaa in position 336 is any amino acid
  Variant (338)..(339): Xaa in position 338 to 339 is any amino acid
  Variant (341)..(342): Xaa in position 341 to 342 is any amino acid
  Variant (345)..(345): Xaa in position 345 is any amino acid
  Variant (348)..(348): Xaa in position 348 is any amino acid
  Variant (350)..(352): Xaa in position 350 to 352 is any amino acid
  Variant (354)..(357): Xaa in position 354 to 357 is any amino acid
  Variant (359)..(362): Xaa in position 359 to 362 is any amino acid
  Variant (363)..(363): Xaa in position 363 is any or no amino acid
  Variant (366)..(366): Xaa in position 366 is any amino acid
  Variant (371)..(373): Xaa in position 371 to 373 is any amino acid
LXXXXXXXPXXXXXXXPXXRXXXXXXXFXXWXVXCXNXNXCXAXXXXXXXXXXXTLXXXXXAXXDXXXXXXRXXXXXXXXXXXXXAXXXXXDGXPLXXXXXXWXXXXXXXXXXXXXPXXLXTXDXATXXAFLXXXXXXXXXXXXXXXXXXXXXXXLXGLXAALLXIDXXQXRVGXXTAXIXKGXXPXXSVPPAPALXXXXXXXPXXXXLSXXEXXXLXDXXXXXXXGXXXXXXXXXXXXXXXXXXRXEXXXXALXXDXALXXXXCXAGAYXXXXDLXXXVXRXXXXXXXXXXLXXPXNXGXXXXXXXXELXXXXFDXXXXXLXTXAKGRGLXDCGXQXXWXXDGXRFXLXXXAXXXXCXXXXXPDXWPTLXXXR

SEQ ID NO: 71213 - protein, 58 aa, Artificial sequence
  protein pattern
  Variant (2)..(3): Xaa in position 2 to 3 is any amino acid
  Variant (4)..(6): Xaa in position 4 to 6 is any or no amino acid
  Variant (8)..(8): Xaa in position 8 is any or no amino acid
  Variant (10)..(10): Xaa in position 10 is Glu or Pro
  Variant (11)..(11): Xaa in position 11 is any amino acid
  Variant (12)..(12): Xaa in position 12 is Ser or Thr
  Variant (13)..(13): Xaa in position 13 is any amino acid
  Variant (14)..(14): Xaa in position 14 is Glu or Thr
  Variant (16)..(16): Xaa in position 16 is Ser or Val
  Variant (18)..(18): Xaa in position 18 is Phe or Leu
  Variant (25)..(25): Xaa in position 25 is Ala, Ser or Thr
  Variant (29)..(29): Xaa in position 29 is Phe or Ile
  Variant (31)..(31): Xaa in position 31 is Ala or Thr
  Variant (32)..(32): Xaa in position 32 is Glu or Arg
  Variant (34)..(34): Xaa in position 34 is any amino acid
  Variant (35)..(35): Xaa in position 35 is Phe, Trp or Tyr
  Variant (38)..(38): Xaa in position 38 is Asp, Gln or Arg
  Variant (39)..(39): Xaa in position 39 is any amino acid
  Variant (41)..(41): Xaa in position 41 is Gln or Arg
  Variant (42)..(42): Xaa in position 42 is Ile or Leu
  Variant (43)..(43): Xaa in position 43 is Ser or Val
  Variant (44)..(45): Xaa in position 44 to 45 is any amino acid
  Variant (46)..(46): Xaa in position 46 is Ala or Ser
  Variant (47)..(47): Xaa in position 47 is Ala, Glu or Gln
  Variant (48)..(48): Xaa in position 48 is Glu or Gln
  Variant (49)..(49): Xaa in position 49 is Glu or Pro
  Variant (50)..(50): Xaa in position 50 is Ser or Thr
  Variant (52)..(52): Xaa in position 52 is Asp or Gly
  Variant (53)..(53): Xaa in position 53 is Gly, Asn or Ser
  Variant (54)..(55): Xaa in position 54 to 55 is any amino acid
  Variant (56)..(57): Xaa in position 56 to 57 is Gly or Pro
EXXXXXFXDXXXXXLXTXAKGRGLXDCGXQXXWXXDGXXFXXXXXXXXXXCXXXXXXD

SEQ ID NO: 71214 - protein, 42 aa, Artificial sequence
  protein pattern
  Variant (2)..(2): Xaa in position 2 is Ala, Ser or Thr
  Variant (5)..(5): Xaa in position 5 is any amino acid
  Variant (10)..(10): Xaa in position 10 is Phe or Leu
  Variant (13)..(13): Xaa in position 13 is any amino acid
  Variant (14)..(14): Xaa in position 14 is any or no amino acid
  Variant (16)..(16): Xaa in position 16 is any amino acid
  Variant (17)..(17): Xaa in position 17 is any or no amino acid
  Variant (21)..(21): Xaa in position 21 is Ser or Thr
  Variant (22)..(22): Xaa in position 22 is any amino acid
  Variant (25)..(25): Xaa in position 25 is any amino acid
  Variant (26)..(26): Xaa in position 26 is Ile or Leu
  Variant (27)..(27): Xaa in position 27 is Glu, Lys or Arg
  Variant (28)..(28): Xaa in position 28 is any amino acid
  Variant (30)..(30): Xaa in position 30 is Asp, Asn or Thr
  Variant (31)..(31): Xaa in position 31 is Glu or Arg
  Variant (33)..(33): Xaa in position 33 is Ala or Pro
  Variant (34)..(34): Xaa in position 34 is any amino acid
  Variant (38)..(38): Xaa in position 38 is Ala or Pro
LXGLXAALLXIDXXQXXRVGXXTAXXXXGXXPXXSVPXAPAL

SEQ ID NO: 71215 - protein, 34 aa, Artificial sequence
  protein pattern
  Variant (2)..(4): Xaa in position 2 to 4 is any or no amino acid
  Variant (6)..(6): Xaa in position 6 is Gln or Ser
  Variant (8)..(8): Xaa in position 8 is Thr or Val
  Variant (10)..(10): Xaa in position 10 is any or no amino acid
  Variant (12)..(12): Xaa in position 12 is Gly or Asn
  Variant (13)..(13): Xaa in position 13 is Asn or Gln
  Variant (14)..(14): Xaa in position 14 is Asn or Arg
  Variant (15)..(16): Xaa in position 15 to 16 is any amino acid
  Variant (17)..(17): Xaa in position 17 is Ala or Val
  Variant (18)..(18): Xaa in position 18 is Ala or Glu
  Variant (19)..(19): Xaa in position 19 is Arg or Ser
  Variant (20)..(20): Xaa in position 20 is any amino acid
  Variant (21)..(21): Xaa in position 21 is Ala or Thr
  Variant (22)..(22): Xaa in position 22 is Asp or Gly
  Variant (23)..(23): Xaa in position 23 is Asp or Glu
  Variant (24)..(25): Xaa in position 24 to 25 is any amino acid
  Variant (26)..(26): Xaa in position 26 is Asp or Gly
  Variant (27)..(27): Xaa in position 27 is Ala or Leu
  Variant (28)..(29): Xaa in position 28 to 29 is any amino acid
  Variant (30)..(30): Xaa in position 30 is Ser or Thr
  Variant (32)..(33): Xaa in position 32 to 33 is any amino acid
  Variant (34)..(34): Xaa in position 34 is Arg or Ser
DXXXWXVXCXNXXXXXXXXXXXXXXXXXXXLXXX

SEQ ID NO: 71216 - protein, 14 aa, Artificial sequence
  protein pattern
  Variant (3)..(3): Xaa in position 3 is any or no amino acid
  Variant (5)..(5): Xaa in position 5 is any or no amino acid
  Variant (8)..(8): Xaa in position 8 is any or no amino acid
  Variant (10)..(11): Xaa in position 10 to 11 is any amino acid
  Variant (12)..(12): Xaa in position 12 is Ser or Val
  Variant (14)..(14): Xaa in position 14 is Lys or Arg
YNXTXDLXWXXXRX

SEQ ID NO: 71217 - protein, 28 aa, Artificial sequence
  protein pattern
  Variant (2)..(2): Xaa in position 2 is Ala, Asp, Gly or Asn
  Variant (4)..(4): Xaa in position 4 is Pro or Thr
  Variant (7)..(8): Xaa in position 7 to 8 is any amino acid
  Variant (10)..(10): Xaa in position 10 is any amino acid
  Variant (12)..(12): Xaa in position 12 is Gln or Thr
  Variant (13)..(14): Xaa in position 13 to 14 is any amino acid
  Variant (15)..(15): Xaa in position 15 is Gln or Arg
  Variant (16)..(16): Xaa in position 16 is Asp, Glu or Asn
  Variant (17)..(17): Xaa in position 17 is Ala or Gly
  Variant (18)..(18): Xaa in position 18 is any amino acid
  Variant (19)..(19): Xaa in position 19 is Ala or Leu
  Variant (20)..(20): Xaa in position 20 is Ile or Leu
  Variant (21)..(21): Xaa in position 21 is Ser or Thr
  Variant (22)..(22): Xaa in position 22 is Phe or Leu
  Variant (23)..(23): Xaa in position 23 is any amino acid
  Variant (24)..(24): Xaa in position 24 is Asp or Asn
  Variant (25)..(25): Xaa in position 25 is Gly or Pro
  Variant (26)..(26): Xaa in position 26 is Ala, Asp, Asn or Val
  Variant (27)..(27): Xaa in position 27 is Gln or Ser
  Variant (28)..(28): Xaa in position 28 is Ala or Thr
TXDXATXXAXLXXXXXXXXXXXXXXXXX

SEQ ID NO: 71218 - protein, 28 aa, Artificial sequence
  protein pattern
  Variant (2)..(2): Xaa in position 2 is Ala or Thr
  Variant (3)..(3): Xaa in position 3 is Pro or Val
  Variant (4)..(4): Xaa in position 4 is Ala, Thr or Val
  Variant (5)..(5): Xaa in position 5 is Asn or Pro
  Variant (8)..(9): Xaa in position 8 to 9 is any or no amino acid
  Variant (11)..(11): Xaa in position 11 is any amino acid
  Variant (12)..(12): Xaa in position 12 is any or no amino acid
  Variant (14)..(14): Xaa in position 14 is Asp, Asn or Pro
  Variant (15)..(15): Xaa in position 15 is any amino acid
  Variant (16)..(16): Xaa in position 16 is Leu or Val
  Variant (17)..(17): Xaa in position 17 is any amino acid
  Variant (18)..(18): Xaa in position 18 is Ala or Asp
  Variant (19)..(19): Xaa in position 19 is any amino acid
  Variant (20)..(20): Xaa in position 20 is Ala, Gly or Leu
  Variant (21)..(21): Xaa in position 21 is Ala or Asn
  Variant (22)..(24): Xaa in position 22 to 24 is any amino acid
  Variant (25)..(25): Xaa in position 25 is Gly or Asn
  Variant (26)..(26): Xaa in position 26 is Asp or Gly
  Variant (27)..(27): Xaa in position 27 is Ile, Leu or Val
  Variant (28)..(28): Xaa in position 28 is Lys or Arg
PXXXXLSXXEXXRXXXXXXXXXXXXXXX

SEQ ID NO: 71219 - protein, 26 aa, Artificial sequence
  protein pattern
  Variant (2)..(2): Xaa in position 2 is any amino acid
  Variant (3)..(4): Xaa in position 3 to 4 is any or no amino acid
  Variant (6)..(6): Xaa in position 6 is any amino acid
  Variant (8)..(8): Xaa in position 8 is Asp or Arg
  Variant (10)..(11): Xaa in position 10 to 11 is any amino acid
  Variant (12)..(12): Xaa in position 12 is Gly or Ser
  Variant (13)..(13): Xaa in position 13 is Ala or Gly
  Variant (14)..(14): Xaa in position 14 is Leu or Pro
  Variant (15)..(15): Xaa in position 15 is any amino acid
  Variant (16)..(16): Xaa in position 16 is Asp, Pro or Ser
  Variant (17)..(17): Xaa in position 17 is Leu or Pro
  Variant (18)..(18): Xaa in position 18 is Asp, Glu or Arg
  Variant (19)..(19): Xaa in position 19 is Ala or Thr
  Variant (20)..(20): Xaa in position 20 is any amino acid
  Variant (21)..(21): Xaa in position 21 is Glu or Arg
  Variant (22)..(22): Xaa in position 22 is Ala, Gly or Val
  Variant (23)..(23): Xaa in position 23 is Ala, Asp or Glu
  Variant (24)..(24): Xaa in position 24 is Gly or Ile
  Variant (25)..(25): Xaa in position 25 is any amino acid
AXXXAXLXIXXXXXXXXXXXXXXXXP

SEQ ID NO: 71220 - protein, 17 aa, Artificial sequence
  protein pattern
  Variant (2)..(2): Xaa in position 2 is Ile or Leu
  Variant (3)..(3): Xaa in position 3 is Ser or Thr
  Variant (4)..(4): Xaa in position 4 is Ala or Asp
  Variant (6)..(6): Xaa in position 6 is Glu or Lys
  Variant (9)..(9): Xaa in position 9 is any amino acid
  Variant (10)..(10): Xaa in position 10 is any or no amino acid
  Variant (12)..(12): Xaa in position 12 is any amino acid
  Variant (13)..(13): Xaa in position 13 is any or no amino acid
  Variant (15)..(15): Xaa in position 15 is Glu or Gln
  Variant (16)..(16): Xaa in position 16 is Ala or Thr
  Variant (17)..(17): Xaa in position 17 is Gly or Ser
AXXXDXALXXIXXCXXX

SEQ ID NO: 71221 - DNA, 879 bp, Escherichia coli K12
  CDS (1)..(879): transl_table=11
atgttcacgggaagtattgtcgcgattgttactccgatggatgaaaaaggtaatgtctgtcgggctagcttgaaaaaactgattgattatcatgtcgccagcggtacttcggcgatcgtttctgttggcaccactggcgagtccgctaccttaaatcatgacgaacatgctgatgtggtgatgatgacgctggatctggctgatgggcgcattccggtaattgccgggaccggcgctaacgctactgcggaagccattagcctgacgcagcgcttcaatgacagtggtatcgtcggctgcctgacggtaaccccttactacaatcgtccgtcgcaagaaggtttgtatcagcatttcaaagccatcgctgagcatactgacctgccgcaaattctgtataatgtgccgtcccgtactggctgcgatctgctcccggaaacggtgggccgtctggcgaaagtaaaaaatattatcggaatcaaagaggcaacagggaacttaacgcgtgtaaaccagatcaaagagctggtttcagatgattttgttctgctgagcggcgatgatgcgagcgcgctggacttcatgcaattgggcggtcatggggttatttccgttacggctaacgtcgcagcgcgtgatatggcccagatgtgcaaactggcagcagaagggcattttgccgaggcacgcgttattaatcagcgtctgatgccattacacaacaaactatttgtcgaacccaatccaatcccggtgaaatgggcatgtaaggaactgggtcttgtggcgaccgatacgctgcgcctgccaatgacaccaatcaccgacagtggtcgtgagacggtcagagcggcgcttaagcatgccggtttgctgtaa

SEQ ID NO: 71222 - protein, 292 aa, Escherichia coli K12
MFTGSIVAIVTPMDEKGNVCRASLKKLIDYHVASGTSAIVSVGTTGESATLNHDEHADVVMMTLDLADGRIPVIAGTGANATAEAISLTQRFNDSGIVGCLTVTPYYNRPSQEGLYQHFKAIAEHTDLPQILYNVPSRTGCDLLPETVGRLAKVKNIIGIKEATGNLTRVNQIKELVSDDFVLLSGDDASALDFMQLGGHGVISVTANVAARDMAQMCKLAAEGHFAEARVINQRLMPLHNKLFVEPNPIPVKWACKELGLVATDTLRLPMTPITDSGRETVRAALKHAGLL

SEQ ID NO: 71223 - DNA, 1095 bp, Arabidopsis thaliana
  CDS (1)..(1095)
atgtcagctttgaaaaattacggcttgatctccattgattctgccctccattttcctcgatcaaatcaattgcagagctataagaggaatgcaaaatgggtctctccaatagcagctgttgtacctaacttccatcttcctatgcgcagtctcgaggataaaaacaggacaaacacagacgacataaggtcccttagagtgatcacagccattaagacaccgtatttacctgatggaagattcgacctccaagcatacgatgacttagtcaacacgcagatagaaaacggtgctgaaggtgtgattgttggtggtacaactggtgaaggccaattgatgagctgggatgagcacataatgcttatcggccatactgtaaattgttttgggggaaggatcaaagtcattggaaacactggaagtaactcgactagggaagctattcatgccactgagcaaggattcgccatgggaatgcacggggcactgcacattaacccttactatggaaaaacatccattgaaggcatgaatgcgcattttcaaaccgttcttcatatgggaccgactattatatacaacgtgccaggtcgaacgtgccaggatatacctccccaggttatctttaaactctctcagaaccctaatatggctggggttaaggaatgcgttggtaataaccgagttgaagagtatactgagaagggaattgtcgtttggagtggaaatgatgatcagtgccatgattctagatgggatcacggtgccactggagtgatatcggttactagcaatttagttccgggtttgatgaggaagttgatgtttgaaggtagaaactcagcgttgaacgcaaagcttcttcctttaatggattggctattccaagaaccgaatcccattggtgtaaacactgctttggctcagttaggagttgcgaggccggtttttcggttaccttatgtgccattgcctctgtccaaaaggattgagttcgttaaactggtgaaggaaatcggaagggagcattttgtaggagacagagatgttcaggtacttgatgatgatgacttcatcttaatcggtcgatattag

SEQ ID NO: 71224 - protein, 364 aa, Arabidopsis thaliana
MSALKNYGLISIDSALHFPRSNQLQSYKRNAKWVSPIAAVVPNFHLPMRSLEDKNRTNTDDIRSLRVITAIKTPYLPDGRFDLQAYDDLVNTQIENGAEGVIVGGTTGEGQLMSWDEHIMLIGHTVNCFGGRIKVIGNTGSNSTREAIHATEQGFAMGMHGALHINPYYGKTSIEGMNAHFQTVLHMGPTIIYNVPGRTCQDIPPQVIFKLSQNPNMAGVKECVGNNRVEEYTEKGIVVWSGNDDQCHDSRWDHGATGVISVTSNLVPGLMRKLMFEGRNSALNAKLLPLMDWLFQEPNPIGVNTALAQLGVARPVFRLPYVPLPLSKRIEFVKLVKEIGREHFVGDRDVQVLDDDDFILIGRY

SEQ ID NO: 71225 - DNA, 954 bp, Streptomyces coelicolor A3(2)
  CDS (1)..(954): transl_table=11
gtggagctacactgtctggccgccgacactactcccatgacgacagacgacgactccgcccccttcggccgcagcctgtgcgccatggtcacgcccttcaccggctccggcgctctcgacctcgacggtgcccagcggctcgccgaccggctggtcgcgcggggctgtgacggcctggtgctgtccggcaccacgggcgagtcgccgaccaccacggacgccgagaaggcggccctggtgacggcggtcagggaggcggtcggggaccgcgcggcactcgtcgccggggtcggcaccgcggacacccggcacaccgtggaactggccctggcggccgagaaggccggcgcggacggactgctggtggtcgcgccgtactacagcaggccgccgcaggacgccctggaggcgcacttccgcgaggtcgccgacgcgagcggcctgcccgtgatgctgtacgacatcccgggccgcaccggcacccgtatcgaacccgacaccgtcgtccggctcgccgcgcacccgcgcatcgtcgccgtcaaggactgcgcctacgacctcctcggcacccagaaggtgctgtcccgcaccggtctggcctactacgcgggctgcgacgaacagatcctccccctctacgcgatcggagcggcggggtacgtcagcaccgtcgccaacgtcgtgccggagctgttccgggccgtcctcgacgccttcgacgcgggcgacaccggccgggccgcgctgctccagcggcgggcggtcccgctcgtcgagtcgatgatggcggccggtctgcccggcacggtcaccgccaaggccctcctcggcgcgctgggcctgccggcgggcccggtccgcgcaccgctgcggtccgcggaccgggagaccaccgccggtctgctggcggcctacggagaactggccgccgacgccggtcagtcccaggcgtag

SEQ ID NO: 71226 - protein, 317 aa, Streptomyces coelicolor A3(2)
MELHCLAADTTPMTTDDDSAPFGRSLCAMVTPFTGSGALDLDGAQRLADRLVARGCDGLVLSGTTGESPTTTDAEKAALVTAVREAVGDRAALVAGVGTADTRHTVELALAAEKAGADGLLVVAPYYSRPPQDALEAHFREVADASGLPVMLYDIPGRTGTRIEPDTVVRLAAHPRIVAVKDCAYDLLGTQKVLSRTGLAYYAGCDEQILPLYAIGAAGYVSTVANVVPELFRAVLDAFDAGDTGRAALLQRRAVPLVESMMAAGLPGTVTAKALLGALGLPAGPVRAPLRSADRETTAGLLAAYGELAADAGQSQA

SEQ ID NO: 71227 - DNA, 900 bp, Yersinia pestis KIM
  CDS (1)..(900): transl_table=11
atgtttacgggaagcccaatgtttacaggcagcatagttgcgctaataacgccaatggacgacaacggtgatgtcgatcgtgcaagcctgaagagcctgattgattaccacgtggccagtgggactgcggcgattgtctctgtggggacgacgggtgagtcagcaacgttgaatcatgatgagcatgtcgatgtggtcatgcagacactcgaactggctgatggccggatcccggtgattgccggaacaggggccaattccacctccgaagccatttctctcactcaacggtttaatgataccggtgttgtgggctgcttaacagtgacgccatattataaccggccaatgcaggaagggttataccaacactttaaagcgatcgctgaaagtaccgatttgccacaaattctttataatgtgccttcgcgtacgggttgcgatatgttaccgccaaccattgctcgcttagcgaagattaaaaatattgttgctgttaaagaagccacagggaacttaagtcgggttagtcagatccaagtgctggttgatgatgaagatttcatcctgctcagtggtgatgatgcgagtggactggactttatgcaactgggtggtaaaggtgttatttctgtgacggcaaatatcgctgcccgtgaaatggttgaactgtgcgcattagcagcacagggaaatttcgccgaaggtcgccgtttgaatcagcgcttgatgccgttgcatcagcatttatttgtagaagcaaacccaattccggttaaatgggccgcgaagaggttgggattaatggcaaatgatactatgcgcctgccaatgaccccactgactgatccggccaaacggattgtggaagacgcgttgaaaagcgcaggtttgctgtaa

SEQ ID NO: 71228 - protein, 299 aa, Yersinia pestis KIM
MFTGSPMFTGSIVALITPMDDNGDVDRASLKSLIDYHVASGTAAIVSVGTTGESATLNHDEHVDVVMQTLELADGRIPVIAGTGANSTSEAISLTQRFNDTGVVGCLTVTPYYNRPMQEGLYQHFKAIAESTDLPQILYNVPSRTGCDMLPPTIARLAKIKNIVAVKEATGNLSRVSQIQVLVDDEDFILLSGDDASGLDFMQLGGKGVISVTANIAAREMVELCALAAQGNFAEGRRLNQRLMPLHQHLFVEANPIPVKWAAKRLGLMANDTMRLPMTPLTDPAKRIVEDALKSAGLL

SEQ ID NO: 71229 - DNA, 888 bp, Pseudomonas putida KT2440
  CDS (1)..(888): transl_table=11
atgattgcgggcagtatggtggcattggtcacacccatggatgcacaagggcgtgttgactggggcagcctcgacaaacttgtagacttccacctggaaaacggcacccatgcgatcgtcgctgtcggcaccaccggtgagtcggccacgctggatgtcgaagaacacatcctggtcatcaagcacgtggtcgagcgcgtcaaacgcagcgccaaaccgattccggtcatcgccggcaccggtgccaactccaccgccgaagccgtgcacctgacccagaacgccaagaatgctggcgccgacgcctgcctgctggttgtgccgtactacaacaagccgacgcaagaaggcctgtaccagcacttcaagcacattgccgaagccgtcgacatcccgcagatcctctacaacgttcccggccgtacctcctgcgacatgcaggccgagaccgtgatccgcctgtcgaccgtgccgaacatcatcggcatcaaggaagccacgggcgacctggcccgcgccaaggccattctcgatggcgtcagcaaggacttcatcgtcatgtccggcgacgacccgactgccgtcgagctgatcctgatgggcggcaagggcaacatctccgtcaccgccaacgtcgctccgcgcgaaatggcggacctgtgcgaggccgcccttgagggcaatgccgagaaggcccgcgcaatcaacgaaaaactcatgccgctgcacaaggacctgttctgcgagtccaacccgatcccggtgaaatgggcgctcgtcgaaatgggcctgatgcaaaaaggtattcgcctgccactgacctggctgagcgaaggctgccacgaaaaagtccgtactgccttgcgccagtccggcgtactggtttaa

SEQ ID NO: 71230 - protein, 295 aa, Pseudomonas putida KT2440
MIAGSMVALVTPMDAQGRVDWGSLDKLVDFHLENGTHAIVAVGTTGESATLDVEEHILVIKHVVERVKRSAKPIPVIAGTGANSTAEAVHLTQNAKNAGADACLLVVPYYNKPTQEGLYQHFKHIAEAVDIPQILYNVPGRTSCDMQAETVIRLSTVPNIIGIKEATGDLARAKAILDGVSKDFIVMSGDDPTAVELILMGGKGNISVTANVAPREMADLCEAALEGNAEKARAINEKLMPLHKDLFCESNPIPVKWALVEMGLMQKGIRLPLTWLSEGCHEKVRTALRQSGVLV

SEQ ID NO: 71231 - DNA, 879 bp, Pseudomonas syringae pv. tomato str. DC3000
  CDS (1)..(879): transl_table=11
atgattgcgggcagtatggtggcactggtcacaccaatggatgcacaaggtcgtctggactgggacagcctgagcaaactggttgacttccacttgcaagagggcaccaacgccattgttgccgtcggcaccacaggtgaatcggcgacgctggatgtgagcgaacacatcgaagtcatccgccgtgtggttgctcaggttgcaggacgtattccggtcatcgccggtacaggcgccaattcgacgcgcgaagccgtcgagctgaccaccaacgccaagaccgctggcgctgatgcgtgcctgctggtaacgccttattacaacaagccgacgcaggaaggcctgttccagcatttcagccacatcgccaatgccgtagacatcccgcagatcctctacaacgtgccgggccgtacggcctgcgacatgctgccagagactgttgcgcgtctgtccagggtcaagaacatcatcggcatcaaggaagccaccggcaacctgcagcgcgccaaggacattctggccagcgtcagcagcgattttctgttgtactccggtgatgacgcgacggctgtcgaactgatgctgttgggcggcaagggcaatatttccgtcacggccaacgttgcaccacgcgccatgagcgatctgtgcgcagcggccatgcgtggcgacgccgagactgcacgggcgattcaccagacgctcatgccgctcaacaataccctgttcatcgaatccaaccctatccccgtgaaatgggccttgcatgagatgggtttgatgccagacggtatccgtctgccgcttacctggctcagcgaagcctgtcacgaaccgctgcgtcaggccatgcgccagtccggcgtcctggtttaa

SEQ ID NO: 71232 - protein, 292 aa, Pseudomonas syringae pv. tomato str. DC3000
MIAGSMVALVTPMDAQGRLDWDSLSKLVDFHLQEGTNAIVAVGTTGESATLDVSEHIEVIRRVVAQVAGRIPVIAGTGANSTREAVELTTNAKTAGADACLLVTPYYNKPTQEGLFQHFSHIANAVDIPQILYNVPGRTACDMLPETVARLSRVKNIIGIKEATGNLQRAKDILASVSSDFLLYSGDDATAVELMLLGGKGNISVTANVAPRAMSDLCAAAMRGDAETARAIHQTLMPLNNTLFIESNPIPVKWALHEMGLMPDGIRLPLTWLSEACHEPLRQAMRQSGVLV

SEQ ID NO: 71233 - DNA, 879 bp, Vibrio parahaemolyticus RIMD 2210633
  CDS (1)..(879): transl_table=11
atgttttcaggaagtatcgtagcgctgattacaccattcaaagcagatggtgaagtagatttcgacggtctacaaaagctagtggagtaccacatcgaagcgggtacagacggtattgtggcagtaggcacgacaggtgagtcagcgacactgaccattgaagagcatgtaaaggtcgttaataaaactgttgagtttgccaacggtcgcatccctgtgattgccggcacgggtgcaaatgcaacccacgaagccgtgacatttagcaaattactcgcggattctggtatcgcaggtttcttgagtgtgacgccttattacaacaaaccaacacaagaaggtttgttccagcattacaaagcgatcgcagaagcgagtgacgtacctctaattttgtacaatgtaccgggtcgtactgccgtagatctgcaacctgagacagtggcacgcttgtcaaagcttgataatatcgttgctctaaaagatgcgacgggcgatttgagccgaattgcacttcaccgtgaactttgtggcaaagattttatcttactaagtggtgatgatgcgacgggcttggaattcgtgaaactgggcggcaatggtgttatctcggtaacgaacaatattgcagcgaaagacatggcagacatgttccatttggcaagtgaaggtaaattcgaagaggcagaaatcattaaccaacgtttgatgactctgcataaaaacctattcgttgaatcaagcccgatcccagtaaaatgggcagcgcataagctgggtttgattgaagaaggtggcttgcgtcttcctttaaccgcactttctgaaaaatcgcagccgatcgtggaacaggcgttgacagacgcaggtatttactag

SEQ ID NO: 71234 - protein, 292 aa, Vibrio parahaemolyticus RIMD 2210633
MFSGSIVALITPFKADGEVDFDGLQKLVEYHIEAGTDGIVAVGTTGESATLTIEEHVKVVNKTVEFANGRIPVIAGTGANATHEAVTFSKLLADSGIAGFLSVTPYYNKPTQEGLFQHYKAIAEASDVPLILYNVPGRTAVDLQPETVARLSKLDNIVALKDATGDLSRIALHRELCGKDFILLSGDDATGLEFVKLGGNGVISVTNNIAAKDMADMFHLASEGKFEEAEIINQRLMTLHKNLFVESSPIPVKWAAHKLGLIEEGGLRLPLTALSEKSQPIVEQALTDAGIY

SEQ ID NO: 71235 - DNA, 879 bp, Nitrosomonas europaea ATCC 19718
  CDS (1)..(879): transl_table=11
atgttcacaggtagcctggtagctatcgttacacccatgctcgaagacggggcgctggatctcgacagattctgcgccctgatcgactttcatatcgaacagaaaacggatggtatcgtcgtggttggtaccacaggcgaatctcctaccgtggatttcgatgaacaccatctgctgatccgcacggctgtcacccacgcagccggacgcattccggtcattgccggcacaggcgccaattcgacgcgcgaagcaatcgagctgacggtattttcgaagaatgccggcgcagacgcctgcttatccgtagccccctattacaacaaacccacccaggaagggttgtaccaacacttcaaagcaattgccgaagcagtcgatatcccgatgattctgtacaacgtaccgggacgaaccgtagtagatatcagcaacgacactgcgttgcggctggcgcagattcccggtatcgtcggtatcaaagatgccactggcaacattgcgcggggatgtgatttattgcagcgtgtgcccgataatttcgcggtctacagcggagatgatgctactgcactggcactgctgctactcggcggtcatggcactatctcggtaacagccaatgtcgcaccccggctgatgcacgagatgtgcaccgctgcctttgccggtgacttggcccgggcacgggaaatcaatacccggctgttcaggctgcatattgatctgttcgtcgaagccaatccgattccggtcaaatgggccgtcgcaaggatgggattgatcaacgatagtctgcgcctgccattgacagctttatccagtcaatatcacgaactaatcagaaaagccatgctccaggctggcatcacggtttaa

SEQ ID NO: 71236 - protein, 292 aa, Nitrosomonas europaea ATCC 19718
MFTGSLVAIVTPMLEDGALDLDRFCALIDFHIEQKTDGIVVVGTTGESPTVDFDEHHLLIRTAVTHAAGRIPVIAGTGANSTREAIELTVFSKNAGADACLSVAPYYNKPTQEGLYQHFKAIAEAVDIPMILYNVPGRTVVDISNDTALRLAQIPGIVGIKDATGNIARGCDLLQRVPDNFAVYSGDDATALALLLLGGHGTISVTANVAPRLMHEMCTAAFAGDLARAREINTRLFRLHIDLFVEANPIPVKWAVARMGLINDSLRLPLTALSSQYHELIRKAMLQAGITV

SEQ ID NO: 71237 - DNA, 876 bp, Chromobacterium violaceum ATCC 12472
  CDS (1)..(876): transl_table=11
atgcttaccggcagcttggtagcgctcgtaacaccgatgtcgaacgatggggcggtggattttgcggcgttgcaacgattggttgagttccacatcgaaaacggcaccgccggcatcgtcgccgtcggcaccaccggcgaatcagccaccctgtcggtggaagagcacatcgccgtggtgaaagcggtggtcgactacgccaagggccgggtcaaggtaatcgccggcgcaggcggcaacgccaccagcgaggcgatcgagctgggcaggctgtcggccgaggtcggcgccgacatggtgctgtcggtggtgccctactacaacaagcccacccaggaaggcatctaccagcacttcaaggccatcgccgacgcaagcccgctgccggtcatcctttataatgtgcccggccgcaccgtggccgacatgagcaacgacaccgcgctgcgcctggctgctcatccgaacatcgtcggcctgaaggacgccaccggcgacatcggccgcgcctgcgatctggcgctgcgcgcgccggaaggcttcgcgctgtactcgggcgacgacgccaccggcatggccttcatgctgtgcggcggccatggcgtgatctcggtcaccgccaatatcgcgcccaaacaaatgagcgagctgtgcgcggccgccacctccggcgacgcccgcaaggcccgctcgatcaacgacaagctgcagggcctgcacaagcagctgttcgtcgaacccaaccctatcccggccaagtgggcgctggagcggatgcagcgcatccccgccggcatccgcctgccgctgaccccgctgagcgccgtctcccgccccctggtggaagcggcgctgaaacaagccgaagtcatttga

SEQ ID NO: 71238 - protein, 291 aa, Chromobacterium violaceum ATCC 12472
MLTGSLVALVTPMSNDGAVDFAALQRLVEFHIENGTAGIVAVGTTGESATLSVEEHIAVVKAVVDYAKGRVKVIAGAGGNATSEAIELGRLSAEVGADMVLSVVPYYNKPTQEGIYQHFKAIADASPLPVILYNVPGRTVADMSNDTALRLAAHPNIVGLKDATGDIGRACDLALRAPEGFALYSGDDATGMAFMLCGGHGVISVTANIAPKQMSELCAAATSGDARKARSINDKLQGLHKQLFVEPNPIPAKWALERMQRIPAGIRLPLTPLSAVSRPLVEAALKQAEVI

SEQ ID NO: 71239 - DNA, 900 bp, Photorhabdus luminescens subsp. laumondii TTO1
  CDS (1)..(900): transl_table=11
atgtctagcgggagatttgaatttacaggtagcattgttgcgctggtaacaccaatggatgcgagtggtcaggttgataaggccagtttgaaaaagttaatcgattaccatgttgctagtgggacatcagcgatagtctcggtagggacaaccggagaatctgccacattgagtcatgatgagcacggtgatgttgttttgacaaccatagaattggctgatgggcgtattccggttattgccggaacaggtgcaaatgcgactgctgaggcaatatccctaacgaaacgttttgaaaacagtggcgttgttggttgcctaacggtaacgccttattataataagccgtcgcaggaaggtttatatcagcattttaaaacgattgctgaaaatacggatttaccacaaattttgtataatgtgccttctcgtaccgggtgtgatctgctgccattaactgtagcgcgtttggcgaagattaaaaatattgtcgcaattaaagaagctacagggaacttaaatcgtgttagtcaaatccaagaattggttaatgatgatagtttcatcttattaagtggtgatgatgcaagtgggttggattttattcagctcggtggtaaaggggttatttctgttactgcaaacattgcagcgcctgacgttgctaagttttgtgaattggcattaaacggccagtttgcagaggcgcgtaagttaaataatcgcctgatggatttacaccgtcagctatttgttgaacctaatccgattccagttaaatggggatgtcaaaaattgggtttgattgctgatgacaccgtgcgtctgccgatgacgccattgacggatgcaggaaaagtctcagttgaaaaagccttgaaaatggccggattattgtaa

SEQ ID NO: 71240 - protein, 299 aa, Photorhabdus luminescens subsp. laumondii TTO1
MSSGRFEFTGSIVALVTPMDASGQVDKASLKKLIDYHVASGTSAIVSVGTTGESATLSHDEHGDVVLTTIELADGRIPVIAGTGANATAEAISLTKRFENSGVVGCLTVTPYYNKPSQEGLYQHFKTIAENTDLPQILYNVPSRTGCDLLPLTVARLAKIKNIVAIKEATGNLNRVSQIQELVNDDSFILLSGDDASGLDFIQLGGKGVISVTANIAAPDVAKFCELALNGQFAEARKLNNRLMDLHRQLFVEPNPIPVKWGCQKLGLIADDTVRLPMTPLTDAGKVSVEKALKMAGLL

SEQ ID NO: 71241 - DNA, 894 bp, Vibrio vulnificus YJ016
  CDS (1)..(894): transl_table=11
atgagggagaaagacatgttatcaggaagtatcgttgcgttacttacgccgttcaaagccgatggagaagtagactttgatggtctgcaaaaattagttgaatatcacatcgctgctggtacgaacggtatcgtggctgtgggtaccacaggagagtcttcaacactgacggttgaagagcacgtaaaagtagtcaacaaaacggttgaatttgttaatggtcgaatcccagtgatcgctggcacgggagcaaatgctacccatgagtcggtgaccttcagccgtctgctgaatgattcaggtatcgatgcatgcctgagtgttactccatactataataagccaacgcaagaaggcctattccagcattacaaagcgattgctgaagtgagtaacgttccccaaattctatacaatgtgcctgggcgtactgcggttgaccttttgccagagaccgttgctcgtttggctgagctcgaaaacatcgttgcactaaaagatgcgacaggtgatttaaatcgagttgcaattcatcgtgaactttgtggcgaagattttatcttactaagtggtgatgatgcgacaggcctagatttcgtcaaacttggcggtcaaggcgtgatttcggttaccaacaatattgctgcaaaagatatggcggatatgttccgtttggcccttgaaggccgttttgaagaagcggaagtgatcaatcaacgtttgatgccactgcataaaaacttgtttatcgaatctagtccaattccagtgaaatgggcagcgacacaacttggtttgattgaatgcgggcatttacgtctaccgttgactgagttatcggaaaaatgtcatccgatcgttgcacaagcaatgaccgacgcagggatttactaa

SEQ ID NO: 71242 - protein, 297 aa, Vibrio vulnificus YJ016
MREKDMLSGSIVALLTPFKADGEVDFDGLQKLVEYHIAAGTNGIVAVGTTGESSTLTVEEHVKVVNKTVEFVNGRIPVIAGTGANATHESVTFSRLLNDSGIDACLSVTPYYNKPTQEGLFQHYKAIAEVSNVPQILYNVPGRTAVDLLPETVARLAELENIVALKDATGDLNRVAIHRELCGEDFILLSGDDATGLDFVKLGGQGVISVTNNIAAKDMADMFRLALEGRFEEAEVINQRLMPLHKNLFIESSPIPVKWAATQLGLIECGHLRLPLTELSEKCHPIVAQAMTDAGIY

SEQ ID NO: 71243 - DNA, 1062 bp, Oryza sativa (japonica cultivar-group)
  CDS (1)..(1062)
atggcgtcgctgctgatcgccagcacggggggcgcccaccgcctcgcgtggaaggacgccgccgccctgggacccgctccgcggctggcgcgaccttggcccgccgccgtggctgcaccggcgccgctgctcaggacatcaacagctgatatcactagtctcagagtaattacagcggtcaaaaccccatatctgcctgatggaagatttgatcttgaagcatatgattcactgataaatatgcagatagatggtggtgctgaaggtgtaatagttggaggaacaacaggagagggccaccttatgagctgggatgaacacatcatgcttattggacatactgttaactgctttggtgctaaagttaaagtggtaggcaacacaggtagtaactcaacaagagaggctattcatgcaacagagcagggatttgctgtaggtatgcatgcggctctccatatcaatccttactatgggaagacctctatcgaagggttgatatctcattttgaggctgtcctcccaatgggtccaaccattatttacaatgttccatctaggactggccaggatattcctcctgcagttattgaggctgtttcaagtttcacaaacttggcaggtgtgaaagaatgtgttggacatgagagggttaagtgctacactgacaaaggtataaccatatggagtggtaatgatgatgaatgccatgattctaggtggaaatatggtgccactggagttatttctgtggctagcaaccttattcctggtctcatgcacgatctcatgtatgaaggggagaataagacgctaaatgagaagctctttcccctgatgaaatggttgttttgccagccaaatccaattgctctcaacactgccctggctcagcttggagtggtaaggcctgttttcagattaccatatgtacctcttcctcttgaaaagagggtagagtttgtccgaatcgttgaatctattggacgggaaaactttgtgggtgagaacgaggcacgggttcttgacgacgatgattttgtgttggtcagtaggtactaa

SEQ ID NO: 71244 - protein, 353 aa, Oryza sativa (japonica cultivar-group)
MASLLIASTGGAHRLAWKDAAALGPAPRLARPWPAAVAAPAPLLRTSTADITSLRVITAVKTPYLPDGRFDLEAYDSLINMQIDGGAEGVIVGGTTGEGHLMSWDEHIMLIGHTVNCFGAKVKVVGNTGSNSTREAIHATEQGFAVGMHAALHINPYYGKTSIEGLISHFEAVLPMGPTIIYNVPSRTGQDIPPAVIEAVSSFTNLAGVKECVGHERVKCYTDKGITIWSGNDDECHDSRWKYGATGVISVASNLIPGLMHDLMYEGENKTLNEKLFPLMKWLFCQPNPIALNTALAQLGVVRPVFRLPYVPLPLEKRVEFVRIVESIGRENFVGENEARVLDDDDFVLVSRY

SEQ ID NO: 71245 - DNA, 822 bp, Oryza sativa (japonica cultivar-group)
  CDS (1)..(822)
atgcagatagaaggtggtgctgaaggtgtaatagtgggaggaacaacaggagagggccacctgatgagctgggatgaacacatcatgcttattgggcatacagttaactgctttggcactaaaattaaagtggtcggcaacacaggaagtaactcaacaagggaggctattcacgcaactgagcagggattcgctgtaggtatgcacgcggctctccacatcaatccttactacgggaagacctccgtcgaagggttgatctcccattttgaggctgttctcccaatgggtccaaccatcatttacaatgtgccatccaggactggccaggatattcctcctgctgttattgaggcggtttcaagtttttcaaacatggcaggtgtcaaagaatgtgttggacatgagagggttaagtgctatactgacaaaggtataaccatatggagtggtaatgatgatgaatgccatgattctaggtggaaatatggtgccactggagtcatttctgtagccagcaaccttattcccggtctcatgcgtaagctcatgtacgaaggggagaatacagcgctcaatgataagctacttcctctgatgaaatggttgttttgccagcctaatccgattgcgctcaacaccgccctggctcagcttggagtggcaaggcccgttttcagattaccttatgtacctctcccccttgaaaagagggttgagttcgtccgaattgtcgaatccattggacgggaaaattttgtgggtcagaaagaagcaagggttcttgatgatgatgattttgtgttgatcagtaggtattaa

SEQ ID NO: 71246 - protein, 273 aa, Oryza sativa (japonica cultivar-group)
MQIEGGAEGVIVGGTTGEGHLMSWDEHIMLIGHTVNCFGTKIKVVGNTGSNSTREAIHATEQGFAVGMHAALHINPYYGKTSVEGLISHFEAVLPMGPTIIYNVPSRTGQDIPPAVIEAVSSFSNMAGVKECVGHERVKCYTDKGITIWSGNDDECHDSRWKYGATGVISVASNLIPGLMRKLMYEGENTALNDKLLPLMKWLFCQPNPIALNTALAQLGVARPVFRLPYVPLPLEKRVEFVRIVESIGRENFVGQKEARVLDDDDFVLISRY

SEQ ID NO: 71247 - DNA, 963 bp, Acinetobacter sp. ADP1
  CDS (1)..(963): transl_table=11
ctgcagaccgtccacttttcgtttttactatttcattcggatggaaaaataggatatttttttaaaatgactcagcaagcaccgaccattcaaggctcaattgtcgcaatcgtcacccctatgcatcaagatggcagtgtagattggaagggtcttgagaagctcgttgagtggcacatacaacaaggtacaaacagtattgtcgccgtcggaaccactggcgaagcgtcaacattgagcatggaagaacacacaaaagttattcaagaaatcattcgtgtggccaacaaacgtattccaattattgctggtactggtgcaaactcaactcacgaagcaatcgagctgactcaggctgctaaagatcttggcgctgatgcagcacttctcgtgacaccttattataataaacccacacaagaaggcctctaccaacactataaagcgattgctgaagcagttgatattccgcagattctttataacgtaccaggtcgtactggtgtcgatttatccaatgaaactgcaattcgtctggctgatcttaccaatattattggtattaaagatgcaactggcgatattccacgtggtcaggcactcattgaaggcctaaatggtaaaatggcggtatattctggtgatgatgaaactgcatgggaactgattacactgggtgcaaaaggtaatatttcggtaactgcaaatattattcctaaagcaatgagtgagttatgtgcaactgcattgcaaggtcaaaaagagcaggcaaaggtgctcaatgatcaagttgcaaatgtacacaatattctattttgcgaatcgaacccaattcctgtgaaatgggcgctacatgagatgggattagttgatacaggtattcgtctaccattaacacctctcgctgaacaatatcgtgaacctctccgtcatcagctaaaagctgcgggaattattcaataa

SEQ ID NO: 71248 - protein, 320 aa, Acinetobacter sp. ADP1
MQTVHFSFLLFHSDGKIGYFFKMTQQAPTIQGSIVAIVTPMHQDGSVDWKGLEKLVEWHIQQGTNSIVAVGTTGEASTLSMEEHTKVIQEIIRVANKRIPIIAGTGANSTHEAIELTQAAKDLGADAALLVTPYYNKPTQEGLYQHYKAIAEAVDIPQILYNVPGRTGVDLSNETAIRLADLTNIIGIKDATGDIPRGQALIEGLNGKMAVYSGDDETAWELITLGAKGNISVTANIIPKAMSELCATALQGQKEQAKVLNDQVANVHNILFCESNPIPVKWALHEMGLVDTGIRLPLTPLAEQYREPLRHQLKAAGIIQ

SEQ ID NO: 71249 - DNA, 879 bp, Erwinia carotovora subsp. atroseptica SCRI1043
  CDS (1)..(879): transl_table=11
atgtttacgggaagtattgttgcgctagttacgccgatggacgccaaaggcgccgttgaccgggcgagcttgaaaaaactgattgattatcatgtcgctagcggtacatcggcgattgtctctgtcggcacgacgggtgagtctgccacgctgagccatgacgaacatggcgatgtcgtgctgctgacgctggaactgagcgacggacgtattcctgttatcgctggaacgggtgctaatgctactgccgaaggcgtttctctgaccaaacggtttcatggcacgggtgttgttggctgcctgacggtcacaccgtactacaataaaccgacgcaagaaggtctataccagcacttcaaagcgatcgccgagcataccgatctgccgcaaatcctgtataacgtaccttcccgtactggctgcgacatgttgccggaaactgttgcccgtttgtccgaagtgaaaaatattgtcgcaattaaagaagcgacggggaacttaagtcgggtaagtcagatccaagagctggttagtgaagacttcattttgctgagcggcgatgacgccagcggtctggattttatgcaactcggcggtaaaggtgtgatttccgtgacagcgaatatcgctgcgcgtgaaatggctgaactttgcaggctggcggcgcagggcaattttgtcgaagcgcgccgtttaaatcagcgcctgatgccactgcatcagaaattatttgttgaacccaatcctatcccagtgaaatgggcttgtaaggaattgggactcatggcgaccgatacgctgcgcctgccgatgacaccgttgactgattccggtcgtacggtgatggggcaagcacttaagcaagcgggtttgctgtaa

SEQ ID NO: 71250 - protein, 292 aa, Erwinia carotovora subsp. atroseptica SCRI1043
MFTGSIVALVTPMDAKGAVDRASLKKLIDYHVASGTSAIVSVGTTGESATLSHDEHGDVVLLTLELSDGRIPVIAGTGANATAEGVSLTKRFHGTGVVGCLTVTPYYNKPTQEGLYQHFKAIAEHTDLPQILYNVPSRTGCDMLPETVARLSEVKNIVAIKEATGNLSRVSQIQELVSEDFILLSGDDASGLDFMQLGGKGVISVTANIAAREMAELCRLAAQGNFVEARRLNQRLMPLHQKLFVEPNPIPVKWACKELGLMATDTLRLPMTPLTDSGRTVMGQALKQAGLL

SEQ ID NO: 71251 - DNA, 900 bp, Yersinia pseudotuberculosis IP 32953
  CDS (1)..(900): transl_table=11
atgtttacgggaagcccaatgtttacaggcagcatagttgcgctaataacgccaatggacgacaacggtgatgtcgatcgtgcaagcctgaagagcctgattgattaccacgtagccagtgggactgcggcgatcgtctctgtggggacgacgggtgagtcagcaacgttgaatcatgatgagcatgtcgatgtggtcatgcagacactcgaactggctggtggccggatcccggtgattgccggaacgggggccaattccacctccgaagccatttctctcactcaacggtttaatgataccggtgttgtgggctgcttaaccgtgacgccatattataaccggccaatgcaggaagggttataccaacattttaaagcgatcgctgaaagtaccgatttgccacaaattctttataatgtgccttcgcgtacgggttgcgatatgttaccgccaaccattgctcgcttagcgaagattaaaaatattgttgcggttaaagaagccacagggaacttaagtcgggttagtcagatccaagtgctggttgatgatgaagatttcatcctgctcagtggtgatgatgcgagtggactggactttatgcaactgggtggtaaaggtgttatttctgtgacggcaaatatcgctgcccgtgaaatggttgaactgtgcgcattagcagcacagggaaatttcgccgaaggtcgccgtttgaatcagcgcttgatgccgttgcatcagcatttatttgtagaagcaaacccaattccggttaaatgggccgcgaagaggttgggattaatggcaaatgatactatgcgcctgccaatgaccccactgactgatccggccaaacggattgtggaagacgcgttgaaaagcgcaggtttgctgtaa

SEQ ID NO: 71252 - protein, 299 aa, Yersinia pseudotuberculosis IP 32953
MFTGSPMFTGSIVALITPMDDNGDVDRASLKSLIDYHVASGTAAIVSVGTTGESATLNHDEHVDVVMQTLELAGGRIPVIAGTGANSTSEAISLTQRFNDTGVVGCLTVTPYYNRPMQEGLYQHFKAIAESTDLPQILYNVPSRTGCDMLPPTIARLAKIKNIVAVKEATGNLSRVSQIQVLVDDEDFILLSGDDASGLDFMQLGGKGVISVTANIAAREMVELCALAAQGNFAEGRRLNQRLMPLHQHLFVEANPIPVKWAAKRLGLMANDTMRLPMTPLTDPAKRIVEDALKSAGLL

SEQ ID NO: 71253 - DNA, 897 bp, Mannheimia succiniciproducens MBEL55E
  CDS (1)..(897): transl_table=11
atgtcatcaacacgtcctttattttacggtagtatcgttgcgcttattacgcctatggatggccatggcgaagttaattatgacgaattaaaaaaattagttgaataccatattgccagcggcactcatgctattgtttcggtgggaacaacaggggagtccgctactttaagtattgatgaaaatgtaaaaaccattcaaaagaccgttgagttcgcggcaggccgtattcccgttatcgcgggtacgggcgctaatgcaaccagcgaagccattacgatgacgaaattattgaataacagcggtgttgccggctgcttgtctgttgtgccttactataataaaccgactcaagaagggatgtatcaacattttaaagctattgccgagtgtacggatcttccgcaaattctttataacgtaccgggacgtaccggtagcgatatgaaacctgaaaccgtgggtcgtttatctaaaattgaaaatattgtggcaattaaagaagctacgggtgatgtgagtcgtgtaaaacaaattaaagaattagccggcgaagattttattttcctgagcggcgatgacgctaccggattagaaagcattaaattaggcggacagggcgtgatttccgtaactaataacctcgcagcggcggatatggctaaaatgtgtgaattggcgcttgccggcaattttgatgaagcggaggcgattaatcagcgcttaatgggattacatcatgatttatttattgaaggtaatccgattccggtaaaatgggcggcctataaattaggtttgatcaaagaacctgtattgcgtctgccgttaaccacattgagcgaagcggcgcagccgaaagtgcttgaagcattaaaacaagcgggcttgatttaa

SEQ ID NO: 71254 - protein, 298 aa, Mannheimia succiniciproducens MBEL55E
MSSTRPLFYGSIVALITPMDGHGEVNYDELKKLVEYHIASGTHAIVSVGTTGESATLSIDENVKTIQKTVEFAAGRIPVIAGTGANATSEAITMTKLLNNSGVAGCLSVVPYYNKPTQEGMYQHFKAIAECTDLPQILYNVPGRTGSDMKPETVGRLSKIENIVAIKEATGDVSRVKQIKELAGEDFIFLSGDDATGLESIKLGGQGVISVTNNLAAADMAKMCELALAGNFDEAEAINQRLMGLHHDLFIEGNPIPVKWAAYKLGLIKEPVLRLPLTTLSEAAQPKVLEALKQAGLI

SEQ ID NO: 71255 - DNA, 873 bp, Legionella pneumophila subsp. pneumophila str. Philadelphia 1
  CDS (1)..(873): transl_table=11
atgttcagtggaagtatagtagccttggtaacccccatgcgaaatgatagcgtcgatgttcatcatttgcgagaactggttgaatttcatatagctaagggaactcatgccttggtcgcagctggcacgactggtgaggctggtactttatcacatagcgaaaaacttttggtcatcaaaacagtcattgaacaagcaaaagaaagagtgcctgtgattgcaggtactgctatgaatgcgaccaaggattgtattgaactaacccagcaagctatggaatatggggcgcatgctgctttaatcatgacaccagcctatatcaagcctactcaagaaggattgtatttgcactacagtcatattgcccaatccgtagcgattccgattattttatataatgttcccggaagaacagcctgtgatatgttacctgaaacggtagcaagactggctaaaatttcgaatataataggaataaaggaagcaaccggacagatgactcgtttacagcagattttacggttatgcgaagggagcattgatgtttacagtggcgatgatttgacagctgcccaatggttgttggccggggctaaaggtgttatttcagtcacggctaatgtggctgctaaattgatggcaaaaatgtgtgatttggcaatggatgatgatcaagcaggatgtttgcgtattcaagagcaattaatgcctttacatgaacttttgttcgtggagtcgaatccaatcccggtaaaatgggctatgaacaaaatgggattaattggaggggaattaagattaccgatgacggagttgtctgaaaaacatcatcaggctttggaaaaggtgttgaagaatttagagttgatataa

SEQ ID NO: 71256 - protein, 290 aa, Legionella pneumophila subsp. pneumophila str. Philadelphia 1
MFSGSIVALVTPMRNDSVDVHHLRELVEFHIAKGTHALVAAGTTGEAGTLSHSEKLLVIKTVIEQAKERVPVIAGTAMNATKDCIELTQQAMEYGAHAALIMTPAYIKPTQEGLYLHYSHIAQSVAIPIILYNVPGRTACDMLPETVARLAKISNIIGIKEATGQMTRLQQILRLCEGSIDVYSGDDLTAAQWLLAGAKGVISVTANVAAKLMAKMCDLAMDDDQAGCLRIQEQLMPLHELLFVESNPIPVKWAMNKMGLIGGELRLPMTELSEKHHQALEKVLKNLELI

SEQ ID NO: 71257 - DNA, 903 bp, Burkholderia mallei ATCC 23344
  CDS (1)..(903): transl_table=11
atggctaacggcactcaagacggcattcaaatccgcggcagcgtccccgcgatcgtcaccccgatgctcgaggacggcggcctcgatctggcggccttccgcaagctgatcgactggcatatcgaagaggggacggatgccctcgtcgtggtcggcacgagcggcgaatcggcgacgctttccgtcgacgagcacgtgctcatgatcgagaccgcggtcaagcacgcggcgaagcggattccgatcgtcgcgggcgcgggcggcaactcgacgaccgaggcgatcgaactgtcgaagcatgcgaaggcggtgggcgccgatgcgacgctgcaagtggtgccgtactacaacaagccgacgcaggaagggatctaccgccacttcaaggcgatcgccgaggcggtggaccttccggtgatcctgtacaacgtgccgggccgcactgtcgcggacatgtcgaacgagacgaccctgcggcttgcgcaagtgccgggcatcatcggcgtgaaggacgcgacgggcaatatcgatcgcgccgcgcaactgatcaaggcggcgcccgcgcacttctcgatctacagcggcgacgatccgaccgcgatcgcgctgatgctcctcggcggccacggcaacatctcggtgacggcgaacgtcgcgccgcgcgcgatgagcgagctttgccgcgcggcgcttgccgccgacgtgaagacggcgcgcgagatccacatgaagctcctgtcgctgcacaagcatctgttcatcgaggcgaacccgattccggtgaagtgggcgctgcaacagatgggcaagatcgcgggcggcatccgcctgccgctcacgccgctcgacgagcgctgccatgaaaccgtgcgcggcgcgcttcgcgaggccggcctcctgtga

SEQ ID NO: 71258 - protein, 300 aa, Burkholderia mallei ATCC 23344
MANGTQDGIQIRGSVPAIVTPMLEDGGLDLAAFRKLIDWHIEEGTDALVVVGTSGESATLSVDEHVLMIETAVKHAAKRIPIVAGAGGNSTTEAIELSKHAKAVGADATLQVVPYYNKPTQEGIYRHFKAIAEAVDLPVILYNVPGRTVADMSNETTLRLAQVPGIIGVKDATGNIDRAAQLIKAAPAHFSIYSGDDPTAIALMLLGGHGNISVTANVAPRAMSELCRAALAADVKTAREIHMKLLSLHKHLFIEANPIPVKWALQQMGKIAGGIRLPLTPLDERCHETVRGALREAGLL

SEQ ID NO: 71259 - DNA, 876 bp, Methylococcus capsulatus str. Bath
  CDS (1)..(876): transl_table=11
atgattcaaggcagtatcgttgccctggcaacgcccatggaacccgatgggaggctggatgttcccggcctcaggcgactggtcgagttccacatcgaacaggggacggatgccatcgtggcggtggggacgaccggcgaatcggcgacgctggacgaggaagaacacacggaagtcatccgtctggtggtggagcaggccgccggcagaatcccggtcatcgccggtaccggtgcgaacgcgaccaccgaagccatccgtttgaccgccagggccaaggccgtcggcgccgacgcgtgtctcctcgtcacgccgtattacaacaagccgacccaggagggcctctaccgccattacctggcggtcgccgaggcagtggacattccgcagatcctttacaacgtgcccggccgtaccggctgcgacatgctgccggccaccgtcgggcggctggcgcaggttcccggcatcgtcggaatcaaggaagcgaccggcaagctcgagcggctggccgagatccgggcgctgtgccccgaggggttcgccctgtattccggcgacgacgcaacggcgtgcgaattctgcctgtcgggcggcaacggcgtgatctcggtcacggccaacgtggcgccgcgtctcatgcaggagatgtgccgagcggccatcgccggtgaccgggcgacggccgaggcgatcaaccgccggctcgaggccctgcaccatgatctgttcatcgagtccaatcccatacccgtgaaatgggcactgcacgaaatgggactgatccaggagggaatccgtctgccgctgacctggctggccgcgtcctgccgggaggcggtgcgccaggccatgcgtcaggccggcgtgctctga

SEQ ID NO: 71260 - protein, 291 aa, Methylococcus capsulatus str. Bath
MIQGSIVALATPMEPDGRLDVPGLRRLVEFHIEQGTDAIVAVGTTGESATLDEEEHTEVIRLVVEQAAGRIPVIAGTGANATTEAIRLTARAKAVGADACLLVTPYYNKPTQEGLYRHYLAVAEAVDIPQILYNVPGRTGCDMLPATVGRLAQVPGIVGIKEATGKLERLAEIRALCPEGFALYSGDDATACEFCLSGGNGVISVTANVAPRLMQEMCRAAIAGDRATAEAINRRLEALHHDLFIESNPIPVKWALHEMGLIQEGIRLPLTWLAASCREAVRQAMRQAGVL

SEQ ID NO: 71261 - DNA, 879 bp, Azoarcus sp. EbN1
  CDS (1)..(879): transl_table=11
atgattaccggatcgcttgtcgccatcgtcacgccgatgcatgaggatggcagcctggattaccctcgtctgcgcagtttgatcgacttccacgtggccgaaggcaccgacgggatcgtggtcgtcggcaccaccggcgaatcgccgacagtgaacgtcgaggagcattgcgaactcattcgcacgacggtcgagcatgccgccggacgcatcccggtgattgccggagccggcggcaactcgacagccgaagcgatcgaactggccagctttgcacaggaggcgggggcagtcgcgcagctttcagtcgttccgtattacaaccggccgactcaggaaggcctttaccggcacttccgttcgatcgccgaagctgtcgaactgccgctgatcctttataacgtgcccgggcgcaccgtcgccgatctgtcgaacgacacgacgctgcgcctggccgagatcccgaacatcatcggcatcaaggacgcgacaggcagcatcgaccgcgcctgcgacctgatcgagcgcgcgccgaaggacttcgccctctacaccggcgacgacatgagcgcggctgctttcattcttctcggcggtcacggcacgatctcggtcaccgccaacgtcgcaccgcgggcaatgcacgagatgtgcgccgcagcgctggcgggagaggcgctcagggtgcgcgagatcaacgggcgcctcgtcggcctgcatcgcgatcttttctgcgaagccaatccgattccggtcaagtgggcggttgcccgcatgggcttgatcgagtccggcattcgtctcccgctgacccccctgtcgtccgcctcgcaggagcgggtgctgctcgcgatgcgtcgcgccggcgtgaacgtttga

SEQ ID NO: 71262 - protein, 292 aa, Azoarcus sp. EbN1
MITGSLVAIVTPMHEDGSLDYPRLRSLIDFHVAEGTDGIVVVGTTGESPTVNVEEHCELIRTTVEHAAGRIPVIAGAGGNSTAEAIELASFAQEAGAVAQLSVVPYYNRPTQEGLYRHFRSIAEAVELPLILYNVPGRTVADLSNDTTLRLAEIPNIIGIKDATGSIDRACDLIERAPKDFALYTGDDMSAAAFILLGGHGTISVTANVAPRAMHEMCAAALAGEALRVREINGRLVGLHRDLFCEANPIPVKWAVARMGLIESGIRLPLTPLSSASQERVLLAMRRAGVNV

SEQ ID NO: 71263 - DNA, 879 bp, Pseudomonas syringae pv. syringae B728a
  CDS (1)..(879): transl_table=11
atgattgcgggcagtatggtggcactggtcacaccaatggatgcacaaggtcgtctggactgggacagcctgagcaaactggttgacttccacttgcaagagggcacccacgccattgttgccgtaggcaccaccggtgaatcggcgacgctggatgtgaacgaacacatcgaagtcatccgccgggtggtcactcaggttgcaggtcgcattccggtcatcgccggtacaggcgccaattcgacgcgtgaagccgtcgaactgaccaccaacgccaaaaatgcgggtgccgacgcgtgcctgctggtgacgccttactacaacaagccgactcaggaaggcctgttccagcatttcagccacatcgccaatgccgtcgacatcccgcagatactctacaacgtgccgggccgtacggcctgcgacatgctgccagagaccgttgcgcgtttgtcgacggtaaaaaacatcgttggtatcaaggaagccaccggcaacctgcaacgcgccaaggacatcctggccagcgtcagcagcgattttctggtgtactccggcgacgacgctacagcagtcgaattgatgctgctgggcggcaagggcaatatttccgtgaccgccaacgttgcaccgcgcgccatgagcgatctgtgcgcagcggccatgcgtggcgatgcgcaaacggcccgggcgattcacgaaaagctcatgccgctcaacaacaccctgttcatcgaatccaaccctatccccgtgaagtgggccttgcatgaaatgggtctgatgccagacggtatccgtctgccgcttacctggctcagcgaagcctgtcatgaaccgctgcgtcaggccatgcgccagtccggcgtcctggtttaa

SEQ ID NO: 71264 - protein, 292 aa, Pseudomonas syringae pv. syringae B728a
MIAGSMVALVTPMDAQGRLDWDSLSKLVDFHLQEGTHAIVAVGTTGESATLDVNEHIEVIRRVVTQVAGRIPVIAGTGANSTREAVELTTNAKNAGADACLLVTPYYNKPTQEGLFQHFSHIANAVDIPQILYNVPGRTACDMLPETVARLSTVKNIVGIKEATGNLQRAKDILASVSSDFLVYSGDDATAVELMLLGGKGNISVTANVAPRAMSDLCAAAMRGDAQTARAIHEKLMPLNNTLFIESNPIPVKWALHEMGLMPDGIRLPLTWLSEACHEPLRQAMRQSGVLV

SEQ ID NO: 71265 - DNA, 897 bp, Haemophilus influenzae 86-028NP
  CDS (1)..(897): transl_table=11
atgtcagcgcaaaatcctttattttcgggtagcatagttgcccttgttacgccaatgaatcattatggcgaagtcgatttttcctgtttagaaaaattagtagaacatcacattgaagctggttctaatgcgcttgtttctgtgggtacaacgggagaatccgccacgctaagtattgaagaaaatgtaaaagtcattgaaaagactgttgaatttgccaaaggacgtattcctattattgcgggagcgggtgcaaatgcgacgagtgaagcaattacaatgaccaaattattacgagacagtggtgtagcaggatgtttatctgttgtgccttattataataaaccaacccaagagggaatgtatcaacattttaaagccattgcggaatgtactgatttaccacagattctttataatgttcctagtcgcacaggcagtgatatgaaaccagaaacagttgctcgtttagctgaaattgaaaatattgtaggcattaaggaagcaacgggagatgttagccgaatagttaaaattaagcagcttgcaggtaagaattttattgttttaagtggcaatgatacaacaggcttagaagcaataaaattaggtgctgaaggagtaatatcagtaacaaataacattgcagcaaaagatatggctgatatgtgccgttatgcacttgcgggagattttgataaagcggaagaaattaatgctcgtttaatgcgtttacatcacgacctgttcattgaatctaatccaattccagtgaagtgggcagcttatcgcttaggcttaattaaatcgccacatttacgcttgccacttacaacacttagtgaagaaattcaaccaaaagtagaagatgcgctaaaaatcgcaggattgttataa

SEQ ID NO: 71266 - protein, 298 aa, Haemophilus influenzae 86-028NP
MSAQNPLFSGSIVALVTPMNHYGEVDFSCLEKLVEHHIEAGSNALVSVGTTGESATLSIEENVKVIEKTVEFAKGRIPIIAGAGANATSEAITMTKLLRDSGVAGCLSVVPYYNKPTQEGMYQHFKAIAECTDLPQILYNVPSRTGSDMKPETVARLAEIENIVGIKEATGDVSRIVKIKQLAGKNFIVLSGNDTTGLEAIKLGAEGVISVTNNIAAKDMADMCRYALAGDFDKAEEINARLMRLHHDLFIESNPIPVKWAAYRLGLIKSPHLRLPLTTLSEEIQPKVEDALKIAGLL

SEQ ID NO: 71267 - DNA, 879 bp, Pseudomonas fluorescens Pf-5
  CDS (1)..(879): transl_table=11
atgattgcgggcagtatggtggcactggtcacacccatggatgcacagggaaatctcgactgggacagcctgagcaaactggtggacttccacctgcaagagggcaccaacgccatcgtggcggtcggcaccacaggtgagtcggccaccctggatgtgaacgagcacatcgaagtgattcgtcgggtggtcacccaggttgcagggcgcattccggtgatcgccggtaccggcgccaactcgacgcgcgaagcgatcgagctgaccaccaatgcgaagatcgccggcgccgatgcgtgcctgctggtgaccccgtactacaacaagccgacccaggaaggcctgtaccagcatttccgcgccattgccgaggccgtggacatcccgcagatcctctacaacgttccgggccgcaccgcatgcgacatgcaggccgagaccgtgatccgcctgtccagcgtgaagaacatcatcggcatcaaggaagccaccggcgacctgcagcgcgccaaggccatcctggccggcgtgcccggcgatttcctggtgtactccggcgatgacgccaccgcagtcgagctgatcctgctgggcggcaagggcaatatctcggtgaccgccaacgtcgcgcctcgggccatgagccagatgtgcgccgcggccatggccggcgatgccgccaaggcccgggagatccacgagaccctgatgccgctgaacaagactctgttcatcgaatccaaccctattcccgtgaaatgggccctgcacgaaatgggcttgatgccggacggtatccgtctgccgctcacctggctcagtgccgcctgtcacgaaccgctgcggcaggccatgcgccagtccggcgtcttggtttaa

SEQ ID NO: 71268 - protein, 292 aa, Pseudomonas fluorescens Pf-5
MIAGSMVALVTPMDAQGNLDWDSLSKLVDFHLQEGTNAIVAVGTTGESATLDVNEHIEVIRRVVTQVAGRIPVIAGTGANSTREAIELTTNAKIAGADACLLVTPYYNKPTQEGLYQHFRAIAEAVDIPQILYNVPGRTACDMQAETVIRLSSVKNIIGIKEATGDLQRAKAILAGVPGDFLVYSGDDATAVELILLGGKGNISVTANVAPRAMSQMCAAAMAGDAAKAREIHETLMPLNKTLFIESNPIPVKWALHEMGLMPDGIRLPLTWLSAACHEPLRQAMRQSGVLV

SEQ ID NO: 71269 - DNA, 879 bp, Pseudomonas syringae pv. phaseolicola 1448A
  CDS (1)..(879): transl_table=11
atgattgcgggcagtatggtggcactggtcacaccaatggatgcacaaggtcgtctggactgggacagcctgagcaaactggttgacttccacttgcaagagggcaccaacgccattgttgccgtcggcaccaccggtgaatcggcgacgctggatgtgagcgaacacatcgaggtcatccgccgtgtggttgcccaggttgcaggacgtattccggtcatcgccggtacaggcgccaattcgacgcgcgaagccgtcgagctgaccaccaacgccaagaccgctggcgccgatgcgtgcctgctggtaacgccttattacaacaagccgacgcaagaaggcctgtttcagcatttcagccacatcgccaacgccgtagatatcccgcagatcctctacaacgtgccgggccgtacggcttgcgacatgctgccagagactgttgcgcgtctttccacggtcaaaaacatcatcggcatcaaggaagccaccggcaacctgcagcgcgccaaggacattctggccagcgtcagcagtgattttctggtgtactccggtgacgacgctacggcagtcgaattgatgctgctgggcggcaagggcaatatttccgtcaccgccaacgttgcaccacgcctcatgagcgatctgtgcgcagcggccatgcgtggcgatgccgagacggcgcgggcgattcacgaaaagctcatgccgctcaacaacaccctgtttatcgaatccaaccctatccccgtgaagtgggccttgcatgaaatgggtaagatgccagccggtatccgtctgccgcttacctggctcagcgaagcctgtcacgaaccgctgcgtcaggccctgcgccagtccggcgtcctggtttaa

SEQ ID NO: 71270 - protein, 292 aa, Pseudomonas syringae pv. phaseolicola 1448A
MIAGSMVALVTPMDAQGRLDWDSLSKLVDFHLQEGTNAIVAVGTTGESATLDVSEHIEVIRRVVAQVAGRIPVIAGTGANSTREAVELTTNAKTAGADACLLVTPYYNKPTQEGLFQHFSHIANAVDIPQILYNVPGRTACDMLPETVARLSTVKNIIGIKEATGNLQRAKDILASVSSDFLVYSGDDATAVELMLLGGKGNISVTANVAPRLMSDLCAAAMRGDAETARAIHEKLMPLNNTLFIESNPIPVKWALHEMGKMPAGIRLPLTWLSEACHEPLRQALRQSGVLV

SEQ ID NO: 71271 - DNA, 879 bp, Dechloromonas aromatica RCB
  CDS (1)..(879): transl_table=11
atgattaccggatccattgtcgccatcgttacgcccatgcatgaggatggcagcctcgatttgaactcctttcgcaatctgctcgacttccatgtgcaggaaggcactgatgccatcgtagtcgttggtacgaccggcgaatcgccgacggtcaatgtcgaggagcattgtgaactgatcaagatcgccgttgatcatgtcgccggccgcattccggtcattgccggaaccggagccaattcgacggctgaagccatcgagctgaccgagttcgccaagaaggccggtgccaacatggcgctgtccgtcgtgccctactacaacaagccgacccaggaaggcctctatcgccatttcaaggcgattgccgaagcggtcgagctgccggtcattctctacaacgtgccgggtcgtactgtggccgacatgtccaacgacaccattctgcgcctggccgaagtgccgggcatcgtcggtgtcaaggatgcgaccggcaacatcgatcgggcctgtgatctgatcgcccgtgccccgaaggatttcgcgctttacaccggcgatgacatgacggctgtggcgacgatcagtctcggtttccacggcgatatatcggtgacggccaatgtggcaccgcgcctgatgcatgaaatgtgcgtcgccgctgccagtggcgacatcgccaaggcccgggaaattcacttcaaagtgcttgccttgcaccgcgatctgttctgcgaagccaatccaatcccggtcaagtgggctgtgcacaagctgggcctgatgcccaatggcatccgcctgcccctgaccacgctttccgaagccaatcaaccacgtgtcctggctgcgttgcgccaggccggcctcgtcgcctga

SEQ ID NO: 71272 - protein, 292 aa, Dechloromonas aromatica RCB
MITGSIVAIVTPMHEDGSLDLNSFRNLLDFHVQEGTDAIVVVGTTGESPTVNVEEHCELIKIAVDHVAGRIPVIAGTGANSTAEAIELTEFAKKAGANMALSVVPYYNKPTQEGLYRHFKAIAEAVELPVILYNVPGRTVADMSNDTILRLAEVPGIVGVKDATGNIDRACDLIARAPKDFALYTGDDMTAVATISLGFHGDISVTANVAPRLMHEMCVAAASGDIAKAREIHFKVLALHRDLFCEANPIPVKWAVHKLGLMPNGIRLPLTTLSEANQPRVLAALRQAGLVA

SEQ ID NO: 71273 - DNA, 960 bp, Ralstonia eutropha JMP134
  CDS (1)..(960): transl_table=11
ttgtcggaacatcggtcgaggcggccggctgttccggtacaatctcgttattcgcatcccgaattccctaacgttatgacacagattaccggcagcattgttgccatcgtcaccccgatgcatgaggacggcagcctggattacccggcgctgcgcgcgctcgtcgactggcacgtggccgagggcaccgatgccatcgtgatcgttggcaccaccggcgaatcgcccaccgtctcggtggacgagcactgcgaactgattcgcatggcggtggagcaggctggcaagcggattcccatcatcgccggtaccggcggcaactcgaccaaggaagccatcgagctgacggccttcgccaagaaggttggcgccgacgcctcgctccaggtcgtgccgtactacaacaagccgacccaggaaggcatgtaccggcatttccgcaccatcgccgaggcggtggaactgccggtgctgctgtacaacgtgccgggccgcaccgttgcggacatgaccaacgacaccatcctgcgcctcgcgcaggtgccaggcatcgtcggggtgaaggaagcgaccggcaacatcgaccgcgccgcgcaactgatcaaggatgcgccggaaggctttgcgatctacagcggtgacgatccgaccgccgtggcgctgatcctgctgggcggcaaaggcaatatctcggtgaccgccaacgtggcgccgcgcaagatgcacgaaatgtgcgtggccgcgctcaagggcgacgtggtgaccgcgcgccgcctgcacatggaactgatcgagttgaacaaggcgatgttcgtcgaagccaacccgattccggtcaagtgggctctgcagcagatgggcaagatggaaggcggcatccgcctgccgctcacgccgctgctggagtccaatcacgagaccgtgcgcaaggcactggccgccgctggcctgctgcgctga

SEQ ID NO: 71274 - protein, 319 aa, Ralstonia eutropha JMP134
MSEHRSRRPAVPVQSRYSHPEFPNVMTQITGSIVAIVTPMHEDGSLDYPALRALVDWHVAEGTDAIVIVGTTGESPTVSVDEHCELIRMAVEQAGKRIPIIAGTGGNSTKEAIELTAFAKKVGADASLQVVPYYNKPTQEGMYRHFRTIAEAVELPVLLYNVPGRTVADMTNDTILRLAQVPGIVGVKEATGNIDRAAQLIKDAPEGFAIYSGDDPTAVALILLGGKGNISVTANVAPRKMHEMCVAALKGDVVTARRLHMELIELNKAMFVEANPIPVKWALQQMGKMEGGIRLPLTPLLESNHETVRKALAAAGLLR

SEQ ID NO: 71275 - DNA, 891 bp, Thiobacillus denitrificans ATCC 25259
  CDS (1)..(891): transl_table=11
atggcagaaataagcacggccagaggaagcctggtcgcgatcgtgaccccgatgtcggatgacggcgcgctcgatctgggcgcgttgcgccgtctgatcgactggcacatcgaacagggaactgacggcatcgtcatcgtcggcacgaccggcgagtcgccgacggtcaacttcgacgagcactgtctgctgatccgcaccgcggtcgaacaggcgggtggacgcgtgccggtcatcgcaggtaccggtgccaattcgaccagcgaggcgatcgcgctcaccgaatgcgcgcgcgcggccggtgcccaggcgggcctctcggtcgtgccctactacaacaagccgacgcaggaagggctctaccagcactaccgcaagatcgccgaagcggtcgacctgccgctcatcctttacaacgtgcccgggcggacggtggccgatctcgccaacgacacggcggtgcgcctcgcggaagtgcccggcatcgtcggcctcaaggacgcgactggcaacatggaacgcgcggccgatctggtgcgtcgggtgccgaagggttttgctctctacagcggcgacgacgcgtcggcgttgccgttcatgttgctcggcggacacggcgtgatctcggtcacggcgaacgtcgcgcctcggttgatgcacgaaatgtgcgtcgcggccttcgaagggaatctcgcgcgtgcgcgcgaatgcaacgacgcgctgttgccgctgcatagcaagcttttcgtcgaagccaatccgattccggtcaagtgggcgtgcgccgaacttggcctgattcccccgggcctgcgcctgccgctgacgccgctgtctggcggacagcacgaagtcgtgcgcgccgcaatgcgccacgccgaattgatctag

SEQ ID NO: 71276 - protein, 296 aa, Thiobacillus denitrificans ATCC 25259
MAEISTARGSLVAIVTPMSDDGALDLGALRRLIDWHIEQGTDGIVIVGTTGESPTVNFDEHCLLIRTAVEQAGGRVPVIAGTGANSTSEAIALTECARAAGAQAGLSVVPYYNKPTQEGLYQHYRKIAEAVDLPLILYNVPGRTVADLANDTAVRLAEVPGIVGLKDATGNMERAADLVRRVPKGFALYSGDDASALPFMLLGGHGVISVTANVAPRLMHEMCVAAFEGNLARARECNDALLPLHSKLFVEANPIPVKWACAELGLIPPGLRLPLTPLSGGQHEVVRAAMRHAELI

SEQ ID NO: 71277 - DNA, 879 bp, Pseudomonas fluorescens PfO-1
  CDS (1)..(879): transl_table=11
atgattgcgggcagtatggtggcactggtcacacccatggatgcacaagggcgtcttgactgggacagcctcagcaaactcgtggacttccatctcaagaacggcacccatgccattgtcgcggtcggcaccaccggcgagtcggcaacccttgatgtagaagaacacatcgccgtcatcaaagccgtggtcaaacaggttgccggtcgtattccggtgatcgccggtaccggcgccaactcgacccgcgaagctgtcgagctgacccgcaatgccaaggaagccggcgccgatgcctgcctgctggtagtcccgtactacaacaagccgacccaggaaggcctgtaccagcacttcaagcacatcgccgaagcggtcgacatcccacagattctctataacgttcccggccgcacctcctgcgacatgcaggccgagaccgtgatccgcctgtccaccgtgccgaacatcatcggcatcaaggaagcgaccggcgacctgaaacgtgccaaggcgatcatcgacggcgtgagcaaggacttcatcgtgctgtccggcgatgatccgaccgccgtcgagctgatcttgttgggcggcaagggcaacatctccgtcaccgccaacgtcgcgccacgcgaaatggccgacctgtgcgaggccgcgctcaagggcgacgccgagaccgcacgggccatcaacgaaaaactgatgccgctgcacaaggacctgttcatcgaagccaacccgattccggtgaagtgggctttggtcgaaatgggcctgatgcaccaaggcatccgcctgccgctgacctggctgagcgctccttgtcatgaaacgctgcgctcggccctgcgccagtgcaacgtcctggtttaa

SEQ ID NO: 71278 - protein, 292 aa, Pseudomonas fluorescens PfO-1
MIAGSMVALVTPMDAQGRLDWDSLSKLVDFHLKNGTHAIVAVGTTGESATLDVEEHIAVIKAVVKQVAGRIPVIAGTGANSTREAVELTRNAKEAGADACLLVVPYYNKPTQEGLYQHFKHIAEAVDIPQILYNVPGRTSCDMQAETVIRLSTVPNIIGIKEATGDLKRAKAIIDGVSKDFIVLSGDDPTAVELILLGGKGNISVTANVAPREMADLCEAALKGDAETARAINEKLMPLHKDLFIEANPIPVKWALVEMGLMHQGIRLPLTWLSAPCHETLRSALRQCNVLV

SEQ ID NO: 71279 - DNA, 906 bp, Burkholderia sp. 383
  CDS (1)..(906): transl_table=11
atggctaacggcacccaagacggcattcaaatccgcggcagcatccccgcgatcgtcaccccgatgctcgaagacggcagtctcgacctgccggcgtttcgcaaactgatcgactggcatatcgcggaaggcaccgatgcgctcgtcgtggtcggtacgagcggcgagtcggcaacgctcaacgtcgaagagcacatcctgatgatccgcacggcggtcgagcatgcggcgaaacgcatcccgatcatcgcgggcgcgggcggcaactcgaccgccgaggcgatcgagctgacgaagcacgcgaaggctgtcggcgcggacgcgacgctgcaggtcgtgccgtactacaacaagccgacgcaggaaggcatgtaccgtcacttcaagacgatcgccgaagcggtcgatcttccggtgatcctgtacaacgtgccgggccgcacggtcgccgacatggcgaacgagacgacgctgcgcctcgcggaagtcccgggcatcatcggcgtgaaggaagcgaccggcaacatcgatcgcgccgcgcacctgatcaaggccgcgccgaagcatttcgcgatctacagcggcgacgatccgaccgcgatcgcgctgatgctgcttggcggccacggcaacatctcggtgacggcgaacgtcgcaccgcgtgcgatgagcgatctgtgccgcgcggcgctggccggcgacgtacagacggctcgcgcgctgcacatgaagctgctgtcgctgcacaagaacctgttcatcgaggcgaacccgattccggtgaagtgggcgctgcaggcgatgggcaagatgcagggcggcatccggctgccgctcacggcgctcgacgagcgctgccacgaagccgtgcgttcggccctcgtcgaggccggcgtcctcgcctga

SEQ ID NO: 71280 - protein, 301 aa, Burkholderia sp. 383
MANGTQDGIQIRGSIPAIVTPMLEDGSLDLPAFRKLIDWHIAEGTDALVVVGTSGESATLNVEEHILMIRTAVEHAAKRIPIIAGAGGNSTAEAIELTKHAKAVGADATLQVVPYYNKPTQEGMYRHFKTIAEAVDLPVILYNVPGRTVADMANETTLRLAEVPGIIGVKEATGNIDRAAHLIKAAPKHFAIYSGDDPTAIALMLLGGHGNISVTANVAPRAMSDLCRAALAGDVQTARALHMKLLSLHKNLFIEANPIPVKWALQAMGKMQGGIRLPLTALDERCHEAVRSALVEAGVLA

SEQ ID NO: 71281 - DNA, 903 bp, Burkholderia thailandensis E264
  CDS (1)..(903): transl_table=11
atggctaacggcactcaagacggcattcaaatccgcggcagcgtccccgcgatcgtcaccccgatgctcgaggacggcagcctcgagctggcggccttccgcaagctgatcgactggcacatcgaagaggggacggatgccctcgtcgtggtcggcacgagcggcgaatcggcgacgctttccgtcgacgagcatgtcctcatgatcgaaaccgcggtcaagcatgcggcgaagcggatcccgatcgtcgcgggcgcgggcggcaactcgacggccgaagcgatcgaattgtcgaagcacgcgaaagcggtgggtgccgacgcgacgctgcaagtggtgccgtattacaacaagccgacgcaggaagggatgtaccgccacttcaaggcgatcgccgaggcggtcgacctgccggtgatcctgtacaacgtgccgggccgcacggtcgcggacatgtcgaacgagacgatcctgcggctcgcgcaggtgccgggcatcgtcggcgtgaaggacgcgacgggcaacatcgaccgcgccgcgcaactgatcaaggctgcgcccgcgcacttctcgatctacagcggcgacgatccgacggcgatcgcgctgatgctcctcggcggccacggcaacatctcggtgacggcgaacgtcgcgccgcgcgcgatgagcgagctctgccgcgcggcgctggccgccgacgtgaagacggcgcgcgagattcatatgaagctcctgtcgctgcacaagcatctgttcatcgaagcgaacccgattccggtgaagtgggcgcttcagcaaatgggcaagatcgcgggcggcattcgcctgccgcttacgccgctcgacgagcgctgccacgaagccgtgcgcggtgcgcttcgcgaggccggcctcctgtga

SEQ ID NO: 71282 - protein, 300 aa, Burkholderia thailandensis E264
MANGTQDGIQIRGSVPAIVTPMLEDGSLELAAFRKLIDWHIEEGTDALVVVGTSGESATLSVDEHVLMIETAVKHAAKRIPIVAGAGGNSTAEAIELSKHAKAVGADATLQVVPYYNKPTQEGMYRHFKAIAEAVDLPVILYNVPGRTVADMSNETILRLAQVPGIVGVKDATGNIDRAAQLIKAAPAHFSIYSGDDPTAIALMLLGGHGNISVTANVAPRAMSELCRAALAADVKTAREIHMKLLSLHKHLFIEANPIPVKWALQQMGKIAGGIRLPLTPLDERCHEAVRGALREAGLL

SEQ ID NO: 71283 - DNA, 876 bp, Saccharophagus degradans 2-40
  CDS (1)..(876): transl_table=11
atgcttcgtggcagtatggttgccctagttaccccaatgcaggcggatggttcgctagattgggaggctctccataagctggttgactggcatttgcaggaaggtaccgatgcaattgttgcagtgggcaccaccggcgaaagcgcaactctcgatgttaaagagcatatcgccgttattcgggctgttgtcgatcaagtaaacggcagggtgcctgttattgctggtactggcgccaactctaccagcgaagccattgagcttactcaagcggccaaagatggcggtgtagatgcttgcctgctggttgccccttattacaacaagcccacccaagagggcttgttccttcaccatcaaaaaattgctgcaagcgtggccattcctcagcttctatataacgtacctggccgcacagcggtagatatgctgcccgagaccattgtgcgtttatcccatgtcgataatattgttggcgtgaaagaagccacgggcgatatagcgcgggtagggcaaatacttgaaagcgccaaagcaggctttttgttgatatctggcgatgatgataccgcggtggactttattgccgctggtggtgtgggggaaatctctgtaaccgccaacgtggcgcctaaattagttgcgcaaatgtgcgaacttgcagcgcaaggtaaggtcgaagaagcgcgtgctattaatgcgcgcctagccgatgtgcatacggccatgtttttagagtctaaccctataccggtaaaatgggctctggcaaaaatgggcttaatgcctaatggtattcgcttgcctcttaccccgttagacgcaaagtatcacttgcaagtagagcaagcactgcgcgcggctaacttactgtaa

SEQ ID NO: 71284 - protein, 291 aa, Saccharophagus degradans 2-40
MLRGSMVALVTPMQADGSLDWEALHKLVDWHLQEGTDAIVAVGTTGESATLDVKEHIAVIRAVVDQVNGRVPVIAGTGANSTSEAIELTQAAKDGGVDACLLVAPYYNKPTQEGLFLHHQKIAASVAIPQLLYNVPGRTAVDMLPETIVRLSHVDNIVGVKEATGDIARVGQILESAKAGFLLISGDDDTAVDFIAAGGVGEISVTANVAPKLVAQMCELAAQGKVEEARAINARLADVHTAMFLESNPIPVKWALAKMGLMPNGIRLPLTPLDAKYHLQVEQALRAANLL

SEQ ID NO: 71285 - DNA, 873 bp, Methylobacillus flagellatus KT
  CDS (1)..(873): transl_table=11
atgctgcaaggcagtctcgttgccatcgtcacccccatgcacgatgatggcagcctggatatccaggcattacgttcactcatcgactaccatatcgagcaaaaatccgatggtatcgtcgtcgtgggcacaacaggggaatctcccacggtcgactttgatgaacatgccctgctgatcaaaaccgcagttgaacacagtgccggacgcatcccggtcatcgctggcacaggggccaactccaccagcgaagccattgcgcttacccgtaaagcaaaagcgctgggggcagatgcatgcctgcttgttaccccctattacaacaaaccaacgcaggaaggcctgtaccagcacttcaaggccattgccgcagctgtagatattccacagattctttataacgttccgggtcggacaggttgcgacctgcataatgaaaccgtactgcgccttgctgcaatagagaatatcattggcatcaaggatgccaccggtaatatcgaacgtggcactgacctgatcctgcgcgcacctgaaggatttgcagtttacagtggtgatgatgccagtagccttgcattattgctgctcggcggacgcggcgtcatctcggtgacggcaaacgccgctcccaggctgatgcatgagatgtgtgctgccgcactgacaggcgatctcaagactgcccgtagtaccaatgccaagctattcgcattgcatcaaaaactgtttatcgaagccaatccaatcccggtgaagtgggtactgcaacagatgggcttgatccaaggtggcattcgcctgccactcgtgccactatcatcccaatttcatgacacattgcgcagcgccatgaagcaagctgccatttga

SEQ ID NO: 71286 - protein, 290 aa, Methylobacillus flagellatus KT
MLQGSLVAIVTPMHDDGSLDIQALRSLIDYHIEQKSDGIVVVGTTGESPTVDFDEHALLIKTAVEHSAGRIPVIAGTGANSTSEAIALTRKAKALGADACLLVTPYYNKPTQEGLYQHFKAIAAAVDIPQILYNVPGRTGCDLHNETVLRLAAIENIIGIKDATGNIERGTDLILRAPEGFAVYSGDDASSLALLLLGGRGVISVTANAAPRLMHEMCAAALTGDLKTARSTNAKLFALHQKLFIEANPIPVKWVLQQMGLIQGGIRLPLVPLSSQFHDTLRSAMKQAAI

SEQ ID NO: 71287 - DNA, 963 bp, Burkholderia xenovorans LB400
  CDS (1)..(963): transl_table=11
atgactaacggcaaccaaagcggcaaccaaagcggcaaccaaagcggcaaccacagcggcaaccagggcagcaacgacggcgttcagattcgcggcagcattcctgccatcatcaccccgatgctcgaagacggcagtctggatctgccggcgtttcgcaaactgatcgactggcacgtcgcagagggcacgaacgctctcgtggtggtcggtacgagcggcgagtcggccacgctgtcggtcgaagaacacgtgctaatggtcaagaccgcggtcgagcacacggcgggccggattccggtgatcgcgggctcgggcggcaactccacgaccgaggcgatcgaacttacccagcgcgccaaagaggtcggcgccgacgccacgctccaggtcgtgccgtactacaacaagccgacgcaggagggcatctaccgccacttcgcgaagatcgcggaaaccgtcgatctgccggtgattctgtacaacgtgccgggccgcaccgttgccgacatgagcaacgaaaccatcctgcgcctcgcgcaggtgccaggtatcatcggtgtgaaggaagcgaccggcaatatcgatcgcgccgcgcatctcatcaagtttgcgccgtcgcacttcggcatctacagcggcgacgatcccaccgccatcgcgctgatgctgctcggcggccacggcaatatttcggtcaccgccaacgtcgtgccgcgcgccatgagcgagctctgcaaggccgctctcgccgcggacgttaagaccgcccgtgagattcatctgaaactcctgtcgctgcataagaacctgttcgtcgaatcgaatccgattccggccaaatgggcgctgcagcaactgggtcgtgtgcagggcggaatccgcctgccgcttacgccgctcgacccgcagtaccacgaagtggtacgcggcgcgctgcgcgaagcgggcctgctgggctag

SEQ ID NO: 71288 - protein, 320 aa, Burkholderia xenovorans LB400
MTNGNQSGNQSGNQSGNHSGNQGSNDGVQIRGSIPAIITPMLEDGSLDLPAFRKLIDWHVAEGTNALVVVGTSGESATLSVEEHVLMVKTAVEHTAGRIPVIAGSGGNSTTEAIELTQRAKEVGADATLQVVPYYNKPTQEGIYRHFAKIAETVDLPVILYNVPGRTVADMSNETILRLAQVPGIIGVKEATGNIDRAAHLIKFAPSHFGIYSGDDPTAIALMLLGGHGNISVTANVVPRAMSELCKAALAADVKTAREIHLKLLSLHKNLFVESNPIPAKWALQQLGRVQGGIRLPLTPLDPQYHEVVRGALREAGLLG

SEQ ID NO: 71289 - DNA, 885 bp, Ralstonia metallidurans CH34
  CDS (1)..(885): transl_table=11
atgacacagattaccggcagcatcgtggccatcgtcaccccgatgcacgaggatggcagcctggactttcccgcgctgcgcgccctcatcgactggcacgcggcggaaggcaccgatggcatcgtgatcgtgggtaccacgggcgaatcgccgaccgtcaacgtcgacgagcattgcgaactgattcgcgtggccgtcgagcaatccgcgggccgtgtaccgatcatcgcgggcacgggcggcaactccaccagcgaggcgattgagctgaccgccttcgccaagaaggtgggcgccaacgcatcgctgcaggtcgtgccctactacaacaagccgacgcaagaaggcatgtaccgccatttccgcacgatcgcggaagcggtggatctgccggtggtgctctacaacgtgcccggccgtaccgtggcggacatgaacaacgatacgatcctgcgcctggcgcaggtacccggtatcgtcggcgtaaaggaagcgactggtaatatcgaccgtgccgcgcaactgatcaatggcgcgccggaaggcttcgccatctacagtggcgacgatcccacggccgtggcgctgatcctgctgggcggccatggaaatatctcggtgaccgctaacgtggcaccgcgcaagatgcatgagatgtgtgttgccgcgctcaagggcgatgtggtgacggcgcgtcgtctgcatatggagctgattgacctcaatcgcgcaatgttcgtggaggccaatccgatccccgtgaagtgggcgctccagcaaatgggcaagatggaaggcggtatccgcctgccgctgaccccgctggccgaaggtcagcatgaaaccgtgcgccgcgcgctcgccgccgccggcctgcttggctaa

SEQ ID NO: 71290 - protein, 294 aa, Ralstonia metallidurans CH34
MTQITGSIVAIVTPMHEDGSLDFPALRALIDWHAAEGTDGIVIVGTTGESPTVNVDEHCELIRVAVEQSAGRVPIIAGTGGNSTSEAIELTAFAKKVGANASLQVVPYYNKPTQEGMYRHFRTIAEAVDLPVVLYNVPGRTVADMNNDTILRLAQVPGIVGVKEATGNIDRAAQLINGAPEGFAIYSGDDPTAVALILLGGHGNISVTANVAPRKMHEMCVAALKGDVVTARRLHMELIDLNRAMFVEANPIPVKWALQQMGKMEGGIRLPLTPLAEGQHETVRRALAAAGLLG

SEQ ID NO: 71291 - DNA, 843 bp, Haemophilus somnus 129PT
  CDS (1)..(843)
atgaataatcatggagaagttgattttaatgcattaaaaaaattagttgaataccacattgtctcaggaactcacgctatcgtttctgtcggtacaaccggagaatcagctaccttaagtatcgctgaaaatgtaaaaacaattttaaagactcttgaatttgccgatggaagaatacctattattgcaggtaccggagcaaatgcaaccagcgaagcgattacgatgaccaagctgttaaatgatagtggtgttgcaggttgtttatccgttgtaccttactacaataaaccaactcaagaaggtatgtatcaacattttaaagccattgcagaatgtacggatattccacaaattctttacaatgtcccgagtcgtaccggtagcgatctattgcctgaaactgttggtcgtttatctcaaattgcaaatattgttggaattaaagaagcaacaggtgatgtcagtcgtgtagcgaaaattaaacagatggcgggggaagatttcattttcctcagcggcgatgacgcaacagggcttgaaagtatgaaacttggcggtcaaggagtcatttccgtcacaaacaatattgctgccgctgatatggcaaaaatgtgtgaattggcattagccggaaaatttgatgaagcagaaatcattaatgataaattaagagctttacataaagatttattcatcgaatcaaatcctattccggtaaaatgggcagcttataaattaggattagtccctgatccgatattacgtttgccgctgacaactttaagcgaacaggcacaaccgaaaattattaacgcattaaaaaatgccggattgctatag

SEQ ID NO: 71292 - protein, 280 aa, Haemophilus somnus 129PT
MNNHGEVDFNALKKLVEYHIVSGTHAIVSVGTTGESATLSIAENVKTILKTLEFADGRIPIIAGTGANATSEAITMTKLLNDSGVAGCLSVVPYYNKPTQEGMYQHFKAIAECTDIPQILYNVPSRTGSDLLPETVGRLSQIANIVGIKEATGDVSRVAKIKQMAGEDFIFLSGDDATGLESMKLGGQGVISVTNNIAAADMAKMCELALAGKFDEAEIINDKLRALHKDLFIESNPIPVKWAAYKLGLVPDPILRLPLTTLSEQAQPKIINALKNAGLL

SEQ ID NO: 71293 - DNA, 897 bp, Haemophilus somnus 2336
  CDS (1)..(897)
atgaccacacacagacctttattctacggtagtatcaccgcacttattacgccaatggataatcatggggaagttgattttaacgcattaaaaaaactggttgaataccatattgcttcaggaactcacgctatcgtttctgtcggtacaaccggagaatccgccacattaagcatcgctgaaaatgtgaaaacaattttaaaaactcttgagtttgccgatggaagaatacctgttattgcaggtaccggagcaaatgcaaccagcgaagcgattacgatgaccaagctgttaaatgatagtggtgttgcaggttgtttatccgttgtaccttactacaataaaccaactcaagaaggtatgtatcaacattttaaagccattgcagaatgtacggatattccacaaattctttacaatgtcccgagtcgtaccggtagcgatctattgcctgaaaccgttggtcgtttagctcaaattagtaatattattggaattaaggaagcgacaggtgatgtcagccgtgtagcgaaaattaaacaggcggcgggggacgatttcatttttctcagcggtgatgatgcaacagggcttgaaagtatgaaacttggcggtcaaggagtcatttccgtcacaaataatattgccgccgctgatatggcaaaaatgtgtgaattggcattagccggaaaatttgatgaagcagaaatcattaatgataaattaagtgctttacataaagatttattcatcgaatcaaatcctattccggtgaaatgggcggcttataaattaggattaattcctgaaccgatattacgtcttccactgacaactttaagcgaacaatcgcaaccaaaagttattgaagcattaaaaaatgccggattgctatag

SEQ ID NO: 71294 - protein, 298 aa, Haemophilus somnus 2336
MTTHRPLFYGSITALITPMDNHGEVDFNALKKLVEYHIASGTHAIVSVGTTGESATLSIAENVKTILKTLEFADGRIPVIAGTGANATSEAITMTKLLNDSGVAGCLSVVPYYNKPTQEGMYQHFKAIAECTDIPQILYNVPSRTGSDLLPETVGRLAQISNIIGIKEATGDVSRVAKIKQAAGDDFIFLSGDDATGLESMKLGGQGVISVTNNIAAADMAKMCELALAGKFDEAEIINDKLSALHKDLFIESNPIPVKWAAYKLGLIPEPILRLPLTTLSEQSQPKVIEALKNAGLL

SEQ ID NO: 71295 - DNA, 894 bp, Actinobacillus pleuropneumoniae serovar 1 str. 4074
  CDS (1)..(894)
atgattatggcaaccccactatttcacggcagcattgttgcacttgtcacgccgatgactcacggtgaagtaaattacgaagagttaaaaaaattggttgaataccatgttcaagccggtactcacggtattgtatcggtcggtacgacaggcgaatcgaccacattaagcattgatgaaaatgtgaaagtgatcaagaaaaccgtggaatttgcagatggtcgtattccgattattgccggtacggggtcgaatgcaaccagcgaagcgattattttaaccaaattattaaccaatagtggcgttgcaggttgtttaagtgtggttccttattacaataaaccgactcaagagggaatgtatttacactataaagcgattgccgaaagtaccgacttaccgcaaattttatataacgtaccgagccgtaccggcagtgatttaaaaccggaaaccatcggacgtttagccgagatcccgaatattgtcggtgtaaaagaagcaacgggtgatttaactcgtttgccgttaattaaaaaattagccggtgaagattttattttcttaagcggtgacgatgcgacaggcttagaatcaatgaaacttggcggtcaaggcgtaatttcggtaaccaataacgttgcggcggcggatatggcaaaaatgtgcgagcttgcattagccggtaaatttgatgaagcggaagcgattaatcagcgtttaatggcattgcaccacgacttatttattgaagcgaatccgattccggtcaaatgggctgcttataaattaggtttaatcagtgagccgaatttacgtttaccattaaccacgttatcggaatccgctcaacctaccgtgttagcggcattgcaaaaagccggtttaatttaa

SEQ ID NO: 71296 - protein, 297 aa, Actinobacillus pleuropneumoniae serovar 1 str. 4074
MIMATPLFHGSIVALVTPMTHGEVNYEELKKLVEYHVQAGTHGIVSVGTTGESTTLSIDENVKVIKKTVEFADGRIPIIAGTGSNATSEAIILTKLLTNSGVAGCLSVVPYYNKPTQEGMYLHYKAIAESTDLPQILYNVPSRTGSDLKPETIGRLAEIPNIVGVKEATGDLTRLPLIKKLAGEDFIFLSGDDATGLESMKLGGQGVISVTNNVAAADMAKMCELALAGKFDEAEAINQRLMALHHDLFIEANPIPVKWAAYKLGLISEPNLRLPLTTLSESAQPTVLAALQKAGLI

SEQ ID NO: 71297 - DNA, 864 bp, Pseudomonas aeruginosa UCBPP-PA14
  CDS (1)..(864)
atggtggcactggtcacccccttcgatgctcagggtcgactggactgggacagcctcgccaagctggtggacttccacttgcaggaaggcaccaacgccatcgtcgccgtcggcaccaccggtgaatcggccacgctggacgtggaagagcacatccaggtgatccgtcgcgtggtcgaccaggtcaagggccgcatcccggtgatcgccggcaccggcgccaactccacccgcgaggcggtggcgctgaccgaggccgcgaaaagcggcggcgccgacgcctgcctgctggtgacgccgtactacaacaagccgacccaggaaggcatgtaccagcacttccgccatatcgccgaagccgttgcgatcccgcagatcctctacaacgtgcccgggcgtacctcctgtgacatgcttccggagaccgtcgagcgcctgtccaaggtgccgaacatcatcggcatcaaggaggccaccggcgacctgcaacgcgccaaggaagtcatcgagcgcgtcggcaaggacttcctcgtctattccggcgacgacgccactgccgtcgagctgatgctgctgggtggcaagggcaacatctcggtgaccgccaacgtcgcgccgcgcgccatgagcgacctgtgcgccgccgccatgcgcggcgacgccgctgccgcgcgcgccatcaacgaccgcctgatgccgctgcacaaggcgttgttcatcgaatccaaccccattccggtgaagtgggccctgcatgagatgggtctgatccccgagggcatccgcctgcccctgacctggctcagcccgcgttgccacgagccgctgcgtcaggccatgcgccagaccggcgtattggcttga

SEQ ID NO: 71298 - protein, 287 aa, Pseudomonas aeruginosa UCBPP-PA14
MVALVTPFDAQGRLDWDSLAKLVDFHLQEGTNAIVAVGTTGESATLDVEEHIQVIRRVVDQVKGRIPVIAGTGANSTREAVALTEAAKSGGADACLLVTPYYNKPTQEGMYQHFRHIAEAVAIPQILYNVPGRTSCDMLPETVERLSKVPNIIGIKEATGDLQRAKEVIERVGKDFLVYSGDDATAVELMLLGGKGNISVTANVAPRAMSDLCAAAMRGDAAAARAINDRLMPLHKALFIESNPIPVKWALHEMGLIPEGIRLPLTWLSPRCHEPLRQAMRQTGVLA

SEQ ID NO: 71299 - DNA, 897 bp, Haemophilus influenzae R2866
  CDS (1)..(897)
atgtcagcgcaaaatcctttattttcgggtagcatagttgcccttgttacgccaatgaatcattatggcgaagtcgatttttcctgtttagaaaaattagtagaacatcatattgaagctggttctaatgcgcttgtttctgtgggtacaacgggagaatccgccacgctaagtattgaagaaaatgtaaaagtcattgaaaagactgttgaatttgccaaaggacgtattcctattattgcgggagcgggtgcaaatgcgacgagtgaagcaattacaatgaccaaattattacgagacagtggtgtagcaggatgtttatctgttgtgccttattataataaaccaacccaagagggaatgtatcaacattttaaagccattgcggaatgtactgatttaccgcagattctttataatgttcctattcgcacaggcagtgatatgaaaccagaaacagttgctcgtttagctgaaattgaaaatattgtaggcattaaggaagcaacgggagatgttagccgaatagttaaaattaagcagcttgcaggtaagaattttattgttttaagtggcaatgatgcaacaggcttagaagcaataaaattaggtgctgaaggagtaatatcagtaacaaataacattgcagcaaaagatatggctgatatgtgccgttatgcacttgcgggagattttgataaagcggaagaaattaatgctcgtttaatgcgtttgcatcacgacctgttcattgaatctaatccaattccagtgaagtgggcagcttatcgcttaggcttaattaaatcgccacatttacgcttgccacttacaacacttagtgaagaaattcaaccaaaagtagaagatgcgctaaaaatcgcaggattgttataa

SEQ ID NO: 71300 - protein, 298 aa, Haemophilus influenzae R2866
MSAQNPLFSGSIVALVTPMNHYGEVDFSCLEKLVEHHIEAGSNALVSVGTTGESATLSIEENVKVIEKTVEFAKGRIPIIAGAGANATSEAITMTKLLRDSGVAGCLSVVPYYNKPTQEGMYQHFKAIAECTDLPQILYNVPIRTGSDMKPETVARLAEIENIVGIKEATGDVSRIVKIKQLAGKNFIVLSGNDATGLEAIKLGAEGVISVTNNIAAKDMADMCRYALAGDFDKAEEINARLMRLHHDLFIESNPIPVKWAAYRLGLIKSPHLRLPLTTLSEEIQPKVEDALKIAGLL

SEQ ID NO: 71301 - DNA, 882 bp, Rubrivivax gelatinosus PM1
  CDS (1)..(882)
atgaaacccatcgttggcagcatcgtcgcgctcgtcacgccgatgcacgaggacggtagcgtcgactacccctctctgcgtcgcctgatcgactggcacattgccgaaggcaccgactgcatcggcgtggtcggcaccaccggcgaatcgccgacggtcgcgcccgaagagcactgcgagatcatccgcgtggcggtcgagcatgtcgccggacgcgtgccggtgatggccggagccggcgcgaactccacgcgcgaagccatcgagctcagccgctacgccaagcaggtcggcgccgactgcacgctgcaggtcgtgccctactacaacaagcccacgcaggaaggccagtaccagcacttccgcagcatcgccgaagcggtggacatcccggtggtgctctacaacgtgcccggccgtaccgtggccgatatgctgcccgagacagtgctgcgtctggcccaggtgcccggcatcgtcggcctgaaggaagccaccggcaacatcgagcgcgcatgctggctgatcaagcaggcaccgaagggcttctccatctactccggcgacgacccgaccgcggtggcgctgatgctgctgggtggccatggcaacgtcagcgtgacggccaacgttgcgccgcgtgcgatgcacgagctgtgcgtcgcggcgatggccggtgacgcgaagcgcgccgccaagatccacctggcgctgttgccgctgcacaagcagttgttctgcgaacccaatccgattccggtgaagtgggcgctgcagcgcatgggccgctgcggcggcgcactgcgcctgccgctgacgccgctgagtgcagcgctgcagccggtggtcgagcagtcgctgcgcgacgccggcctgctgtga

SEQ ID NO: 71302 - protein, 293 aa, Rubrivivax gelatinosus PM1
MKPIVGSIVALVTPMHEDGSVDYPSLRRLIDWHIAEGTDCIGVVGTTGESPTVAPEEHCEIIRVAVEHVAGRVPVMAGAGANSTREAIELSRYAKQVGADCTLQVVPYYNKPTQEGQYQHFRSIAEAVDIPVVLYNVPGRTVADMLPETVLRLAQVPGIVGLKEATGNIERACWLIKQAPKGFSIYSGDDPTAVALMLLGGHGNVSVTANVAPRAMHELCVAAMAGDAKRAAKIHLALLPLHKQLFCEPNPIPVKWALQRMGRCGGALRLPLTPLSAALQPVVEQSLRDAGLL

SEQ ID NO: 71303 - DNA, 879 bp, Vibrio sp. Ex25
  CDS (1)..(879)
atgttttcaggaagtatcgtagcgctgattacgccattcaaagcagatggcgaagtagactttgacagtctgcaaaagctagtagagtaccacgttgaagcgggtacagacggtattgtggcggtaggcacaacaggtgagtcagcgacactgaccattgaagagcatgtaaaggtcgttaataaaactgttgagtttgccgacggtcgcatccctgtgattgctggcacgggtgcaaatgcaacccacgaggcagtaacatttagcaaattactggctgattctggtattgctggcttcctgagtgtgacaccgtattacaacaaaccaactcaagaaggtttgttcttgcactacaaggcaattgctgaagcgagtgatgtgcctctaattttatacaacgtaccaggccgtactgctgttgatatgcagccagaaacagtggcacgcttgtcaaagcttgataatatcgtggctttaaaagatgcaacgggcgatttggaccgaattgcaattcaccgtgaactttgtggcgaagattttatcttactaagtggcgatgatgcgacgggtctcgattttgtgaaacttggcggcaatggtgttatctcggtaacgaacaatattgcagctaaagacatggctgacatgttccatttggcaagtgaaggtaagtacgaagaagcagaagcgattaaccaacgcttgatgactctacacaaaaaccttttcattgaagcaagccctatcccagtaaaatgggcagcgcaaaagcttggtttgattgaagaaggtggtttgcgtcttcctttaaccacactttctgaaaaatcgcagccgatcgttgaacaggcgttaaccgacgccggtatttattaa

SEQ ID NO: 71304 - protein, 292 aa, Vibrio sp. Ex25
MFSGSIVALITPFKADGEVDFDSLQKLVEYHVEAGTDGIVAVGTTGESATLTIEEHVKVVNKTVEFADGRIPVIAGTGANATHEAVTFSKLLADSGIAGFLSVTPYYNKPTQEGLFLHYKAIAEASDVPLILYNVPGRTAVDMQPETVARLSKLDNIVALKDATGDLDRIAIHRELCGEDFILLSGDDATGLDFVKLGGNGVISVTNNIAAKDMADMFHLASEGKYEEAEAINQRLMTLHKNLFIEASPIPVKWAAQKLGLIEEGGLRLPLTTLSEKSQPIVEQALTDAGIY

SEQ ID NO: 71305 - DNA, 873 bp, Alkalilimnicola ehrlichei MLHE-1
  CDS (1)..(873): transl_table=11
atgttccatggcagcatggtggcgatggtgacgcccatgcacccggacggcgcggtggatgaggtgtcgctggcgcgtctggtggattatcacgtggagcacggcaccgatgccatcgtggccgtgggcaccaccggtgagtccgccacgctggattacgacgagcactgccatgtgatgcgcaaggtggtggaggccgcccgcggccgtattccggtcattggcggcaccggcgccaactccacgtgggaggcgatcaagctcacccgctgcgcgatggagggcggctgcgacgccacgctgctggtggtgccctattacaacaagcccacccaggacggcctttaccgccactttgcagcgatcgccgatgcggtggcgatcccgcagatcctctacaacgtccccggtcgcaccgcctgcgatctgttgccggatacagtggaccggttggcggacatctccaacatcgtcggcatcaaggaggcctccaccatcgagcgggtgcacgatctggtcgagcgctgcagtgaccggctcgatgtcttcagcggcgaggacggcctcagccgggaagcggtgctggcgggggccaagggcgtcatctcggtgaccgccaacgtcgcaccgcaacagatgcacgacatggtcgctgccgcgctgcgtggtgatgaggaggaggcgagccgcatcgacgcccgcctggcggcgttgcactcggccctgttcctggagtccaacccgatccccgtgaagtgggccgtcagccagatggggctgtgtggcccgagcatccggctgccgctgacggagctttccgaacagcaccacgaaactgtacgccaggccatgaaactggccggctcgctctga

SEQ ID NO: 71306 - protein, 290 aa, Alkalilimnicola ehrlichei MLHE-1
MFHGSMVAMVTPMHPDGAVDEVSLARLVDYHVEHGTDAIVAVGTTGESATLDYDEHCHVMRKVVEAARGRIPVIGGTGANSTWEAIKLTRCAMEGGCDATLLVVPYYNKPTQDGLYRHFAAIADAVAIPQILYNVPGRTACDLLPDTVDRLADISNIVGIKEASTIERVHDLVERCSDRLDVFSGEDGLSREAVLAGAKGVISVTANVAPQQMHDMVAAALRGDEEEASRIDARLAALHSALFLESNPIPVKWAVSQMGLCGPSIRLPLTELSEQHHETVRQAMKLAGSL

SEQ ID NO: 71307 - DNA, 879 bp, Photobacterium sp. SKA34
  CDS (1)..(879): transl_table=11
atgtttaaaggaagcatggttgcgctattaactccactagattcagcaggcgaagtagattacgtcggtttgaaaacgctggtggattatcatattaacgcaggaacaagtgcgattattgccgtgggtaccacgggagagtctgcaacacttaccgttgatgagcatattaaggttgttttaaaaacattggaatatgttgatggacgagttcctgttattgcaggtacaggcgcaaatgcgacgcatgaagccatcacaatcaccaagcttttttctggcacgggtgtagcagcatgtttaagtgttacaccgtactataataagccaacccaagaaggtttattccaacattataaagccattgctgaagcgacagatattccgcaaattctttacaatgtacctggacgaactgcggtagacttattacctgaaactgtcgcgcgtttagctaaaatcgataatattattggtattaaagatgcgacagctgatttatctcgtgtgaaaaaaacacgggaactttgtggtgaagatttcatccaattaagcggtgatgacgctacagccgtagactttgtcgctgaaggtggtcacggtgttatttctgtcacggcaaatattgccgcagcagatatggctcaaatgttttcactcgcattaagtggccaaattgacgctgcacgagaaattaatcagcgtttaatgccattacacagtcatctgtttgttgaagcgaaccctattccagtgaaatgggcggctcatcagttaggcttgattgataatggtgaattacgactaccgctaactgtattaagcgagtcacagcaaccgattgttaaacaggctcttttggatgccggtgtgctttaa

SEQ ID NO: 71308 - protein, 292 aa, Photobacterium sp. SKA34
MFKGSMVALLTPLDSAGEVDYVGLKTLVDYHINAGTSAIIAVGTTGESATLTVDEHIKVVLKTLEYVDGRVPVIAGTGANATHEAITITKLFSGTGVAACLSVTPYYNKPTQEGLFQHYKAIAEATDIPQILYNVPGRTAVDLLPETVARLAKIDNIIGIKDATADLSRVKKTRELCGEDFIQLSGDDATAVDFVAEGGHGVISVTANIAAADMAQMFSLALSGQIDAAREINQRLMPLHSHLFVEANPIPVKWAAHQLGLIDNGELRLPLTVLSESQQPIVKQALLDAGVL

SEQ ID NO: 71309 - DNA, 876 bp, Oceanospirillum sp. MED92
  CDS (1)..(876): transl_table=11
atgattactggcagcattgttgctcttgttacccctatgcaatctaacggcgatgtcgattgggaaaatctcgacaaacttgtagatatgcatttggataagggcacagattctatcgttgcagtgggcacaacaggtgagtccgcgactttaaactgcgatgagcactgtcaggtcattaaacgtgtagttgatcgtgttgctggtcggattccggttattgcaggtactggcgcaaactcaacaagcgaagcgatagagcttactgaagaagcaaagaaagtgggtgcagatgcctgtctgttagttacgccttactacaacaagccaactcaggaagggctttatcagcactttaaagcgattgctgaagccgttgatattcctcagatcctatataatgttccgggtcgtactgcatgtgatatgcagactgaaacggtagttcgtttggctgagatcgataacattattggtattaaagaagcgacaggtgatgtagagcgcggcatcgatttggtgaagcgtgtacctgaagatttcgcagtttattccggcgacgaccctacggctgtagagctaattttgggtggcggtaaaggtaatatctctgtcactgcaaacgttgctcctgcggagatgtctaatctgtgtgaacttgcactggcgggtaaggcagatgaagcgcgtgcactaaatgatcgtctgatgccattacatgagaaacttttcgttgaggctaatcctatccctgtaaaatgggctttagctgatatgggcctcatgggactgggtattcgtttgcctctcactgttttagcagatgaataccatgaagtagtacgtgaagctttgcgtagcagcgaaattatctaa

SEQ ID NO: 71310 - protein, 291 aa, Oceanospirillum sp. MED92
MITGSIVALVTPMQSNGDVDWENLDKLVDMHLDKGTDSIVAVGTTGESATLNCDEHCQVIKRVVDRVAGRIPVIAGTGANSTSEAIELTEEAKKVGADACLLVTPYYNKPTQEGLYQHFKAIAEAVDIPQILYNVPGRTACDMQTETVVRLAEIDNIIGIKEATGDVERGIDLVKRVPEDFAVYSGDDPTAVELILGGGKGNISVTANVAPAEMSNLCELALAGKADEARALNDRLMPLHEKLFVEANPIPVKWALADMGLMGLGIRLPLTVLADEYHEVVREALRSSEII

SEQ ID NO: 71311 - DNA, 879 bp, marine gamma proteobacterium HTCC2207
  CDS (1)..(879): transl_table=11
atgattcgcggaagcattgtcgccctggtcacgcccatgcaccaagagacccaaggggttgattggtcagccctaaaacacctggtcgattggcatatagagcagggcaccaacagcatagtggcggtgggtactactggtgaatcagccacgttaagtgttgctgagcacgctcaggttatccgcgtcatagtggagcaagccgctggccgcttgccgattatcgctggaaccggtgccaactctaccagagaagcgattgtcttaacccaggcggcggcagattcaggcgccgatgcctgcttgctcgtgaccccctattacaataagccgactcaggaaggtctatatttgcaccacaaagcgattgctgaggctgttgctatagatcaaattctgtacaacgtccctgggcgtaccgcttgtgatatgcagccagagacggttctgcgtctcagtgaaattgataatattgtcggagtaaaagaagccacaggtgatcttgaacgagctaaaacgttaattgatcagtgccgagagggctttgccatttattctggcgatgatgccacggccagagagctcattttgttgggcggtgacggtgacatttcagtaaccgccaatgttgctcctaagttaatgtcccaaatgtgtgcggcagcgctggctggagatgccgctctggctgctgaactagaccgcaagcttgaggcactgcaccgagatctatttgtcgaagctaacccaatcccagttaagtgggcggtggctgagttgggtttgcaggaaaatgtgttgcgattgccaatgacgccgttgagcgcagagcaccgtgaaagggttcgagcggctatgcggaacgccgaaattatttaa

SEQ ID NO: 71312 - protein, 292 aa, marine gamma proteobacterium HTCC2207
MIRGSIVALVTPMHQETQGVDWSALKHLVDWHIEQGTNSIVAVGTTGESATLSVAEHAQVIRVIVEQAAGRLPIIAGTGANSTREAIVLTQAAADSGADACLLVTPYYNKPTQEGLYLHHKAIAEAVAIDQILYNVPGRTACDMQPETVLRLSEIDNIVGVKEATGDLERAKTLIDQCREGFAIYSGDDATARELILLGGDGDISVTANVAPKLMSQMCAAALAGDAALAAELDRKLEALHRDLFVEANPIPVKWAVAELGLQENVLRLPMTPLSAEHRERVRAAMRNAEII

SEQ ID NO: 71313 - DNA, 879 bp, Oceanobacter sp. RED65
  CDS (1)..(879): transl_table=11
atgatcaccggaagtatggtggcattagtcacaccaatgagtaaagcaggggatattcagtgggattccctagaaaaattggtggagatgcatataaaagagggtaccgattcgattgttgctgtaggtaccacaggcgagtcatccaccttgtcaaccgaagagcatttgaaagttattgaacaagttatcaagtggtcaaatggctgtattagcgtaattgctggtaccggtgcgaactcaacatctgaggctctctatctaaccaaagaagccgagcgtctgggcgcagatgccgcgttattggtcgtcccatattacaataagccgactcaagaaggtctatatcagcactataaaacaattgctgaggccagtgggattgaccagattttgtataacgttccgggtcgtacagtttgtgacatgttaccagagactgtggagcgtctagcctcgatcaaaaacatcgtcggtataaaagaggccaccggcgatatcaatcgtgtttacgatattattaatcgctgtggtgatgagatgatcatatacagtggtgacgatgccacggcctatgagctaatgctggcgggcgggaaaggcaatatttcagtgactgctaacgtcgctccaaaacagatggcggagctatgtcgtttatctattgaagggcatgcggaggaggcaaaagccttaaatgatcagctgatgcctttacatcactcactattcactgaagcgaacccgattcctgtgaagtgggcgatgcacgaaatggggttgatgggaccaggcatccgtttgcctcttactcctttatcagagcacttgcgggaaccattacgccaagtattgcgtcaatacgatctactaaaataa

SEQ ID NO: 71314 - protein, 292 aa, Oceanobacter sp. RED65
MITGSMVALVTPMSKAGDIQWDSLEKLVEMHIKEGTDSIVAVGTTGESSTLSTEEHLKVIEQVIKWSNGCISVIAGTGANSTSEALYLTKEAERLGADAALLVVPYYNKPTQEGLYQHYKTIAEASGIDQILYNVPGRTVCDMLPETVERLASIKNIVGIKEATGDINRVYDIINRCGDEMIIYSGDDATAYELMLAGGKGNISVTANVAPKQMAELCRLSIEGHAEEAKALNDQLMPLHHSLFTEANPIPVKWAMHEMGLMGPGIRLPLTPLSEHLREPLRQVLRQYDLLK

SEQ ID NO: 71315 - DNA, 954 bp, Zizania latifolia
  CDS (1)..(954)
atgcgaagttctgaagtgaaaaatcggacatcaacagctgatatcactagcctcagattaataacagcagtcaaaaccccttatctgccagatggaagatttgatcttgaagcatatgattcactgataaatatgcaggtagatggtggtgccgaaggtgtaatagttggaggaacaacaggagaaggccaccttatgagctgggatgaacacatcatgcttattgggcatactgttaactgctttggcactaaaattaaagtgatcggcaacacaggaagtaactcaacaagagaggctattcatgcaacagagcagggatttgctgtaggtatgcatgcagctctccacatcaatccttactacgggaagacctctatcgaagggttgatctctcattttgaggctgtcctcccaatgggtccaaccatcatttacaatgtgccatccaggactggtcaggatattcctcctgccgttatcgaggcagtttcaagtttttcaaacatggcaggtgtgaaagaatgtgttggacatgagagggttaagtgctacactgacaaaggtataaccatatggagcggtaatgatgatgaatgccatgattctaggtggaaacatggtgccactggagttatttctgtagctagcaaccttgttcctggtctcatgcacaatctcatgtatgaagagcagactgcagtgctaaatgagaagctcctgccattgatgaaatggctgttttgccagccaaatccgattgctctcaacactgccctggctcagcttggagtggtaaggcctgttttcaggctaccgtatgtaccccttcctcgtgaaaagagggttgagtttgtccgaattgttgaatctatcggacgggaaaactttgtgggtcagaaagaggcacgggttcttgatgatgacgattttgtgttggtcagtaggtactag

SEQ ID NO: 71316 - protein, 317 aa, Zizania latifolia
MRSSEVKNRTSTADITSLRLITAVKTPYLPDGRFDLEAYDSLINMQVDGGAEGVIVGGTTGEGHLMSWDEHIMLIGHTVNCFGTKIKVIGNTGSNSTREAIHATEQGFAVGMHAALHINPYYGKTSIEGLISHFEAVLPMGPTIIYNVPSRTGQDIPPAVIEAVSSFSNMAGVKECVGHERVKCYTDKGITIWSGNDDECHDSRWKHGATGVISVASNLVPGLMHNLMYEEQTAVLNEKLLPLMKWLFCQPNPIALNTALAQLGVVRPVFRLPYVPLPREKRVEFVRIVESIGRENFVGQKEARVLDDDDFVLVSRY

SEQ ID NO: 71317 - DNA, 906 bp, Corynebacterium glutamicum
  CDS (1)..(906): transl_table=11
atgagcacaggtttaacagctaagaccggagtagagcacttcggcaccgttggagtagcaatggttactccattcacggaatccggagacatcgatatcgctgctggccgcgaagtcgcggcttatttggttgataagggcttggattctttggttctcgcgggcaccactggtgaatccccaacgacaaccgccgctgaaaaactagaactgctcaaggccgttcgtgaggaagttggggatcgggcgaagctcatcgccggtgtcggaaccaacaacacgcggacatctgtggaacttgcggaagctgctgcttctgctggcgcagacggccttttagttgtaactccttattactccaagccgagccaagagggattgctggcgcacttcggtgcaattgctgcagcaacagaggttccaatttgtctctatgacattcctggtcggtcaggtattccaattgagtctgataccatgagacgcctgagtgaattacctacgattttggcggtcaaggacgccaagggtgacctcgttgcagccacgtcattgatcaaagaaacgggacttgcctggtattcaggcgatgacccactaaaccttgtttggcttgctttgggcggatcaggtttcatttccgtaattggacatgcagcccccacagcattacgtgagttgtacacaagcttcgaggaaggcgacctcgtccgtgcgcgggaaatcaacgccaaactatcaccgctggtagctgcccaaggtcgcttgggtggagtcagcttggcaaaagctgcttcgcgtctgcagggcatcaacgtaggagatcctcgacttccaattatggctccaaatgagcaggaacttgaggctctccgagaagacatgaaaaaagctggagttctataa

SEQ ID NO: 71318 - protein, 301 aa, Corynebacterium glutamicum
MSTGLTAKTGVEHFGTVGVAMVTPFTESGDIDIAAGREVAAYLVDKGLDSLVLAGTTGESPTTTAAEKLELLKAVREEVGDRAKLIAGVGTNNTRTSVELAEAAASAGADGLLVVTPYYSKPSQEGLLAHFGAIAAATEVPICLYDIPGRSGIPIESDTMRRLSELPTILAVKDAKGDLVAATSLIKETGLAWYSGDDPLNLVWLALGGSGFISVIGHAAPTALRELYTSFEEGDLVRAREINAKLSPLVAAQGRLGGVSLAKAASRLQGINVGDPRLPIMAPNEQELEALREDMKKAGVL

SEQ ID NO: 71319 - DNA, 882 bp, Serratia marcescens
  CDS (1)..(882): transl_table=11
atgtttacgggaagtattgttgcactggttacgccgatggacgacaaaggtgctgtcgatcgcgcgagcctgaaaaaattgatcgattatcatgtagccagtggcaccgcggcgatcgtttccgtagggaccaccggcgagtccgcaacgcttgcccatgacgagcacgttgacgtggtgctgcagacgctggagttggccgacggccgcattccggtgatcgccggcaccggcgccaacgccaccgccgaagccatcgcgctcaccacccgcttcgccaacaccggcgtggtgggctgcctgacggtgacgccgtactacaataagccgacgcaggaagggctgtatcagcacttcaaggcgatcgccgagagcaccgaactgccgcagatcctgtataacgtgccttcgcgcaccggctgcgacatgctgccgccgaccatcgctcggctggcgaaaatcaagaatattgttgctgtaaaagaagcgacggggaacttaagtcgcgttagtcagatccaagtgctggttgacgatgaagatttcattttgctgagcggcgacgacgccagcgggctggacttcatgcaactgggcggcaaaggggtgatttccgtgacggccaacgtggccgcgcgcgagatggcggaactttgcgcgctggcggcgcagggcaaatttgccgaagcgcgccgcttaaatcagcgcttgatgccgttgcatcaggatctatttgtagaagcaaacccaattccggtgaagtgggcctgtaaggcgttgggattgatggcaaccgatacgctgcgtctgccgatgacgccgttgagcgaagccgcccgcccggtggtggagcgcgcgctgaaaagcgtcggtttgctgtaa

SEQ ID NO: 71320 - protein, 293 aa, Serratia marcescens
MFTGSIVALVTPMDDKGAVDRASLKKLIDYHVASGTAAIVSVGTTGESATLAHDEHVDVVLQTLELADGRIPVIAGTGANATAEAIALTTRFANTGVVGCLTVTPYYNKPTQEGLYQHFKAIAESTELPQILYNVPSRTGCDMLPPTIARLAKIKNIVAVKEATGNLSRVSQIQVLVDDEDFILLSGDDASGLDFMQLGGKGVISVTANVAAREMAELCALAAQGKFAEARRLNQRLMPLHQDLFVEANPIPVKWACKALGLMATDTLRLPMTPLSEAARPVVERALKSVGLL

SEQ ID NO: 71321 - DNA, 882 bp, Yersinia ruckeri
  CDS (1)..(882): transl_table=11
atgtttacgggaagtattgttgcactggtaacgccgatggacgacaaaggtgctgtcgatcgtgtgagccttaaaaaactgattgattatcatgttgccagcggcactgccgcgattgtctccgttggtacgacgggtgagtctgccacgctgaatcatgacgaacatgcggatgtggttatgatgacgctggaactggctgatggccgcattccagtgattgcaggaaccggtgcgaatgcgactgcggaggcgatttctctcactaaacgttttgacaatacgggagtggtggggtgtttaaccgtcacgccgtattataaccgtccaatgcaggaaggtctgttccagcattttaaagcgatcgccgaaagtaccgaattgccacaaattctctataatgtgccagcgcgtaccggctgcgatatgctgccggaaacggtggctcgtttagccaagatcaagaatattgttgcgataaaagaagccacagggaacttatcacgggtaagtcagatccaagtgctggttgatgatgaagatttcatcctgcttggtggtgacgatgccagtggtctggactttatgcaactgggtggcaaaggtgttatttcggtaaccgctaacgttgcggcccgtgaaatggcacagctttgtgctttagcggctgaaggcaaatttgccgaagcgcgccggttaaaccaacgcttgatgccgttgcatcagcatttatttgtagaagcaaatccaattccggtgaaatgggcctgtaaggcgctggggttgatggcaaatgacgctatgcgtctgccaatgacgccgctgactgaccctgccaaactggtagtggaaaaagcgttgaaaagcgccggtttgctgtaa

SEQ ID NO: 71322 - protein, 293 aa, Yersinia ruckeri
MFTGSIVALVTPMDDKGAVDRVSLKKLIDYHVASGTAAIVSVGTTGESATLNHDEHADVVMMTLELADGRIPVIAGTGANATAEAISLTKRFDNTGVVGCLTVTPYYNRPMQEGLFQHFKAIAESTELPQILYNVPARTGCDMLPETVARLAKIKNIVAIKEATGNLSRVSQIQVLVDDEDFILLGGDDASGLDFMQLGGKGVISVTANVAAREMAQLCALAAEGKFAEARRLNQRLMPLHQHLFVEANPIPVKWACKALGLMANDAMRLPMTPLTDPAKLVVEKALKSAGLL

SEQ ID NO: 71323 - DNA, 891 bp, Methylophilus methylotrophus
  CDS (1)..(891): transl_table=11
atggcgctaggtatgttaacgggcagtttggtcgcaatcgtgacccccatgtttgaagatggacgtttggatctggacgccctcaaaaagctggtcgactttcatgtagaggcagggacagatggtattgtcatcgttggcacgactggcgagtcgcccacggtggatgtagatgagcattgtctgctgatcaaaaccacgatcgagcatgtcgccaagcgcgtgccagtcattgccggtactggcgcaaattccactgctgaagccattgaactgactgccaaggccaaggcgcttggcgcagacgcctgcctgctggtggcaccgtattacaacaagccctcgcaagagggtttgtaccagcactttaaagccgtggctgaggcggtcgatattccgcaaattctctataatgtgccaggccgcaccggttgcgacttgtctaacgacaccgtattgcgcctggcgcagattcgcaacattgtcgggattaaggatgcgactggagggattgagcgcggtaccgatttgttgttgcgtgcaccagctgatttcgccatttacagcggggatgatgccactgcgctggccctgatgttattaggggggaaaggcgtgatttcggtcacggccaatgtcgcgcccaaattaatgcatgaaatgtgcgagcatgctttgaatggcaacctggccgcagccaaagcggccaatgccaaactgtttgcattgcaccagaagttgtttgtagaagcgaacccgattccagtgaaatgggtattacaacaaatgggaatgattgccactggcatccgtttgccgctggtcaatttatccagccaatatcatgaagtattgcgcaacgccatgaagcaggcagaaattgccgcttga

SEQ ID NO: 71324 - protein, 296 aa, Methylophilus methylotrophus
MALGMLTGSLVAIVTPMFEDGRLDLDALKKLVDFHVEAGTDGIVIVGTTGESPTVDVDEHCLLIKTTIEHVAKRVPVIAGTGANSTAEAIELTAKAKALGADACLLVAPYYNKPSQEGLYQHFKAVAEAVDIPQILYNVPGRTGCDLSNDTVLRLAQIRNIVGIKDATGGIERGTDLLLRAPADFAIYSGDDATALALMLLGGKGVISVTANVAPKLMHEMCEHALNGNLAAAKAANAKLFALHQKLFVEANPIPVKWVLQQMGMIATGIRLPLVNLSSQYHEVLRNAMKQAEIAA

SEQ ID NO: 71325 - DNA, 882 bp, Yersinia enterocolitica
  CDS (1)..(882): transl_table=11
atgtttacaggaagcatagttgcgctgatcacgccgatggacgacaaaggtaatgtcgatcgtgcgagtcttaagaaacttatcgattatcatgtagccagtggaactgcggcgattgtctccgtaggcacgacgggtgaatctgcgacgttgaaccatgacgagcatgttgatgttgtcttgcagacgctcgaactggccgatggccggattcctgtgattgccggaaccggtgctaatgccacctccgaagctatttcgctcacgcagcgctttaatgataccggtgtggttggttgcctgacggtgacgccatattataaccgcccaatgcaggaagggttatatcagcacttcaaagcgattgctgaaagtaccgatttaccacaaatcctctataatgtgccctcgcgtaccggttgcgatatgttaccgccgaccattgcccgtttagccaagattaaaaatattgttgctgttaaagaagcaacagggaacttaagtcgggtaagtcagatccaagtgctggttgatgatgaagatttcatcctgctcagtggtgacgatgcgagcggtttagactttatgcagttaggtggccaaggtgttatttcggtgacagccaacattgctgcgcgcgaaatggttgaactttgcgcgctggctgcacagggtaactttgcagaggcacgccgtttgaatcagcgcttgatgccgttgcatcagcatttatttgtagaagcaaacccaattccggtgaaatgggctgcgaagaagctgggattaatggcgaatgacactctgcgtctgccaatgaccccactgactgacccagctaaacgggttgtggaagacgcgctgaaaagcgcaggtttgctgtaa

SEQ ID NO: 71326 - protein, 293 aa, Yersinia enterocolitica
MFTGSIVALITPMDDKGNVDRASLKKLIDYHVASGTAAIVSVGTTGESATLNHDEHVDVVLQTLELADGRIPVIAGTGANATSEAISLTQRFNDTGVVGCLTVTPYYNRPMQEGLYQHFKAIAESTDLPQILYNVPSRTGCDMLPPTIARLAKIKNIVAVKEATGNLSRVSQIQVLVDDEDFILLSGDDASGLDFMQLGGQGVISVTANIAAREMVELCALAAQGNFAEARRLNQRLMPLHQHLFVEANPIPVKWAAKKLGLMANDTLRLPMTPLTDPAKRVVEDALKSAGLL

SEQ ID NO: 71327 - DNA, 873 bp, Methylobacillus glycogenes
  CDS (1)..(873): transl_table=11
atgctgcaaggcagtctcgttgccatcgtcacccccatgctcgacgatggcagcctggatatccaggcgttacgctcactcatcgattaccatatcgagcagaaatccgatggcatcgtggtggtgggcacaacaggcgaatcccccactgtcgactttgatgaacacgccctgctgatcaagaccacggtcgagcatagtgctggccgtatcccggtcattgccggtacgggcgccaactccaccagcgaggctatcgccctcacccgcaaggcgaaagagctaggcgcagatgcatgcctgctggtcaccccctattacaacaagccgacacaggaaggcctgtatcagcacttccaggcgattgccgcggcagtggacattccgcagattttgtataacgtccccggccgcacaggctgcgacctgcaaaacgataccgtgcttcgccttgccgcgatcaagaacattgtcggcattaaggacgccacgggcaatatcgagcgcggcaccgacctgatcctgcgcgcaccggcaggatttgcaatctacagcggcgatgacgccagcagcctggcgctgttgttactcggcgggcacggcgtcatctcggtgacggcgaatgcggcccccaggctgatgcacgacatgtgtacggcggccctggcaggcgacaccaaggccgcccgcagcgccaacgccaagctgttcgcattgcatcagaaactgttcgtcgaggccaacccgatcccggtgaaatgggtgttgcagcagatgggcctgatccagggtggcattcgcctgccgctcgtgccactatcatcccaattccatgacacattgcgcagcgccatgaagcaagctgccatttga

SEQ ID NO: 71328 - protein, 290 aa, Methylobacillus glycogenes
MLQGSLVAIVTPMLDDGSLDIQALRSLIDYHIEQKSDGIVVVGTTGESPTVDFDEHALLIKTTVEHSAGRIPVIAGTGANSTSEAIALTRKAKELGADACLLVTPYYNKPTQEGLYQHFQAIAAAVDIPQILYNVPGRTGCDLQNDTVLRLAAIKNIVGIKDATGNIERGTDLILRAPAGFAIYSGDDASSLALLLLGGHGVISVTANAAPRLMHDMCTAALAGDTKAARSANAKLFALHQKLFVEANPIPVKWVLQQMGLIQGGIRLPLVPLSSQFHDTLRSAMKQAAI

SEQ ID NO: 71329 - DNA, 1044 bp, Oryza sativa
  CDS (1)..(1044)
atgcaacactctgacacagacaaatattcatacaggattagcagaggaaagttttcagtgacggccatctccctggatgattatcttccaatgcgaagtagtgaagtgaaaaatcggacatcaacaggtgatatcactagcctcagagtaataacagcggttaaaaccccttatctgccggatggaagatttgatcttgaagcatatgattcgctgataaacatgcagattgaaggtggtgctgaaggtgtaatagtgggaggaacaacaggagagggccacctgatgagctgggatgaacacatcatgcttattgggcatacagttaactgctttggcactaaaattaaagtggtcggcaacacaggaagtaactcaacaagggaggctattcacgcaactgagcagggattcgctgtaggtatgcacgcggctctccacatcaatccttactacgggaagacctccgtcgaagggttgatctcccattttgaggctgttctcccaatgggtccaaccatcatttacaatgtgccatccagagactggcaagacataccacctcctgtgattgaggcggtttcctcttatacgaacatggcaggtgtcaaagaatgtgttggacatgagagggttaagtgctatgctgacagaggaataagcatatggagtggtaatgatgatgaatgccatgagtctaggtggaaatatggtgccactggagtcatttctgtagccagcaaccttattcccggtctcatgcatagcctcatgtacgaaggggagaatgcagcgctcaatgataagctacttcctctgatgaaatggttgttttgccagcctaatccgattgcgctcaacaccgccctggctcagcttggagtggcaagacccgttttcagattaccttatgtacctctcccccttgaaaagagggttgagttcgtccgaattgtcgaatccattggacgggaaaattttgtgggtcagaaagaagcaagggttcttgatgatgatgattttgtgttgatcagtaggtattaa

SEQ ID NO: 71330 - protein, 347 aa, Oryza sativa
MQHSDTDKYSYRISRGKFSVTAISLDDYLPMRSSEVKNRTSTGDITSLRVITAVKTPYLPDGRFDLEAYDSLINMQIEGGAEGVIVGGTTGEGHLMSWDEHIMLIGHTVNCFGTKIKVVGNTGSNSTREAIHATEQGFAVGMHAALHINPYYGKTSVEGLISHFEAVLPMGPTIIYNVPSRDWQDIPPPVIEAVSSYTNMAGVKECVGHERVKCYADRGISIWSGNDDECHESRWKYGATGVISVASNLIPGLMHSLMYEGENAALNDKLLPLMKWLFCQPNPIALNTALAQLGVARPVFRLPYVPLPLEKRVEFVRIVESIGRENFVGQKEARVLDDDDFVLISRY

SEQ ID NO: 71331 - DNA, 1098 bp, Arabidopsis thaliana
  CDS (1)..(1098)
atgtcagctttgaaaaattacggcttgatctccattgattctgccctccattttcctcgatcaaatcaattgcagagctataagagaaggaatgcaaaatgggtctctccaatagcagctgttgtacctaacttccatcttcctatgcgcagtctcgaggataaaaacaggacaaacacagacgacataaggtcccttagagtgatcacagccattaagacaccgtatttacctgatggaagattcgacctccaagcatacgatgacttagtcaacacgcagatagaaaacggtgctgaaggtgtgattgttggtggtacaactggtgaaggccaattgatgagctgggatgagcacataatgcttatcggccatactgtaaattgttttgggggaaggatcaaagtcattggaaacactggaagtaactcgactagggaagctattcatgccactgagcaaggattcgccatgggaatgcacggggcactgcacattaacccttactatggaaaaacatccattgaaggcatgaatgcgcattttcaaaccgttcttcatatgggaccgactattatatacaacgtgccaggtcgaacgtgccaggatatacctccccaggttatctttaaactctctcagaaccctaatatggctggggttaaggaatgcgttggtaataaccgagttgaagagtatactgagaagggaattgtcgtttggagtggaaatgatgatcagtgccatgattctagatgggatcacggtgccactggagtgatatcggttactagcaatttagttccgggtttgatgaggaagttgatgtttgaaggtagaaactcagcgttgaacgcaaagcttcttcctttaatggattggctattccaagaaccgaatcccattggtgtaaacactgctttggctcagttaggagttgcgaggccggtttttcggttaccttatgtgccattgcctctgtccaaaaggattgagttcgttaaactggtgaaggaaatcggaagggagcattttgtaggagacagagatgttcaggtacttgatgatgatgacttcatcttaatcggtcgatattag

SEQ ID NO: 71332 - protein, 365 aa, Arabidopsis thaliana
MSALKNYGLISIDSALHFPRSNQLQSYKRRNAKWVSPIAAVVPNFHLPMRSLEDKNRTNTDDIRSLRVITAIKTPYLPDGRFDLQAYDDLVNTQIENGAEGVIVGGTTGEGQLMSWDEHIMLIGHTVNCFGGRIKVIGNTGSNSTREAIHATEQGFAMGMHGALHINPYYGKTSIEGMNAHFQTVLHMGPTIIYNVPGRTCQDIPPQVIFKLSQNPNMAGVKECVGNNRVEEYTEKGIVVWSGNDDQCHDSRWDHGATGVISVTSNLVPGLMRKLMFEGRNSALNAKLLPLMDWLFQEPNPIGVNTALAQLGVARPVFRLPYVPLPLSKRIEFVKLVKEIGREHFVGDRDVQVLDDDDFILIGRY

SEQ ID NO: 71333 - DNA, 885 bp, Rhizobium meliloti
  CDS (1)..(885): transl_table=11
atgttcaagggttccattcccgcactcgtaacgccgttcaccgccgccggctcggttgatgcggatagtttcgtcgcgcatgtggagtggcagataaaagagggcagccacggccttgtgccggtgggcaccacgggtgaatctccgacgctttcccacgacgagcataagaaggtcgtggaactgtgcgtcgaggcgtcggcgcggcgcgtaccggtcatcgccggtgccgggtccaataatacgatcgaagcgatcgagcttgcgcagcatgcggagaaggccggtgcggacgcgatcctcgtcgtcacgccctattacaacaaaccgacgcagaagggtcttttcgcccacttcgcggcgatcgccgaaagcgtgaagctgccgatcgtgatctataacattcccggccgttccgtcgtcgacatgagcgtcgagaccatggcggcgctggcgaaggcccatccgacgatcgtcggcgtgaaggatgcgaccggcaggatcgagagggtttccgagcagcgcatggcctgcggcaaggccttcgtgcagctttcgggtgaggatgcgaccgcgctcggcttcaatgcccatggcggcgtcggctgcatttccgtcaccgccaatgtcgcgccgcgcctgtgcgccgagttccaggaggccacccttgccggcaattatgccaaggccttggagcttcaggacaaattgatgccgcttcacaaggccatcttccttgagccgggcgtctgcggcgccaaatatgcgttgaaccgcctcgggcgaatgagctttaccgttcgttcgccgttgttgtcggcgctcgagccggccacggcctcggctatcgacgcggcgctcaggcatgcagggctgatgaactga

SEQ ID NO: 71334 - protein, 294 aa, Rhizobium meliloti
MFKGSIPALVTPFTAAGSVDADSFVAHVEWQIKEGSHGLVPVGTTGESPTLSHDEHKKVVELCVEASARRVPVIAGAGSNNTIEAIELAQHAEKAGADAILVVTPYYNKPTQKGLFAHFAAIAESVKLPIVIYNIPGRSVVDMSVETMAALAKAHPTIVGVKDATGRIERVSEQRMACGKAFVQLSGEDATALGFNAHGGVGCISVTANVAPRLCAEFQEATLAGNYAKALELQDKLMPLHKAIFLEPGVCGAKYALNRLGRMSFTVRSPLLSALEPATASAIDAALRHAGLMN

SEQ ID NO: 71335 - DNA, 900 bp, Streptomyces coelicolor
  CDS (1)..(900): transl_table=11
atggctccgacctccactccgcagacccccttcgggcgggtcctcaccgccatggtcacgcccttcacggcggacggcgcactcgacctcgacggcgcccagcggctcgccgcccacctggtggacgcaggcaacgacggcctgatcatcaacggcaccaccggcgagtccccgaccaccagcgacgcggagaaagcggacctcgtacgggccgtcgtggaggcggtcggcgaccgggcgcacgtggtggccggagtcggcaccaacaacacccagcacagcatcgagctggcccgcgccgccgagcgcgtcggcgcccacggcctgctgctcgtcacgccgtactacaacaagcccccgcaggagggcctgtacctgcacttcacggccatcgccgacgccgccgggctgccggtcatgctctacgacatccccggccgcagcggcgtcccgatcaacaccgagaccctggtccgcctcgcggagcacccgcggatcgtcgccaacaaggacgccaagggcgacctcggccgggccagctgggccatcgcgcgctccggcctcgcctggtactccggcgacgacatgctcaacctgccgctgctcgccgtgggcgcggtcggcttcgtctccgtcgtgggccacgtcgtcaccccggagctgcgcgccatggtggacgcgcacgtcgccggtgacgtacagaaggccctggagatccaccagaagctgctccccgtcttcaccggcatgttccgcacccagggcgtcatgaccaccaagggcgcgctcgccctccagggactgcccgcgggaccgctgcgcgcccccatggtcggcctcacgcccgaggaaaccgagcagctcaagatcgatcttgccgccggcggggtacagctctga

SEQ ID NO: 71336 - protein, 299 aa, Streptomyces coelicolor
MAPTSTPQTPFGRVLTAMVTPFTADGALDLDGAQRLAAHLVDAGNDGLIINGTTGESPTTSDAEKADLVRAVVEAVGDRAHVVAGVGTNNTQHSIELARAAERVGAHGLLLVTPYYNKPPQEGLYLHFTAIADAAGLPVMLYDIPGRSGVPINTETLVRLAEHPRIVANKDAKGDLGRASWAIARSGLAWYSGDDMLNLPLLAVGAVGFVSVVGHVVTPELRAMVDAHVAGDVQKALEIHQKLLPVFTGMFRTQGVMTTKGALALQGLPAGPLRAPMVGLTPEETEQLKIDLAAGGVQL

SEQ ID NO: 71337 - DNA, 1167 bp, Triticum aestivum
  CDS (1)..(1167)
atgccgtacctccagcccccgcgcccccacccccacccccacccgacctcccgcctctcgcgcgcgtcgccgccgtcgccgttcccgttcttccccgccgggacatcgcgctccggtcgtctccaacccgtcccagtctccggccactcggcctcgagggttagtaaaggaaagtttgcagttgcagccgtcactctagatgattatcttccgatgcgaagtactgaagtgaaaaaccggacatcaacagatggaatcaaaagcctcagactaatcacagcggtcaaaaccccctatttgccagatggaagatttgatcttgaagcatacgattctctgataaacacgcaaataaatggcggtgcggaaggtgtaatagttggaggaacaacaggagaaggtcacctcatgagctgggatgagcacatcatgctcatcgggcatactgttaactgctttggagccaacattaaagtgataggcaacacgggaagtaactcaaccagagaagctgttcacgcgacagagcagggatttgctgttggcatgcatgcagctcttcatgtcaatccttactacgggaagacctcaactgaaggcctgatctctcattttaaggaagtcctcccgatgggcccaacaatcatttacaacgtgccatccaggacaagtcaggacatacctccaccagtcattgaggcgctttcatcttactcaaacatggcaggagtgaaagaatgtgtcggacatgagcgggttaagtgctacaccgacaaaggcatatcaatatggagcggcaacgatgatgaatgtcatgactcaaggtggaagtatggcgctactggagtcatttctgtggcgagcaaccttgttcccggtctcatgcatagcctcatgtttgaaggggagaatgcggcgctaaatgagaagctactgcctctgatgaaatggctgttctgcgagcctaacccgatcggtctcaacaccgccctggctcagctcggcgtggtgagacctgttttcaggttgccgtacactccccttcctcttgagaagagggtggagtttgtccggattgtcgaagccattggacgtgagaactttgtgggacagaaggagtcccgggttctggatgacgatgatttcgtgttgatcagcaggtattga

SEQ ID NO: 71338 - protein, 388 aa, Triticum aestivum
MPYLQPPRPHPHPHPTSRLSRASPPSPFPFFPAGTSRSGRLQPVPVSGHSASRVSKGKFAVAAVTLDDYLPMRSTEVKNRTSTDGIKSLRLITAVKTPYLPDGRFDLEAYDSLINTQINGGAEGVIVGGTTGEGHLMSWDEHIMLIGHTVNCFGANIKVIGNTGSNSTREAVHATEQGFAVGMHAALHVNPYYGKTSTEGLISHFKEVLPMGPTIIYNVPSRTSQDIPPPVIEALSSYSNMAGVKECVGHERVKCYTDKGISIWSGNDDECHDSRWKYGATGVISVASNLVPGLMHSLMFEGENAALNEKLLPLMKWLFCEPNPIGLNTALAQLGVVRPVFRLPYTPLPLEKRVEFVRIVEAIGRENFVGQKESRVLDDDDFVLISRY

SEQ ID NO: 71339 - DNA, 1098 bp, Arabidopsis thaliana
  CDS (1)..(1098)
atggctgctttgaaaggttatggcttgtgttctatggactctgctcttcaattcccctgtcctaagctattcaatagctacaagagaaggagctcgaaatgggtctctcccaaagcagctgttgtacccaatttccatctcccaatgcgcagcttggaggttaaaaacaggacaaacacagacgacattaaagctctacgtgtgatcacagctatcaaaacaccgtatctacctgatggaagattcgaccttgaagcctacgatgacttggtcaacattcagatacaaaacggtgctgaaggtgtcattgttggtggtacaactggtgaaggacaactgatgagctgggacgaacacattatgcttataggccataccgttaactgttttggcggaagcatcaaagtcattggaaacactggaagcaattcgactagagaagcaatccacgcgactgaacaaggattcgcggttggaatgcatgctgctcttcatataaacccttactatggcaagacttctattgagggactgattgcacatttccagtctgttcttcatatgggaccgacgattatatacaatgtgcctggtcgaacagggcaagatataccgcctcgtgccatcttcaaactttctcagaatccgaatttagctggtgtgaaggaatgtgttgggaacaagcgagtcgaagagtacactgagaatggggttgttgtgtggagtgggaatgatgatgagtgtcatgattccagatgggattatggagcaacaggagttatatcagttactagtaatttagttccgggtttgatgaggaagttgatgtttgaaggtaggaattcatctttgaactcaaagcttctacctttgatggcttggctgttccacgagccaaacccgattggaatcaacactgctttggctcagcttggagtttcgaggccggtttttaggttaccatatgtaccattgccactgtctaagaggcttgagtttgtgaaactggtgaaggagattggacgagagcattttgtgggtgagaaagatgttcaggctcttgatgatgatgattttatccttatcggtcgatattag

SEQ ID NO: 71340 - protein, 365 aa, Arabidopsis thaliana
MAALKGYGLCSMDSALQFPCPKLFNSYKRRSSKWVSPKAAVVPNFHLPMRSLEVKNRTNTDDIKALRVITAIKTPYLPDGRFDLEAYDDLVNIQIQNGAEGVIVGGTTGEGQLMSWDEHIMLIGHTVNCFGGSIKVIGNTGSNSTREAIHATEQGFAVGMHAALHINPYYGKTSIEGLIAHFQSVLHMGPTIIYNVPGRTGQDIPPRAIFKLSQNPNLAGVKECVGNKRVEEYTENGVVVWSGNDDECHDSRWDYGATGVISVTSNLVPGLMRKLMFEGRNSSLNSKLLPLMAWLFHEPNPIGINTALAQLGVSRPVFRLPYVPLPLSKRLEFVKLVKEIGREHFVGEKDVQALDDDDFILIGRY

SEQ ID NO: 71341 - DNA, 1134 bp, Triticum aestivum
  CDS (1)..(1134)
atgatggcggcgcagccgacggctaacccgggggtccgcctcggctggaaggcccccggcgctctagcatccccgccgcgcctggctctgtctcgctccgccgcggccccgctcgcgtcacacagggttggcagaggaaagttttcagctgcggccatcactactgatgattatcttccaatgcgaagtactgaagtgaaaaatcggacatcagtagatggaatcaaaagtctcagactaatcacagcggtcaaaaccccctatttgccagatggaagatttgatcttgaagcatatgattctttgataaacacgcaaataaacgggggcgccgaaggtgtaattgttggtggaacaacaggagaaggtcatcttatgagctgggatgaacacatcatgctcatcgggcacactgttaactgctttggaactaacattaaagtgataggcaacacgggaagtaactcaactagagaagcgattcacgcttcagagcagggatttgctgttggcatgcatgcagctctccatgtcaatccttactatgggaagacctcaactgcaggactgatctctcatttcgacgaagtcctcccgatgggtccaacaatcatttacaatgtgccatccaggactggtcaggacatacctcctgcagtcattgaggcactctcaacttatccaaacatggcaggagtgaaagaatgtgttggacatgaacgagtgaagtgctacacagacaaaggtataacaatatggagtggcaatgatgacgaatgccatgattcaaggtggaagtatggtgctactggagtcatttctgtgactagcaaccttgttcctggtctcatgcgcagtctcatgtttgaaggggagaatgcggccctaaatgagaagctactgcctctgatgaaatggttattttctgagcctaatccgattggtctcaacactgccctggctcagctcggtgtagtgaggcctgttttcaggagaccgtatgcccctctctctcttgaaaagaggaccgagtttgtccggattgttgaagcaatcgggcgggagaactttgtgggacagaaagaggtgcgggttctggatgatgatgattttgtgttgatcagtaggtattaa

SEQ ID NO: 71342 - protein, 377 aa, Triticum aestivum
MMAAQPTANPGVRLGWKAPGALASPPRLALSRSAAAPLASHRVGRGKFSAAAITTDDYLPMRSTEVKNRTSVDGIKSLRLITAVKTPYLPDGRFDLEAYDSLINTQINGGAEGVIVGGTTGEGHLMSWDEHIMLIGHTVNCFGTNIKVIGNTGSNSTREAIHASEQGFAVGMHAALHVNPYYGKTSTAGLISHFDEVLPMGPTIIYNVPSRTGQDIPPAVIEALSTYPNMAGVKECVGHERVKCYTDKGITIWSGNDDECHDSRWKYGATGVISVTSNLVPGLMRSLMFEGENAALNEKLLPLMKWLFSEPNPIGLNTALAQLGVVRPVFRRPYAPLSLEKRTEFVRIVEAIGRENFVGQKEVRVLDDDDFVLISRY

SEQ ID NO: 71343 - DNA, 885 bp, Agrobacterium tumefaciens
  CDS (1)..(885): transl_table=11
atgttcaagggatcaattcccgccctcattaccccgttcacggacaatggttccgtggacgaaaaggcctttgccgcccatgtggaatggcagatcgccgaaggcagcaacggccttgtgcccgtgggcacgacgggggaatccccgacgctctctcacgatgagcacaaacgggtcgttgagctgtgcatcgaggttgcggcgaaacgggttccggtcattgcgggtgctggctccaacaataccgatgaagcaatcgagcttgcgctgcacgcgcaggaggccggtgcggatgccctgctggtcgtcactccctattacaacaagccgacgcagaagggcctgttcgcgcatttttccgctgtcgccgaagcggtgaaactgccgatcgtcatctacaatatcccgccgcgctcggtggtggacatgtcgccggaaaccatgggtgcgctggtcaaagcgcataagaatatcatcggcgtcaaggatgcgaccggcaaactcgatcgggtttccgaacagcgcatttcctgcggcaaggattttgtccagctgtcgggcgaggatggcacggcgctcggctttaacgcccatggcggcgtcggctgcatttcggtcaccgccaatgtcgcgccgcgcctttgttccgagtttcaggcggcaatgcttgccggtgattacgccaaggcgcttgagtatcaggaccgcctgatgccgctgcacagggcgatcttcatggagcccggcgtctgcggcaccaaatatgcgctgtcgaagacacgcggcggcaatcgccgggtccgttcgcccttgatgagcacgctggaaccggcaacggaagcggcgatcgatgcggcgctgaagcatgccggcctgatgaactga

SEQ ID NO: 71344 - protein, 294 aa, Agrobacterium tumefaciens
MFKGSIPALITPFTDNGSVDEKAFAAHVEWQIAEGSNGLVPVGTTGESPTLSHDEHKRVVELCIEVAAKRVPVIAGAGSNNTDEAIELALHAQEAGADALLVVTPYYNKPTQKGLFAHFSAVAEAVKLPIVIYNIPPRSVVDMSPETMGALVKAHKNIIGVKDATGKLDRVSEQRISCGKDFVQLSGEDGTALGFNAHGGVGCISVTANVAPRLCSEFQAAMLAGDYAKALEYQDRLMPLHRAIFMEPGVCGTKYALSKTRGGNRRVRSPLMSTLEPATEAAIDAALKHAGLMN

SEQ ID NO: 71345 - DNA, 873 bp, Bacillus subtilis
  CDS (1)..(873): transl_table=11
atgaatttcggaaatgtgtctacagcgatgattacaccctttgacaataaagggaacgtagactttcaaaaactgtctacactgattgattacttgttgaaaaacggaacggattctttagtagtagcgggaacaactggagaatctccgaccctttcaactgaagaaaaaattgcgctttttgaatatacggtaaaagaagtaaacggacgggtgcccgttatcgctggtactgggagcaacaacacgaaagattccattaagctgacaaaaaaagctgaggaagcgggcgtggacgctgttatgcttgttaccccgtattacaataaaccttctcaagaaggaatgtaccagcattttaaagcaattgcggcagagacatctcttccggttatgctctataatgttcctggccgtacggttgcttctcttgctcctgaaacgacgatccgtttggcggcagacattccgaatgtggttgcgattaaagaagcgagcggagacctcgaagcgattacaaaaattattgctgaaacacctgaagacttctatgtctattcaggggatgatgctctaacgcttccaattctttcagttggaggtagaggagttgtgtcagtggcgagccatattgcaggcactgatatgcagcaaatgatcaaaaattatacgaatgggcaaacagctaatgcggcactgattcatcagaaactgctgccgattatgaaggaactgtttaaagcgcctaatcctgctccagtcaaaacagcgcttcagctgagaggtcttgatgtcggttctgtgcgtctgcctctagtcccattaactgaggatgaacgtctgagcttaagcagcacgatcagcgaactgtaa

SEQ ID NO: 71346 - protein, 290 aa, Bacillus subtilis
MNFGNVSTAMITPFDNKGNVDFQKLSTLIDYLLKNGTDSLVVAGTTGESPTLSTEEKIALFEYTVKEVNGRVPVIAGTGSNNTKDSIKLTKKAEEAGVDAVMLVTPYYNKPSQEGMYQHFKAIAAETSLPVMLYNVPGRTVASLAPETTIRLAADIPNVVAIKEASGDLEAITKIIAETPEDFYVYSGDDALTLPILSVGGRGVVSVASHIAGTDMQQMIKNYTNGQTANAALIHQKLLPIMKELFKAPNPAPVKTALQLRGLDVGSVRLPLVPLTEDERLSLSSTISEL

SEQ ID NO: 71347 - DNA, 879 bp, Blochmannia floridanus
  CDS (1)..(879): transl_table=11
atgtttacgggtagtatagtagcattgattacacctatggattcaaaaggttctatagatcgaatgggtttaaaaaaattggtagattatcatgtcgataatggtacatcagctattgtttccgtcgggactacgggagaaatgtctggacttactcattctgaacatgttgatgtagtgatgtggactatagaatttagtgatggaagattgccagtaattgctggaactggatcgaattcaacatcagaagcaatcttattaactaatcagtttaatgatagcgctgtatcagcatgtttaagtgtaactccttattataatagaccaagtcaagaaggtttgtttcagcattttagagctattgcggaaagtacaaatttacctcaaatattatataatgtccctatacgtacaggttgtgatttattacctattactgtaggtcgtttatcaacaataaaaaatatagttggaattaaagaggctactgggaatttaaatagggttaatcagttaaaacggctagtgaatgaggattttattttattgagtggggatgatataagtgctgtggattttatgagacttggaggtcatggagtcatttctgtaaccgcgaatgtggctccaaaagatatgtcaactctgtgtagttttgtacaaaaaaatgattttaaaagtgcatatgatattaataatcgtttaattccagtacatcaatctttattttttgattctaatcctattcccgtaaaatgggcatgtaaagaattagggttaatatcatatgatacccttcgattacctatgacttctatatctaaggagcatagtgtgttgattagaaaagcattagaggatgctgatttattataa

SEQ ID NO: 71348 - protein, 292 aa, Blochmannia floridanus
MFTGSIVALITPMDSKGSIDRMGLKKLVDYHVDNGTSAIVSVGTTGEMSGLTHSEHVDVVMWTIEFSDGRLPVIAGTGSNSTSEAILLTNQFNDSAVSACLSVTPYYNRPSQEGLFQHFRAIAESTNLPQILYNVPIRTGCDLLPITVGRLSTIKNIVGIKEATGNLNRVNQLKRLVNEDFILLSGDDISAVDFMRLGGHGVISVTANVAPKDMSTLCSFVQKNDFKSAYDINNRLIPVHQSLFFDSNPIPVKWACKELGLISYDTLRLPMTSISKEHSVLIRKALEDADLL

SEQ ID NO: 71349 - DNA, 885 bp, Buchnera aphidicola subsp
  CDS (1)..(885): transl_table=11
atgttcaaaggaagtattgttgcactaattacacccatggatgaaaaaggtcagatttgtcgtattagtttagaaaagttaattaattatcatgttgctagtaaaactgaagcaattgtttcaattggaactactggagaatccgcaacacttagtcaagaagaacacataaatattgttatgctcactttagaattagcagatggacgtattccagttattgcaggtacaggagcaaatgctacaacagaagctatatctttaaccaaaagatttgaaaaatctggtgttgcaggttgtttaagtgtaacgccatattataatagacctacacaagaaggattgtatcaacattttaaagctatttcagaaaacactgaattaccacaaattttatataatgtacccagtcgtaccggatgtgatttactcccagaaacagttgccaaattatctcattttaacaacataataggaattaaagaagcaactggagatttatcaagaatccataaaataaaagaattagttaaaactaattttttattaatcagtggagatgatgcaacagctttagattttatgcaattaggcggacaaggtgtaatatcggttacagcaaatattgctgcaaaagaaatgatggaaatttgttcgtatgcattaaaaggggattttataaatgcaagatctataaataaacgcctaatgttactacatgaagcgctgttcatagaacccaatcctattcccgtaaaatggttagcaaaaaaaataggattaataaaaagtgatacacttcgtttgcctatgacacccgttttagattctacacgttttcaacttgaaaaagcaattcaatatgctaatctcaaaatatcatag

SEQ ID NO: 71350 - protein, 294 aa, Buchnera aphidicola subsp
MFKGSIVALITPMDEKGQICRISLEKLINYHVASKTEAIVSIGTTGESATLSQEEHINIVMLTLELADGRIPVIAGTGANATTEAISLTKRFEKSGVAGCLSVTPYYNRPTQEGLYQHFKAISENTELPQILYNVPSRTGCDLLPETVAKLSHFNNIIGIKEATGDLSRIHKIKELVKTNFLLISGDDATALDFMQLGGQGVISVTANIAAKEMMEICSYALKGDFINARSINKRLMLLHEALFIEPNPIPVKWLAKKIGLIKSDTLRLPMTPVLDSTRFQLEKAIQYANLKIS

SEQ ID NO: 71351 - DNA, 885 bp, Buchnera aphidicola subsp
  CDS (1)..(885): transl_table=11
atgttcaaaggaagtattgttgcattaattacaccaatgaatgaagaaggtgaaatttgtcattcaagcttaaaaaagctaattgattatcatgtattaaataaaacaaaagctattgtttctattggaacgactggagaatcggctactcttagtcaagaagaacatattgaagtagttatgctaactttaaaacttgcaaataaacgcattcctatcattgcaggtacaggtgcgaatgcgacaacagaagcaatatccttaacaaaaagatttgaaaaatcaggaattgaagcatgtcttactgttacaccatactataacaaaccaactcaagaaggattataccagcattttaaagcaatttcagaaaacacaaaattaccacaaattttatataatgttccaagtcgaactggatgtgatttacttccatcaactgtggcaagattatctgaatttaaaaatattattggaattaaagaagcgacaggtgatctatcaagaatacataaaattaaaaaattggttaaagacgattttttattaattagtggtgatgaccctacggctttagattttattcaattaggtggtcaaggagtgatatcagttacagcaaatattgctgcaaaagaaatgacacagatgtgttcatatgcacttgaaggtaactttaaaagtgcaagatctataaatgaacgtttgatgttattacatgaatctttatttatagaacctaatcctattccaataaaatggttagctaaaaaaataggtttaataaaaagtgatacacttcgactaccgatgacaccaattttaaattctacacgtacacaaattgaaaaagcacttcaatatgctaatcttcaaaagatataa

SEQ ID NO: 71352 - protein, 294 aa, Buchnera aphidicola subsp
MFKGSIVALITPMNEEGEICHSSLKKLIDYHVLNKTKAIVSIGTTGESATLSQEEHIEVVMLTLKLANKRIPIIAGTGANATTEAISLTKRFEKSGIEACLTVTPYYNKPTQEGLYQHFKAISENTKLPQILYNVPSRTGCDLLPSTVARLSEFKNIIGIKEATGDLSRIHKIKKLVKDDFLLISGDDPTALDFIQLGGQGVISVTANIAAKEMTQMCSYALEGNFKSARSINERLMLLHESLFIEPNPIPIKWLAKKIGLIKSDTLRLPMTPILNSTRTQIEKALQYANLQKI

SEQ ID NO: 71353 - DNA, 885 bp, Buchnera aphidicola subsp
  CDS (1)..(885): transl_table=11
atgttaagaggaagtattgtagcacttataacaccaatgaatgaatatggtcatgtttgtgaaacaagtttagaaaaattaattaattatcatatcaataatggaaccaaagctattgtttctgttggaacaactggggaatcatctactcttagccaagaagaacacatcaacgtcgtaatgttaacattagaaataactaataaacgtcttccaatcattgcaggaacaggtgctaacgcaacatcagaagctattttattaactaaaaaatttgagaacacaggaatttctgcatgtttaacagtaactccatattacaatcgtcctacgcaaaaaggactatatcaacattttaaagcaatctcagaaaatacaaaaatacctcaaatcctatataacgttcccattcggacggggtgcgatttaatacctgaaacaatcattaaattatcgaaatttaaaaatattatcggtataaaagaagcaaccggtgatttatcacgtgttcaaaaaatcaaaaattcagtgcacaaaaatttttttattattagtggcgatgatacgacttttttagattttatacaattaggaggacatggtgtaatctcagttactgctaatatcgctgcaaaaataatgagtaatatttgtcatctagcacttaataaaaactttaaattagctagattcatgaataataaactaattccgttacatcaaggactctttcatgagcctaatcctattcccataaaatggctagctaaaaaaataggtttaatcgcatcagatacattacgtttacccatgactcctgtttctaataaaacacgtttaattttagaaaaagcactttatttttctaaaattactgcaaaataa

SEQ ID NO: 71354 - protein, 294 aa, Buchnera aphidicola subsp
MLRGSIVALITPMNEYGHVCETSLEKLINYHINNGTKAIVSVGTTGESSTLSQEEHINVVMLTLEITNKRLPIIAGTGANATSEAILLTKKFENTGISACLTVTPYYNRPTQKGLYQHFKAISENTKIPQILYNVPIRTGCDLIPETIIKLSKFKNIIGIKEATGDLSRVQKIKNSVHKNFFIISGDDTTFLDFIQLGGHGVISVTANIAAKIMSNICHLALNKNFKLARFMNNKLIPLHQGLFHEPNPIPIKWLAKKIGLIASDTLRLPMTPVSNKTRLILEKALYFSKITAK

SEQ ID NO: 71355 - DNA, 1134 bp, Coix lachryma
  CDS (1)..(1134)
atgatttccccccggatgacgacgaatctcctcccggctcggacgatctcccttgtctcaaatggcggcgcagcgacggcgagcccctcttctccctcggtggccgcacggccacggcgaccctcttcagggactggcagagggaaggtttctgccatcactctagatgattatcttccaatgcgaagtactgaagtgaagaaccgaacatcaacagatgacatcacaagtctgagattaatcacagctgtcaaaaccccctatttgcctgatggaagattcgatctggaagcatatgattctctcataaacatgcagatagagggtggtgctgaaggtgtaatagttggaggaacaacaggagagggtcacctcatgagctgggatgaacatatcatgctcattgggcatactgtgaactgctttggctctagaattaaagtgataggcaacacaggaagtaactcaaccagagaagctgttcacgcaacagagcagggatttgctgttggcatgcatgcagctctccacatcaatccttactatgggaagacctcaactgaaggaatgatttctcattttgagtctgtcctcccaatgggtccgaccatcatctacaacgtgccatccaggagtgcccaggatatccctcctgaagttattgtagcaatttcaggctatataaacatggcaggtgtcaaggaatgcattgggcacgagaggatcaagcactatgctgacaaaggtataacaatttggagcggtaatgacgacgaatgccatgattctaggtggaaatatggtgctactggagtaatttctgttactagcaaccttgttcctgggctcatgcacagcctcatgtacaaaggcgagaacgcggtgctgaaagagaagctgctgcccctgatgaaatggttgttctgccaaccaaatccgattgctctcaacactgctctggctcagctcggcgtggcaaggcctgtcttcagactgccatatgttccacttcctcttgaaaagagggccgagttcgtccggattgttgaggctattggacgggagaattttgtgggacagaaagagacccgagttctcgatgatgacgatttcgtgttgatcagtaggtactag

SEQ ID NO: 71356 - protein, 377 aa, Coix lachryma
MISPRMTTNLLPARTISLVSNGGAATASPSSPSVAARPRRPSSGTGRGKVSAITLDDYLPMRSTEVKNRTSTDDITSLRLITAVKTPYLPDGRFDLEAYDSLINMQIEGGAEGVIVGGTTGEGHLMSWDEHIMLIGHTVNCFGSRIKVIGNTGSNSTREAVHATEQGFAVGMHAALHINPYYGKTSTEGMISHFESVLPMGPTIIYNVPSRSAQDIPPEVIVAISGYINMAGVKECIGHERIKHYADKGITIWSGNDDECHDSRWKYGATGVISVTSNLVPGLMHSLMYKGENAVLKEKLLPLMKWLFCQPNPIALNTALAQLGVARPVFRLPYVPLPLEKRAEFVRIVEAIGRENFVGQKETRVLDDDDFVLISRY

SEQ ID NO: 71357 - DNA, 906 bp, Corynebacterium glutamicum
  CDS (1)..(906): transl_table=11
atgagcacaggtttaacagctaagaccggagtagagcacttcggcaccgttggagtagcaatggttactccattcacggaatccggagacatcgatatcgctgctggccgcgaagtcgcggcttatttggttgataagggcttggattctttggttctcgcgggcaccactggtgaatccccaacgacaaccgccgctgaaaaactagaactgctcaaggccgttcgtgaggaagttggggatcgggcgaagctcatcgccggtgtcggaaccaacaacacgcggacatctgtggaacttgcggaagctgctgcttctgctggcgcagacggccttttagttgtaactccttattactccaagccgagccaagagggattgctggcgcacttcggtgcaattgctgcagcaacagaggttccaatttgtctctatgacattcctggtcggtcaggtattccaattgagtctgataccatgagacgcctgagtgaattacctacgattttggcggtcaaggacgccaagggtgacctcgttgcagccacgtcattgatcaaagaaacgggacttgcctggtattcaggcgatgacccactaaaccttgtttggcttgctttgggcggatcaggtttcatttccgtaattggacatgcagcccccacagcattacgtgagttgtacacaagcttcgaggaaggcgacctcgtccgtgcgcgggaaatcaacgccaaactatcaccgctggtagctgcccaaggtcgcttgggtggagtcagcttggcaaaagctgctctgcgtctgcagggcatcaacgtaggagatcctcgacttccaattatggctccaaatgagcaggaacttgaggctctccgagaagacatgaaaaaagctggagttctataa

SEQ ID NO: 71358 - protein, 301 aa, Corynebacterium glutamicum
MSTGLTAKTGVEHFGTVGVAMVTPFTESGDIDIAAGREVAAYLVDKGLDSLVLAGTTGESPTTTAAEKLELLKAVREEVGDRAKLIAGVGTNNTRTSVELAEAAASAGADGLLVVTPYYSKPSQEGLLAHFGAIAAATEVPICLYDIPGRSGIPIESDTMRRLSELPTILAVKDAKGDLVAATSLIKETGLAWYSGDDPLNLVWLALGGSGFISVIGHAAPTALRELYTSFEEGDLVRAREINAKLSPLVAAQGRLGGVSLAKAALRLQGINVGDPRLPIMAPNEQELEALREDMKKAGVL

SEQ ID NO: 71359 - DNA, 879 bp, Escherichia coli; identical to SEQ ID NO: 71221
  CDS (1)..(879): transl_table=11

SEQ ID NO: 71360 - protein, 292 aa, Escherichia coli; identical to SEQ ID NO: 71222

SEQ ID NO: 71361 - DNA, 894 bp, Haemophilus ducreyi
  CDS (1)..(894): transl_table=11
atgattatgtccgtcccactctttcacggcagtattgttgctttattaacgccgatgacgcatggcgaagttaattaccaagagataaaaaatttagttgaatatcatattcaagcgggttcacatggcattgtggcaatggggacgaccggtgaatctacaaccctcagtattgatgaacacgtgaaagtaattaagaaaaccgtagagtttgctgatggaagaattcccattattgctggttccggctcaaatgcaacgagtgaagcggtaaccattactaaattattgaatggtgttggcgttgtgggctgtctaagtgttgtgccgtattataataaacctactcaagaaggattatatttacattataaagcgattgccgaaagcaccgaactacctcaaattttatataatgtgccaagtcgaacaggctgtgatttaaaacccgaaacaatcgggcgtttgtcagaaattcctaatattatcggggtaaaggaagcgacaggcgatttaactcgcttgcctttaattaaaacattagcgggcgaagatttcatttttttaagtggtgatgatgccactggcttagagtcaatgaaattaggcggacaaggtgtaatatcggtgactaataatctggcagcagcggatatggctaaaatgtgtgaattagttttagcaggcaattttgctgaagcagaagcaattaatcaacgtttgattgatttacatcacgatttatttattgaagcaaatccaatcccagtaaaatgggcggcttataaattagggttgattagtgagcctagcttacgcttgccgcttacaccactttctgaaaccgcacaacccactatattaaaagcgctacaaaaagcaggtttaatttag

SEQ ID NO: 71362 - protein, 297 aa, Haemophilus ducreyi
MIMSVPLFHGSIVALLTPMTHGEVNYQEIKNLVEYHIQAGSHGIVAMGTTGESTTLSIDEHVKVIKKTVEFADGRIPIIAGSGSNATSEAVTITKLLNGVGVVGCLSVVPYYNKPTQEGLYLHYKAIAESTELPQILYNVPSRTGCDLKPETIGRLSEIPNIIGVKEATGDLTRLPLIKTLAGEDFIFLSGDDATGLESMKLGGQGVISVTNNLAAADMAKMCELVLAGNFAEAEAINQRLIDLHHDLFIEANPIPVKWAAYKLGLISEPSLRLPLTPLSETAQPTILKALQKAGLI

SEQ ID NO: 71363 - DNA, 897 bp, Haemophilus influenzae
  CDS (1)..(897): transl_table=11
atgtcagcgcaaaattctttattttcgggtagcatagttgcccttgttacgccaatgaatcattatggcgaagtcgatttttcctgtttagaaaaattagtagaacaccacattgaagctggttctaacgcacttgtttctgtgggtacaacgggagaatccgccacgctaagtattgaagaaaatgtaaaagtcattgaaaagactgttgaatttgccaaaggacgtattcctattattgcgggagcgggtgcaaatgcgacgagtgaagcaattacaatgaccaaattattacgagacagtggtgtagcaggatgtttatctgttgtgccttattataataaaccaacccaagagggaatgtatcaacattttaaagccattgcggaatgtactgatttaccacagattctttataatgttcctagtcgcacaggcagtgatatgaaacctgaaacagttgctcgtttagctgaaattgaaaatattgtaggcattaaggaagcaacgagagatgttagccgaatagttaaaattaagcagcttgcaggtaagaattttattgttttaagtggtgatgatgcaacaggcttagaagcaataaaattaggtgctgaaggagtaatatcagtaacaaataacattgcagcaaaagatatggctgatatgtgccgttatgcacttgcgggagattttgataaagcggaagaaattaatgctcgtttaatgcgtttacatcacgacctattcattgaatctaatccaattccagtgaagtgggcagcttatcgcttaggcttaattaaatcgccacatttacgcttgccacttacaacacttagtgaagaaattcaaccaaaagtaggagatgcgctaaaaatcgcaggattattataa

SEQ ID NO: 71364 - protein, 298 aa, Haemophilus influenzae
MSAQNSLFSGSIVALVTPMNHYGEVDFSCLEKLVEHHIEAGSNALVSVGTTGESATLSIEENVKVIEKTVEFAKGRIPIIAGAGANATSEAITMTKLLRDSGVAGCLSVVPYYNKPTQEGMYQHFKAIAECTDLPQILYNVPSRTGSDMKPETVARLAEIENIVGIKEATRDVSRIVKIKQLAGKNFIVLSGDDATGLEAIKLGAEGVISVTNNIAAKDMADMCRYALAGDFDKAEEINARLMRLHHDLFIESNPIPVKWAAYRLGLIKSPHLRLPLTTLSEEIQPKVGDALKIAGLL

SEQ ID NO: 71365 - DNA, 891 bp, Idiomarina loihiensis
  CDS (1)..(891): transl_table=11
atgcttaagggcagtattgtcgctttagttaccccttttacaaaatatggcaatgttgattacagtgaacttgagtttctggttaacaaacattgcgaagcgggtaccgacgctattgtagcggttggcacgacaggggagtcaacaaccttaacgcatgaagaacatatcgctgtcgttaatgccatggtcgaactcagtgccgggcgcatcgatattattgctggaaacggttcaaactcgaccagcgaagccgtgcaactgacagaaaaaatgacccaggcgggtgtaagtggctttttaaatgttacgccatattacaataaaccttctttagcaggcttaattgcacattatcaggcctgtgccgatgctacggataaaccccaaattctatataatgttccggggcgcaccagtcttgatatgacaccggacatggtcgaacagctggcaaaaattgataacgttattggtataaaagaagctaccggtgacgtgagtcgggttcaggaacttaaagagcgctgcggcgatgactttatcttattaagcggtgatgaccctactgcacgcgaatttatgtttgcgggtggtcatggtgttatcagtgttaccgctaatattgttccggcaaaaatgaaagaactggtaacggcggcacttgctggtgataaagaaagtgcgaatcagatcgatgctgagctggcacctttgcataatatgttatttgttgaatccaaccccattccggtaaaatggtcgctcgctttaatgggttgggtcagcgcaaattatcgtctgccactgacacctccggaagagagtaatcaacaattgattgagtcagtgttacagaaagcaaacctactgaatattcaggagtcgtaa

SEQ ID NO: 71366 - protein, 296 aa, Idiomarina loihiensis
MLKGSIVALVTPFTKYGNVDYSELEFLVNKHCEAGTDAIVAVGTTGESTTLTHEEHIAVVNAMVELSAGRIDIIAGNGSNSTSEAVQLTEKMTQAGVSGFLNVTPYYNKPSLAGLIAHYQACADATDKPQILYNVPGRTSLDMTPDMVEQLAKIDNVIGIKEATGDVSRVQELKERCGDDFILLSGDDPTAREFMFAGGHGVISVTANIVPAKMKELVTAALAGDKESANQIDAELAPLHNMLFVESNPIPVKWSLALMGWVSANYRLPLTPPEESNQQLIESVLQKANLLNIQES

SEQ ID NO: 71367 - DNA, 897 bp, Pasteurella multocida
  CDS (1)..(897): transl_table=11
atgtcagcaaacaattatctcttctcgggcagtatcgttgctatcgtgaccccaatggacagttctggcgaaattgattttgtcagattgaaaagtttagttgaacatcatatcgcagcgggcacggatgcgattgtctcagtaggtacaaccggtgaagctgcaacattaagcattgatgagaatgttaaaaccattttaaaaacggtcgagtttgctgatggacgtattcctgtgattgcgggagccggtgctaatgccactagcgaagccattgtaatgactaaactcttaaatgacagtggtgtagcaggctgtctttctgtggtgccttattataataagccaacccaagaaggtatgtatcagcattttaaagccattgcagaatgtacagatttgccacaaattttatataacgtaccaagtcgtactggaagcgatttgttgccagaaacagtagcccgtttggcgaaaatcaacaatattgttgctattaaagaagcaaccggtgatcttagtcgtgtcgccaaaattaaagaattggcgggagaggatttcattttcttaagtggtgatgatgcaacagggttagagtccattaaattaggggggcaaggtgtaatttctgtgaccaataacgtggcggccgcggacatggcaaaaatgtgtcatcttgcactaaatggacaatttgaggaagctgaacaaattaatcagcgcttgatggcattacataaaaatttatttgtcgaatccaatccaattcctgtgaaatgggcagcttaccgtttaggtttgattgatacaccgactttacgcttaccgttgacaacgctgagtgaacatttacaacctaaagtcgaagacgcattaaaaatcgcgggtttgttgtaa

SEQ ID NO: 71368 - protein, 298 aa, Pasteurella multocida
MSANNYLFSGSIVAIVTPMDSSGEIDFVRLKSLVEHHIAAGTDAIVSVGTTGEAATLSIDENVKTILKTVEFADGRIPVIAGAGANATSEAIVMTKLLNDSGVAGCLSVVPYYNKPTQEGMYQHFKAIAECTDLPQILYNVPSRTGSDLLPETVARLAKINNIVAIKEATGDLSRVAKIKELAGEDFIFLSGDDATGLESIKLGGQGVISVTNNVAAADMAKMCHLALNGQFEEAEQINQRLMALHKNLFVESNPIPVKWAAYRLGLIDTPTLRLPLTTLSEHLQPKVEDALKIAGLL

SEQ ID NO: 71369 - DNA, 879 bp, Pseudomonas aeruginosa
  CDS (1)..(879): transl_table=11
atgattgcgggcagtatggtggcactggtcacccccttcgatgctcagggtcgactggactgggacagcctcgccaagctggtggacttccacttgcaggaaggcaccaacgccatcgtcgccgtcggcaccaccggtgaatcggccacgctggacgtggaagagcacatccaggtgatccgtcgcgtggtcgaccaggttaagggccgcatcccggtgatcgccggcaccggcgccaactccacccgcgaggcggtggcgctgaccgaggccgcgaaaagcggcggcgccgacgcctgcctgctggtgacgccgtactacaacaagccgacccaggaaggcatgtaccagcacttccgccatatcgccgaagccgttgcgatcccgcagatcctctacaacgtaccgggccgcacctcctgcgacatgcttccggagaccgtcgagcgcctgtccaaggtgccgaacatcatcggcatcaaggaggccaccggcgacctgcaacgcgccaaggaagtcatcgagcgcgtcggcaaggacttcctcgtctattccggcgacgacgccacggccgtcgagctgatgctgctgggtggcaagggcaacatctcggtgaccgccaacgtcgcgccgcgcgccatgagcgacctgtgcgccgccgccatgcgcggcgacgccgcagccgcgcgcgccatcaacgatcgcctgatgccgctgcacaaggcgctgttcatcgaatccaaccccattccggtgaagtgggccctgcatgagatgggtctgatccccgagggcatccgcctgcccctgacctggctcagcccgcgttgccacgagccgctgcgtcaggccatgcgccagaccggcgtattggcttga

SEQ ID NO: 71370 - protein, 292 aa, Pseudomonas aeruginosa
MIAGSMVALVTPFDAQGRLDWDSLAKLVDFHLQEGTNAIVAVGTTGESATLDVEEHIQVIRRVVDQVKGRIPVIAGTGANSTREAVALTEAAKSGGADACLLVTPYYNKPTQEGMYQHFRHIAEAVAIPQILYNVPGRTSCDMLPETVERLSKVPNIIGIKEATGDLQRAKEVIERVGKDFLVYSGDDATAVELMLLGGKGNISVTANVAPRAMSDLCAAAMRGDAAAARAINDRLMPLHKALFIESNPIPVKWALHEMGLIPEGIRLPLTWLSPRCHEPLRQAMRQTGVLA

SEQ ID NO: 71371 - DNA, 879 bp, Salmonella typhi
  CDS (1)..(879): transl_table=11
atgttcacgggaagtattgtcgcgcttgttacgccgatggatgagaaaggtaacgtcagtaggtcttgcctgaaaaaactcattgattatcatgtcgccaacggtacctcggcgattgtttcggttggcaccaccggcgagtctgccacgctaagccatgatgaacatggcgatgtcgtgatgatgacgctggaactggctgacggacgtattccggttatcgctggcacgggcgcaaacgcgaccgcggaagcgattagcctgacgcagcgttttaacgatagcggcattgttggctgcctgacggtaacgccgtactacaatcgccccacgcaggaaggtttgttccagcatttcaaagccatcgcggaacacactgacttgccgcaaattctgtataatgtgccgtcccgtaccggttgcgacatgttgccggaaaccgtgggtcgtctggcggaaataaaaaatattatcgctatcaaagaggcgacagggaacttaacccgcgttcaccagatcaaagagctggtttcagacgattttattctgcttagcggcgatgacgcgtccgcgctggactttatgcaactgggtggtcatggcgtgatttccgttactgctaacgtagcggcgcgcgatatggctgacatgtgcaaactggcggcggaagggcaatttgccgaggcgcgcgctatcaaccagcgtctgatgccgttacacaacaaactatttgtcgaacccaatcctatcccggtgaaatgggcatgtaaggcattgggtcttgtggcgaccgacacgctgcgcctgccaatgacgcctatcaccgaccatggtcgtgacatcgtcaaagcagcgcttcagcatgctggcctgctgtaa

SEQ ID NO: 71372 - protein, 292 aa, Salmonella typhi
MFTGSIVALVTPMDEKGNVSRSCLKKLIDYHVANGTSAIVSVGTTGESATLSHDEHGDVVMMTLELADGRIPVIAGTGANATAEAISLTQRFNDSGIVGCLTVTPYYNRPTQEGLFQHFKAIAEHTDLPQILYNVPSRTGCDMLPETVGRLAEIKNIIAIKEATGNLTRVHQIKELVSDDFILLSGDDASALDFMQLGGHGVISVTANVAARDMADMCKLAAEGQFAEARAINQRLMPLHNKLFVEPNPIPVKWACKALGLVATDTLRLPMTPITDHGRDIVKAALQHAGLL

SEQ ID NO: 71373 - DNA, 879 bp, Salmonella typhimurium
  CDS (1)..(879): transl_table=11
atgttcacgggaagtattgtcgcgcttgttacgccgatggatgagaaaggtaacgtcagtaggtcttgcctgaaaaaactcattgattatcatgtcgccaacggtacctcggcgattgtttcggttggcactaccggcgagtctgccacgctaagccatgatgaacatggcgatgtcgtgatgatgacgctggaactggctgacggacgtattccggttatcgccggcacgggcgcaaacgcgaccgcggaagcgattagcctgacgcagcgttttaacgatagcggtattgtaggctgcctgacggtaacgccgtactacaatcgccccacgcaggaaggtttgttccagcatttcaaagccatcgcggaacacactgacttgccgcaaattctgtataatgtgccgtcccgtaccggttgcgatatgttgccggaaaccgtgggtcgtctggcggaaataaaaaatattatcgctatcaaagaggcgacagggaacttaacccgcgttcaccagatcaaagagctggtttcagacgattttattctgcttagcggcgatgacgcgtctgcgctggactttatgcaactgggtggtcatggcgtgatttccgttacggctaacgtagcggcgcgcgagatggctgacatgtgcaaactggcggcggaagggcaatttgccgaggcgcgcgctatcaaccagcgtctgatgccgttacacaacaaactatttgtcgaacccaatcctatcccggtgaaatgggcatgtaaggcattgggtcttgtggcgaccgacacgctgcgcctgccaatgacgcctatcacggaccatggtcgtgacatcgtcaaagcagcgcttcagcatgctggcctgctgtaa

SEQ ID NO: 71374 - protein, 292 aa, Salmonella typhimurium
MFTGSIVALVTPMDEKGNVSRSCLKKLIDYHVANGTSAIVSVGTTGESATLSHDEHGDVVMMTLELADGRIPVIAGTGANATAEAISLTQRFNDSGIVGCLTVTPYYNRPTQEGLFQHFKAIAEHTDLPQILYNVPSRTGCDMLPETVGRLAEIKNIIAIKEATGNLTRVHQIKELVSDDFILLSGDDASALDFMQLGGHGVISVTANVAAREMADMCKLAAEGQFAEARAINQRLMPLHNKLFVEPNPIPVKWACKALGLVATDTLRLPMTPITDHGRDIVKAALQHAGLL

SEQ ID NO: 71375 - DNA, 885 bp, Shewanella oneidensis
  CDS (1)..(885): transl_table=11
atgataaacggaagcatcgtagccttaatcacgccaatgaacagtgatggctcagtagattttgcaagtcttgaaaggttagtcgaattccatattgaccaaggcacagacgccattgttgccgtgggaaccaccggcgagtcagcgactctgccaatgaatgagcacgttaccgtggtggcgcaaaccgttaagtttgcggcaggccgtattcctgtgattggtggcaacggtgctaatgcgacagcagaagctatcgaactgaccaagtccttatctaaagtgggggttgcggccatgttaggcgtaacaccttactacaataaacccactccaaagggcttagttgcacactataaagctgtcgcggcaagcactgatattccacaaattctgtataacgttcctggacgcaccgccgttgatatgaagcccgaaactgtggctgaattagtgagcgtgagcaatattattggcgtaaaagaagcaacgggcgacgtatctcgcgttaaacgcctacgtgagctttgtggtaatgactttatgttgtatagcggtgatgacgcgacagcaagcgagtttttactcttgggtggtaatggggtgatttctgttgccaacaacatagtgccaaaagcctttaaagccatgtgcgacgctgcgcttgcgggcaatgccgaattagccgcaagcatcgacgaaccactacgtggtctgtatagcacactgttttgcgaagcaaacccgatccctgttaaatgggcggcccatcgtatggggctgattgaatgtggtcatattcgtttacctttgactgaactttctgagcaatgtcatggtctgttgttagaggcaatgactcgtgcccagatagaggttaaataa

SEQ ID NO: 71376 - protein, 294 aa, Shewanella oneidensis
MINGSIVALITPMNSDGSVDFASLERLVEFHIDQGTDAIVAVGTTGESATLPMNEHVTVVAQTVKFAAGRIPVIGGNGANATAEAIELTKSLSKVGVAAMLGVTPYYNKPTPKGLVAHYKAVAASTDIPQILYNVPGRTAVDMKPETVAELVSVSNIIGVKEATGDVSRVKRLRELCGNDFMLYSGDDATASEFLLLGGNGVISVANNIVPKAFKAMCDAALAGNAELAASIDEPLRGLYSTLFCEANPIPVKWAAHRMGLIECGHIRLPLTELSEQCHGLLLEAMTRAQIEVK

SEQ ID NO: 71377 - DNA, 999 bp, Glycine max
  CDS (1)..(999)
atgattacgaattcggcagccgtgaagcccaatttccatctcccaatgcgcagttttgagttaaaaaataggacttctccagaggacataaaggctctgagattgataactgccattaaaactccatacctacctgatggtcgttttgatcttgaagcatatgatgacttggtgaatatgcagattggacaaggggctgaaggtgttattgttggtgggacaactggtgaaggccaattaatgagctgggaagagcacataatacttattgctcatacagtcaactgttttggtgggaaaattaaggttattggaaatactggaagcaactccaccagggaagcaattcatgccactgagcagggttttgctgttggaatgcatgctgcccttcacataaacccttactatggcaaaacctccttggatggtatggttgctcactttcgaagtgtgctttccatgggacccacaataatctacaatgtgcctgcacggaccggacaagacattcctccgcatgtaattcaaaccttagctgaaagtgttaacctggctggtgtcaaggagtgtgtgggaaatgaccgaatcaaacagtatacagatgatggaattgttgtgtggagtgggaatgatgatcaatgtcatgatgctagatggggttatggggctaccggagtggtatctgttgcgagcaacctggttcccggtttaatgcgagaactcatgtttggcggtgtaaaccctactctaaattctaaactcttgcctctgattgactggcttttccacatgccaaaccccattggtttgaacactgctcttgctcaacttggggtcatcagacccgtttttaggctaccttttgtacctctccctgtggacaaaaggatagagtttgccaatttggtgaaggaaattggtcgagagcattttgttggaaataaagttgttgaggttcttgatgatgatgacttcttcttggttagtcgttattaa

SEQ ID NO: 71378 - protein, 332 aa, Glycine max
MITNSAAVKPNFHLPMRSFELKNRTSPEDIKALRLITAIKTPYLPDGRFDLEAYDDLVNMQIGQGAEGVIVGGTTGEGQLMSWEEHIILIAHTVNCFGGKIKVIGNTGSNSTREAIHATEQGFAVGMHAALHINPYYGKTSLDGMVAHFRSVLSMGPTIIYNVPARTGQDIPPHVIQTLAESVNLAGVKECVGNDRIKQYTDDGIVVWSGNDDQCHDARWGYGATGVVSVASNLVPGLMRELMFGGVNPTLNSKLLPLIDWLFHMPNPIGLNTALAQLGVIRPVFRLPFVPLPVDKRIEFANLVKEIGREHFVGNKVVEVLDDDDFFLVSRY

SEQ ID NO: 71379 - DNA, 1080 bp, Nicotiana tabacum
  CDS (1)..(1080)
atgtcatcatcaattataggtcgctgccatttcgtagcagatagcattgaagctgccggaacgaagaggaggactacaagatggaggtccccgagagcagcagtaattccaagttttcatctcccaatgcgcagtaatgaagttaaaaataggacgttcgccgatgacataaaagcacttcgattgatcactgcaatcaaaaccccatatctaccggatggcagattcgatcttgaggcttatgacacgttagtaaatttgcaaatcgaaaatggcgctgagggtgtgatagttggtggcactacaggtgaaggtcaattgatgagctgggatgaacacatcatgctcattggtcacacagtcaattgttttggagggtccatcaaagtcatcgggaacactggaagcaactccacaagggaagcaatccatgcaactgaacagggatttgctgtaggtatgcatgcagctcttcacattaatccctactatggcaagacctccttagagggtttgatttctcactttgaaagcgtgctccctatgggccctactatcatttataatgtgccatcacgaactggtcaagacatccctccacgtgtaattcagacaatggcaaagagccctaaccttgctggtgtcaaagagtgtgttggaaatgatagggtggagcagtatacaagtgatggggttgtcgtttggagtggcaatgatgatgaatgccatgtttcaaggtgggattatggtgctacaggagttatttctgttaccagcaacttggttcccggtctgatgagagaactgatgtttggaggaaagaaccctgctttgaactcaaagctgatgcctttgatggaatggctgtttcatgaaccaaaccccattgctctaaatacagctttagctcaacttggggttgtgaggccagtctttcgccttccatacgttccacttacaaaggcaaagagagaggagtttgtgaaaattgttaaggaaattggacgagagaactttataggggagagagatgtccaaattttggatgacaatgatttcattttggtgggtcggtattag

SEQ ID NO: 71380 - protein, 359 aa, Nicotiana tabacum
MSSSIIGRCHFVADSIEAAGTKRRTTRWRSPRAAVIPSFHLPMRSNEVKNRTFADDIKALRLITAIKTPYLPDGRFDLEAYDTLVNLQIENGAEGVIVGGTTGEGQLMSWDEHIMLIGHTVNCFGGSIKVIGNTGSNSTREAIHATEQGFAVGMHAALHINPYYGKTSLEGLISHFESVLPMGPTIIYNVPSRTGQDIPPRVIQTMAKSPNLAGVKECVGNDRVEQYTSDGVVVWSGNDDECHVSRWDYGATGVISVTSNLVPGLMRELMFGGKNPALNSKLMPLMEWLFHEPNPIALNTALAQLGVVRPVFRLPYVPLTKAKREEFVKIVKEIGRENFIGERDVQILDDNDFILVGRY

SEQ ID NO: 71381 - DNA, 879 bp, Vibrio cholerae
  CDS (1)..(879): transl_table=11
atgttttcaggaagtatcgttgcgttaattaccccatttactccggacggtgaagtcgattatatcagcctgaaaaagctggtcgatttccatgttgatgcaggaaccgatgcgattgtttccgttggcaccaccggtgaatccgcgacgctaacggtcgaagaacacgtgaaagtagtagcaaaaacggtggagttcgctgaaggtcgtctgcctattattgctggaacaggcgcaaatgcgacccatgaagcggtcacttttagccgcctgctgaacaacacaggtattgcagggtatttgagtgtcacgccttattacaataagccgacccaagaaggtctgttcctgcactacaacgcgattgcgcaagaaaccgatattcccgtgattttgtacaacgtgccgggacgtaccgctgtggatatgcgtccagaaaccgttgcccgtttatctgaaatcaagaacattgtcgcactgaaagatgcaaccggtgatttaagccgtgttgcgaagcaccgtgagatgtgtaaagaaggttttgtcctactcagcggtgatgatgccacaggccttgagttcgtcaaactcggggggcaaggtgtgatttcagtgaccaacaatatcgctgctgccgacatggcgaagatgatgcatttggcgctggatggtaagtttgatgaagcggcgatcatcaaccaacgtttgatgactctgcataaaaatctgtttatcgaatcgagcccaattccagtgaaatgggcagcccataagatgggattgattgcaaatggtgatctgcgtctacctttgacgcaactttcggaaccagcacgcccaatcgttgcccaagccctgtctgaagcctgtatttattaa

SEQ ID NO: 71382 - protein, 292 aa, Vibrio cholerae
MFSGSIVALITPFTPDGEVDYISLKKLVDFHVDAGTDAIVSVGTTGESATLTVEEHVKVVAKTVEFAEGRLPIIAGTGANATHEAVTFSRLLNNTGIAGYLSVTPYYNKPTQEGLFLHYNAIAQETDIPVILYNVPGRTAVDMRPETVARLSEIKNIVALKDATGDLSRVAKHREMCKEGFVLLSGDDATGLEFVKLGGQGVISVTNNIAAADMAKMMHLALDGKFDEAAIINQRLMTLHKNLFIESSPIPVKWAAHKMGLIANGDLRLPLTQLSEPARPIVAQALSEACIY

SEQ ID NO: 71383 - DNA, 879 bp, Vibrio vulnificus
  CDS (1)..(879): transl_table=11
atgttatcaggaagtatcgttgcgttacttacgccgttcaaagccgatggagaagtagactttgatggtctgcaaaaattagttgaatatcacatcgctgctggtacgaacggtatcgtggctgtgggtaccacaggagagtcttcaacactgacggttgaagagcacgtaaaagtagtcaacaaaacggttgaatttgttaatggtcgaatcccagtgatcgctggcacgggagccaatgctacccatgagtcggtgaccttcagccgtctgctgaatgattcaggtatcgatgcgtgcctgagtgttactccatactacaataagccaacgcaagaaggcctattccagcattacaaagcgattgctgaagtgagtaacgttccccaaattctatacaatgtgcctgggcgtactgcggttgaccttttgccagagcccgttgctcgtttggctgagctcgaaaacatcgttgcactaaaagatgcgactggtgatttaaatcgagttgcaattcatcgtgaactttgtggcgaagattttatcttactaagtggtgatgatgcgacaggcctagatttcgtcaaacttggcggtcaaggcgtgatttcggttaccaacaatattgctgcaaaagatatggcggatatgttccgtttggcccttgaaggccgttttgaagaagcggaagtgatcaatcaacgtttgatgccactgcataaaaacttgtttatcgaatctagcccaattccagtgaaatgggcagcgacacaacttggtttgattgaatgcgggcatttacgtctaccgttgactgagttatcggaaaaatgtcatccgatcgttgcacaagcaatgaccgacgcagggatttactaa

SEQ ID NO: 71384 - protein, 292 aa, Vibrio vulnificus
MLSGSIVALLTPFKADGEVDFDGLQKLVEYHIAAGTNGIVAVGTTGESSTLTVEEHVKVVNKTVEFVNGRIPVIAGTGANATHESVTFSRLLNDSGIDACLSVTPYYNKPTQEGLFQHYKAIAEVSNVPQILYNVPGRTAVDLLPEPVARLAELENIVALKDATGDLNRVAIHRELCGEDFILLSGDDATGLDFVKLGGQGVISVTNNIAAKDMADMFRLALEGRFEEAEVINQRLMPLHKNLFIESSPIPVKWAATQLGLIECGHLRLPLTELSEKCHPIVAQAMTDAGIY

SEQ ID NO: 71385 - DNA, 882 bp, Yersinia pestis
  CDS (1)..(882): transl_table=11
atgtttacaggcagcatagttgcgctaataacgccaatggacgacaacggtgatgtcgatcgtgcaagcctgaagagcctgattgattaccacgtggccagtgggactgcggcgattgtctctgtggggacgacgggtgagtcagcaacgttgaatcatgatgagcatgtcgatgtggtcatgcagacactcgaactggctgatggccggatcccggtgattgccggaacaggggccaattccacctccgaagccatttctctcactcaacggtttaatgataccggtgttgtgggctgcttaacagtgacgccatattataaccggccaatgcaggaagggttataccaacactttaaagcgatcgctgaaagtaccgatttgccacaaattctttataatgtgccttcgcgtacgggttgcgatatgttaccgccaaccattgctcgcttagcgaagattaaaaatattgttgctgttaaagaagccacagggaacttaagtcgggttagtcagatccaagtgctggttgatgatgaagatttcatcctgctcagtggtgatgatgcgagtggactggactttatgcaactgggtggtaaaggtgttatttctgtgacggcaaatatcgctgcccgtgaaatggttgaactgtgcgcattagcagcacagggaaatttcgccgaaggtcgccgtttgaatcagcgcttgatgccgttgcatcagcatttatttgtagaagcaaacccaattccggttaaatgggccgcgaagaggttgggattaatggcaaatgatactatgcgcctgccaatgaccccactgactgatccggccaaacggattgtggaagacgcgttgaaaagcgcaggtttgctgtaa

SEQ ID NO: 71386 - protein, 293 aa, Yersinia pestis
MFTGSIVALITPMDDNGDVDRASLKSLIDYHVASGTAAIVSVGTTGESATLNHDEHVDVVMQTLELADGRIPVIAGTGANSTSEAISLTQRFNDTGVVGCLTVTPYYNRPMQEGLYQHFKAIAESTDLPQILYNVPSRTGCDMLPPTIARLAKIKNIVAVKEATGNLSRVSQIQVLVDDEDFILLSGDDASGLDFMQLGGKGVISVTANIAAREMVELCALAAQGNFAEGRRLNQRLMPLHQHLFVEANPIPVKWAAKRLGLMANDTMRLPMTPLTDPAKRIVEDALKSAGLL

SEQ ID NO: 71387 - DNA, 1002 bp, Rhizobium meliloti
  CDS (1)..(1002): transl_table=11
atgtttgagggttcgattaccgcgcttgtcacgccttttgctgatgatcgcatcgatgaggttgcattgcacgacctcgtcgagtggcagatcgaagagggatccttcggtctcgttccatgcgggacaacaggggaaagcccgacgctcagcaaatccgagcatgagcaggtggtcgagatcacgatcaaaaccgcaaacgggcgtgtgcccgtcatcgcgggcgccggatcaaacagcacggcggaagcgatcgccttcgttcgccatgcgcagaacgccggcgccgatggagtactgatcgtttcaccctattacaacaagcccacccaggaggggatctaccagcatttcaaggcgatcgatgctgcgtctactattccgatcatcgtctacaatatccctggccgtagcgccattgaaattcacgttgaaacgttggcccgcatttttgaagattgcccgaatgtgaagggcgtcaaggatgcaaccggcaacctgttgcgcccgtccctcgagcgcatggcctgcggggaagacttcaatctcttgaccggtgaagacggcacggcgcttggctatatggcgcatggcggacatggctgcatctcggtgacggcgaatgtcgcaccggccctctgcgctgacttccagcaggcctgcctgaacggcgactttgccgccgccttgaaactgcaggaccgtctgatgccgctgcaccgggcgctttttcttgaaaccaacccggcgggggcgaaatacgcgctccagcgtcttggccgaatgcgtggggatttgcgcctaccactcgtcacgatcagtccttcctttcaagaagagatcgatgacgcgatgcgccacgcgggggatccttttatgatggacaacgcaagatttgctgaacgcatcgagatggatcttatcggtgcgaacaaccagcgaaggaaacaaggtggcacctgcatgggattggattctggagaagcaccatgcacctcgtag

SEQ ID NO: 71388 - protein, 333 aa, Rhizobium meliloti
MFEGSITALVTPFADDRIDEVALHDLVEWQIEEGSFGLVPCGTTGESPTLSKSEHEQVVEITIKTANGRVPVIAGAGSNSTAEAIAFVRHAQNAGADGVLIVSPYYNKPTQEGIYQHFKAIDAASTIPIIVYNIPGRSAIEIHVETLARIFEDCPNVKGVKDATGNLLRPSLERMACGEDFNLLTGEDGTALGYMAHGGHGCISVTANVAPALCADFQQACLNGDFAAALKLQDRLMPLHRALFLETNPAGAKYALQRLGRMRGDLRLPLVTISPSFQEEIDDAMRHAGDPFMMDNARFAERIEMDLIGANNQRRKQGGTCMGLDSGEAPCTS

SEQ ID NO: 71389 - DNA, 21 bp, Artificial sequence
  primer
atgttcacgggaagtattgtc

SEQ ID NO: 71390 - DNA, 24 bp, Artificial sequence
  primer
ttacagcaaaccggcatgcttaag

SEQ ID NO: 71391 - protein, 276 aa, Artificial sequence
  consensus sequence
  Variant (2)..(3): Xaa in position 2 to 3 is any amino acid
  Variant (6)..(8): Xaa in position 6 to 8 is any amino acid
  Variant (9)..(9): Xaa in position 9 is any or no amino acid
  Variant (11)..(11): Xaa in position 11 is any amino acid
  Variant (12)..(13): Xaa in position 12 to 13 is any or no amino acid
  Variant (15)..(20): Xaa in position 15 to 20 is any amino acid
  Variant (22)..(26): Xaa in position 22 to 26 is any amino acid
  Variant (27)..(28): Xaa in position 27 to 28 is any or no amino acid
  Variant (30)..(33): Xaa in position 30 to 33 is any amino acid
  Variant (35)..(36): Xaa in position 35 to 36 is any amino acid
  Variant (43)..(43): Xaa in position 43 is any amino acid
  Variant (45)..(48): Xaa in position 45 to 48 is any amino acid
  Variant (51)..(63): Xaa in position 51 to 63 is any amino acid
  Variant (64)..(66): Xaa in position 64 to 66 is any or no amino acid
  Variant (68)..(70): Xaa in position 68 to 70 is any amino acid
  Variant (74)..(74): Xaa in position 74 is any amino acid
  Variant (76)..(76): Xaa in position 76 is any amino acid
  Variant (78)..(78): Xaa in position 78 is any amino acid
  Variant (80)..(80): Xaa in position 80 is any amino acid
  Variant (83)..(92): Xaa in position 83 to 92 is any amino acid
  Variant (94)..(97): Xaa in position 94 to 97 is any amino acid
  Variant (99)..(99): Xaa in position 99 is any amino acid
  Variant (101)..(101): Xaa in position 101 is any amino acid
  Variant (108)..(108): Xaa in position 108 is any amino acid
  Variant (112)..(114): Xaa in position 112 to 114 is any amino acid
  Variant (116)..(119): Xaa in position 116 to 119 is any amino acid
  Variant (121)..(123): Xaa in position 121 to 123 is any amino acid
  Variant (124)..(125): Xaa in position 124 to 125 is any or no amino acid
  Variant (127)..(127): Xaa in position 127 is any amino acid
  Variant (134)..(134): Xaa in position 134 is any amino acid
  Variant (137)..(138): Xaa in position 137 to 138 is any amino acid
  Variant (140)..(143): Xaa in position 140 to 143 is any amino acid
  Variant (145)..(147): Xaa in position 145 to 147 is any amino acid
  Variant (149)..(152): Xaa in position 149 to 152 is any amino acid
  Variant (153)..(153): Xaa in position 153 is any or no amino acid
  Variant (156)..(158): Xaa in position 156 to 158 is any amino acid
  Variant (160)..(160): Xaa in position 160 is any amino acid
  Variant (162)..(162): Xaa in position 162 is any amino acid
  Variant (164)..(166): Xaa in position 164 to 166 is any amino acid
  Variant (168)..(180): Xaa in position 168 to 180 is any amino acid
  Variant (181)..(184): Xaa in position 181 to 184 is any or no amino acid
  Variant (188)..(196): Xaa in position 188 to 196 is any amino acid
  Variant (198)..(199): Xaa in position 198 to 199 is any amino acid
  Variant (201)..(201): Xaa in position 201 is any amino acid
  Variant (206)..(206): Xaa in position 206 is any amino acid
  Variant (208)..(212): Xaa in position 208 to 212 is any amino acid
  Variant (214)..(228): Xaa in position 214 to 228 is any amino acid
  Variant (229)..(234): Xaa in position 229 to 234 is any or no amino acid
  Variant (236)..(237): Xaa in position 236 to 237 is any amino acid
  Variant (239)..(241): Xaa in position 239 to 241 is any amino acid
  Variant (244)..(244): Xaa in position 244 is any amino acid
  Variant (246)..(246): Xaa in position 246 is any amino acid
  Variant (247)..(248): Xaa in position 247 to 248 is any or no amino acid
  Variant (252)..(253): Xaa in position 252 to 253 is any amino acid
  Variant (255)..(255): Xaa in position 255 is any amino acid
  Variant (257)..(260): Xaa in position 257 to 260 is any amino acid
  Variant (262)..(267): Xaa in position 262 to 267 is any amino acid
  Variant (268)..(268): Xaa in position 268 is any or no amino acid
  Variant (272)..(274): Xaa in position 272 to 274 is any amino acid
  Variant (275)..(275): Xaa in position 275 is any or no amino acid
AXXTPXXXXGXXXDXXXXXXLXXXXXXXGXXXXVXXGTTGESXTXXXXEHXXXXXXXXXXXXXXXXRXXXIAGXGXNXTXEAXXXXXXXXXXGXXXXLXVXPYYNKPXQEGXXXHXXXXAXXXXXPXILYNVPXRTXXDXXXXTXXXLXXXXXNIXXXKXAXGXXXRXXXXXXXXXXXXXXXXXGDDXXXXXXXXXGXXGXISVTXNXXXXXMXXXXXXXXXXXXXXXXXXXXXLXXLXXXLFXEXXXNPIXXKXAXXXXGXXXXXXXRLPXXXXL

SEQ ID NO: 71392 - protein, 23 aa, Artificial sequence
  protein pattern
  Variant (2)..(2): Xaa in position 2 is Ala, Ser, Thr or Val
  Variant (7)..(7): Xaa in position 7 is Lys or Arg
  Variant (9)..(11): Xaa in position 9 to 11 is any amino acid
  Variant (13)..(15): Xaa in position 13 to 15 is any amino acid
  Variant (17)..(18): Xaa in position 17 to 18 is any amino acid
  Variant (19)..(20): Xaa in position 19 to 20 is any or no amino acid
  Variant (22)..(22): Xaa in position 22 is any amino acid
  Variant (23)..(23): Xaa in position 23 is Ala, Cys, Asp, Asn, Ser, Thr or Val
VXPYYNXPXXXGXXXHXXXXAXX

SEQ ID NO: 71393 - protein, 23 aa, Artificial sequence
  protein pattern
  Variant (2)..(2): Xaa in position 2 is any amino acid
  Variant (4)..(4): Xaa in position 4 is Ile or Leu
  Variant (9)..(9): Xaa in position 9 is any amino acid
  Variant (12)..(12): Xaa in position 12 is Ala, Cys, Gly, Ser or Val
  Variant (13)..(13): Xaa in position 13 is any amino acid
  Variant (15)..(15): Xaa in position 15 is Ile, Leu or Met
  Variant (16)..(16): Xaa in position 16 is any amino acid
  Variant (17)..(17): Xaa in position 17 is Ala, Asn, Pro or Thr
  Variant (18)..(22): Xaa in position 18 to 22 is any amino acid
  Variant (23)..(23): Xaa in position 23 is Leu, Met or Val
PXIXYNVPXRTXXDXXXXXXXXX

SEQ ID NO: 71394 - protein, 25 aa, Artificial sequence
  protein pattern
  Variant (2)..(3): Xaa in position 2 to 3 is any amino acid
  Variant (5)..(7): Xaa in position 5 to 7 is any amino acid
  Variant (10)..(10): Xaa in position 10 is any amino acid
  Variant (11)..(11): Xaa in position 11 is Glu or Gln
  Variant (12)..(12): Xaa in position 12 is Ala, Gly, Pro or Ser
  Variant (13)..(13): Xaa in position 13 is Asn or Ser
  Variant (16)..(16): Xaa in position 16 is Ala, Gly or Pro
  Variant (17)..(17): Xaa in position 17 is Ala, Ile, Leu or Val
  Variant (18)..(23): Xaa in position 18 to 23 is any amino acid
  Variant (24)..(24): Xaa in position 24 is Ile, Leu or Met
LXXLXXXLFXXXXPIXXXXXXXXXG

SEQ ID NO: 71395 - protein, 13 aa, Artificial sequence
  protein pattern
  Variant (3)..(3): Xaa in position 3 is Ser or Thr
  Variant (7)..(7): Xaa in position 7 is Ala, Pro, Ser or Thr
  Variant (9)..(9): Xaa in position 9 is any amino acid
  Variant (10)..(10): Xaa in position 10 is Ala, Asp, Asn, Pro, Ser or Thr
  Variant (11)..(12): Xaa in position 11 to 12 is any amino acid
GTXGESXTXXXXE

SEQ ID NO: 71396 - protein, 13 aa, Artificial sequence
  protein pattern
  Variant (2)..(2): Xaa in position 2 is Ala, Ile, Leu or Val
  Variant (3)..(3): Xaa in position 3 is any amino acid
  Variant (4)..(4): Xaa in position 4 is Ile, Leu or Val
  Variant (5)..(5): Xaa in position 5 is Ile, Met or Val
  Variant (6)..(6): Xaa in position 6 is Ala or Gly
  Variant (8)..(8): Xaa in position 8 is Ala, Asn, Ser, Thr or Val
  Variant (10)..(10): Xaa in position 10 is Ala, Gly, Ser or Thr
  Variant (12)..(12): Xaa in position 12 is Ala, Asn or Ser
RXXXXXGXGXNXT

SEQ ID NO: 71397 - protein, 14 aa, Artificial sequence
  protein pattern
  Variant (2)..(2): Xaa in position 2 is Ala or Gly
  Variant (3)..(3): Xaa in position 3 is any amino acid
  Variant (5)..(5): Xaa in position 5 is Cys, Asn, Thr or Val
  Variant (10)..(10): Xaa in position 10 is Ala, Asn or Ser
  Variant (12)..(12): Xaa in position 12 is Ala, Ile, Leu or Val
  Variant (13)..(13): Xaa in position 13 is Ala, Ile or Val
  Variant (14)..(14): Xaa in position 14 is Ala or Pro
GXXGXISVTXNXXX

SEQ ID NO: 71398 - DNA, 1335 bp, Escherichia coli K12
  CDS (1)..(1335): transl_table=11
atgagccataaacctgcgcatttattattggtcgatgacgatccgggattgctgaaactgcttggcctgcgcctgaccagcgaaggctacagtgtggtcacggcggaaagtggcgctgaaggattacgggtactgaatcgcgaaaaagtagatttagtcatcagcgacctgcggatggatgaaatggacggtatgcagctgtttgctgaaatccagaaagtgcagccgggaatgccggtaattattcttaccgcgcatggttctattcccgatgccgttgctgcaacacagcagggcgtttttagtttcctcaccaagcctgtcgacaaagacgcgctatatcaggcaattgacgatgcgctggagcaatccgcgccagccaccgatgaacgctggcgcgaggcaattgtcacccgcagcccgctgatgctgcgtttgctggaacaggcgcggctggtggcgcaatcagacgtcagcgttttgattaacggtcagagcggcaccgggaaagagattttcgcccaggctatccacaacgccagcccgcgcaacagcaaaccatttattgctattaactgtggcgcattgcccgagcaattgctggagtcggagctgtttggtcatgcgcgtggcgcgtttactggcgctgtcagcaatcgcgaaggtttattccaggcggcggaaggcggaacgctatttctcgatgaaattggcgatatgcctgcgccgttacaggtcaaactgctgcgcgtgttgcaggagcgtaaagtgcgcccgctgggcagtaaccgcgatattgatatcaatgtgcggattatttctgccactcaccgtgatctgccaaaagcgatggcgcgcggggaattccgcgaagatctctattaccgcctcaacgttgtcagcctgaaaattccggcactggcggagcgcacagaagacattccgctactggcaaatcacctgttgcgccaggcggcagagcgacataaaccgtttgtccgcgcgttctctaccgatgcgatgaaacgcctgatgaccgcgagctggccgggtaatgtgcgccagttggtcaacgtgattgaacagtgcgtggcgctgacctcatctccggtgattagtgatgcgctggtggagcaggcgctggagggtgaaaatacggcgctgccaacctttgttgaggcacgtaatcagtttgaactcaactatttgcgtaagctgctgcaaatcaccaaaggcaacgtcacccacgcggcgagaatggcggggcgcaaccggacagaattttataaactgctttcccgacacgagctggatgcaaacgatttcaaggaatga

SEQ ID NO: 71399 - protein, 444 aa, Escherichia coli K12
MSHKPAHLLLVDDDPGLLKLLGLRLTSEGYSVVTAESGAEGLRVLNREKVDLVISDLRMDEMDGMQLFAEIQKVQPGMPVIILTAHGSIPDAVAATQQGVFSFLTKPVDKDALYQAIDDALEQSAPATDERWREAIVTRSPLMLRLLEQARLVAQSDVSVLINGQSGTGKEIFAQAIHNASPRNSKPFIAINCGALPEQLLESELFGHARGAFTGAVSNREGLFQAAEGGTLFLDEIGDMPAPLQVKLLRVLQERKVRPLGSNRDIDINVRIISATHRDLPKAMARGEFREDLYYRLNVVSLKIPALAERTEDIPLLANHLLRQAAERHKPFVRAFSTDAMKRLMTASWPGNVRQLVNVIEQCVALTSSPVISDALVEQALEGENTALPTFVEARNQFELNYLRKLLQITKGNVTHAARMAGRNRTEFYKLLSRHELDANDFKE

SEQ ID NO: 71400 - DNA, 1410 bp, Escherichia coli O157:H7 EDL933
  CDS (1)..(1410): transl_table=11
atgcaacgagggatagtctgggtagtcgatgacgatagttccatccgttgggtgcttgaacgtgcgctcgctggagcgggtttaacctgtacaacatttgagaacggcrcggaggtactggaggcgctggcgagcaaaacgccggatgtgctgctttcagatatccgtatgccgggaatggacgggctggcactgctcaagcagattaaacagcgccatccgatgcttccggtcatcattatgaccgcacattccgatctggatgctgccgtcagcgcctatcaacaaggggcgtttgattatctgcccaaaccgtttgatatcgacgaagccgtggcgctggttgagcgcgccatcagtcattaccaggaacagcagcagccgcgtaatgttcagcttaacggcccaacgaccgatatcatcggcgaagcgccagccatgcaggacgtgttccgtattatcggtcggctttcgcgttcttctattagcgtgctgattaacggcgaatccggcaccggtaaagaactggtcgctcatgccctgcatcgccacagtccgcgagccaaagcgccatttatcgctctgaatatggcggctatcccgaaggatttgatcgaatcagaactgtttggtcacgagaaaggcgcgtttaccggcgcgaataccattcgtcaggggcgttttgaacaggctgatggcggtacattatttctcgatgaaattggcgatatgccgctggatgtgcagacgcgtttgctgcgcgtgctggcagacggtcagttttaccgcgttggcggctatgcgccggtgaaagtggatgtgcggattatcgctgccactcaccagaatctcgaacagcgggtgcaggaaggtaagttccgtgaggatctgttccaccgcctgaacgttatccgcgttcatctgccgccgctgcgtgagcgtcgggaagatattccccgcctggcgcgccattttttacaggttgccgcgcgagaactgggcgtagaagcgaagttgctgcatccggaaaccgaagccgcgttgacgcgtctggcgtggccaggcaacgtgcgccagctggaaaacacctgccgctggctaacggtaatggctgccggacaggaagtgttgattcaggatttgcctggcgaactgtttgaatcaacggttgcggagagtacttcgcaaatgcaaccggacagttgggcgacgcttcttgcgcagtgggcagacagagcgctacgttccggtcatcaaaatctgctttccgaagcgcagccagagctggagcggacgttactgacgaccgcgttgcgacatacgcaggggcataaacaggaggcggcgcggctactcggctggggccgcaacaccctgacgcgtaagttaaaagagctggggatggagtga

SEQ ID NO: 71401 - protein, 469 aa, Escherichia coli O157:H7 EDL933
  misc_feature <37>..<37>: The Xaa at location 37 stands for Ala, or Thr.
MQRGIVWVVDDDSSIRWVLERALAGAGLTCTTFENGXEVLEALASKTPDVLLSDIRMPGMDGLALLKQIKQRHPMLPVIIMTAHSDLDAAVSAYQQGAFDYLPKPFDIDEAVALVERAISHYQEQQQPRNVQLNGPTTDIIGEAPAMQDVFRIIGRLSRSSISVLINGESGTGKELVAHALHRHSPRAKAPFIALNMAAIPKDLIESELFGHEKGAFTGANTIRQGRFEQADGGTLFLDEIGDMPLDVQTRLLRVLADGQFYRVGGYAPVKVDVRIIAATHQNLEQRVQEGKFREDLFHRLNVIRVHLPPLRERREDIPRLARHFLQVAARELGVEAKLLHPETEAALTRLAWPGNVRQLENTCRWLTVMAAGQEVLIQDLPGELFESTVAESTSQMQPDSWATLLAQWADRALRSGHQNLLSEAQPELERTLLTTALRHTQGHKQEAARLLGWGRNTLTRKLKELGME

SEQ ID NO: 71402 - DNA, 1371 bp, Agrobacterium tumefaciens str. C58
  CDS (1)..(1371): transl_table=11
gtggcgcacggaggcggctgcggaatgaccatgtcgcgggttctgttgatcgacgacgaggaggagctgcgcttttccaccgcccaggcactggagctttccggttttgccgtcaccatgctggcgagcgcggaacatgcgctcgaactgatcggctacagcttcgacggtgtcgtggtcagcgatatccgcatgcccggcatggatggcatgacgctgctgcagaaggtacgggagcttgacccggaaatacccgtcatcctgatgacgggccatggcgatgtgcagcttgccgtcaacgccatgcgcaacggtgcttatgacttcatcgaaaaacccttcaccccgcaatatctcgccggcatcatcaagagggcaaatgaccggcgcgcactggtgctggaaaaccgccgcctgaaggcggttgccggcaagcatgacgatctcgaaacacgcctgcccggcagaacccaggtcatggtcgatctgcgctaccgcatccgcgccatcggcgcgacagacgccgatacgctgatcgtgggtgatactggggccggcaaggaggtggtggcgcgggcgctgcacgatatcagcgccagagccaaccgacccttcgtcgcgatcaattgtgctgcccttccgcagacgctgatcgagagcgaattgttcggccatgaggccggtgcttttccgggcgcactgcgctcccgttatggcaagttcgaacatgcccggggcggcaccatcctgctggatgagattggctccatgcctttcgaattgcaggggcgcttcctgcgcgtcttgcaagagcgggtgattacccgtctcggctccaatgagacggtcgaactcgatgtccgcttcatcgccaccagcaaggtcgatctggagcaggaagttgcggccggccggttccgcgcagaccttctttatcgcctgaacgtggcgacgcttcttgtgccttcgctttcgcagcggagtgcggacataccgctgctcttcctgcatctggtacgggaagccgccgcccgttacgggcgggaggatatggacgtgccgcagcatctgctttccgccgtttcgctgcgggaatggccgggcaacgtgcgggaattgcgcaatgccgcggatcgtttcgtgctcggtttggaaagcgatgtgtccgaggtgtcgctggcgcttgatgatgacggcacctcgacgctggcgccgcgggttgccgcttatgaaaaaagcctgatcgcgcatgccattgcagtgcatggcggaaatttgaaatccgtctatgaaagcctcggtatttcacgcaaaacgctatatgaaaaaatgcagaaatacgggctgcatcggcatatgaccgaggtctga

SEQ ID NO: 71403 - protein, 456 aa, Agrobacterium tumefaciens str. C58
MAHGGGCGMTMSRVLLIDDEEELRFSTAQALELSGFAVTMLASAEHALELIGYSFDGVVVSDIRMPGMDGMTLLQKVRELDPEIPVILMTGHGDVQLAVNAMRNGAYDFIEKPFTPQYLAGIIKRANDRRALVLENRRLKAVAGKHDDLETRLPGRTQVMVDLRYRIRAIGATDADTLIVGDTGAGKEVVARALHDISARANRPFVAINCAALPQTLIESELFGHEAGAFPGALRSRYGKFEHARGGTILLDEIGSMPFELQGRFLRVLQERVITRLGSNETVELDVRFIATSKVDLEQEVAAGRFRADLLYRLNVATLLVPSLSQRSADIPLLFLHLVREAAARYGREDMDVPQHLLSAVSLREWPGNVRELRNAADRFVLGLESDVSEVSLALDDDGTSTLAPRVAAYEKSLIAHAIAVHGGNLKSVYESLGISRKTLYEKMQKYGLHRHMTEV

SEQ ID NO: 71404 - DNA, 1542 bp, Agrobacterium tumefaciens str. C58
  CDS (1)..(1542): transl_table=11
atgaccgcgcatgttctcgtgatagacgatgatcccgtccagcgccgcctgctcaaaaatgcggtggaacgttatgggcatctggccttgcttgccgaaaacggcagggcggggctggaattgctcaagcaatatagtggcgagatcaacgtcattgtcctcgatctgatgatgccggaaatggacgggcttgcctttctgaaagctgtaggcgaactcggcacggatgttccggtcatcgtacaaaccggacagggcggcatcgacaccgttgtgcaggccatgcgcgccggcgcttttgatttcgtcgtgaagccggtttcgccggaaaggatcggcgccgccatctccaatgcgctcaagctcgacaggaaagaggcaaaggcccgcacgggcaggcgcggacggagcaatgcagtgaattttaccgatatcgtttccgcaagccccgcaatgctgagggtcatcgaactggcgcagcgcgccgcccagtccagcattcccgtggtgctggaaggcgaatccggtgtcggcaaggaaatggtcgcccgcgccatccagtcaggcggcgaccgggcgaacaagccgttcataacagtcaattgcggtgccattccccataatctcgtggaaagcatcctctttggccacgagaagggcgccttcacgggtgcgacggaaaaacatgtcggcaaattcatggaggcggatggcggcacgctgttcctcgatgaaatcggtgatctgccgctcgacgtacaggtgaagctgctgcgcgccgtgcagcagggcgaaatcgaaaccgtcggctccgcgcgggtgcagaaggtcaatgtgcggctgatttcggccaccaacaagaaccttatcgaagaggtgaaggaaggccgcttccgcgaggacctctattatcgcctcaacgtcttcccgatcaccattccggcgctgcgccggcgcaaggaagatattccccatctggcgcgggttttcgccgaacgcttttcggcggagcagaaactgcccaatcccgtcggcctcgatgccagtgcgctggcgctgctgacggcctatgactggcccggcaatatccgccagttggaaaacgccgttttccgtgccgtggttctgtcgcagggttcggaactgtcggattccgattttccgcagatcgcgctgcagctgccggaattttcgaacggtgatgatggggacgatattatccgctcaccatccggatcgtcgttgaagcttgcggcctattcaccgccgccggctgccgaaagccatgctgttatcgaggagccgtcggatatctccaccacgatctatcgtggcggaaacctgatctccagcacggacgattcgggcaatatccggaaactggcagagatcgaggaggagctcatccgtttcgccctgcgtttttatcgcggccagatgagccaggtcgcgagaaagctcggcatcggccgctctacgctttatcgcaagctgaaagattatggcatcgatccggatgatccgcttcgagacgtcgcatga

SEQ ID NO: 71405 - protein, 513 aa, Agrobacterium tumefaciens str. C58
MTAHVLVIDDDPVQRRLLKNAVERYGHLALLAENGRAGLELLKQYSGEINVIVLDLMMPEMDGLAFLKAVGELGTDVPVIVQTGQGGIDTVVQAMRAGAFDFVVKPVSPERIGAAISNALKLDRKEAKARTGRRGRSNAVNFTDIVSASPAMLRVIELAQRAAQSSIPVVLEGESGVGKEMVARAIQSGGDRANKPFITVNCGAIPHNLVESILFGHEKGAFTGATEKHVGKFMEADGGTLFLDEIGDLPLDVQVKLLRAVQQGEIETVGSARVQKVNVRLISATNKNLIEEVKEGRFREDLYYRLNVFPITIPALRRRKEDIPHLARVFAERFSAEQKLPNPVGLDASALALLTAYDWPGNIRQLENAVFRAVVLSQGSELSDSDFPQIALQLPEFSNGDDGDDIIRSPSGSSLKLAAYSPPPAAESHAVIEEPSDISTTIYRGGNLISSTDDSGNIRKLAEIEEELIRFALRFYRGQMSQVARKLGIGRSTLYRKLKDYGIDPDDPLRDVA

SEQ ID NO: 71406 - DNA, 1365 bp, Agrobacterium tumefaciens str. C58
  CDS (1)..(1365): transl_table=11
atgatggcggatggaaccatattcctggtggatgacgattcccagttgcgcaaggcgatggtgcagacgctggaactcgacggattgccggtcacctccttttccagggcggagcaggcgcttgcggccctgaacgaggatttcgacggcatcatcatcaccgatgtgcgcatgccgggcatgacaggcctcgaattcttcgaccatgtccgcaagatcgatgccgatctgcctgtcatcctcattaccggccatggcgacgtgccgatggccgtcgatgcgcttcacaacggcgcttatgatttcatcgcgaaaccctttcccgccgaacgcatggtggaaagtgcgcgccgggcgctggaaaagcgccgtctcgtgctggaaaaccgtgcgcttcgccgggctgcgggacaggcggaggacgatctgccattgatcggccagacacccgccatggagcgcctgcgcaccacgctacgccacattgccgatacggatgtggatgtgctggtggcgggtgaaacgggcagtggcaaggaagttgtggcaacggcgttgcatcgctggagcaagaagcgttcaaagggcaatttcgtggcgctgaattgcggcgcgttgccggaaacggtgatcgaaagtgagctttttggccatgagccgggggcctttaccggtgcacagaaaaagcgcgttggccgtatcgaacattccagcggtggtacgctatttctggacgaaatcgaaagtatgccgctcgcggttcaggtgaagatgctgcgtgtgctggaaatgcgcgaagtctcgccgctcggttcaaacgaggagaggccggtcgatatccgcgtggtggcggcggcgaaggtggatctcggcgatccggccgagcgcggcacgttccgcgaagatctctattaccggctgaacgtggtgaccttgtccattccgccgctgcgcgaacgcaaggcggatattccgctcctgttttcccatttcgtcaccaaggctgccaaccgtttcaacatgccggtgccgcagatcagcgccggcacgtcccggcggctccaggaccacgactggccgggcaatgtccgagaactcgggcattttgccgaaagggtggtgctggggctggaggcagaaccagcggctgcgcccacctcgcaatccgccattccggcttcagggactctgccggagcgcatggatgagattgaggcgcatatcatccgcgaaacactggagcgctcgaacggagacgtggcggaaaccatcgcaacgctcggcattgcccgcaagaccttttacgacaagctgcagcgtcatggtatcaaccgggcggattatgtgaagaacggcacggcgtga

SEQ ID NO: 71407 - protein, 454 aa, Agrobacterium tumefaciens str. C58
MMADGTIFLVDDDSQLRKAMVQTLELDGLPVTSFSRAEQALAALNEDFDGIIITDVRMPGMTGLEFFDHVRKIDADLPVILITGHGDVPMAVDALHNGAYDFIAKPFPAERMVESARRALEKRRLVLENRALRRAAGQAEDDLPLIGQTPAMERLRTTLRHIADTDVDVLVAGETGSGKEVVATALHRWSKKRSKGNFVALNCGALPETVIESELFGHEPGAFTGAQKKRVGRIEHSSGGTLFLDEIESMPLAVQVKMLRVLEMREVSPLGSNEERPVDIRVVAAAKVDLGDPAERGTFREDLYYRLNVVTLSIPPLRERKADIPLLFSHFVTKAANRFNMPVPQISAGTSRRLQDHDWPGNVRELGHFAERVVLGLEAEPAAAPTSQSAIPASGTLPERMDEIEAHIIRETLERSNGDVAETIATLGIARKTFYDKLQRHGINRADYVKNGTA

SEQ ID NO: 71408 - DNA, 1338 bp, Yersinia pestis CO92
  CDS (1)..(1338): transl_table=11
atgacaccacgcaaaccggccaatctactgctggttgacgacgatcccagcttattgaaattgctggggatgcgtttaaccagtgaagggtttaatgtcacgacagctgaaagcggtcacgaagcattgcgtttgttaatgcgtgagaaaattgacattgttatcagtgatctgcgaatggatgagatggacggcatggcgctgttcgctgaaattcaaaaatatcaaccggggatgcctgtgattatcctcacagcgcacggttcgatccctgatgccgttgccgcgacccagcaaggggtattcagttttctgaccaagcctgttgatcgcgatgcgctatataaggctattgatgcggcattagaactttcgattccagcgggtgatgatacttggcgtgaagagatagtgactcgcagcccggtcatgctacgtctgttagaacaagcgaaaatggtcgcacaatctgacgtcagtgtgctgattaacgggcaaagcggcaccggtaaagaggtattggcacaggctatccatgccgccagcccacgggccaaaaaagcctttattgccatcaactgtggtgccttaccagagcagttgctggagtctgaattattcggccatgctaagggtgcgtttaccggtgcagtcagcagccgtgaagggttgtttcaggccgctgaagggggcacattgttcctggatgagatcggcgatatgccgctctcattacaagtaaaattactgcgggtattgcaagagcgcaaagttcgtccattgggcagcaatcgtgatttaagtattaatgtccgggtgatttcagcgactcaccgtgacttgcccaaagcgatggcaaagaatgaattccgtgaagatctctactaccgtttaaatgtggttaacctaaaaatcccggcgctacacgagcgggcggaagatattccattgctggcaaaccatctattacgggagtcggctaagcggcataagccgtttgttcgcagtttctcaaacgatgcgatgaagcggttgatgacagccagttggcccggtaacgtgcgccaactggtcaacgtgattgagcaatgcgtggcgttgacctcggcaccggttatcagcgaagcgctggttgagcaggcgctggagggtgaaaataccgtattaccgacgtttgtggaggcccgtaatcaattcgaactaaactatttgcgtaagctattacaaattgccaaaggtaacgttacccaagccgctcgtatggcggggcgtaaccgtactgagttctataaattgttgtctcgccacgagttggatgccaacgattttaaagagtaa

SEQ ID NO: 71409 - protein, 445 aa, Yersinia pestis CO92
MTPRKPANLLLVDDDPSLLKLLGMRLTSEGFNVTTAESGHEALRLLMREKIDIVISDLRMDEMDGMALFAEIQKYQPGMPVIILTAHGSIPDAVAATQQGVFSFLTKPVDRDALYKAIDAALELSIPAGDDTWREEIVTRSPVMLRLLEQAKMVAQSDVSVLINGQSGTGKEVLAQAIHAASPRAKKAFIAINCGALPEQLLESELFGHAKGAFTGAVSSREGLFQAAEGGTLFLDEIGDMPLSLQVKLLRVLQERKVRPLGSNRDLSINVRVISATHRDLPKAMAKNEFREDLYYRLNVVNLKIPALHERAEDIPLLANHLLRESAKRHKPFVRSFSNDAMKRLMTASWPGNVRQLVNVIEQCVALTSAPVISEALVEQALEGENTVLPTFVEARNQFELNYLRKLLQIAKGNVTQAARMAGRNRTEFYKLLSRHELDANDFKE

SEQ ID NO: 71410 - DNA, 1338 bp, Salmonella enterica subsp. enterica serovar Typhi str. CT18
  CDS (1)..(1338): transl_table=11
atgataagccgtaaaccggcgcacctgctgctggtcgatgacgatcccggattactgaaattgctcggtatgcgcctgaccagtgaaggatacagcgtcgtgaccgcagagagcggccaggaaggactacgggtactgcatcgggaaaaagtggatctggtaataagcgacctgcgcatggacgaaatggatggtatgcaactgttcacagaaattcagaaagtacagccgggaatgccggttattattctgacggcgcatggttctattccggatgcggtggccgctacccagaagggcgtattcagctttttgacgaagccgatcgacagagacgcgttatataaagcgatagatgaagcgctggagcagtccgctcccgcgacggacgatagctggcgcaacgctatcgttacccgtagcccgctgatgctgcgactgcttgaacaggcgcgcatggtcgcgcagtcggatgtcagcgtattgattaacggacaaagcggcaccgggaaagagattttcgcacaggcgattcataatgccagcccgcgcaataacaagccgtttgtcgccatcaactgcggcgcgttaccggaacagttgctggagtccgaattattcggccatgcgcgcggcgcctttaccggcgcagtgagcaatcgtgaagggttgttccaggcggcggaaggcggcacgctgtttctggatgaaattggcgatatgcccgcgccgttacaggtgaagctgctgcgggtgttacaggagcgcaaagtcaggccgctgggcagcaatcgcgatattgatatcgacgtgcgaattatttccgcgacgcaccgcgatctgccgaaggcgatggcgcggggcgaatttcgtgaagatttgtactaccggctgaatgtcgtgagcctgaaaattccggcgctggcggagcgtaccgaggatattccgctgctggctaatcatctgctcagacagtcggcacagcggcataaaccgtttgttcgcgccttttctactgatgcaatgaaacggctgatgacggcaagctggccgggcaacgtgcgccaactggtcaacgtcattgaacaatgtgtggcgttaacctcttcgccggtgatcagcgatgcattggtcgagcaggcgctggaaggcgaaaacaccgcgctgccaacttttgccgaagcgcgaaaccaatttgaactgaactatctgcgcaagttactgcaaattaccaaaggtaacgtgacgcacgcggcaaggatggcggggcgcaaccgcacggaattctataagctactctcccgtcacgaactggatgcgaatgatttcaaagagtag

SEQ ID NO: 71411 - protein, 445 aa, Salmonella enterica subsp. enterica serovar Typhi str. CT18
MISRKPAHLLLVDDDPGLLKLLGMRLTSEGYSVVTAESGQEGLRVLHREKVDLVISDLRMDEMDGMQLFTEIQKVQPGMPVIILTAHGSIPDAVAATQKGVFSFLTKPIDRDALYKAIDEALEQSAPATDDSWRNAIVTRSPLMLRLLEQARMVAQSDVSVLINGQSGTGKEIFAQAIHNASPRNNKPFVAINCGALPEQLLESELFGHARGAFTGAVSNREGLFQAAEGGTLFLDEIGDMPAPLQVKLLRVLQERKVRPLGSNRDIDIDVRIISATHRDLPKAMARGEFREDLYYRLNVVSLKIPALAERTEDIPLLANHLLRQSAQRHKPFVRAFSTDAMKRLMTASWPGNVRQLVNVIEQCVALTSSPVISDALVEQALEGENTALPTFAEARNQFELNYLRKLLQITKGNVTHAARMAGRNRTEFYKLLSRHELDANDFKE

SEQ ID NO: 71412 - DNA, 1338 bp, Salmonella typhimurium LT2
  CDS (1)..(1338): transl_table=11
atgataagccgtaaaccggcgcacctgctgctggtcgatgacgatcccggattactgaaattgctcggtatgcgcctgaccagtgaaggatacagcgtcgtgaccgcagagagcggccaggaaggactacgggtactacatcgggaaaaagtggatctggtaataagcgacctgcgcatggacgaaatggatggtatgcaactgttcacagaaattcagaaagtacagccgggaatgccggttatcattctgacggcgcatggttctattccggatgcggtggccgctacccagaaaggcgtattcagctttttgacgaagccgatcgacagagacgcgttatataaagcgatagatgaagcgctggagcagtccgctcccgcgacggacgatagctggcgcaacgctatcgttacccgtagcccgctgatgctgcgactgcttgaacaggcgcgcatggtcgcgcagtcggatgtcagcgtattgattaacggacaaagcggcaccgggaaagagattttcgcacaggcgattcataatgccagcccgcgcagtaacaagccgtttgtcgccattaactgcggcgcgttaccggaacagttgctggagtccgaattattcggccatgcgcgcggcgcctttaccggcgcagtgagcaatcgtgaagggttgttccaggcggcggaaggcggcacgctgtttctggatgaaattggcgatatgcccgcgccgttacaggtgaagctgctgcgggtgttacaggagcgcaaagtcaggccgctgggcagcaatcgcgatattgatatcgacgtgcgaattatttccgcgacgcaccgcgatctgccgaaggcgatggcgcggggcgaatttcgtgaagatttgtactaccggctgaatgtcgtgagcctgaaaattccggcgctggcggagcgtaccgaggatattccgctgctggctaatcatctgctcagacagtcggcacagcggcataaaccgtttgttcgcgccttttctactgatgcaatgaaacggctgatgacggcaagctggccgggcaacgtgcgccaactggtcaacgtcattgaacaatgcgtggcgttaacttcttcgccggtgatcagcgatgcgttggtcgagcaggcgctggaaggcgaaaacaccgcgctgccaacttttgccgaagcgcgaaaccaatttgaactgaactatctgcgcaagttactgcaaattaccaaaggtaacgtgacgcacgcggcaaggatggcggggcgcaaccgcacggaattctataagctactctcccgtcacgaactggatgcgaatgatttcaaagagtag

SEQ ID NO: 71413 - protein, 445 aa, Salmonella typhimurium LT2
MISRKPAHLLLVDDDPGLLKLLGMRLTSEGYSVVTAESGQEGLRVLHREKVDLVISDLRMDEMDGMQLFTEIQKVQPGMPVIILTAHGSIPDAVAATQKGVFSFLTKPIDRDALYKAIDEALEQSAPATDDSWRNAIVTRSPLMLRLLEQARMVAQSDVSVLINGQSGTGKEIFAQAIHNASPRSNKPFVAINCGALPEQLLESELFGHARGAFTGAVSNREGLFQAAEGGTLFLDEIGDMPAPLQVKLLRVLQERKVRPLGSNRDIDIDVRIISATHRDLPKAMARGEFREDLYYRLNVVSLKIPALAERTEDIPLLANHLLRQSAQRHKPFVRAFSTDAMKRLMTASWPGNVRQLVNVIEQCVALTSSPVISDALVEQALEGENTALPTFAEARNQFELNYLRKLLQITKGNVTHAARMAGRNRTEFYKLLSRHELDANDFKE

SEQ ID NO: 71414 - DNA, 1347 bp, Agrobacterium tumefaciens str. C58
  CDS (1)..(1347): transl_table=11
atgaccatgtcgcgggttctgttgatcgacgacgaggaggagctgcgcttttccaccgcccaggcactggagctttccggttttgccgtcaccatgctggcgagcgcggaacatgcgctcgaactgatcggctacagcttcgacggtgtcgtggtcagcgatatccgcatgcccggcatggatggcatgacgctgctgcagaaggtacgggagcttgacccggaaatacccgtcatcctgatgacgggccatggcgatgtgcagcttgccgtcaacgccatgcgcaacggtgcttatgacttcatcgaaaaacccttcaccccgcaatatctcgccggcatcatcaagagggcaaatgaccggcgcgcactggtgctggaaaaccgccgcctgaaggcggttgccggcaagcatgacgatctcgaaacacgcctgcccggcagaacccaggtcatggtcgatctgcgctaccgcatccgcgccatcggcgcgacagacgccgatacgctgatcgtgggtgatactggggccggcaaggaggtggtggcgcgggcgctgcacgatatcagcgccagagccaaccgacccttcgtcgcgatcaattgtgctgcccttccgcagacgctgatcgagagcgaattgttcggccatgaggccggtgcttttccgggcgcactgcgctcccgttatggcaagttcgaacatgcccggggcggcaccatcctgctggatgagattggctccatgcctttcgaattgcaggggcgcttcctgcgcgtcttgcaagagcgggtgattacccgtctcggctccaatgagacggtcgaactcgatgtccgcttcatcgccaccagcaaggtcgatctggagcaggaagttgcggccggccggttccgcgcagaccttctttatcgcctgaacgtggcgacgcttcttgtgccttcgctttcgcagcggagtgcggacataccgctgctcttcctgcatctggtacgggaagccgccgcccgttacgggcgggaggatatggacgtgccgcagcatctgctttccgccgtttcgctgcgggaatggccgggcaacgtgcgggaattgcgcaatgccgcggatcgtttcgtgctcggtttggaaagcgatgtgtccgaggtgtcgctggcgcttgatgatgacggcacctcgacgctggcgccgcgggttgccgcttatgaaaaaagcctgatcgcgcatgccattgcagtgcatggcggaaatttgaaatccgtctatgaaagcctcggtatttcacgcaaaacgctatatgaaaaaatgcagaaatacgggctgcatcggcatatgaccgaggtctga

SEQ ID NO: 71415 - protein, 448 aa, Agrobacterium tumefaciens str. C58
MTMSRVLLIDDEEELRFSTAQALELSGFAVTMLASAEHALELIGYSFDGVVVSDIRMPGMDGMTLLQKVRELDPEIPVILMTGHGDVQLAVNAMRNGAYDFIEKPFTPQYLAGIIKRANDRRALVLENRRLKAVAGKHDDLETRLPGRTQVMVDLRYRIRAIGATDADTLIVGDTGAGKEVVARALHDISARANRPFVAINCAALPQTLIESELFGHEAGAFPGALRSRYGKFEHARGGTILLDEIGSMPFELQGRFLRVLQERVITRLGSNETVELDVRFIATSKVDLEQEVAAGRFRADLLYRLNVATLLVPSLSQRSADIPLLFLHLVREAAARYGREDMDVPQHLLSAVSLREWPGNVRELRNAADRFVLGLESDVSEVSLALDDDGTSTLAPRVAAYEKSLIAHAIAVHGGNLKSVYESLGISRKTLYEKMQKYGLHRHMTEV

SEQ ID NO: 71416 - DNA, 1368 bp, Yersinia pestis KIM
  CDS (1)..(1368): transl_table=11
atgtaccacctgcgtctaataaggaatctcatgacaccacgcaaaccggccaatctactgctggttgacgacgatcccagcttattgaaattgctggggatgcgtttaaccagtgaagggtttaatgtcacgacagctgaaagcggtcacgaagcattgcgtttgttaatgcgtgagaaaattgacattgttatcagtgatctgcgaatggatgagatggacggcatggcgctgttcgctgaaattcaaaaatatcaaccggggatgcctgtgattatcctcacagcgcacggttcgatccctgatgccgttgccgcgacccagcaaggggtattcagttttctgaccaagcctgttgatcgcgatgcgctatataaggctattgatgcggcattagaactttcgattccagcgggtgatgatacttggcgtgaagagatagtgactcgcagcccggtcatgctacgtctgttagaacaagcgaaaatggtcgcacaatctgacgtcagtgtgctgattaacgggcaaagcggcaccggtaaagaggtattggcacaggctatccatgccgccagcccacgggccaaaaaagcctttattgccatcaactgtggtgccttaccagagcagttgctggagtctgaattattcggccatgctaagggtgcgtttaccggtgcagtcagcagccgtgaagggttgtttcaggccgctgaagggggcacattgttcctggatgagatcggcgatatgccgctctcattacaagtaaaattactgcgggtattgcaagagcgcaaagttcgtccattgggcagcaatcgtgatttaagtattaatgtccgggtgatttcagcgactcaccgtgacttgcccaaagcgatggcaaagaatgaattccgtgaagatctctactaccgtttaaatgtggttaacctaaaaatcccggcgctacacgagcgggcggaagatattccattgctggcaaaccatctattacgggagtcggctaagcggcataagccgtttgttcgcagtttctcaaacgatgcgatgaagcggttgatgacagccagttggcccggtaacgtgcgccaactggtcaacgtgattgagcaatgcgtggcgttgacctcggcaccggttatcagcgaagcgctggttgagcaggcgctggagggtgaaaataccgtattaccgacgtttgtggaggcccgtaatcaattcgaactaaactatttgcgtaagctattacaaattgccaaaggtaacgttacccaagccgctcgtatggcggggcgtaaccgtactgagttctataaattgttgtctcgccacgagttggatgccaacgattttaaagagtaa

SEQ ID NO: 71417 - protein, 455 aa, Yersinia pestis KIM
MYHLRLIRNLMTPRKPANLLLVDDDPSLLKLLGMRLTSEGFNVTTAESGHEALRLLMREKIDIVISDLRMDEMDGMALFAEIQKYQPGMPVIILTAHGSIPDAVAATQQGVFSFLTKPVDRDALYKAIDAALELSIPAGDDTWREEIVTRSPVMLRLLEQAKMVAQSDVSVLINGQSGTGKEVLAQAIHAASPRAKKAFIAINCGALPEQLLESELFGHAKGAFTGAVSSREGLFQAAEGGTLFLDEIGDMPLSLQVKLLRVLQERKVRPLGSNRDLSINVRVISATHRDLPKAMAKNEFREDLYYRLNVVNLKIPALHERAEDIPLLANHLLRESAKRHKPFVRSFSNDAMKRLMTASWPGNVRQLVNVIEQCVALTSAPVISEALVEQALEGENTVLPTFVEARNQFELNYLRKLLQIAKGNVTQAARMAGRNRTEFYKLLSRHELDANDFKE

SEQ ID NO: 71418 - DNA, 1407 bp, Pseudomonas putida KT2440
  CDS (1)..(1407): transl_table=11
atgaccaccgagacactgatcgacagccgagcccaggtcatcctggtggacgatgacccccacctgcgccaagccttgagccagaccctggacctggccgggctcaaggtagtcgcgctggccgaagcccaaggcctggccgagcgtatcgaggccgactggcccggcgtggtggtcagcgacattcgcatgccgggcatcgatggcctgcagttgctggaacaactgcacggccgcgacagcgaactgccggtgctgctgattaccggccatggcgatgtgccgctggcggtgcaggcgatgcgcgccggggcttatgacttcctggaaaaaccctttgccacagacgccctgctcgacagcgtgcgccgcgccctggctttgcgccggctggtgctggacaaccgtagcctgcgtctggcactgagcgaccgccagcaactggcaacccgcctggtcggccattcaccggccatgctgcgcctgcgcgagcagatcggcgctttggccggcacccgcgccgacgtgttgattctgggcgaaaccggcgccggcaaagaggtggtggcccgcgcgctgcacgacctgtccagccgcagcgaagggccgttcgtggcgatcaacgccggcgcgctggccgaatcggtggtcgaaagcgaactgttcggccacgagcccggtgcgttcaccggcgcgcagaaacgccgtatcggcaagttcgaatttgccaacggcggcacgctgttcctcgacgaaatcgagagcatgagcctggatgtacaggtgaagttgctgcgcatgctgcaggagcgagtggtcgaacgcctgggcggcaaccagttgatcccgctggacatccgcatcatagccgcgaccaaggaagacctgcgtcagtctgccgaccaagggcgtttccgcgcagacctgtattaccgcctgaacgtggcgccgctgcgtattccgccactgcgtgaacgcggcgacgacatattggtgttgttccagcatttcgccgatgctgccagccaacgtcatggcctgtcgccgcatgcgctgcaacccgcgcaacgcgccctgctgctgcgtcatgactggccaggcaacgtccgcgagctacagaacgccgccgagcgtttcgcccttggcctggagctggcactggatggccaggcaccctcggcagcagccccggcagcgcccatgctcagcggcaacctcagcgaacaggtcgagcaattcgaacgttcgctgatcgccgccgaactggcccagccacacggctccatgcggagcctggccgaagcactgggtatcccccgcaaaaccttgcacgacaagctgcgcaagcatggcttgaacttcgacggcggcagcggcgggcatgacgatcaagaggacaaccgttaa

SEQ ID NO: 71419 - protein, 468 aa, Pseudomonas putida KT2440
MTTETLIDSRAQVILVDDDPHLRQALSQTLDLAGLKVVALAEAQGLAERIEADWPGVVVSDIRMPGIDGLQLLEQLHGRDSELPVLLITGHGDVPLAVQAMRAGAYDFLEKPFATDALLDSVRRALALRRLVLDNRSLRLALSDRQQLATRLVGHSPAMLRLREQIGALAGTRADVLILGETGAGKEVVARALHDLSSRSEGPFVAINAGALAESVVESELFGHEPGAFTGAQKRRIGKFEFANGGTLFLDEIESMSLDVQVKLLRMLQERVVERLGGNQLIPLDIRIIAATKEDLRQSADQGRFRADLYYRLNVAPLRIPPLRERGDDILVLFQHFADAASQRHGLSPHALQPAQRALLLRHDWPGNVRELQNAAERFALGLELALDGQAPSAAAPAAPMLSGNLSEQVEQFERSLIAAELAQPHGSMRSLAEALGIPRKTLHDKLRKHGLNFDGGSGGHDDQEDNR

SEQ ID NO: 71420 - DNA, 1329 bp, Pseudomonas putida KT2440
  CDS (1)..(1329): transl_table=11
atgaaccaagcgcctcttaccgtcctgatcgtcgaagacgacccgcatgtgctgctcggctgccagcaggcgctggccctggaggatatcgcctgcgagggcgtaggcagcgccgaacaggcgctggaacgcatcggcgacgattttgccggcattgtcgtcagcgatatccgcctgccgggtattgatggcctggagctgctcaatcgcctcaaggcccgtgaccgcagcctgccggtggtgctgatcactggccatggcgatatcgacatggccgttggcgccatgcgtaacggcgcctacgacttcatggaaaaaccgttctcccccgagcgcctggtcgacgtggtacgccgcgcgctggaacagcgcgggctgtcacgcgaagtggtggccctgcgccgccagctggccgaacagagcagcctggagggacgcatcattggtcgctcaccggccatggagcacttgcgcgaactgatcgccaacgtcgccgacacctcagccaacgtgcttatcgaaggcgagaccggcaccggcaaagagctggtcgcacgctgcctgcacgacttcagccgtcgccagagccacccgttcgtggcgctgaactgtggcggcctgccggaaaacctgtttgaaagcgagatattcggccacgaggccaacgccttcaccggtgccggcaaacgccgcatcggcaagatcgaacatgccaacggcggcacgctgttcctcgatgaagtggagagcatgccgatcaacctgcagatcaagctgctgcgcgtgctgcaggagcgcaccctggaacgattgggctcgaaccagagcatcccggtggattgccgggtgatcgccgcgacaaaggcggaccttgatgccctgggccagagcggccagttccgcagcgacctgtattaccggctgaacgtggtcaccctggagctgccgccgctgcgtgagcgccgtgaagacatcctgcagttgttcgaacatttcctgcagcagtcggccctgcgcttcgatcgggaaacaccgacactggacagccagaccctgtcgcgcctgatggcccacgactggccaggcaacgtgcgcgagttgcgcaacgtggccgaacgctatgccctcggcctgccagcgttcaagaaaggccccagcggtggtgccaaccaaggcctgctttttgccgaggcggtggaagcattcgaacgcaacctgctcactgatgccctgcaacgcacgggtggcaacctgagccaggccagccaggagctgggcatggccaagaccacgctgttcgacaaagtgaaaaaatacggcctcgcctga

SEQ ID NO: 71421 - protein, 442 aa, Pseudomonas putida KT2440
MNQAPLTVLIVEDDPHVLLGCQQALALEDIACEGVGSAEQALERIGDDFAGIVVSDIRLPGIDGLELLNRLKARDRSLPVVLITGHGDIDMAVGAMRNGAYDFMEKPFSPERLVDVVRRALEQRGLSREVVALRRQLAEQSSLEGRIIGRSPAMEHLRELIANVADTSANVLIEGETGTGKELVARCLHDFSRRQSHPFVALNCGGLPENLFESEIFGHEANAFTGAGKRRIGKIEHANGGTLFLDEVESMPINLQIKLLRVLQERTLERLGSNQSIPVDCRVIAATKADLDALGQSGQFRSDLYYRLNVVTLELPPLRERREDILQLFEHFLQQSALRFDRETPTLDSQTLSRLMAHDWPGNVRELRNVAERYALGLPAFKKGPSGGANQGLLFAEAVEAFERNLLTDALQRTGGNLSQASQELGMAKTTLFDKVKKYGLA

SEQ ID NO: 71422 - DNA, 1335 bp, Pseudomonas putida KT2440
  CDS (1)..(1335): transl_table=11
atgttgaattcggtgatcgtcgtcgatgatgaagctagtatccgcactgctgtcgagcaatggctgagcctgtctggcttcagcgtggagttgttcgctcgcgccgaagcgtgcctggcacacctgccgcagcacttccctggggtgatcatcagcgatgtgcgcatgccgggcatggatggcctgcaattgctcgaacgcctgcaggcgaacgaccccgacctgcccgtaattctgctgaccggtcacggtgatgtaccgatggcggtagaagccatgcgcagcggggcctatgacttcctggaaaaacccttcacgccgcaagacttgctgggcagcctgcgccgcgcccttgaaaaacgccagctggtgcttgagaaccgccggctccacgagcaggccgacctcaagtcacgcctggaaggcacgctgctgggcatgtcccagggcctgcaacagctgcgccggcaagtgctggacctggccggcctgccggtgaacgtgttgatccgcggtgaaaccggcagtggcaaggagcgggtggcccgctgcctgcacgacttcggcccccgtgccgccaagccctttgtagcccttaactgcgcggccatccccgagtcgctgttcgaggccgaactgttcggccatgagagcggcgccttcacgggcgcccagggtaaacgcatcggcaagctggagtatgccaacggtggcaccgtgttcctcgacgaaatcgagagcatgcccctggcccaacaggccaagctgttgcgggtgatacaggagcagaagttggagcgcctgggggcaaaccagagcatcagcgtcgacctgcgcatcattgctgcgaccaagcctgacctgctcgaggaggctcgtgccgggcgcttccgcgaagacctggcctaccgcctgaacgtcgccgaattgcgcctggcaccgctgcgcgagcggcgggaggacattccgctgctgttcgaacactttgcccgtgctgccggtgaaaagcttggtcgcgcggccccgccgctatcgggtgcacagctggcgcagctgctgtcacatgactggcctggcaacgtgcgtgaactggccaatgcggcggagcggcatgcgttggggctgggttcgccaaatatcgaggtggcacctgccgggcagtcgctgggcgagcagatggaagcattcgaggcgcaatgcctgcgtgcggccttgcgtcagcatgggggcgagatcaagtcggtgatggaggccttgcaactgcctcggcgcacgcttaacgagaagatgcaacggcatgggctggtgcgcgaggattttattgggcaggcatga

SEQ ID NO: 71423 - protein, 444 aa, Pseudomonas putida KT2440
MLNSVIVVDDEASIRTAVEQWLSLSGFSVELFARAEACLAHLPQHFPGVIISDVRMPGMDGLQLLERLQANDPDLPVILLTGHGDVPMAVEAMRSGAYDFLEKPFTPQDLLGSLRRALEKRQLVLENRRLHEQADLKSRLEGTLLGMSQGLQQLRRQVLDLAGLPVNVLIRGETGSGKERVARCLHDFGPRAAKPFVALNCAAIPESLFEAELFGHESGAFTGAQGKRIGKLEYANGGTVFLDEIESMPLAQQAKLLRVIQEQKLERLGANQSISVDLRIIAATKPDLLEEARAGRFREDLAYRLNVAELRLAPLRERREDIPLLFEHFARAAGEKLGRAAPPLSGAQLAQLLSHDWPGNVRELANAAERHALGLGSPNIEVAPAGQSLGEQMEAFEAQCLRAALRQHGGEIKSVMEALQLPRRTLNEKMQRHGLVREDFIGQA

SEQ ID NO: 71424 - DNA, 1428 bp, Pseudomonas putida KT2440
  CDS (1)..(1428): transl_table=11
atggagcacagcatcctggtcgtcgaggatgatgaaatccttgccgacaacattcgcacttacctcagcctcaagggctacgaagtcatcgtgtgccacagcgcggagctggcgttggagcagatcaagcgggcgcaacctgacgcggtgctgaccgacaactcgttgccaggcatgagcgggcacgacctgctgcgcacgctggtggcccaggcgccggacctgaaagtgatcatgatgaccggctacggcaatgtcgaagatgccgtgcaggcgatgaaggagggcgcctttcattacctgaccaagccggtggtactggccgagctcaaactgaccctggacaaggccctggctaccgagcgcatggagcgcacgctgtcgttctaccaggagcgcgaggcgcagaagtccgggttgcaggctttgatcggcgagtcgccggtgatgctcaccctcaagcacaccctgcgccaggtgctcgatgccgagcggcgcatggccagtgacgacctgccaccggtgctgatcgaaggcgagaccggtactggcaaggaactggtggcccgtgccctgcatttcgatggttcgcgcagtaaagggcctttcatcgagttcaattgcgcttcgatccctgccaacctgcttgaggccgaactgtttggccacgagaagggcgcgttcaccgatgccaaggaacgccgggtaggcctggtggaggctgccgatggcggtaccttgttccttgacgagatcggcgaaatggacctggtgctgcaggccaagctgctcaagttgctggaagaccgcagcatccgccggattggtgccgtgaaggaacgcaaggtcgatctgcgggtgatcagcgccaccaactgtaacctggagcaaatggtgcagcagggcaaattcaggcgtgacctgttcttccgccttcgcattatcgccctgaaggtgccgcgcctgtattcgcgtgggcaggacatcctgctactggcgcggcatttccttgcccaccatagccggcgctatggcaagccgaacctgcgcttttcggccgaggccgaaagcctgctgctcggttatagctggcctggcaatgtgcgtgaattgcgcaacatgctggagcagacggtgttgctggcgccgaacgaggtggtgcaagcgcatcagttgaacctgtgcatgaccttggttgacgagccgttggcgcaacagccgatggcggccatgttcgaaatgccgcggcacgagccagaaccggggacaagcctgcctgacatggagcgtgaccttgtctgcaagaccctggaccgcaccgactggaacgtgaccaagtcggcgcggatgcttgggttgtcgcgggatatgctgcgttaccggatcgaaaagctggggctgacccggcctgacaagcgtcagtggtag

SEQ ID NO: 71425 - protein, 475 aa, Pseudomonas putida KT2440
MEHSILVVEDDEILADNIRTYLSLKGYEVIVCHSAELALEQIKRAQPDAVLTDNSLPGMSGHDLLRTLVAQAPDLKVIMMTGYGNVEDAVQAMKEGAFHYLTKPVVLAELKLTLDKALATERMERTLSFYQEREAQKSGLQALIGESPVMLTLKHTLRQVLDAERRMASDDLPPVLIEGETGTGKELVARALHFDGSRSKGPFIEFNCASIPANLLEAELFGHEKGAFTDAKERRVGLVEAADGGTLFLDEIGEMDLVLQAKLLKLLEDRSIRRIGAVKERKVDLRVISATNCNLEQMVQQGKFRRDLFFRLRIIALKVPRLYSRGQDILLLARHFLAHHSRRYGKPNLRFSAEAESLLLGYSWPGNVRELRNMLEQTVLLAPNEVVQAHQLNLCMTLVDEPLAQQPMAAMFEMPRHEPEPGTSLPDMERDLVCKTLDRTDWNVTKSARMLGLSRDMLRYRIEKLGLTRPDKRQW

SEQ ID NO: 71426 - DNA, 1356 bp, Pseudomonas putida KT2440
  CDS (1)..(1356): transl_table=11
atggcaatcaaggtgctgctggtcgaggatgaccgcgtattgcgccaggcgctgggcgataccctggaaatcggcggtttcgcctaccaggcagtgggcagtgccgaagaagcgctggaggccgtactcgaagacgcgttcagcctggtggtcagtgacgtcaacatgcccggtatggatgggcaccagttgctgagccagttgcgccgccagcagccacagttgccggtgctgttgatgacggcgcatgccgccgtcgagcgtgcggtcgaggccatgcgccaaggcgccgccgactacctggtcaaaccgttcgagcccaaggcgctgctcaacctcgtggagcggcatgccgccgggcgtgtgaccggcgaagaagggccggtggcctgcgagccggccagtcgccagttgctggagctggcggcccgtgtggcgcgcagtgactcgaccgtactgatttccggcgagtccggtactggcaaggaagtgctggcgcgctacattcaccagcagtcgccgcgtgcggcgcagcccttcgtggcgatcaactgcgcggcgatccccgacaacatgctcgaggccaccctgttcggccacgagaagggcgccttcaccggcgctatcgcggctcaggctggcaagttcgagcaggccgaaggcggcaccttgctgctcgacgaaatctcggaaatgcccatggccttgcaggccaagctgctgcgtgtgctgcaggaacgcgaggtggagcgggtaggcgggcgcaagccgatcagcctggacattagggtgctggccaccaccaaccgcgacctggccggcgaagtggcggctgggcgcttccgcgaagacctgtactaccgcctgtcggtgttcccgctggcctggcgcccgctgcgtgagcggccgggcgatatcctgcagttggccgagcgcctgctggcgcgccatgtggccaagatgaagcatgcctcggtgcgcctctcgccagcggctcgggcctgcctgcaggcatatgcctggccgggcaacgtgcgcgaactggacaacgccctgcagcgggcgttgattctgcagcagggtggcgtgatcgaggcggcggatttttgtctggcaggcgccattccattgtcggctggcaccgagccatctctcgaggtggttgctgatgccggcggcctgggggatgacatgcgtcgtcacgagtaccagatgatcatcgacaccctgcgcgccgagcgcggccgccgcaaagaggcggccgaacgcctggggatcagtccgcggacgttgcgctacaagctggcgcagatgcgcgatgccgggtttgacgtcgaggccagcctgttcggctga

SEQ ID NO: 71427 - protein, 451 aa, Pseudomonas putida KT2440
MAIKVLLVEDDRVLRQALGDTLEIGGFAYQAVGSAEEALEAVLEDAFSLVVSDVNMPGMDGHQLLSQLRRQQPQLPVLLMTAHAAVERAVEAMRQGAADYLVKPFEPKALLNLVERHAAGRVTGEEGPVACEPASRQLLELAARVARSDSTVLISGESGTGKEVLARYIHQQSPRAAQPFVAINCAAIPDNMLEATLFGHEKGAFTGAIAAQAGKFEQAEGGTLLLDEISEMPMALQAKLLRVLQEREVERVGGRKPISLDIRVLATTNRDLAGEVAAGRFREDLYYRLSVFPLAWRPLRERPGDILQLAERLLARHVAKMKHASVRLSPAARACLQAYAWPGNVRELDNALQRALILQQGGVIEAADFCLAGAIPLSAGTEPSLEVVADAGGLGDDMRRHEYQMIIDTLRAERGRRKEAAERLGISPRTLRYKLAQMRDAGFDVEASLFG

SEQ ID NO: 71428 - DNA, 1443 bp, Pseudomonas putida KT2440
  CDS (1)..(1443): transl_table=11
atgccgcacattctgatcgtcgaagacgaaaccatcatccgctcggccctgcgtcgcctgcttgagcggaaccagtaccaggtcagcgaggccggctcggtgcaggaagcccaggaacgcttcagcattgccactttcgacctcatcgtcagcgacctgcgcctgcccggcgcgcccggcaccgagctgatcaagctcggccagggcaccccggtgctgatcatgaccagttacgccagcctgcgctcagcggtggactcgatgaaaatgggcgcggtggactacatcgccaagcccttcgaccacgacgagatgctgcaggcagtagcgcgtattctgcgtgaccggcagaacgcccccgctgctgcaccgccagccgagccacgcgccagcaatggcaaggctacagcgtccgacaaaggcagcgcggcaacggccaatggcgagatcggcatcatcggctcgtgccagcccatgcaggacatgtacagcaagatccgcaaggtcgcgcctaccgactccaatgtgctgatccagggcgagtcgggcaccggtaaagagctggtggcccgcgccctgcacaacctgtctcgccgggccaaggcaccgatgatctcggtgaactgcgcggccatccccgaaacgctgatcgaatccgaactgttcggccacgaaaaaggcgcgttcaccggcgccagcgccgggcgcgccggcttggtggaggccgccgatggcggtacgctgttcctcgatgaaattggcgaactgccgctcgaagcccaggctcgcctgctgcgtgtgctgcaggaaggcgagatacgccgggtaggttcggtgcagtcgcaaaaggtcgatgtgcgcctgatcgccgcgacccaccgcgacctgaaaaacctggccaaggccggccagttccgtgaagacttgtattaccgactgcacgtcatcgccctgaagctgccggccctgcgcgagcgtggcagcgacgtcaacgagatcgccaacgtcttcctcgcccgccagagcgctcgcatcggccgcgacgacctgcacttctcggccgaggccgagcaagccattcgtcactacagctggcccggtaacgtgcgtgaactggaaaacgccgtggagcgcgcggtgatcctcagcgagagcgcagaaatttccgccgagctgctgggcatcgacatcgagctgagcgacctggatgaggatgacatcctcgacaatgccctggtggtggccaacgcgggcaatgccagccacgagccgaccgaagacctgtcgctggaagactacttccagcacttcgtgcttgaacaccaggaccacatgaccgagaccgaactggcacgcaagctcggcgtaagccgcaagtgcctgtgggaacgccgccagcgcctgggcatcccacggcgcaagagcaacgctaccagcgaataa

SEQ ID NO: 71429 - protein, 480 aa, Pseudomonas putida KT2440
MPHILIVEDETIIRSALRRLLERNQYQVSEAGSVQEAQERFSIATFDLIVSDLRLPGAPGTELIKLGQGTPVLIMTSYASLRSAVDSMKMGAVDYIAKPFDHDEMLQAVARILRDRQNAPAAAPPAEPRASNGKATASDKGSAATANGEIGIIGSCQPMQDMYSKIRKVAPTDSNVLIQGESGTGKELVARALHNLSRRAKAPMISVNCAAIPETLIESELFGHEKGAFTGASAGRAGLVEAADGGTLFLDEIGELPLEAQARLLRVLQEGEIRRVGSVQSQKVDVRLIAATHRDLKNLAKAGQFREDLYYRLHVIALKLPALRERGSDVNEIANVFLARQSARIGRDDLHFSAEAEQAIRHYSWPGNVRELENAVERAVILSESAEISAELLGIDIELSDLDEDDILDNALVVANAGNASHEPTEDLSLEDYFQHFVLEHQDHMTETELARKLGVSRKCLWERRQRLGIPRRKSNATSE

SEQ ID NO: 71430 - DNA, 1368 bp, Nitrosomonas europaea ATCC 19718
  CDS (1)..(1368): transl_table=11
atgatacaagacaagaaaattcttctggtggatgatgacagggatttgcttgaactgctttccatccgtctgacggcagccgggtatgaaaccacgcttgcagacagtactgaggcagcaatcaattatctcgacatttcccgtccccatctcgttatcagtgacatgcaaatgggcggtctcgatggcatggcgctgttcgagtacatccatcgcaacattccgacactgccggtcatcattttgactgcttacggtactatcccggatgccgtggcagcgacgcaacgcgggatttttggctatctcaccaagccttacgatcctaaaattctgctgggtcaggttgaacgcgccctcaatcttgcccctgccgttgaaacgctttccagcacgacacccgtttcctcatggcgcaagaccatcgttacccggagcgcggtcatggaagatctgcttgcaaaagtaggccgagtggcgcaaggggatgccagtgtgctgctgtccggtgaaagcggtgttggcaaggaattgcttgcccgtgccattcatcaggcttcccgacgttgtgatcagccgttcgttaccatcaattgcgcggccattccggaacaactgctggaatccgagctgtttggccatgccaaaggtgcatttaccggtgctgtgcgggatcataagggattattccagctggctgatggtggcagtctgtttctggatgagatcggtgacatgcctctgctgttacaggcaaaactgttgcatgcgctgcaggaaagagtcatccggcctgttggttccacccagagtattccaatcaatgtgcgcatcatctccgctacgcaccgggatctgaaatcggaaatccaggcgggaaattttcgtgaagatctgtattaccggcttttcgtggtggggctgacgattccctcacttgcccagcgcagtgaagatattcccctgctggccaatcattttctgcgtgtatttgccgagaaacatcagaaagatatcaatgtattttccccggaagcgatcagctttctgctggcatcctcctggccgggtaatattcggcagctcatgaatgtcgtcgaacaaagtgtcgtcatgagtgcggtgccgctcatctccggtgagcttgtccgtgatgccatgcacaaggatgaagagcagatgacgtcattcgatgaagcccgcagacagtttgaaagagattatctggtcaagatactgaaaattactgccggaaatgtgactcaggcagccaagctggccaaacgcaatcgcacggagttttataaattgctgcagcggcaccagcttgatttcacactctataaatcgttacaggaaaaggtctga

SEQ ID NO: 71431 - protein, 455 aa, Nitrosomonas europaea ATCC 19718
MIQDKKILLVDDDRDLLELLSIRLTAAGYETTLADSTEAAINYLDISRPHLVISDMQMGGLDGMALFEYIHRNIPTLPVIILTAYGTIPDAVAATQRGIFGYLTKPYDPKILLGQVERALNLAPAVETLSSTTPVSSWRKTIVTRSAVMEDLLAKVGRVAQGDASVLLSGESGVGKELLARAIHQASRRCDQPFVTINCAAIPEQLLESELFGHAKGAFTGAVRDHKGLFQLADGGSLFLDEIGDMPLLLQAKLLHALQERVIRPVGSTQSIPINVRIISATHRDLKSEIQAGNFREDLYYRLFVVGLTIPSLAQRSEDIPLLANHFLRVFAEKHQKDINVFSPEAISFLLASSWPGNIRQLMNVVEQSVVMSAVPLISGELVRDAMHKDEEQMTSFDEARRQFERDYLVKILKITAGNVTQAAKLAKRNRTEFYKLLQRHQLDFTLYKSLQEKV

SEQ ID NO: 71432 - DNA, 1341 bp, Chromobacterium violaceum ATCC 12472
  CDS (1)..(1341): transl_table=11
atgaacgcccccgcccgcatcgtcctggtggacgacgatcccgatctgctgtgcctggtccggctgcggcttgaggccgccggccacgaagtggaggcgctcgccagcgccgaggccgcgctggcagcgctggccgcgcgccgcgccgacctgttgctgaccgactggcgcttgcccggcatggacgggctgcagctgttcgaaaccgcgcgccgccgctatccgacgctgccggtcatcctgttcaccgcccacggcacggtgccggacgcggtggaggcggtcagccgcggcgtgttctgctacctggaaaaaccgttcgacggccagctgctgctggacaaggtggcccagggactggcgctgtccgcgggcgacggcgccgccggcgacgactggcgcgccggcatcgtcagccggggcccggcgatggaggaactgctgagcgaagcgcgcatggtggccgccaccgacgccagcgtgctgctgcagggcgaaagcggcagcggcaaggaagtgctggcgcgcgccattcatcaggccagccgccgcgctggccggccctttgtcgccgtcaactgcggcgcgatcccggaaaacctgctggaaagcgagctgttcggccacgagaagggcgccttcaccggcgccgccgcgcgccacgacggcctgatccgccaggcggacggcggcacgctgttcctggacgagatcggcgacatgccgctgccgctgcaggtgaagctgctgcgggtgctgcaggatcgcgaggtcaggccggtgggcgccagccggccgctgccggtggatatccggctgctgtcggccacccaccgcgatttgccggcccgcatcgccgacggccagttccgcgaggacctctactatcggctgaacgtggtgtcgctgaccctgccgcccttggccgagcggcgcgaggacatccccttgctggcgcagcatttcctgcagcaggtggccgcgcgctacggcaagtccgtcagcggcttcgcgcccgacgccctggccttcctcgccgccgcgcgctggccgggcaatatccgccagctggccaatgtggtggagcaatgctgcgtgctggcgaccggccccttgctgaccctggcccaggtggaaaaggcggtagccggcgagtcgcgcgcgattccgacgctggccgaggcgcggcgggacttcgaacgcgactacctggagcggctgctgcgcctgaccggcggcaacgtcagcgacgccgcccggctggccgaccgcaatcgcaccgagttctaccggctgctgcagaaacacgagctgaatgccgccgcgttcaaggacggctga

SEQ ID NO: 71433 - protein, 446 aa, Chromobacterium violaceum ATCC 12472
MNAPARIVLVDDDPDLLCLVRLRLEAAGHEVEALASAEAALAALAARRADLLLTDWRLPGMDGLQLFETARRRYPTLPVILFTAHGTVPDAVEAVSRGVFCYLEKPFDGQLLLDKVAQGLALSAGDGAAGDDWRAGIVSRGPAMEELLSEARMVAATDASVLLQGESGSGKEVLARAIHQASRRAGRPFVAVNCGAIPENLLESELFGHEKGAFTGAAARHDGLIRQADGGTLFLDEIGDMPLPLQVKLLRVLQDREVRPVGASRPLPVDIRLLSATHRDLPARIADGQFREDLYYRLNVVSLTLPPLAERREDIPLLAQHFLQQVAARYGKSVSGFAPDALAFLAAARWPGNIRQLANVVEQCCVLATGPLLTLAQVEKAVAGESRAIPTLAEARRDFERDYLERLLRLTGGNVSDAARLADRNRTEFYRLLQKHELNAAAFKDG

SEQ ID NO: 71434 - DNA, 1338 bp, Photorhabdus luminescens subsp. laumondii TTO1
  CDS (1)..(1338): transl_table=11
atgacagcgcgtaaaccagcccatcttcttctggttgatgatgatcctggtttgttgaaattgttgggaatgcgtcttaccagtgaaggttttcgtgtcacaaccgcagaaagtggcggtgaagcgttgagattgctaactaaagaaaaaatcgatttggtgatcagtgacctgcgtatggatgaaatggatggtatggcactgttcgctgaaatccagaagcagcaaccgggtatgccagttatcattctaacggctcatggctcaattccagaggcagtagcggccactcaacagggtgtctttagttttctgactaaacccgttgatcgggatgcgctttataaagcgattgatggtgcattggcgttgaccacgcctgccagtgatgaacagtggcgggaacagatagttacccgcagtcctgctatgttgcgtttgttggagcaggcgcgaatggttgctcaatctgatgtcagtgtactgataaacggtcagagtggtaccgggaaggaagtgctagcccaggcaattcaccgtgccagtccacgggcgaaaaaaccatttatcgcgattaactgtggtgctttgccggaacaactccttgagtcagaactgtttggtcatgctaaaggtgcatttaccggtgcggtcagcagccgtgaagggttattccttgctgcgcaggggggaacgctgtttcttgatgaaatcggtgatatgccacaggctttgcaggttaaattgttgcgcgtattgcaggaacgtaaaatacgtccgctcggaagtaaccgtgatctggatattgatgtacggattatctcagcgactcaccgtgatttaccgaaggcaatggcaaaaaatgagtttcgcgaagatctctattaccgcctaaatgtggtgaacttgaaaattccagctttgaatggccgggttgaagatattcctttattggcgaatcatctgttgcgtgaatcagcgaaacgccataaaccttttgtccgtagtttctcagttgatgcgatgaaatgcctgatggcggcaagttggcctggcaatgtgcgtcagcttgttaatgtgatcgaacagtgtgttgcgctgactactgcgccggttattagtgaagccttggttacgcaggcactagaaggggaaaatacagcgttacccacttttgtagaagccagaaatcagtttgaactgaattatctgcgtaaattactgcaaatgaccaaagggaatgtgactcatgcggcgcgtatggcggggcgtaaccggactgaattctacaaattactggcgcgccatgaattggatgcgaatgattttaaagaataa

SEQ ID NO: 71435 - protein, 445 aa, Photorhabdus luminescens subsp. laumondii TTO1
MTARKPAHLLLVDDDPGLLKLLGMRLTSEGFRVTTAESGGEALRLLTKEKIDLVISDLRMDEMDGMALFAEIQKQQPGMPVIILTAHGSIPEAVAATQQGVFSFLTKPVDRDALYKAIDGALALTTPASDEQWREQIVTRSPAMLRLLEQARMVAQSDVSVLINGQSGTGKEVLAQAIHRASPRAKKPFIAINCGALPEQLLESELFGHAKGAFTGAVSSREGLFLAAQGGTLFLDEIGDMPQALQVKLLRVLQERKIRPLGSNRDLDIDVRIISATHRDLPKAMAKNEFREDLYYRLNVVNLKIPALNGRVEDIPLLANHLLRESAKRHKPFVRSFSVDAMKCLMAASWPGNVRQLVNVIEQCVALTTAPVISEALVTQALEGENTALPTFVEARNQFELNYLRKLLQMTKGNVTHAARMAGRNRTEFYKLLARHELDANDFKE

SEQ ID NO: 71436 - DNA, 1338 bp, Erwinia carotovora subsp. atroseptica SCRI1043
  CDS (1)..(1338): transl_table=11
atgacagccagaaaaacggcgagtttgttgctcgtggatgatgaccctagcctgctaaaactgttgggaatgcgtctgaccagcgagggattcagtgtgatgacggcggagagcggccaagaggcactgcgtctgttaacgcgtgagaaattcgatctggtgatcagcgatcttcgtatggacgaaatggatggcatggcgctgttttccgaaatccagcgttatcagccggggatgccggtgatcattctaaccgctcacggttctattcccgatgcggttgcggctacgcagcaaggggtattcagcttcctcacgaagcctgttgaccgtgatgcgctctacaaagcgatagatgaagcgatggcgctgtccgcgccggcaggtgatgaaagctggcgtgaaactatcgtaacgcgcagcccaattatgctgcgtctgctggagcaggcccgaatggtcgcacagtcggacgtcagcgtgctgattaatggccagagcggaaccgggaaagaggtgctggctcaggcgattcatgcggcaagcccgcgagcgaaaaaagcctttatcgcgattaactgcggtgcgctgccggagccactgttggagtcggaactgttcggtcatgcgaaaggggcttttactggtgctgtcagcagccgtgaagggctttttcaggcagcagaaggtggtacgctgtttttagatgaaatcggcgatatgccgctgtctttacaggttaagctgttgcgcgttttgcaggagcgaaaagtccgtccgctggggagtaaccgcgatctggacattgatgtgcggattatttccgccacgcaccgtgatttaccgaaggcgatggaaaaaaacgaattccgcgaggatttgtattatcggctcaacgtggtgaatatgaagctgccagcgctgcatgaacgcgctgaagatatcccgatgctggcaaaccatctgctgcgcgaatcagccaatcgtcacaagccttttgtgcgcaccttttcaaccgatgcgatgaagcgtttgatgacggcgagctggccgggtaacgtgcgccaactggtgaatgtcatcgaacaatgtgtggcgctgaccagcgcaccagtgatcagtggcgcgttagttgaacaggcgctagaaggtgaaaataccgcgttgccgacgtttgttgaagcgcgtcatcagtttgagcttaactatttgcgaaaattattacagatcgcaaaaggtaacgtgacgcaggctgcacgaatggctgggcgtaatcgaacggagttttataaactgctgggccgccacgagttggatgccaacgattttaaagactag

SEQ ID NO: 71437 - protein, 445 aa, Erwinia carotovora subsp. atroseptica SCRI1043
MTARKTASLLLVDDDPSLLKLLGMRLTSEGFSVMTAESGQEALRLLTREKFDLVISDLRMDEMDGMALFSEIQRYQPGMPVIILTAHGSIPDAVAATQQGVFSFLTKPVDRDALYKAIDEAMALSAPAGDESWRETIVTRSPIMLRLLEQARMVAQSDVSVLINGQSGTGKEVLAQAIHAASPRAKKAFIAINCGALPEPLLESELFGHAKGAFTGAVSSREGLFQAAEGGTLFLDEIGDMPLSLQVKLLRVLQERKVRPLGSNRDLDIDVRIISATHRDLPKAMEKNEFREDLYYRLNVVNMKLPALHERAEDIPMLANHLLRESANRHKPFVRTFSTDAMKRLMTASWPGNVRQLVNVIEQCVALTSAPVISGALVEQALEGENTALPTFVEARHQFELNYLRKLLQIAKGNVTQAARMAGRNRTEFYKLLGRHELDANDFKD

SEQ ID NO: 71438 - DNA, 1383 bp, Methylococcus capsulatus str. Bath
  CDS (1)..(1383): transl_table=11
atgagtgaagcgcgcaagcgagtgttgctggtggacgacgatcccgacctgttgcgtctgatcgggctgcgcctgaccgcggcggggttcgatgtggcgaaagcggcgaacggccagtcggcactgtcgcaggtagtggtcttccggccccatgtcgtcgtcaccgatctgaggatggacggtatggacggcatggcattgttcgacgccttgaacgaacgccatcccaccttgccagtgatcatcatgacggcacacggtaccatcaacgacgcagtcgcggcgacccggcggggcgtattcggattcgtcaccaagccggtggacaagaacgaactgattgagcacatctccgaagcgatccgcatcaacggaaacacgaccgtcattcccgacaaggaggagtggcgcgcccggatcgtcacccagagccctttgatggaagaggtcctggggcaggcccagcgtgtggcccagaaccgggccagcgtgttcatcggtggtgaaagcggtaccggcaaggaactgctggctcgggccattcacgacctcagtcctcgtgccaaggggccgttcgtggcggtcaattgcagcgccatcccggaaaatctgctcgagtccgagctgttcggttaccgcaagggggcgttcaccggggcgacgcgggaccaccagggcctgttcaaagcggccgacggtggcacgctgttcctggatgaagtcggtgacatgccacgatcctttcaggtgaaactgttgcgcgcccttcaggagatgaaggtgcgtcccgtcggagcgacccatgacgagccggtcgacgtccgggtgatctcggccacccatgtcgaccttgaacaggcgatggcggaggggaacttccgcgaggatctgtattaccgcctcaacgtcgtgaccctgctgttgccgcccctggtcaaacgtcccgaggacattcccttgctggccatgcattttcttcgggagctggtgagttcgtacggcgaccaggtcaagggcttctctccggaggcgatggaggcgctggtgaattttcagtggcccggcaacgtccggcaactgcgcaacgtggtggaacagtgcgtggcgctgtcgaccacgccactgatccccgtgaccctggtgcaacgtgctttgcgggaggcgccgtcgtctttcccttcgttgcaggaagccagggaccagttcgaactcaactacctcatccgcctattgcagatgacccgagggaacgtgacccaggccgcccgtctggctaagcgcaaccgtaccgagttttaccggctcctgagccggcatggcatgaatccggcgatgttcaagggaggcggagatgccgccggcgatgcgcagccgccttcgtga

SEQ ID NO: 71439 - protein, 460 aa, Methylococcus capsulatus str. Bath
MSEARKRVLLVDDDPDLLRLIGLRLTAAGFDVAKAANGQSALSQVVVFRPHVVVTDLRMDGMDGMALFDALNERHPTLPVIIMTAHGTINDAVAATRRGVFGFVTKPVDKNELIEHISEAIRINGNTTVIPDKEEWRARIVTQSPLMEEVLGQAQRVAQNRASVFIGGESGTGKELLARAIHDLSPRAKGPFVAVNCSAIPENLLESELFGYRKGAFTGATRDHQGLFKAADGGTLFLDEVGDMPRSFQVKLLRALQEMKVRPVGATHDEPVDVRVISATHVDLEQAMAEGNFREDLYYRLNVVTLLLPPLVKRPEDIPLLAMHFLRELVSSYGDQVKGFSPEAMEALVNFQWPGNVRQLRNVVEQCVALSTTPLIPVTLVQRALREAPSSFPSLQEARDQFELNYLIRLLQMTRGNVTQAARLAKRNRTEFYRLLSRHGMNPAMFKGGGDAAGDAQPPS

SEQ ID NO: 71440 - DNA, 1404 bp, Azoarcus sp. EbN1
  CDS (1)..(1404): transl_table=11
atgaaagccactcacagtcccgcccccactgccggcgcccacctgctgctcgtcgatgacgacaccgacctgctcaagctgctgtcgctgcgcctgcacgcgagcggttatcgcgtcagcaccgccgagacggcggaggctgcgctcggacgcatcgcagtcgaacgcttcagcctggtcgtcagcgacgtgcgcctcccggaccgcgacggactcgcgctgttcgaggaaatccggcgtacctgccctgtgctgccggtgatcctgctcaccgcgcacggcagcattcccgacgccgtcgaggcgacttcccgcggcgtcttcggctatctgacaaaacctttcgacagtcaggcgctgcttgaaaagatctcccaggcgttgcaggtaggcggcccgatacacgtcgggaacgacgccgacgacggggactggcgtgatgaaatcatcagccacagcaaccgcatggcgaccgtcctcgacgaagcccgtctcgtcgccgcgtcggacgcgagcattctcatccgcggcgacagcggcaccggcaaggaattgctcgcgcgcgcaatccaccgcatcagcagccgcgcgaacgcgccgttcgtcgcgatcaactgtggcgcaattccggaacagttgctcgaatcggaactcttcggccacgtgaaaggcgctttcaccggcgcggcgacggccaacaccgggcttttccttaccgcccatcgcggcacggtgtttctcgacgagatcggcgacatgccgctcgcgctgcaggtgaagctgctgcgcgtgctgcaggagcgcgccgtgcgccccgtcggggcgagtcgcgccgagccgatcgacgtgcggatcatctccgcgacgcaccgcgacctggaactcgcgcttgccgaggggcagttccgcgaggatctgttctaccgcctcaacgtcgtcagcctgaccttgccgacgctcgaccagcgccgcgaagacatcccgctgctcgccaaccatttcctcgaggttatcgggcgcaaataccacaaacggctgcgcggtttcgcccccgaagcgatggaagcactcgcgacggcggcttggccggggaatatccgccagctgcagaacgtcgtcgaacaggcctgcgcgctcgcgacgacgtcactgatcccgctcgcgttggtcgaacgggcgctgcgggtgccgagcatcgaagccctgagttacgccgaagcaaagcaacgcttcgaacgcaactacctcatccagctgctcaaactcaccgacggcaatgtttcggacgcagcgcgcctcgcggaccgcaaccgtacggagttctatcgcctgctgcaacggcatgcgctgactcccagtctgttccgcgacggttcggttgtcgctcgcgaacgacagcaataa

SEQ ID NO: 71441 - protein, 467 aa, Azoarcus sp. EbN1
MKATHSPAPTAGAHLLLVDDDTDLLKLLSLRLHASGYRVSTAETAEAALGRIAVERFSLVVSDVRLPDRDGLALFEEIRRTCPVLPVILLTAHGSIPDAVEATSRGVFGYLTKPFDSQALLEKISQALQVGGPIHVGNDADDGDWRDEIISHSNRMATVLDEARLVAASDASILIRGDSGTGKELLARAIHRISSRANAPFVAINCGAIPEQLLESELFGHVKGAFTGAATANTGLFLTAHRGTVFLDEIGDMPLALQVKLLRVLQERAVRPVGASRAEPIDVRIISATHRDLELALAEGQFREDLFYRLNVVSLTLPTLDQRREDIPLLANHFLEVIGRKYHKRLRGFAPEAMEALATAAWPGNIRQLQNVVEQACALATTSLIPLALVERALRVPSIEALSYAEAKQRFERNYLIQLLKLTDGNVSDAARLADRNRTEFYRLLQRHALTPSLFRDGSVVARERQQ

SEQ ID NO: 71442 - DNA, 1374 bp, Colwellia psychrerythraea 34H
  CDS (1)..(1374): transl_table=11
atgagcctaagcaaccaaacagttaccagtaattcagccaaaatactgatagtggatgatgacccaagtttattacgtttacttggtattcgtttatctgcggcaggatatgatgttgagtctgccgccaatgcaaaaattgctttaggaagattacaaaattttattcctcaagtagttattagtgatttgcgtatggaaggcatggatggcatggctttattcgaacaaattagaatacagcatcctaatattcctgtcgtcattatgactgctcatggcaccattccagatgcaattaacgccactaaacaaggtgtgtttagttttttaactaaaccttttgaaagccaagagctacttgataccgttgaacaagccatacgattacagccttcacagaatgagaaaaccggagaaacagagctatggcgaaataatataattagccgaagtactgtgatgacttcactattacaacaagctaaacaagtagctaacagtgattttagtgtacttattcatagccaaagcggtaccggtaaagagctattggcaaaagcaattcaccaagcgagtaacaggaaaaataaggtattcacggcaatcaattgtgccgctatacctgaacaactccttgagtctgaattgtttggtcacattaaaggggcgtttactggtgcagagcgaaatcaccaaggtttatttcaagccaccaatggcggtactttatttttagatgaaattggtgatatgccacttagctttcaggtaaaacttctacgggttttacaggaacgagaagtcaggccggtaggtagtacacaagcggtaaaggtcgatgttcgcatcatttcagcaacccatgttaatttaaccaatgccattaaagccaatacctttagagaagatttgtactaccgacttaatgtagttgagttggaattacctactttggcgcaacgacgagaagatattccattgttggtacaatatttcttaaatcaagcagttgctcgatcgaatgtccctatcaaaagcatcaatcaagaagccatggaattacttattagtgccccttggccgggtaatattagacagctgcaaaatgttatagagcaaagtattgcgctgtctagtgaaagcattatcagtgcaaatttagtaaaaaatgcgctgcgtgatgattcaactcagtttccctcttttcagcaagcacgtgatcattttgagcgagattacttatcaaaattattaaaaattaccgcaggaaatgtatcacaggcagctcgaattgctcaacgtaaccgtactgagttttataagttgttaaatcgtcatcatctagtcgctgaatcataccgagaagagtaa

SEQ ID NO: 71443 - protein, 457 aa, Colwellia psychrerythraea 34H
MSLSNQTVTSNSAKILIVDDDPSLLRLLGIRLSAAGYDVESAANAKIALGRLQNFIPQVVISDLRMEGMDGMALFEQIRIQHPNIPVVIMTAHGTIPDAINATKQGVFSFLTKPFESQELLDTVEQAIRLQPSQNEKTGETELWRNNIISRSTVMTSLLQQAKQVANSDFSVLIHSQSGTGKELLAKAIHQASNRKNKVFTAINCAAIPEQLLESELFGHIKGAFTGAERNHQGLFQATNGGTLFLDEIGDMPLSFQVKLLRVLQEREVRPVGSTQAVKVDVRIISATHVNLTNAIKANTFREDLYYRLNVVELELPTLAQRREDIPLLVQYFLNQAVARSNVPIKSINQEAMELLISAPWPGNIRQLQNVIEQSIALSSESIISANLVKNALRDDSTQFPSFQQARDHFERDYLSKLLKITAGNVSQAARIAQRNRTEFYKLLNRHHLVAESYREE

SEQ ID NO: 71444 - DNA, 1410 bp, Dechloromonas aromatica RCB
  CDS (1)..(1410): transl_table=11
atgatggcggcgccatccaaggcggtcggtgcgcatgtgctggtagtcgatgacgatgaggatattctgcgcctgctgaccatgcgcttgcgggcgagggggttccgggtgtctgccgttggttcggccgagcaggcgctggcccagatcgccgttgatccgccccggctcgtcgtcagcgatgttcgtctgcccggcctggatggcctgtcgctgttcgaagagatccgccgcacgcggccgaccttgccggtcattctgcttacggcccacggcaatattcccgatgccgtcgatgccacctcccgcggcgtctttggctacctgaccaagccgttcgatagccagatcctgctcgaaaagattgatcgcgccctgcaactctcggcaccgacgccccatgttggcgaactgccacccgtcactgccgagggtgacgatgcctggatggccggtgttattttccgtagcagccgcatggccgagttgatggccgaagcccgcatgattgccgcctctgatgccagcgtgctgatccgtggcgaaagcggctccggcaaggaggttctggcgcgagccatccaccgggccagtccgcgtgccaaggggccgtttatcgccatcaactgcggcgccattcctgaacagctgctcgagtcggaattgtttggccacgccaagggggccttcaccggcgccgcaaccaatcgcgttggtctgtttcaggcggccaatggcggcacgctcttcctcgacgaaatcggcgacatgccgctggccttgcaggtcaagctgctgcgcgtgttgcaggaacgtgttgtccggccggtgggtacgaccaaggccgagccggtggatgtccgcctgctgtcggccacccatcgcgatctcgatgccgccatggcgcaaggccagttccgcgaggacctctattaccgcctcgatgtcgtttccctgaccctgccgcgtctcgatgaacgacgagaagacattccgctgctcgcttcgcattttgtccaattgctcgccggcaaatacggcaagcaggtcaacggcttcgctcccgaggcgctggaggccttggcgaccgcggcctggccgggcaatgtccgacaactgttcaacgtcgtcgaacaaagctgtgcgctgacttcgacgccattgatcccgctaacgctagtccagcgcgccctgcgggtgccagccatggatgccttgacctacgctgacgccaagcagcgcttcgagcgcaattacctcgttcagctgctcaagctgaccgatggcaacgttgccgatgcggcgcgcattgccgaacgcaaccgcactgagttctaccgcctgctgcaaaaacatgacctgactccggccatgttccgcagcgatagcgaagtggccgccgaacgctga

SEQ ID NO: 71445 - protein, 469 aa, Dechloromonas aromatica RCB
MMAAPSKAVGAHVLVVDDDEDILRLLTMRLRARGFRVSAVGSAEQALAQIAVDPPRLVVSDVRLPGLDGLSLFEEIRRTRPTLPVILLTAHGNIPDAVDATSRGVFGYLTKPFDSQILLEKIDRALQLSAPTPHVGELPPVTAEGDDAWMAGVIFRSSRMAELMAEARMIAASDASVLIRGESGSGKEVLARAIHRASPRAKGPFIAINCGAIPEQLLESELFGHAKGAFTGAATNRVGLFQAANGGTLFLDEIGDMPLALQVKLLRVLQERVVRPVGTTKAEPVDVRLLSATHRDLDAAMAQGQFREDLYYRLDVVSLTLPRLDERREDIPLLASHFVQLLAGKYGKQVNGFAPEALEALATAAWPGNVRQLFNVVEQSCALTSTPLIPLTLVQRALRVPAMDALTYADAKQRFERNYLVQLLKLTDGNVADAARIAERNRTEFYRLLQKHDLTPAMFRSDSEVAAER

SEQ ID NO: 71446 - DNA, 1350 bp, Thiobacillus denitrificans ATCC 25259
  CDS (1)..(1350): transl_table=11
atgaagaagctgaccatcctcgtcgtcgacgatgacgccgcgctgcgcgagctgatcacgctgcggctcgaagcgaacgggtttcgcgtggtcgccgtcgacagcggcgaggccgcgctcgcgcagctcgcgctggcgcggccggacgccgtgctgaccgacctgcagatggccggcatggacggcatggcgctgttccgcgcgatacaggcgcgcgatcctgcgctgcccgtcgtcgtgctgaccgcgcacggaaccattcccgacgcggtcgcggcgacccagcaagggctgttcggctatctgaccaagccctacgacgcgccgacgctgatcgaactcctgaagcgcgcgacccgcctgggcgtaagcgccgcggaggtcgcggacgactggcgcgccgaaatcatcaccgccagcccggcgatggaagccttgctggccgaggcgcggctcgccgcgcagagcgaagcctcgctgctgatccagggcgaatccggcaccggcaaggagttgctcgcgcgggccatccaccgcgccagcccgcgccgcgccaagccattcgtcgcgatcaactgcggcgcgatcccggccgaactgctcgaatccgagctcttcggccacctcaagggcgccttcacgggcgcggcgcgcgacaatccgggcctcttcatgagcgcgcagggcggcacggtgtttctcgacgagatcggcgacatgccgctgccgctgcaggtcaagctcctgcgcgtcctgcaggaaggcgaggtgcgtccggtgggggcgaccgagacgcgcccggtcgacgtgcgcatcctctcggcgacacacaggaacctcgaggatgccatcggcagcggcgaattccgcgaggacctctactaccgtctcaacgtcgtcaacctcatgctgccgccgctgcgcgagcggcgcgaggacattccgctgctggcgcagcatttcctcgccgagctgaccgagaaatacgaccgtcgtgtacgcggcttcgcccccgacgcgctcgacatgctggccgccgccgattggccgggcaacatccgccagctgcgcaacgtgctcgaacagtgcgtcgccctctgtacgacgccgacgatccccggcagcctcgtcgcgcgcgcactgcgcgagaaaccggcggagattcagccgctcgccgaagcccgcgccgccttcgagcgcgactatctcatctccctgctcaagctcacgcgcggccaggtcagcgaagtcgcgcggctcgccggacgcaaccgcaccgaggtctaccggctgctgcagcgtcacggcctgacgcccgcgctgttcaaggatcgcgacgacgcgccctga

SEQ ID NO: 71447 - protein, 449 aa, Thiobacillus denitrificans ATCC 25259
MKKLTILVVDDDAALRELITLRLEANGFRVVAVDSGEAALAQLALARPDAVLTDLQMAGMDGMALFRAIQARDPALPVVVLTAHGTIPDAVAATQQGLFGYLTKPYDAPTLIELLKRATRLGVSAAEVADDWRAEIITASPAMEALLAEARLAAQSEASLLIQGESGTGKELLARAIHRASPRRAKPFVAINCGAIPAELLESELFGHLKGAFTGAARDNPGLFMSAQGGTVFLDEIGDMPLPLQVKLLRVLQEGEVRPVGATETRPVDVRILSATHRNLEDAIGSGEFREDLYYRLNVVNLMLPPLRERREDIPLLAQHFLAELTEKYDRRVRGFAPDALDMLAAADWPGNIRQLRNVLEQCVALCTTPTIPGSLVARALREKPAEIQPLAEARAAFERDYLISLLKLTRGQVSEVARLAGRNRTEVYRLLQRHGLTPALFKDRDDAP

SEQ ID NO: 71448 - DNA, 1371 bp, Methylobacillus flagellatus KT
  CDS (1)..(1371): transl_table=11
atgataggaacaaccaagaaaatcctgactgtcgatgatgatcccgacatcctcaaactcatgggaatgaggctgcaggcagcaggttaccaagtcatcactgccaccaatgcagaagaggcgctgtcccaaattgccatcagccgaccaagcctggtgattacagacttacgcatgcctggcatggatggcttggccctgttcgatgccatccatcaatccgatcctgccttgcccgtgatcatggttacagcccacggctcgatccctgaagcggtcgatgcgacacaacgcggcgtattcggcttcctcactaagccttttgacagcaagtcactgctgcagcaggtagaggccgcattacgcatcggcacaggcgatctgcagcctcatgaccaggatatcgacaatgaatggcgcaagagcatcattacacgcagtccgcaaatggaaaacttgctcgggcaagccaagctcatggcagtttccgatgccagcgtatttatccaaggtgaaagcgggacgggcaaggagttgctggcacgcgccatccatcaggccagtcctcgccgggacaagccttttatcgccatcaattgcggtgccattccagaagccctgcttgagtctgaactattcggtcatagcaaaggggcattcaccggcgccttgcgcgatcacaaagggctgttccagacggctgacggcggcaccctgttcctggacgaaatcggcgacatgccgctgccattgcaggtaaaactgcttagagccctgcaggagcgcgccatccgtcccgtcgggtccaataccagcatcaacattgatgtgcgtgtgatttctgcgactcaccgcaacctggcagaggagatgaaagccggacggttccgcgaagacctgtactatcgcatcaatgttgtcggacttgaaattcctcccctggctgcacgtcgtgaagatatttccctattggccaataactttctcaacgaactggccaccaagtaccgtaaaaaactcaacggctttgcccccgaagccttggagctgttgatcactgcgccatggcctggcaacgtccgccagttgcagaatatcgtcgaacaaaccgtagtgctctgcaccacacccttaatcccggccactttggtacaaaaagcattgcaagaaaacatcggcggcattgtaccgtttgaagttgcacggaagaattttgagcgcgactacctgatcaagctgctcaaggccacgaatggaggcgttacacaagctgcccgcctggcgcaacgcaatcgcaccgagttttacaagctattgcaacgccaccagctcacgccggcgttgttcaagaacgacaataccgcacattaa

SEQ ID NO: 71449 - protein, 456 aa, Methylobacillus flagellatus KT
MIGTTKKILTVDDDPDILKLMGMRLQAAGYQVITATNAEEALSQIAISRPSLVITDLRMPGMDGLALFDAIHQSDPALPVIMVTAHGSIPEAVDATQRGVFGFLTKPFDSKSLLQQVEAALRIGTGDLQPHDQDIDNEWRKSIITRSPQMENLLGQAKLMAVSDASVFIQGESGTGKELLARAIHQASPRRDKPFIAINCGAIPEALLESELFGHSKGAFTGALRDHKGLFQTADGGTLFLDEIGDMPLPLQVKLLRALQERAIRPVGSNTSINIDVRVISATHRNLAEEMKAGRFREDLYYRINVVGLEIPPLAARREDISLLANNFLNELATKYRKKLNGFAPEALELLITAPWPGNVRQLQNIVEQTVVLCTTPLIPATLVQKALQENIGGIVPFEVARKNFERDYLIKLLKATNGGVTQAARLAQRNRTEFYKLLQRHQLTPALFKNDNTAH

SEQ ID NO: 71450 - DNA, 1320 bp, Oceanospirillum sp. MED92
  CDS (1)..(1320): transl_table=11
atgaaccctgcgattcttcttgtcgatgacgacagctcactactgaaacttctttctatgcgtctggaggccagtgggtataaagtcacctgtgccgatagtgctgagcgagccttagaattaatcaacgatcagttcgacctgctgatcacagacctgcgaatggaagggatggacgggatggccctgtttaatcaggtccagcgcctatacccgcaactccctgttgtcatcatcaccgcccacggatccatacctgaagcggtcaccgcaacacagcaaggtgtatttggttttctaaccaaacctatagatcgcgaccagcttttacagacgattagtgccgcactagccagtacaagccgttctctgggtaaatggcgtgagaatattatcagccgcagctctatcatggaaaacctgctggcagaagctgagcaaattgcagggtctgatgtcagtgtattagtcaccgggcccagcggtagtggtaaagaactgatggcaaatgcgatacataacgccagtcctcggcataaaaagccctttgtcgccatcaactgcggtgcactacctgaacaactgctggagtctgaactctttggccataccaaaggggcctttaccggcgcggttaataaacatgaaggattatttcaggcagctaatggaggcacgctgtttcttgatgagatcggtgatatgccaatgccacttcaggtgaagttgttacgggtattacaggagagacagatcaggcctgtcggtagtactgaaaccgtgcctgtcgatgtgaggataatctctgccactcaccgaaacctagaagaagccatgcttaacaatgacttccgggaagacctgttttatcgacttaacgtggtcaacctccatctccctccattatcagaacgccccgaggatattccgccccttgctcggcacttcgtagataaagcggctcaacgccataacccaaaggttaaaaacatctccagcgctgcccttcacgagctagcgcagtcggcatggcctggaaacgtcaggcagttagaaaatattattgagaaagtcaccgcactttcaacaacgccgattatctctgatagcgcggtaaaacgagcactggcgaatcaggaacaagtgattccgaattttaatgaagcccgtgcggaatttgagaaacgctatctgattaaggtgctacaaataacagagggaaatgtttctcaagcggctaaaattgcggggagaaaccgcactgatttctacaagctgctcaagaaacatgaattggaagcggcaaactttaaaggctga

SEQ ID NO: 71451 - protein, 439 aa, Oceanospirillum sp. MED92
MNPAILLVDDDSSLLKLLSMRLEASGYKVTCADSAERALELINDQFDLLITDLRMEGMDGMALFNQVQRLYPQLPVVIITAHGSIPEAVTATQQGVFGFLTKPIDRDQLLQTISAALASTSRSLGKWRENIISRSSIMENLLAEAEQIAGSDVSVLVTGPSGSGKELMANAIHNASPRHKKPFVAINCGALPEQLLESELFGHTKGAFTGAVNKHEGLFQAANGGTLFLDEIGDMPMPLQVKLLRVLQERQIRPVGSTETVPVDVRIISATHRNLEEAMLNNDFREDLFYRLNVVNLHLPPLSERPEDIPPLARHFVDKAAQRHNPKVKNISSAALHELAQSAWPGNVRQLENIIEKVTALSTTPIISDSAVKRALANQEQVIPNFNEARAEFEKRYLIKVLQITEGNVSQAAKIAGRNRTDFYKLLKKHELEAANFKG

SEQ ID NO: 71452 - DNA, 1443 bp, Pseudomonas putida
  CDS (1)..(1443): transl_table=11
atgccgcacattctgatcgtcgaagacgaaaccatcatccgctcggccttgcgtcgcctgctcgagcggaaccagtaccaggtcagcgaagccggctcggtgcaggaagcccaggaacgcttcagcattgccaccttcgacctgatcgtcagcgacctgcgcctgccaggcgcacccggcaccgagctgatcaagctcggccagggcaccccggtgctgatcatgaccagctacgccagcctgcgctcggcggtggactcgatgaaaatgggcgcggtggactacatcgccaagcctttcgaccacgacgagatgcttcaggccgtggcgcgcatcctgcgcgaccggcagaacgccccggctgccgcatcggctgccgagccacgcgccaccaatggcaaggccgcctcggccgacaaaggcagcgcggctgcggccaatggcgaaatcggcatcatcggctcgtgcccgccgatgcaggacatgtacagcaagatccgcaaggtggcgcctaccgactccaacgtgctgatccagggcgagtcgggtaccggtaaagagctggtggcccgcgccctgcacaacctgtcgcgccgggccaaggcaccgatgatctcggtgaactgcgccgccatccccgagacactgatcgagtcagaactgttcggtcacgaaaaaggcgccttcacgggcgccagcgccgggcgtgccggcctggtagaagccgccgacggcggcacgctgttcctcgacgaaatcggcgaactgccgctcgaagcccaggcccgcctgctgcgcgtgctgcaggaaggcgagattcgccgggtaggttcggtgcaatcgcaaaaggtcgatgtgcgcctgatcgccgcgacccaccgcgacctgaagaacctggccaaggccggccagttccgcgaggacctttactaccgcctgcacgtgatcgccctgaaactgcctgccctgcgcgagcgcggcagcgacgtcaacgagatcgccagcgccttcctcgcccgccagagtgcgcgcatcggccgcgacgacctgcatttctcggccgaagccgagcaggccattcgtcattacagctggccgggtaacgtacgtgagctggaaaacgccgtggagcgcgcggtgatcctcagcgagagcgcagaaatttctgccgagctgctgggcatcgacatcgagctgagcgacctggaggaggacgagatcctcaacaacgcgctggtcgtggccagtgctgccagtgccagccacgagccgaccgaagacctttcgctggaagactacttccagcacttcgtgctcgagcaccaggaccacatgaccgaaaccgaactggcacgcaagctaggcgtcagccgcaagtgcctgtgggaacgccgtcaacgcctgggtattccacggcgcaagagcaacgctaccagcgaataa

SEQ ID NO: 71453 - protein, 480 aa, Pseudomonas putida
MPHILIVEDETIIRSALRRLLERNQYQVSEAGSVQEAQERFSIATFDLIVSDLRLPGAPGTELIKLGQGTPVLIMTSYASLRSAVDSMKMGAVDYIAKPFDHDEMLQAVARILRDRQNAPAAASAAEPRATNGKAASADKGSAAAANGEIGIIGSCPPMQDMYSKIRKVAPTDSNVLIQGESGTGKELVARALHNLSRRAKAPMISVNCAAIPETLIESELFGHEKGAFTGASAGRAGLVEAADGGTLFLDEIGELPLEAQARLLRVLQEGEIRRVGSVQSQKVDVRLIAATHRDLKNLAKAGQFREDLYYRLHVIALKLPALRERGSDVNEIASAFLARQSARIGRDDLHFSAEAEQAIRHYSWPGNVRELENAVERAVILSESAEISAELLGIDIELSDLEEDEILNNALVVASAASASHEPTEDLSLEDYFQHFVLEHQDHMTETELARKLGVSRKCLWERRQRLGIPRRKSNATSE

SEQ ID NO: 71454 - DNA, 1386 bp, Escherichia coli
  CDS (1)..(1386): transl_table=11
atgactgctattaatcgcatccttattgtggatgatgaagataatgttcgccgtatgctgagcaccgcttttgcactacaaggattcgaaacacattgtgcgaacaacggacgcacagcattacacctgtttgccgatattcaccctgatgtggtgttgatggatatccgcatgccagagatggacggcatcaaggcactaaaggagatgcgcagccatgagacccggacacccgttattctgatgacggcctatgcggaagtggaaaccgccgtcgaagcgctacgctgcggagccttcgactatgttattaaaccgtttgatctcgatgagttgaatttaatcgttcagcgcgctttacaactccagtcaatgaaaaaagagatccgtcatctgcaccaggcactgagcaccagctggcaatgggggcacattctcaccaacagcccggcgatgatggacatctgcaaagacaccgccaaaattgccctttctcaggccagcgtcttgattagcggtgaaagcggcaccgggaaagagttgattgccagagcgattcactacaattcgcggcgggcaaaggggccgttcattaaagtcaactgcgcggcgctgccggaatcgttgctcgaaagtgaactgtttggtcatgaaaaaggtgcatttactggtgcacaaaccttgcgtcagggattatttgaacgagccaacgaaggtactctgctcctcgacgaaattggcgaaatgccgctggtactacaagccaaattactacgcattctacaggaacgggaatttgaacggattggcggccatcagaccataaaagttgatatccgcatcattgctgccaccaaccgcgacttgcaggcaatggtaaaagaaggcaccttccgtgaagatctcttttatcgccttaacgttattcatttaatactgccgcctctgcgcgatcgccgggaagatatttccctgttagctaatcactttttgcaaaaattcagtagtgagaatcagcgcgatattatcgacatcgatccgatggcaatgtcactgcttaccgcctggtcatggccgggaaatattcgagagctttccaacgttattgaacgcgccgtcgtgatgaattcaggcccgatcattttttctgaggatcttccgccacagattcgtcagccagtctgtaatgctggcgaggtaaaaacagcccctgtcggtgagcgtaatttaaaagaggaaattaaacgcgtcgaaaaacgcatcattatggaagtgctggaacaacaagaaggaaaccgaacccgcactgctttaatgctgggcatcagtcgccgtgcattgatgtataaactccaggaatacggtatcgatccggcggatgtataa

SEQ ID NO: 71455 - protein, 461 aa, Escherichia coli
MTAINRILIVDDEDNVRRMLSTAFALQGFETHCANNGRTALHLFADIHPDVVLMDIRMPEMDGIKALKEMRSHETRTPVILMTAYAEVETAVEALRCGAFDYVIKPFDLDELNLIVQRALQLQSMKKEIRHLHQALSTSWQWGHILTNSPAMMDICKDTAKIALSQASVLISGESGTGKELIARAIHYNSRRAKGPFIKVNCAALPESLLESELFGHEKGAFTGAQTLRQGLFERANEGTLLLDEIGEMPLVLQAKLLRILQEREFERIGGHQTIKVDIRIIAATNRDLQAMVKEGTFREDLFYRLNVIHLILPPLRDRREDISLLANHFLQKFSSENQRDIIDIDPMAMSLLTAWSWPGNIRELSNVIERAVVMNSGPIIFSEDLPPQIRQPVCNAGEVKTAPVGERNLKEEIKRVEKRIIMEVLEQQEGNRTRTALMLGISRRALMYKLQEYGIDPADV

SEQ ID NO: 71456 - DNA, 1347 bp, Rhizobium leguminosarum
  CDS (1)..(1347): transl_table=11
atggacacactgatgcccgttgcgctgatcgacgacgacaaggatctgcgccgtgccaccgcgcagacgctcgaactcgccggattttccgtttccgcctatgacggtgcgaaagccgcgctggcggacctgccggcggactttgccggccccgtcgtcaccgatatccgcatgcccgagatcgacggactgcagctcttcgccacgctgcaagggatggatgtcgacctgccggtgatcctgatgaccggccacggcgatattcccatggccgttcaggcgattcaggacggcgcctatgatttcatcgccaagcccttcgcagccgatcggctcgtgcagagcgtgcgtcgcgcaagcgagaagcgccggcttgttctggagaaccgcatgctgcggaaagcagccgaagatgcgcaggagaatttgccgctgatcggccagacgcctgtgatggaaaacctcagaaacattcttcgccacatcgccgataccgatgtggacgtactcgtcgccggcgaaacgggcagcggcaaggaagtggttgcccagatcctgcatcagtggagccaccgccggaaaggcaatttcgtggccctgaactgtggcgccctgcccgaaaccgtcatcgaaagcgaactgttcggccacgagcgcggcgcctttaccggcgcccagaagcgccgcacgggccgcatcgaacatgcaagcggcggcacgctgttcctcgacgagatcgaaagcatgccggccgccacgcaggtcaagatgctgagggtgctggagatgcgcgagatcacgccgctcggcaccaatgaggtgcgccccgtcaatcttcgcgtcgtcgcggctgccaagatcgacctcggggaccccgcggttcgcggcgattttcgcgaggatctctattacaggctgaatgtcgtgacgatctccattccgccgctgagagaacggcgggacgatattccgctgctgttttcccacttcgccgctcgcgccgcggagcgcttccgtcgcgatgtcccgccgctttcacctgatgtgcggcggcatctcgcctcgcacacatggccaggcaatgtccgcgagctctcgcattatgccgaacgcgtggtgcttggcgtggaaggcggcggagcggcagcggtccctcctcagccgacgggtgcgacgctccccgaacggctggaacgctacgaggcggagatcatccgcgacacgctgtcagccaatgacggcgacgtgcgccgcaccatcgaggcgctcggcattccgagaaagacgttttatgacaaacttcagcgccacggcatcaaccggggcggctatagctcgcgcaagtaa

SEQ ID NO: 71457 - protein, 448 aa, Rhizobium leguminosarum
MDTLMPVALIDDDKDLRRATAQTLELAGFSVSAYDGAKAALADLPADFAGPVVTDIRMPEIDGLQLFATLQGMDVDLPVILMTGHGDIPMAVQAIQDGAYDFIAKPFAADRLVQSVRRASEKRRLVLENRMLRKAAEDAQENLPLIGQTPVMENLRNILRHIADTDVDVLVAGETGSGKEVVAQILHQWSHRRKGNFVALNCGALPETVIESELFGHERGAFTGAQKRRTGRIEHASGGTLFLDEIESMPAATQVKMLRVLEMREITPLGTNEVRPVNLRVVAAAKIDLGDPAVRGDFREDLYYRLNVVTISIPPLRERRDDIPLLFSHFAARAAERFRRDVPPLSPDVRRHLASHTWPGNVRELSHYAERVVLGVEGGGAAAVPPQPTGATLPERLERYEAEIIRDTLSANDGDVRRTIEALGIPRKTFYDKLQRHGINRGGYSSRK

SEQ ID NO: 71458 - DNA, 1383 bp, Rhizobium meliloti
  CDS (1)..(1383): transl_table=11
atgagcgccgccccatccgtgttcctgatcgatgacgaccgcgacttgcgcaaggcaatgcagcagacgctcgagcttgcgggcttcaccgtctcgtccttcgccagcgcgaccgaagcgctcgccggactttccgccgacttcgcgggcatcgtcatcagcgatatccgcatgcccggcatggacgggcttgcccttttccgcaagatcctggcgctcgatccggacctgccgatgatccttgttacggggcacggcgacataccgatggcggtgcaggcgatccaggacggcgcctatgacttcatcgccaagccgtttgccgccgatcgtcttgtccagagcgcccggcgcgcagaggagaagcggcggctcgtgatggagaaccggtcgctgcgccgcgcggccgaagccgcctccgaaggcctgccgctgatcggccagacgccggtcatggagcggcttcgccagaccttgaaacacatcgccgacaccgatgtcgacgtgttggttgccggcgagacgggcagcggcaaggaggtcgtcgccacgctgctgcaccaatggagccgccgcaggaccggcaatttcgtcgcgctgaattgcggcgctctgccggaaacggtgatcgaaagcgagctcttcggccacgagcccggcgcctttaccggcgccgtcaagaagcggatcggccggatcgagcatgcgagcggcggcacgctcttcctcgacgagatcgaggccatgccgccggcaactcaggtgaagatgctgcgcgtgctggaagcccgcgagatcacgccgctcggcaccaatctgacccgccccgtcgacatccgcgtcgtcgccgcagccaaggtcgatctcggcgacccggccgcgcgcggcgatttccgcgaggatctctattaccggctgaacgtcgtgacgctctcgatcccgcccctgcgcgaacggcgcgacgacatccccctcctcttctcccatttcctggcccgcgcctcggaacgcttcggccgcgaagtgcccgcgatctcggctgccatgcgcgcgtacctggcgacgcattcctggcccggcaatgtgcgcgagctttcgcacttcgccgaacgggtggcgctgggggtggagggaaacctgggagttccggccgcagcgcccgcctcaagcggagcgaccctgccggaaagattggaacgctacgaggccgatatcctcaagcaggcgctcacggcgcattgcggcgacgtcaaagagaccctgcaagccctcggcatcccccgcaagactttttacgacaagctgcagcgccatgggatcaaccgggcagattatgtcgaacgggcaggcccggggcgtcccaatgccatatcgaaaacttga

SEQ ID NO: 71459 - protein, 460 aa, Rhizobium meliloti
MSAAPSVFLIDDDRDLRKAMQQTLELAGFTVSSFASATEALAGLSADFAGIVISDIRMPGMDGLALFRKILALDPDLPMILVTGHGDIPMAVQAIQDGAYDFIAKPFAADRLVQSARRAEEKRRLVMENRSLRRAAEAASEGLPLIGQTPVMERLRQTLKHIADTDVDVLVAGETGSGKEVVATLLHQWSRRRTGNFVALNCGALPETVIESELFGHEPGAFTGAVKKRIGRIEHASGGTLFLDEIEAMPPATQVKMLRVLEAREITPLGTNLTRPVDIRVVAAAKVDLGDPAARGDFREDLYYRLNVVTLSIPPLRERRDDIPLLFSHFLARASERFGREVPAISAAMRAYLATHSWPGNVRELSHFAERVALGVEGNLGVPAAAPASSGATLPERLERYEADILKQALTAHCGDVKETLQALGIPRKTFYDKLQRHGINRADYVERAGPGRPNAISKT

SEQ ID NO: 71460 - DNA, 1410 bp, Escherichia coli O157
  CDS (1)..(1410): transl_table=11
atgcaacgagggatagtctgggtagtcgatgacgatagttccatccgttgggtgcttgaacgtgcgctcgctggagcgggtttaacctgtacaacatttgagaacggcgcggaggtactggaggcgctggcgagcaaaacgccggatgtgctgctttcagatatccgtatgccgggaatggacgggctggcactgctcaagcagattaaacagcgccatccgatgcttccggtcatcattatgaccgcacattccgatctggatgctgccgtcagcgcctatcaacaaggggcgtttgattatctgcccaaaccgtttgatatcgacgaagccgtggcgctggttgagcgcgccatcagtcattaccaggaacagcagcagccgcgtaatgttcagcttaacggcccaacgaccgatatcatcggcgaagcgccagccatgcaggacgtgttccgtattatcggtcggctttcgcgttcttctattagcgtgctgattaacggcgaatccggcaccggtaaagaactggtcgctcatgccctgcatcgccacagtccgcgagccaaagcgccatttatcgctctgaatatggcggctatcccgaaggatttgatcgaatcagaactgtttggtcacgagaaaggcgcgtttaccggcgcgaataccattcgtcaggggcgttttgaacaggctgatggcggtacattatttctcgatgaaattggcgatatgccgctggatgtgcagacgcgtttgctgcgcgtgctggcagacggtcagttttaccgcgttggcggctatgcgccggtgaaagtggatgtgcggattatcgctgccactcaccagaatctcgaacagcgggtgcaggaaggtaagttccgtgaggatctgttccaccgcctgaacgttatccgcgttcatctgccgccgctgcgtgagcgtcgggaagatattccccgcctggcgcgccattttttacaggttgccgcgcgagaactgggcgtagaagcgaagttgctgcatccggaaaccgaagccgcgttgacgcgtctggcgtggccaggcaacgtgcgccagctggaaaacacctgccgctggctaacggtaatggctgccggacaggaagtgttgattcaggatttgcctggcgaactgtttgaatcaacggttgcggagagtacttcgcaaatgcaaccggacagttgggcgacgcttcttgcgcagtgggcagacagagcgctacgttccggtcatcaaaatctgctttccgaagcgcagccagagctggagcggacgttactgacgaccgcgttgcgacatacgcaggggcataaacaggaggcggcgcggctactcggctggggccgcaacaccctgacgcgtaagttaaaagagctggggatggagtga

SEQ ID NO: 71461 - protein, 469 aa, Escherichia coli O157
MQRGIVWVVDDDSSIRWVLERALAGAGLTCTTFENGAEVLEALASKTPDVLLSDIRMPGMDGLALLKQIKQRHPMLPVIIMTAHSDLDAAVSAYQQGAFDYLPKPFDIDEAVALVERAISHYQEQQQPRNVQLNGPTTDIIGEAPAMQDVFRIIGRLSRSSISVLINGESGTGKELVAHALHRHSPRAKAPFIALNMAAIPKDLIESELFGHEKGAFTGANTIRQGRFEQADGGTLFLDEIGDMPLDVQTRLLRVLADGQFYRVGGYAPVKVDVRIIAATHQNLEQRVQEGKFREDLFHRLNVIRVHLPPLRERREDIPRLARHFLQVAARELGVEAKLLHPETEAALTRLAWPGNVRQLENTCRWLTVMAAGQEVLIQDLPGELFESTVAESTSQMQPDSWATLLAQWADRALRSGHQNLLSEAQPELERTLLTTALRHTQGHKQEAARLLGWGRNTLTRKLKELGME

SEQ ID NO: 71462 - DNA, 1410 bp, Salmonella typhimurium
  CDS (1)..(1410): transl_table=11
atgcaacgaggaatagtctgggtcgtcgatgatgatagttccatccgttgggtgcttgagcgtgctctcgccggggcagggttgacctgtaccacctttgagaatggtaatgaagtactggctgcgctggccagtaaaacgccggacgtcttgctgtcggatatccgaatgccgggaatggacgggctggcgctattaaagcagattaaacagcgtcacccgatgcttccggtcatcattatgaccgcgcattccgatttagatgccgccgtgagcgcctatcagcagggggcgtttgattatctgcctaaaccgtttgatattgatgaagccgtcgctctggtcgagcgcgcgattagccactatcaggagcagcaacagccgcgtaatatcgaggttaacggcccgacaacagacatgataggcgaagcgcccgccatgcaggatgtgtttcgcattattggtcggctgtcgcgttcttcgattagcgtgctgattaacggcgaatcagggaccggtaaagaactggtcgcccatgcgcttcaccgccatagcccacgcgccaaagcgccgtttatcgcactcaatatggcggccatcccgaaagatttgattgaatccgaactgtttggccatgagaaaggcgcttttaccggggcgaataccatccggcagggccgtttcgagcaggctgacggcggcacgctgtttctggacgaaattggcgatatgccgctggatgtccagactcgtctgttacgcgtgctggctgacggacagttctaccgcgtgggcgggtacgcgccggtaaaagtcgatgtgcgcattatcgccgccacccaccagaacctcgaacgacgcgttcaggaagggaaattccgcgaagacctgttccaccgcctgaacgtgattcgtatccatcttccgccgttgcgtgaacgccgtgaggatattccgcgcctggcgcgccattttttgcaggtcgccgcccgtgaattaggcgtggaagccaaattattacatccggaaaccgaaacggcgttaacgcgcctggcatggcctggtaacgtgcgtcagttagaaaatacctgccgctggctcaccgtcatggccgccggacaggaggtattgatccaggatttaccgggcgaactgtttgaagcctcgacgccggatagcccgtcccacctgccgccggatagctgggctacattactggcacaatgggcggaccgcgccttgcgatccggtcatcaaaacctgctttctgaagcgcagccagaactggagagaacgctactgaccacggcattacgccatacgcagggtcataaacaggaagccgccaggctgctcggttgggggcgaaacaccctaacgcggaagttgaaagagctgggaatggagtaa

SEQ ID NO: 71463 - protein, 469 aa, Salmonella typhimurium
MQRGIVWVVDDDSSIRWVLERALAGAGLTCTTFENGNEVLAALASKTPDVLLSDIRMPGMDGLALLKQIKQRHPMLPVIIMTAHSDLDAAVSAYQQGAFDYLPKPFDIDEAVALVERAISHYQEQQQPRNIEVNGPTTDMIGEAPAMQDVFRIIGRLSRSSISVLINGESGTGKELVAHALHRHSPRAKAPFIALNMAAIPKDLIESELFGHEKGAFTGANTIRQGRFEQADGGTLFLDEIGDMPLDVQTRLLRVLADGQFYRVGGYAPVKVDVRIIAATHQNLERRVQEGKFREDLFHRLNVIRIHLPPLRERREDIPRLARHFLQVAARELGVEAKLLHPETETALTRLAWPGNVRQLENTCRWLTVMAAGQEVLIQDLPGELFEASTPDSPSHLPPDSWATLLAQWADRALRSGHQNLLSEAQPELERTLLTTALRHTQGHKQEAARLLGWGRNTLTRKLKELGME

SEQ ID NO: 71464 - DNA, 1326 bp, Escherichia coli O157
  CDS (1)..(1326): transl_table=11
atgacgcacgataatatcgatattctggtggtggatgatgacattagccactgcactattttgcaggctttgctgcgcggctggggctataacgtcgcgctggcgaacagcgggcgacaggcgctggagcaggtgcgggagcgggtttttgatcttgtgctttgcgatgtgcgaatggcggagatggacggcattgccacgctaaaagagatcaaagcgttaaatccggcgattccggtactgattatgaccgcatactctagcgtcgagacggcggtagaggcgttgaaaaccggggcgctggattatctcatcaagccgctggatttcgataacctgcaggcgacgctggaaaaggcgctcgcgcatacgcacattattgatgctgaaacgcctgcggtgactgccagccagttcggtatggtcggtaaaagcccggcgatgcaacacctgctcagtgaaatcgccctcgtcgcgccatcggaagccacggtgctgatccacggcgattccggcaccggtaaagagctggtcgccagggcgattcacgccagtagcgcacgtagcgaaaaaccgctggtaacgctcaactgtgcggcactcaacgaatccttgctggaatctgaattgttcggtcacgaaaaaggggcgtttactggagccgataaacgccgggaagggcgctttgttgaggcggacggcggcacgttgtttctcgatgaaattggcgatatctcgccgatgatgctggtgcgtctgctgcgtgcgattcaggagcgcgaagttcagcgtgtcggtagcaaccagactatttcggttgatgtccggctgattgccgcgacccatcgcgatcttgccgcagaggtgaatgccgggcgttttcgccaggatctctactatcgcctgaacgtggtggcgattgaagtaccatcgctgcggcaacggcgggaagatattcctctgctggctggccattttctgcagcgctttgctgaacgtaatcgcaaggcggtaaaaggctttacgccccaggcgatggatctgttgattcattacgactggccgggaaatattcgtgaactggaaaatgcggtggaacgggcggtggtgctgctgactggggaatatatttccgaacgcgagctgccgctggcgattgccagtacgccgatcccgctggcacaaagcctggatattcagccgctggtggaagtcgaaaaagaagtgattctggcggcactggagaaaacgggcggcaacaaaaccgaagccgcccgtcagttagggatcacgcgcaaaacgctgttggcaaaattgtcgcgttag

SEQ ID NO: 71465 - protein, 441 aa, Escherichia coli O157
MTHDNIDILVVDDDISHCTILQALLRGWGYNVALANSGRQALEQVRERVFDLVLCDVRMAEMDGIATLKEIKALNPAIPVLIMTAYSSVETAVEALKTGALDYLIKPLDFDNLQATLEKALAHTHIIDAETPAVTASQFGMVGKSPAMQHLLSEIALVAPSEATVLIHGDSGTGKELVARAIHASSARSEKPLVTLNCAALNESLLESELFGHEKGAFTGADKRREGRFVEADGGTLFLDEIGDISPMMLVRLLRAIQEREVQRVGSNQTISVDVRLIAATHRDLAAEVNAGRFRQDLYYRLNVVAIEVPSLRQRREDIPLLAGHFLQRFAERNRKAVKGFTPQAMDLLIHYDWPGNIRELENAVERAVVLLTGEYISERELPLAIASTPIPLAQSLDIQPLVEVEKEVILAALEKTGGNKTEAARQLGITRKTLLAKLSR

SEQ ID NO: 71466 - DNA, 1326 bp, Escherichia coli
  CDS (1)..(1326): transl_table=11
atgacgcacgataatatcgatattctggtggtggatgatgacattagccactgcactattttgcaggctttactgcgcggctggggctataacgtcgcgctggcgaacagcgggcgacaggcgttggagcaggtgcgggaacaggtttttgatcttgtgctttgcgatgtgcgaatggcggagatggacggcatcgccacgctgaaagagatcaaagcgttaaacccggcaattccggtgctgattatgactgcgtactccagcgtcgagacggcggtagaggcactgaaaactggggcgctggattatctcatcaagccgctggatttcgataacctacaggcgacgctggaaaaagcgctcgcgcatacgcacagtattgatgctgaaacacctgcggtgactgccagccagttcggtatggtcggtaaaagcccggcgatgcaacacctgctcagtgaaatcgccctcgtcgcgccatcggaagccacggtactgatccacggcgattccggcaccggtaaagagctggtcgccagggcgattcacgccagtagcgcacgtagcgaaaaaccgctggtaacgctcaactgtgcggcactcaacgaatccttgctggaatctgaattgttcggtcacgaaaaaggggcgtttactggagccgataaacgccgggaagggcgctttgttgaggcggacggcggcacgctgtttctcgatgaaattggcgatatctcgccgatgatgcaggtgcgtctgctgcgtgcgattcaggagcgcgaagttcagcgtgtcggtagcaaccagattatctcggttgatgtccggctgattgcggcgacccatcgcgatcttgccgcagaggtgaatgccgggcgttttcgccaggatctctactatcgcctgaatgtggtggcgattgaagtaccatcgctgcggcaacggcgggaagatatccctctgctggctggccattttctgcagcgctttgccgagcgtaatcgcaaggcggtaaaaggttttacgccccaggcgatggatctgttgattcattacgactggccgggaaatattcgtgagctggaaaacgcggtggaacgggcagtggtgctgctgaccggggaatatatttccgaacgcgagctgccgctggcgattgccagtacgccgatcccgctgggacaaagtcaggatattcagccgttggtggaagtggaaaaagaggtgattctggcggcgctggagaaaacgggcggcaacaaaaccgaagccgcccgtcagttagggatcacgcgcaaaacgctattggcaaaactgtcgcgttag

SEQ ID NO: 71467 - protein, 441 aa, Escherichia coli
MTHDNIDILVVDDDISHCTILQALLRGWGYNVALANSGRQALEQVREQVFDLVLCDVRMAEMDGIATLKEIKALNPAIPVLIMTAYSSVETAVEALKTGALDYLIKPLDFDNLQATLEKALAHTHSIDAETPAVTASQFGMVGKSPAMQHLLSEIALVAPSEATVLIHGDSGTGKELVARAIHASSARSEKPLVTLNCAALNESLLESELFGHEKGAFTGADKRREGRFVEADGGTLFLDEIGDISPMMQVRLLRAIQEREVQRVGSNQIISVDVRLIAATHRDLAAEVNAGRFRQDLYYRLNVVAIEVPSLRQRREDIPLLAGHFLQRFAERNRKAVKGFTPQAMDLLIHYDWPGNIRELENAVERAVVLLTGEYISERELPLAIASTPIPLGQSQDIQPLVEVEKEVILAALEKTGGNKTEAARQLGITRKTLLAKLSR

SEQ ID NO: 71468 - DNA, 1332 bp, Klebsiella oxytoca
  CDS (1)..(1332): transl_table=11
atgagtggcgagcaggtcgatattctggtggtggacgatgacattagccactgcactatcttacaggcgctgttgcggggctggggttatcgggttgcgctggccaacaacggcttacaggcgctggaaaaggtgcgcgagaaggtctttgatctggtgctttgcgatattcgcatggcggagatggacggcatcgaaacgctaaaagagatcaaaaccttcaatccgtcgattcccgttctgatcatgaccgcgtactccagcgttgataccgctgtagaggcgctgaaatccggtgcgctggactaccttattaagccgctggactttgacaagctgcagctgacgctatccgaggcgttggcccacacccggctaagcgagtctcccgtcacagagacccccgccgcccagtttggtatggtgggggatagcccggcgatgcgggcgctgctgaacaatatcaccctggttgcgccctccgatgcgacggtattaattcacggcgagtcgggcacagggaaagagctggtcgcgcgagcgctgcacgccagcagcgctcgcagccgcaggccgctggtgatcctcaactgtgcggcgctcaacgagtcgttgctggagtcggagctgtttggccatgagaagggcgcgtttaccggtgcggacaaacggcgagaagggcgcttcgttgaagcggacggcggtacgctgttccttgatgagataggcgacatttcgccgttgatgcaggtgcgcctgctgcgggcgattcaggagcgcgaagtgcagcgcgtgggcagcaaccagaccctttcggttgacgtacggctgattgccgccacccatcgggatttagccgaagaggtcagcgccggacgttttcgccaggatctctactaccgtttgaacgtcgtgactatcgacatgccgccgctgcgtcatcgcagggaggatatccccccgctggcgcgctatttcctgcaacggtatgccgagcgtaaccgcaaagcggtacagggatttacgccacaggcgatggacttgctgattcactacgcctggccgggcaatattcgcgagctggaaaatgcggtggagcgggcggtggtcctgctgaccggcgagtacatctccgaacgcgagctgccgctggcgattaccggtacgccggttgcggacgcgccgcacggcgatgatagtattcagccgctggtggaggtggagaaagaagcgattctggcggcacttgaaagaacgggcggcaacaaaactgaagccgcccgtcggttaggcattacgcgcaaaacgctgctggcaaagctcagccgttag

SEQ ID NO: 71469 - protein, 443 aa, Klebsiella oxytoca
MSGEQVDILVVDDDISHCTILQALLRGWGYRVALANNGLQALEKVREKVFDLVLCDIRMAEMDGIETLKEIKTFNPSIPVLIMTAYSSVDTAVEALKSGALDYLIKPLDFDKLQLTLSEALAHTRLSESPVTETPAAQFGMVGDSPAMRALLNNITLVAPSDATVLIHGESGTGKELVARALHASSARSRRPLVILNCAALNESLLESELFGHEKGAFTGADKRREGRFVEADGGTLFLDEIGDISPLMQVRLLRAIQEREVQRVGSNQTLSVDVRLIAATHRDLAEEVSAGRFRQDLYYRLNVVTIDMPPLRHRREDIPPLARYFLQRYAERNRKAVQGFTPQAMDLLIHYAWPGNIRELENAVERAVVLLTGEYISERELPLAITGTPVADAPHGDDSIQPLVEVEKEAILAALERTGGNKTEAARRLGITRKTLLAKLSR

SEQ ID NO: 71470 - DNA, 24 bp, Artificial sequence
  primer
atgagccataaacctgcgcattta

SEQ ID NO: 71471 - DNA, 27 bp, Artificial sequence
  primer
ttattccttgaaatcgtttgcatccag

SEQ ID NO: 71472 - protein, 518 aa, Artificial sequence
  consensus sequence
  Variant (5)..(14): Xaa in position 5 to 14 is any amino acid
  Variant (16)..(18): Xaa in position 16 to 18 is any amino acid
  Variant (20)..(31): Xaa in position 20 to 31 is any amino acid
  Variant (33)..(44): Xaa in position 33 to 44 is any amino acid
  Variant (45)..(47): Xaa in position 45 to 47 is any or no amino acid
  Variant (49)..(49): Xaa in position 49 is any amino acid
  Variant (52)..(54): Xaa in position 52 to 54 is any amino acid
  Variant (57)..(58): Xaa in position 57 to 58 is any amino acid
  Variant (60)..(66): Xaa in position 60 to 66 is any amino acid
  Variant (67)..(70): Xaa in position 67 to 70 is any or no amino acid
  Variant (73)..(75): Xaa in position 73 to 75 is any amino acid
  Variant (77)..(83): Xaa in position 77 to 83 is any amino acid
  Variant (86)..(86): Xaa in position 86 is any amino acid
  Variant (88)..(90): Xaa in position 88 to 90 is any amino acid
  Variant (92)..(97): Xaa in position 92 to 97 is any amino acid
  Variant (100)..(104): Xaa in position 100 to 104 is any amino acid
  Variant (106)..(111): Xaa in position 106 to 111 is any amino acid
  Variant (113)..(129): Xaa in position 113 to 129 is any amino acid
  Variant (130)..(158): Xaa in position 130 to 158 is any or no amino acid
  Variant (160)..(169): Xaa in position 160 to 169 is any amino acid
  Variant (171)..(175): Xaa in position 171 to 175 is any amino acid
  Variant (176)..(176): Xaa in position 176 is any or no amino acid
  Variant (180)..(180): Xaa in position 180 is any amino acid
  Variant (182)..(183): Xaa in position 182 to 183 is any amino acid
  Variant (185)..(185): Xaa in position 185 is any amino acid
  Variant (189)..(190): Xaa in position 189 to 190 is any amino acid
  Variant (192)..(192): Xaa in position 192 is any amino acid
  Variant (194)..(194): Xaa in position 194 is any amino acid
  Variant (196)..(197): Xaa in position 196 to 197 is any amino acid
  Variant (199)..(199): Xaa in position 199 is any amino acid
  Variant (201)..(203): Xaa in position 201 to 203 is any amino acid
  Variant (204)..(204): Xaa in position 204 is any or no amino acid
  Variant (207)..(209): Xaa in position 207 to 209 is any amino acid
  Variant (212)..(212): Xaa in position 212 is any amino acid
  Variant (214)..(214): Xaa in position 214 is any amino acid
  Variant (216)..(217): Xaa in position 216 to 217 is any amino acid
  Variant (219)..(219): Xaa in position 219 is any amino acid
  Variant (227)..(228): Xaa in position 227 to 228 is any amino acid
  Variant (235)..(239): Xaa in position 235 to 239 is any amino acid
  Variant (241)..(244): Xaa in position 241 to 244 is any amino acid
  Variant (246)..(246): Xaa in position 246 is any amino acid
  Variant (257)..(257): Xaa in position 257 is any amino acid
  Variant (260)..(262): Xaa in position 260 to 262 is any amino acid
  Variant (264)..(265): Xaa in position 264 to 265 is any amino acid
  Variant (269)..(269): Xaa in position 269 is any amino acid
  Variant (272)..(278): Xaa in position 272 to 278 is any amino acid
  Variant (280)..(286): Xaa in position 280 to 286 is any amino acid
  Variant (288)..(288): Xaa in position 288 is any amino acid
  Variant (290)..(290): Xaa in position 290 is any amino acid
  Variant (292)..(292): Xaa in position 292 is any amino acid
  Variant (295)..(297): Xaa in position 295 to 297 is any amino acid
  Variant (299)..(304): Xaa in position 299 to 304 is any amino acid
  Variant (306)..(306): Xaa in position 306 is any amino acid
  Variant (309)..(309): Xaa in position 309 is any amino acid
  Variant (312)..(312): Xaa in position 312 is any amino acid
  Variant (318)..(322): Xaa in position 318 to 322 is any amino acid
  Variant (324)..(324): Xaa in position 324 is any amino acid
  Variant (326)..(327): Xaa in position 326 to 327 is any amino acid
  Variant (329)..(330): Xaa in position 329 to 330 is any amino acid
  Variant (333)..(334): Xaa in position 333 to 334 is any amino acid
  Variant (336)..(337): Xaa in position 336 to 337 is any amino acid
  Variant (339)..(361): Xaa in position 339 to 361 is any amino acid
  Variant (362)..(362): Xaa in position 362 is any or no amino acid
  Variant (364)..(367): Xaa in position 364 to 367 is any amino acid
  Variant (372)..(372): Xaa in position 372 is any amino acid
  Variant (374)..(374): Xaa in position 374 is any amino acid
  Variant (376)..(376): Xaa in position 376 is any amino acid
  Variant (378)..(379): Xaa in position 378 to 379 is any amino acid
  Variant (381)..(383): Xaa in position 381 to 383 is any amino acid
  Variant (384)..(395): Xaa in position 384 to 395 is any or no amino acid
  Variant (397)..(419): Xaa in position 397 to 419 is any amino acid
  Variant (420)..(484): Xaa in position 420 to 484 is any or no amino acid
  Variant (486)..(492): Xaa in position 486 to 492 is any amino acid
  Variant (494)..(495): Xaa in position 494 to 495 is any amino acid
  Variant (496)..(497): Xaa in position 496 to 497 is any or no amino acid
  Variant (499)..(503): Xaa in position 499 to 503 is any amino acid
  Variant (505)..(510): Xaa in position 505 to 510 is any amino acid
  Variant (512)..(517): Xaa in position 512 to 517 is any amino acid
VDDDXXXXXXXXXXLXXXGXXXXXXXXXXXXLXXXXXXXXXXXXXXXDXRMXXXDGXXLXXXXXXXXXXXPVXXXTXXXXXXXAVXAXXXGXXXXXXKPXXXXXLXXXXXXAXXXXXXXXXXXXXXXXXXXXXXXXXXXXXXXXXXXXXXXXXXXXXXMXXXXXXXXXXAXXXXXXVLIXGXXGXGKEXXAXAXHXXSXRXXXXPFXXXNCXAXPXXLXESELFGHXXGAFTGAXXXXXGXXXXAXGGTLFLDEIGXMPXXXQXXLLRXLQXXXXXXXGXXXXXXXDXRXIXATXXXLXXXXXXGXFRXDLXYRLNVXXXXXPXLXXRXXDIXXLXXHXXXXXXXXXXXXXXXXXXXXXXXXLXXXXWPGNXRXLXNXXEXXXXXXXXXXXXXXXLXXXXXXXXXXXXXXXXXXXXXXXXXXXXXXXXXXXXXXXXXXXXXXXXXXXXXXXXXXXXXXXXXXXXXXXXXXXXXXXXXXXXXXXXEXXXXXXXLXXXXGXXXXXAXXXXXXRXXXXXXL

SEQ ID NO: 71473 - protein, 60 aa, Artificial sequence
  protein pattern
  Variant (2)..(5): Xaa in position 2 to 5 is any amino acid
  Variant (6)..(10): Xaa in position 6 to 10 is any or no amino acid
  Variant (12)..(12): Xaa in position 12 is any amino acid
  Variant (13)..(13): Xaa in position 13 is Ala or Gly
  Variant (15)..(15): Xaa in position 15 is Ile or Leu
  Variant (16)..(16): Xaa in position 16 is Ala, Asn or Pro
  Variant (17)..(18): Xaa in position 17 to 18 is any amino acid
  Variant (19)..(19): Xaa in position 19 is Leu, Met or Val
  Variant (20)..(20): Xaa in position 20 is Phe, Ile, Leu or Val
  Variant (22)..(22): Xaa in position 22 is Ala or Ser
  Variant (23)..(23): Xaa in position 23 is any amino acid
  Variant (28)..(29): Xaa in position 28 to 29 is any amino acid
  Variant (33)..(33): Xaa in position 33 is Pro or Thr
  Variant (36)..(40): Xaa in position 36 to 40 is any amino acid
  Variant (42)..(42): Xaa in position 42 is any amino acid
  Variant (43)..(43): Xaa in position 43 is Phe, Ile, Leu or Val
  Variant (44)..(45): Xaa in position 44 to 45 is any amino acid
  Variant (47)..(48): Xaa in position 47 to 48 is any amino acid
  Variant (50)..(50): Xaa in position 50 is Ser or Thr
  Variant (51)..(51): Xaa in position 51 is Ile, Leu or Val
  Variant (52)..(52): Xaa in position 52 is Phe or Leu
  Variant (57)..(57): Xaa in position 57 is Glu, Gly or Ser
  Variant (58)..(58): Xaa in position 58 is Asp, Glu or Ser
  Variant (59)..(59): Xaa in position 59 is Ile, Leu or Met
  Variant (60)..(60): Xaa in position 60 is Pro or Ser
PXXXXXXXXXNXXAXXXXXXEXXLFGHXXGAFXGAXXXXXGXXXXAXXGXXXLDEIXXXX

SEQ ID NO: 71474 - protein, 58 aa, Artificial sequence
  protein pattern
  Variant (2)..(2): Xaa in position 2 is Ala, Gly, Ser or Thr
  Variant (3)..(7): Xaa in position 3 to 7 is any amino acid
  Variant (8)..(8): Xaa in position 8 is Ile, Leu or Val
  Variant (9)..(9): Xaa in position 9 is Asp or Asn
  Variant (10)..(10): Xaa in position 10 is any amino acid
  Variant (12)..(12): Xaa in position 12 is Phe, Ile, Leu or Val
  Variant (13)..(13): Xaa in position 13 is Ile, Leu or Val
  Variant (14)..(14): Xaa in position 14 is Ala or Ser
  Variant (15)..(15): Xaa in position 15 is Ala or Thr
  Variant (16)..(16): Xaa in position 16 is Ala, Ser or Thr
  Variant (17)..(18): Xaa in position 17 to 18 is any amino acid
  Variant (19)..(19): Xaa in position 19 is Asp or Asn
  Variant (21)..(26): Xaa in position 21 to 26 is any amino acid
  Variant (27)..(27): Xaa in position 27 is Gly or Asn
  Variant (28)..(28): Xaa in position 28 is any amino acid
  Variant (31)..(31): Xaa in position 31 is Ala, Glu, Gln or Ser
  Variant (34)..(34): Xaa in position 34 is any or no amino acid
  Variant (36)..(36): Xaa in position 36 is any or no amino acid
  Variant (39)..(39): Xaa in position 39 is any amino acid
  Variant (41)..(42): Xaa in position 41 to 42 is any amino acid
  Variant (43)..(43): Xaa in position 43 is Ile, Leu or Met
  Variant (44)..(44): Xaa in position 44 is any amino acid
  Variant (45)..(45): Xaa in position 45 is Ile, Leu, Met or Val
  Variant (47)..(47): Xaa in position 47 is any amino acid
  Variant (49)..(50): Xaa in position 49 to 50 is any amino acid
  Variant (52)..(52): Xaa in position 52 is any amino acid
  Variant (53)..(53): Xaa in position 53 is Ala, Asp, Glu or Ser
  Variant (55)..(55): Xaa in position 55 is Ile or Val
  Variant (56)..(57): Xaa in position 56 to 57 is any amino acid
  Variant (58)..(58): Xaa in position 58 is Ile or Leu
GXXXXXXXXXRXXXXXXXXLXXXXXXXXFRXDLXYXRLXVXXXXXPXLXXRXXDXXXX

SEQ ID NO: 71475 - protein, 30 aa, Artificial sequence
  protein pattern
  Variant (3)..(3): Xaa in position 3 is any or no amino acid
  Variant (5)..(5): Xaa in position 5 is any amino acid
  Variant (6)..(6): Xaa in position 6 is any or no amino acid
  Variant (8)..(8): Xaa in position 8 is Ala, Gly or Ser
  Variant (9)..(9): Xaa in position 9 is His or Tyr
  Variant (10)..(10): Xaa in position 10 is Ala, Gly or Ser
  Variant (11)..(11): Xaa in position 11 is Asp, Glu, Asn, Ser or Thr
  Variant (12)..(12): Xaa in position 12 is Ile, Leu or Val
  Variant (13)..(14): Xaa in position 13 to 14 is any amino acid
  Variant (16)..(16): Xaa in position 16 is Ile or Val
  Variant (17)..(17): Xaa in position 17 is Ala, Asp, Glu, Asn, Gln, Ser or Thr
  Variant (18)..(18): Xaa in position 18 is Ala or Ser
  Variant (19)..(21): Xaa in position 19 to 21 is any amino acid
  Variant (23)..(23): Xaa in position 23 is Ala, Ile or Val
  Variant (24)..(24): Xaa in position 24 is any amino acid
  Variant (25)..(25): Xaa in position 25 is Cys, Asp, Gly or Ser
  Variant (26)..(26): Xaa in position 26 is Phe or Tyr
  Variant (27)..(27): Xaa in position 27 is Ile, Leu or Val
  Variant (28)..(28): Xaa in position 28 is any amino acid
PVXIXXTXXXXXXXAXXXXXXGXXXXXXKP

SEQ ID NO: 71476 - protein, 22 aa, Artificial sequence
  protein pattern
  Variant (2)..(2): Xaa in position 2 is Phe or Leu
  Variant (3)..(3): Xaa in position 3 is Ile, Leu or Val
  Variant (4)..(4): Xaa in position 4 is any amino acid
  Variant (5)..(5): Xaa in position 5 is Gly or Ser
  Variant (6)..(6): Xaa in position 6 is Asp, Glu, Pro or Gln
  Variant (7)..(7): Xaa in position 7 is Ser or Thr
  Variant (9)..(9): Xaa in position 9 is Ala, Ser, Thr or Val
  Variant (13)..(13): Xaa in position 13 is Ile, Leu or Val
  Variant (14)..(14): Xaa in position 14 is Phe, Ile, Leu, Met or Val
  Variant (16)..(17): Xaa in position 16 to 17 is any amino acid
  Variant (18)..(18): Xaa in position 18 is Ile or Leu
  Variant (20)..(20): Xaa in position 20 is any amino acid
  Variant (21)..(21): Xaa in position 21 is any or no amino acid
VXXXXXXGXGKEXXAXXXHXXS

SEQ ID NO: 71477 - protein, 22 aa, Artificial sequence
  protein pattern
  Variant (2)..(3): Xaa in position 2 to 3 is any amino acid
  Variant (4)..(4): Xaa in position 4 is any or no amino acid
  Variant (6)..(6): Xaa in position 6 is any amino acid
  Variant (7)..(9): Xaa in position 7 to 9 is any or no amino acid
  Variant (14)..(14): Xaa in position 14 is Ile or Val
  Variant (16)..(16): Xaa in position 16 is Glu or Gln
  Variant (18)..(18): Xaa in position 18 is any amino acid
  Variant (20)..(21): Xaa in position 20 to 21 is any amino acid
  Variant (22)..(22): Xaa in position 22 is Asp, Glu, Gln or Arg
AXXXLXXXXWPGNXRXLXNXXX

SEQ ID NO: 71478 - protein, 13 aa, Artificial sequence
  protein pattern
  Variant (2)..(2): Xaa in position 2 is Ala, Thr or Val
  Variant (3)..(3): Xaa in position 3 is Lys or Arg
  Variant (4)..(4): Xaa in position 4 is Leu or Met
  Variant (7)..(7): Xaa in position 7 is Ala, Ile or Val
  Variant (8)..(8): Xaa in position 8 is Ile, Leu or Val
  Variant (9)..(9): Xaa in position 9 is Ala, Glu or Gln
  Variant (10)..(12): Xaa in position 10 to 12 is any amino acid
  Variant (13)..(13): Xaa in position 13 is Phe, Ile, Leu or Val
QXXXLRXXXXXXX

SEQ ID NO: 71479 - DNA, 288 bp, Escherichia coli
  CDS (1)..(288)
atgaataaccattttggtaaaggcttaatggcgggattaaaagcaacgcatgccgacagtgcggttaatgtgacaaaattctgtgccgattataaacgcggttttgtattaggctactcacaccggatgtacgaaaagaccggagatcgccagcttagcgcctgggaagcgggtattctgacgcgccgctatggactggataaagagatggtaatggatttctttcgtgagaataattcctgttctacgttgcgcttttttatggccggttatcgcctcgaaaattga

SEQ ID NO: 71480 - protein, 95 aa, Escherichia coli
MNNHFGKGLMAGLKATHADSAVNVTKFCADYKRGFVLGYSHRMYEKTGDRQLSAWEAGILTRRYGLDKEMVMDFFRENNSCSTLRFFMAGYRLEN

SEQ ID NO: 71481 - DNA, 288 bp, Salmonella typhimurium LT2
  CDS (1)..(288): transl_table=11
atgaataatcattttgggaaagggttaatggccgggttgcacgcgccatatgcatatagcgcgcatcatgcggtgaatttctgttctgagtataaacgtggctttgtattgggttttacacaccgtatgttcgaaaagaccggcgatcgtcaacttagcgcgtgggaggctggaattctgacgcgtcgctatggtctggataaagaaatggtgatggatttctttaaagagaatcattccgggatggcggttcgcttctttatggccggttatcgactcgaaggttga

SEQ ID NO: 71482 - protein, 95 aa, Salmonella typhimurium LT2
MNNHFGKGLMAGLHAPYAYSAHHAVNFCSEYKRGFVLGFTHRMFEKTGDRQLSAWEAGILTRRYGLDKEMVMDFFKENHSGMAVRFFMAGYRLEG

SEQ ID NO: 71483 - DNA, 294 bp, Erwinia carotovora subsp. atroseptica SCRI1043
  CDS (1)..(294): transl_table=11
gtgggaaaccattttgagcgaggcgtcctcgcggggctgagatctgccaacccaaaatccaccaacgacattaacccttactgctacgattatcggcgcggctatatctgtggctatgctcaccatctggcggaaaccaaaggcgaccgccagcaggccgccttcgaggctgggttgttatcgcgccgctacgggctggaacgggagagagtcgcagagttctttaccgaacaaggcaacccttacgcgattcggtttttttatgctggctatgatgcacacacgccgcgctag

SEQ ID NO: 71484 - protein, 97 aa, Erwinia carotovora subsp. atroseptica SCRI1043
MGNHFERGVLAGLRSANPKSTNDINPYCYDYRRGYICGYAHHLAETKGDRQQAAFEAGLLSRRYGLERERVAEFFTEQGNPYAIRFFYAGYDAHTPR

SEQ ID NO: 71485 - DNA, 26 bp, Artificial sequence
  primer
atgaataaccattttggtaaaggctt

SEQ ID NO: 71486 - DNA, 25 bp, Artificial sequence
  primer
ttaattttcgaggcgataaccggcc

SEQ ID NO: 71487 - protein, 91 aa, Artificial sequence
  consensus sequence
  Variant (2)..(2): Xaa in position 2 is any amino acid
  Variant (6)..(7): Xaa in position 6 to 7 is any amino acid
  Variant (9)..(10): Xaa in position 9 to 10 is any amino acid
  Variant (14)..(19): Xaa in position 14 to 19 is any amino acid
  Variant (21)..(27): Xaa in position 21 to 27 is any amino acid
  Variant (29)..(30): Xaa in position 29 to 30 is any amino acid
  Variant (32)..(32): Xaa in position 32 is any amino acid
  Variant (35)..(37): Xaa in position 35 to 37 is any amino acid
  Variant (39)..(40): Xaa in position 39 to 40 is any amino acid
  Variant (42)..(44): Xaa in position 42 to 44 is any amino acid
  Variant (46)..(47): Xaa in position 46 to 47 is any amino acid
  Variant (52)..(53): Xaa in position 52 to 53 is any amino acid
  Variant (55)..(55): Xaa in position 55 is any amino acid
  Variant (59)..(59): Xaa in position 59 is any amino acid
  Variant (61)..(61): Xaa in position 61 is any amino acid
  Variant (67)..(68): Xaa in position 67 to 68 is any amino acid
  Variant (70)..(70): Xaa in position 70 is any amino acid
  Variant (72)..(73): Xaa in position 72 to 73 is any amino acid
  Variant (76)..(76): Xaa in position 76 is any amino acid
  Variant (78)..(84): Xaa in position 78 to 84 is any amino acid
  Variant (88)..(88): Xaa in position 88 is any amino acid
MXNHFXXGXXAGLXXXXXXSXXXXXXXCXXYXRGXXXGXXHXXXEXXGDRQXXAXEAGXLXRRYGLXXEXVXXFFXEXXXXXXXRFFXAGY

SEQ ID NO: 71488 - protein, 61 aa, Artificial sequence
  protein pattern
  Variant (2)..(2): Xaa in position 2 is any amino acid
  Variant (3)..(3): Xaa in position 3 is Asp or Glu
  Variant (5)..(5): Xaa in position 5 is Lys or Arg
  Variant (8)..(8): Xaa in position 8 is Phe or Tyr
  Variant (9)..(9): Xaa in position 9 is Ile or Val
  Variant (10)..(10): Xaa in position 10 is any amino acid
  Variant (12)..(12): Xaa in position 12 is Phe or Tyr
  Variant (13)..(13): Xaa in position 13 is Ala, Ser or Thr
  Variant (15)..(15): Xaa in position 15 is His or Arg
  Variant (16)..(16): Xaa in position 16 is Leu or Met
  Variant (17)..(17): Xaa in position 17 is any amino acid
  Variant (19)..(19): Xaa in position 19 is any or no amino acid
  Variant (21)..(21): Xaa in position 21 is any or no amino acid
  Variant (26)..(26): Xaa in position 26 is any amino acid
  Variant (27)..(27): Xaa in position 27 is Ala or Ser
  Variant (29)..(29): Xaa in position 29 is Phe or Trp
  Variant (33)..(33): Xaa in position 33 is Ile or Leu
  Variant (35)..(35): Xaa in position 35 is Ser or Thr
  Variant (41)..(41): Xaa in position 41 is Asp or Glu
  Variant (42)..(42): Xaa in position 42 is Lys or Arg
  Variant (44)..(44): Xaa in position 44 is any amino acid
  Variant (46)..(46): Xaa in position 46 is any amino acid
  Variant (47)..(47): Xaa in position 47 is Asp or Glu
  Variant (50)..(50): Xaa in position 50 is any amino acid
  Variant (52)..(52): Xaa in position 52 is Asn or Gln
  Variant (53)..(53): Xaa in position 53 is any amino acid
  Variant (54)..(54): Xaa in position 54 is Asn or Ser
  Variant (55)..(55): Xaa in position 55 is Cys, Gly or Pro
  Variant (56)..(56): Xaa in position 56 is any amino acid
  Variant (57)..(57): Xaa in position 57 is Ala or Thr
  Variant (58)..(58): Xaa in position 58 is Ile, Leu or Val
CXXYXRGXXXGXXHXXXEXKXGDRQXXAXEAGXLXRRYGLXXEXVXXFFXEXXXXXXXRFF

SEQ ID NO: 71489 - DNA, 450 bp, Escherichia coli K12
  CDS (1)..(450): transl_table=11
atgaggatcatcgataacttagaacagttccgccagatttacgcctctggcaagaagtggcaacgctgcgttgaagcgattgaaaatatcgacaacattcagcctggcgtcgcccactccatcggtgactcattgacttaccgcgtggagacagactccgcgaccgatgcgctatttaccgggcatcgacgctattttgaagtgcattactacctgcaagggcagcaaaaaattgaatatgcgccgaaagagacattacaggtagtggaatattatcgtgatgaaactgaccgtgaatatttaaaaggctgcggagaaaccgttgaggtccacgaagggcaaatcgttatttgcgatatccatgaagcgtatcggtttatctgcaataacgcggtcaaaaaagtggttctcaaagtcaccatcgaagatggttatttccataacaaataa

SEQ ID NO: 71490 - protein, 149 aa, Escherichia coli K12 [sequence omitted]

SEQ ID NO: 71491 - DNA, 450 bp, Shigella flexneri 2a str. 301
  CDS (1)..(450): transl_table=11
atgaggatcatcgataacttagaacagttccgccagatttacgcctctggcaagaagtggcaacgctgcgttgaagcgattgaaaatatcgacaacattcagcctggcgtcgcccactccatcggtgattcattgacctaccgtgtggaaaatgactccgcgaccgatgcgctatttaccgggcatcgacgctattttgaagtgcattactacctgcaagggcagcaaaaaattgaatatgcgccgaaagagacattacaggtagtggaatattatcgtgatgaaactgaccgtgaatatttaaaaggctgcggagaaaccgtagaggtccacgaagggcaaatcgttatttgcgatatccatgaagcgtatcggtttatctgcaataacgcggtcaaaaaagtggttctcaaagtcaccatcgaagatggttatttccataacaaataa

SEQ ID NO: 71492 - protein, 149 aa, Shigella flexneri 2a str. 301
MRIIDNLEQFRQIYASGKKWQRCVEAIENIDNIQPGVAHSIGDSLTYRVENDSATDALFTGHRRYFEVHYYLQGQQKIEYAPKETLQVVEYYRDETDREYLKGCGETVEVHEGQIVICDIHEAYRFICNNAVKKVVLKVTIEDGYFHNK

SEQ ID NO: 71493 - DNA, 453 bp, Vibrio vulnificus CMCP6
  CDS (1)..(453): transl_table=11
atgatcgtgttagacagcttagagcaattcaaacaggtatatcgcaacggtcgtaaatggaaccgctgtgtggaggcgattaataacctcaaccatatcaaaccgggggtgatgcattcgattggtgattccttggtttatatgctggtggaaggcagctctcaaagctgtgaaacctttaccggaaaccgtcgttactttgatgtgcattactacctcgaaggcggcgaaaccgtagagtttgccgccaaatccgaactcgataccgttaccccttatcgtgatgaaaccgatcgcgaacaactgcaaggccaaggagaaacgcgccagctacaacaaggtcaagtggccatttttgaaaacgacaaagcctaccgtttttgcggcaaccaagcggtgaaaaaagtggtgctgaaagtgacgatcgaggatggctatttcctcaataaataa

SEQ ID NO: 71494 - protein, 150 aa, Vibrio vulnificus CMCP6
MIVLDSLEQFKQVYRNGRKWNRCVEAINNLNHIKPGVMHSIGDSLVYMLVEGSSQSCETFTGNRRYFDVHYYLEGGETVEFAAKSELDTVTPYRDETDREQLQGQGETRQLQQGQVAIFENDKAYRFCGNQAVKKVVLKVTIEDGYFLNK

SEQ ID NO: 71495 - DNA, 453 bp, Vibrio parahaemolyticus RIMD 2210633
  CDS (1)..(453): transl_table=11
atgatcgtgttagacagcttagagcaattcaaacaggtatatcgcaacggtcgtaaatggaaccgctgtgtggaagccattggcaacatcggcagcatcaaagatggcgtgatgcactcgattggcgattcactggtttacatggttgaggatggcatcgcgaaacaaaccgaaacgttcatcggtaaccgtcgttacttcgatgtgcattactacctcgaaggccaagaaaccgttgagttcgcggataaaaccgcgttgacactagaacaaacttatcgtgatgaaaccgaccgcgaatttttttctggtcaaggtgaaatacgtgagctttgcgaaggccaagtagcgatttttgaaaacagtgaagcgtaccgcttccatggagacaaccgcgtaagaaaagtggtgctcaaagtgaccatcgaagatggctacttcctaaataaataa

SEQ ID NO: 71496 - protein, 150 aa, Vibrio parahaemolyticus RIMD 2210633
MIVLDSLEQFKQVYRNGRKWNRCVEAIGNIGSIKDGVMHSIGDSLVYMVEDGIAKQTETFIGNRRYFDVHYYLEGQETVEFADKTALTLEQTYRDETDREFFSGQGEIRELCEGQVAIFENSEAYRFHGDNRVRKVVLKVTIEDGYFLNK

SEQ ID NO: 71497 - DNA, 453 bp, Vibrio vulnificus YJ016
  CDS (1)..(453): transl_table=11
atgatcgtgttagacagcttagagcaattcaaacaggtatatcgcaacggtcgtaaatggaaccgctgtgtggaggcgattaataacctcaaccatatcaaaccgggggtgatgcattcgattggtgattccttggtttatatgctggtggaaggcagctctcaaagctgtgaaacctttaccggaaaccgtcgttactttgatgtgcattactacctcgaaggcactgaaaccgtagagtttgccgccaaatccgaactcgataccgttaccccttatcgtgatgaaaccgatcgcgaacaactgcaaggccaaggagaaactcgccagctacaacaaggtcaagtggccatttttgaaaacgacaaagcctaccgtttttgcggcaaccaagcggtgaaaaaggtggtgctgaaagtgacgatcgaggatggctacttcctcaataaataa

SEQ ID NO: 71498 - protein, 150 aa, Vibrio vulnificus YJ016
MIVLDSLEQFKQVYRNGRKWNRCVEAINNLNHIKPGVMHSIGDSLVYMLVEGSSQSCETFTGNRRYFDVHYYLEGTETVEFAAKSELDTVTPYRDETDREQLQGQGETRQLQQGQVAIFENDKAYRFCGNQAVKKVVLKVTIEDGYFLNK

SEQ ID NO: 71499 - DNA, 453 bp, Vibrio sp. Ex25
  CDS (1)..(453)
atgatcgtgttagacagcttagagcaattcaaacaggtatatcgcaacggtcgtaaatggaaccgctgtgtggaagccattggcaacatcggcaacatcaaagatggcgtgatgcactcgattggcgattcactggtttacatggttgaagatggcatcgcgaaacaaaccgaaacgttcatcggtaaccgtcgttacttcgatgtgcattactacctcgaaggccgagaaaccgttgagttcgcggataaaaccacgttaaccctagaacaagcttatcgtgatgaaactgaccgcgaatttttttctggtcagggtgaaacacgtgagctttgcgaaggccaagtggcgatttttgaaaacagtgaagcgtaccgcttccacggagacaaccgcgtaagaaaagtggtgctcaaagtgaccatcgaagatggctacttcctaaataaataa

SEQ ID NO: 71500 - protein, 150 aa, Vibrio sp. Ex25
MIVLDSLEQFKQVYRNGRKWNRCVEAIGNIGNIKDGVMHSIGDSLVYMVEDGIAKQTETFIGNRRYFDVHYYLEGRETVEFADKTTLTLEQAYRDETDREFFSGQGETRELCEGQVAIFENSEAYRFHGDNRVRKVVLKVTIEDGYFLNK

SEQ ID NO: 71501 - DNA, 453 bp, Photobacterium sp. SKA34
  CDS (1)..(453): transl_table=11
atgatcgtattaaatagcttagcgcaatttaaattggtgtaccgcaatggacgtaaatggaaccgttgtgtagaagccattgaaaatatagaaaacatcaaagagggtgtgatgcattcgattggcgattcattggtgtacatggtgcaaaacggtgttacgccaaccaatggtatgtttaatggtaaccgtcgttattttgatgtgcattactatcttgacggtagtgagcaagtggaagtctcagagaaagcacaattaaccactgaagtagcttatcaagatgaaacagactatgaaactttgttgggcggtggtgaagtcattgtgttatcacaggggcaaattgcgatttttgaaaatgataaagcgtaccgtttcttaggtgaaagcagagtaaggaaagtggtgctaaaagtgaccatcgaagatggctacttcttgaataaatag

SEQ ID NO: 71502 - protein, 150 aa, Photobacterium sp. SKA34
MIVLNSLAQFKLVYRNGRKWNRCVEAIENIENIKEGVMHSIGDSLVYMVQNGVTPTNGMFNGNRRYFDVHYYLDGSEQVEVSEKAQLTTEVAYQDETDYETLLGGGEVIVLSQGQIAIFENDKAYRFLGESRVRKVVLKVTIEDGYFLNK

SEQ ID NO: 71503 - DNA, 25 bp, Artificial sequence
  primer
atgaggatcatcgataacttagaac

SEQ ID NO: 71504 - DNA, 26 bp, Artificial sequence
  primer
ttatttgttatggaaataaccatctt

SEQ ID NO: 71505 - protein, 150 aa, Artificial sequence
  consensus sequence
  Variant (2)..(4): Xaa in position 2 to 4 is any amino acid
  Variant (6)..(6): Xaa in position 6 is any amino acid
  Variant (11)..(11): Xaa in position 11 is any amino acid
  Variant (13)..(13): Xaa in position 13 is any amino acid
  Variant (15)..(16): Xaa in position 15 to 16 is any amino acid
  Variant (18)..(18): Xaa in position 18 is any amino acid
  Variant (21)..(21): Xaa in position 21 is any amino acid
  Variant (28)..(28): Xaa in position 28 is any amino acid
  Variant (30)..(32): Xaa in position 30 to 32 is any amino acid
  Variant (34)..(35): Xaa in position 34 to 35 is any amino acid
  Variant (38)..(38): Xaa in position 38 is any amino acid
  Variant (46)..(46): Xaa in position 46 is any amino acid
  Variant (48)..(58): Xaa in position 48 to 58 is any amino acid
  Variant (59)..(59): Xaa in position 59 is any or no amino acid
  Variant (61)..(61): Xaa in position 61 is any amino acid
  Variant (63)..(63): Xaa in position 63 is any amino acid
  Variant (68)..(68): Xaa in position 68 is any amino acid
  Variant (74)..(74): Xaa in position 74 is any amino acid
  Variant (76)..(79): Xaa in position 76 to 79 is any amino acid
  Variant (81)..(81): Xaa in position 81 is any amino acid
  Variant (83)..(83): Xaa in position 83 is any amino acid
  Variant (85)..(86): Xaa in position 85 to 86 is any amino acid
  Variant (88)..(92): Xaa in position 88 to 92 is any amino acid
  Variant (101)..(103): Xaa in position 101 to 103 is any amino acid
  Variant (105)..(105): Xaa in position 105 is any amino acid
  Variant (108)..(113): Xaa in position 108 to 113 is any amino acid
  Variant (116)..(117): Xaa in position 116 to 117 is any amino acid
  Variant (119)..(123): Xaa in position 119 to 123 is any amino acid
  Variant (128)..(132): Xaa in position 128 to 132 is any amino acid
  Variant (134)..(134): Xaa in position 134 is any amino acid
  Variant (148)..(148): Xaa in position 148 is any amino acid
MXXXDXLEQFXQXYXXGXKWXRCVEAIXNXXXIXXGVXHSIGDSLXYXXXXXXXXXXXXFXGXRRYFXVHYYLXGXXXXEXAXKXXLXXXXXYRDETDREXXXGXGEXXXXXXGQXXIXXXXXAYRFXXXXXVXKVVLKVTIEDGYFXNK

SEQ ID NO: 71506 - protein, 56 aa, Artificial sequence
  protein pattern
  Variant (2)..(2): Xaa in position 2 is any amino acid
  Variant (3)..(3): Xaa in position 3 is Ile or Val
  Variant (4)..(4): Xaa in position 4 is Ile or Leu
  Variant (5)..(5): Xaa in position 5 is Asp or Asn
  Variant (6)..(6): Xaa in position 6 is Asn or Ser
  Variant (8)..(8): Xaa in position 8 is Ala or Glu
  Variant (11)..(11): Xaa in position 11 is Lys or Arg
  Variant (12)..(12): Xaa in position 12 is any amino acid
  Variant (13)..(13): Xaa in position 13 is Ile or Val
  Variant (15)..(15): Xaa in position 15 is any amino acid
  Variant (16)..(16): Xaa in position 16 is Asn or Ser
  Variant (18)..(18): Xaa in position 18 is Lys or Arg
  Variant (21)..(21): Xaa in position 21 is Asn or Gln
  Variant (28)..(28): Xaa in position 28 is Glu, Gly or Asn
  Variant (30)..(30): Xaa in position 30 is any amino acid
  Variant (31)..(31): Xaa in position 31 is any or no amino acid
  Variant (33)..(33): Xaa in position 33 is any or no amino acid
  Variant (35)..(35): Xaa in position 35 is any amino acid
  Variant (36)..(36): Xaa in position 36 is Asp, Glu or Pro
  Variant (39)..(39): Xaa in position 39 is any amino acid
  Variant (47)..(47): Xaa in position 47 is Thr or Val
  Variant (49)..(49): Xaa in position 49 is any amino acid
  Variant (50)..(50): Xaa in position 50 is any or no amino acid
  Variant (52)..(52): Xaa in position 52 is Glu or Gln
  Variant (53)..(53): Xaa in position 53 is Asp, Gly, Asn or Thr
  Variant (54)..(54): Xaa in position 54 is Asp, Gly or Ser
  Variant (55)..(55): Xaa in position 55 is any amino acid
  Variant (56)..(56): Xaa in position 56 is Ala, Gln or Thr
MXXXXXLXQFXXXYXXGXKWXRCVEAIXNXXNXIXXGVXHSIGDSLXYXXVXXXXX

SEQ ID NO: 71507 - protein, 57 aa, Artificial sequence
  protein pattern
  Variant (8)..(8): Xaa in position 8 is any amino acid
  Variant (9)..(9): Xaa in position 9 is Phe or Leu
  Variant (10)..(10): Xaa in position 10 is any amino acid
  Variant (12)..(12): Xaa in position 12 is any amino acid
  Variant (15)..(16): Xaa in position 15 to 16 is any amino acid
  Variant (17)..(17): Xaa in position 17 is Glu or Gln
  Variant (18)..(18): Xaa in position 18 is Leu or Val
  Variant (19)..(19): Xaa in position 19 is any amino acid
  Variant (20)..(20): Xaa in position 20 is Glu or Gln
  Variant (23)..(23): Xaa in position 23 is Ile or Val
  Variant (24)..(24): Xaa in position 24 is Ala or Val
  Variant (26)..(26): Xaa in position 26 is any amino acid
  Variant (27)..(27): Xaa in position 27 is Asp or Glu
  Variant (28)..(29): Xaa in position 28 to 29 is any amino acid
  Variant (30)..(30): Xaa in position 30 is Glu or Lys
  Variant (35)..(35): Xaa in position 35 is any amino acid
  Variant (36)..(36): Xaa in position 36 is Cys or Gly
  Variant (37)..(37): Xaa in position 37 is Asp or Asn
  Variant (38)..(38): Xaa in position 38 is Asn or Gln
  Variant (39)..(39): Xaa in position 39 is any amino acid
  Variant (41)..(41): Xaa in position 41 is Lys or Arg
  Variant (55)..(55): Xaa in position 55 is any amino acid
RDETDREXXXGXGEXXXXXXGQXXIXXXXXAYRFXXXXXVXKVVLKVTIEDGYFXNK

SEQ ID NO: 71508 - protein, 29 aa, Artificial sequence
  protein pattern
  Variant (2)..(3): Xaa in position 2 to 3 is any or no amino acid
  Variant (5)..(5): Xaa in position 5 is any amino acid
  Variant (10)..(10): Xaa in position 10 is Asp or Glu
  Variant (16)..(16): Xaa in position 16 is Glu or Gln
  Variant (18)..(18): Xaa in position 18 is any amino acid
  Variant (19)..(19): Xaa in position 19 is Glu or Gln
  Variant (20)..(20): Xaa in position 20 is any amino acid
  Variant (21)..(21): Xaa in position 21 is Ile or Val
  Variant (23)..(23): Xaa in position 23 is Phe or Tyr
  Variant (25)..(25): Xaa in position 25 is Ala, Asp or Pro
  Variant (27)..(27): Xaa in position 27 is Glu, Ser or Thr
  Variant (28)..(28): Xaa in position 28 is Ala, Glu or Thr
TXXGXRRYFXVHYYLXGXXXXEXAXKXXL

SEQ ID NO: 71509 - DNA, 561 bp, Escherichia coli
  CDS (1)..(561)
atgatgacaaggcaggcatcaatgaaaggcttcccaattgcgcatatttttcacccttcaatcccgccaatgcacgcagtggttaacaatcacaatagaaatattgattattggacggtaaaaagaaagtttgcagaaattgtctccaccaatgacgttaataaaatttacagtataagtaatgaactgcggagagtattatctgcaataactgcattgaatttctatcatggcgatgttccttctgtcatgatccgaatccaaccggaaaatatgagtccattcattatagatatttctacaggagaacatgatgattatatcatacaaacattagatgtaggcacttttgcaccttttggtgaacaatgtacttgctcagccgtcaataaaaaagagctggaatgtattaaggagacgatttctaagtattgtgcaaaattcacccgaaaagaagccatcttaaccccccttgtgcactttaataaaaccagcattacttcagattgttggcaaattctctttttttcacccgatcattttaataatgatttttattga

SEQ ID NO: 71510 - protein, 186 aa, Escherichia coli
MMTRQASMKGFPIAHIFHPSIPPMHAVVNNHNRNIDYWTVKRKFAEIVSTNDVNKIYSISNELRRVLSAITALNFYHGDVPSVMIRIQPENMSPFIIDISTGEHDDYIIQTLDVGTFAPFGEQCTCSAVNKKELECIKETISKYCAKFTRKEAILTPLVHFNKTSITSDCWQILFFSPDHFNNDFY

SEQ ID NO: 71511 - DNA, 22 bp, Artificial sequence
  primer
atgatgacaaggcaggcatcaa

SEQ ID NO: 71512 - DNA, 28 bp, Artificial sequence
  primer
ttaataaaaatcattattaaaatgatcg

SEQ ID NO: 71513 - DNA, 2382 bp, Escherichia coli
  CDS (1)..(2382)
atgttaaaaaaaacgttactggcctacaccattggttttgccttttctcccccagccaatgcagatggtatagagattgccgctgttgattttgatcgggaaacattaaaatcactaggtgtagatcctaatatatcgcattatttttcccgttcagcccgttttttgccaggtgaatattcactgatagtatcagtaaatggcgaaaaaaaaggcaacattgctacgcgctttgatgaaaatggcgacatttgtcttgatcaggcatttctgcaacaagccggtttaaaaattccttctgaagaaaaaaatggctgttacgactatatattgtcctacccgggtaccacaatcacaccattacctaaccaggaagcgttagatattatcgtttcaccacaggcgatcattcccatagggttggatctcacaaacgcagcaactggtggaacagctgcgctgctaaactactctctgatgagcagccgtgcagaattttctaatgggagttcggactactcccaggctgcacttgaaggcgggattaatattaatgactggatgttacgcagccatcagttccttacacaaacaaatggcacattcagtaaccagaactcgtcaacctaccttcaacgtacctttacagatcttaaaacactcatgcgagcaggtgaagttaacctcaataatagcgtgttggaaggagccagtatttacggtatcgaaatcgcaccggacaacgcattgcaaaccagcggcagtggtgtgcaagttactggtatagccaacacctctcaggctcgtgtcgagattcgtcaacaaggagttttaattcattccattctggttcctgcgggcgcattcactatccctgatgtacctgttcgcaatggtaatagtgatcttaatgtcaccgttgtcgaaacagacggtagttcgcacaactatattgttccctccaccctgtttaatcagcatgtagaaagcttccagggttatcgcttcgcgatagggcgggtagacgatgactatgacgaatcaccttgggtaattagtgcatcgagcggatggaatctgacacgctggagtgcaatgaacggcggcgttatcgtagcagaaaattatcaggcggcatcaatccggtcgagtctggttcccctgcccgatttaacagtgagcagccaaattagtacatcgcaggatacgaaagactcactgcaaggacagaaatatcgtcttgacgcgaactacaatctcccattttcacttgggctaacaaccagcctcactcgatctgatcgccattatcgcgaactgtctgaagcgattgatgatgattataccgatccgactaaaagcacttatgcgcttggtttaaactggtctaactccattctgggtggtttcaacatcagtggctataaaacatatagttacgacggtgacaatgactcaagcaaccttaatattaactggaacaaagcgttcaaacacgccacggtttccgtcaactggcagcatcaacttagtgcttcagaaaataatgaagacgatggtgatctgttctacgtcaacatcagtattccatttggcagatcaaacaccgccacactgtatactcgccatgacgatcataaaacccactatggtactggtgtcatgggagtcgtctcagatgagatgtcctactatgtgaatgctgaacgagatcacgacgaacgtgaaacgagcttgaacggcagtatcagttccaatctccattacacccaagtcagccttgccgcaggagcaagcggcagtgatagccgtacttacaacggtacgatgtcaggtggtattgccgtacatgatcagggagtgaccttttcaccgtggactatcaatgacactttcgccatcgcaaaaatggataacaatattgcaggtgtcagaattacatctcaggcaggcccagtatggacagattttcggggtaatgccgtcattccatcaatccagccgtggcgaacatcaggagttgagatcgataccgccagcttgccaaaaaatgtcgatatcggtaacggcacaaaaatgatcaaacaaggccgtggtgcagtagggaaagtcggattcagtgcgataacacaacgccgtgcattactcaatatcacactttccgacggcaaaaaactgcccagaggcgttgcgattgaagatagtgaaggcaactatctgacaacatcagtggatgacggtgttgtattcctcaataacatcaaaccggacatggtgctagatataaaagatgagcagcaatcatgccgtattcaccttacattcccagaagatgcaccaaaagatgtgttctatgagacagcaacaggagagtgccaatga

SEQ ID NO: 71514 - protein, 793 aa, Escherichia coli
MLKKTLLAYTIGFAFSPPANADGIEIAAVDFDRETLKSLGVDPNISHYFSRSARFLPGEYSLIVSVNGEKKGNIATRFDENGDICLDQAFLQQAGLKIPSEEKNGCYDYILSYPGTTITPLPNQEALDIIVSPQAIIPIGLDLTNAATGGTAALLNYSLMSSRAEFSNGSSDYSQAALEGGININDWMLRSHQFLTQTNGTFSNQNSSTYLQRTFTDLKTLMRAGEVNLNNSVLEGASIYGIEIAPDNALQTSGSGVQVTGIANTSQARVEIRQQGVLIHSILVPAGAFTIPDVPVRNGNSDLNVTVVETDGSSHNYIVPSTLFNQHVESFQGYRFAIGRVDDDYDESPWVISASSGWNLTRWSAMNGGVIVAENYQAASIRSSLVPLPDLTVSSQISTSQDTKDSLQGQKYRLDANYNLPFSLGLTTSLTRSDRHYRELSEAIDDDYTDPTKSTYALGLNWSNSILGGFNISGYKTYSYDGDNDSSNLNINWNKAFKHATVSVNWQHQLSASENNEDDGDLFYVNISIPFGRSNTATLYTRHDDHKTHYGTGVMGVVSDEMSYYVNAERDHDERETSLNGSISSNLHYTQVSLAAGASGSDSRTYNGTMSGGIAVHDQGVTFSPWTINDTFAIAKMDNNIAGVRITSQAGPVWTDFRGNAVIPSIQPWRTSGVEIDTASLPKNVDIGNGTKMIKQGRGAVGKVGFSAITQRRALLNITLSDGKKLPRGVAIEDSEGNYLTTSVDDGVVFLNNIKPDMVLDIKDEQQSCRIHLTFPEDAPKDVFYETATGECQ

SEQ ID NO: 71515 - DNA, 2409 bp, Salmonella typhimurium LT2
  CDS (1)..(2409): transl_table=11
gtgaagtatttaaaactgccgctatacatcaaaactgcgctttattgctcactggcaaccacgacgttttcagctctggcggaggagctgaattttgacatgggtattctcacctccagaggcattagccccaacgtcgcacaatatttttcccgcgcgccgcgctttctaccaggcagccacaccgtcatggtaaagatcaatggcgtaaatagagggtcgttggtcgcgcgtttcgacacagaaggccagctttgcgtggatgacgatttcctcagcgccagcgggctcgtttcgcttaatatcagcgccaaagaaacctgccatagcctacaagaagattatccctcagcgattattaccccactgccaaacagtgaatcgctggagctttttgttccggcacaggctctggataataacttactatcgctaaacaacgtgattaaaggcggcaccgccgggttatttaactataacctgtacgccagtcgcagcgagtcatccggtagcgatagccgaaactatgcccaggcaaaccttgaagctggcttaaacttcgcggaatggacgctgcgcagccgctacatgctgacgaataatgatggagaataccgtaccgatagtctatatacctatgcggagcacgtatttcaggcacaaaaaatgcgtgcgcaagttgggcagatcaacgtcaactccagtctattcagtggcgcgccgatcaacggcgtacagcttatccctgaacaagggctggcacaggatacacaaggcgtaaccattaacggtattgcccgaacccaccaggctcgcgttgaagttcgtcagtccggacagattatttataccgcaccagtgaacgctggggcatttacccttgaaaatgtccccatcatacgcagcaataccgaccttaacgtcagcgtcgttgaaaccgatggctcaacgacaaccttcacggtgccggcagtatcctttaatttacgcgaactcacgcccgcaggcttaacaatgtccatagggcgcatacgtgataccaccagcgactattcgctcccctggatctataacatcagcgatggttggaaactgagtgaaaactggctggcgcaggcgtctggcgtactggcacaagactatcaagcggcaggagggatgctgcaatggcttccaaccaataaatggacgttttccggctcaatgctgggcagtaaagcgtcctttggcgaatctctgcagggtgcgaaaagtgaactacgcgccagcatggcgctgcccggggaaattagacttgacgtcagtaccgcccgctacagcgacggatatcgtgagttaacggatgcgctcaataaagatgcttacgaatatcaaagtagctccagtgctaatattgcctggaaccataatctgttaggtaccttctctctgggttattacacttatcaggctacggataatgacaacgactctcgcagtataatggcttcctggggcaaaacgtttaaatatgcctcaattaccgctaactggcagcacgctgttaatcaggatgatgagaatcataacgacagtaatgatgatgatatgttttacatcaacatcagcattccactaggtgagcagcgcgtcggcgcttatatgcgtaatcaaggtgataaaacaacctacgggctacaaaataatggttcgctgagtaaagatacccattactatatttctgcggatcgtgatgcaaaaaaccagcaaaatagcttcaacggtaatctcaatagcaatcttcattacactcaactcagcgtgggcggcggcactgatggcgataattaccgcaactataacgcaaccttcagcggaggcatcgctgcacacgaacatggcataacgttctcgccttatacaatcaaaaatacctttgctatcgcacgcctgagtgaaccagaaagcggcattgaaatcgccacgccacaggggcgaatctggactgaccactgggggcaagccgtcattccggggctaactgaatggcggaaatcccgcgtagaggttaatgcgaatacgctaccaaagagtatggaactggcaaacggtattaagaatattaccgtcgcgcacagcgcttttcgggtactggatttcaacgtgctgaatacacgccgtgtgatgctggcagtaaagcgtccggatggctcatggctacctaaaggcaccagcattgtagatgaaaaaaataactatttggtcagcgctgtcgacagcggacgcgtatttatcaccgatgttggggataatcctgcgttatatgccgctgatgatgatatgaatcgtctgtgtcgcatccactacacgctgcagaaaacccaggataaagaggcattttatgaaacggcaaagggagtctgtcaatga

SEQ ID NO: 71516 - protein, 802 aa, Salmonella typhimurium LT2
MKYLKLPLYIKTALYCSLATTTFSALAEELNFDMGILTSRGISPNVAQYFSRAPRFLPGSHTVMVKINGVNRGSLVARFDTEGQLCVDDDFLSASGLVSLNISAKETCHSLQEDYPSAIITPLPNSESLELFVPAQALDNNLLSLNNVIKGGTAGLFNYNLYASRSESSGSDSRNYAQANLEAGLNFAEWTLRSRYMLTNNDGEYRTDSLYTYAEHVFQAQKMRAQVGQINVNSSLFSGAPINGVQLIPEQGLAQDTQGVTINGIARTHQARVEVRQSGQIIYTAPVNAGAFTLENVPIIRSNTDLNVSVVETDGSTTTFTVPAVSFNLRELTPAGLTMSIGRIRDTTSDYSLPWIYNISDGWKLSENWLAQASGVLAQDYQAAGGMLQWLPTNKWTFSGSMLGSKASFGESLQGAKSELRASMALPGEIRLDVSTARYSDGYRELTDALNKDAYEYQSSSSANIAWNHNLLGTFSLGYYTYQATDNDNDSRSIMASWGKTFKYASITANWQHAVNQDDENHNDSNDDDMFYINISIPLGEQRVGAYMRNQGDKTTYGLQNNGSLSKDTHYYISADRDAKNQQNSFNGNLNSNLHYTQLSVGGGTDGDNYRNYNATFSGGIAAHEHGITFSPYTIKNTFAIARLSEPESGIEIATPQGRIWTDHWGQAVIPGLTEWRKSRVEVNANTLPKSMELANGIKNITVAHSAFRVLDFNVLNTRRVMLAVKRPDGSWLPKGTSIVDEKNNYLVSAVDSGRVFITDVGDNPALYAADDDMNRLCRIHYTLQKTQDKEAFYETAKGVCQ

SEQ ID NO: 71517 - DNA, 2379 bp, Yersinia pestis KIM
  CDS (1)..(2379): transl_table=11
gtggtcgcccgttgtattaatctccagtgtatcgcattcttattctctttttttcctacgctggctttccctgtcacagaagagggtgaggtggtttttgacatagaaacgctggagagattaggttattcagctgaattggcaaaattcttcagcggtcaggatagatttctacccggccaacatgatgtcactatcattattaatgccagcaagacctaccgtattgcagcgaccttcgatagcgaagggaaactgtgtatggataaagcattactgatggccttgaaattacgaaatacagagagtgacggcagttgtgagaatatggaagcccggtggccgggtatggttgttaaactctttcccggccagttccgggtggaaataacattgccgcaagaggcgtttgatcccgaaatggaaggaagtgagtatcagcaaggagggcatgcactattgcttaattacaatatctttggccaacgggtcgaaagtaacaatagccgctttaatcttgttcaggggcaatttgaaccggggattaattttaaaaattgggtactgagaaaccgaggttcctacagttataatcaaggagtgagccaatactataatcaggaaacctctgctttacgcgcggttgaatcattgaaatccgtggttcaactgggtgaatttggtttagtgggtaacaccttttctggtttacccgtaaccggcattcagttgtattccgataacgcacaacgggatgatacacaattgatcgtacccatcgaggggattgccaataccaatgccaccattgaaatccgtcagcgtgggcgggttatttatcgtaccatagtggcaccaggtcctttttcgttatccaatatcagtaacttctcaagtggtgttaacaccgatgtcagtattatcgaagaggatggcactcaacagaattttacggtgacgagcgcccttgatattaacgctgaacaacaggcatccatctaccaactggccgtgggccgttaccgggacatgtttaccggtgaggacaggccgtcaccgctgctgctttccggagaaatgtcattcaatccggcggctaccttttatatgacgtcggctgggttactgtcctctggctatcaaaatatccgtgtgcaaaatctttacagtggatgggatcaggcctggttttcagcggcagcaagttatgctaataccaaagatgcaggacagggataccaatttagcgttcagaatcagatgacgattaacggtaattttggtgtttcatggtcctcggtttatggctcggccaattactggttaccggatgatgccctaagcagtagcaataatctgaatgacctgatgtttggaaaattaaaaaatgcaacgtcggtagccgtgagctgggtgcacccacgttggggggcattctcctatgctttatcaaataatatgtattatcaggcttctggtcgtacttaccatattttctcaattagcgaacaatttggccgggcgactaccatcttgagttctcaattaagttcgcaagggcaaaattcgctctatgttggtatcaatatgccattgggtaatgggacgttaagtggccgggtgcaacgtaacaatggcaatgtggcacttggtagtacttatcaagggcgatggggtgacaacaaagattattcggtagggatcagcggtgacaataggcaacggcgtatcaatggttcgatgaatataaggacggcctattcacaattaaccggtggggtttctcaagcgacaaacaatagccggtctgcatatctgtcatcgcgtggttcagtggcttacgtgaataacacctttgccacatcgtcgtcatcggttggcgatacttttgcggtggtgaacatacccaaccaacccggtttgcgcgtttcatcgccgagcagcggtattgcgattacggattatgctgggatagccttgctgccattagtgaggccttacaccgcttcgaaagtacaaataagcacgcaaacattgccgctgaatattcggcttaataacaccagtgccgatttgctgatgactcgaggctcggtagcaacccatcattttgagacaacagaaacccgccaattgctgctaaccatccgtggtagtgatggtgaaatgctgccgattggtgccaatgtattggatgaaaaaggtaactttctggggacgattatcggtgacggaaactttatgctggaaaataaggcgattggcgtgacattacgtgttaaggcaaataaccgcgatgaatgtcgcgttaactaccgtgaacctgaaaaatttgaccccgatgtattgtatgaagttgccgatgcggtctgtcagtaa

SEQ ID NO: 71518 - protein, 792 aa, Yersinia pestis KIM
MVARCINLQCIAFLFSFFPTLAFPVTEEGEVVFDIETLERLGYSAELAKFFSGQDRFLPGQHDVTIIINASKTYRIAATFDSEGKLCMDKALLMALKLRNTESDGSCENMEARWPGMVVKLFPGQFRVEITLPQEAFDPEMEGSEYQQGGHALLLNYNIFGQRVESNNSRFNLVQGQFEPGINFKNWVLRNRGSYSYNQGVSQYYNQETSALRAVESLKSVVQLGEFGLVGNTFSGLPVTGIQLYSDNAQRDDTQLIVPIEGIANTNATIEIRQRGRVIYRTIVAPGPFSLSNISNFSSGVNTDVSIIEEDGTQQNFTVTSALDINAEQQASIYQLAVGRYRDMFTGEDRPSPLLLSGEMSFNPAATFYMTSAGLLSSGYQNIRVQNLYSGWDQAWFSAAASYANTKDAGQGYQFSVQNQMTINGNFGVSWSSVYGSANYWLPDDALSSSNNLNDLMFGKLKNATSVAVSWVHPRWGAFSYALSNNMYYQASGRTYHIFSISEQFGRATTILSSQLSSQGQNSLYVGINMPLGNGTLSGRVQRNNGNVALGSTYQGRWGDNKDYSVGISGDNRQRRINGSMNIRTAYSQLTGGVSQATNNSRSAYLSSRGSVAYVNNTFATSSSSVGDTFAVVNIPNQPGLRVSSPSSGIAITDYAGIALLPLVRPYTASKVQISTQTLPLNIRLNNTSADLLMTRGSVATHHFETTETRQLLLTIRGSDGEMLPIGANVLDEKGNFLGTIIGDGNFMLENKAIGVTLRVKANNRDECRVNYREPEKFDPDVLYEVADAVCQ

SEQ ID NO: 71519 - DNA, 2385 bp, Burkholderia pseudomallei K96243
  CDS (1)..(2385): transl_table=11
gtgtacgcaagacggttggtcctgtcgtttagcttgctcctcggcatcgcatggggaagcaacgacgcactcgccgtctcgtcgccttcgcccagcgcggcggttgaattcgacacccaaacgctgattgcgcgaggctattccgccgacattgcaaaattcttcagcggcgattcgcgctttctccccggcaagcaggaggtcacgatcgcactcaacgccaaccagacctacacgacgaacgttcaatttgatgacgacggcgatccgtgcttcgacgccgcgctgttggacacgctgcgactgcgcaaaccatccgatctggccggctgcgccgatcccgaacaaatgtggccggaatttcacatgaaactccaccctgggcagtttcgaatcgacatgaccgtgccggaggaagcattcgacccacggcgacgcggcaacggactgcactccggcggcgaggcggtgttactgaattacgatgtcttcgcgcagcgcttcgatacccggttcggcagcagccattacttacaggcacggctcgagcccggcttcaatatcggaaactggtttttccgtaaccgtggagcgctgacccattcaggcaagggattctcgtatcagttgcaagacacctacctcgcgcgtaccgtcgacgcgtggggggccatcacgcagatcggccagttcacgtccacaggcgaaaatctgggcggcctgccgatgctcggcttccagatcagttcggaccgcttgcaaaatagcgggcaactgaccgttcccatccaaggcatcgcggaaagcaacgcgacggtcgaagtgcgtcagcgcggccgtgtcgtctatcgcacgatcgtcccgcccgggcctttcatgctgtccgacatcggcagcgtcgcgcagaacgccgacctccaaatcgaaatcaccgaacaggacggacgaaagcgacgcttcgagatgcccgtcggcatgggctatgccgacgcgaagcagccgacgacttggcaggccgccatcggccgctatcaggatgcaggcaattccgatcgaacgcgtgcacccgcgatattcgccaccggtgaaatctctttctcaccgctcgacaatctacgcgtgtcgaccgccgcgctcgcggcctccggctatcttcatgcgagcgtccaaggaacgctttcggcgaaatccggagcatggcttgcaagcggagtgcgctattcgcggatggctggcgcgggccaaggatatcagttcgagttacaaggctcgtcccgaatcggaggaaacgtgttcgcatccgcctcatggctgtcgcgctcgattcgctataccacgccagatgtcgcgctcggatcgcttggcgatgcaaccggaaccggtcaaaccaagcattcggcgaacgcgtcgatcaactgggcccatccgcgttggggtagctttacgtatggcctgtcgtacaacagtttcgtcggcgcaccgaactccgtatctcacacgctgagcatcggtcgcaagatcggtcgggcaaacgtcagccttgccgcacaaatcagccccaagagcggcagcagcgtctacgccaacgtgtcgattccgctaggcggtggttcgttgagtgcgcgaaccacgcgctcgcagcggggggatctcacgttcggcacgtcctacggcaatcgattgggacgagacggatcgtattccatcggcgcatcgggcagcaagagcggccagaccgcgaacgcgtccgtcagcatgaggacgggcttcgctcaatttggcgccggcgtggctcagagtacgtccaactcacggtctacctacctgtctgcaagcggaggcatcgcctacgccaatggactattcggcacggcatccagccggatcggggaaacgttcgccatcgtgtcggtcccgaaccaaaagggtttgcgcatcagcgcacctggtggaacgtccatcaccaacccattcggcaccgcagtcatctcttccctgacgccctacacgaaagcgcaactcagactcgatacgcaaagccttcccatgaatgtgcgtctcgacacgaccaccgtcgacatcgggctccgacggggcagcgtgctgacgcgcacgatccatgcagccgaaacgcgacagctcatgttgacgatacgagattcgaccggtgccaccgcaccggtcggcaccaccgtgcttgatgagcaaggccagttcctcggcacgatcatcggagatgggaacttcatcctgaatgacgacgacatcggtaggccgatcaggttgtcgggcgtcaatcgtagcgagtgccgcgtgacctacgaggcacccgcacggttcgatccaaatcagccttatgaagaggcagaaggaacatgcgggtga

SEQ ID NO: 71520 - protein, 794 aa, Burkholderia pseudomallei K96243
MYARRLVLSFSLLLGIAWGSNDALAVSSPSPSAAVEFDTQTLIARGYSADIAKFFSGDSRFLPGKQEVTIALNANQTYTTNVQFDDDGDPCFDAALLDTLRLRKPSDLAGCADPEQMWPEFHMKLHPGQFRIDMTVPEEAFDPRRRGNGLHSGGEAVLLNYDVFAQRFDTRFGSSHYLQARLEPGFNIGNWFFRNRGALTHSGKGFSYQLQDTYLARTVDAWGAITQIGQFTSTGENLGGLPMLGFQISSDRLQNSGQLTVPIQGIAESNATVEVRQRGRVVYRTIVPPGPFMLSDIGSVAQNADLQIEITEQDGRKRRFEMPVGMGYADAKQPTTWQAAIGRYQDAGNSDRTRAPAIFATGEISFSPLDNLRVSTAALAASGYLHASVQGTLSAKSGAWLASGVRYSRMAGAGQGYQFELQGSSRIGGNVFASASWLSRSIRYTTPDVALGSLGDATGTGQTKHSANASINWAHPRWGSFTYGLSYNSFVGAPNSVSHTLSIGRKIGRANVSLAAQISPKSGSSVYANVSIPLGGGSLSARTTRSQRGDLTFGTSYGNRLGRDGSYSIGASGSKSGQTANASVSMRTGFAQFGAGVAQSTSNSRSTYLSASGGIAYANGLFGTASSRIGETFAIVSVPNQKGLRISAPGGTSITNPFGTAVISSLTPYTKAQLRLDTQSLPMNVRLDTTTVDIGLRRGSVLTRTIHAAETRQLMLTIRDSTGATAPVGTTVLDEQGQFLGTIIGDGNFILNDDDIGRPIRLSGVNRSECRVTYEAPARFDPNQPYEEAEGTCG

SEQ ID NO: 71521 - DNA, 26 bp, Artificial sequence
  primer
atgttaaaaaaaacgttactggccta

SEQ ID NO: 71522 - DNA, 25 bp, Artificial sequence
  primer
ttattggcactctcctgttgctgtc

SEQ ID NO: 71523 - protein, 781 aa, Artificial sequence
  consensus sequence
  Variant (3)..(5): Xaa in position 3 to 5 is any amino acid
  Variant (7)..(9): Xaa in position 7 to 9 is any amino acid
  Variant (11)..(18): Xaa in position 11 to 18 is any amino acid
  Variant (21)..(23): Xaa in position 21 to 23 is any amino acid
  Variant (29)..(36): Xaa in position 29 to 36 is any amino acid
  Variant (38)..(47): Xaa in position 38 to 47 is any amino acid
  Variant (50)..(51): Xaa in position 50 to 51 is any amino acid
  Variant (53)..(54): Xaa in position 53 to 54 is any amino acid
  Variant (56)..(56): Xaa in position 56 is any amino acid
  Variant (58)..(60): Xaa in position 58 to 60 is any amino acid
  Variant (62)..(65): Xaa in position 62 to 65 is any amino acid
  Variant (67)..(74): Xaa in position 67 to 74 is any amino acid
  Variant (75)..(76): Xaa in position 75 to 76 is any or no amino acid
  Variant (78)..(84): Xaa in position 78 to 84 is any amino acid
  Variant (86)..(92): Xaa in position 86 to 92 is any amino acid
  Variant (94)..(105): Xaa in position 94 to 105 is any amino acid
  Variant (107)..(118): Xaa in position 107 to 118 is any amino acid
  Variant (119)..(119): Xaa in position 119 is any or no amino acid
  Variant (122)..(122): Xaa in position 122 is any amino acid
  Variant (124)..(124): Xaa in position 124 is any amino acid
  Variant (126)..(126): Xaa in position 126 is any amino acid
  Variant (129)..(133): Xaa in position 129 to 133 is any amino acid
  Variant (135)..(145): Xaa in position 135 to 145 is any amino acid
  Variant (146)..(146): Xaa in position 146 is any or no amino acid
  Variant (148)..(150): Xaa in position 148 to 150 is any amino acid
  Variant (152)..(152): Xaa in position 152 is any amino acid
  Variant (154)..(154): Xaa in position 154 is any amino acid
  Variant (156)..(158): Xaa in position 156 to 158 is any amino acid
  Variant (160)..(161): Xaa in position 160 to 161 is any amino acid
  Variant (163)..(180): Xaa in position 163 to 180 is any amino acid
  Variant (182)..(196): Xaa in position 182 to 196 is any amino acid
  Variant (198)..(207): Xaa in position 198 to 207 is any amino acid
  Variant (209)..(212): Xaa in position 209 to 212 is any amino acid
  Variant (214)..(238): Xaa in position 214 to 238 is any amino acid
  Variant (239)..(239): Xaa in position 239 is any or no amino acid
  Variant (241)..(242): Xaa in position 241 to 242 is any amino acid
  Variant (244)..(244): Xaa in position 244 is any amino acid
  Variant (247)..(247): Xaa in position 247 is any amino acid
  Variant (249)..(255): Xaa in position 249 to 255 is any amino acid
  Variant (257)..(258): Xaa in position 257 to 258 is any amino acid
  Variant (260)..(260): Xaa in position 260 is any amino acid
  Variant (262)..(280): Xaa in position 262 to 280 is any amino acid
  Variant (282)..(282): Xaa in position 282 is any amino acid
  Variant (285)..(310): Xaa in position 285 to 310 is any amino acid
  Variant (313)..(314): Xaa in position 313 to 314 is any amino acid
  Variant (316)..(347): Xaa in position 316 to 347 is any amino acid
  Variant (348)..(352): Xaa in position 348 to 352 is any or no amino acid
  Variant (354)..(383): Xaa in position 354 to 383 is any amino acid
  Variant (384)..(385): Xaa in position 384 to 385 is any or no amino acid
  Variant (388)..(406): Xaa in position 388 to 406 is any amino acid
  Variant (408)..(414): Xaa in position 408 to 414 is any amino acid
  Variant (416)..(420): Xaa in position 416 to 420 is any amino acid
  Variant (422)..(438): Xaa in position 422 to 438 is any amino acid
  Variant (439)..(445): Xaa in position 439 to 445 is any or no amino acid
  Variant (447)..(451): Xaa in position 447 to 451 is any amino acid
  Variant (453)..(453): Xaa in position 453 is any amino acid
  Variant (455)..(482): Xaa in position 455 to 482 is any amino acid
  Variant (483)..(483): Xaa in position 483 is any or no amino acid
  Variant (485)..(490): Xaa in position 485 to 490 is any amino acid
  Variant (492)..(500): Xaa in position 492 to 500 is any amino acid
  Variant (501)..(510): Xaa in position 501 to 510 is any or no amino acid
  Variant (512)..(516): Xaa in position 512 to 516 is any amino acid
  Variant (518)..(518): Xaa in position 518 is any amino acid
  Variant (520)..(527): Xaa in position 520 to 527 is any amino acid
  Variant (528)..(528): Xaa in position 528 is any or no amino acid
  Variant (530)..(536): Xaa in position 530 to 536 is any amino acid
  Variant (537)..(537): Xaa in position 537 is any or no amino acid
  Variant (539)..(550): Xaa in position 539 to 550 is any amino acid
  Variant (552)..(564): Xaa in position 552 to 564 is any amino acid
  Variant (565)..(566): Xaa in position 565 to 566 is any or no amino acid
  Variant (568)..(577): Xaa in position 568 to 577 is any amino acid
  Variant (579)..(590): Xaa in position 579 to 590 is any amino acid
  Variant (592)..(598): Xaa in position 592 to 598 is any amino acid
  Variant (600)..(601): Xaa in position 600 to 601 is any amino acid
  Variant (603)..(617): Xaa in position 603 to 617 is any amino acid
  Variant (621)..(636): Xaa in position 621 to 636 is any amino acid
  Variant (637)..(637): Xaa in position 637 is any or no amino acid
  Variant (639)..(641): Xaa in position 639 to 641 is any amino acid
  Variant (643)..(645): Xaa in position 643 to 645 is any amino acid
  Variant (647)..(647): Xaa in position 647 is any amino acid
  Variant (649)..(667): Xaa in position 649 to 667 is any amino acid
  Variant (670)..(698): Xaa in position 670 to 698 is any amino acid
  Variant (700)..(702): Xaa in position 700 to 702 is any amino acid
  Variant (704)..(709): Xaa in position 704 to 709 is any amino acid
  Variant (711)..(713): Xaa in position 711 to 713 is any amino acid
  Variant (715)..(715): Xaa in position 715 is any amino acid
  Variant (717)..(720): Xaa in position 717 to 720 is any amino acid
  Variant (722)..(726): Xaa in position 722 to 726 is any amino acid
  Variant (728)..(733): Xaa in position 728 to 733 is any amino acid
  Variant (735)..(755): Xaa in position 735 to 755 is any amino acid
  Variant (756)..(757): Xaa in position 756 to 757 is any or no amino acid
  Variant (760)..(773): Xaa in position 760 to 773 is any amino acid
  Variant (776)..(776): Xaa in position 776 is any amino acid
  Variant (778)..(780): Xaa in position 778 to 780 is any amino acid
FDXXXLXXXGXXXXXXXXFSXXXRFLPGXXXXXXXXNXXXXXXXXXXFDXXGXXCXDXXXLXXXXLXXXXXXXXXXCXXXXXXXPXXXXXXXPXXXXXXXXXXXXAXXXXXXXXXXXXXGGXAXLXNYXXXXXRXXXXXXXXXXXXQXXXEXGXNXXXWXXRXXXXXXXXXXXXXXXXXXTXXXXXXXXXXXXXXXGXXXXXXXXXXGXXXXGXXXXXXXXXXXXXXXXXXXXXXXXXXAXXEXRQXGXXXXXXXVXXGXFXXXXXXXXXXXXXXXXXXXEXDGXXXXXXXXXXXXXXXXXXXXXXXXXXGRXXDXXXXXXXXXXXXXXXXXXXXXXXXXXXXXXXXXXXXXYXXXXXXXXXXXXXXXXXXXXXXXXXXXXXXXXQGXXXXXXXXXXXXXXXXXXXSXXXXXXXYXXXXXAXXXXXXXXXXXXXXXXXXXXXXXXWXXXXXGXFXXXXXXXXXXXXXXXXXXXXXXXXXXXXXAXXXXXXQXXXXXXXXXXXXXXXXXXXYXXXXXPXGXXXXXXXXXRXXXXXXXXGXXXXXXXXXXXXYXXXXXXXXXXXXXXXNXXXXXXXXXXQXXXXXXXXXXXXRXXXXXXXGXXAXXXXXXXXXXXXXXXTFAXXXXXXXXXXXXXXXXXGXXXTXXXGXAXXXXXXXXXXXXXXXXXXXLPXXXXXXXXXXXXXXXXXXXXXXXXXXXXXRXXXLXXXXXXGXXXPXGXXXXDXXXXXLXXXXXXGXXXXXXXXXXXXXXXXXXXXXXXCRXXXXXXXXXXXXXXYEXAXXXC

SEQ ID NO: 71524 - protein, 58 aa, Artificial sequence
  protein pattern
  Variant (2)..(3): Xaa in position 2 to 3 is any amino acid
  Variant (4)..(5): Xaa in position 4 to 5 is any or no amino acid
  Variant (7)..(8): Xaa in position 7 to 8 is any amino acid
  Variant (9)..(10): Xaa in position 9 to 10 is any or no amino acid
  Variant (12)..(12): Xaa in position 12 is any amino acid
  Variant (13)..(13): Xaa in position 13 is Asp or Ser
  Variant (14)..(14): Xaa in position 14 is Ala or Pro
  Variant (15)..(15): Xaa in position 15 is Asp, Glu or Asn
  Variant (16)..(16): Xaa in position 16 is Ile, Leu or Val
  Variant (17)..(17): Xaa in position 17 is Ala or Ser
  Variant (18)..(18): Xaa in position 18 is any amino acid
  Variant (19)..(19): Xaa in position 19 is Phe or Tyr
  Variant (22)..(22): Xaa in position 22 is any amino acid
  Variant (23)..(23): Xaa in position 23 is Ala, Asp, Gln or Ser
  Variant (24)..(24): Xaa in position 24 is Ala, Asp, Pro or Ser
  Variant (30)..(31): Xaa in position 30 to 31 is any amino acid
  Variant (32)..(32): Xaa in position 32 is Asp, Glu, Ser or Thr
  Variant (33)..(33): Xaa in position 33 is Leu or Val
  Variant (34)..(34): Xaa in position 34 is any amino acid
  Variant (35)..(35): Xaa in position 35 is Ile or Val
  Variant (36)..(36): Xaa in position 36 is any amino acid
  Variant (37)..(37): Xaa in position 37 is Ile, Leu or Val
  Variant (39)..(39): Xaa in position 39 is Ala or Gly
  Variant (40)..(45): Xaa in position 40 to 45 is any amino acid
  Variant (46)..(46): Xaa in position 46 is Ala, Asn or Val
  Variant (47)..(47): Xaa in position 47 is Ala, Thr or Val
  Variant (48)..(48): Xaa in position 48 is any amino acid
  Variant (51)..(51): Xaa in position 51 is Asp, Glu, Ser or Thr
  Variant (52)..(52): Xaa in position 52 is Asp, Glu or Asn
  Variant (54)..(54): Xaa in position 54 is any amino acid
  Variant (55)..(55): Xaa in position 55 is Ile, Leu or Pro
  Variant (57)..(57): Xaa in position 57 is Phe, Leu, Met or Val
DXXXXTXXXXGXXXXXXXXFSXXXRFLPGXXXXXXXXNXXXXXXXXXXFDXXGXXCXD

SEQ ID NO: 71525 - protein, 53 aa, Artificial sequence
  protein pattern
  Variant (2)..(3): Xaa in position 2 to 3 is any amino acid
  Variant (5)..(6): Xaa in position 5 to 6 is any amino acid
  Variant (8)..(8): Xaa in position 8 is Asp, Gln, Arg or Ser
  Variant (10)..(10): Xaa in position 10 is any amino acid
  Variant (11)..(11): Xaa in position 11 is Ile, Leu or Val
  Variant (12)..(12): Xaa in position 12 is Ile or Val
  Variant (13)..(13): Xaa in position 13 is His or Tyr
  Variant (14)..(15): Xaa in position 14 to 15 is any amino acid
  Variant (16)..(16): Xaa in position 16 is Ile, Leu or Pro
  Variant (18)..(18): Xaa in position 18 is Ala, Asn or Pro
  Variant (19)..(19): Xaa in position 19 is Ala or Pro
  Variant (21)..(21): Xaa in position 21 is Ala or Pro
  Variant (23)..(23): Xaa in position 23 is any amino acid
  Variant (24)..(24): Xaa in position 24 is Ile or Leu
  Variant (25)..(25): Xaa in position 25 is Glu, Pro or Ser
  Variant (26)..(26): Xaa in position 26 is Asp or Asn
  Variant (27)..(27): Xaa in position 27 is Ile or Val
  Variant (28)..(28): Xaa in position 28 is Gly, Pro or Ser
  Variant (29)..(31): Xaa in position 29 to 31 is any amino acid
  Variant (32)..(32): Xaa in position 32 is Gly, Gln or Ser
  Variant (33)..(33): Xaa in position 33 is Gly or Asn
  Variant (34)..(34): Xaa in position 34 is Ala, Ser, Thr or Val
  Variant (35)..(35): Xaa in position 35 is Asp or Asn
  Variant (36)..(36): Xaa in position 36 is any amino acid
  Variant (37)..(37): Xaa in position 37 is Asp, Asn or Gln
  Variant (38)..(38): Xaa in position 38 is Ile or Val
  Variant (39)..(39): Xaa in position 39 is Glu, Ser or Thr
  Variant (40)..(40): Xaa in position 40 is Ile or Val
  Variant (41)..(41): Xaa in position 41 is any amino acid
  Variant (43)..(43): Xaa in position 43 is Glu, Gln or Thr
  Variant (46)..(49): Xaa in position 46 to 49 is any amino acid
  Variant (50)..(50): Xaa in position 50 is Phe or Tyr
  Variant (51)..(51): Xaa in position 51 is any amino acid
  Variant (52)..(52): Xaa in position 52 is Met or Val
  Variant (53)..(53): Xaa in position 53 is Pro or Thr
AXXEXXQXGXXXXXXXVXXGXFXXXXXXXXXXXXXXXXXXXEXDGXXXXXXXX

SEQ ID NO: 71526 - protein, 26 aa, Artificial sequence
  protein pattern
  Variant (2)..(8): Xaa in position 2 to 8 is any amino acid
  Variant (9)..(10): Xaa in position 9 to 10 is any or no amino acid
  Variant (12)..(15): Xaa in position 12 to 15 is any amino acid
  Variant (16)..(17): Xaa in position 16 to 17 is any or no amino acid
  Variant (20)..(20): Xaa in position 20 is any amino acid
  Variant (22)..(22): Xaa in position 22 is any amino acid
  Variant (23)..(23): Xaa in position 23 is Ala or Gly
  Variant (24)..(24): Xaa in position 24 is any amino acid
  Variant (26)..(26): Xaa in position 26 is Gly or Gln
RXXXXXXXXXDXXXXXXYEXAXXXCX

SEQ ID NO: 71527 - protein, 60 aa, Artificial sequence
  protein pattern
  Variant (3)..(3): Xaa in position 3 is any amino acid
  Variant (4)..(4): Xaa in position 4 is Asn or Ser
  Variant (5)..(5): Xaa in position 5 is Ile, Met or Val
  Variant (6)..(6): Xaa in position 6 is Asp, Glu or Arg
  Variant (7)..(7): Xaa in position 7 is Ile or Leu
  Variant (8)..(8): Xaa in position 8 is Ala, Asp, Gly or Asn
  Variant (9)..(9): Xaa in position 9 is Asn or Thr
  Variant (10)..(10): Xaa in position 10 is Gly or Thr
  Variant (11)..(13): Xaa in position 11 to 13 is any amino acid
  Variant (14)..(14): Xaa in position 14 is Ile or Leu
  Variant (15)..(17): Xaa in position 15 to 17 is any amino acid
  Variant (18)..(18): Xaa in position 18 is His or Arg
  Variant (19)..(19): Xaa in position 19 is Gly or Ser
  Variant (20)..(20): Xaa in position 20 is Ala or Ser
  Variant (21)..(21): Xaa in position 21 is Phe or Val
  Variant (22)..(25): Xaa in position 22 to 25 is any amino acid
  Variant (26)..(26): Xaa in position 26 is Phe or Ile
  Variant (27)..(27): Xaa in position 27 is any amino acid
  Variant (28)..(28): Xaa in position 28 is Ala, Thr or Val
  Variant (29)..(29): Xaa in position 29 is any amino acid
  Variant (30)..(30): Xaa in position 30 is Glu, Asn or Thr
  Variant (31)..(31): Xaa in position 31 is Gln or Thr
  Variant (33)..(33): Xaa in position 33 is Gln or Arg
  Variant (34)..(34): Xaa in position 34 is Ala, Leu or Val
  Variant (35)..(35): Xaa in position 35 is Leu or Met
  Variant (37)..(37): Xaa in position 37 is Ala, Asn or Thr
  Variant (38)..(38): Xaa in position 38 is Ile or Val
  Variant (39)..(40): Xaa in position 39 to 40 is any amino acid
  Variant (41)..(41): Xaa in position 41 is Pro or Ser
  Variant (42)..(42): Xaa in position 42 is Asp or Thr
  Variant (44)..(45): Xaa in position 44 to 45 is any amino acid
  Variant (46)..(46): Xaa in position 46 is Ala or Leu
  Variant (48)..(48): Xaa in position 48 is any amino acid
  Variant (50)..(50): Xaa in position 50 is Ala, Thr or Val
  Variant (51)..(51): Xaa in position 51 is Ala, Asn, Ser or Thr
  Variant (52)..(52): Xaa in position 52 is Ile or Val
  Variant (53)..(53): Xaa in position 53 is any amino acid
  Variant (55)..(55): Xaa in position 55 is Glu or Ser
  Variant (56)..(56): Xaa in position 56 is any amino acid
  Variant (57)..(57): Xaa in position 57 is Gly or Asn
  Variant (58)..(58): Xaa in position 58 is Asn or Gln
  Variant (59)..(59): Xaa in position 59 is Phe or Tyr
LPXXXXXXXXXXXXXXXXXXXXXXXXXXXXXRXXXLXXXXXXGXXXPXGXXXXDXXXXXL

SEQ ID NO: 71528 - protein, 33 aa, Artificial sequence
  protein pattern
  Variant (2)..(3): Xaa in position 2 to 3 is any amino acid
  Variant (4)..(8): Xaa in position 4 to 8 is any or no amino acid
  Variant (10)..(10): Xaa in position 10 is Glu, Gly or Ser
  Variant (11)..(12): Xaa in position 11 to 12 is any amino acid
  Variant (13)..(13): Xaa in position 13 is Ile, Met or Val
  Variant (14)..(14): Xaa in position 14 is any amino acid
  Variant (15)..(15): Xaa in position 15 is Leu or Pro
  Variant (16)..(16): Xaa in position 16 is any amino acid
  Variant (18)..(18): Xaa in position 18 is Gly or Asn
  Variant (19)..(19): Xaa in position 19 is Gln or Ser
  Variant (20)..(21): Xaa in position 20 to 21 is any amino acid
  Variant (22)..(22): Xaa in position 22 is Ile, Leu or Val
  Variant (23)..(23): Xaa in position 23 is Asp or Glu
  Variant (24)..(24): Xaa in position 24 is Ile, Leu or Met
  Variant (25)..(25): Xaa in position 25 is any amino acid
  Variant (26)..(26): Xaa in position 26 is Leu or Val
  Variant (27)..(27): Xaa in position 27 is Pro or Ser
  Variant (28)..(28): Xaa in position 28 is any amino acid
  Variant (29)..(29): Xaa in position 29 is Glu or Gln
  Variant (31)..(31): Xaa in position 31 is Phe, Ile or Leu
  Variant (32)..(32): Xaa in position 32 is any amino acid
  Variant (33)..(33): Xaa in position 33 is Asn or Pro
CXXXXXXXPXXXXXXXPXXXXXXXXXXXXAXXX

SEQ ID NO: 71529 - protein, 55 aa, Artificial sequence
  protein pattern
  Variant (2)..(3): Xaa in position 2 to 3 is any amino acid
  Variant (5)..(5): Xaa in position 5 is any amino acid
  Variant (6)..(10): Xaa in position 6 to 10 is any or no amino acid
  Variant (12)..(12): Xaa in position 12 is Phe or Ile
  Variant (13)..(13): Xaa in position 13 is any amino acid
  Variant (14)..(14): Xaa in position 14 is Asp, Glu or Asn
  Variant (16)..(16): Xaa in position 16 is any amino acid
  Variant (17)..(17): Xaa in position 17 is Phe or Leu
  Variant (19)..(19): Xaa in position 19 is Asn or Ser
  Variant (20)..(20): Xaa in position 20 is His or Arg
  Variant (21)..(23): Xaa in position 21 to 23 is any amino acid
  Variant (24)..(24): Xaa in position 24 is Ser or Thr
  Variant (25)..(25): Xaa in position 25 is any amino acid
  Variant (26)..(26): Xaa in position 26 is Asn, Ser or Thr
  Variant (27)..(27): Xaa in position 27 is Asp, Gly, Asn or Gln
  Variant (28)..(30): Xaa in position 28 to 30 is any amino acid
  Variant (31)..(31): Xaa in position 31 is Gln, Arg or Ser
  Variant (32)..(36): Xaa in position 32 to 36 is any amino acid
  Variant (38)..(38): Xaa in position 38 is any amino acid
  Variant (39)..(39): Xaa in position 39 is Ala or Leu
  Variant (40)..(40): Xaa in position 40 is any amino acid
  Variant (41)..(41): Xaa in position 41 is His or Arg
  Variant (42)..(42): Xaa in position 42 is Ala, Thr or Val
  Variant (43)..(43): Xaa in position 43 is Phe or Val
  Variant (44)..(44): Xaa in position 44 is Asp, Glu, Gln or Thr
  Variant (45)..(45): Xaa in position 45 is Ala, Asp or Ser
  Variant (46)..(50): Xaa in position 46 to 50 is any amino acid
  Variant (51)..(51): Xaa in position 51 is Gln or Arg
  Variant (52)..(52): Xaa in position 52 is Ala, Ile, Leu or Val
  Variant (54)..(54): Xaa in position 54 is Glu or Gln
  Variant (55)..(55): Xaa in position 55 is Phe, Ile or Val
LXXGXXXXXXNXXXWXXRXXXXXXXXXXXXXXXXXXTXXXXXXXXXXXXXXXGXX

SEQ ID NO: 71530 - protein, 59 aa, Artificial sequence
  protein pattern
  Variant (2)..(5): Xaa in position 2 to 5 is any amino acid
  Variant (6)..(6): Xaa in position 6 is any or no amino acid
  Variant (8)..(10): Xaa in position 8 to 10 is any or no amino acid
  Variant (12)..(12): Xaa in position 12 is Phe, Leu or Val
  Variant (13)..(13): Xaa in position 13 is Gly, Ser or Thr
  Variant (14)..(14): Xaa in position 14 is Ala, Gly, Leu or Val
  Variant (15)..(15): Xaa in position 15 is Ala or Gly
  Variant (16)..(16): Xaa in position 16 is Ala, Gly or Val
  Variant (17)..(17): Xaa in position 17 is Ala, Gly or Ser
  Variant (18)..(18): Xaa in position 18 is Ala, Gln or Thr
  Variant (19)..(19): Xaa in position 19 is Ala, Asp or Ser
  Variant (20)..(20): Xaa in position 20 is Gly or Thr
  Variant (21)..(21): Xaa in position 21 is Asp, Asn or Ser
  Variant (22)..(22): Xaa in position 22 is Asp or Asn
  Variant (23)..(23): Xaa in position 23 is any amino acid
  Variant (25)..(25): Xaa in position 25 is Asn, Ser or Thr
  Variant (26)..(27): Xaa in position 26 to 27 is any amino acid
  Variant (28)..(28): Xaa in position 28 is Ala, Gly or Leu
  Variant (29)..(29): Xaa in position 29 is Ser or Thr
  Variant (30)..(30): Xaa in position 30 is any amino acid
  Variant (31)..(31): Xaa in position 31 is Arg or Ser
  Variant (33)..(33): Xaa in position 33 is Gly or Ser
  Variant (34)..(34): Xaa in position 34 is Ile or Val
  Variant (36)..(37): Xaa in position 36 to 37 is any amino acid
  Variant (38)..(38): Xaa in position 38 is Asp, Glu or Asn
  Variant (39)..(40): Xaa in position 39 to 40 is any amino acid
  Variant (41)..(41): Xaa in position 41 is Phe, Ile or Val
  Variant (42)..(42): Xaa in position 42 is Ala, Gly or Thr
  Variant (43)..(43): Xaa in position 43 is any amino acid
  Variant (44)..(44): Xaa in position 44 is Ala or Ser
  Variant (45)..(45): Xaa in position 45 is Pro or Ser
  Variant (46)..(47): Xaa in position 46 to 47 is any amino acid
  Variant (48)..(48): Xaa in position 48 is Ile or Val
  Variant (49)..(49): Xaa in position 49 is any amino acid
  Variant (50)..(50): Xaa in position 50 is Asp, Glu or Asn
  Variant (54)..(54): Xaa in position 54 is Ile or Val
  Variant (55)..(55): Xaa in position 55 is Ala or Val
  Variant (56)..(56): Xaa in position 56 is any amino acid
  Variant (57)..(57): Xaa in position 57 is Ile, Leu, Met or Val
  Variant (58)..(58): Xaa in position 58 is Asp, Pro or Ser
  Variant (59)..(59): Xaa in position 59 is Glu or Asn
SXXXXXTXXXQXXXXXXXXXXXXRXXXXXXXGXXAXXXXXXXXXXXXXXXTFAXXXXXX

SEQ ID NO: 71531 - DNA, 339 bp, Escherichia coli
  CDS (1)..(339)
atgggttacaaaatgaatatttcatctctccgtaaagcgtttatttttatgggcgctgtagcggctttgtcactggtgaacgcacaatctgcgttggcagccaatgaatccgctaaagatatgacctgccaggaatttattgatctgaatccaaaagcaatgaccccggttgcatggtggatgctgcatgaagaaacagtatataaaggtggcgataccgttactttaaatgaaaccgatctcactcaaattcctaaagtgatcgaatactgtaagaaaaacccgcagaaaaatttgtataccttcaaaaatcaagcatctaatgacttgccgaattaa

SEQ ID NO: 71532 - protein, 112 aa, Escherichia coli
MGYKMNISSLRKAFIFMGAVAALSLVNAQSALAANESAKDMTCQEFIDLNPKAMTPVAWWMLHEETVYKGGDTVTLNETDLTQIPKVIEYCKKNPQKNLYTFKNQASNDLPN

SEQ ID NO: 71533 - DNA, 330 bp, Salmonella typhimurium LT2
  CDS (1)..(330): transl_table=11
atgaataaattctcccttgctacagcaggtattatcgtggcagcgctggtaaccagtgttagcgtgaatgcggcaacagatactactaaaacaaacgttacgcctaaaggtatgagctgccaggagtttgttgacctcaatccgcagacgatggcgccagtcgctttctgggtgctgaatgaagatgaagattttaaaggcggggactacgtagatttccaggaaactgagacgacagcagtgccgctagccgttgagctttgtaagaaaaacccgcagagtgaattaagcaaaataaaagacgaaatcaagaaagaactctcaaaataa

SEQ ID NO: 71534 - protein, 109 aa, Salmonella typhimurium LT2
MNKFSLATAGIIVAALVTSVSVNAATDTTKTNVTPKGMSCQEFVDLNPQTMAPVAFWVLNEDEDFKGGDYVDFQETETTAVPLAVELCKKNPQSELSKIKDEIKKELSK

SEQ ID NO: 71535 - DNA, 330 bp, Yersinia pestis KIM
  CDS (1)..(330): transl_table=11
atgtcctacaaatcactgcgtaatattgcactgactggtttgcttctttccaccgcggcaactacctttgcagcaacgccgacagggaccacaccaagtgatatgacttgcaaagagttcttggatctaaatcctaagtcatttactccggtagtttattgggtattgaacgatgatacccaatataaacaaggtgattatgttgatctgcatgagaccgatactctcgtgacacctaaagtggtcgaggtatgtaagaaggccccagaaagtaaactgtctgaaattaaacaggacattttaaatttcgccaaaaaacacaatatgtaa

SEQ ID NO: 71536 - protein, 109 aa, Yersinia pestis KIM
MSYKSLRNIALTGLLLSTAATTFAATPTGTTPSDMTCKEFLDLNPKSFTPVVYWVLNDDTQYKQGDYVDLHETDTLVTPKVVEVCKKAPESKLSEIKQDILNFAKKHNM

SEQ ID NO: 71537 - DNA, 27 bp, Artificial sequence
  primer
atgggttacaaaatgaatatttcatct

SEQ ID NO: 71538 - DNA, 25 bp, Artificial sequence
  primer
ttaattcggcaagtcattagatgct

SEQ ID NO: 71539 - protein, 100 aa, Artificial sequence
  consensus sequence
  Variant (2)..(4): Xaa in position 2 to 4 is any amino acid
  Variant (7)..(23): Xaa in position 7 to 23 is any amino acid
  Variant (25)..(34): Xaa in position 25 to 34 is any amino acid
  Variant (35)..(37): Xaa in position 35 to 37 is any or no amino acid
  Variant (39)..(39): Xaa in position 39 is any amino acid
  Variant (41)..(41): Xaa in position 41 is any amino acid
  Variant (44)..(44): Xaa in position 44 is any amino acid
  Variant (49)..(52): Xaa in position 49 to 52 is any amino acid
  Variant (55)..(56): Xaa in position 55 to 56 is any amino acid
  Variant (58)..(58): Xaa in position 58 is any amino acid
  Variant (60)..(65): Xaa in position 60 to 65 is any amino acid
  Variant (67)..(67): Xaa in position 67 is any amino acid
  Variant (70)..(70): Xaa in position 70 is any amino acid
  Variant (72)..(74): Xaa in position 72 to 74 is any amino acid
  Variant (77)..(81): Xaa in position 77 to 81 is any amino acid
  Variant (83)..(85): Xaa in position 83 to 85 is any amino acid
  Variant (87)..(87): Xaa in position 87 is any amino acid
  Variant (91)..(91): Xaa in position 91 is any amino acid
  Variant (93)..(95): Xaa in position 93 to 95 is any amino acid
  Variant (97)..(99): Xaa in position 97 to 99 is any amino acid
MXXXSLXXXXXXXXXXXXXXXXXAXXXXXXXXXXXXXMXCXEFXDLNPXXXXPVXXWXLXXXXXXKXGDXVXXXETXXXXXPXXXEXCKKXPXXXLXXXK

SEQ ID NO: 71540 - protein, 58 aa, Artificial sequence
  protein pattern
  Variant (2)..(2): Xaa in position 2 is Ser or Thr
  Variant (4)..(4): Xaa in position 4 is any amino acid
  Variant (7)..(7): Xaa in position 7 is Ile, Leu or Val
  Variant (12)..(12): Xaa in position 12 is any amino acid
  Variant (13)..(14): Xaa in position 13 to 14 is any or no amino acid
  Variant (16)..(17): Xaa in position 16 to 17 is any or no amino acid
  Variant (20)..(20): Xaa in position 20 is Ala or Val
  Variant (21)..(21): Xaa in position 21 is Phe, Trp or Tyr
  Variant (23)..(23): Xaa in position 23 is Met or Val
  Variant (25)..(25): Xaa in position 25 is any amino acid
  Variant (26)..(27): Xaa in position 26 to 27 is Asp or Glu
  Variant (28)..(28): Xaa in position 28 is Glu or Thr
  Variant (29)..(29): Xaa in position 29 is any amino acid
  Variant (30)..(30): Xaa in position 30 is Phe or Tyr
  Variant (32)..(32): Xaa in position 32 is Gly or Gln
  Variant (35)..(35): Xaa in position 35 is any amino acid
  Variant (37)..(37): Xaa in position 37 is Asp or Thr
  Variant (38)..(38): Xaa in position 38 is Phe or Leu
  Variant (39)..(39): Xaa in position 39 is any amino acid
  Variant (42)..(42): Xaa in position 42 is Asp or Glu
  Variant (43)..(46): Xaa in position 43 to 46 is any amino acid
  Variant (48)..(48): Xaa in position 48 is any amino acid
  Variant (49)..(49): Xaa in position 49 is Ala or Val
  Variant (50)..(50): Xaa in position 50 is Ile or Val
  Variant (52)..(52): Xaa in position 52 is any amino acid
  Variant (56)..(56): Xaa in position 56 is Ala or Asn
  Variant (58)..(58): Xaa in position 58 is Glu or Gln
MXCXEFXDLNPXXXTXXPVXXWXLXXXXXXKXGDXVXXXETXXXXXPXXXEXCKKXPX

SEQ ID NO: 71541 - DNA, 363 bp, Escherichia coli
  CDS (1)..(363)
atgtttctaaactatttcgcgttgggagtgctgatcttcgtctttctggtgattttttatggaatcatcgcgatacatgacatcccttatctgattgccaaaaagcgcaaccatccccatgccgacgctattcatacggcgggctgggtgagcctgtttactctgcatgttatctggccgtttctgtggatctgggcgacgctctatcaaccggagcgtggctggggtatgcagtcacatgttgcgtcgcaggagaaagcgactgacccggaaatcgccgcactttctgaccgaatttcccggctggagcatcaactcgccgccgagaaaaagactgactattccacgttcccggagatctaa

SEQ ID NO: 71542 - protein, 120 aa, Escherichia coli
MFLNYFALGVLIFVFLVIFYGIIAIHDIPYLIAKKRNHPHADAIHTAGWVSLFTLHVIWPFLWIWATLYQPERGWGMQSHVASQEKATDPEIAALSDRISRLEHQLAAEKKTDYSTFPEI

SEQ ID NO: 71543 - DNA, 390 bp, Vibrio cholerae O1 biovar eltor str. N16961
  CDS (1)..(390): transl_table=11
atgtttcttgattattttgcactcgggttgctgatcttcgtcgccctagtgattttctacggaattattgttatccacgacatcccttacgaaattgccaaagaacgcgaacacccacaccaagatgccattcattatgcaggctgggtaagtttattcactttgcacgccctttggccatttttgtggatttgggcaacattatggcgcaaagaacgtggctggggatttcagaaattggaagccgagcaacatgatattcaccatcgagtcgacgttttgattgatgaagtaaaacaattgcgtaccgaactagagacgttaaaaacttcttctctctcagtacctaaatctacccctgcggcatcaacatcagaggagaagcaataa

SEQ ID NO: 71544 - protein, 129 aa, Vibrio cholerae O1 biovar eltor str. N16961
MFLDYFALGLLIFVALVIFYGIIVIHDIPYEIAKEREHPHQDAIHYAGWVSLFTLHALWPFLWIWATLWRKERGWGFQKLEAEQHDIHHRVDVLIDEVKQLRTELETLKTSSLSVPKSTPAASTSEEKQ

SEQ ID NO: 71545 - DNA, 384 bp, Vibrio vulnificus CMCP6
  CDS (1)..(384): transl_table=11
atgtttctcgattatttcgcattgggattgcttgttttcgtcgctttagtgattttctacggcatcatcgtgattcacgatatcccttacgaaatcgctaaagaacgtgaacacccacatcaagacgctattcactacgcaggctgggtaagtttattcactctacacaccatttggcctttcctttggatctgggcaactttatggcgcaaagagcgcggttggggcttccaaaaactcgaagaagaacagcacgacatgcaccatcgtgttgatcaattaattgatgaagtcaaacagcttcgtgaggaagtggatcaattgagaaatgcgcaacgtgcgcctgccacgcccgtcgttaccagtgaagaggagaagcaataa

SEQ ID NO: 71546 - protein, 127 aa, Vibrio vulnificus CMCP6
MFLDYFALGLLVFVALVIFYGIIVIHDIPYEIAKEREHPHQDAIHYAGWVSLFTLHTIWPFLWIWATLWRKERGWGFQKLEEEQHDMHHRVDQLIDEVKQLREEVDQLRNAQRAPATPVVTSEEEKQ

SEQ ID NO: 71547 - DNA, 381 bp, Vibrio parahaemolyticus RIMD 2210633
  CDS (1)..(381): transl_table=11
atgtttctagactattttgcacttgggttactcatcttcgttgctttagttatcttctacggaatcattgttatccatgacatcccgtatgaaattgctaaagagcgtgaacacccgcaccaagacgcaattcactacgcaggttgggtcagcctgttcacactgcacgcactttggccattcctttggatatgggcaacattgtggcgcaaagagcgtggttggggtttcaaacaacttgagcaagaaacacacgacattcatcaccgtcttgaagaactcatcgacgaagtcaacgaactcaaaaacgaagtatcgatgttgaaacaacaaaagattcagcaaaagcctttgactgaacaaagtaaagaggacgaataa

SEQ ID NO: 71548 - protein, 126 aa, Vibrio parahaemolyticus RIMD 2210633
MFLDYFALGLLIFVALVIFYGIIVIHDIPYEIAKEREHPHQDAIHYAGWVSLFTLHALWPFLWIWATLWRKERGWGFKQLEQETHDIHHRLEELIDEVNELKNEVSMLKQQKIQQKPLTEQSKEDE

SEQ ID NO: 71549 - DNA, 384 bp, Vibrio vulnificus YJ016
  CDS (1)..(384): transl_table=11
atgtttctcgattatttcgcattgggattgcttgttttcgtcgctttagtgattttctacggcatcatcgtgattcacgatatcccttacgaaatcgctaaagaacgtgaacacccacatcaagacgctattcactacgcaggctgggtaagtttattcactctacacaccatttggcctttcctttggatctgggcaactttatggcgcaaagagcgcggttggggcttccaaaaactcgaagaagaacagcacgacatgcaccatcgcgtggatcaattaattgatgaagtcaaacagcttcgtgaggaagtggatcaattgagaaatgcgcaacgtgcgcctgccacgcccgtcattaccagtgaagaggagaagcaataa

SEQ ID NO: 71550 - protein, 127 aa, Vibrio vulnificus YJ016
MFLDYFALGLLVFVALVIFYGIIVIHDIPYEIAKEREHPHQDAIHYAGWVSLFTLHTIWPFLWIWATLWRKERGWGFQKLEEEQHDMHHRVDQLIDEVKQLREEVDQLRNAQRAPATPVITSEEEKQ

SEQ ID NO: 71551 - DNA, 348 bp, Colwellia psychrerythraea 34H
  CDS (1)..(348): transl_table=11
atgttagattattttgcattatttttagtgttttttgttattttagtgctgttttacggaatcatcgtagtacacgatatcccttatgaaattgcagttcaccgtcaacatccccatcaagatgcaattcatgttgccggttggatcagtttatttactttaggtgctatttggccgtttttatggatttgggcgaccttgtacaagccaggaatcggttggggtatggttcaccatacctctgatagcgatatcaaaacaagcaaattagaactagatattcttgaactacaaaagcaggtcgaattactagctaatagccaaattaaagaaaccaaagggatataa

SEQ ID NO: 71552 - protein, 115 aa, Colwellia psychrerythraea 34H
MLDYFALFLVFFVILVLFYGIIVVHDIPYEIAVHRQHPHQDAIHVAGWISLFTLGAIWPFLWIWATLYKPGIGWGMVHHTSDSDIKTSKLELDILELQKQVELLANSQIKETKGI

SEQ ID NO: 71553 - DNA, 381 bp, Vibrio sp. Ex25
  CDS (1)..(381)
atgtttctagactattttgcacttgggttactcatcttcgttgctttggtgatcttctacgggattatcgttattcacgatattccgtatgaaattgctaaagaacgcgaacaccctcatcaagacgcaattcattacgcaggctgggttagccttttcactttacatgcactgtggccatttttatggatatgggcaacattgtggcgcaaggagcgaggctggggcttcaaacaacttgagcaagaaactcacgacattcatcaccgtcttgaagagctcatcgacgaagtcaacgaactcaaaaacgaagtatcgatgttgaaacaacaaaagattcagcaaaggcctttgactgaacaaagtaaagaggacgaataa

SEQ ID NO: 71554 - protein, 126 aa, Vibrio sp. Ex25
MFLDYFALGLLIFVALVIFYGIIVIHDIPYEIAKEREHPHQDAIHYAGWVSLFTLHALWPFLWIWATLWRKERGWGFKQLEQETHDIHHRLEELIDEVNELKNEVSMLKQQKIQQRPLTEQSKEDE

SEQ ID NO: 71555 - DNA, 417 bp, Shewanella sp. ANA-3
  CDS (1)..(417): transl_table=11
atgtttttggattattttgccttaggcattttgttttttgtcatagtggtgatcttctatggcgtaattgccattcacgatatcccctatgaaattgcgaaaaaacgcaatcatccccagcaggatgcattgcatatcgcgggctgggtcagtttatttaccttgcatgccctttggccgtttctgtggatttgggcgaccttatatcgagaagatagaggctggggctttaataccgtgatgaagcgcgagcaggcattggaggatgatgttaaagcgctaagggaaacggtattggccttgcaggcaaagcttgaacaactggaatcgacagccaagcctgcggtggtgaagcaatccgaggcaatacccacagaagccagtgtgaccgaaactagccaaaaagccgaggtgtaa

SEQ ID NO: 71556 - protein, 138 aa, Shewanella sp. ANA-3
MFLDYFALGILFFVIVVIFYGVIAIHDIPYEIAKKRNHPQQDALHIAGWVSLFTLHALWPFLWIWATLYREDRGWGFNTVMKREQALEDDVKALRETVLALQAKLEQLESTAKPAVVKQSEAIPTEASVTETSQKAEV

SEQ ID NO: 71557 - DNA, 417 bp, Shewanella sp. MR-7
  CDS (1)..(417): transl_table=11
atgtttttggactattttgccttaggcattttattttttgtcattgtggtgattttttatggcgtgattgcgattcacgacatcccgtatgaaattgcgaaaaagcgcaatcatccccagcaggatgcattacatatcgccgggtgggtcagtttatttaccttacatgctatttggccatttttatggatttgggcgaccttgtatcgagaggatagaggctggggctttagcactgtgatgaagcgcgaagaggcattggaggatgatgttaaagcgctaagggaaacggtattggccttacagacaaagcttgagcgactcgaatcgacagccgctccagcggttgtaaaccatcaagctgcaatgacagcagaagctagtgtgaccgaaattagccaaaaagccgaggtataa

SEQ ID NO: 71558 - protein, 138 aa, Shewanella sp. MR-7
MFLDYFALGILFFVIVVIFYGVIAIHDIPYEIAKKRNHPQQDALHIAGWVSLFTLHAIWPFLWIWATLYREDRGWGFSTVMKREEALEDDVKALRETVLALQTKLERLESTAAPAVVNHQAAMTAEASVTEISQKAEV

SEQ ID NO: 71559 - DNA, 417 bp, Shewanella sp. MR-4
  CDS (1)..(417): transl_table=11
atgtttttggactattttgccttaggcattttattttttgtcattgtggtgattttttatggcgtgattgcgattcacgacatcccgtatgaaattgcgaaaaagcgcaatcatccccagcaggatgcattacatatcgccgggtgggtcagtttatttaccttacatgctatttggccatttttatggatttgggcgaccttgtatcgagaggatagaggctggggctttagcactgtgatgaagcgcgaagaggcattggaggatgatgttaaagcgctaagggaaacggtattggccttacagacaaagcttgagcgactcgaatcgacagccgctccagcggttgtaaaccatcaagctgcaatgacagcagaagctagtgtgaccgaagttagccaaaaagccgaggtataa

SEQ ID NO: 71560 - protein, 138 aa, Shewanella sp. MR-4
MFLDYFALGILFFVIVVIFYGVIAIHDIPYEIAKKRNHPQQDALHIAGWVSLFTLHAIWPFLWIWATLYREDRGWGFSTVMKREEALEDDVKALRETVLALQTKLERLESTAAPAVVNHQAAMTAEASVTEVSQKAEV

SEQ ID NO: 71561 - DNA, 324 bp, Escherichia coli O157
  CDS (1)..(324): transl_table=11
atgttcctggactattttgcactgggagtgcttatttttgtatttctggtgatattctatgggattattattttacatgatattccctacctgattgctaaaaaacgtaatcatcctcatgccgacgccattcatgttgctggttgggtgagtctttttacgctgcatgttatctggccatttttgtggatttgggccacgctttaccgcccggagcggggatggggaatgcaaagccatgattcatccgttatgcaactgcaacagcgcattgccgggctggagaaacagctcgccgacatcaaatcctcttctgccgagtaa

SEQ ID NO: 71562 - protein, 107 aa, Escherichia coli O157
MFLDYFALGVLIFVFLVIFYGIIILHDIPYLIAKKRNHPHADAIHVAGWVSLFTLHVIWPFLWIWATLYRPERGWGMQSHDSSVMQLQQRIAGLEKQLADIKSSSAE

SEQ ID NO: 71563 - DNA, 25 bp, Artificial sequence
  primer
atgtttctaaactatttcgcgttgg

SEQ ID NO: 71564 - DNA, 23 bp, Artificial sequence
  primer
ttagatctccgggaacgtggaat

SEQ ID NO: 71565 - protein, 108 aa, Artificial sequence
  consensus sequence
  Variant (10)..(10): Xaa in position 10 is any amino acid
  Variant (12)..(12): Xaa in position 12 is any amino acid
  Variant (15)..(16): Xaa in position 15 to 16 is any amino acid
  Variant (22)..(22): Xaa in position 22 is any amino acid
  Variant (24)..(24): Xaa in position 24 is any amino acid
  Variant (35)..(35): Xaa in position 35 is any amino acid
  Variant (37)..(37): Xaa in position 37 is any amino acid
  Variant (40)..(40): Xaa in position 40 is any amino acid
  Variant (44)..(44): Xaa in position 44 is any amino acid
  Variant (46)..(46): Xaa in position 46 is any amino acid
  Variant (57)..(58): Xaa in position 57 to 58 is any amino acid
  Variant (69)..(69): Xaa in position 69 is any amino acid
  Variant (71)..(72): Xaa in position 71 to 72 is any amino acid
  Variant (77)..(83): Xaa in position 77 to 83 is any amino acid
  Variant (84)..(93): Xaa in position 84 to 93 is any or no amino acid
  Variant (95)..(97): Xaa in position 95 to 97 is any amino acid
  Variant (99)..(100): Xaa in position 99 to 100 is any amino acid
  Variant (102)..(107): Xaa in position 102 to 107 is any amino acid
MFLDYFALGXLXFVXXVIFYGXIXIHDIPYEIAKXRXHPXQDAXHXAGWVSLFTLHXXWPFLWIWATLXRXXRGWGXXXXXXXXXXXXXXXXXLXXXVXXLXXXXXXL

SEQ ID NO: 71566 - protein, 59 aa, Artificial sequence
  protein pattern
  Variant (5)..(5): Xaa in position 5 is Ile or Val
  Variant (7)..(7): Xaa in position 7 is Ala or Val
  Variant (14)..(14): Xaa in position 14 is any amino acid
  Variant (18)..(18): Xaa in position 18 is Glu or Lys
  Variant (20)..(20): Xaa in position 20 is Glu or Asn
  Variant (23)..(23): Xaa in position 23 is any amino acid
  Variant (24)..(24): Xaa in position 24 is Ala or Gln
  Variant (27)..(27): Xaa in position 27 is Ile or Leu
  Variant (29)..(29): Xaa in position 29 is any amino acid
  Variant (40)..(40): Xaa in position 40 is Ala, Thr or Val
  Variant (41)..(41): Xaa in position 41 is Ile or Leu
  Variant (52)..(52): Xaa in position 52 is Trp or Tyr
  Variant (53)..(53): Xaa in position 53 is Gln or Arg
  Variant (54)..(54): Xaa in position 54 is any amino acid
  Variant (55)..(55): Xaa in position 55 is Asp or Glu
IFYGXIXIHDIPYXIAKXRXHPXXDAXHXAGWVSLFTLHXXWPFLWIWATLXXXXRGWG

SEQ ID NO: 71567 - DNA, 951 bp, Escherichia coli K12
  CDS (1)..(951): transl_table=11
atgagtataaaagagcaaacgttaatgacgccttacctacagtttgaccgcaaccagtgggcagctctgcgtgattccgtacctatgacgttatcggaagatgagatcgcccgtctcaaaggtattaatgaagatctctcgttagaagaagttgccgagatctatttacctttgtcacgtttgctgaacttctatataagctcgaatctgcgccgtcaggcagttctggaacagtttcttggtaccaacgggcaacgcattccttacattatcagtattgctggcagtgtcgcggtggggaaaagtacaaccgcccgtgtattgcaggcgctattaagccgttggccggaacatcgtcgtgttgaactgatcactacagatggcttccttcaccctaatcaggttctgaaagaacgtggtctgatgaagaagaaaggcttcccggaatcgtatgatatgcatcgcctggtgaagtttgtttccgatctcaaatccggcgtgccaaacgttacagcacctgtttactcacatcttatttatgatgtgatcccggatggagataaaacggttgttcagcctgatattttaattcttgaagggttaaatgtcttacagagcgggatggattatccacacgatccacatcatgtatttgtttctgattttgtcgatttttcgatatatgttgatgcaccggaagacttacttcagacatggtatatcaaccgttttctgaaattccgcgaaggggcttttaccgacccggattcctattttcataactacgcgaaattaactaaagaagaagcgattaagactgccatgacattgtggaaagagatcaactggctgaacttaaagcaaaatattctacctactcgtgagcgcgccagtttaatcctgacgaaaagtgctaatcatgcggtagaagaggtcagactacgcaaataa

SEQ ID NO: 71568 - protein, 316 aa, Escherichia coli K12
MSIKEQTLMTPYLQFDRNQWAALRDSVPMTLSEDEIARLKGINEDLSLEEVAEIYLPLSRLLNFYISSNLRRQAVLEQFLGTNGQRIPYIISIAGSVAVGKSTTARVLQALLSRWPEHRRVELITTDGFLHPNQVLKERGLMKKKGFPESYDMHRLVKFVSDLKSGVPNVTAPVYSHLIYDVIPDGDKTVVQPDILILEGLNVLQSGMDYPHDPHHVFVSDFVDFSIYVDAPEDLLQTWYINRFLKFREGAFTDPDSYFHNYAKLTKEEAIKTAMTLWKEINWLNLKQNILPTRERASLILTKSANHAVEEVRLRK

SEQ ID NO: 71569 - DNA, 951 bp, Streptococcus pneumoniae
  CDS (1)..(951)
atgatagacaaaatatctaggggaaaacaaatgaccaacgaatttttacattttgaaaaaatcagccgccagacttggcaatctttacatcgaaagacaacacctcctttgacagaagaagaattggaatctatcaagagttttaatgaccaaatcagtctccaagacgttacagatatctatctccccttggctcatctgattcagatttacaagcgaactaaggaagatttagccttttcaaaaggaattttcctccaacgtgaaagtaaatctcaaccttttattattggggtttctgggagtgttgccgttggaaaatccacaaccagtcgcctacttcaaatcctactgtcccgtacgtttacagatgctacggttgagttggttacaactgatggttttctctatcccaatcaaaccttgattgagcaggggattttaaatcgtaaaggatttcctgaaagctatgatatggaagctcttctcaacttcttggaccgcatcaaaaatggacaagatgtagatattcctgtctattctcatgaagtttacgacatcgtacccgaaaagaaacaaagtgtcaaagctgctgattttgtaattgttgagggaattaatgtctttcaaaatccacaaaacgatcgtctctatatcactgacttctttgacttttccatctatgtagatgctggagtggatgatattgaaagttggtatctggaccgtttcttgaaaatgctgagcctagcccaaaacgaccctgatagctactattatcgttttactcagatgccgattggggaagtggagtcctttgcccatcaggtctggaccagtatcaatctcacaaatctgcaaaattatattgaaccaaccagaaatcgtgcagaagtgattcttcataaaagcaagaaccatgaaatcgatgaaatttacttaaaaaagtaa

SEQ ID NO: 71570 - protein, 316 aa, Streptococcus pneumoniae
MIDKISRGKQMTNEFLHFEKISRQTWQSLHRKTTPPLTEEELESIKSFNDQISLQDVTDIYLPLAHLIQIYKRTKEDLAFSKGIFLQRESKSQPFIIGVSGSVAVGKSTTSRLLQILLSRTFTDATVELVTTDGFLYPNQTLIEQGILNRKGFPESYDMEALLNFLDRIKNGQDVDIPVYSHEVYDIVPEKKQSVKAADFVIVEGINVFQNPQNDRLYITDFFDFSIYVDAGVDDIESWYLDRFLKMLSLAQNDPDSYYYRFTQMPIGEVESFAHQVWTSINLTNLQNYIEPTRNRAEVILHKSKNHEIDEIYLKK

SEQ ID NO: 71571 - DNA, 921 bp, Streptococcus pneumoniae
  CDS (1)..(921)
atgaccaacgaatttttacattttgaaaaaatcagccgccagacttggcaatctttacatcgaaagacaacacctcctttgacagaagaagaattggaatctatcaagagttttaatgaccaaatcagtctccaagacgttacagatatctatctccccttggctcatctgattcagatttacaagcgaactaaggaagatttagccttttcaaaaggaattttcctccaacgtgaaagtaaatctcaaccttttattattggggtttctgggagtgttgccgttggaaaatccacaaccagtcgcctacttcaaatcctactgtcccgtacgtttacagatgctacggttgagttggttacaactgatggttttctctatcccaatcaaaccttgattgagcagggaattttaaatcgtaaaggatttcctgaaagctatgatatggaagctcttctcaacttcttggaccgcatcaaaaatggacaagatgtagatattcctgtctattctcatgaagtttacgacatcgtacccaaaaagaaacaaagtgtcaaagctgctgattttgtaatcgttgagggaattaatgtctttcaaaatccacaaaacgatcgtctctatatcactgacttctttgacttttccatctatgtagatgctggagtggatgatattgaaagttggtatctggaccgtttcttgaaaatgctgagtctagcccaaaacgaccctgatagctactattatcgttttactcagatgccgattggggaagtggagtcctttgcccatcaggtctggaccagtatcaatctcacaaatctgcaaaattatattgaaccaaccagaaatcgtgcagaagtgattcttcataaaagcaagaaccatgaaatcgatgaaatttacttaaaaaagtaa

SEQ ID NO: 71572 - protein, 306 aa, Streptococcus pneumoniae
MTNEFLHFEKISRQTWQSLHRKTTPPLTEEELESIKSFNDQISLQDVTDIYLPLAHLIQIYKRTKEDLAFSKGIFLQRESKSQPFIIGVSGSVAVGKSTTSRLLQILLSRTFTDATVELVTTDGFLYPNQTLIEQGILNRKGFPESYDMEALLNFLDRIKNGQDVDIPVYSHEVYDIVPKKKQSVKAADFVIVEGINVFQNPQNDRLYITDFFDFSIYVDAGVDDIESWYLDRFLKMLSLAQNDPDSYYYRFTQMPIGEVESFAHQVWTSINLTNLQNYIEPTRNRAEVILHKSKNHEIDEIYLKK

SEQ ID NO: 71573 - DNA, 921 bp, Listeria monocytogenes
  CDS (1)..(921)
atgaatgattacaaccactactttcatttcccacgagaagaatggcgcaagctggaagtgagtaaggaccaaattttaactgcagaggaactggaagaaatacgtggtttaaatgaccgaatttctttacaagacatctctgaaatctatttaccactaataaaactaattgcgattcaataccatgaagcgatttttattcatggcgaaaaaatggaatacttgaagaaaaaagaatcgcgtgcaccatttattattgcattagctggaagtgtggctgttgggaaaagtacgacagcacgtgttttcaaattaatgcttgatcgctggttctccaaaactagacaagtagagcttgtaacgacagacggctttctttaccctaacaaagttctagaagagcgcggtatcatggacaaaaaaggcttccctgaaagctacgaccgcgaccgttttgctaagtttttaaccgacttaaaagcaaataaagaagatgtcgaaattccactttattcgcatttcacttatgatgttttagacgaaactcgcgtgattcataatccagatatcgttattattgaaggaatcaatgttcttcaagctgatcaacatgagagcctgtttccaagtgacttttttgatttctcggtttacatggatgccaatgaagcggatattaagaaatggtatttagagcgtttcttcatgcttcgcgaaacagctttccaagatgaaagttcttatttccacccatatactaaaattagcaaacaagaagcagaaacatttgcactcggggtttgggatacaatcaacggcgtcaacttaaaagaaaacattgagaaaacaaaatatcgagccgacttagttcttcaaaaaggcacagatcatctcatttcagacatttatttacgcaaataa

SEQ ID NO: 71574 - protein, 306 aa, Listeria monocytogenes
MNDYNHYFHFPREEWRKLEVSKDQILTAEELEEIRGLNDRISLQDISEIYLPLIKLIAIQYHEAIFIHGEKMEYLKKKESRAPFIIALAGSVAVGKSTTARVFKLMLDRWFSKTRQVELVTTDGFLYPNKVLEERGIMDKKGFPESYDRDRFAKFLTDLKANKEDVEIPLYSHFTYDVLDETRVIHNPDIVIIEGINVLQADQHESLFPSDFFDFSVYMDANEADIKKWYLERFFMLRETAFQDESSYFHPYTKISKQEAETFALGVWDTINGVNLKENIEKTKYRADLVLQKGTDHLISDIYLRK

SEQ ID NO: 71575 - DNA, 921 bp, Lactococcus lactis; IL1403
  CDS (1)..(921)
atgaatgaattcattaattttgacgaaattagccgaaaaacatggcaaaatctttataatacttcgattgctcccttaactcatgatgagttagagtcaatccgctcactcaatgatgaaatcagcttacaagatgtggaggacgtctatttaccactgattcatcttcttcgcttatataaaaaaaatttagaagacatgagttactctaaaggacttttcctacaaaaaattgtcaaaactcccccactcatcattgggatttccggctcagtcgccgttggaaaatcaacgactgcaagacttctccagcttctcctttcacgtgcctttccaaaattaaccgttgatttagtgacaaccgacggatttttgtacacgactaatgatttaaaaaatatggggattctcgaccgcaaaggttttcccgaaagctatgatatggaaaaattaacaagttttctttatcacgtcaaaaatggtgaaaaatttgaagttccgatttactcacatgaaacttacgatattttgcctaaccaaagtcaaatcattgacagccctgatattcttattgtagaaggaattaatgtgcttcaaaatccacaaaatcaactactttatatcagtgatttttacgatttttcaatttatgtcgatgctgacgaaaaactcattgaaaaatggtacctcgaacgttttgacagccttttaaaactagctaaatatgaccagacaaacttctatcatcaatttacaaaaatgccagaagataaagtaatcaatctagcccgtgaaatatgggcacgtgtcaatcgtgtcaatctcagagaatatattgagcccacaagaaatcgggcagaaattattctccacaaaacagaaaatcactatattgacaaaatttacctgaaaaaattctaa

SEQ ID NO: 71576 - protein, 306 aa, Lactococcus lactis; IL1403
MNEFINFDEISRKTWQNLYNTSIAPLTHDELESIRSLNDEISLQDVEDVYLPLIHLLRLYKKNLEDMSYSKGLFLQKIVKTPPLIIGISGSVAVGKSTTARLLQLLLSRAFPKLTVDLVTTDGFLYTTNDLKNMGILDRKGFPESYDMEKLTSFLYHVKNGEKFEVPIYSHETYDILPNQSQIIDSPDILIVEGINVLQNPQNQLLYISDFYDFSIYVDADEKLIEKWYLERFDSLLKLAKYDQTNFYHQFTKMPEDKVINLAREIWARVNRVNLREYIEPTRNRAEIILHKTENHYIDKIYLKKF

SEQ ID NO: 71577 - DNA, 924 bp, Myxococcus xanthus
  CDS (1)..(924)
atgttcatcgacctggaacgggatgcctggcgggcgctgcgtgccgcaacgcctctgccgctgaagtccgaggacattgacggcctgcggggcctgggagagcacctcgacctggacgaggtggtggacgtctacctgcccttgtcccggttgctgaacctgcaggtggccgcggcgcagcggctgtgggcggagcagcaagccttcctgggaggttcgacgcagaaggtgccgtacatcatcgccatcgccgggagcgtggcggtgggcaagagcacgacggcgcgcatcctccaggcgctgctgaagcggtggccggaccacccgcgcgtggagttggtgacgacggacgggttccttttccccaacgacgtcctcaccgagcgcgacttgatgaagcgcaagggcttcccggagagctacgaccggcgcgccctggtgcgcttcctggcggagctgaaggccggacgcgcggaggtggcggcgccggtgtattcgcacctcgtctacgacgtggtgcccggtgaggcgcaggtcgtccgccagcccgacatcctcatcctggaagggctcaacgtcctccaggccggggcacaggaggggaagcagatgccggcgacgttcctctccgacttcttcgacttctccatctacgtggacgcgcacgagcacgacatccgccgctggtacgtcaaccgtttcctcaagctccagcagacggcgtttcgcgacgagcgcagctacttccgccggttctccgagctgaaccacgagcaggcgattcagctcgccgagtcggtgtggggcgaaatcaacgggcccaacctggcccagaacatcgcgcccacccgttcgcgcgcgcgcctcatcctcctcaagggccccgaccacaaggtgaagcgggtgaggctgcgcaagctgtag

SEQ ID NO: 71578 - protein, 307 aa, Myxococcus xanthus
MFIDLERDAWRALRAATPLPLKSEDIDGLRGLGEHLDLDEVVDVYLPLSRLLNLQVAAAQRLWAEQQAFLGGSTQKVPYIIAIAGSVAVGKSTTARILQALLKRWPDHPRVELVTTDGFLFPNDVLTERDLMKRKGFPESYDRRALVRFLAELKAGRAEVAAPVYSHLVYDVVPGEAQVVRQPDILILEGLNVLQAGAQEGKQMPATFLSDFFDFSIYVDAHEHDIRRWYVNRFLKLQQTAFRDERSYFRRFSELNHEQAIQLAESVWGEINGPNLAQNIAPTRSRARLILLKGPDHKVKRVRLRKL

SEQ ID NO: 71579 - DNA, 975 bp, Alloiococcus otitis
  CDS (46)..(975)
agaatcaaatttgttttaaaattatcagcttttggaggtcagaacatgaacaattcccgtatttttttagtctatgaccgtaaagactggcagtctcttagagaaaatgccagcctttctttaacggaaaaaaacctaaataacttgcgtgcagtgaatgacgtcatatcgatggaagatgtccgagaagtttacgtccccattatccaattactggatgtctacataaaaagttactaccgccaccaggcttccttgatcaattacttgaacctggaccagcctaaaaagtaccaaccctatgtgattgggattgcagggagcgtggctgtgggcaagtctacggttgccaggcttcttaagtccctcttgagcgactactatccggaaaaaaaggtagacctcctcacaacagatggcttcctttatccgaataagattttaaaagagcgagatatcatggaccgcaagggttttcccgaaagctatgatatgaaacgtttgattaactttatgaccgatgtcaaaaataatgttcccaacatccaggtgcccaagtattcccaccaagtttacgacatagtagaaggggaaaggttgaccattaaccagccagacatcttgattgtcgaagggatcaatgtgctccaacttccttctaatgagaagatttttgttagcgattttttcgacttctccttttatgtggatgcctcagaaaatctgattgaaaaatggtacatgcaacgctttggcacctttatggataccgccttccaagaccccaacaactattactacaagtttaatgactgggaccgcaaggaagcttttgcctatgccaaccaagtttgggaaacggttaacctagaaaacctcagggaatatattctacccacccgactccgggctaacctcatcctccataaaacccataaccactacatcgacaagattttactcaaaaaacactga

SEQ ID NO: 71580 - protein, 309 aa, Alloiococcus otitis
MNNSRIFLVYDRKDWQSLRENASLSLTEKNLNNLRAVNDVISMEDVREVYVPIIQLLDVYIKSYYRHQASLINYLNLDQPKKYQPYVIGIAGSVAVGKSTVARLLKSLLSDYYPEKKVDLLTTDGFLYPNKILKERDIMDRKGFPESYDMKRLINFMTDVKNNVPNIQVPKYSHQVYDIVEGERLTINQPDILIVEGINVLQLPSNEKIFVSDFFDFSFYVDASENLIEKWYMQRFGTFMDTAFQDPNNYYYKFNDWDRKEAFAYANQVWETVNLENLREYILPTRLRANLILHKTHNHYIDKILLKKH

SEQ ID NO: 71581 - DNA, 951 bp, Streptococcus pneumoniae
  CDS (1)..(951)
atgatagataaaatacctaggggaaaacaaatgaccaacgaatttttacattttgaaaaaatcagccgccagacttggcaatctttacatcgaaagacaacacctcctttgacagaagaagaattggaatctatcaagagttttaatgaccaaatcagtctccaagacgttacagatatctatctccccttggctcatctgattcagatttacaagcgaactaaggaagatttagccttttcaaaaggaattttcctccaacgtgaaagtaaatctcaaccttttattattggggtttctgggagtgttgccgttggaaaatccacaaccagtcgcctacttcaaatcctactgtcccgtacgtttacagatgctacggttgagttggttacaactgatggttttctctatcccaatcaaaccttgattgagcagggaattttaaatcgtaaaggatttcctgaaagctatgatatggaagctcttctcaacttcttggaccgcatcaaaaatggacaagatgtagatattcctgtctattctcatgaagtttacgacatcgtacccaaaaagaaacaaagtgtcaaagctgctgattttgtaatcgttgagggaattaatgtctttcaaaatccacaaaacgatcgtctctatatcactgacttctttgacttttccatctatgtagatgctggagtggatgatattgaaagttggtatctggaccgtttcttgaaaatgctgagtctagcccaaaacgaccctgatagctactattatcgttttactcagatgccgattggggaagtggagtcctttgcccatcaggtctggaccagtatcaatctcacaaatctgcaaaattatattgaaccaaccagaaatcgtgcagaagtgattcttcataaaagcaagaaccatgaaatcgatgaaatttacttaaaaaagtaa

SEQ ID NO: 71582 - protein, 316 aa, Streptococcus pneumoniae
MIDKIPRGKQMTNEFLHFEKISRQTWQSLHRKTTPPLTEEELESIKSFNDQISLQDVTDIYLPLAHLIQIYKRTKEDLAFSKGIFLQRESKSQPFIIGVSGSVAVGKSTTSRLLQILLSRTFTDATVELVTTDGFLYPNQTLIEQGILNRKGFPESYDMEALLNFLDRIKNGQDVDIPVYSHEVYDIVPKKKQSVKAADFVIVEGINVFQNPQNDRLYITDFFDFSIYVDAGVDDIESWYLDRFLKMLSLAQNDPDSYYYRFTQMPIGEVESFAHQVWTSINLTNLQNYIEPTRNRAEVILHKSKNHEIDEIYLKK

SEQ ID NO: 71583 - DNA, 1002 bp, Agrobacterium tumefaciens str. C58
  CDS (1)..(1002): transl_table=11
atgaagattgaggcgggcagcggggagagaggcatgccaggcacactcgatcattttcgtgcggacgaatattcgccctatcacttcttcagttccgaagaatgggccaaattccgcgctgacacgccactgacgctttccgccgatgaggtgaagcggctgcgatcgctggatgaccccatcgatctggatgaagtgcggcgcatttacctgtcgctgtcgcgcctcctttcatcgcatgttgaagcgtcgcagctgcttttcgaacagcgcaaccgctttctgaatatgggggatgtcaacaagacgcccttcgtcatcggcattgccggatcggtggccgttggcaaatcgacgacagcgcgtatcctgaaagagcttctggcgcggtggccttccagcccgaaggtcgatctcatcaccactgacgggtttctttacccgaacgaggtgctgcggcgcgaaaacctgatggagcgcaagggctttccggaaagctacgatatcggcgcgctgctgcgttttctttcggcgatcaaggcgggccagccgaatgtgaaggccccgcgttattcgcacctgacctacgacgtgttgccgaacgaattcaccgtcatcgaccagccggatatcctgatcttcgaaggcatcaacgtgctgcaatcccgtgaccttccggcgggcggtcgtatcgtgccgatcgtttccgacttcttcgatttctcgatctatatcgatgccgatgaggatttcattcacaactggtatgtgaaccggttcatgaacctgagacagaccgccttccgcgacccgaactcattcttcaaccggtatgcgtcgatcagcgaagaggcggcactcagcattgccgaagggctctggcagaacatcaacctgaagaacctgcgccagaacatcgtgccgacgcgcccgcgcgccgatcttattctgcgcaagggagagaaccacctgatagatacggtggcgctgcgaaagctctga

SEQ ID NO: 71584 - protein, 333 aa, Agrobacterium tumefaciens str. C58
MKIEAGSGERGMPGTLDHFRADEYSPYHFFSSEEWAKFRADTPLTLSADEVKRLRSLDDPIDLDEVRRIYLSLSRLLSSHVEASQLLFEQRNRFLNMGDVNKTPFVIGIAGSVAVGKSTTARILKELLARWPSSPKVDLITTDGFLYPNEVLRRENLMERKGFPESYDIGALLRFLSAIKAGQPNVKAPRYSHLTYDVLPNEFTVIDQPDILIFEGINVLQSRDLPAGGRIVPIVSDFFDFSIYIDADEDFIHNWYVNRFMNLRQTAFRDPNSFFNRYASISEEAALSIAEGLWQNINLKNLRQNIVPTRPRADLILRKGENHLIDTVALRKL

SEQ ID NO: 71585 - DNA, 972 bp, Corynebacterium glutamicum ATCC 13032
  CDS (1)..(972): transl_table=11
atggcagagcaaaacgctgcaagcacaactggtgtgaaaccttccccacgcacaccagatttcagcccctaccttgatttcgaccgcgcacaatggcgcgagctgagaaactcaatgcctcaggtgctgacccaaaaagaagtcattgaacttcgaggcatcggagaaaacattgacctcgctgaagtggcagaagtctaccttccgctgtcccgtctgattcacctccaggtagcggcccgacagcaacttactgcagccaccgaaaccttcctcggaacttccccctctatctctgtgccgtttgtcattggtgtcgcgggatccgtcgccgtcggtaaatcaaccaccgcccgactcctccaagttctgcttcagcgctggaattcccacccccgcgtggacctcgtcaccaccgacggattcctctatcccggcgcggaactaatccgccgcggattaatgtcccgaaaaggattccccgaaagctacgaccaacgtgcactcctccgctttgtcaccgacgtaaaatccggaaaactcgaagtcaacgcacctgtctactcccacaccgcgtacgaccgagttccaggcgaattcaccacagtccgccaacccgacattttgatcgtcgaaggcttaaacgtcctccaaactggcccaacattgatggtcagtgaccttttcgacttcagcgtctacgtagatgcccgcaccgaagatatcgaaaaatggtacatcgaccgcttcctcaaactccgcgacactgcattccgtcgccccggtgcccacttctcccattacgccgacatggctgatccagagtccatcgccgtcgctcgagaactgtggcaatcgatcaacctgcccaacttggtggagaatattcttcccacccgagttcgcgcgtcgttggtactgaaaaaaggtagcgatcacttggtggaacgggtgaggatgcgcaagatctag

SEQ ID NO: 71586 - protein, 323 aa, Corynebacterium glutamicum ATCC 13032
MAEQNAASTTGVKPSPRTPDFSPYLDFDRAQWRELRNSMPQVLTQKEVIELRGIGENIDLAEVAEVYLPLSRLIHLQVAARQQLTAATETFLGTSPSISVPFVIGVAGSVAVGKSTTARLLQVLLQRWNSHPRVDLVTTDGFLYPGAELIRRGLMSRKGFPESYDQRALLRFVTDVKSGKLEVNAPVYSHTAYDRVPGEFTTVRQPDILIVEGLNVLQTGPTLMVSDLFDFSVYVDARTEDIEKWYIDRFLKLRDTAFRRPGAHFSHYADMADPESIAVARELWQSINLPNLVENILPTRVRASLVLKKGSDHLVERVRMRKI

SEQ ID NO: 71587 - DNA, 969 bp, Agrobacterium tumefaciens
  CDS (1)..(969): transl_table=11
atgccaggcacactcgatcattttcgtgcggacgaatattcgccctatcacttcttcagttccgaagaatgggccaaattccgcgctgacacgccactgacgctttccgccgatgaggtgaagcggctgcgatcgctggatgaccccatcgatctggatgaagtgcggcgcatttacctgtcgctgtcgcgcctcctttcatcgcatgttgaagcgtcgcagctgcttttcgaacagcgcaaccgctttctgaatatgggggatgtcaacaagacgcccttcgtcatcggcattgccggatcggtggccgttggcaaatcgacgacagcgcgtatcctgaaagagcttctggcgcggtggccttccagcccgaaggtcgatctcatcaccactgacgggtttctttacccgaacgaggtgctgcggcgcgaaaacctgatggagcgcaagggctttccggaaagctacgatatcggcgcgctgctgcgttttctttcggcgatcaaggcgggccagccgaatgtgaaggccccgcgttattcgcacctgacctacgacgtgttgccgaacgaattcaccgtcatcgaccagccggatatcctgatcttcgaaggcatcaacgtgctgcaatcccgtgaccttccggcgggcggtcgtatcgtgccgatcgtttccgacttcttcgatttctcgatctatatcgatgccgatgaggatttcattcacaactggtatgtgaaccggttcatgaacctgagacagaccgccttccgcgacccgaactcattcttcaaccggtatgcgtcgatcagcgaagaggcggcactcagcattgccgaagggctctggcagaacatcaacctgaagaacctgcgccagaacatcgtgccgacgcgcccgcgcgccgatcttattctgcgcaagggagagaaccacctgatagatacggtggcgctgcgaaagctctga

SEQ ID NO: 71588 - protein, 322 aa, Agrobacterium tumefaciens
MPGTLDHFRADEYSPYHFFSSEEWAKFRADTPLTLSADEVKRLRSLDDPIDLDEVRRIYLSLSRLLSSHVEASQLLFEQRNRFLNMGDVNKTPFVIGIAGSVAVGKSTTARILKELLARWPSSPKVDLITTDGFLYPNEVLRRENLMERKGFPESYDIGALLRFLSAIKAGQPNVKAPRYSHLTYDVLPNEFTVIDQPDILIFEGINVLQSRDLPAGGRIVPIVSDFFDFSIYIDADEDFIHNWYVNRFMNLRQTAFRDPNSFFNRYASISEEAALSIAEGLWQNINLKNLRQNIVPTRPRADLILRKGENHLIDTVALRKL

SEQ ID NO: 71589 - DNA, 939 bp, Corynebacterium glutamicum
  CDS (1)..(939): transl_table=11
gtgaaaccttccccacgcacaccagatttcagcccctaccttgatttcgaccgcgcacaatggcgcgagctgagaaactcaatgcctcaggtgctgacccaaaaagaagtcattgaacttcgaggcatcggagaaaacattgacctcgctgaagtggcagaagtctaccttccgctgtcccgtctgattcacctccaggtagcggcccgacagcaacttactgcagccaccgaaaccttcctcggaacttccccctctatctctgtgccgtttgtcattggtgtcgcgggatccgtcgccgtcggtaaatcaaccaccgcccgactcctccaagttctgcttcagcgctggaattcccacccccgcgtggacctcgtcaccaccgacggattcctctatcccggcgcggaactaatccgccgcggattaatgtcccgaaaaggattccccgaaagctacgaccaacgtgcactcctccgctttgtcaccgacgtaaaatccggaaaactcgaagtcaacgcacctgtctactcccacaccgcgtacgaccgagttccaggcgaattcaccacagtccgccaacccgacattttgatcgtcgaaggcttaaacgtcctccaaactggcccaacattgatggtcagtgaccttttcgacttcagcgtctacgtagatgcccgcaccgaagatatcgaaaaatggtacatcgaccgcttcctcaaactccgcgacactgcattccgtcgccccggtgcccacttctcccattacgccgacatggctgatccagagtccatcgccgtcgctcgagaactgtggcaatcgatcaacctgcccaacttggtggagaatattcttcccacccgagttcgcgcgtcgttggtactgaaaaaaggtagcgatcacttggtggaacgggtgaggatgcgcaagatctag

SEQ ID NO: 71590 - protein, 312 aa, Corynebacterium glutamicum
MKPSPRTPDFSPYLDFDRAQWRELRNSMPQVLTQKEVIELRGIGENIDLAEVAEVYLPLSRLIHLQVAARQQLTAATETFLGTSPSISVPFVIGVAGSVAVGKSTTARLLQVLLQRWNSHPRVDLVTTDGFLYPGAELIRRGLMSRKGFPESYDQRALLRFVTDVKSGKLEVNAPVYSHTAYDRVPGEFTTVRQPDILIVEGLNVLQTGPTLMVSDLFDFSVYVDARTEDIEKWYIDRFLKLRDTAFRRPGAHFSHYADMADPESIAVARELWQSINLPNLVENILPTRVRASLVLKKGSDHLVERVRMRKI

SEQ ID NO: 71591 - DNA, 996 bp, Rhizobium meliloti
  CDS (1)..(996): transl_table=11
atgagcatcgccgcgaaagacatcgaaccggccgacattccgggaaatctccaggggggcgaatattcgccctatcacgtcttctccgcggaggaatggtcgcgctttcgcgccgacacgccgctgacgctgacggccgacgaggtgcagcgcctgcgctctctcaacgatccggtcgatctcgacgaggtgcgacggatctatctctcgctctcacgactcctctcggcccatgtggaggcgtcgcagatcctcttcaggcagcgcacgcgcttcctcagcatgtcgaacgagacgaagacgcccttcgtcatcggcgtcgccggctcggtcgccgtcggcaagtcgacgaccgcgcgcatccttgccgagcttctcgcgcgctggccctcgagcccgaaggtcgacctcgtcaccaccgacggctttctttatccgaatgcggttctccagcgcgaaaacctgatggaccgcaagggttttccagcgagctacgatatcggtgcgctgctcagattcctctcggcgatcaaggcgggccggccgaacgtcaaggctccgacctattcgcacctgacctatgacgtgatccccgaccagttccaggtgatcgaccggccggacatcctgattttcgaagggataaacgtactgcagtcgcgcgatcttccggccgacggcaagatcgtgccgatggtctccgatttcttcgacttttcgatctatatcgatgccgaggagagtctgatccacagctggtacgtgaaccgcttcatgcgactgcgcgaaaccgcgttccagagcccgcagtccttcttccatcgctatgcgacgatcagcgaggatgcggcgcgcgcgatcgccgagggcctctggcacaatatcaacctgaagaacctgcatcagaacatcctgccgacgcggccgcgcgccgatctcatcctgcagaagggtcccaaccacctgacgcagacggtggcgctcaggaagctctga

SEQ ID NO: 71592 - protein, 331 aa, Rhizobium meliloti
MSIAAKDIEPADIPGNLQGGEYSPYHVFSAEEWSRFRADTPLTLTADEVQRLRSLNDPVDLDEVRRIYLSLSRLLSAHVEASQILFRQRTRFLSMSNETKTPFVIGVAGSVAVGKSTTARILAELLARWPSSPKVDLVTTDGFLYPNAVLQRENLMDRKGFPASYDIGALLRFLSAIKAGRPNVKAPTYSHLTYDVIPDQFQVIDRPDILIFEGINVLQSRDLPADGKIVPMVSDFFDFSIYIDAEESLIHSWYVNRFMRLRETAFQSPQSFFHRYATISEDAARAIAEGLWHNINLKNLHQNILPTRPRADLILQKGPNHLTQTVALRKL

SEQ ID NO: 71593 - DNA, 951 bp, Salmonella typhimurium
  CDS (1)..(951): transl_table=11
atgagtataaaagagcaatcgttaatgacgccttacctacagtttgatcgcagccagtgggctgcgcttcgcgattctgtgccgatgaccctgaccgaggatgagatcgcgcagttaaaaggcattaatgaagatttatcgctggaagaagttgcagaaatatatttacctctctcccgtttgctaaatttctatatcagttcaaatctgcgtcgtcaggctgtcctggaacagtttctgggcactaacggccagcgaatcccttacatcatcagtatcgcgggcagcgtcgcagtgggtaaaagcacgacagcacgcgttctgcaagcgttgctgagtcgctggccggaacaccgccgtgttgaattgattaccacagacggcttcctccacccaaaccaggtgttgaaagaacgcgggttaatgaagaaaaaggggttccccgaatcgtatgatatgcaccgactggtgaaattcgtttctgacctcaagtcgggcgtaccgaacgtgacggcgccagtctattctcatttgatttacgatgttattcctgaaggggataaaaccgtcgctcagcctgatatattgattcttgaaggtttgaatgttttacaaagcggtatggattatcctcacgatccgcatcatgtatttgtctctgatttcgttgatttctctatttacgtggatgcgccagaagaacttcttcagacgtggtatatcaatcgcttcctgaaattccgcgaaggggcgtttaccgatcctgactcttatttccacaattatgcgaaattatctaaagaagaagctgttaatacagcaacttcgctttggaaagaaattaactggttgaatttaaaacaaaatatcttacctacacgagaacgtgccagccttattatgaccaagagcgctaaccatgcggtggaacaggtaagattgcggaaataa

SEQ ID NO: 71594 - protein, 316 aa, Salmonella typhimurium
MSIKEQSLMTPYLQFDRSQWAALRDSVPMTLTEDEIAQLKGINEDLSLEEVAEIYLPLSRLLNFYISSNLRRQAVLEQFLGTNGQRIPYIISIAGSVAVGKSTTARVLQALLSRWPEHRRVELITTDGFLHPNQVLKERGLMKKKGFPESYDMHRLVKFVSDLKSGVPNVTAPVYSHLIYDVIPEGDKTVAQPDILILEGLNVLQSGMDYPHDPHHVFVSDFVDFSIYVDAPEELLQTWYINRFLKFREGAFTDPDSYFHNYAKLSKEEAVNTATSLWKEINWLNLKQNILPTRERASLIMTKSANHAVEQVRLRK

SEQ ID NO: 71595 - DNA, 990 bp, Streptomyces avermitilis
  CDS (1)..(990): transl_table=11
gtgatctctccggtctcctcgataccccggagcgcccaccggtccaggccggaggcgactccctacctcgacctcacccgtgccgagtggagcgctctgcgcgaaaagacgccgctcccgctgaacgccgaggaggtcgagaagctgcgcggcctgggcgacgtcatcgacctcgacgaagtacgggacatctatctgccgctgtcgcgcctcctcaatctgtacgtgggagcgaccgacggcctgcgcggcgcgctgaacaccttcctcggcgagcagggctcccagtccggcaccccgttcgtcatcggggtcgccggctcggtggcggtcgggaagtccaccgtcgcccgccttctccaggccctcctgtcccgctggcccgaacacccgcgcgtcgaactggtgacgacggacgggttcctcctccccaccaaggagctcgaggcccgcggcctgatgtcgcggaagggattccccgagtcgtacgaccgccgcgcgctcacccgcttcgtcgccgacatcaaggcgggcaaggacgaggtgacggccccggtctactcccacctgatctacgacatcgtccccggccagaagctcacggtccgccgcccggacatcctgatcgtcgagggcctgaacgtgctccagcccgccctgccgggcaaggacggccgcacccgcgtcggactcgccgactacttcgacttcagcgtgtacgtcgacgcccgccccgaggacatcgagcgctggtacctgaaccgcttccgcaagctgcgcgccaccgccttccagaacccgtcctcgtacttccgcaggtacacccaggtctccgaggacgaggcgctcgactacgcgcgcacgacctggcggaccatcaacaaggtgaacctgctggagaacgtggccccgacccgcggccgggccgccctcgtcgtccgcaagggccccgaccacaaggtgcagcgcctgagcctgcgcaaactgtga

SEQ ID NO: 71596 - protein, 329 aa, Streptomyces avermitilis
MISPVSSIPRSAHRSRPEATPYLDLTRAEWSALREKTPLPLNAEEVEKLRGLGDVIDLDEVRDIYLPLSRLLNLYVGATDGLRGALNTFLGEQGSQSGTPFVIGVAGSVAVGKSTVARLLQALLSRWPEHPRVELVTTDGFLLPTKELEARGLMSRKGFPESYDRRALTRFVADIKAGKDEVTAPVYSHLIYDIVPGQKLTVRRPDILIVEGLNVLQPALPGKDGRTRVGLADYFDFSVYVDARPEDIERWYLNRFRKLRATAFQNPSSYFRRYTQVSEDEALDYARTTWRTINKVNLLENVAPTRGRAALVVRKGPDHKVQRLSLRKL

SEQ ID NO: 71597 - DNA, 990 bp, Streptomyces coelicolor
  CDS (1)..(990): transl_table=11
gtgatctctccggtcccctcgattccccggagcgcccaccggcagcggccggaggcgactccctacgtcgacctcacccgtcccgagtggagcgcgctgcgcgacaagacgccgctgccgctgaccgccgaggaggtcgagaagctgcgcggcctcggcgacgtcatcgacctcgacgaggtgcgggacatctacctcccgctctcccggctcctcaacctctacgtcggcgccaccgacggcctgcgcggcgcactgaacaccttcctcggcgaacagggctcccagtccggcacccccttcgtcataggggtcgccggctcggtcgcggtcggcaagtccaccgtcgcccgcctgctccaggcgctgctgtcccgctggcccgagcacccgcgcgtggagctggtcaccaccgacggcttcctgctgccgacacgggagctggaggcgcgcggcctgatgtcgcggaaaggtttccccgagtcgtacgaccgccgggcgctcacccggttcgtcgccgacatcaaggcgggcaaggcggaggtgaccgcccccgtctactcccacctcatctacgacatcgtcccggaccagcggctcgtcgtccgccgccccgacatcctgatcgtcgagggcctcaacgtgctccagcccgcgctccccggcaaggacggccgcaccagggtcggactcgccgactacttcgacttcagcgtgtacgtcgacgcgcgcaccgaggacatcgagcgctggtacctcaaccgcttccgcaagctgcgcgcgaccgccttccagaacccctcctcgtacttccgcaagtacacgcaggtgtccgaggaggaggccctcgactacgcccgcaccacctggcgcaccatcaacaagcccaacctggtggagaacgtggcccccacccggggccgggccaccctggtgctgcgcaagggccccgaccacaaggtccagcgcctgagcctgcgcaagctctga

SEQ ID NO: 71598 - protein, 329 aa, Streptomyces coelicolor
MISPVPSIPRSAHRQRPEATPYVDLTRPEWSALRDKTPLPLTAEEVEKLRGLGDVIDLDEVRDIYLPLSRLLNLYVGATDGLRGALNTFLGEQGSQSGTPFVIGVAGSVAVGKSTVARLLQALLSRWPEHPRVELVTTDGFLLPTRELEARGLMSRKGFPESYDRRALTRFVADIKAGKAEVTAPVYSHLIYDIVPDQRLVVRRPDILIVEGLNVLQPALPGKDGRTRVGLADYFDFSVYVDARTEDIERWYLNRFRKLRATAFQNPSSYFRKYTQVSEEEALDYARTTWRTINKPNLVENVAPTRGRATLVLRKGPDHKVQRLSLRKL

SEQ ID NO: 71599 - DNA, 27 bp, Artificial sequence
  primer
atgagtataaaagagcaaacgttaatg

SEQ ID NO: 71600 - DNA, 24 bp, Artificial sequence
  primer
ttatttgcgtagtctgacctcttc

SEQ ID NO: 71601 - protein, 303 aa, Artificial sequence
  consensus sequence
  Variant (2)..(3): Xaa in position 2 to 3 is any amino acid
  Variant (5)..(6): Xaa in position 5 to 6 is any amino acid
  Variant (8)..(14): Xaa in position 8 to 14 is any amino acid
  Variant (16)..(18): Xaa in position 16 to 18 is any amino acid
  Variant (20)..(31): Xaa in position 20 to 31 is any amino acid
  Variant (33)..(34): Xaa in position 33 to 34 is any amino acid
  Variant (36)..(38): Xaa in position 36 to 38 is any amino acid
  Variant (43)..(44): Xaa in position 43 to 44 is any amino acid
  Variant (46)..(61): Xaa in position 46 to 61 is any amino acid
  Variant (62)..(63): Xaa in position 62 to 63 is any or no amino acid
  Variant (65)..(71): Xaa in position 65 to 71 is any amino acid
  Variant (72)..(73): Xaa in position 72 to 73 is any or no amino acid
  Variant (75)..(76): Xaa in position 75 to 76 is any amino acid
  Variant (78)..(80): Xaa in position 78 to 80 is any amino acid
  Variant (93)..(93): Xaa in position 93 is any amino acid
  Variant (95)..(96): Xaa in position 95 to 96 is any amino acid
  Variant (99)..(99): Xaa in position 99 is any amino acid
  Variant (101)..(106): Xaa in position 101 to 106 is any amino acid
  Variant (107)..(107): Xaa in position 107 is any or no amino acid
  Variant (109)..(109): Xaa in position 109 is any amino acid
  Variant (111)..(111): Xaa in position 111 is any amino acid
  Variant (118)..(118): Xaa in position 118 is any amino acid
  Variant (120)..(122): Xaa in position 120 to 122 is any amino acid
  Variant (124)..(130): Xaa in position 124 to 130 is any amino acid
  Variant (140)..(142): Xaa in position 140 to 142 is any amino acid
  Variant (144)..(145): Xaa in position 144 to 145 is any amino acid
  Variant (147)..(150): Xaa in position 147 to 150 is any amino acid
  Variant (152)..(152): Xaa in position 152 is any amino acid
  Variant (154)..(155): Xaa in position 154 to 155 is any amino acid
  Variant (156)..(156): Xaa in position 156 is any or no amino acid
  Variant (158)..(159): Xaa in position 158 to 159 is any amino acid
  Variant (161)..(161): Xaa in position 161 is any amino acid
  Variant (165)..(166): Xaa in position 165 to 166 is any amino acid
  Variant (169)..(170): Xaa in position 169 to 170 is any amino acid
  Variant (172)..(179): Xaa in position 172 to 179 is any amino acid
  Variant (183)..(183): Xaa in position 183 is any amino acid
  Variant (185)..(185): Xaa in position 185 is any amino acid
  Variant (188)..(188): Xaa in position 188 is any amino acid
  Variant (193)..(200): Xaa in position 193 to 200 is any amino acid
  Variant (201)..(207): Xaa in position 201 to 207 is any or no amino acid
  Variant (209)..(209): Xaa in position 209 is any amino acid
  Variant (214)..(214): Xaa in position 214 is any amino acid
  Variant (216)..(216): Xaa in position 216 is any amino acid
  Variant (219)..(222): Xaa in position 219 to 222 is any amino acid
  Variant (224)..(225): Xaa in position 224 to 225 is any amino acid
  Variant (228)..(229): Xaa in position 228 to 229 is any amino acid
  Variant (232)..(237): Xaa in position 232 to 237 is any amino acid
  Variant (239)..(241): Xaa in position 239 to 241 is any amino acid
  Variant (243)..(260): Xaa in position 243 to 260 is any amino acid
  Variant (262)..(264): Xaa in position 262 to 264 is any amino acid
  Variant (266)..(267): Xaa in position 266 to 267 is any amino acid
  Variant (270)..(271): Xaa in position 270 to 271 is any amino acid
  Variant (274)..(276): Xaa in position 274 to 276 is any amino acid
  Variant (278)..(278): Xaa in position 278 is any amino acid
  Variant (282)..(282): Xaa in position 282 is any amino acid
  Variant (285)..(287): Xaa in position 285 to 287 is any amino acid
  Variant (289)..(289): Xaa in position 289 is any amino acid
  Variant (291)..(293): Xaa in position 291 to 293 is any amino acid
  Variant (295)..(300): Xaa in position 295 to 300 is any amino acid
  Variant (302)..(302): Xaa in position 302 is any amino acid
RXXWXXLXXXXXXXLXXXEXXXXXXXXXXXXLXXVXXXYLPLXXLXXXXXXXXXXXXXXXXXXLXXXXXXXXXPXXIXXXGSVAVGKSTTARXLXXLLXRXXXXXXXVXLXTTDGFLXPXXXLXXXXXXXRKGFPESYDXXXLXXFXXXXKXGXXXVXXPXYSHXXYDXXPXXXXXXXXPDIXIXEGXNVLQXXXXXXXXXXXXXXXDXFDFSXYXDAXXXXIXXWYXXRFXXXXXXAXXXPXXXXXXXXXXXXXXXXXXAXXXWXXINXXNLXXXIXPTRXRAXXXLXKXXXHXXXXXXLXK

SEQ ID NO: 71602 - protein, 34 aa, Artificial sequence
  protein pattern
  Variant (2)..(2): Xaa in position 2 is Asp or Glu
  Variant (4)..(4): Xaa in position 4 is Ile, Leu or Val
  Variant (11)..(11): Xaa in position 11 is any amino acid
  Variant (13)..(13): Xaa in position 13 is Asn or Thr
  Variant (14)..(15): Xaa in position 14 to 15 is any amino acid
  Variant (17)..(18): Xaa in position 17 to 18 is any or no amino acid
  Variant (20)..(24): Xaa in position 20 to 24 is any amino acid
  Variant (25)..(26): Xaa in position 25 to 26 is any or no amino acid
  Variant (31)..(31): Xaa in position 31 is Ala or Glu
VXLXTTDGFLXPXXXLXXEXXXXXXXKGFPXSYD

SEQ ID NO: 71603 - protein, 27 aa, Artificial sequence
  protein pattern
  Variant (2)..(2): Xaa in position 2 is Phe or Tyr
  Variant (3)..(3): Xaa in position 3 is Ile or Val
  Variant (5)..(7): Xaa in position 5 to 7 is any or no amino acid
  Variant (9)..(9): Xaa in position 9 is any or no amino acid
  Variant (17)..(17): Xaa in position 17 is Thr or Val
  Variant (18)..(18): Xaa in position 18 is Ala or Ser
  Variant (20)..(20): Xaa in position 20 is Ile, Leu or Val
  Variant (22)..(23): Xaa in position 22 to 23 is any amino acid
  Variant (26)..(26): Xaa in position 26 is Ala, Gln or Ser
  Variant (27)..(27): Xaa in position 27 is Asp or Arg
PXXIXXXGXVAVGKSTXXRXLXXLLXX

SEQ ID NO: 71604 - protein, 45 aa, Artificial sequence
  protein pattern
  Variant (2)..(3): Xaa in position 2 to 3 is any amino acid
  Variant (4)..(4): Xaa in position 4 is any or no amino acid
  Variant (6)..(6): Xaa in position 6 is any amino acid
  Variant (7)..(7): Xaa in position 7 is any or no amino acid
  Variant (9)..(9): Xaa in position 9 is any amino acid
  Variant (10)..(10): Xaa in position 10 is Ala, Glu, Gln or Ser
  Variant (11)..(11): Xaa in position 11 is Asp, Glu or Lys
  Variant (12)..(12): Xaa in position 12 is Asp or Glu
  Variant (13)..(13): Xaa in position 13 is Ile, Leu or Val
  Variant (14)..(15): Xaa in position 14 to 15 is any amino acid
  Variant (16)..(16): Xaa in position 16 is Ile or Leu
  Variant (17)..(17): Xaa in position 17 is Lys or Arg
  Variant (18)..(18): Xaa in position 18 is Gly or Ser
  Variant (19)..(19): Xaa in position 19 is Phe, Ile or Leu
  Variant (20)..(20): Xaa in position 20 is Asp, Gly or Asn
  Variant (21)..(21): Xaa in position 21 is Asp or Glu
  Variant (22)..(22): Xaa in position 22 is any amino acid
  Variant (23)..(23): Xaa in position 23 is Ile, Leu or Val
  Variant (24)..(24): Xaa in position 24 is Asp or Ser
  Variant (26)..(26): Xaa in position 26 is Ala, Asp, Glu or Gln
  Variant (27)..(27): Xaa in position 27 is Asp or Glu
  Variant (29)..(29): Xaa in position 29 is any amino acid
  Variant (30)..(30): Xaa in position 30 is Asp, Glu or Arg
  Variant (31)..(31): Xaa in position 31 is Ile or Val
  Variant (34)..(34): Xaa in position 34 is Pro or Ser
  Variant (36)..(36): Xaa in position 36 is Ala or Ser
  Variant (37)..(37): Xaa in position 37 is His or Arg
  Variant (39)..(39): Xaa in position 39 is Ile or Leu
  Variant (40)..(44): Xaa in position 40 to 44 is any amino acid
  Variant (45)..(45): Xaa in position 45 is Ala, Ser or Thr
RXXXPXXLXXXXXXXXXXXXXXXXLXXVXXXYLXLXXLXXXXXXX

SEQ ID NO: 71605 - protein, 20 aa, Artificial sequence
  protein pattern
  Variant (2)..(3): Xaa in position 2 to 3 is any amino acid
  Variant (4)..(4): Xaa in position 4 is any or no amino acid
  Variant (6)..(6): Xaa in position 6 is any amino acid
  Variant (7)..(7): Xaa in position 7 is Ala or Ile
  Variant (9)..(9): Xaa in position 9 is any amino acid
  Variant (13)..(14): Xaa in position 13 to 14 is any amino acid
  Variant (17)..(17): Xaa in position 17 is any or no amino acid
  Variant (19)..(19): Xaa in position 19 is any or no amino acid
GXXXVXXPXYSHXXYDXVXP

SEQ ID NO: 71606 - protein, 28 aa, Artificial sequence
  protein pattern
  Variant (3)..(4): Xaa in position 3 to 4 is any amino acid
  Variant (7)..(7): Xaa in position 7 is any amino acid
  Variant (8)..(8): Xaa in position 8 is any or no amino acid
  Variant (10)..(11): Xaa in position 10 to 11 is any amino acid
  Variant (12)..(12): Xaa in position 12 is any or no amino acid
  Variant (16)..(16): Xaa in position 16 is any amino acid
  Variant (19)..(19): Xaa in position 19 is any amino acid
  Variant (20)..(20): Xaa in position 20 is Leu or Val
  Variant (21)..(21): Xaa in position 21 is Ile or Val
  Variant (22)..(22): Xaa in position 22 is Leu, Met or Val
  Variant (23)..(23): Xaa in position 23 is any amino acid
  Variant (25)..(25): Xaa in position 25 is Gly or Ser
  Variant (26)..(26): Xaa in position 26 is any amino acid
  Variant (27)..(27): Xaa in position 27 is Asp or Asn
INXXNLXXNXXXPTRXRAXXXXXKXXXH

SEQ ID NO: 71607 - protein, 13 aa, Artificial sequence
  protein pattern
  Variant (4)..(4): Xaa in position 4 is Leu or Val
  Variant (6)..(6): Xaa in position 6 is Phe, Ile, Leu or Val
  Variant (9)..(9): Xaa in position 9 is Ile or Leu
PDIXIXEGXNVLQ

SEQ ID NO: 71608 - DNA, 1356 bp, Saccharomyces cerevisiae
  CDS (1)..(1356)
atgtcagaagtttccaaatggccagcaatcaacccattccattggggatacaatggtacagtttcgcatattgtcggtgaaaatggttccattaaactccatttaaaagacaacaaggagcaagttgattttgacgagttcgctaacaaatatgtcccaacgttgaagaatggtgcccaattcaaattgagtccttacttgttcacaggtattttgcaaactttgtacttaggtgctgctgatttctctaagaaatttcctgtattctacggcagggaaattgtcaaattctcggatggtggagtttgcaccgctgactggctcatagattcatggaaaaaggattatgaattcgatcaaagtactacgagctttgataaaaaaaaatttgataaagacgagaaggcgacacatccagaaggatggcctcgtttacaaccacgtacaaggtacctgaaagataatgagttggaagaactacgggaggttgatctacccctagtagttattctacatggtcttgctggtggtagtcatgagccgattataagatctcttgctgaaaacctgtctcgcagtgggagatttcaagtggtcgtcctaaataccagaggttgtgcacgttccaaaattaccaccagaaatttatttacagcttatcacacaatggatattcgcgagtttttgcaaagagaaaagcaaagacatccagatagaaaactatacgctgtgggatgctcttttggtgctacgatgctggcaaactatctgggagaagagggcgataaatcacctttatccgcagctgctactttgtgcaatccttgggatcttctcctttcagcaattaggatgagccaggattggtggtcaagaactttattttccaaaaatattgcgcaattcttaacaagaaccgttcaggttaatatgggtgaattaggagttccaaatggctctctccccgatcatcctcccacagtcaagaatccatctttctatatgttcacgcctgaaaatctaataaaggcaaagagctttaaatcgacccgggaatttgatgaagtgtacactgcgcctgctttaggcttcccaaatgctatggagtattataaagcggccagctcaataaacagagttgatacaattcgggttcctacccttgttatcaattccagggatgatcctgttgtcggcccagatcaaccatactcaatcgtggaaaagaatcctcgtattttgtattgtagaaccgatttaggtggtcatttagcttacctagataaagacaacaactcgtgggctaccaaggcaattgcagaatttttcactaagtttgatgaattagtcgtatga

SEQ ID NO: 71609 - protein, 451 aa, Saccharomyces cerevisiae
MSEVSKWPAINPFHWGYNGTVSHIVGENGSIKLHLKDNKEQVDFDEFANKYVPTLKNGAQFKLSPYLFTGILQTLYLGAADFSKKFPVFYGREIVKFSDGGVCTADWLIDSWKKDYEFDQSTTSFDKKKFDKDEKATHPEGWPRLQPRTRYLKDNELEELREVDLPLVVILHGLAGGSHEPIIRSLAENLSRSGRFQVVVLNTRGCARSKITTRNLFTAYHTMDIREFLQREKQRHPDRKLYAVGCSFGATMLANYLGEEGDKSPLSAAATLCNPWDLLLSAIRMSQDWWSRTLFSKNIAQFLTRTVQVNMGELGVPNGSLPDHPPTVKNPSFYMFTPENLIKAKSFKSTREFDEVYTAPALGFPNAMEYYKAASSINRVDTIRVPTLVINSRDDPVVGPDQPYSIVEKNPRILYCRTDLGGHLAYLDKDNNSWATKAIAEFFTKFDELVV

SEQ ID NO: 71610 - DNA, 1593 bp, Arabidopsis thaliana
  CDS (1)..(1593)
atggaagaagaagatctgattctatctccatctccatacgatcttctctttcaagctctaactctcatcccgattcgtcactacctcatcgctctcttcgttctctgtaccatcttcttctacaatttcgtcgaatttcacttccttggagatgcgattcttcgttatttcagatgtcgcgtcaatctcatttacaatccagattctcctctttatcacggtgttgtttctcggtgtcagattcttcacggccgatatgtggcgacgccatggttagcgagccctcatattcagacttgtttcttgaatttccatggattgcctccagttttcacctatacaagacagctatttcttacttctgatggtggaacgattgcattagattggcttacgaattctgatgttcttgatggttctcttcacaataagagtgaaattacaaaagaagatacaacgcctatagctgttgttattccagggttaactagtgattcttcatctgcatatttaaagcatcttgcttacgacactgcaaaaacaggttggaatgttgttattagcaaccatagaggattgggaggagtttctgttacttcagattgcttctataatgctggatggacagatgatataagggtagttcttgattatcttcaacacaaatacccgagggctcctctctttgctattggcactagcattggagcaaatgttctggtaaaataccttggggaagagggtgaaaagactcctctgagaggtgctgttgctatctgctctccatgggacctcttgattggtgacaggtttatctgtcggactttgaaacaaaagctctatgacaaagctctcaccatcggactccaaggttatgcccaattgcatgaacctcagtttttacggcttgctaattgggaaggcatcaaaaagtcacgttccatccgagattttgacaaccatgctacctgtctagttggaaaattcgagactgtggatacgtattaccgaaaatcgagcagcactcaatacgtaggaaatgtggcggtgccactactctgtataagtgctctagatgatccattatgcacaaaggaagctattccctgggacgaatgcagggccaacaaaaacattgtcttggctacaacaaatcacgggggacatctagcgttcttcgaaggattaactggatctagcttatggtgggttcgagccaccaacgagtttcttggcgtccttagctgcagtccttatatgcatatacagaaaattgtagataaaagaagctcagggtcagggaaacaagagccatcgataaaccaaggcccgtacctaaacattgcagaagacgggttggtggcagcagtcaaatatgagcaagacaccaataagaccacactgaagcagagagggcgaaagcctgaggaagatgtaacaaagaaaagctttaaagagctgtgtaggcagacaaaacagtcggtatggtggcttggttacataggcatggttacaagtttccctttacttgggatgctcctaaactacatcttccgtaagaagcaacgacccacaacaacatccacatcctga

SEQ ID NO: 71611 - protein, 530 aa, Arabidopsis thaliana
MEEEDLILSPSPYDLLFQALTLIPIRHYLIALFVLCTIFFYNFVEFHFLGDAILRYFRCRVNLIYNPDSPLYHGVVSRCQILHGRYVATPWLASPHIQTCFLNFHGLPPVFTYTRQLFLTSDGGTIALDWLTNSDVLDGSLHNKSEITKEDTTPIAVVIPGLTSDSSSAYLKHLAYDTAKTGWNVVISNHRGLGGVSVTSDCFYNAGWTDDIRVVLDYLQHKYPRAPLFAIGTSIGANVLVKYLGEEGEKTPLRGAVAICSPWDLLIGDRFICRTLKQKLYDKALTIGLQGYAQLHEPQFLRLANWEGIKKSRSIRDFDNHATCLVGKFETVDTYYRKSSSTQYVGNVAVPLLCISALDDPLCTKEAIPWDECRANKNIVLATTNHGGHLAFFEGLTGSSLWWVRATNEFLGVLSCSPYMHIQKIVDKRSSGSGKQEPSINQGPYLNIAEDGLVAAVKYEQDTNKTTLKQRGRKPEEDVTKKSFKELCRQTKQSVWWLGYIGMVTSFPLLGMLLNYIFRKKQRPTTTSTS

SEQ ID NO: 71612 - DNA, 1614 bp, Arabidopsis thaliana
  CDS (1)..(1614)
atgaattgcgcaatcacagaggatgatttgatctctccttacctcatcatcttcaaatcgctcttactcatcccaatctctcactatctcatcttcttcttcctcacaatcttacttttcctctacttcttcctagagattcattttcctaaagcagatcctatctctcttaccttcaatccaaactctgacttctgcaagtttattgtctccaagtgtcgtctccttcatggacgatactttcctacgttctggctttcaagccctcatcttcaaacagctttccttaccctttttggaaagtctcctcctttctcctataagcgaattctctatcaggcaacagatggtggcacaattgctttggattggttaatgcattctgatgttgtggaaggtatatctcaagtggtcaatgcctcaaatccaggaactgataggactccaattgctattatagttccagggctcactagtgattcttctgctgcatatattaaacatattgccttcaggctggcaaaggaaggatggaatgttgttgtgcaaaaccaccgtggacttggagggatatctttaacttctgactgcgtctacactgccgggtggacagaagatcttcggaaagtaattgctcacatccattctcagttcccagaggctcctttgtttgctgttggaacaagcattggtgccaacgttctggtaaaatatcttggggaggatgggccaaatacacctcttattggagctactgctgtgtgttctccttgggatctattgatatgtgatcgatttatcaaccgcaaactcgtgcaaaaagtgtatgacagaatgcttactattggtctacaaggttatgcacaattgcaccattccatcatttctcgtatagccgattgggaaggcattaagaagtcacgttcagttcgagagtttgacaactacgccaccaggcttgttgccaaattcgagacaactgatacatactatagacgttcaagcagttcacaatatgtggaaaatgtcgctgttccgctcctttgcatcagtgctttggatgatccagtttgtactagagaagctattccttgggatgaatgtagggcaaacaaaaacatagttctggctaccacaacacatggtggtcatctagcttactatgaagggttgacagcgtcaagcatgtggtggacaagggttgtacacgaatattttgaagtgctactctccagcccctttgcagacagaagacacaagatcatccccgaaccattgggatcttcgattgatcagggaccattcgtggatgctggagaacacgggatggttgctgctgcaagtgaagtggacacaacaagagctgatgcagaaccagaggataatgctcaaatttatgtaaagacaagtaatcatctacacaaggacaataatcctcaagtttataacaatatactcggtcctttgaagaagagagtggatcagctttcaagatacagccggaaatcgatttggctattggcatacattgctatagtcacgacgtggccactagtaggacctgcacttttgttttcaattaagagaagattcagaaagctcgtagaaaaatag

SEQ ID NO: 71613 - protein, 537 aa, Arabidopsis thaliana
MNCAITEDDLISPYLIIFKSLLLIPISHYLIFFFLTILLFLYFFLEIHFPKADPISLTFNPNSDFCKFIVSKCRLLHGRYFPTFWLSSPHLQTAFLTLFGKSPPFSYKRILYQATDGGTIALDWLMHSDVVEGISQVVNASNPGTDRTPIAIIVPGLTSDSSAAYIKHIAFRLAKEGWNVVVQNHRGLGGISLTSDCVYTAGWTEDLRKVIAHIHSQFPEAPLFAVGTSIGANVLVKYLGEDGPNTPLIGATAVCSPWDLLICDRFINRKLVQKVYDRMLTIGLQGYAQLHHSIISRIADWEGIKKSRSVREFDNYATRLVAKFETTDTYYRRSSSSQYVENVAVPLLCISALDDPVCTREAIPWDECRANKNIVLATTTHGGHLAYYEGLTASSMWWTRVVHEYFEVLLSSPFADRRHKIIPEPLGSSIDQGPFVDAGEHGMVAAASEVDTTRADAEPEDNAQIYVKTSNHLHKDNNPQVYNNILGPLKKRVDQLSRYSRKSIWLLAYIAIVTTWPLVGPALLFSIKRRFRKLVEK

SEQ ID NO: 71614 - DNA, 1353 bp, Eremothecium gossypii
  CDS (1)..(1353)
atggggttaccaacttttgcgccaagaagctggggctacaggggtaccatcacgcatcggccacatgaggagggtcttgttaaactgcccttgaaggacaaagagaaagagccagtaacactttcagacctgctaaacgagcacgttcctgaactaaaggatggtgcgcgattctatctacacccatatttatacaatggtatcctgcagacgatgtacctgtacggcgccgacttcagccaacagtataaaccattttatggccgtgagatcgtcagctactctgatggtggtgtttcgacggcagattgggccatgcgcgaatgggatgacctgtatgcggcacctgagggctacaacaaggagaaattcgatgcggatgctgccaagacgcaccctgagaactggccgagactacagccaaatacacgctttctcgatgaagaagagcttgcgaaaataccaaaggatacgcgccctctaattgtcgtagcacatggtcttgctggtgggtcgcacgagaatatcatccgtgccctggttacagagctattgtcagttggcaacggccagtttaatgtcgttgtgctaaactcccgtggatgtgcacgttcgaagatcgccaacaagaagctattctctgctttccacacgatggacattcgggagttcattaacagagagcatgcgagacagccggaacgcaaaatatatggtcttggcttctcattcggctctgtcatctttggcaactatctaggtgaggagggcgataagagtccactttcaggcgccgtttgctgtgctgggccttgggatatgttcgcctcatctaaaatgctgaatgatgatttttggatcagccgcctctttggcaaaaatctggtgaagcatttgtcgagattgcttcatgttaaccgtaaggaactggagtacgatggcagcaagggtgacgatgtagaagacgcgtccccaacgaatcctgcctcccatatctttactaaggaaaatctggcgcgcgcctcgaccatggcttgcacacgcgatttcgacaacttcttcactgcgcctgctcttggtttcaagaatgccaatgactactataaagcggctagtcccgttaacattgtgggcaagataagagtcccaacactgttaatcaacgctctggatgatccgatggtaggcgccgagggttttcttccaatcgaaaagctaagaagtaacaagcatatattgttatgcacgacagacataggcggtcacctagcctacctggataaaaactataccccatggatggccggtagagtagctgaattcctatctaaaatggacacgctagttgcctag

SEQ ID NO: 71615 - protein, 450 aa, Eremothecium gossypii
MGLPTFAPRSWGYRGTITHRPHEEGLVKLPLKDKEKEPVTLSDLLNEHVPELKDGARFYLHPYLYNGILQTMYLYGADFSQQYKPFYGREIVSYSDGGVSTADWAMREWDDLYAAPEGYNKEKFDADAAKTHPENWPRLQPNTRFLDEEELAKIPKDTRPLIVVAHGLAGGSHENIIRALVTELLSVGNGQFNVVVLNSRGCARSKIANKKLFSAFHTMDIREFINREHARQPERKIYGLGFSFGSVIFGNYLGEEGDKSPLSGAVCCAGPWDMFASSKMLNDDFWISRLFGKNLVKHLSRLLHVNRKELEYDGSKGDDVEDASPTNPASHIFTKENLARASTMACTRDFDNFFTAPALGFKNANDYYKAASPVNIVGKIRVPTLLINALDDPMVGAEGFLPIEKLRSNKHILLCTTDIGGHLAYLDKNYTPWMAGRVAEFLSKMDTLVA

SEQ ID NO: 71616 - DNA, 1368 bp, Eremothecium gossypii
  CDS (1)..(1368)
atgggggtgcttgcgtggttgccattttgcaatgaggtgcggcacaccgtgccggagcagccgttgaagttccgggacaaggagcagcaggggtccatgaccatgctcgagctcatagagaagtacgtgcccgagttccaggaccgggcgacacagctcttccacccggtgcttccgacggggcacctgcagaccatatttgcctcgctgaggaactttgagacggtggatgtggtgtactacgagcggatgatgttgagctaccacgacggcggcgtgggcgcgttggacttcgcgacgtcggcggcgagtcttgagcacttccaggacttgccgaacgaggtgccgccgcaccagcaccgggcgttgaccgaccggtaccgctacttgactgccaaggagatcgacgagctcgcctcgaacgacgcaaagcccatgctcattgtcatgcacggccttacgggcgggtctgacgagggctatgtgcgcgcgatcgtgaaccgcgcgcgcgacgtctacggcttcgaggcctgtgtgttgaacagtaggggctgcgcacaaagttcgatcacgacgccctctttgtacaacggcgcctggacggacgacatccggcactgcgtcaaggtgctacgcgggatgtacccacaacggaagttctaccttgtcggggtttcgctcggggcgtccatggccaccaactacttgggccaggagcaaaacagctcggacattgagtgcgccgccgtcttgggcaatccgtgggatttgacgagtggggcctacaacctaagcaagggccttctatcgcgctacgtgtactcgccagcgctccgcaagaactgtgttcaggttctaaagagcaacatacggcagttgagactggatccgtacatgaagaagcagtacgatgagaaactaaactctttgcagacgattgaggacttcgacaatgagttcacggccaagatgttcggcttcaacacctcctacgaatactacagacatgccagcagcgtaaatcggttaccccaggtgagaactcccttgcttgcgatcaacgctttggatgacccgattgtcggctcagaggccctcccacgtcgtgaagtcgccataaatccgtatgtcgtgcttcttgaaacgtcgaagggaggtcacataggctggtttgattacaagggcagtcgctggtacgttgatccgttgtgcagatttttctacgccttccaccgcgaaataaccaaaaagaacatgattcccgaccttgatggtgtcgtcttacctcacccccacaaattcgagaaagacaggctcgtcaatccacttgtgagagagtgggatacgggaaggcagggttcctcttaa

SEQ ID NO: 71617 - protein, 455 aa, Eremothecium gossypii
MGVLAWLPFCNEVRHTVPEQPLKFRDKEQQGSMTMLELIEKYVPEFQDRATQLFHPVLPTGHLQTIFASLRNFETVDVVYYERMMLSYHDGGVGALDFATSAASLEHFQDLPNEVPPHQHRALTDRYRYLTAKEIDELASNDAKPMLIVMHGLTGGSDEGYVRAIVNRARDVYGFEACVLNSRGCAQSSITTPSLYNGAWTDDIRHCVKVLRGMYPQRKFYLVGVSLGASMATNYLGQEQNSSDIECAAVLGNPWDLTSGAYNLSKGLLSRYVYSPALRKNCVQVLKSNIRQLRLDPYMKKQYDEKLNSLQTIEDFDNEFTAKMFGFNTSYEYYRHASSVNRLPQVRTPLLAINALDDPIVGSEALPRREVAINPYVVLLETSKGGHIGWFDYKGSRWYVDPLCRFFYAFHREITKKNMIPDLDGVVLPHPHKFEKDRLVNPLVREWDTGRQGSS

SEQ ID NO: 71618 - DNA, 1290 bp, Magnaporthe grisea 70-15
  CDS (1)..(1290)
atggcgagctggctgggactggcaagcactcgcttcagccattctccatcacctttagtgttgcgcaccaaagatggagaggagaagacgctggctgatgtttgcaaggaaagtacacctccgtgctggcttaaccctctcctcttcaatggtcacctgcagaccatgtggacgtctgtcaaatacgagggccccttggtctactacaagcggaaggtcttccaagcagactccacgtaccttggctcctttgccgtggactttgccgtcgatccccacgaggagcatgatgcaaagctacccccgcgcaccgcctactacactgatgaggagttcaataagctgggttccgatgatagtcgacccatgttaatcgtcctgcacggtttatctggcggctcgtacgagctgtatctgagggaggcgatccagcctctgattgcggacggttcgaactgggacgtcatcgtcgtaaactcgcgcggatgtgccaacagcgagatcaccagcggggtcttgttcaatgctagagcgacatgggacgtccgacaagtggtgaaatgggctcacgaaaaatatcccaaccggcctctatttggagttggcttttctctcggagcaaacatcatcaccaactacgtgggtgaggagggagcaggctgcttgctcaaggcgtgtatttccgttggcaacccgtttgacctggaggtctcgaacaaggctatgcaaaactccatcctgggactgaatgtctactccaaagtcatgggaggtaacctcaaaaagctcattgccaagcataaggagagcttattgaaacacagtgaccttgacttcgacgtgatcgagaacgtcacgtatttgcacgagtttgacagagctgtgcagtgccagagctggggataccccacggagaacgcttattacagagatgcatcttgttccgactctatactaggaatcaggatcccgtacttcgccataagcgccgccgatgacccgatcgctgtggaccaggccgtcccttaccaggaattcaaagttaacccttatacggtccactgcagcacctcactgggagggcatctgtcgtggttcgagcttgggggtggcagatggcacgcccgccctgtggtgaactttctgcgtgaaatggctgccaacattgatctcaacttcaacaaggccaaggtaaacaaggatatggagcccaaggctgcagaagcgcatggttttgatcccatgagaaggaggatgagaataaatccacgacagctgaaagccgagtag

SEQ ID NO: 71619 - protein, 429 aa, Magnaporthe grisea 70-15
MASWLGLASTRFSHSPSPLVLRTKDGEEKTLADVCKESTPPCWLNPLLFNGHLQTMWTSVKYEGPLVYYKRKVFQADSTYLGSFAVDFAVDPHEEHDAKLPPRTAYYTDEEFNKLGSDDSRPMLIVLHGLSGGSYELYLREAIQPLIADGSNWDVIVVNSRGCANSEITSGVLFNARATWDVRQVVKWAHEKYPNRPLFGVGFSLGANIITNYVGEEGAGCLLKACISVGNPFDLEVSNKAMQNSILGLNVYSKVMGGNLKKLIAKHKESLLKHSDLDFDVIENVTYLHEFDRAVQCQSWGYPTENAYYRDASCSDSILGIRIPYFAISAADDPIAVDQAVPYQEFKVNPYTVHCSTSLGGHLSWFELGGGRWHARPVVNFLREMAANIDLNFNKAKVNKDMEPKAAEAHGFDPMRRRMRINPRQLKAE

SEQ ID NO: 71620 - DNA, 1254 bp, Gibberella zeae PH-1
  CDS (1)..(1254)
atggagtggcttggacgtgcagcaatcgacttcactcatgcgcctacaccgcgcaaggtgaccgaaaaggacggcaacgagactgatctcttgtccatcaccgaaaaggcgacgccgccatgcaacctgaaccctctgctcttcaatggtcacctgcagacaatgtggacggccaccaagcctgctggtcccaaaatctactacaagcgcaagatttttgatgccgaccacaagatttaccatggaacctttgctgtagatttcgccgttgagccctttcaggcccctgatgatcctaccctgtcgcgccgaacagcttacctcaccgacgaagagtttgagaactttggatccgacgacaccaagcccatgctcgtcatcttacatggcctttcgggtggttctcatgagatctacctgcgacacacaattgcgccaatgattggtgagggtggctgggaggcctgtgtcgtcaattcgagaggttgtgccagatctaaaatcaccagcggtgtgctgtacaacgcgcgagcaacctgggatatccgtcagaagaagttccccaaccgaccccttttcggtctaggattctcgctcggtgcaaacatgctcaccaactattgtggtgaagagggttctaactgcgttctcaagggagctgttgtttgctccaacccctttaaccttgatgtttccagcaagatcctccaaaacagctacatcggcaaagaggtgtacttgcgagtcatgggtagtgctttgaaggaacttgctgctacgcacagaaaggagctggaacagtatagcacaattgacgttgatgctgtcatgaagatcacgtatctctatgagtttgatcgcttgattcagtgcccttcttggggatatcccaccgagactgcatactatcgagacgcctcgtccgttgactcaatcttgtcaattgagattcctttcctggctattcatgccactgatgatcctattgctgtcaaggaagccattccttacgaagagttcaagcagaaccccaacactatccttctcacatcgagtcttggaggacacttgtgttggtttgaatccggaggtagccgctggttcccaaagcctgttgccaacttcctgaatcatctggctttcaagaccgaccttgacagcctcaagccccaagcaaacccgaacggcggtgtcttcactgctggacacggatacagtcccatgagacgcaagctgatgatttctgaggattga

SEQ ID NO: 71621 - protein, 417 aa, Gibberella zeae PH-1
MEWLGRAAIDFTHAPTPRKVTEKDGNETDLLSITEKATPPCNLNPLLFNGHLQTMWTATKPAGPKIYYKRKIFDADHKIYHGTFAVDFAVEPFQAPDDPTLSRRTAYLTDEEFENFGSDDTKPMLVILHGLSGGSHEIYLRHTIAPMIGEGGWEACVVNSRGCARSKITSGVLYNARATWDIRQKKFPNRPLFGLGFSLGANMLTNYCGEEGSNCVLKGAVVCSNPFNLDVSSKILQNSYIGKEVYLRVMGSALKELAATHRKELEQYSTIDVDAVMKITYLYEFDRLIQCPSWGYPTETAYYRDASSVDSILSIEIPFLAIHATDDPIAVKEAIPYEEFKQNPNTILLTSSLGGHLCWFESGGSRWFPKPVANFLNHLAFKTDLDSLKPQANPNGGVFTAGHGYSPMRRKLMISED

SEQ ID NO: 71622 - DNA, 1332 bp, Candida glabrata CBS 138
  CDS (1)..(1332)
atggttggctactattggcttaattcacttgaagtaacacaagttactcctgatcatgcagctaaaattaatgtcggtggtagcagcaccactatccctgagtttattgacaagaatatccctgaattagctaatggtgcaactgacacgttgtctccacttttattcaacggtcatctgcaaacagcttataccgcgctggcgtcctttgaaagcattgatcaagtgaactacaagagaatcatgttaaaatatccagatggcggtgtaggtgccttggattttgctatgaaggaacctgataataaaactgaatatgtacctgagggccagactcctctagatgcattaaactcacatatgcccggaagattttatacctacatggatcctaatgatgccagacttcgctccaatgatagtaaacccttgttaattgcactacatggtctaactggtggttcacatgagagttacgtaaggtctatggtgaggactctgcaaaataaatatgattttgaagcatgtgtcctcaactctagagggtgttgtaattctgctattaccacagctcaactttacaatggtggttggactaatgatatcagacattgtgtaaaagagctgagagaaatgtatcccaacagaaaattttacatgattggattctccttgggtgcatctatacttacaaattacctaggcgagcaaggtgataagtcggatatagaattggcaattgcgttcggtacaccttttgatctaagtcattctgctaaatgcatatcagagtctagaataggaagtagagtatactcaccgaagcttacgcaaaatcttctaaggttggttaagagtcatgaggaagaattgaccaaaaatgagaagttcagaattaaatatgagagttacgcggccaatctgaaatcggttactaggtttgatgatctatttactggtcctatgtttggctatcgagacgctgaggattattaccaaaattcttcttcttacaagagactgctaggtattaggaccccttacatcgctataaattctgctgacgaccccattgttgggtaccaagcccttcatgaaaatatgttcagggcaaatccatacacaacactgattagaacctcaattggtgggcatatagcatggttcaaggatatgaagggtgatagatggtacactgaacctgcttgcaaactaattgcagattaccacagtaagattgttagtcaggatcatgctataaatgtcaatataaatgatttaccaaaggaaagcattgagccagttaagacgacatacagagatgacttatag

SEQ ID NO: 71623 - protein, 443 aa, Candida glabrata CBS 138
MVGYYWLNSLEVTQVTPDHAAKINVGGSSTTIPEFIDKNIPELANGATDTLSPLLFNGHLQTAYTALASFESIDQVNYKRIMLKYPDGGVGALDFAMKEPDNKTEYVPEGQTPLDALNSHMPGRFYTYMDPNDARLRSNDSKPLLIALHGLTGGSHESYVRSMVRTLQNKYDFEACVLNSRGCCNSAITTAQLYNGGWTNDIRHCVKELREMYPNRKFYMIGFSLGASILTNYLGEQGDKSDIELAIAFGTPFDLSHSAKCISESRIGSRVYSPKLTQNLLRLVKSHEEELTKNEKFRIKYESYAANLKSVTRFDDLFTGPMFGYRDAEDYYQNSSSYKRLLGIRTPYIAINSADDPIVGYQALHENMFRANPYTTLIRTSIGGHIAWFKDMKGDRWYTEPACKLIADYHSKIVSQDHAINVNINDLPKESIEPVKTTYRDDL

SEQ ID NO: 71624 - DNA, 1362 bp, Candida glabrata CBS 138
  CDS (1)..(1362)
atgtcggtgaatacgtggccattgatcaaccctttcaattggggttataacggtactatcaagcatgttacgcatgatgaaggtactgtcaagttgcagttgaagaatggtgaggagcccttacaattcgaagagtttttgaacaagtatgttcctgagttgaagaacgacgctaagtttaagctgaatcctgcgctgtttacgggtattttgcagaccatgtaccttggatccgctgattattcccgcgagtttcaagtgttctatggtagagagatagttaagttctccgatggaggtgtttgcaccgtggactacgtgatgaaagactgggaaaatgagtataagttgaacgagaccacgaagaagttcgatgttgagaaattcaagcaggacgaggccgatactcacgcggaagggtggccgcgcttgcaaccacgtaccagatacctaagagacaatgaactgcaagaagttcacagcgatgacagaccattggtgctagttctgcatggcttggctggtggctctcatgagccggttatcagatccctaacccaacaactgtctagaatcggcggtggtaaattccaagttgcggttttgaacagtagaggctgtgctcgttctaagattaccactagaagcttgtttactgcgttccatactggggatacgcgtgaatttttgcaaagggtaagaaaccaccacccaaacaagaagatatacgctgtgggtttctccttcggtgccaccatgctggcaaactatctaggtgaagaaggtgaaaacacaccattgtcagcagcatgtactctaagtaacccttgggatatggtcatgtcttctgttaagacttcaaatgactggtggtcaaagaacttgttctcagcgaacattacacaattcttagtaagattggtcaaggtcaatatgggtgaactagaagtcccagaaggtactgaaccagatcaccctccaactgtcaaaaacccatcgtattataacttcaccaagtccaacttgcaaaaggcattcaagtttaagacaatcgccgatttcgatagcacttacacagcaccttgcttaggtttcaagagtgcaatggactactacaagtctgctagctccataaacagactgccaaacattaagatcccactattaagtataaatgctagagatgacccagtggttggccctgaaggtgttccattcgatttaatgaagcagaatccacacgtggttcactgtgaaaccgacattggtggacatcttgcatacttggatttagaatggaagccttgggttaccaaagagattgcacaatacttcaatgtatttgatgatcacgtcgagtaa

SEQ ID NO: 71625 - protein, 453 aa, Candida glabrata CBS 138
MSVNTWPLINPFNWGYNGTIKHVTHDEGTVKLQLKNGEEPLQFEEFLNKYVPELKNDAKFKLNPALFTGILQTMYLGSADYSREFQVFYGREIVKFSDGGVCTVDYVMKDWENEYKLNETTKKFDVEKFKQDEADTHAEGWPRLQPRTRYLRDNELQEVHSDDRPLVLVLHGLAGGSHEPVIRSLTQQLSRIGGGKFQVAVLNSRGCARSKITTRSLFTAFHTGDTREFLQRVRNHHPNKKIYAVGFSFGATMLANYLGEEGENTPLSAACTLSNPWDMVMSSVKTSNDWWSKNLFSANITQFLVRLVKVNMGELEVPEGTEPDHPPTVKNPSYYNFTKSNLQKAFKFKTIADFDSTYTAPCLGFKSAMDYYKSASSINRLPNIKIPLLSINARDDPVVGPEGVPFDLMKQNPHVVHCETDIGGHLAYLDLEWKPWVTKEIAQYFNVFDDHVE

SEQ ID NO: 71626 - DNA, 1323 bp, Kluyveromyces lactis NRRL Y-1140
  CDS (1)..(1323)
atggtattgggagaattatattcgttattaccgtgggttcaaactgtacagcagttcttacctgatgagctgttacaatttaacagcgaaccaggcaaaactgcaaaaagtgtcagcattaaatcattaattgacaaatatgcaccggagttccaacataatagcaagtgtgtgattccaccttttctttgcagtggtcatatgcagacgatttttgcttcgatgttcactttcgaatcgaaacatttggtttattataagagatatattctcaattatccagacggcggtgaaggtgcactagatgtgtgtgttccccaatcgttatggaaagagactggttacgttcccaaaaatcagagaaatcaactgcttccgaggtatacctattttgatgctgatgaaaagttcggatcgtctgatacaaagccgatgctcattatattacatgggttgacaggtggttctaacgaaagttatgtcagatctttagttgacaccatcacgaacgagtacaattttgaagcctgcgtcttaaatagccgtgggtgctgccaatcaagcattacgacaccatttttgtattgtgggctatggactgatgatgtaaggttttgcgtgaaggaattgaggaacaagtttcctaatagaaaattctttttatgtggggtctctttaggggcaagtatgacggccaattatctgggacaagaatccgatcaatcagacgtagaattaggtgttgtgttgggaaatccatgggatttaacggcatcatcttatcatttggaaagaaacttgatagggaaatacgcctacactccagcgttagcgaaaaatttagttaaactaacgacatctcatcttgatgttttgaagcaaaatcctgaaatggcgcgtatgtacgccgaccacctacatgaagtgaaaacagtggaagaattcgataacttttttacggctagaatgtttggattcaatacgtcttttgaatattacaggcacggtacgagttcgaacagattaaacaagttgagaactccattactgattctgaatgccttagatgatcctattgttggatgtgaagcgctaccatatcgtgaagtccaaagtaatccgtacaccttaatgttaacaactacaaggggaggtcacattggatggtttgacatgaacttggacaggtggtacgtgaaaccgttgtgcagattgcttcataaattttatacagacatttcaatgcaaggtctcgcacccgatcttaaatctgttgacctgcctaaagagaataaattcaaaaatgatagaatcatcagataa

SEQ ID NO: 71627 - protein, 440 aa, Kluyveromyces lactis NRRL Y-1140
MVLGELYSLLPWVQTVQQFLPDELLQFNSEPGKTAKSVSIKSLIDKYAPEFQHNSKCVIPPFLCSGHMQTIFASMFTFESKHLVYYKRYILNYPDGGEGALDVCVPQSLWKETGYVPKNQRNQLLPRYTYFDADEKFGSSDTKPMLIILHGLTGGSNESYVRSLVDTITNEYNFEACVLNSRGCCQSSITTPFLYCGLWTDDVRFCVKELRNKFPNRKFFLCGVSLGASMTANYLGQESDQSDVELGVVLGNPWDLTASSYHLERNLIGKYAYTPALAKNLVKLTTSHLDVLKQNPEMARMYADHLHEVKTVEEFDNFFTARMFGFNTSFEYYRHGTSSNRLNKLRTPLLILNALDDPIVGCEALPYREVQSNPYTLMLTTTRGGHIGWFDMNLDRWYVKPLCRLLHKFYTDISMQGLAPDLKSVDLPKENKFKNDRIIR

SEQ ID NO: 71628 - DNA, 1350 bp, Kluyveromyces lactis NRRL Y-1140
  CDS (1)..(1350)
atggtgaacttattattcaacccactgcactggggttacaatggtactgtaactcaacatatcggtgaaaaaggaacaatcaagttgcaaaagaaagatggatccgaggctcaattgcatgaattaatctccgaagaggttactggattgagcgatggcagcaaatttcaattaagtccactaatctttactggtattttacaaaccatgtatttggcaggtggtgatttcagcaagaaattcaatgtattttacggtagagaactgtttgagatgtctgatcatgggattgccagtattgattgggttagaaatgactggaagaaactgtacgaactagaccctgccaccggtacatacaataaagagaaactagctgaggatggtaaaaagacacatcctgaaggctggcctcgtttgcatccacgtactagatacatggatgacgaagaaaaagagtctgttttgaacgatacaagtaagccattgatcattgttatgcatggtttggctggtggtagccatgaaccaatcatcagatcattaacggagcaactttcaaatatctctaatgagaagtttaaagtggccgtgttgaacaccagaggttgtgcacgtacaaaagttgtatcaccgaaattgttctatgcgtttgcaacagaagatctgcgtgagtttgtgcaaagagaacacaagcgtgatccaaagagaaagatttatgctgttgggttttcattcggtgcaacaatgttggctaatttcctgggagaagaaggagaaaagtgtcttttatcaggtgctgcattagtatgtaatccttgggacttgactaattctgcccataaaatgagggaagacttctggtctagtcgtttgttcgcaaagagtatcactcaatttttagtaagaacactggaagttaacatgaatcaaatcgaatggaagggcggtgagaagcctgctgagatttcgccagaacactattcgaattattctttcacacgtgaaaacttgaaaaaagctaagcagttcactgatccaagtcagtttgatgacatttttacagcaaaggctgttggattcgaagactcctggtcttattaccgtgtcggaagctctattaaccgtctaccaactataaatgttccaactctagtcatcaattccaaagatgacccagtcataggtgataaatgtattccagtgaaggaagctgaggaaaatcctcatgttttactgatcgaaacagatttaggtggccatttagcttacttggagaaaaaccatgactcttgggcaacaaagcaggttgcccaatattttgatgctcttgaatcattagtcaaataa

SEQ ID NO: 71629 - protein, 449 aa, Kluyveromyces lactis NRRL Y-1140
MVNLLFNPLHWGYNGTVTQHIGEKGTIKLQKKDGSEAQLHELISEEVTGLSDGSKFQLSPLIFTGILQTMYLAGGDFSKKFNVFYGRELFEMSDHGIASIDWVRNDWKKLYELDPATGTYNKEKLAEDGKKTHPEGWPRLHPRTRYMDDEEKESVLNDTSKPLIIVMHGLAGGSHEPIIRSLTEQLSNISNEKFKVAVLNTRGCARTKVVSPKLFYAFATEDLREFVQREHKRDPKRKIYAVGFSFGATMLANFLGEEGEKCLLSGAALVCNPWDLTNSAHKMREDFWSSRLFAKSITQFLVRTLEVNMNQIEWKGGEKPAEISPEHYSNYSFTRENLKKAKQFTDPSQFDDIFTAKAVGFEDSWSYYRVGSSINRLPTINVPTLVINSKDDPVIGDKCIPVKEAEENPHVLLIETDLGGHLAYLEKNHDSWATKQVAQYFDALESLVK

SEQ ID NO: 71630 - DNA, 1383 bp, Debaryomyces hansenii CBS767
  CDS (1)..(1383)
atggttttagggttctttaaatcacatgtggataacaagtatccaactacacctttgaaatttacggggaaagactcaggggaggctacacttgaggatattatttcacataaagttccggagttgtataagggtgcatcgttttggtataatccgttattaccgtccggagacttccagacggcctataccgggttgagtaagtttgagagcgttgataaggtttgctacaagagacggattttgaatattgagctggaggacaagacatacgaggtggagggagaaaagttgaagtacgatgattgggaaggtagaagcacgattgctattgattacgttgttcctccaggaagggaagaccccaatcacgagaagtacaggccggtgagtcagaccaaacatctaccacccagaactgagtatttgaatccggaacacgaacttgaactcttgagcgacgattcgaagccattagtgattgcattgcacggattgtcgggcggttcgtacgagtcgtacatcagggcattcttgagtaaggttacggataaaccatacgattttgatgcattggtgttgaattcaagaggatgtgccaaccacaccattacatccccccagttgttttgcgggttgtggacaaacgacttgcggtacttgattaacgagcacattagacccaactggcctaataagcggatctatcttatagggttctcgttaggaggagctatttgcgctaattacttagggcaagaggccgataacacatatcacaacatcaagggtggtgccatcatgggttgtccatgggattttcccgattcatgtattcagttacaatctagtttgcttgggagccatatttactcgcctaagatgtgtaacaatttggtggacttgttgaatgaacactacgaaggtcatttgcgtagcaatccgttagtcgaagcttataagaaaaatccagaaaacttcaaattgggtacgttaaaggcctttgacgaaaattttacgtcgaagctttttggtttcaattgtgcagacgagtattacagacatgcatcccctatccagagattgttaaaagttagagttcctcttgtcattgtaaattccattgacgacccaattattggatacagaacgcttcccttcagcgaagttaggctaaatccattcacggctcttgtgactactactactggaggacatcttggatggtttgattataaaggaaacagatggtacgcggatcctatttctagattattcaaagaattggatgacaattggtcatttaataagaaaagtgtagacgaaaaagatttaccattcgatactacaaagctctggaagtatgatagaataattatgtaa

SEQ ID NO: 71631 - protein, 460 aa, Debaryomyces hansenii CBS767
MVLGFFKSHVDNKYPTTPLKFTGKDSGEATLEDIISHKVPELYKGASFWYNPLLPSGDFQTAYTGLSKFESVDKVCYKRRILNIELEDKTYEVEGEKLKYDDWEGRSTIAIDYVVPPGREDPNHEKYRPVSQTKHLPPRTEYLNPEHELELLSDDSKPLVIALHGLSGGSYESYIRAFLSKVTDKPYDFDALVLNSRGCANHTITSPQLFCGLWTNDLRYLINEHIRPNWPNKRIYLIGFSLGGAICANYLGQEADNTYHNIKGGAIMGCPWDFPDSCIQLQSSLLGSHIYSPKMCNNLVDLLNEHYEGHLRSNPLVEAYKKNPENFKLGTLKAFDENFTSKLFGFNCADEYYRHASPIQRLLKVRVPLVIVNSIDDPIIGYRTLPFSEVRLNPFTALVTTTTGGHLGWFDYKGNRWYADPISRLFKELDDNWSFNKKSVDEKDLPFDTTKLWKYDRIIM

SEQ ID NO: 71632 - DNA, 1281 bp, Debaryomyces hansenii CBS767
  CDS (1)..(1281)
atggtttttccttggggctttagaagtaatgttaaaatacatcaatctaacagtgataaatctatcgatttgcctttaaggaatggtgaaaaaacaatcaaatacgcagattttatcaaagacgaattgccaattatcgatgagaaagaaaaattatggttgaacccacttttatttaatggattattacaaacattatactattcgtccgctaacttatctcataagttccaagtatattatggtagggagattttcacatatgaagatggaggtgtttgttccattgatcatgtaatcccgcaaccagaaaatactgaagaattcaaggcacttcacgataagaccttaccagagggatggccaaaattgcatcctagatctagatatttttccaatgaagaattagaacaggttaatagccctagtgaaggttcacaatctacgaaaccaatttgtgttgtcttgcatggtttagcaggtggttctcacgaaccattgattcgtaacttagcagaatacttgagtactggcaagaatgaaaataaatgggatactttagttattaattctagaggatgttgtcgtactaaaatcaccaacggaaaattgtttactgcattatcaaccggtgatattcacgaagttttggttgaattaaagaaaagaaatcctaatagacctatttacaccgtcgggttttcatttggagctgctattttggccaattacttagctgaaataaaggatgataccatgataaccgctgcctgtttggtcggttgtccatgggatttgatcgacagtgcctaccacattgaaaaatcatggtccggtagctatctttttaatcctgctttaacctcgtttttgaataagttggtgaagaataactttactgagttaaaccaccataatccggaattattcaatgaagagaacttaaagagaggtatgaagcaaactaagacctggcaatttgactctgtgtacacctgtcacactattggatacagcaatccttttgaatattatagagacgcttctccagttaatagaatcctgaagattcacacacctacattaatcttgaactctacggatgacccggccgttggtgtaagattaccatggatggaagttgaaaataaccctcacctttgtatggtggaaactgatttaggtggacatttaggttatgttcaatcttctggaaaattctggtgtgtccaattagttgaagaattctttgctaagtttgatgaattaatcgcctcctag

SEQ ID NO: 71633 - protein, 426 aa, Debaryomyces hansenii CBS767
MVFPWGFRSNVKIHQSNSDKSIDLPLRNGEKTIKYADFIKDELPIIDEKEKLWLNPLLFNGLLQTLYYSSANLSHKFQVYYGREIFTYEDGGVCSIDHVIPQPENTEEFKALHDKTLPEGWPKLHPRSRYFSNEELEQVNSPSEGSQSTKPICVVLHGLAGGSHEPLIRNLAEYLSTGKNENKWDTLVINSRGCCRTKITNGKLFTALSTGDIHEVLVELKKRNPNRPIYTVGFSFGAAILANYLAEIKDDTMITAACLVGCPWDLIDSAYHIEKSWSGSYLFNPALTSFLNKLVKNNFTELNHHNPELFNEENLKRGMKQTKTWQFDSVYTCHTIGYSNPFEYYRDASPVNRILKIHTPTLILNSTDDPAVGVRLPWMEVENNPHLCMVETDLGGHLGYVQSSGKFWCVQLVEEFFAKFDELIAS

SEQ ID NO: 71634 - DNA, 1746 bp, Oryza sativa (japonica cultivar-group)
  CDS (1)..(1746)
atgggaaacgcggccgccggcgattcggccgccgagctgctgctccgcgcggcggcgctggtgccgccggcgcactacgccctcgccgccctcctcctcgcctgcgccttactgtaccgcttcctcgagctccacctcatcggcgacctcctccgcggcctccgcgggggccgcgtcgcgctcaccttccaccccgcctcccacgtctaccaccgcgtcgcatccaagtgccgctccctccatggcaggtacttggcgacgccgtggcttgcgagccctcatttgcagacactgttcctgagcatctctgggagacccccttcgttcacgtataggaggcagctgtacacagttcgcgatggtgggaccattgctttggattggttactagcctctgattgtgaagaagaagatgttggtttttgtgatggagttatctctagggatgattcgacgcctcttgttgttgtgatacctggattaactagtgattctactgctgcttatgtgaagcacttggtcttttctatggcaagcaaagggtggaatgttgttgtaggcaatcataggggtctgggtggcatctccataacttctgattgcttctacaatgctggatggacagaagatttccgtgagattgtcaattaccttcatcagaagtatccacaggctccattatttgctgttgggacaagcataggtgccaatattctggttaagtatctcggagaagaaggtgagggtacccctgtggctggtgctgtatctatttgctcaccctgggatctgctggtgaccaacagatttattcagcgcaagcttgtgcaacgatgttatgacaaagctcttgcaattggtctgaaaggatatgcaaaactacaccaacccgtcttggcaagacttgctaactgggaagatattagaaagtcacgatctatcagggaattcgaccgtcatgccacttgtgtggttgcaaaatatgagacagtggacacattctaccgtcggtgcagcagtgcaaattacattagtaatgtgtcagtgcccctgctttgtatcagtgctcttgatgacccactttgcacaagggaggccattccctgggacgaatgcagggcaaacaaaaacattgttttggcaactgcacctaacggtggccatcttgccttttttcaagggctaactgctggaaagctgtggtgggtgggagctgtttctgagtttctacttgctctacatgatagcccctgcatgcatcggcaaaaggcacaagaacacagcttgcacacttcgttggaatcatccattgataaaagcccatatgtgaatttcatggaagatgggatggtaactgcggtgacaaatgatgatgccaacaatagtgactcagataatcctatttccaatgaaatggaactccgcaatggcatggttggtgtgcaacaggatggaatcgccacagaaatacagaatgagtgtgacggtaataggtcacaagagaatgtgacgccagcccaaggtcctgtaggatcacaggaacagccaaaacaaaacatagataaaatccaggatgctattgctcctgtaaagatatccattaatcagctcattcgatcgcaggggagatctgtttggttgcttacttacattgcttttgtaacatcttggcctttccttggtgccctgggttttatcttgtttaggaaaaagttcaggaattctttgcctgctaaacggttatga

SEQ ID NO: 71635 - protein, 581 aa, Oryza sativa (japonica cultivar-group)
MGNAAAGDSAAELLLRAAALVPPAHYALAALLLACALLYRFLELHLIGDLLRGLRGGRVALTFHPASHVYHRVASKCRSLHGRYLATPWLASPHLQTLFLSISGRPPSFTYRRQLYTVRDGGTIALDWLLASDCEEEDVGFCDGVISRDDSTPLVVVIPGLTSDSTAAYVKHLVFSMASKGWNVVVGNHRGLGGISITSDCFYNAGWTEDFREIVNYLHQKYPQAPLFAVGTSIGANILVKYLGEEGEGTPVAGAVSICSPWDLLVTNRFIQRKLVQRCYDKALAIGLKGYAKLHQPVLARLANWEDIRKSRSIREFDRHATCVVAKYETVDTFYRRCSSANYISNVSVPLLCISALDDPLCTREAIPWDECRANKNIVLATAPNGGHLAFFQGLTAGKLWWVGAVSEFLLALHDSPCMHRQKAQEHSLHTSLESSIDKSPYVNFMEDGMVTAVTNDDANNSDSDNPISNEMELRNGMVGVQQDGIATEIQNECDGNRSQENVTPAQGPVGSQEQPKQNIDKIQDAIAPVKISINQLIRSQGRSVWLLTYIAFVTSWPFLGALGFILFRKKFRNSLPAKRL

SEQ ID NO: 71636 - DNA, 1443 bp, Yarrowia lipolytica CLIB122
  CDS (1)..(1443)
atgaaccccactatcgaacgatccgcacggctggccgactacgtctggtcgtttctgggcgcacacaaggtggtggttggcctgtttctggccgcctacttcattttcaagtcacgagaccatgtgaagatcaccaagcccagaaaaccgttggagctgcatctcaagaacggcaagactgagtcgctcgacgctctgatccagcaggtccccggcctcaaaaacggcgacactctgtggtacaaccctctcaagatcctcaaccatgtgcagaccatcatggcttctcagaacgacctccatggcaccgacctggtctactacgcccgacgaatggttgatttcgacgacggcgttcagattgccgccgattacgtcgtccccgcccccaagacccctgaggaaaaggcggcctggaagaagggactcgagtacaagcccgaggagaacaccccgaagttcccagttcgaacccgatacaagcagccccaggaagtggagctcgaccacagcgacgactccaagcccatgctgattcttctccacggcctcaccggcggctcttatgagtcctacgtgcgagctgttgttgctaaaatcacctctcaatacaacgcttctgccgacggaacccttgtagactttgagtgtgttgtcatgaacactcgaggatgcgcccgaaccaccatcaagacccccgagctgttcaacggctgctggaccgaggacgtgcgaaggtttgtcaaggatatgcgaaagcgataccccaaccggcgattctacatggtgggtttctctcttggagcctccattctcgctaactacctgggccaagaggccgaggacatcgacattgaggctgcctgtgttgttgccaacccctgggacctgtgtgcctcatactacgccctgcgaagctcgtggtctggacgacacctgtacaacccccagatggctaagaacctgctgcgaatgctccgaaaccaccgggaggtcatgaagcgaaaccccatctacgacgagtcgctgactaagcaggtcaagtccattgtcgactttgacaacctgttcaccgcccccatgttcggattcgacaccgccaccgactactatcgacatggctcgtcgtgtaaccgaatcatgaacatccgagtccccactttgattctgcatgccctggacgaccccgtggctcccggcttccagctgccctaccacgagatcaagcgaaacccctacaccgtcatggctgccaccaatcatggaggacacattggctggttccactggggcaaggacaaacgatggttcccctccaagattgctggtttcttctcgcagtttgagaaggaggtggatcacaccaaggacaacaacacaaaggtggagcgactggagcgtcggtgggagaatgatagacttcgagctgttcgatacgattag

SEQ ID NO: 71637 - protein, 480 aa, Yarrowia lipolytica CLIB122
MNPTIERSARLADYVWSFLGAHKVVVGLFLAAYFIFKSRDHVKITKPRKPLELHLKNGKTESLDALIQQVPGLKNGDTLWYNPLKILNHVQTIMASQNDLHGTDLVYYARRMVDFDDGVQIAADYVVPAPKTPEEKAAWKKGLEYKPEENTPKFPVRTRYKQPQEVELDHSDDSKPMLILLHGLTGGSYESYVRAVVAKITSQYNASADGTLVDFECVVMNTRGCARTTIKTPELFNGCWTEDVRRFVKDMRKRYPNRRFYMVGFSLGASILANYLGQEAEDIDIEAACVVANPWDLCASYYALRSSWSGRHLYNPQMAKNLLRMLRNHREVMKRNPIYDESLTKQVKSIVDFDNLFTAPMFGFDTATDYYRHGSSCNRIMNIRVPTLILHALDDPVAPGFQLPYHEIKRNPYTVMAATNHGGHIGWFHWGKDKRWFPSKIAGFFSQFEKEVDHTKDNNTKVERLERRWENDRLRAVRYD

SEQ ID NO: 71638 - DNA, 1416 bp, Aspergillus nidulans FGSC A4
  CDS (1)..(1416)
atggatacctcggtagccggcttctttgttacaagcctggtgattgcaatgggacttctctcctgggctcggcccagtgggcgagtatccttttttagctccaaagagaacaatcttttcctcaataggagaaatgggaaagccggttccaagcagaccacgctaaaagaactctgccgcactgctacaccagcaagatgtgatctcaaccctctcttgttcaacggccacttgcagacctgctggactacagtgaaatttgatgacgttcctgtttactacaagcgccggatattcgaggccgacagcgaggcgtataaggggcatttcgccgttgactttgtcgttgagccttacaaagcacccaaatccgctgaagcaactgatgcggagagaaagtataccctgccatcaggtctcccagaacggacggcaatgttctccgaggatgaattcgccgctctaccttcagaagactcaaagcctatgctcgtggttctgcatggtttaagcggtggttcccatgagctttatttacgccatgtagtccacccgctgattgcggatcgaggctgggaggcttgcgttatcaactctagaggttgtgcccagacaaagatctctacggggattctttacaacgctcgcgctacttgggatgttcggcaagttgtgaagtggttaagagcagctttccctaaccgacctctcttcggaattggcttctctctcggtgcaaacattcttacgaactatttgggcgaggaaggagacgcctgccagctgaaagcagctgttctctgcgcaaatccctggaatcttgaagtcagttcggtggccatgcaaagtaactttatgggcctcaaagtctatagcaaggtaatgggcgccaacatgaagaagctttttgaacagcatgccgacgaagtcgtgaaaaaccctagggtagatgcagaagcaatcaggaatatcacgtatctgcacgaattcgacaggaccctgcagtgcgccctatgggggtatcctacggaaggcgcatactaccgtgacgcatcctctatcgactctttactctctatccgaattcctttctttgtggtgcaggccgaagatgatccaatcgttaccgtaaaagcggttcctttccaggagatcgctcaaacaccttatggtgtcatgatgaccacctcatggggtggacacctcggttggtttgagtttggcggcgggagatggtttgtgaaaccagtgaccaaattcctgaatatgatggctcatgagattgatctcgatacccctcctgtggtcgagaagccggaagctgttcctggacgtacttccagccttcagaaagacgccgctgtaaaagagcccaaaccggcagctttcagccctatgcggcaacactgtgaatag

SEQ ID NO: 71639 - protein, 471 aa, Aspergillus nidulans FGSC A4
MDTSVAGFFVTSLVIAMGLLSWARPSGRVSFFSSKENNLFLNRRNGKAGSKQTTLKELCRTATPARCDLNPLLFNGHLQTCWTTVKFDDVPVYYKRRIFEADSEAYKGHFAVDFVVEPYKAPKSAEATDAERKYTLPSGLPERTAMFSEDEFAALPSEDSKPMLVVLHGLSGGSHELYLRHVVHPLIADRGWEACVINSRGCAQTKISTGILYNARATWDVRQVVKWLRAAFPNRPLFGIGFSLGANILTNYLGEEGDACQLKAAVLCANPWNLEVSSVAMQSNFMGLKVYSKVMGANMKKLFEQHADEVVKNPRVDAEAIRNITYLHEFDRTLQCALWGYPTEGAYYRDASSIDSLLSIRIPFFVVQAEDDPIVTVKAVPFQEIAQTPYGVMMTTSWGGHLGWFEFGGGRWFVKPVTKFLNMMAHEIDLDTPPVVEKPEAVPGRTSSLQKDAAVKEPKPAAFSPMRQHCE

SEQ ID NO: 71640 - DNA, 1467 bp, Candida albicans SC5314
  CDS (1)..(1467): transl_table=12
atgtcagggttttttgtctcaagagtagaaagtcatttctcaaaaaatcctatcaaatttaaaccacgttcaaactcatctcatgaagctaataacaacacaacttcaaatttgattaacaaattcaaaccaaagaaaacttccaagggcacggataatgaattacccaactctatacctgaaatgattcaaactgctatccctgagttcagccccaaatattccttttttgtgaacccattactttcttctggtcatacacaaacagcatataccgctttaaacaagtttgagaatcaacacgaggttcactataaaagagaaatcataacaattgaaaataaaccttacactttacccaatggagatcaattgtattacgaccagtggaaaggtgagagtaccattgctttagattatgctgtaaacctgtcacttggtccagatttgaaccacgagcagtacaagcctgaatctcaaacaagaccacttccacctcgtactgaattcaagaaccctaacgaagatttgatcagtgatgacgagaagcctttattgattattttgcatgggttgtcgggaggatcatatgaagcgtatttgcgagcagttattgacaaaattattgaaccaccatttgaattcgatgccatggtgattaattcacgtggctgtgccaaccacaccattacgtctcctcaattgtataacggcttgtggacgaatgatgtgagatatgtgatcaatgagattgtctcaaaaaggtggccccaaaaaagagttttcttgatgggtttttcattgggagctgctatacttgcaaattatttagggcaagaaggagcacatgcaagcccacaaatcaaagggtcagtagcaattggatgtccctgggactttgtggatggaagtttccaattgcgtgaatctgtgattggtcattacatttactcccccaccatggctaacaatttattgaaattgttgaatagtcatcatattttattggctaatgatttggtcaaacaatataaagaagaccccactcgaaacgaaattaaattcttaaagcaattcgacaacgagtttactgcaaaaatgtttgggttaaattcagcagatgaatactacagaaaggctagtcccattcaaagattattaaatgtgagagtgcccatggtcattttgagttctttggatgatccagttgttgggtctaggtctttgccatattcagaagtgaatttgaatccatatgtcagcttaattacaaccagtgtgggtggccacttgggttggtttgctatcaatggtgatagatggtacgtcgagcctgtttgtaaattattgacggtgttaaatcaatatgacgcagacaaggaaagtatagttgagttgccagttgatatttcagaaacaagttggaagtatgatagattagtcaatggtatgttggttgatcagtag

SEQ ID NO: 71641 - protein, 488 aa, Candida albicans SC5314
MSGFFVSRVESHFSKNPIKFKPRSNSSHEANNNTTSNLINKFKPKKTSKGTDNELPNSIPEMIQTAIPEFSPKYSFFVNPLLSSGHTQTAYTALNKFENQHEVHYKREIITIENKPYTLPNGDQLYYDQWKGESTIALDYAVNSSLGPDLNHEQYKPESQTRPLPPRTEFKNPNEDLISDDEKPLLIILHGLSGGSYEAYLRAVIDKIIEPPFEFDAMVINSRGCANHTITSPQLYNGLWTNDVRYVINEIVSKRWPQKRVFLMGFSLGAAILANYLGQEGAHASPQIKGSVAIGCPWDFVDGSFQLRESVIGHYIYSPTMANNLLKLLNSHHILLANDLVKQYKEDPTRNEIKFLKQFDNEFTAKMFGLNSADEYYRKASPIQRLLNVRVPMVILSSLDDPVVGSRSLPYSEVNLNPYVSLITTSVGGHLGWFAINGDRWYVEPVCKLLTVLNQYDADKESIVELPVDISETSWKYDRLVNGMLVDQ

SEQ ID NO: 71642 - DNA, 1278 bp, Candida albicans SC5314
  CDS (1)..(1278): transl_table=12
atggggatattaggctggggtttcagatcaaacattaagattcatcagtcaggcgatgaaggttctgctacgttatcgttgaaagacaaaggcaccatcaagttcagtcaattcatcaaacaagatttacctattttggatgaatctcaaaagttgtggttgaacccattgctattcaatgggactttgcaaacattgtattatacttctatggatagttctaacaaatttttaatttactatggtagagagcttttcacctattcagatggtggtatttgttctttggattgggttattccaaaaccagaagatgagcaaaagtttgagactattcgaaaggaaacattacccgaagggttccctagattacaaccccgttgcagatacttcacgaatgaagaattggcagagttgcaccaagaagattctactagtgaaaaaccaattgttgttataattcatggtttaggtggtggaagtcatgaatccttgattcgtgattttgccgaaactattgaaaaaaagaccagtggttggggggttgtggttataaattctcgtgggtgcggtagaaccaaattgactagtgggaagttgttcaatgctggatcaacaaacgatatcagagaagtgttgcaagattttaagaaaagatggccaaatagaccaatttatcttgttggattctcttttggtggggcattaacagccaatttcttaggtgaagagggtgaaaaggagaattcggaaagcttggtgaaagctgcttgtactgttggttgtccttgggattttgttgatggtgcttatcacttgcaaaaatcgtggactggtaaatatttattgagtcctgctttggccaaattcttagctaaaattgttaccaataattataaagagttggaaacttatgcccctgacattgtcaacaaggaaacattgaaggttatcaaaaactgtaaaacattgtgggagttcgataacaatgtaacttgcaaaaccaccccatacaaagatgccttcgagtattatcaagagttgtctccagttaagaaactttcacaaataaaaacaccattgttagctctcaattcaaccgatgatcctgcagttggagtcaaattgcctatactgcaaatgaaagccaatccttatttttgcttagttgaaacagatttaggtggtcatttgggatatgtccaactgaatggtgaattttggtgtgttgaactagttgaacaatttttccaaaaatttgaagaattggtcaaatag

SEQ ID NO: 71643 - protein, 425 aa, Candida albicans SC5314
MGILGWGFRSNIKIHQSGDEGSATLSLKDKGTIKFSQFIKQDLPILDESQKLWLNPLLFNGTLQTLYYTSMDSSNKFLIYYGRELFTYSDGGICSLDWVIPKPEDEQKFETIRKETLPEGFPRLQPRCRYFTNEELAELHQEDSTSEKPIVVIIHGLGGGSHESLIRDFAETIEKKTSGWGVVVINSRGCGRTKLTSGKLFNAGSTNDIREVLQDFKKRWPNRPIYLVGFSFGGALTANFLGEEGEKENSESLVKAACTVGCPWDFVDGAYHLQKSWTGKYLLSPALAKFLAKIVTNNYKELETYAPDIVNKETLKVIKNCKTLWEFDNNVTCKTTPYKDAFEYYQELSPVKKLSQIKTPLLALNSTDDPAVGVKLPISQMKANPYFCLVETDLGGHLGYVQSNGEFWCVELVEQFFQKFEELVK

SEQ ID NO: 71644 - DNA, 2091 bp, Ustilago maydis 521
  CDS (1)..(2091)
atgtccagcttcctgtcttccaccgcgacgctgctgacaagaaccatcctgtccccagtcgcaccgccgtcactctttgcagtcaatgtcgagtactacaagtccaccagctcctcgcccaacaccgcatcttccaggtcttcaccaagcatagaatcgcttctctcggcaacacagactctcgacccggccaagaagcccactttcaagccaaccccctggctctcgagcggtcatctccaaaccatctactctgctgttgccaacttttcgcagatcgatgctgtcgagtatcaacggcgcgtgtttctcacaccggatggcggtaccatcgggctggacatctcacccccgtccttggcaccctcggagcaagacttgaaaacgcaagcgcatcccgcagccgatggtctgcccaccgtcgtctgcttgcacggtcttacaggcggcagtcatgagagctacgtgcgcaactgcttctcgcacttgaccaaacccacctcgcaaggagggctgggatatcgagcaatcgtaatcaactttcgtggatgcgccaatgtgcctgtcacctcgccacagctgtattcagcattgaagatcgccgatgtgcgctctgcattgctgctgatcaccaagctctatccaagctcgccgctggtgggcatcggattctctctcggcgcaaacgtgcttggttgctaccttggagaggaaggcgacaacactccactgctaggtggcgtcattgtcggtactccattcgacttgaaagcgggcgcagaccaactcgattacggcggtttcctctcgcaaaagtattccgtggccatgggcaacaacctgcgacgcatggcatgtaagcacaaggacacactggcactccatccaccctttcgtgcactgctcgatgatctgtacgatgctcctccgcagcccaaagccgaactcgagctgtacaaacagcaggtcaagaacggtggtcctctacagaaccaacgtgtcattatcaagcgtggctcgctgaaagcggcagatcagaccctgactcgattcgtcggtggtctgcccaagccttacggcgagttcccgttcgaaagcgccgatgactattacatcaacggtggctgtgcggacagggtgagcaacgtgcagcgaccgatgctctgtctctctgccgaggatgatcccattgttcccagccagatttggcaaaagattcgcgcggcaatagcaaggaatcccgacggtacaccactcgaggcagatgcacacgcagagttcaacgaaaacgtggtgcttgcgtggaccaaggcaggtgggcatctgggttggtttgaagggattcgacccaaacgatggctgtacaggcccacgtccgagtttatcaaggcgctatttgaccagacgtcggaagagcaacaggcgcgactaagggccaagagtcggtgggccgaggcccaggtggaagcgcgcgaggttctagttgaactcatgccaaaagaagctttgcccgtgtacacgcttcccggccaaggtggacgatcgagtcgctggactgacactgaacttgcaccatccaagagcgacagccagcgctcgaatccaagtggcagtgacacgccgtctcgtctagccgagcttgatcgcgatctgcagtccgacaagctaggcgccgaagacagcctgctcaacccctccgatacgggcttctctgccaacgcgccacccacctcctctgatacacaagtcaacgacggtcagcactcgacactgcgtctagcgtggctgctcacgcacgtgctcaaagaagcaccgctcgtccacccgcgccacgccatctatgctccctacaacgaaccgcagtcgtccgatgccgatcaacgcaagaggctaggctggcaaaaggtcacattgaccatgtacaccgatcgacagcacccggaagtcggtttcgccgagctcggtccagaaacgcgcgtagcaggcgcaggcgagacgttcagaggcggcatcgacgtgcccggtgcaagcatggagcccaagcaagccggcgtccacgcaagcgccaacaacgtcatcgctggattgtaa

SEQ ID NO: 71645 - protein, 696 aa, Ustilago maydis 521
MSSFLSSTATLLTRTILSPVAPPSLFAVNVEYYKSTSSSPNTASSRSSPSIESLLSATQTLDPAKKPTFKPTPWLSSGHLQTIYSAVANFSQIDAVEYQRRVFLTPDGGTIGLDISPPSLAPSEQDLKTQAHPAADGLPTVVCLHGLTGGSHESYVRNCFSHLTKPTSQGGLGYRAIVINFRGCANVPVTSPQLYSALKIADVRSALLLITKLYPSSPLVGIGFSLGANVLGCYLGEEGDNTPLLGGVIVGTPFDLKAGADQLDYGGFLSQKYSVAMGNNLRRMACKHKDTLALHPPFRALLDDLYDAPPQPKAELELYKQQVKNGGPLQNQRVIIKRGSLKAADQTLTRFVGGLPKPYGEFPFESADDYYINGGCADRVSNVQRPMLCLSAEDDPIVPSQIWQKIRAAIARNPDGTPLEADAHAEFNENVVLAWTKAGGHLGWFEGIRPKRWLYRPTSEFIKALFDQTSEEQQARLRAKSRWAEAQVEAREVLVELMPKEALPVYTLPGQGGRSSRWTDTELAPSKSDSQRSNPSGSDTPSRLAELDRDLQSDKLGAEDSLLNPSDTGFSANAPPTSSDTQVNDGQHSTLRLAWLLTHVLKEAPLVHPRHAIYAPYNEPQSSDADQRKRLGWQKVTLTMYTDRQHPEVGFAELGPETRVAGAGETFRGGIDVPGASMEPKQAGVHASANNVIAGL

SEQ ID NO: 71646 - DNA, 2091 bp, Ustilago maydis 521; identical to SEQ ID NO: 71644
  CDS (1)..(2091)

SEQ ID NO: 71647 - protein, 696 aa, Ustilago maydis 521; identical to SEQ ID NO: 71645

SEQ ID NO: 71648 - DNA, 1749 bp, Oryza sativa
  CDS (1)..(1749)
atggaggcggtcgccggcggcggaggcggaggcggaggggagtcggtcggggagctgctgctccgcgcggcggcgatggtgccagcggagcactacgcgctcgcggcgctcgccgtggtgtcggtcctcgcgtacgggttcctggagctgcacttcctcggggacctcctccgcgggttccgcggcggccgcgtcgagctcaccttccacccggcctccgagatctaccaccgcgtagcctccaagtgccgctccctccacggcaggtatctggcgacgccttggctcgccagcccacatttgcagacactgttcctgggtatctccgggaggccaccttcgttcacatacaaaaggcaattgtacacagtacatgatggtgggaccattgctttggactggctgcttgccactgattcaaagggttcagatgggatcctttctgaggatgcttcagcaccacttgtagttattgtacctggattaactagtgattctgctgctgcttatgtaaaacacatggcttattccatggcaacgaaggggtgtaacactgttgtaagcaatcacaggggtcttggtggtgtgtccattacttcagattgcctctacaatgctggatggacagaagatctccgagaagtcattaattatctccatcacaaatatccaaaggctccaatgctctgtgttggtacaagcataggggccaacattgtggtcaaatatcttggagaagaaggtgagaatactcctgtggctggtgctgcatctatttgttctccctgggatctggtggtgggcgaccgatttatttcccgcaagcttgtgcagcggttttacgacaaagcccttgcctttggtcttaagggatatgcaaagctgcatgaacctgtgttggttcgacttgcaaattgggaaggtattaaaaagtcacgctctatccgggaatttgaccaccatgccacttgcatggttgcaaaatatgagacagtagatacctactaccgccgttgcagcagtgccagttatgttggtaatgtgtcagttcccttgctatgtgtcaatgctttggatgaccccctctgcacaagggaggccatcccttgggatgagtgcagggccaacaagaacattgttttggctactactccgaatggcggtcatcttgcattctttcaaggactaactgctggaagactatggtgggtcggagctgtttctgagttcctcttcgctctgcttgacagtaaatacatgcatcagcaaaaggcacaagaccatattttgcgttcttccttggagtcgtccatcgataagagcccatatgtcaacgtcatggaagatggaatgatagctccggtgacagatgatggcccttgtgatgatatcaccccttctcaccaggttaatgacataaaacaagataatggggattttacgcaacagaatgaacacaccagggaagtagatgataaaaatatcacagaagtaaatgcaatgccttcccaaagccctgaacagtctgcaggacagcaagtagaggaacactacgttggtaagtttcatgaggccattgctccagttaagagatccataaaccaactcactcggtaccagggtaagtcagtctggttgcttgcttatattgcttttgtaacatcatggccactccttggttccttagcttttatcgcatttaggaaaaagttcaggaataatttgctagctaagtggctgagaagataa

SEQ ID NO: 71649 - protein, 582 aa, Oryza sativa
MEAVAGGGGGGGGESVGELLLRAAAMVPAEHYALAALAVVSVLAYGFLELHFLGDLLRGFRGGRVELTFHPASEIYHRVASKCRSLHGRYLATPWLASPHLQTLFLGISGRPPSFTYKRQLYTVHDGGTIALDWLLATDSKGSDGILSEDASAPLVVIVPGLTSDSAAAYVKHMAYSMATKGCNTVVSNHRGLGGVSITSDCLYNAGWTEDLREVINYLHHKYPKAPMLCVGTSIGANIVVKYLGEEGENTPVAGAASICSPWDLVVGDRFISRKLVQRFYDKALAFGLKGYAKLHEPVLVRLANWEGIKKSRSIREFDHHATCMVAKYETVDTYYRRCSSASYVGNVSVPLLCVNALDDPLCTREAIPWDECRANKNIVLATTPNGGHLAFFQGLTAGRLWWVGAVSEFLFALLDSKYMHQQKAQDHILRSSLESSIDKSPYVNVMEDGMIAPVTDDGPCDDITPSHQVNDIKQDNGDFTQQNEHTREVDDKNITEVNAMPSQSPEQSAGQQVEEHYVGKFHEAIAPVKRSINQLTRYQGKSVWLLAYIAFVTSWPLLGSLAFIAFRKKFRNNLLAKWLRR

SEQ ID NO: 71650 - DNA, 1122 bp, Arabidopsis thaliana
  CDS (1)..(1122)
atgaattgcgcaatcacagaggatgatttgatctctccttacctcatcatcttcaaatcgctcttactcatcccaatctctcactatctcatcttcttcttcctcacaatcttacttttcctctacttcttcctagagattcattttcctaaagcagatcctatctctcttaccttcaatccaaactctgacttctgcaagtttattgtctccaagtgtcgtctccttcatggacgatactttcctacgttctggctttcaagccctcatcttcaaacagctttccttaccctttttggaaagtctcctcctttctcctataagcgaattctctatcaggcaacagatggtggcacaattgctttggattggttaatgcattctgatgttgtggaaggtatatctcaagtggtcaatgcctcaaatccaggaactgataggactccaattgctattatagttccagggctcactagtgattcttctgctgcatatattaaacatattgccttcaggctggcaaaggaaggatggaatgttgttgtgcaaaaccaccgtggacttggagggatatctttaacttctgactgcgtctacactgccgggtggacagaagatcttcggaaagtaattgctcacatccattctcagttcccagaggctcctttgtttgctgttggaacaagcattggtgccaacgttctggtaaaatatcttggggaggatgggccaaatacacctcttattggagctactgctgtgtgttctccttgggatctattgatatgtgatcgatttatcaaccgcaaactcgtgcaaaaagtgtatgacagaatgcttactattggtctacaaggttatgcacaattgcaccattccatcatttctcgtatagccgattgggaaggcattaagaagtcacgttcagttcgagagtttgacaactacgccaccaggcttgttgccaaattcgagacaactgatacatactatagacgttcaagcagttcacaatatgtggaaaatgtcgctgttccgctcctttgcatcagtgctttggatgatccagtttgtactagagaagctattccttgggatgaatgtagggcaaacaaaacatag

SEQ ID NO: 71651 - protein, 373 aa, Arabidopsis thaliana
MNCAITEDDLISPYLIIFKSLLLIPISHYLIFFFLTILLFLYFFLEIHFPKADPISLTFNPNSDFCKFIVSKCRLLHGRYFPTFWLSSPHLQTAFLTLFGKSPPFSYKRILYQATDGGTIALDWLMHSDVVEGISQVVNASNPGTDRTPIAIIVPGLTSDSSAAYIKHIAFRLAKEGWNVVVQNHRGLGGISLTSDCVYTAGWTEDLRKVIAHIHSQFPEAPLFAVGTSIGANVLVKYLGEDGPNTPLIGATAVCSPWDLLICDRFINRKLVQKVYDRMLTIGLQGYAQLHHSIISRIADWEGIKKSRSVREFDNYATRLVAKFETTDTYYRRSSSSQYVENVAVPLLCISALDDPVCTREAIPWDECRANKT

SEQ ID NO: 71652 - DNA, 1374 bp, Picea glauca
  CDS (1)..(1374)
atggcaatctctagcagatccgtgggcatgacagaaatccactgcaacttcccacagaatccgttccgcagaatttcccggcgaatttctcagttccgagcaggtttcccggacaaaaaacccgcagcgggcgcctgcgaagagcaggatgaattaacaagtggttcagccgcaagaattcagcggcgggacaagcagctgccggagattatcggttccgacagagaattaatgtctaaattgacgaccttggggcgtccttaccggcactttccatttatgggaaaccggcacgtggagactatattcgcttccttcttcagatcttggccggtaatcaagtccaggcgggagtgtcttagaatggaagatggcggtactgtggaactggactggccattggaaggggaagatgccgagctgtggaacggggagctgccggtcaacagccccgtccttattttactgccaggtcttacaggtgggagtgatgattcttacgtaaagcacatgcttttgcgagcaaggaagcatggatggcatagcgtagttttcaacagccgtggctgtgcagacagtcctgtcactacgcctcagttctactcagcttcctttacaaaggatctctgccaagttgtgaaacatgttgctgttcgtttttctgagtcgaatatatatgcggtcggttggtcccttggggccaatatccttgtgcggtatttaggcgaggtggctggtaactgccccctatctggagcagtttctctttgcaatcctttcaacttggtcatcgcagatgaggattttcacaagggtttgggtttcaataatgtctatgataaagctcttgctagaggtcttcgccaaatattcccaaagcatacacgtctttttgaagggatagaaggagaatacaatatacccacggttgctaaagcaagatctgtaagggattttgatggaggcttaacaagagtatcctttgggttccaatcagtgggcgactactacagcaattcaagcagctctctttctatcaaatatgtccaaacttctttattatgcatccaggcttcaaatgatccaatagctccctctcgtggtatcccttgggaagatatcaaggaaaatcctaattgcttgctggtagtgacaccgaatggtggtcatcttggttgggttgcgggagatgatgctccgtttggagcaccctggacagatcctcttgtgatggaatatttggaggttttggaaaagaatcaaatagaaaagccattacgtaggacaattgatgacgttcatactccaagagttgattctgtacatactcgagaaacaaacaactacaaaagtcctattgagaatgttaattga

SEQ ID NO: 71653 - protein, 457 aa, Picea glauca
MAISSRSVGMTEIHCNFPQNPFRRISRRISQFRAGFPDKKPAAGACEEQDELTSGSAARIQRRDKQLPEIIGSDRELMSKLTTLGRPYRHFPFMGNRHVETIFASFFRSWPVIKSRRECLRMEDGGTVELDWPLEGEDAELWNGELPVNSPVLILLPGLTGGSDDSYVKHMLLRARKHGWHSVVFNSRGCADSPVTTPQFYSASFTKDLCQVVKHVAVRFSESNIYAVGWSLGANILVRYLGEVAGNCPLSGAVSLCNPFNLVIADEDFHKGLGFNNVYDKALARGLRQIFPKHTRLFEGIEGEYNIPTVAKARSVRDFDGGLTRVSFGFQSVGDYYSNSSSSLSIKYVQTSLLCIQASNDPIAPSRGIPWEDIKENPNCLLVVTPNGGHLGWVAGDDAPFGAPWTDPLVMEYLEVLEKNQIEKPLRRTIDDVHTPRVDSVHTRETNNYKSPIENVN

SEQ ID NO: 71654 - DNA, 1350 bp, Saccharomyces cerevisiae
  CDS (1)..(1350)
atgcgtctaaaagaattgttacctaattttttgattgttcatcaagaggtccctgaggatcctattgcattcaagtccaccgataaacgagagaatgaaaataaagagatcaccatccctgagctaatagatactaaagttcctgaattagctgacggtgctactgacactttatatggtttactggtcaatggccatttacaaactgcatatggttcctttagacactttgacaatatatacaaagttcaatataaaagaatgataatcaaatacccacatgggggagaagggactgtggattttgctgtaaatggtagaagtaccaaaagaagaaaagtggaaaaagaatacgtgccgacaagtcaaccggtatttaacggaaacttgaaacgaagatattcgtactattcccctgatgatcctaaattgaactcagacgatgctaagcctatgcttattattctccatggattaacagggggttcgagggaaagctacgtgagggcaattgttcatgaaatcaccacgaagtatgactttgaagcatgcgtgtttaatgctagaggatgttgttattctgcaattacaacgccgctattatacaacggtggttggaccaatgatataagatattgtgttaatgacttgaggaaaagatttccgaatagaaagttttatatgatgggattttcgttaggcgcatctataatgacaaattacttgggagaagagtcagatcgtactaaaatcgaatgtgctatttccgtgagtaatccatttgacctgtacaactctgcatattttattaacagtacaccaatggggtcacgattttattcacctgctttgggtcacaacttactacgcatggttcgaaaccatctctctactctggaagaaaaccctgatttcaaagatgttatcgagaagcatttaaaaaagattcgcactgtgaggcaatttgataacttgttgacaggcccaatgtttggatataaaaatgcagaggagtattacaagaatgcttcatcatataaaagaatacccgggatcagaactccttttatagctttgcatgctcaggatgacccaattgtcggaggtgatcttcctatagaccaaataaaatccaatccatacactttgcttctagaaacttcgacgggggggcatgttggatggttcaaagacagatccggcagaaggtggtacgcagaacccttatgcagatttttgaaaatatttcacgacgaaattactgtaaagggcttaaaacctgacttggaaaatgttcaactcccagatcctaattgcgaacccatagccacaacctttcgcgcgaattag

SEQ ID NO: 71655 - protein, 449 aa, Saccharomyces cerevisiae
MRLKELLPNFLIVHQEVPEDPIAFKSTDKRENENKEITIPELIDTKVPELADGATDTLYGLLVNGHLQTAYGSFRHFDNIYKVQYKRMIIKYPHGGEGTVDFAVNGRSTKRRKVEKEYVPTSQPVFNGNLKRRYSYYSPDDPKLNSDDAKPMLIILHGLTGGSRESYVRAIVHEITTKYDFEACVFNARGCCYSAITTPLLYNGGWTNDIRYCVNDLRKRFPNRKFYMMGFSLGASIMTNYLGEESDRTKIECAISVSNPFDLYNSAYFINSTPMGSRFYSPALGHNLLRMVRNHLSTLEENPDFKDVIEKHLKKIRTVRQFDNLLTGPMFGYKNAEEYYKNASSYKRIPGIRTPFIALHAQDDPIVGGDLPIDQIKSNPYTLLLETSTGGHVGWFKDRSGRRWYAEPLCRFLKIFHDEITVKGLKPDLENVQLPDPNCEPIATTFRAN

SEQ ID NO: 71656 - DNA, 1371 bp, Saccharomyces cerevisiae
  CDS (1)..(1371)
atgtttcgctcgggttactatccaactgtcactcctagccattggggctataacggcaccgtcaaacatgtactgggagagaaaggaaccaagtctttggctttcagagattctaagcgccaaattcctcttcatgaattcgtaaccaaacacgtgcctacactcaaagatggtgcaaattttaggttaaacagcttgcttttcacaggttacttacagaccctttatttgtcagccggtgatttttccaaaaaatttcaggtattttatggaagagagattataaaattttctgatggaggggtctgcactgcagattgggttatgcctgaatgggagcaaacatattcattaaatgctgaaaaggctagttttaacgagaaacaattttcgaacgatgaaaaggccacccatccaaagggttggcctcgtcttcacccgagaactagatatctatcctctgaggaacttgaaaaatgtcattctaagggttattcttaccctttagtggtagtacttcatggtcttgcagggggaagccatgagcctctcatcagggcattatctgaagatctatcaaaagtcggtgacggtaaattccaagtggtagtccttaatgctagaggttgctcaagatctaaagtcaccacccgtagaatctttaccgcattacacacaggtgatgtgagagaatttttgaaccaccaaaaagctctatttccgcaaagaaaaatatatgcagtcggaacatcatttggagcagccatgctaacgaactacttaggtgaagaaggagataactgtccattaaatgctgcagtcgctctctcaaacccatgggatttcgtacacacttgggacaagttggctcatgattggtggtccaaccatattttttctagaactttaacacaatttctaacaaggactgtcaaggttaatatgaatgagttgcaggtaccagagaattttgaggtttcgcacaaaccgacagttgagaaaccagtcttttatacgtataccagagaaaatttggaaaaggctgaaaaatttacagacatattagaattcgataatcttttcactgccccatcgatgggcctgccggacgggttaacatattatagaaaggccagttcgataaatagattgcctaatatcaaaatcccaactttaataatcaacgcaacggatgatccagttacaggtgaaaacgtaattccgtacaaacaagctagagaaaatccttgtgtgttgttatgcgagactgacttgggtggacatttggcttatctcgacaatgaaagtaattcctggttaacaaagcaagctgccgagttcttgggcagctttgatgagttagttttataa

SEQ ID NO: 71657 - protein, 456 aa, Saccharomyces cerevisiae
MFRSGYYPTVTPSHWGYNGTVKHVLGEKGTKSLAFRDSKRQIPLHEFVTKHVPTLKDGANFRLNSLLFTGYLQTLYLSAGDFSKKFQVFYGREIIKFSDGGVCTADWVMPEWEQTYSLNAEKASFNEKQFSNDEKATHPKGWPRLHPRTRYLSSEELEKCHSKGYSYPLVVVLHGLAGGSHEPLIRALSEDLSKVGDGKFQVVVLNARGCSRSKVTTRRIFTALHTGDVREFLNHQKALFPQRKIYAVGTSFGAAMLTNYLGEEGDNCPLNAAVALSNPWDFVHTWDKLAHDWWSNHIFSRTLTQFLTRTVKVNMNELQVPENFEVSHKPTVEKPVFYTYTRENLEKAEKFTDILEFDNLFTAPSMGLPDGLTYYRKASSINRLPNIKIPTLIINATDDPVTGENVIPYKQARENPCVLLCETDLGGHLAYLDNESNSWLTKQAAEFLGSFDELVL

SEQ ID NO: 71658 - DNA, 24 bp, Artificial sequence
  primer
atgtcagaagtttccaaatggcca

SEQ ID NO: 71659 - DNA, 26 bp, Artificial sequence
  primer
tcatacgactaattcatcaaacttag

SEQ ID NO: 71660 - protein, 445 aa, Artificial sequence
  consensus sequence
  Variant (2)..(2): Xaa in position 2 is any amino acid
  Variant (4)..(7): Xaa in position 4 to 7 is any amino acid
  Variant (11)..(23): Xaa in position 11 to 23 is any amino acid
  Variant (24)..(25): Xaa in position 24 to 25 is any or no amino acid
  Variant (27)..(27): Xaa in position 27 is any amino acid
  Variant (29)..(34): Xaa in position 29 to 34 is any amino acid
  Variant (35)..(49): Xaa in position 35 to 49 is any or no amino acid
  Variant (51)..(77): Xaa in position 51 to 77 is any amino acid
  Variant (78)..(118): Xaa in position 78 to 118 is any or no amino acid
  Variant (120)..(125): Xaa in position 120 to 125 is any amino acid
  Variant (128)..(128): Xaa in position 128 is any amino acid
  Variant (132)..(151): Xaa in position 132 to 151 is any amino acid
  Variant (152)..(161): Xaa in position 152 to 161 is any or no amino acid
  Variant (163)..(163): Xaa in position 163 is any amino acid
  Variant (165)..(165): Xaa in position 165 is any amino acid
  Variant (169)..(173): Xaa in position 169 to 173 is any amino acid
  Variant (175)..(183): Xaa in position 175 to 183 is any amino acid
  Variant (185)..(185): Xaa in position 185 is any amino acid
  Variant (187)..(187): Xaa in position 187 is any amino acid
  Variant (189)..(192): Xaa in position 189 to 192 is any amino acid
  Variant (193)..(199): Xaa in position 193 to 199 is any or no amino acid
  Variant (201)..(207): Xaa in position 201 to 207 is any amino acid
  Variant (209)..(209): Xaa in position 209 is any amino acid
  Variant (211)..(211): Xaa in position 211 is any amino acid
  Variant (214)..(218): Xaa in position 214 to 218 is any amino acid
  Variant (224)..(237): Xaa in position 224 to 237 is any amino acid
  Variant (238)..(241): Xaa in position 238 to 241 is any or no amino acid
  Variant (243)..(243): Xaa in position 243 is any amino acid
  Variant (245)..(268): Xaa in position 245 to 268 is any amino acid
  Variant (269)..(269): Xaa in position 269 is any or no amino acid
  Variant (271)..(298): Xaa in position 271 to 298 is any amino acid
  Variant (299)..(332): Xaa in position 299 to 332 is any or no amino acid
  Variant (335)..(337): Xaa in position 335 to 337 is any amino acid
  Variant (339)..(349): Xaa in position 339 to 349 is any amino acid
  Variant (350)..(358): Xaa in position 350 to 358 is any or no amino acid
  Variant (361)..(363): Xaa in position 361 to 363 is any amino acid
  Variant (365)..(374): Xaa in position 365 to 374 is any amino acid
  Variant (376)..(382): Xaa in position 376 to 382 is any amino acid
  Variant (386)..(391): Xaa in position 386 to 391 is any amino acid
  Variant (392)..(393): Xaa in position 392 to 393 is any or no amino acid
  Variant (395)..(400): Xaa in position 395 to 400 is any amino acid
  Variant (401)..(416): Xaa in position 401 to 416 is any or no amino acid
  Variant (418)..(419): Xaa in position 418 to 419 is any amino acid
  Variant (420)..(424): Xaa in position 420 to 424 is any or no amino acid
  Variant (426)..(427): Xaa in position 426 to 427 is any amino acid
  Variant (431)..(440): Xaa in position 431 to 440 is any amino acid
  Variant (441)..(444): Xaa in position 441 to 444 is any or no amino acid
PXLXXXXLQTXXXXXXXXXXXXXXXYXRXXXXXXXXXXXXXXXXXXXXXDXXXXXXXXXXXXXXXXXXXXXXXXXXXXXXXXXXXXXXXXXXXXXXXXXXXXXXXXXXXXXXXXXXXXPXXXXXXGLXGGSXXXXXXXXXXXXXXXXXXXXXXXXXXXXXXVXNXRGCXXXXXTXXXXXXXXXTXDXRXXXXXXXXXXXPXXXXXXXGXSXGAXXXXXYLGEEXXXXXXXXXXXXXXXXXXPXDXXXXXXXXXXXXXXXXXXXXXXXXXLXXXXXXXXXXXXXXXXXXXXXXXXXXXXXXXXXXXXXXXXXXXXXXXXXXXXXXXXXXXXXXFDXXXTXXXXXXXXXXXXXXXXXXXXYYXXXSXXXXXXXXXXPXXXXXXXDDPXXXXXXXXPXXXXXXXXXXXXXXXXXXXXXXNXXXXXXXTXXGGHXXXXXXXXXXXXXXW

SEQ ID NO: 71661 - protein, 25 aa, Artificial sequence
  protein pattern
  Variant (2)..(2): Xaa in position 2 is any or no amino acid
  Variant (4)..(4): Xaa in position 4 is any amino acid
  Variant (8)..(8): Xaa in position 8 is Ala, Cys, Gly or Ser
  Variant (9)..(11): Xaa in position 9 to 11 is any amino acid
  Variant (12)..(12): Xaa in position 12 is Ile, Leu or Val
  Variant (13)..(13): Xaa in position 13 is any amino acid
  Variant (14)..(14): Xaa in position 14 is Asn, Ser or Thr
  Variant (15)..(16): Xaa in position 15 to 16 is any amino acid
  Variant (17)..(17): Xaa in position 17 is Phe, Ile or Leu
  Variant (18)..(18): Xaa in position 18 is Phe or Tyr
  Variant (19)..(19): Xaa in position 19 is any amino acid
  Variant (20)..(20): Xaa in position 20 is Ala or Gly
  Variant (21)..(24): Xaa in position 21 to 24 is any amino acid
VXNXRGCXXXXXXXXXXXXXXXXXD

SEQ ID NO: 71662 - protein, 26 aa, Artificial sequence
  protein pattern
  Variant (2)..(2): Xaa in position 2 is Asp, Glu, Asn, Gln, Arg or Ser
  Variant (3)..(4): Xaa in position 3 to 4 is any amino acid
  Variant (5)..(5): Xaa in position 5 is Phe, Ile, Leu or Val
  Variant (6)..(8): Xaa in position 6 to 8 is any amino acid
  Variant (10)..(10): Xaa in position 10 is any amino acid
  Variant (12)..(12): Xaa in position 12 is Phe, Ile or Leu
  Variant (14)..(14): Xaa in position 14 is Ala, Gly or Ser
  Variant (15)..(15): Xaa in position 15 is Ala, Asn, Ser, Thr or Val
  Variant (16)..(16): Xaa in position 16 is Ile, Met or Val
  Variant (17)..(17): Xaa in position 17 is any amino acid
  Variant (18)..(18): Xaa in position 18 is Ala, Gly, Thr or Val
  Variant (19)..(19): Xaa in position 19 is any amino acid
  Variant (21)..(21): Xaa in position 21 is any amino acid
  Variant (23)..(23): Xaa in position 23 is any or no amino acid
  Variant (25)..(25): Xaa in position 25 is Ala, Asp, Glu, Gly, Gln or Ser
  Variant (26)..(26): Xaa in position 26 is Ala, Asp, Glu, Gly, Asn or Ser
PXXXXXXXGXSXGXXXXXXYXGXEXX

SEQ ID NO: 71663 - protein, 27 aa, Artificial sequence
  protein pattern
  Variant (3)..(4): Xaa in position 3 to 4 is any amino acid
  Variant (5)..(5): Xaa in position 5 is Ala, Gly or Ser
  Variant (6)..(6): Xaa in position 6 is Gly or Ser
  Variant (7)..(10): Xaa in position 7 to 10 is any amino acid
  Variant (11)..(11): Xaa in position 11 is Ile, Leu or Val
  Variant (12)..(13): Xaa in position 12 to 13 is any amino acid
  Variant (14)..(14): Xaa in position 14 is Ile or Val
  Variant (15)..(16): Xaa in position 15 to 16 is any amino acid
  Variant (18)..(18): Xaa in position 18 is any amino acid
  Variant (19)..(19): Xaa in position 19 is Phe, Ile, Leu or Val
  Variant (20)..(20): Xaa in position 20 is any amino acid
  Variant (21)..(21): Xaa in position 21 is Ile, Leu or Val
  Variant (22)..(22): Xaa in position 22 is any amino acid
  Variant (23)..(23): Xaa in position 23 is Ala or Ser
  Variant (24)..(24): Xaa in position 24 is any amino acid
YYXXXXXXXXXXXXXXPXXXXXXXDDP

SEQ ID NO: 71664 - protein, 24 aa, Artificial sequence
  protein pattern
  Variant (2)..(3): Xaa in position 2 to 3 is any amino acid
  Variant (4)..(4): Xaa in position 4 is Ile, Leu or Val
  Variant (5)..(7): Xaa in position 5 to 7 is any amino acid
  Variant (10)..(10): Xaa in position 10 is Ala, Gly, Ser or Thr
  Variant (14)..(18): Xaa in position 14 to 18 is any amino acid
  Variant (19)..(23): Xaa in position 19 to 23 is any or no amino acid
PXXXXXXGLXGGSXXXXXXXXXXR

SEQ ID NO: 71665 - protein, 24 aa, Artificial sequence
  protein pattern
  Variant (2)..(7): Xaa in position 2 to 7 is any amino acid
  Variant (9)..(15): Xaa in position 9 to 15 is any amino acid
  Variant (16)..(16): Xaa in position 16 is Ala, Ser or Thr
  Variant (17)..(17): Xaa in position 17 is Asp, Asn, Pro, Ser or Thr
  Variant (18)..(18): Xaa in position 18 is any amino acid
  Variant (22)..(22): Xaa in position 22 is Ile, Leu or Val
  Variant (23)..(23): Xaa in position 23 is Ala, Cys, Gly or Ser
  Variant (24)..(24): Xaa in position 24 is Phe, Trp or Tyr
PXXXXXXNXXXXXXXXXXGGHXXX

SEQ ID NO: 71666 - DNA, 2637 bp, Saccharomyces cerevisiae
  CDS (1)..(2637)
atgtacgatagcaggggtgtcgcattgcactctgaactaattcataggtggaatcacgctttttccatcttatccattgttgcatttccaaaaaaaagattgttgtttgctggtagccaagactccaagatattggtttttgatcttcccacatataatctaatacatacgattagactaggcgaatcacaagaggaaacgcataccagatcttcggttttgtgcttgacaggatcagaagatgaaaactttttattttcaggcggcgcagattctttggtgagaatttggtccattggcgaaaagaccattagagatgactttctacctgttactgaaatagccactgtttactcagtgaccgatattggtgatattttctcattggcatatttggattcgttggaaactattgtctttggctgtcaaaatgcaagcttactatatgttgagaacttgattcagaagattgaaaaaaaatcctctgatggagtagaaaatatcaataaattaccgcatagaagatatgataagttctttgattcgttaggtccgactggatatagttcaaattcattatctcaaacttcattgacctctctacaagaaaactgtggcgctgccatcatagaggttccctccgaaaacattattaaatatgcacattatgggtttatttattctattaataaattgtgtcccaggtttaatcagttattggaaaaaagctcacgaacttctggtgcagagcacataatttcatccgctggtgatggaataagcaagctttgggagttctctaaagataaagggcaaaacactgttaaaatctccttgataaacgataaaatcgacaatgaagatagcgtcatatcccaaactattgagttcccatttttatattgcgggttgactgacgggattataaaaatctgggacttaaatactcagcaaataatctcaactctgaaaacaaagcatgaatcggacgtcatttcaatatcagtttatatggaccatgtatttgccattgatgaatcaggcatcacgcatttttaccagaaccaagttaaccattggaaccctcaacaaggaaaaatattaagctcagagattttcagtaaatcaaatgctggatctgttagtttattaacgggtggtagcgatgggtcattgactctctgggatataacctcattattatctgcggtgcctctgtcaagcaactcacccatcaatgcatcatctacattacaaaccaccaatttatgggccgcctatcaatctgcctctctaaataacgaggagatgttaaacacactgagagaacttatttctttccagacagtgtctcaaagcaaagacactactaatactttgtcattaaggcgttgtgcaatctacctgcaacaattattcttgaagtttggagctacaaactcccaattatttccattgcctgatggtggtaatcctgttgtattcgcatattttcaagggaatgggaaagtttcacaggtgaagggtgccaagaaaaagcgtattctatggtatgggcattatgacgttatatcgtctggaaatactttcaactggaataccgacccatttactttaacttgtgaaaacggatacttaaaaggtcgaggagtatcagataataaagggccattggtgagcgctattcatagtgtggcgtatttgtttcaacagggagaattggtgaacgatgtcgtatttttggtggaaggaagtgaagaaatcggatctgctagtttgaagcaagtttgtgaaaagtaccatgatattattggaaaagatattgactggattttattaagtaattctacttgggttgatcaagaacatccatgcttgaattatggattgagaggtgttattaatgcccaaataaaagtctggagcgataagcctgacggacattctggtcttaacggtggtgtttatgatgaacctatggttaatttagtgaaaatcgtgtccaaactacaaaacgaacaaaatgaaattatgattccaaatttttattcaccattgaaagatctgactgaagaagaatatcaaaggtttcagaaaattaccgagcttgcaaatatcgacgaaaatactactgttcaagatttaattaccaactggactaagccttccttgtctatgacaacagtcaagtttagcggtcctggtaacataacagttattccaaaaagtgtcaccatgggtatctccatcaggttagtacctgagcaaagtgtagaacaagtcaagagagatctcaaagcgtatttagaagaaagtttcaagcaattgaaatctcaaaatcatctagaaattaaagttttaaacgaagcagaaggttggttgggtgacccaacaaatcatgcataccaaatattaaaggacgaaattactactgcatgggacgtagaaccattgctagtaagagaaggaggttctatttcatgtttgagaatgttggaaagaatattcgacgcgccagctgttcaaataccatgtggccaatccactgacaatggccatttagccaacgaaaatctcagaatcaaaaattggtctaatttgactgagattttgtctaaagtattcaataggttataa

SEQ ID NO: 71667 - protein, 878 aa, Saccharomyces cerevisiae
MYDSRGVALHSELIHRWNHAFSILSIVAFPKKRLLFAGSQDSKILVFDLPTYNLIHTIRLGESQEETHTRSSVLCLTGSEDENFLFSGGADSLVRIWSIGEKTIRDDFLPVTEIATVYSVTDIGDIFSLAYLDSLETIVFGCQNASLLYVENLIQKIEKKSSDGVENINKLPHRRYDKFFDSLGPTGYSSNSLSQTSLTSLQENCGAAIIEVPSENIIKYAHYGFIYSINKLCPRFNQLLEKSSRTSGAEHIISSAGDGISKLWEFSKDKGQNTVKISLINDKIDNEDSVISQTIEFPFLYCGLTDGIIKIWDLNTQQIISTLKTKHESDVISISVYMDHVFAIDESGITHFYQNQVNHWNPQQGKILSSEIFSKSNAGSVSLLTGGSDGSLTLWDITSLLSAVPLSSNSPINASSTLQTTNLWAAYQSASLNNEEMLNTLRELISFQTVSQSKDTTNTLSLRRCAIYLQQLFLKFGATNSQLFPLPDGGNPVVFAYFQGNGKVSQVKGAKKKRILWYGHYDVISSGNTFNWNTDPFTLTCENGYLKGRGVSDNKGPLVSAIHSVAYLFQQGELVNDVVFLVEGSEEIGSASLKQVCEKYHDIIGKDIDWILLSNSTWVDQEHPCLNYGLRGVINAQIKVWSDKPDGHSGLNGGVYDEPMVNLVKIVSKLQNEQNEIMIPNFYSPLKDLTEEEYQRFQKITELANIDENTTVQDLITNWTKPSLSMTTVKFSGPGNITVIPKSVTMGISIRLVPEQSVEQVKRDLKAYLEESFKQLKSQNHLEIKVLNEAEGWLGDPTNHAYQILKDEITTAWDVEPLLVREGGSISCLRMLERIFDAPAVQIPCGQSTDNGHLANENLRIKNWSNLTEILSKVFNRL

SEQ ID NO: 71668 - DNA, 2667 bp, Eremothecium gossypii
  CDS (1)..(2667)
atggctaatgagcctcccctgattcacttgtggaaccacccccactccattatttcaacgatagcatttccgcacagaaagctgctctttgcggggacacaagattcaaagatcttgtgttttgatctttgcacgtacaatttggtcaagacgatacatcttggagaggataccgataatttcacgaagactagtgtgttaggcctcagcaagtcccaagacgaaaagctattgtttagtgcgggcacagactcgctggtaagagtgtggtctataggaacagtgccccaagatgatagcattgaggcgaaggagctggttactatttactccctcatggatatcggggacatcttttccttggcgtatcttgacgcggaacaaacgctagtgttcggctgtcagaatgcgtctatgctatatgttgacaatttcatggctcgtaagattcccactcgctcggccatagactttgataaacttccgcacagacggtataacaaattttttgactcaactggaccaggcggaggaggtggaggaggtggaggaggtggaggcggcacaggcggcgcaggtggcggcgtgagtaatcttccgtctgtccgaagtgctagctttatttcacccgagggtaacaacttgatactacaggtgccgtcggaaaatatcatcacttatgcacacaatggcttcatatactccatttgccggataaatggccgcgggacgtggctttctacgcatttcgagcaatacgctactgatccaaacgtttcattttttgtttcaagtgccggcgacggcatctcgaagatatgggcactcttgccattgaattcacaagaaagaagagttggccacaaggtacagctattgacggagtttgacaatgaagagagtgtgttctgccaattcgtcgaatacccatttttgtattgtggtcttagcggtggaatcattaagatctgggatctcaatatcaaccaacttgtgacgtcgcttaaaacaccatatgcggaggacattatgtccatcaccgtgtacaaggacaatgtttttgccacgcacaagcagggcattacgcggttccaccaagggaacgtgaacttctggaatgctcaccagggactcgtcttgagtagcgaaatattgcgcaagagctgtaccagtaatcgtatagatcggatggttactggcggaaatgatgggtcattagcgttgtggaatattaacgaatggctgaacggtacagcgtccccgggtggatcagccccgaccgaagaacactcgcttccctctggcgagcgccgaaattcttggaccgagtatcaacaaatccagttagataacgatcacatgattgcaacactgcgggaattcattagttaccagactgtttcccaactcccagagccccaaaatatcatcgattcgcgtaggtgtgcgaacttcctgcaaaatctcttcactaagctcggtgctaaccattgtgggcttatacctgtcagtacaggcagcaacccggtggttctcgcgcagttcaagggcaatgcagccgcgcccaaacgcatactatggtatggccactacgatgtgatatccgcggaccacccgtcgcagtgggacaacgaccccttcacgctcacttgcgaaaatgggtatcttaagggaagaggcgtgtctgataacaaaggcccgctgcttgccgccatcttcagtgtagccgagcttttccagaaaggatacctgaacaacgacatcatctttctagtcgagggcgaggaagaaaatggctctcgcggcttcagggaaattttgcttgcctccgaagggcttctcaatcagcggtgggactggatcctgttcagcaattcctactggctggatcagaaggtgccctgcctcaactatggcctccgaggcgtcataaacgccgaaatcaccatatcatccgacgagcccgaccgccactccggtgtcgatggcggtgtctatcgcgagccttcggccgacctcatctgcatcacctcgaagttacaggccgatgatggcactatcaggatcccccacttccacgacgccgtccagcccgtcaccgagcaggagcgccaggacttccgcgatatcatcagccgcgccgagatcgacaaccgcaccaccgtcgagcacctcgtagcaaaatggacccagcccagcatctccttcacaaagttcaacaccagtggccccggtaacgccaccgtcatctcccagcgtgcgagccttgtcgtctccatccgtctcgttccgccccaggacgtccgcacgatcaaacagcttctgatcgactacatcacacagagctttgccgctctccgctcgcgaaaccacctgcacatctccattctcaacgaggccgagccatggctgggcgacccccacaacacctgctacgaaatactgcgcgaggagctgcacgacacctggggaattgacccactgttcatccgcgagggtggctccattccctgcatccggttcctcgagcgccagctgaatgctcccgccgtccagatcccgtgcggacagtcaacggacaatgctcacttggataacgaaaatctacgcatcaagaactggtataacatgcgcgccatcttaaccaaggtatttaacagactatag

SEQ ID NO: 71669 - protein, 888 aa, Eremothecium gossypii
MANEPPLIHLWNHPHSIISTIAFPHRKLLFAGTQDSKILCFDLCTYNLVKTIHLGEDTDNFTKTSVLGLSKSQDEKLLFSAGTDSLVRVWSIGTVPQDDSIEAKELVTIYSLMDIGDIFSLAYLDAEQTLVFGCQNASMLYVDNFMARKIPTRSAIDFDKLPHRRYNKFFDSTGPGGGGGGGGGGGGGTGGAGGGVSNLPSVRSASFISPEGNNLILQVPSENIITYAHNGFIYSICRINGRGTWLSTHFEQYATDPNVSFFVSSAGDGISKIWALLPLNSQERRVGHKVQLLTEFDNEESVFCQFVEYPFLYCGLSGGIIKIWDLNINQLVTSLKTPYAEDIMSITVYKDNVFATHKQGITRFHQGNVNFWNAHQGLVLSSEILRKSCTSNRIDRMVTGGNDGSLALWNINEWLNGTASPGGSAPTEEHSLPSGERRNSWTEYQQIQLDNDHMIATLREFISYQTVSQLPEPQNIIDSRRCANFLQNLFTKLGANHCGLIPVSTGSNPVVLAQFKGNAAAPKRILWYGHYDVISADHPSQWDNDPFTLTCENGYLKGRGVSDNKGPLLAAIFSVAELFQKGYLNNDIIFLVEGEEENGSRGFREILLASEGLLNQRWDWILFSNSYWLDQKVPCLNYGLRGVINAEITISSDEPDRHSGVDGGVYREPSADLICITSKLQADDGTIRIPHFHDAVQPVTEQERQDFRDIISRAEIDNRTTVEHLVAKWTQPSISFTKFNTSGPGNATVISQRASLVVSIRLVPPQDVRTIKQLLIDYITQSFAALRSRNHLHISILNEAEPWLGDPHNTCYEILREELHDTWGIDPLFIREGGSIPCIRFLERQLNAPAVQIPCGQSTDNAHLDNENLRIKNWYNMRAILTKVFNRL

SEQ ID NO: 71670 - DNA, 3117 bp, Magnaporthe grisea 70-15
  CDS (1)..(3117)
atggcgacaacacatctgatacaaatctcgcccaattgccgagaaccgtcaccagctccccacaacgcattcgtctggagacttgaaggcggtagacgcagctcatcatttgcatcacaagcgaatcctctcagcatcgacgacgaaatgggtgtggtcgacgactaccactcgagcaaccatgtggatagaaaccgcgaggagcacgaagaagccacagagagcgactgtcagggatgtcacaggatcagggttgacgaggaaagacggcagaaattgagtttggcagatctgggagcgattcacggagctgcatttcccaatggcacggtcgaccctccccactctggaatcgggatgccgctggcggccaactcgtcggcgacgtcaccgccctcgaatggcctggccacaaccttccccgcacacttgcagagtccagaacgtatccaccagctgaagcatgatagctctgttctggcacttgctgtcaacgacgagttcatatacgccggcactcatgatggcgaaatattggtctggtcattggggacgttccagctagttcaacgtgtccaggcccacaagcgcagcgttctctgcctcttcctctcgtcgccgaccgacaaagacataacaaaaccatcatcttccgatgacgcctccgaacctcaagaatcgcggccctcgtctctcctcttctcttccgccggcgatgccattatcagcgtgtggtgtccgcgcacgctcaagcgcttgtacgagatatacagttcccacgatgttggcgacgtctttagcgtggcctattcctcccagaacgacaccgtctacattggcgcacagaacacttcgatccagtgggttcggctgaacgacccagaagcccgcgttcttcatgagtctgctcagcacccggaccggagataccatcgcttcttcgattccaaggcagtcgggggcacgagcacaccacggcgcaacgatgatcgcttctcgatgatccccaaggcgcagtccgtccttgagatatcacagggtgcaatccatcagtttgcgcattttggttacgtttattgcatgctcatatccaggggcccgaccgtacgggtcggacaagatgaggacgtccttatatctggaggtggcgatggcacgataaagctttggagactagcgcaccacgctaagactaccgacggcagtgtacagaccggcgccgaggagggcatagaagagataatggtattgggcacagatgaggctgagtctgtcttgtctttggctattgatgggtcattcctatatagcggcaagcttgacggagtgatagagctatgggacctcgacacaaagcagaaattgcgcgtcatcaaggcacatgacgcagatgtcatgacattacagatcagatggggtctcttgtggagtgccgcggcgaacggcgttgcgacaaaacacagcaccgtcaatgacaaccgtgacgccagccccgggtcggacttggctagccacaaataccgctgtctcagccggtggactgctcacgatggcaaaattctcgcgtcggcagccacatcccacaagggcgagcggtttttcatcaccggcgcgaatgacgacaacgtatgcgtctggcgcgtgaacgactgcatagatggggcgactgaacaaaaggccgtggctgaagacgagctgttgcgttctctccgcaagtttgtctcctacaagaccatatcttcacgcccagaatatgcagaagactgccgccgaggagccacgttcctctgctccttgttcaaaaggctgggagccgaggtagaaatgctatcaagtggtgacagtaacaacctccacaaccccgtcgtttttgcaaagttttctggatatcaagagcctgccgaaaagcgcaagcgaatcttgttctacggccattacgatgtggttcctgccgacgccaagaaaggcaactggacctcagacccgttcacacttactggaaccaacggctacctgtacgggcgtggtgtctcagacaataaaggccctatcatggcggctttgtatgcagtaacagatttgatgcaggccaaacaacttcgctcggatgttgtctttctgatcgaaggcgaggaggagtctggttcacggagcttcaaggaagccgtaaggcggaaccgcgatctcatcggagacgtggattacatactattggcgaacagctattggctggacgacgagacgccttgcctgacctatggcctccgaggtgtcctgcacgcgacggtctgcgtcgactcaccacacccggaccttcactccggcgttgatggttcctacatgatggcggagccgctgtcagacttgacctgtctccttagcaagctcaagggcccagggaacaaggtgatgataccaggtttctacgacggagtgttgccgctcaccccccacgaggagaagagatacgatgcaattgcatccatcctgatgaagcgcagtccggagaacgggccggctgaggctttgaagcgaagcttgatggctcggtggcgcgagcccaacctgacgatccacagatacaaagtgtcgggtccggacggaagcctggtcagcagccatgctagcgcgaacatatctttgcggttggtcccggggcaagaggtcgacgtggtggcggcgtcgctgaggtctttgctggaaagtgaattcgtcagcttgggcggtagcaactcgctcagcatgcggattgacaaccaggcggagccatggctgggcgacccaagcaacgagatcttcaggactctcgagaacgccgtggtaaaggtctggggtctggacgcgaatgaggagcagggtgcggaggatggcgacaatagccatgacggggtggaggcttcggcaactaccaaggccaagacgaggaagcccctgtacatccgcgagggcggttccattcccgccattcgatttttggagaaggaatttgccgcgccggcggcacatttgccgtgcggccaggccagcgatgccgcgcatcttgataacgagcgactgagggtcctgaatctcctgaaaagccgggagatatttggggatgtctttaaaagtttgtga

SEQ ID NO: 71671 - protein, 1038 aa, Magnaporthe grisea 70-15
MATTHLIQISPNCREPSPAPHNAFVWRLEGGRRSSSFASQANPLSIDDEMGVVDDYHSSNHVDRNREEHEEATESDCQGCHRIRVDEERRQKLSLADLGAIHGAAFPNGTVDPPHSGIGMPLAANSSATSPPSNGLATTFPAHLQSPERIHQLKHDSSVLALAVNDEFIYAGTHDGEILVWSLGTFQLVQRVQAHKRSVLCLFLSSPTDKDITKPSSSDDASEPQESRPSSLLFSSAGDAIISVWCPRTLKRLYEIYSSHDVGDVFSVAYSSQNDTVYIGAQNTSIQWVRLNDPEARVLHESAQHPDRRYHRFFDSKAVGGTSTPRRNDDRFSMIPKAQSVLEISQGAIHQFAHFGYVYCMLISRGPTVRVGQDEDVLISGGGDGTIKLWRLAHHAKTTDGSVQTGAEEGIEEIMVLGTDEAESVLSLAIDGSFLYSGKLDGVIELWDLDTKQKLRVIKAHDADVMTLQIRWGLLWSAAANGVATKHSTVNDNRDASPGSDLASHKYRCLSRWTAHDGKILASAATSHKGERFFITGANDDNVCVWRVNDCIDGATEQKAVAEDELLRSLRKFVSYKTISSRPEYAEDCRRGATFLCSLFKRLGAEVEMLSSGDSNNLHNPVVFAKFSGYQEPAEKRKRILFYGHYDVVPADAKKGNWTSDPFTLTGTNGYLYGRGVSDNKGPIMAALYAVTDLMQAKQLRSDVVFLIEGEEESGSRSFKEAVRRNRDLIGDVDYILLANSYWLDDETPCLTYGLRGVLHATVCVDSPHPDLHSGVDGSYMMAEPLSDLTCLLSKLKGPGNKVMIPGFYDGVLPLTPHEEKRYDAIASILMKRSPENGPAEALKRSLMARWREPNLTIHRYKVSGPDGSLVSSHASANISLRLVPGQEVDVVAASLRSLLESEFVSLGGSNSLSMRIDNQAEPWLGDPSNEIFRTLENAVVKVWGLDANEEQGAEDGDNSHDGVEASATTKAKTRKPLYIREGGSIPAIRFLEKEFAAPAAHLPCGQASDAAHLDNERLRVLNLLKSREIFGDVFKSL

SEQ ID NO: 71672 - DNA, 2724 bp, Gibberella zeae PH-1
  CDS (1)..(2724)
atgccttcacggacggtatcgccgataatgtcacccggcccagcgtctccgattctttcgcccctcgaagctgccgaagaccctgccacgagtcccggcctcgtccactcgctatcccacgcaagcaccgttctcgctctcgccgttagtccacagcacgaaaccatctacgccggtacacaagacggtgaaatagtagcatggtctctcgaaacattccgacaagtccgccgtgtccaagcgcacaagagaagcattctctcgctttcgctatcacctgatgcctctcttttgttctcgagtgctggagatcccatcatcaacgtttgggaccctaagaccttgactcgactctacgagatttacggctcctacgacgtcggtgatatcttttgcacagcgtatagtcctcaacatgagacgctatatatcggtgcacagaacgctactatccaatgggttggcctcaacgacgttaccgctcgcgtgtcccccgaatcccaacagcaccccgaccgccgaaatcaccgcttcttcgactccaaggccgttggtggcggcgcgagtacaccccgacgcaacgacgatcgatggggattgatccccaaagcccataatgtcctcgagatgcacgccggctgcgtcaagaactttgcgcactacggctacgtatactgcatgctcatggccaagggtccgacagttgacgttggcactgatgatgatgttttgatctctggtgcgggtgatggtacaatcaagctttggagtctgggacatacggtgaaggacgatgaggagcttggtgatggtatacaggagatcatgacactaggtgtcgatgatggcgagtctgttctgtctatggcacttgacagctcgttcttgtacgctggcaagctcgatggcattgttgagctatgggatctcgatacagcgcagcgattgagagttatcaaggcacacgactgtgatatcatgtcgattcaaatgggctggggatacctgtggactgccgcgactaatggttgggccagcaaatacagcacaacccactacggaaaataccagcatgccgcgtctggtgctgttccccagaaataccagtgtctccttcgatgggaagctcaccagggcaaggtacttgcatcagctgtgaccaactacaagaacaagcagtacttcatcacgggcgcaaacgacgacaacatctctgtctggtccattgataccgaaaagtgcggcaccaaagagaaggaagtctcgcaagattcagataacctccttctatcgtcgctacgagatttcgtatcatacaagaccgtctcttcgagacccgagtttgcggaggattgtcgcaagggagctacatacctcggtgcgctgttcaagcggctaggtggacatgttgagttgcttagcactgagaagcatcacaacccagtcgtctacgctcggttttctgccaagaaggaggctgctgagacccgcaaacgaattctcttttatggtcactacgatgttgtcgccgctgatagccgcaaggggaagtgggagacagatccattcaccatgcagggaaccaacggctacttgtatggccgcggagtcagcgacaacaagggtcctatcatcgctgctttatatgcggtgactgatctgatggagaaccaacagttggagaacgatgttgtctttctgattgaaggcgaggaagagtttggatcgcttggctttgaagaggctgtcaagaagaacaaggagctcatcggtgaggtggactacatcctgctcgccaacagttattggctcgacgacgaagttccctgcctaacgtatggtctccgtggtgtgttgcacacaactgtctgcgtcgatgcgcctcgtccagacatccactcgggcgtggatggttcctacatgatgaatgagcctctctccgacctgacacagatccttggcaaactcaagggacctggcaaccaggtgcagattcctggcttctacgatgggatcctccccgttacaccagaagaagatgcccgatatgatgatatcgccaggattctgatccgcagcaatcccgaaaagggacctgaggagaggctgaagcagtcgcttatggcgcgctggcgtgaacccaatcttacgctccacagatacaaggtttcgggtcctgacgggagtcttgtcagcagtcatgccagctctcatatcagtttacgagtagtaccaggccaagaggtggacgtcgtgattgaagcgctgacgaaattcctcgaagaagagttttcgcaactcgagtcgcagaacaaactcactatcaacgtggacaaccgagcggagccgtggcttggtgatcccaccaacgccatcttccaaacgctggaaaaggccatcttggaaacgtgggaggattgctttgagacgtcttcttcatctggagacgccacgcccgataaaaccgacggcgtagacaagtcaaaggaggaagagatcctttctgtcaagaccaagatgggtaagccgcgcaagccgctttatatccgcgagggtggatccatccctgcgattcggtttttagagaaggaattcggagcaccagcagctcatcttccttgtgggcagtctagtgattctgcccatttggataatgaaaggttatgcttgttgaatcttttgaaggcgagagagatttttgccaaggtgtttggacggttgtga

SEQ ID NO: 71673 - protein, 907 aa, Gibberella zeae PH-1
MPSRTVSPIMSPGPASPILSPLEAAEDPATSPGLVHSLSHASTVLALAVSPQHETIYAGTQDGEIVAWSLETFRQVRRVQAHKRSILSLSLSPDASLLFSSAGDPIINVWDPKTLTRLYEIYGSYDVGDIFCTAYSPQHETLYIGAQNATIQWVGLNDVTARVSPESQQHPDRRNHRFFDSKAVGGGASTPRRNDDRWGLIPKAHNVLEMHAGCVKNFAHYGYVYCMLMAKGPTVDVGTDDDVLISGAGDGTIKLWSLGHTVKDDEELGDGIQEIMTLGVDDGESVLSMALDSSFLYAGKLDGIVELWDLDTAQRLRVIKAHDCDIMSIQMGWGYLWTAATNGWASKYSTTHYGKYQHAASGAVPQKYQCLLRWEAHQGKVLASAVTNYKNKQYFITGANDDNISVWSIDTEKCGTKEKEVSQDSDNLLLSSLRDFVSYKTVSSRPEFAEDCRKGATYLGALFKRLGGHVELLSTEKHHNPVVYARFSAKKEAAETRKRILFYGHYDVVAADSRKGKWETDPFTMQGTNGYLYGRGVSDNKGPIIAALYAVTDLMENQQLENDVVFLIEGEEEFGSLGFEEAVKKNKELIGEVDYILLANSYWLDDEVPCLTYGLRGVLHTTVCVDAPRPDIHSGVDGSYMMNEPLSDLTQILGKLKGPGNQVQIPGFYDGILPVTPEEDARYDDIARILIRSNPEKGPEERLKQSLMARWREPNLTLHRYKVSGPDGSLVSSHASSHISLRVVPGQEVDVVIEALTKFLEEEFSQLESQNKLTINVDNRAEPWLGDPTNAIFQTLEKAILETWEDCFETSSSSGDATPDKTDGVDKSKEEEILSVKTKMGKPRKPLYIREGGSIPAIRFLEKEFGAPAAHLPCGQSSDSAHLDNERLCLLNLLKAREIFAKVFGRL

SEQ ID NO: 71674 - DNA, 2613 bp, Candida glabrata CBS 138
  CDS (1)..(2613)
atgtctgccaactcagatttgatacataggtggtcccacacttattctattttgtcgatactgccgtttccgaaaaagaagctgcttattgcgggtactcaggattcgaagatcctggtgtttgatctacctgcatacaatttgattgaaacaattaagctaggtgagataagtgagaataatactagatctagtgtcctttctttggccaaatctaaaaatgagaaatacttgttttccgccggagctgactcattagtgagagtgtggcgtgtgggttccagagacagtcaccatggggtttgcttgacggaaatggcaactatatactctgtgactgatataggtgacatattttctatgaaatatttggactccttagatactttggtatttggttgccaaaacgcaagcttgctattcttagagaatctatgtgaaagaatgtgtattgctcaaaagagctctacaagagatatgaatagattaccacaccgtaggtacgataaattttttgattcacaaggacccactggtacgggttccaagaaaccaaattatggtgattctgggacagattccggtgacgacagtgatacacaaaatgtaatattagaagtaccctcagaaaacattgtgccatacgcacataatggtttcatttattcgatctgcaaactggataatgagtttcattcatttttctcaactcagagatctgatgacacaaatgtggaatacataacatcagcaagcggggatggaattaataagatatggaaattttctggcagggccaatactgttaccattacttttatggatattcaattagataatcatgatagcgtaatatcgcaggctgttgaatttccatttctgtattcgggcctgactcaaggtataattaatatatgggatttaagcactagggaactagtctctacaatcaagacgaaaaatgacgatgatatcacgtctatttcagtttataaggaccatatttttgctatcgacgaatctgggataaatatgatatatgaaaatcaagctatacactggaatcccaatcaaggtaaaattttaagctctgaaatatttgagaagagcaactctaaccattctttaactgtatatttgttggctggtggaaatgacggttctttaaccttatgggatgtttcaacactaatggaaacaggttttaccatgagaccctctaccttatctgcaaactcttcgaacatatcatattactctaccaaatcgtcatcagcatccccagtgaacaatgaagaaatgctagaaactttgaaaaccttaattcaatttcaaactgtttcacagtgcaaatctacactacatcagatggctttaagaaaatgtgccaccttcttgcagcaactttttacctctctaggtgcaactaactgccaacttttgccatcaacgaaaggcagtagtcctattgtaactgcaaagtttattggatctcaaactcaggacaaaaaaaaatgcattctttggtatgggcattatgatgttatagatgccggtgacacacaaaattggcagagtgatccatttactttaacttgtgagaatggctacatgaaaggtcgtggtgtaacagacaataagggcccattagtcagtgcgatatatagtgtaacaaatttgcacagaagaggagagcttttaaatgatgttatatttttagtcgagggtagtgaagaatgtgggtcaccaggttttgcacaggtatgcagagaatttagagaaagattagataccgctatagactggatatttttgagcaactctacatgggttgacgagaataacccttgcttgaattacggactaagaggtgtgatcaacgctaaactgacaatctctagtgatgccccagacagacattcaggtgttgatggtggtgtacatagagaaccaacagccgacttgatcaatgtggtatcgaagttgcaggatactgatgggagagtacttatacccgacttctattcacctgtcaaagagattgaccaagaagagtatgagagatttcagaaaatcatcgaaattgctgacattaacagagacacaacagcggatgatctggtcacaaactgggctaaaccatcattatcattgacatcaatgaaaatcagtggtccaggaaacgtaacggttatacctcaaacagcaagcattggcctctcaataaggcttgttcctggccagcacgttgcaaagatcaaagaggacctttttaagtacatcagggattgttttgatactctcaacactgagaatcatttagagatagagcttttaaatgaagccgagccttggctgggagacccaaacaatcatgcctacagagtcctaagagacgaactagcattggcatgggagaaagagcctctgttcgtgagagaaggtggttctatcccatgcttgcgaacactggaacatatcttccaagcaccggcagtacaaattccgtgtggtcagtcaacagataacgcccatttgaataacgaaaacttacgaatcaaaaactggaccaaaatggcagaaatactagacaacgtaataaacaagctgtag

SEQ ID NO: 71675 - protein, 870 aa, Candida glabrata CBS 138
MSANSDLIHRWSHTYSILSILPFPKKKLLIAGTQDSKILVFDLPAYNLIETIKLGEISENNTRSSVLSLAKSKNEKYLFSAGADSLVRVWRVGSRDSHHGVCLTEMATIYSVTDIGDIFSMKYLDSLDTLVFGCQNASLLFLENLCERMCIAQKSSTRDMNRLPHRRYDKFFDSQGPTGTGSKKPNYGDSGTDSGDDSDTQNVILEVPSENIVPYAHNGFIYSICKLDNEFHSFFSTQRSDDTNVEYITSASGDGINKIWKFSGRANTVTITFMDIQLDNHDSVISQAVEFPFLYSGLTQGIINIWDLSTRELVSTIKTKNDDDITSISVYKDHIFAIDESGINMIYENQAIHWNPNQGKILSSEIFEKSNSNHSLTVYLLAGGNDGSLTLWDVSTLMETGFTMRPSTLSANSSNISYYSTKSSSASPVNNEEMLETLKTLIQFQTVSQCKSTLHQMALRKCATFLQQLFTSLGATNCQLLPSTKGSSPIVTAKFIGSQTQDKKKCILWYGHYDVIDAGDTQNWQSDPFTLTCENGYMKGRGVTDNKGPLVSAIYSVTNLHRRGELLNDVIFLVEGSEECGSPGFAQVCREFRERLDTAIDWIFLSNSTWVDENNPCLNYGLRGVINAKLTISSDAPDRHSGVDGGVHREPTADLINVVSKLQDTDGRVLIPDFYSPVKEIDQEEYERFQKIIEIADINRDTTADDLVTNWAKPSLSLTSMKISGPGNVTVIPQTASIGLSIRLVPGQHVAKIKEDLFKYIRDCFDTLNTENHLEIELLNEAEPWLGDPNNHAYRVLRDELALAWEKEPLFVREGGSIPCLRTLEHIFQAPAVQIPCGQSTDNAHLNNENLRIKNWTKMAEILDNVINKL

SEQ ID NO: 71676 - DNA, 2607 bp, Kluyveromyces lactis NRRL Y-1140
  CDS (1)..(2607)
atgtctccatcgcagttacataaatggagccatgacttctgtatattgtctaccgttacatttccacgcaagaagcttttgtttgctggtactcaggattctagaattttatgcattgatttacgcacttacaatttgattcataccatccgtctaggagctttagatggaaccaacacgagatctagcgttttgtgtttgacaaagtccaaaaacgaagagtatttgtttagtggtggagctgattcattagtacgagcctggtcagtcggtgggaacactcatgactacagtttagccgttaaagagatggttactatttactcgttaatggatatcggtgatatcttctcattggcatatattgatgaactagacttggttgtttttggctcgcagaatgcgtccttgttgtatgttgccaatgttttcaagcaaaacaacttaaagaaagattacaccatgttgcctcatctaagattcgataaattttttgactcaaagggacctcagcaacaatcaacacaaccccttgcagattcatttgaaactttacccagtacaatatcatccctgtcactacacgatgaagaatcagcgtgtcagaccttacaagttccatcttccaatatcctaccatttgcgcacaatggatttgtatattccatcgtcaaattagagtcccacagagatactctaccaatatacctggacttgaaacctgacgttcaatacattatttctggtggtggagatggcgtttccaagttatggtcattgcatgtagatccagccgatgatcaatcggtcaaaatctgtttggttaccgaattagataatgatgaaccagttttaacacaattcctggaattccctttcctctacgtaggactcacggacggtttattgaaaatttgggatttgaacaccaatcaatcggtaagtaccttacagagcgatgatccaagtgatatcacctcactggcagtttgtcaagatcagattttcgcctctcaaagaaaaggcgttactaaattcttccaggatgacgtttatcattggcaagggcatcaaggaagtattttaagctctgagataatttgcaaaagttgtaccaaaaatccgtatacaaggctcgtcacaggtggtaatgacggttccttgatcctttggaatatcacagacttaatcaataatggccaagaggatatagatccgatattccatagtcatgaagctactgccaaggaccgtcataattcttggactgctacgaatttggataatgaccatatgcttcataatttgagcactcttattcattttcaaactgtttctagaaaagctgatacaagacacttacttgaaggtcgtcgttgtgcaactcacctccagcagctattttataaactaggagcaagaaattgtgatttaattcctgttcacaatgaaggaaatcccatcgtatattctgcattctctggtaactccagaaatgtagagaaaaggaagaaaatagtatggtacggacattatgatgtggtagcagcagatatggattattggaacacagatcctttcaaactcacttgtgaaaacggctttttgaagggaagaggtgtatctgataacaagggtccattattagctgctatgtactcggtggcagaacttgtgcaaaatggtgaactagatcatgacatcacctttatcatcgaaggacaagaggagaatggttcagcaggcttcaaagaagcacttgcagacaatagatatagattcggagaaaagattgattgggtcattttaagtaattcttattggttagatgacaacattccctgtttgaattatgggctaagaggtatggtcaatttaacagtcagtgtgactagtgacgaaccaaatagacattctgggtttgatggtggtgttcatcgtgaacctacagccgatttaatcagcatcatttctaaattacaagatgatggtgggaaaattttgattccacattatgacgacaacataaagcctctgtctgagaaagaactggcacaattgatcgaaattgtggaaagagctcagctacacgaatctgtcacagtcgatagtttaatcgccaaatggaccaaaccatcactatcagttaccaccatgaaggtgagtggaccatgtgaaccgacagtcattccacaatctgcctctgttgacatatcaattcgattggttcctggtcaagatctcaatgtcatcaaacagtcattgaatgactacttgcattcatgcttttcaagattgaagaccaaaaatcatctctctatcaaggtattaaatgaagcagaaccttggttaggaaatccttcgaatagtgcctatcaaattataagagaggaaataggcaaagaatggaacacagaacctttaatggtgagagaaggaggttccattccaagtattagataccttgagaagactttgggcgcccctgtcgtacaaataccttgtggccaatcaaatgataaagcacatctaccaaatgaacagttaagaatgaaaaactggtataagatgagagagattcttaccagagtattcaataggctctga

SEQ ID NO: 71677 - protein, 868 aa, Kluyveromyces lactis NRRL Y-1140
MSPSQLHKWSHDFCILSTVTFPRKKLLFAGTQDSRILCIDLRTYNLIHTIRLGALDGTNTRSSVLCLTKSKNEEYLFSGGADSLVRAWSVGGNTHDYSLAVKEMVTIYSLMDIGDIFSLAYIDELDLVVFGSQNASLLYVANVFKQNNLKKDYTMLPHLRFDKFFDSKGPQQQSTQPLADSFETLPSTISSLSLHDEESACQTLQVPSSNILPFAHNGFVYSIVKLESHRDTLPIYLDLKPDVQYIISGGGDGVSKLWSLHVDPADDQSVKICLVTELDNDEPVLTQFLEFPFLYVGLTDGLLKIWDLNTNQSVSTLQSDDPSDITSLAVCQDQIFASQRKGVTKFFQDDVYHWQGHQGSILSSEIICKSCTKNPYTRLVTGGNDGSLILWNITDLINNGQEDIDPIFHSHEATAKDRHNSWTATNLDNDHMLHNLSTLIHFQTVSRKADTRHLLEGRRCATHLQQLFYKLGARNCDLIPVHNEGNPIVYSAFSGNSRNVEKRKKIVWYGHYDVVAADMDYWNTDPFKLTCENGFLKGRGVSDNKGPLLAAMYSVAELVQNGELDHDITFIIEGQEENGSAGFKEALADNRYRFGEKIDWVILSNSYWLDDNIPCLNYGLRGMVNLTVSVTSDEPNRHSGFDGGVHREPTADLISIISKLQDDGGKILIPHYDDNIKPLSEKELAQLIEIVERAQLHESVTVDSLIAKWTKPSLSVTTMKVSGPCEPTVIPQSASVDISIRLVPGQDLNVIKQSLNDYLHSCFSRLKTKNHLSIKVLNEAEPWLGNPSNSAYQIIREEIGKEWNTEPLMVREGGSIPSIRYLEKTLGAPVVQIPCGQSNDKAHLPNEQLRMKNWYKMREILTRVFNRL

SEQ ID NO: 71678 - DNA, 2874 bp, Debaryomyces hansenii CBS767
  CDS (1)..(2874)
atggcgttcaacggtaacattcatgaagcagagtatgtaccaattccagctagagtgcggttacccataaatagtacttcggagtcgtcagtgtctacaccagcacgaattccgacacctgtcaaatcacctaatttgaccgttgctaatttgagcagcgataactcaacaaatgtgcctgtggacagatttcctaatttaatccataaatggtcgcatactcactcgattttatgtgttgttccttctccgaaacgtaatttgatattctgtgggacacagaattcgaagattttagtctttgacatagttaactacagtttaaagtacgaaatcaagtgtggcaattcagatcattcagcatcaatattatgtttaacgatagacgaatcagaggactatttattcagtgctgggtcagactcgttgattaaggtgtgggatctatccatggttaatgacaacaccaactatcctatacattgcactcatattatttacctgcttgtcgatataggtgacgttttttctatatgctggtctgatgctttatcgacattatttattggagcccaaaatgcatctatcttatggtgtaaattatatttatattcctcaactatttctgatagtcagtccacaatcgatagaatgccgcattttagatacgataagttttttgattcaaagggaccgggtggctcaattaataatttgcaatcaaaacaccagattttaaagtcgacttctcttgagacatcgaatagcgtatcacctaaattaattgaagttaacaatgatgatattatcagatttgctcataatgggtatgtttattgtatgaattactttaatgttgaagacacttcaaatgacttcactaaaaactacccaacacagtttgcgaatttattaattaccggtggaggggatgggctagttattatctggggcgttagctgtactaataaaaaagtatctcttcaaaagttaaaaatattaaagaacaatgagtcagttttatccatgtctattcaagactcttacttgtacgttggcttatcagaaccatgtatcaatgtttgggatttaatgacattccaattaattcgatcaattcatttctccaattctcaacaggtcaaaaataattacgatgaagtcttgagtttggggatatataatgattgtatttttaaagcatcaaatttaggcggattaataaagttttccttgaaaactgatcccccaaacatggttcctagcgaccatggaaatcttaatccggatagatcatcgatggtggttattaccgaagaagacgataagtataatgcggaattcaataaatccagtgttgaaaatggaagtgtacttgctgtaaaaatttttacttcgacaacaggtgtcacttatttggtttctggaggccataaagcactttgtctttgggatattactaatttgggaagtactaatagacatctttcagacgccaacagcttatcgtctaatttggtggataacgaaaatttgttaaaatctttaaagagatttatctcatacaagacaattctgaaatttcctgcgttatacttagaagattctcgtcgttgttctcaatttttaacaaatttattagtaaacttaggtgcaactgtaactaaattgttaccagtgcctaatagtaatcctgttgtttattcatgcttctcaagcaattctccagatagacccaaacaagcgaagagaattctttggtatgggcattatgatgttgttgatgcaacggctgattcaaactcttggtcaaccgatccattttgtctcactgcaagagatggtaatttgtatgctcgtggggtttctgataataagggtcctattttggctgcaatatatgcggtatcagaattatttcacaacaaggaacttagttgtgatgttgtatttataatcgagggtgaggaagaatgtggttctattggatttcaggatgtgattcacgaaaataaggaattgattggagatattgattggattatgttatctaattcgtattggcttgacgatgaaacgccttgcctcaactatggtttgagaggagttatcaatgcatctatcacaataaattccgataaacccgacagacattctggtgtagatgggggcgtcctgaaagagccaacaatggacttgattcaaatcctaggtcaattaatgaatccatttaataacaatattaagattcctaacttctatgacgatgtgctatcattaaccgatagagaaatagaaatttatcagaagattgagaacacagcgtctacgaagaatattaagaatcaagattttaagtctttaatggcgaagtggagaaacccttcattgactattcataatattcaagtctcaggcccaaataataatactgtcattcctcagctggctaaagcatctgtttcaattcgtatagttcctaatcaggatctagaaaagattaaaaaactgttgattaagacattaaatgattcgtttaacaaactagaaactgataatcatttactaataaacattttccacgaagctgaaccctggcttggtgatccatataacttggtgtataaaattctttatgataaaattcgctcgaattgggggccagaggttcctgaaccattatttattcgtgaaggaggtacgattccctcgattaggttcctagagaagtgtttcaatgcatgcgctgcccaaattccatgtggacaagcgagtgataatgcccatttaaaagatgaaaaattgaggattcttaatttgttcaagttgagagatatcttggctgatacattaaaagaattaggcagtaaatag

SEQ ID NO: 71679 - protein, 957 aa, Debaryomyces hansenii CBS767
MAFNGNIHEAEYVPIPARVRLPINSTSESSVSTPARIPTPVKSPNLTVANLSSDNSTNVPVDRFPNLIHKWSHTHSILCVVPSPKRNLIFCGTQNSKILVFDIVNYSLKYEIKCGNSDHSASILCLTIDESEDYLFSAGSDSLIKVWDLSMVNDNTNYPIHCTHIIYLLVDIGDVFSICWSDALSTLFIGAQNASILWCKLYLYSSTISDSQSTIDRMPHFRYDKFFDSKGPGGSINNLQSKHQILKSTSLETSNSVSPKLIEVNNDDIIRFAHNGYVYCMNYFNVEDTSNDFTKNYPTQFANLLITGGGDGLVIIWGVSCTNKKVSLQKLKILKNNESVLSMSIQDSYLYVGLSEPCINVWDLMTFQLIRSIHFSNSQQVKNNYDEVLSLGIYNDCIFKASNLGGLIKFSLKTDPPNMVPSDHGNLNPDRSSMVVITEEDDKYNAEFNKSSVENGSVLAVKIFTSTTGVTYLVSGGHKALCLWDITNLGSTNRHLSDANSLSSNLVDNENLLKSLKRFISYKTILKFPALYLEDSRRCSQFLTNLLVNLGATVTKLLPVPNSNPVVYSCFSSNSPDRPKQAKRILWYGHYDVVDATADSNSWSTDPFCLTARDGNLYARGVSDNKGPILAAIYAVSELFHNKELSCDVVFIIEGEEECGSIGFQDVIHENKELIGDIDWIMLSNSYWLDDETPCLNYGLRGVINASITINSDKPDRHSGVDGGVLKEPTMDLIQILGQLMNPFNNNIKIPNFYDDVLSLTDREIEIYQKIENTASTKNIKNQDFKSLMAKWRNPSLTIHNIQVSGPNNNTVIPQLAKASVSIRIVPNQDLEKIKKLLIKTLNDSFNKLETDNHLLINIFHEAEPWLGDPYNLVYKILYDKIRSNWGPEVPEPLFIREGGTIPSIRFLEKCFNACAAQIPCGQASDNAHLKDEKLRILNLFKLRDILADTLKELGSK

SEQ ID NO: 71680 - DNA, 2604 bp, Yarrowia lipolytica CLIB122
  CDS (1)..(2604)
atgtcgtatccactggatgtcggtctgtcgacgtgttcgggtcctctcaacgagttcgacacgccctcgccgcgcctctcacccgcatctttcgccgaagatcgacgtggacccggctacaaaagtaaaggaccccaggaaccccaactgactcacaaatggcgtcacgactactcggtggtctcgctggccgctaacgacaagttcatctttgccggcacccaaaactcggacatccaggtctttgacgtggaaaccttttcgctaaagacgtctctacagggccatgaaggatgtgtctacgccctgtccatcgctacagtggccggagacagctccaagcaattcctcgtgtcgggaggctccgattcgctcattaaaatttgggacattgtcgaactgaaagaggtgtcgaccgtttactcgtcgtttgatgtcggtgacatcttttctgtcgtgtatgatccggtccataatatgatattcctaggagctcagaacgcctctattcagtggattgagctcggaagcgacacgggcaacagtcagacagttaattcggaaatcctacggcttcccagctacagattcgaccgatttttcgactcaagaggaccaggtggaaaaactgcgccccagcagctggaaagagacgactacgtcagcattcacggtcagaagccccatgaacacgccctcctgcaaattccctcggaaaatgcttaccaatacgcccacaatggctatgtttactgcttggtttgcgttgagaactttgtgtggaaagataacgtggtggagtgtgttttgatctctggaggaggagatgcgcatgtcaacttttggtcgtggtgccctcaaaagaaggatctcgtcctgatagcatctatcgactgtgaaacgtctgttcaaacactgtgtgtttcggatagcatgttgtactgtggcactgatcatggcgatgtcaagatctgggatttgggcactctgcagctcattcgacaagacaccattggaacttcacctgttgtgtctctatccacttcaggagactgtgtattcaagggtagcgaaggaggtcttcaacggtggtctttaaagggggagagaacagctacctggcttgcccatgaaggaaccgtacaaacgactattgttcgagagctcaagggtcgcacctatctcatttcaggcggaaatgatggtgttgccatctgggatatcactgtgactgactctgagcattctcaacaaattgccaaggctcgtcagaactttggcttcaccaatgaccgtctgatttccactctgttcgagtttgtggctttccgaaccgtttccagtcatggaatcgagtacggttccgattcaagacgttgtgctatctttctgagagacctgttgcgagactttggagctcattcgtctctgttggctgttcctgataagaatcccgttgttctcggtactttcagcgccaacaagagtgatctcaaaggagccaagccgaagagattgctgttctacggtcattacgatgtcattcctgcccatgaaactgacggatgggacacgtatccctacacaattacacctctggatggatacctatatggacgaggagtctcagacaacaagggccctgttctggctactatctttgcagtggcggaggcgtttgccaagggcgaactgggagtcgatgtggtgttcctggtagaaggagaggaggagtgtggatcccccgggttcgaagacgtgattgacaagaacgactccatgatcggagacattgattacattcttctgtgcaattcgtattggctcgacgataccacaccttgcatcaactacggtcttcgaggagttcttcatgccaccgtcgaagtgtactctgacaatcccgatttgcattctggtgtcgaaggaggagccactcgagagcccactattgatctgattcgtctcctggctcttctgacaactcccgagggtgatatctgtctcccagacttttacaaaaaggtcaagccgcccaccgagtctgaagagaagcggtttgagcatatcatcaagacatctcataagccacttaccaaggcttctatcagagctaaatgggctcttccgtcgcttacagtgcatcgtttcaacgtctctggacccggtaacttgaccgtcattcccaaatctgcccaggcttctgtttctctgcggattgtgcctgaccaggacgccgacgaaatcaaacagatattcacagagtacatgcaggacaagtttgctgaacacaagtcgcccaaccatctcaaaatctctgtattccatcaggctgatccctggatcggagacatcgatactcccgtttgtcaggtattgagatcaattgtgaccgaggtctggggagtagagcccttgctgatccgagaaggaggctcgattcccgtcatgcggttcctagagaagcgattcaacgcatctgccatccagttcccctgtggccaatcttcagaccatgcccatcttaacaacgagagactgagaatcatcaacctgattaattttagacgcattctgatggagttcttcaccaagattcagtag

SEQ ID NO: 71681 - protein, 867 aa, Yarrowia lipolytica CLIB122
MSYPLDVGLSTCSGPLNEFDTPSPRLSPASFAEDRRGPGYKSKGPQEPQLTHKWRHDYSVVSLAANDKFIFAGTQNSDIQVFDVETFSLKTSLQGHEGCVYALSIATVAGDSSKQFLVSGGSDSLIKIWDIVELKEVSTVYSSFDVGDIFSVVYDPVHNMIFLGAQNASIQWIELGSDTGNSQTVNSEILRLPSYRFDRFFDSRGPGGKTAPQQLERDDYVSIHGQKPHEHALLQIPSENAYQYAHNGYVYCLVCVENFVWKDNVVECVLISGGGDAHVNFWSWCPQKKDLVLIASIDCETSVQTLCVSDSMLYCGTDHGDVKIWDLGTLQLIRQDTIGTSPVVSLSTSGDCVFKGSEGGLQRWSLKGERTATWLAHEGTVQTTIVRELKGRTYLISGGNDGVAIWDITVTDSEHSQQIAKARQNFGFTNDRLISTLFEFVAFRTVSSHGIEYGSDSRRCAIFLRDLLRDFGAHSSLLAVPDKNPVVLGTFSANKSDLKGAKPKRLLFYGHYDVIPAHETDGWDTYPYTITPLDGYLYGRGVSDNKGPVLATIFAVAEAFAKGELGVDVVFLVEGEEECGSPGFEDVIDKNDSMIGDIDYILLCNSYWLDDTTPCINYGLRGVLHATVEVYSDNPDLHSGVEGGATREPTIDLIRLLALLTTPEGDICLPDFYKKVKPPTESEEKRFEHIIKTSHKPLTKASIRAKWALPSLTVHRFNVSGPGNLTVIPKSAQASVSLRIVPDQDADEIKQIFTEYMQDKFAEHKSPNHLKISVFHQADPWIGDIDTPVCQVLRSIVTEVWGVEPLLIREGGSIPVMRFLEKRFNASAIQFPCGQSSDHAHLNNERLRIINLINFRRILMEFFTKIQ

SEQ ID NO: 71682 - DNA, 2685 bp, Aspergillus oryzae
  CDS (1)..(2685)
atggaccacacagtactacatgaatcggatagcacatccgaaattgatgagcagactaaaacctgggaatctgatccgcgctctataactacgcacctcacggacgatgacgcgaatgactccaatgcaatgattgaatgtggcatcggccaccgtgttcaggccagtcggtctgtcctagcgctagtcttagacgatgactgcgtgtttgctggtctccagggcggagacattgtagcatggtccctacagacatacgagcttgtgctctcggtgcatgctcaccaggaaagcgttctagatcttcatctctccgaggacaaagagttgctcttctccagcggcggagattcagtcgtcaatgtgtggtcgacgaggaccttcgatcgcttgtactcgattcactcccaccatgacgtaggtgatattttcgcagtggcctactcatcaagcttgaagacgatctattgcgccggtcagaacaccagtatccagtggtgtgatatctcacaagctgatgcggctgccacacaattgtcagcggctcacctgtcgagaaggacccataggttctttgattctcggggtcctgatggcactcgtgctcccagaccggaggcgggagcggacggaagccattcggtcacgcagggtgggcaagttctcacctttaaacgtgatcaccacaggatattctcccaccatggctatgtatacacgatgctcctggtccgagggctggttgagtcggcgccatctgaggaagtactcatcaccggtgctggggatggcgttgtcaaactttggagtctggatcaggacaaaaccaacgcggcgccgtcccagatggcaaagctgcagaatggtgacccagtactctccatcgcggttgacgggtcatttctctattgtggcctcgcaggtggcgcattaaacatttggaacctagactctcatcagcttgttaaacgcatcactaggcacaccggcgatctgtgggcggtagatatcatccatggagtggctgtgtgtggcgactcaaacggaatcgtcaaggaggttggtagctgggccgctcatgagggaacaatgctcgcgtcggccgctggtcggcacaaagaccgatttatttatgcttcaggaggaaacgacaacactgttggtatctgggatttgacagacgtgtccctaaagcagaacgaactacctcctatcaacaacgatgaaatggtcaactgccttgccaagtttgtcgctttcaagacagtttcagctagccccaaattcgcgggcgaatgcaatcaaggtgcagcgtttctgcgaagacactgcgtttatctgggagcaaaaacgaagcttctcaccaccgggaaagacacgaatccaattgtctacgcacggtttaacgcaacttcctcggagaagattgacaaaactattttgttctacggccactacgatgttgttggggctgatgccaaccttaccaagtggaaaacggatccctatcagcttacttcgatggatggtttcttatacggccgcggtgtatccgacaacaagggccccatcttggcggctttatacgcggctgcggatcttgcacgccaaaaagcgctccgatgcaatgttgctttcctcatcgaaggtgaggaagaatcgggttcccagggcttccatgaaaccgttcgacaacacaaggagcagattggttcggtggactacatcctgcttgccaacagttactggctggatgactacaacccctgcttgacctacggacaacgtggtgtcgtccatgcgaacctgattgtaactagcgaccaccccgaccttcatagcggtattgatggaagtgcactgctggatgaaccgctaaaggaccttacgttgctgatcggcactctagtggggcctaaaggccgcattaatctccccgacttccgggaccgagtcttgcctctccctgaggccgagaagcagcgatatgcggacatcgcgcagatccttctgcaacagcaccccgagattaccgatcgcgatgccttgattgactcacttatgcatcggtggagggagccagcccttaccattcactccatcgaggtgccgggcaatagcaagagcacgacgacaaccatctcacgccgggcgaaagccagtgtatccattcgtttagtgccaaaccaggaagcagacgatgttgcagcaagtttgaccatgtatgcgcaggaacaatttgatctcctggaatcgcaaaacgacctgacggttgagatcacgggtaaatccgatccctggttaggtgatccagacaacgagatgttcgagactcttgcggaggctatcacagcggcctggacgccagacaggcagggccagaaacatcaatatcctccagttcagcggaacctacaagaccgaacgggagaaacgcctccccctcccgaaccggtgcccgggccgtccgacgtccgtcctatatatatccgcgagggaggatctattccgacaatccgttttctggagaaggaattctcggcgccggcagccaatcttccctgcgggcaggcgagcgataatgcgcatttgtacaatgagaggctgcgcgtgcagaacttgtacaagagccgggagatctttagctatgtattttcgcgcctgccggagagggagcgtaagtga

SEQ ID NO: 71683 - protein, 894 aa, Aspergillus oryzae
MDHTVLHESDSTSEIDEQTKTWESDPRSITTHLTDDDANDSNAMIECGIGHRVQASRSVLALVLDDDCVFAGLQGGDIVAWSLQTYELVLSVHAHQESVLDLHLSEDKELLFSSGGDSVVNVWSTRTFDRLYSIHSHHDVGDIFAVAYSSSLKTIYCAGQNTSIQWCDISQADAAATQLSAAHLSRRTHRFFDSRGPDGTRAPRPEAGADGSHSVTQGGQVLTFKRDHHRIFSHHGYVYTMLLVRGLVESAPSEEVLITGAGDGVVKLWSLDQDKTNAAPSQMAKLQNGDPVLSIAVDGSFLYCGLAGGALNIWNLDSHQLVKRITRHTGDLWAVDIIHGVAVCGDSNGIVKEVGSWAAHEGTMLASAAGRHKDRFIYASGGNDNTVGIWDLTDVSLKQNELPPINNDEMVNCLAKFVAFKTVSASPKFAGECNQGAAFLRRHCVYLGAKTKLLTTGKDTNPIVYARFNATSSEKIDKTILFYGHYDVVGADANLTKWKTDPYQLTSMDGFLYGRGVSDNKGPILAALYAAADLARQKALRCNVAFLIEGEEESGSQGFHETVRQHKEQIGSVDYILLANSYWLDDYNPCLTYGQRGVVHANLIVTSDHPDLHSGIDGSALLDEPLKDLTLLIGTLVGPKGRINLPDFRDRVLPLPEAEKQRYADIAQILLQQHPEITDRDALIDSLMHRWREPALTIHSIEVPGNSKSTTTTISRRAKASVSIRLVPNQEADDVAASLTMYAQEQFDLLESQNDLTVEITGKSDPWLGDPDNEMFETLAEAITAAWTPDRQGQKHQYPPVQRNLQDRTGETPPPPEPVPGPSDVRPIYIREGGSIPTIRFLEKEFSAPAANLPCGQASDNAHLYNERLRVQNLYKSREIFSYVFSRLPERERK

SEQ ID NO: 71684 - DNA, 2874 bp, Neurospora crassa
  CDS (1)..(2874)
atggcctccagaatgtcgtcagtcccaaagaccccattcctccacgtcgacatcacacagtcatcgacattaccgactgcggcgcgtccgaatcccgccaatcccacaaagcaaaactccacagtcacagtcacgatgcccggaacactgcaacattccgagctcgacgatggcggccccaagactgcccccgatcagttgcaagaattgaggcatgacggctcggttctctccatcgccgtgtctggcgactacatcttcaccggcaccagcaagggccagatcgttgtctggtccctcggcacctaccagctcgtccggaccattcaagcccacaagcgaagcgtcctctgcctctttctgtcgcaagatggcaaatatctcttctcgaccgcgtgcgaaccaataatcaacgtgtggtgccccaaaacattcaggcgactctatgagatctacagcacctacgatgttggagacgtcttcagcgtcgtctactctccccagaacgagacggtatactttggcacacagacacagtacatacagtgggtcagcctgaaggacgaggacagaagggtttcacacgactcggccaatcatccggacaggcgacagcacaagttcttcgattcccgtgctgttggcggcacctctacccctaggcgcaccgaggattactattccctaataccccgagccgagaccgtgctcgaagtcgacccatatgccattgagaaatatgcacactacggctgggtcttttgcatgcagatcgcaaagggcccaaccgtcctggtggacgatgacgaggaagttcttgtctccggaggcggtgatggtaccatcaagctatggagacttagcgacaagggccccggataccatgaagacgaggataccaagggcagtatccaggagctgatggtgcttggcgaggatgacgccgagtccgtcatgtctttgttcgtggacggttccttcctttatgccggcaagctaggtggcattatcgagctatgggatctcgacaccaagcagaggttgagagttattcatgctcatactggaaacattaatgctgttgggttgagattcgggctcctttggagtgcctctaccgacgggtttgcttctaaacatagagcagcccacactaccgaggagtctaatggcacttctcaatacgtcagccagcgatatcagtgcctcagccgatggaaggcacacaatgccaagattctttcggcagctgtcgccacatatcagaacaaccagctattcatcaccggagccaatgacaacactgtccggatatggcatgttaacggcgcgcctgcggaaactgaagaggtggatggtgagcacgaggacatggtgattcgctcccttcgccaattcgtctcgtacaagaccgtttcgtcacgcccggagtttactgaggattgccgtaaaggagcgaccttcctcggttccttgttcaagcggctgggcgctcaagtggaaatgctcagctccgatggccctcataatccagtggtatttgcaaagtttagcggcaagctcgagcctgctgagaagcggaagagggttctgttttacggccattacgatgtggtccccgcggatatggccggtgagaactggaagaccgacccattcaagcttgtcgggcagaatgggtatctctatggtcgtggtgttagtgataacaagggacctatcattgccgctctttacgccgtctccgatctgttgcaggccaaggccctggactccgacatcatcttcctaatcgaaggcgaagaagagtctggatcccgaggctttgaggagaccatcctcaagcacaaggacctcatcggacacattgactatgtgcttcttgccaacagttactggctagacgacgaggtaccctgcctgacctacggtctacgcggtgtcctgcatgccacggtttgcgtcgactcaaagcaccccgatttgcactcgggcgtcgacggaagcaacatgatctccgagcctctgaccgacttaaccctgctgctcggcaagctcaagggccccaggaacaaagtcaacattcccggcttctacgacggaatcctccccatcaccgaggaggaagagctgcgctacgacgacattgccagcatcttgatcaagcgcaaccctaccgccggaccagtcgacgcgcttaagcgtagcctgatggctcgctggcgcgaacctaacctgaccatccatcgttataacgtctcgggtcccgatggcagtctgatcagtagccacgcgaccgccaacgtcagcatccgtctggtgcccggtcaggaagtagaggaaattatttccaagctcaagtccttcctcaagaccgagtacgagaagtttgatagcgacaataccctcactgtgcgtatcgacaacaaggccgagccgtggttgggtgtaccaggtaattacatctttcgtaccctcgaagaggcagtaatgagggcatggggcggctcctcatcatcttctccttccacctccaccccctcggacacagactcagcatcatcaccatcatcaccatcatcatcgctgtcggataatgagaaagccaacggcgtaaccctcccgcccaacgccacaaacggcgaaaccacttccactggcgccgccgcccccaagacgagaaaaccgctgtatattcgtgaaggcggatccattccgcccatcaggtttttggagaaggagtttaacgcacccgcggcgcatttaccctgtggacaggcgagcgactcggcgcacttgcataatgagcggttgcggttggtgaatttgcagaagagtagggagattttcacgacggtttttaggaagttgtag

SEQ ID NO: 71685 - protein, 957 aa, Neurospora crassa
MASRMSSVPKTPFLHVDITQSSTLPTAARPNPANPTKQNSTVTVTMPGTLQHSELDDGGPKTAPDQLQELRHDGSVLSIAVSGDYIFTGTSKGQIVVWSLGTYQLVRTIQAHKRSVLCLFLSQDGKYLFSTACEPIINVWCPKTFRRLYEIYSTYDVGDVFSVVYSPQNETVYFGTQTQYIQWVSLKDEDRRVSHDSANHPDRRQHKFFDSRAVGGTSTPRRTEDYYSLIPRAETVLEVDPYAIEKYAHYGWVFCMQIAKGPTVLVDDDEEVLVSGGGDGTIKLWRLSDKGPGYHEDEDTKGSIQELMVLGEDDAESVMSLFVDGSFLYAGKLGGIIELWDLDTKQRLRVIHAHTGNINAVGLRFGLLWSASTDGFASKHRAAHTTEESNGTSQYVSQRYQCLSRWKAHNAKILSAAVATYQNNQLFITGANDNTVRIWHVNGAPAETEEVDGEHEDMVIRSLRQFVSYKTVSSRPEFTEDCRKGATFLGSLFKRLGAQVEMLSSDGPHNPVVFAKFSGKLEPAEKRKRVLFYGHYDVVPADMAGENWKTDPFKLVGQNGYLYGRGVSDNKGPIIAALYAVSDLLQAKALDSDIIFLIEGEEESGSRGFEETILKHKDLIGHIDYVLLANSYWLDDEVPCLTYGLRGVLHATVCVDSKHPDLHSGVDGSNMISEPLTDLTLLLGKLKGPRNKVNIPGFYDGILPITEEEELRYDDIASILIKRNPTAGPVDALKRSLMARWREPNLTIHRYNVSGPDGSLISSHATANVSIRLVPGQEVEEIISKLKSFLKTEYEKFDSDNTLTVRIDNKAEPWLGVPGNYIFRTLEEAVMRAWGGSSSSSPSTSTPSDTDSASSPSSPSSSLSDNEKANGVTLPPNATNGETTSTGAAAPKTRKPLYIREGGSIPPIRFLEKEFNAPAAHLPCGQASDSAHLHNERLRLVNLQKSREIFTTVFRKL

SEQ ID NO: 71686 - DNA, 22 bp, Artificial sequence
  primer
atgtacgatagcaggggtgtcg

SEQ ID NO: 71687 - DNA, 28 bp, Artificial sequence
  primer
ttataacctattgaatactttagacaaa

SEQ ID NO: 71688 - protein, 1024 aa, Artificial sequence
  consensus sequence
  Variant (2)..(4): Xaa in position 2 to 4 is any amino acid
  Variant (6)..(7): Xaa in position 6 to 7 is any amino acid
  Variant (9)..(9): Xaa in position 9 is any amino acid
  Variant (11)..(20): Xaa in position 11 to 20 is any amino acid
  Variant (21)..(22): Xaa in position 21 to 22 is any or no amino acid
  Variant (27)..(29): Xaa in position 27 to 29 is any amino acid
  Variant (31)..(34): Xaa in position 31 to 34 is any amino acid
  Variant (36)..(36): Xaa in position 36 is any amino acid
  Variant (38)..(39): Xaa in position 38 to 39 is any amino acid
  Variant (41)..(49): Xaa in position 41 to 49 is any amino acid
  Variant (50)..(57): Xaa in position 50 to 57 is any or no amino acid
  Variant (59)..(59): Xaa in position 59 is any amino acid
  Variant (61)..(61): Xaa in position 61 is any amino acid
  Variant (63)..(64): Xaa in position 63 to 64 is any amino acid
  Variant (66)..(70): Xaa in position 66 to 70 is any amino acid
  Variant (71)..(92): Xaa in position 71 to 92 is any or no amino acid
  Variant (96)..(98): Xaa in position 96 to 98 is any amino acid
  Variant (100)..(104): Xaa in position 100 to 104 is any amino acid
  Variant (106)..(115): Xaa in position 106 to 115 is any amino acid
  Variant (116)..(124): Xaa in position 116 to 124 is any or no amino acid
  Variant (128)..(129): Xaa in position 128 to 129 is any amino acid
  Variant (131)..(131): Xaa in position 131 is any amino acid
  Variant (134)..(134): Xaa in position 134 is any amino acid
  Variant (137)..(138): Xaa in position 137 to 138 is any amino acid
  Variant (140)..(144): Xaa in position 140 to 144 is any amino acid
  Variant (146)..(148): Xaa in position 146 to 148 is any amino acid
  Variant (150)..(150): Xaa in position 150 is any amino acid
  Variant (153)..(153): Xaa in position 153 is any amino acid
  Variant (155)..(174): Xaa in position 155 to 174 is any amino acid
  Variant (175)..(179): Xaa in position 175 to 179 is any or no amino acid
  Variant (181)..(182): Xaa in position 181 to 182 is any amino acid
  Variant (184)..(186): Xaa in position 184 to 186 is any amino acid
  Variant (191)..(215): Xaa in position 191 to 215 is any amino acid
  Variant (216)..(234): Xaa in position 216 to 234 is any or no amino acid
  Variant (236)..(245): Xaa in position 236 to 245 is any amino acid
  Variant (248)..(248): Xaa in position 248 is any amino acid
  Variant (250)..(251): Xaa in position 250 to 251 is any amino acid
  Variant (253)..(271): Xaa in position 253 to 271 is any amino acid
  Variant (272)..(281): Xaa in position 272 to 281 is any or no amino acid
  Variant (283)..(284): Xaa in position 283 to 284 is any amino acid
  Variant (288)..(289): Xaa in position 288 to 289 is any amino acid
  Variant (291)..(291): Xaa in position 291 is any amino acid
  Variant (293)..(307): Xaa in position 293 to 307 is any amino acid
  Variant (308)..(321): Xaa in position 308 to 321 is any or no amino acid
  Variant (323)..(325): Xaa in position 323 to 325 is any amino acid
  Variant (328)..(335): Xaa in position 328 to 335 is any amino acid
  Variant (339)..(339): Xaa in position 339 is any amino acid
  Variant (341)..(343): Xaa in position 341 to 343 is any amino acid
  Variant (345)..(348): Xaa in position 345 to 348 is any amino acid
  Variant (352)..(352): Xaa in position 352 is any amino acid
  Variant (354)..(354): Xaa in position 354 is any amino acid
  Variant (356)..(383): Xaa in position 356 to 383 is any amino acid
  Variant (384)..(391): Xaa in position 384 to 391 is any or no amino acid
  Variant (393)..(399): Xaa in position 393 to 399 is any amino acid
  Variant (400)..(422): Xaa in position 400 to 422 is any or no amino acid
  Variant (424)..(427): Xaa in position 424 to 427 is any amino acid
  Variant (429)..(430): Xaa in position 429 to 430 is any amino acid
  Variant (432)..(432): Xaa in position 432 is any amino acid
  Variant (434)..(446): Xaa in position 434 to 446 is any amino acid
  Variant (447)..(451): Xaa in position 447 to 451 is any or no amino acid
  Variant (453)..(453): Xaa in position 453 is any amino acid
  Variant (456)..(459): Xaa in position 456 to 459 is any amino acid
  Variant (460)..(460): Xaa in position 460 is any or no amino acid
  Variant (462)..(484): Xaa in position 462 to 484 is any amino acid
  Variant (485)..(515): Xaa in position 485 to 515 is any or no amino acid
  Variant (517)..(523): Xaa in position 517 to 523 is any amino acid
  Variant (527)..(535): Xaa in position 527 to 535 is any amino acid
  Variant (536)..(537): Xaa in position 536 to 537 is any or no amino acid
  Variant (539)..(540): Xaa in position 539 to 540 is any amino acid
  Variant (542)..(543): Xaa in position 542 to 543 is any amino acid
  Variant (545)..(546): Xaa in position 545 to 546 is any amino acid
  Variant (548)..(550): Xaa in position 548 to 550 is any amino acid
  Variant (554)..(556): Xaa in position 554 to 556 is any amino acid
  Variant (557)..(557): Xaa in position 557 is any or no amino acid
  Variant (559)..(564): Xaa in position 559 to 564 is any amino acid
  Variant (565)..(567): Xaa in position 565 to 567 is any or no amino acid
  Variant (570)..(570): Xaa in position 570 is any amino acid
  Variant (572)..(574): Xaa in position 572 to 574 is any amino acid
  Variant (576)..(582): Xaa in position 576 to 582 is any amino acid
  Variant (583)..(589): Xaa in position 583 to 589 is any or no amino acid
  Variant (591)..(591): Xaa in position 591 is any amino acid
  Variant (594)..(594): Xaa in position 594 is any amino acid
  Variant (601)..(602): Xaa in position 601 to 602 is any amino acid
  Variant (604)..(607): Xaa in position 604 to 607 is any amino acid
  Variant (608)..(609): Xaa in position 608 to 609 is any or no amino acid
  Variant (611)..(612): Xaa in position 611 to 612 is any amino acid
  Variant (616)..(616): Xaa in position 616 is any amino acid
  Variant (619)..(621): Xaa in position 619 to 621 is any amino acid
  Variant (623)..(623): Xaa in position 623 is any amino acid
  Variant (625)..(625): Xaa in position 625 is any amino acid
  Variant (636)..(637): Xaa in position 636 to 637 is any amino acid
  Variant (640)..(642): Xaa in position 640 to 642 is any amino acid
  Variant (644)..(645): Xaa in position 644 to 645 is any amino acid
  Variant (647)..(651): Xaa in position 647 to 651 is any amino acid
  Variant (653)..(654): Xaa in position 653 to 654 is any amino acid
  Variant (656)..(657): Xaa in position 656 to 657 is any amino acid
  Variant (660)..(660): Xaa in position 660 is any amino acid
  Variant (663)..(663): Xaa in position 663 is any amino acid
  Variant (666)..(666): Xaa in position 666 is any amino acid
  Variant (669)..(669): Xaa in position 669 is any amino acid
  Variant (672)..(682): Xaa in position 672 to 682 is any amino acid
  Variant (684)..(685): Xaa in position 684 to 685 is any amino acid
  Variant (686)..(686): Xaa in position 686 is any or no amino acid
  Variant (688)..(688): Xaa in position 688 is any amino acid
  Variant (690)..(690): Xaa in position 690 is any amino acid
  Variant (692)..(692): Xaa in position 692 is any amino acid
  Variant (699)..(701): Xaa in position 699 to 701 is any amino acid
  Variant (705)..(705): Xaa in position 705 is any amino acid
  Variant (712)..(713): Xaa in position 712 to 713 is any amino acid
  Variant (715)..(719): Xaa in position 715 to 719 is any amino acid
  Variant (721)..(722): Xaa in position 721 to 722 is any amino acid
  Variant (725)..(725): Xaa in position 725 is any amino acid
  Variant (729)..(729): Xaa in position 729 is any amino acid
  Variant (732)..(735): Xaa in position 732 to 735 is any amino acid
  Variant (736)..(736): Xaa in position 736 is any or no amino acid
  Variant (739)..(740): Xaa in position 739 to 740 is any amino acid
  Variant (743)..(748): Xaa in position 743 to 748 is any amino acid
  Variant (750)..(757): Xaa in position 750 to 757 is any amino acid
  Variant (758)..(758): Xaa in position 758 is any or no amino acid
  Variant (761)..(761): Xaa in position 761 is any amino acid
  Variant (763)..(772): Xaa in position 763 to 772 is any amino acid
  Variant (774)..(779): Xaa in position 774 to 779 is any amino acid
  Variant (781)..(792): Xaa in position 781 to 792 is any amino acid
  Variant (793)..(800): Xaa in position 793 to 800 is any or no amino acid
  Variant (802)..(804): Xaa in position 802 to 804 is any amino acid
  Variant (806)..(807): Xaa in position 806 to 807 is any amino acid
  Variant (809)..(809): Xaa in position 809 is any amino acid
  Variant (811)..(817): Xaa in position 811 to 817 is any amino acid
  Variant (820)..(824): Xaa in position 820 to 824 is any amino acid
  Variant (825)..(827): Xaa in position 825 to 827 is any or no amino acid
  Variant (829)..(831): Xaa in position 829 to 831 is any amino acid
  Variant (833)..(836): Xaa in position 833 to 836 is any amino acid
  Variant (838)..(838): Xaa in position 838 is any amino acid
  Variant (840)..(840): Xaa in position 840 is any amino acid
  Variant (843)..(843): Xaa in position 843 is any amino acid
  Variant (845)..(852): Xaa in position 845 to 852 is any amino acid
  Variant (854)..(860): Xaa in position 854 to 860 is any amino acid
  Variant (862)..(863): Xaa in position 862 to 863 is any amino acid
  Variant (865)..(867): Xaa in position 865 to 867 is any amino acid
  Variant (869)..(869): Xaa in position 869 is any amino acid
  Variant (871)..(877): Xaa in position 871 to 877 is any amino acid
  Variant (886)..(886): Xaa in position 886 is any amino acid
  Variant (888)..(892): Xaa in position 888 to 892 is any amino acid
  Variant (894)..(900): Xaa in position 894 to 900 is any amino acid
  Variant (902)..(904): Xaa in position 902 to 904 is any amino acid
  Variant (905)..(962): Xaa in position 905 to 962 is any or no amino acid
  Variant (965)..(966): Xaa in position 965 to 966 is any amino acid
  Variant (974)..(975): Xaa in position 974 to 975 is any amino acid
  Variant (977)..(977): Xaa in position 977 is any amino acid
  Variant (980)..(981): Xaa in position 980 to 981 is any amino acid
  Variant (983)..(983): Xaa in position 983 is any amino acid
  Variant (987)..(989): Xaa in position 987 to 989 is any amino acid
  Variant (994)..(995): Xaa in position 994 to 995 is any amino acid
  Variant (997)..(997): Xaa in position 997 is any amino acid
  Variant (1001)..(1001): Xaa in position 1001 is any amino acid
  Variant (1004)..(1004): Xaa in position 1004 is any amino acid
  Variant (1007)..(1008): Xaa in position 1007 to 1008 is any amino acid
  Variant (1010)..(1013): Xaa in position 1010 to 1013 is any amino acid
  Variant (1015)..(1015): Xaa in position 1015 is any amino acid
  Variant (1017)..(1019): Xaa in position 1017 to 1019 is any amino acid
  Variant (1022)..(1023): Xaa in position 1022 to 1023 is any amino acid
HXXXHXXSXLXXXXXXXXXXXXAGTQXXXIXXXXLXTXXLXXXXXXXXXXXXXXXXXSXLXLXXSXXXXXXXXXXXXXXXXXXXXXXXXXXXLFSXXXDXXXXXWXXXXXXXXXXXXXXXXXXXIYSXXDXGDXFSXXYXXXXXTXXXGXQNXSXXXXXXXXXXXXXXXXXXXXXXXXXPXXRXXXFFDSXXXXXXXXXXXXXXXXXXXXXXXXXXXXXXXXXXXXXXXXXXXXLXXXXXXXXXXAHXGXXYXXXXXXXXXXXXXXXXXXXXXXXXXXXXXSXXGDGXXKXWXXXXXXXXXXXXXXXXXXXXXXXXXXXXXDXXXSVXXXXXXXXFLYXGXXXGXXXXWDLXTXQXXXXXXXXXXXXXXXXXXXXXXXXXXXXXXXXXXXXGXXXXXXXXXXXXXXXXXXXXXXXXXXXXXXWXXXXGXXLXSXXXXXXXXXXXXXXXXXXGXNDXXXXXWXXXXXXXXXXXXXXXXXXXXXXXXXXXXXXXXXXXXXXXXXXXXXXXXXXXXXXLXXXXXXXTVSXXXXXXXXXXXRXXAXXLXXLXXXLGAXXXXLXXXXXXXXXNPXVXXXFXXXXXXXXXXXXXXKXILXYGHYDVXXAXXXXXXWXXDPFXLTXXXGXLXGRGVSDNKGPXXAAXXXVXXLXXXXXLXXDXXFLXEGXEEXGSXGFXXXXXXXXXXXGXXXDXIXLXNSYWLDXXXPCLXYGLRGVXXAXXXXXSXXPDXHSGXDGXXXXXEPXXDLXXXXXXLXXXXXXXXXIPXFXXXXXXXXXXEXXXXXXIXXXXXXXXXXXXXXXXXXXXLXXXWXXPXLXXXXXXXSGXXXXXXXXIXXXAXXXXSXRXVPXQXXXXXXXXLXXXXXXXFXXLXXXNXLXXXXXXXAEPWLGDPXNXXXXXLXXXXXXXWXXXXXXXXXXXXXXXXXXXXXXXXXXXXXXXXXXXXXXXXXXXXXXXXXXXXXXXXXXXXXPLXXREGGSIPXXRXLEXXFXAPAXXXPCGQXXDXAHLXNEXLRXXNXXXXRXIXXXVFXXL

SEQ ID NO: 71689 - protein, 60 aa, Artificial sequence
  protein pattern
  Variant (3)..(3): Xaa in position 3 is any amino acid
  Variant (4)..(4): Xaa in position 4 is Ile or Val
  Variant (11)..(11): Xaa in position 11 is Pro or Ser
  Variant (12)..(12): Xaa in position 12 is any amino acid
  Variant (13)..(13): Xaa in position 13 is Ile, Leu or Met
  Variant (15)..(15): Xaa in position 15 is any amino acid
  Variant (18)..(18): Xaa in position 18 is His, Lys or Arg
  Variant (19)..(19): Xaa in position 19 is any amino acid
  Variant (20)..(20): Xaa in position 20 is Phe or Leu
  Variant (21)..(21): Xaa in position 21 is Ala, Asp, Gly, Asn or Gln
  Variant (23)..(23): Xaa in position 23 is Pro or Ser
  Variant (24)..(24): Xaa in position 24 is Ala or Val
  Variant (25)..(25): Xaa in position 25 is Ala, Ile or Val
  Variant (26)..(26): Xaa in position 26 is any amino acid
  Variant (27)..(27): Xaa in position 27 is Phe, Ile or Leu
  Variant (32)..(32): Xaa in position 32 is any or no amino acid
  Variant (34)..(34): Xaa in position 34 is any or no amino acid
  Variant (36)..(36): Xaa in position 36 is any amino acid
  Variant (37)..(37): Xaa in position 37 is Ala or Gly
  Variant (40)..(40): Xaa in position 40 is any amino acid
  Variant (43)..(43): Xaa in position 43 is Asn, Gln or Arg
  Variant (45)..(45): Xaa in position 45 is any amino acid
  Variant (46)..(46): Xaa in position 46 is Ile, Leu, Met or Val
  Variant (47)..(47): Xaa in position 47 is any amino acid
  Variant (49)..(54): Xaa in position 49 to 54 is any amino acid
  Variant (56)..(56): Xaa in position 56 is Phe or Leu
  Variant (57)..(58): Xaa in position 57 to 58 is any amino acid
  Variant (59)..(59): Xaa in position 59 is Phe or Val
  Variant (60)..(60): Xaa in position 60 is Phe or Ile
PLXXREGGSIXXXRXLEXXXXAXXXXXPCGQXSXDXXHLXNEXLXXXNXXXXXXIXXXXX

SEQ ID NO: 71690 - protein, 61 aa, Artificial sequence
  protein pattern
  Variant (2)..(3): Xaa in position 2 to 3 is any or no amino acid
  Variant (5)..(6): Xaa in position 5 to 6 is any or no amino acid
  Variant (9)..(9): Xaa in position 9 is any amino acid
  Variant (10)..(10): Xaa in position 10 is Leu or Met
  Variant (11)..(11): Xaa in position 11 is any amino acid
  Variant (12)..(12): Xaa in position 12 is Ala, Cys or Gly
  Variant (13)..(13): Xaa in position 13 is any amino acid
  Variant (14)..(14): Xaa in position 14 is Asp or Asn
  Variant (16)..(16): Xaa in position 16 is any amino acid
  Variant (17)..(17): Xaa in position 17 is Leu or Met
  Variant (18)..(18): Xaa in position 18 is any amino acid
  Variant (19)..(19): Xaa in position 19 is Ala or Gly
  Variant (23)..(23): Xaa in position 23 is Ser or Thr
  Variant (29)..(29): Xaa in position 29 is Ile or Leu
  Variant (30)..(30): Xaa in position 30 is Ile, Leu, Met or Val
  Variant (31)..(31): Xaa in position 31 is Ala or Ser
  Variant (33)..(33): Xaa in position 33 is Ile, Leu or Met
  Variant (34)..(34): Xaa in position 34 is Phe, His or Tyr
  Variant (35)..(35): Xaa in position 35 is Ala or Ser
  Variant (37)..(37): Xaa in position 37 is Ala, Ser or Thr
  Variant (38)..(38): Xaa in position 38 is any amino acid
  Variant (40)..(44): Xaa in position 40 to 44 is any amino acid
  Variant (46)..(47): Xaa in position 46 to 47 is any amino acid
  Variant (49)..(49): Xaa in position 49 is Ile or Val
  Variant (50)..(50): Xaa in position 50 is any amino acid
  Variant (52)..(52): Xaa in position 52 is Ile or Leu
  Variant (53)..(53): Xaa in position 53 is Ile or Val
  Variant (56)..(56): Xaa in position 56 is Glu, Gln or Ser
  Variant (59)..(59): Xaa in position 59 is any amino acid
WXXDXXPFXXXXXXGXXXXRGVXDNKGPXXXAXXXVXXLXXXXXLXXDXXFXXEGXEEXGS

SEQ ID NO: 71691 - protein, 50 aa, Artificial sequence
  protein pattern
  Variant (2)..(3): Xaa in position 2 to 3 is any amino acid
  Variant (4)..(4): Xaa in position 4 is any or no amino acid
  Variant (6)..(6): Xaa in position 6 is Trp or Tyr
  Variant (7)..(7): Xaa in position 7 is Ile or Val
  Variant (8)..(8): Xaa in position 8 is Ile, Leu or Met
  Variant (10)..(10): Xaa in position 10 is Ala, Cys or Ser
  Variant (13)..(13): Xaa in position 13 is any amino acid
  Variant (15)..(15): Xaa in position 15 is Leu or Val
  Variant (17)..(17): Xaa in position 17 is Asp or Gln
  Variant (18)..(19): Xaa in position 18 to 19 is any amino acid
  Variant (22)..(22): Xaa in position 22 is Ile or Leu
  Variant (23)..(23): Xaa in position 23 is Asn or Thr
  Variant (26)..(26): Xaa in position 26 is any amino acid
  Variant (29)..(29): Xaa in position 29 is Met or Val
  Variant (30)..(30): Xaa in position 30 is Ile, Leu or Val
  Variant (31)..(32): Xaa in position 31 to 32 is any amino acid
  Variant (33)..(33): Xaa in position 33 is Asn, Gln, Ser or Thr
  Variant (34)..(34): Xaa in position 34 is Ile, Leu or Val
  Variant (35)..(35): Xaa in position 35 is any amino acid
  Variant (36)..(36): Xaa in position 36 is Ile or Val
  Variant (37)..(37): Xaa in position 37 is any amino acid
  Variant (38)..(38): Xaa in position 38 is Ala or Ser
  Variant (39)..(40): Xaa in position 39 to 40 is any amino acid
  Variant (42)..(42): Xaa in position 42 is Asp or Asn
  Variant (43)..(43): Xaa in position 43 is any amino acid
  Variant (47)..(47): Xaa in position 47 is Phe, Ile, Leu or Val
  Variant (48)..(48): Xaa in position 48 is Asp, Glu or Asn
  Variant (50)..(50): Xaa in position 50 is Gly or Ser
GXXXDXXXLXNSXWXDXXXPCXXYGXRGXXXXXXXXXXXXPXXHSGXXGX

SEQ ID NO: 71692 - protein, 41 aa, Artificial sequence
  protein pattern
  Variant (2)..(2): Xaa in position 2 is any amino acid
  Variant (3)..(8): Xaa in position 3 to 8 is any or no amino acid
  Variant (10)..(10): Xaa in position 10 is Gly or Ser
  Variant (11)..(12): Xaa in position 11 to 12 is any amino acid
  Variant (14)..(14): Xaa in position 14 is Ile or Val
  Variant (17)..(17): Xaa in position 17 is Ile or Val
  Variant (19)..(19): Xaa in position 19 is Cys or Ser
  Variant (20)..(21): Xaa in position 20 to 21 is any amino acid
  Variant (23)..(23): Xaa in position 23 is any amino acid
  Variant (24)..(24): Xaa in position 24 is Asp, Pro or Ser
  Variant (25)..(26): Xaa in position 25 to 26 is any amino acid
  Variant (27)..(27): Xaa in position 27 is Asp, Glu, Asn or Gln
  Variant (28)..(28): Xaa in position 28 is any amino acid
  Variant (29)..(29): Xaa in position 29 is Ile, Leu or Val
  Variant (30)..(30): Xaa in position 30 is any amino acid
  Variant (31)..(31): Xaa in position 31 is Phe, Ile or Leu
  Variant (33)..(33): Xaa in position 33 is Ala, Cys, Ser or Thr
  Variant (35)..(35): Xaa in position 35 is Asn or Thr
  Variant (36)..(36): Xaa in position 36 is Ala, Gln or Thr
  Variant (37)..(37): Xaa in position 37 is any amino acid
  Variant (38)..(38): Xaa in position 38 is Ile, Leu or Met
  Variant (39)..(39): Xaa in position 39 is any amino acid
  Variant (40)..(40): Xaa in position 40 is Phe, Trp or Tyr
  Variant (41)..(41): Xaa in position 41 is Ile, Leu or Val
EXXXXXXXYXXXDXGDXFXXXYXXXXXXXXXGXQXXXXXXX

SEQ ID NO: 71693 - protein, 36 aa, Artificial sequence
  protein pattern
  Variant (2)..(2): Xaa in position 2 is Phe, Ile, Leu or Met
  Variant (3)..(3): Xaa in position 3 is Cys, Ser or Thr
  Variant (4)..(5): Xaa in position 4 to 5 is any amino acid
  Variant (6)..(6): Xaa in position 6 is Ile, Leu or Val
  Variant (7)..(7): Xaa in position 7 is Asp or Glu
  Variant (8)..(8): Xaa in position 8 is any amino acid
  Variant (9)..(9): Xaa in position 9 is Pro or Ser
  Variant (13)..(13): Xaa in position 13 is Ala, Cys, Ser or Val
  Variant (15)..(15): Xaa in position 15 is any or no amino acid
  Variant (17)..(17): Xaa in position 17 is any amino acid
  Variant (18)..(18): Xaa in position 18 is any or no amino acid
  Variant (20)..(23): Xaa in position 20 to 23 is any amino acid
  Variant (24)..(24): Xaa in position 24 is any or no amino acid
  Variant (26)..(26): Xaa in position 26 is Asp or Asn
  Variant (28)..(28): Xaa in position 28 is Asp, Asn or Ser
  Variant (29)..(30): Xaa in position 29 to 30 is any amino acid
  Variant (31)..(31): Xaa in position 31 is Glu or Gln
  Variant (32)..(32): Xaa in position 32 is any amino acid
  Variant (33)..(33): Xaa in position 33 is Ile, Leu or Val
  Variant (34)..(35): Xaa in position 34 to 35 is any amino acid
  Variant (36)..(36): Xaa in position 36 is Ile or Leu
VXXXXXXXXFLYXGXLXXGXXXXXWXLXXXXXXXXX

SEQ ID NO: 71694 - protein, 15 aa, Artificial sequence
  protein pattern
  Variant (2)..(2): Xaa in position 2 is any amino acid
  Variant (4)..(4): Xaa in position 4 is Leu or Val
  Variant (5)..(5): Xaa in position 5 is Phe or Trp
  Variant (12)..(12): Xaa in position 12 is Ile or Val
  Variant (13)..(13): Xaa in position 13 is Ala, Asp, Gly, Pro or Ser
  Variant (14)..(14): Xaa in position 14 is Ala or Ser
  Variant (15)..(15): Xaa in position 15 is Asp, Gly or Thr
KXIXXYGHYDVXXXX

SEQ ID NO: 71695 - protein, 18 aa, Artificial sequence
  protein pattern
  Variant (2)..(5): Xaa in position 2 to 5 is any or no amino acid
  Variant (7)..(7): Xaa in position 7 is any amino acid
  Variant (8)..(8): Xaa in position 8 is Asp or His
  Variant (9)..(9): Xaa in position 9 is Lys or Arg
  Variant (14)..(14): Xaa in position 14 is any amino acid
  Variant (15)..(15): Xaa in position 15 is Ala or Gly
  Variant (16)..(16): Xaa in position 16 is Pro or Val
  Variant (17)..(17): Xaa in position 17 is Asp, Gly or Thr
RXXXXRXXXFFDSXXXXG

SEQ ID NO: 71696 - protein, 22 aa, Artificial sequence
  protein pattern
  Variant (2)..(2): Xaa in position 2 is Ile, Met or Val
  Variant (3)..(4): Xaa in position 3 to 4 is any amino acid
  Variant (6)..(7): Xaa in position 6 to 7 is any amino acid
  Variant (9)..(9): Xaa in position 9 is Ala, Asn or Ser
  Variant (11)..(12): Xaa in position 11 to 12 is any or no amino acid
  Variant (14)..(18): Xaa in position 14 to 18 is any amino acid
  Variant (19)..(20): Xaa in position 19 to 20 is any or no amino acid
  Variant (22)..(22): Xaa in position 22 is Asn or Pro
LXXXWXXPXLXXTXXXXXXXGX

SEQ ID NO: 71697 - protein, 25 aa, Artificial sequence
  protein pattern
  Variant (2)..(2): Xaa in position 2 is any amino acid
  Variant (3)..(4): Xaa in position 3 to 4 is any or no amino acid
  Variant (6)..(8): Xaa in position 6 to 8 is any amino acid
  Variant (9)..(9): Xaa in position 9 is Gly or Ser
  Variant (10)..(10): Xaa in position 10 is any amino acid
  Variant (12)..(12): Xaa in position 12 is any amino acid
  Variant (13)..(13): Xaa in position 13 is Ala, Cys or Val
  Variant (14)..(14): Xaa in position 14 is any amino acid
  Variant (15)..(15): Xaa in position 15 is Asp or Ser
  Variant (16)..(16): Xaa in position 16 is Ile, Leu or Val
  Variant (17)..(17): Xaa in position 17 is any amino acid
  Variant (18)..(18): Xaa in position 18 is Asn or Thr
  Variant (19)..(19): Xaa in position 19 is Phe or Tyr
  Variant (20)..(20): Xaa in position 20 is Glu, Asn, Gln or Ser
  Variant (22)..(24): Xaa in position 22 to 24 is any amino acid
  Variant (25)..(25): Xaa in position 25 is Ile, Leu or Val
FXXXGXXXXXIXXXXXXXXXLXXXX

SEQ ID NO: 71698 - protein, 14 aa, Artificial sequence
  protein pattern
  Variant (4)..(4): Xaa in position 4 is any amino acid
  Variant (5)..(5): Xaa in position 5 is any or no amino acid
  Variant (7)..(7): Xaa in position 7 is any or no amino acid
  Variant (9)..(9): Xaa in position 9 is Ala, Pro or Ser
  Variant (10)..(10): Xaa in position 10 is Ile, Leu or Val
  Variant (11)..(11): Xaa in position 11 is Ile or Val
  Variant (12)..(12): Xaa in position 12 is any amino acid
  Variant (13)..(13): Xaa in position 13 is Ala, Ile or Val
LFSXXGXDXXXXXW

SEQ ID NO: 71699 - protein, 14 aa, Artificial sequence
  protein pattern
  Variant (2)..(2): Xaa in position 2 is Lys or Arg
  Variant (3)..(3): Xaa in position 3 is Cys or Gly
  Variant (5)..(5): Xaa in position 5 is any amino acid
  Variant (6)..(6): Xaa in position 6 is Phe, His or Tyr
  Variant (8)..(8): Xaa in position 8 is any amino acid
  Variant (9)..(9): Xaa in position 9 is Ala, Asp, Asn, Gln or Ser
  Variant (11)..(13): Xaa in position 11 to 13 is any or no amino acid
RXXAXXLXXLXXXF

SEQ ID NO: 71700 - protein, 28 aa, Artificial sequence
  protein pattern
  Variant (2)..(2): Xaa in position 2 is any amino acid
  Variant (3)..(3): Xaa in position 3 is Ala, Asp, Gly, Asn or Thr
  Variant (4)..(4): Xaa in position 4 is Asp, Glu, Pro or Thr
  Variant (5)..(5): Xaa in position 5 is any amino acid
  Variant (6)..(6): Xaa in position 6 is Gly or Asn
  Variant (7)..(7): Xaa in position 7 is any amino acid
  Variant (8)..(8): Xaa in position 8 is Ile or Val
  Variant (9)..(9): Xaa in position 9 is any amino acid
  Variant (10)..(10): Xaa in position 10 is Ile or Leu
  Variant (12)..(12): Xaa in position 12 is any amino acid
  Variant (14)..(15): Xaa in position 14 to 15 is any amino acid
  Variant (16)..(18): Xaa in position 16 to 18 is any or no amino acid
  Variant (20)..(20): Xaa in position 20 is Ile, Leu, Pro or Val
  Variant (21)..(21): Xaa in position 21 is any amino acid
  Variant (22)..(22): Xaa in position 22 is Asp, Glu or Pro
  Variant (23)..(23): Xaa in position 23 is any amino acid
  Variant (24)..(24): Xaa in position 24 is Asp, Glu or Thr
  Variant (25)..(26): Xaa in position 25 to 26 is any amino acid
  Variant (27)..(27): Xaa in position 27 is Asp, Glu or Arg
  Variant (28)..(28): Xaa in position 28 is Phe or Tyr
LXXXXXXXXXPXFXXXXXPXXXXXXXXX

SEQ ID NO: 71701 - protein, 12 aa, Artificial sequence
  protein pattern
  Variant (2)..(3): Xaa in position 2 to 3 is any amino acid
  Variant (4)..(4): Xaa in position 4 is Phe or Leu
  Variant (5)..(5): Xaa in position 5 is Ile or Val
  Variant (6)..(6): Xaa in position 6 is Ala, Gln or Ser
  Variant (7)..(7): Xaa in position 7 is Phe or Tyr
  Variant (8)..(8): Xaa in position 8 is any amino acid
  Variant (10)..(10): Xaa in position 10 is Ile or Val
  Variant (12)..(12): Xaa in position 12 is Ala, Gln or Ser
LXXXXXXXTXSX

SEQ ID NO: 71702 - DNA, 930 bp, Saccharomyces cerevisiae
  CDS (1)..(930)
atgattttcaaaaggttcgttaatttgcttgtgtttttattcctactcggtgctggcttattgacgttttttcttattctgtcaggaggcagagaatctggaacgctgaaaaatttttattggttacaggctgatacaaacggctttaacagcgctccatcgaccacgagatggtacaattacaattggtgcggctacgaagacggccagctagctaattgctctagcagggcgcccgccaagcctttctctcccagagacaattttggtaactctgtcaatttaccatcgtcgttcagaaacaaccgggatacctactattatctatccagggttggatgggccatgctgctgatttccctatttttcatcgtactggcgctggtacccggctttctggctaccttccttcctttcaaggcagtgccagtcctgtactgtgtgttgtcctggttggcctttttcttcattatattggctgcatgcttgtacacaggttgctatgtgaaggccagaaagaccttccgcaacagcgggaggtctgcaaggctgggacccaaaaactttgcgttcatctggacttcggtcttcttgatgctcgtgaacgccatttggtccactatattcagtgctacccacaaggcccactctacctactcggaccacgacatgtatgcccaatatgaaagcccttctgttgacaccggtgctcaaatggagaaatccacttacaatagtggggcgacggacggcgcgggccctatcacagccgcacctgtggttggacagcctcaacctacaaccaccactactccggctggcaatggcaagttctttcaaaaactgaaaacaagaaagcaggtgccatcagctgagttagaaccagctggggatggtggtcttgccgggccagtgacggtacgcgactag

SEQ ID NO: 71703 - protein, 309 aa, Saccharomyces cerevisiae
MIFKRFVNLLVFLFLLGAGLLTFFLILSGGRESGTLKNFYWLQADTNGFNSAPSTTRWYNYNWCGYEDGQLANCSSRAPAKPFSPRDNFGNSVNLPSSFRNNRDTYYYLSRVGWAMLLISLFFIVLALVPGFLATFLPFKAVPVLYCVLSWLAFFFIILAACLYTGCYVKARKTFRNSGRSARLGPKNFAFIWTSVFLMLVNAIWSTIFSATHKAHSTYSDHDMYAQYESPSVDTGAQMEKSTYNSGATDGAGPITAAPVVGQPQPTTTTTPAGNGKFFQKLKTRKQVPSAELEPAGDGGLAGPVTVRD

SEQ ID NO: 71704 - DNA, 1290 bp, Eremothecium gossypii
  CDS (1)..(1290)
atgatgtttaaaggagtgattacatcgctgtcgtttctactattattaggctcatgcctgttgggctttttcacgattttgtccggtgcgaagcacacgggcgtcttgaagaacttctactggctagaagctaacaccatcaacttcaaccaggccccaccgaacacgagatggtacaactacaactggtgtgagtacggtgatgaccacaccggtgtgtgttccaacaacaaggtcatgggcttcgcgccacgggaccactggggtgactcttcggagatgcctgaaaactttatcagcaagcgggctacctatttctacttgtcgagagttggttgggctatgttggtgattggtttgttcttcatggttttggcgatcctcccatacatcgtttccatctttaccgagaaggcagcttatgtgtcgacccctgcattgtggttggcattgttcttcgtgactctagccgcgtgcttatacactgcttgctacgttaaggctcgcaacgctttccacagcaggaaccgttacgccaagttgggtcctcgcaacttcgcctttatctggacggctgtcttcctactattcctcaactgtgtgtggtcgaccttcttggccgctagcagagctgtgatgtccttcagaaaccgcaacaagaatgacaactactacgacccggcttctgacaagtcctttgacaacagcactgcgatccacagtggcgcgaccgtggtcccatcccgcaagaactactttagagaagatggcagaccagccaggggcgccgcctacgacggcgaggtcatgaccggccatggacatcagtacaacaacgcgactaactacggcgtcggttcgaagaccgctgccgctggtgccgccgtggcaggcgctgcgggtgcctacggagcttccaactacggtcactccgagcctcacgcgccagtctccaagcaggccgcctacgacacataccaggccccaagcgctcctcagaccacctcgtacacgacatccgagccatacaaggtctacaaggacccaagcgccaaggcaccaaaggtatacgtctactcggagtccgccacgcgcgacgccttcccagaggccgtcgagagacagaataaaccctccaaacagggtgtcagcagaaactcaggcagaattgtcgaccccaccgagtaccagacggccaaggacgccgcctccggcaccacagcccatgacgacctagcccacccaaggggcctaggcatggccgcgcaggccgctgcccaggctgtctaa

SEQ ID NO: 71705 - protein, 429 aa, Eremothecium gossypii
MMFKGVITSLSFLLLLGSCLLGFFTILSGAKHTGVLKNFYWLEANTINFNQAPPNTRWYNYNWCEYGDDHTGVCSNNKVMGFAPRDHWGDSSEMPENFISKRATYFYLSRVGWAMLVIGLFFMVLAILPYIVSIFTEKAAYVSTPALWLALFFVTLAACLYTACYVKARNAFHSRNRYAKLGPRNFAFIWTAVFLLFLNCVWSTFLAASRAVMSFRNRNKNDNYYDPASDKSFDNSTAIHSGATVVPSRKNYFREDGRPARGAAYDGEVMTGHGHQYNNATNYGVGSKTAAAGAAVAGAAGAYGASNYGHSEPHAPVSKQAAYDTYQAPSAPQTTSYTTSEPYKVYKDPSAKAPKVYVYSESATRDAFPEAVERQNKPSKQGVSRNSGRIVDPTEYQTAKDAASGTTAHDDLAHPRGLGMAAQAAAQAV

SEQ ID NO: 71706 - DNA, 843 bp, Candida glabrata CBS 138
  CDS (1)..(843)
atgcaatacaaaagatttgtaaacgctattgtgtgtttgtttatagtaggtgcaggtctactatctttcttcctaatcctgtcaggtgcccgtgattctggtactttgaagaatttttactggttcgaagctgacaccagtggttttaatgatgccccagatgtcacaagatggtacaactacatgtactgtggttatgcagaccatgagacttacgactgttccgacaaaggtgccgacaaaccattttctccaaaggataacttcggtgaatcccccaacatgccaagaactttcattgaccacagaaagacatactactacttgtctaaggtcggctgggctatgttgttgatatcccttttcttcaccgtgttggctattgtcccaatattcctaagtatcttcaagttggctagaccattgagcatcacaacttgtgtgttgtgctggctgtcatggttcttcattacattggctgcttgtttgtacactggttgttatgccaaagctaagaatgcattccaccacgacgacagacatgcaaagatgggtgctaagaactttgctttcctatggactactgttttcctaatgggtgtatcttctatttggactatgatcgatgctattactagaagaaaggagaagtataacaagtacagaactactgacgtctattctgacaccgaagtggtcggtgctgtaccacctgttgaaagccaaccatcttctggccgtacctttttcagaaagctaagaactaagaaacacgaaactccagctggtgtgatggcggaagaggaatcccatgaaaaggtggttgaaggtgtccaaacttag

SEQ ID NO: 71707 - protein, 280 aa, Candida glabrata CBS 138
MQYKRFVNAIVCLFIVGAGLLSFFLILSGARDSGTLKNFYWFEADTSGFNDAPDVTRWYNYMYCGYADHETYDCSDKGADKPFSPKDNFGESPNMPRTFIDHRKTYYYLSKVGWAMLLISLFFTVLAIVPIFLSIFKLARPLSITTCVLCWLSWFFITLAACLYTGCYAKAKNAFHHDDRHAKMGAKNFAFLWTTVFLMGVSSIWTMIDAITRRKEKYNKYRTTDVYSDTEVVGAVPPVESQPSSGRTFFRKLRTKKHETPAGVMAEEESHEKVVEGVQT

SEQ ID NO: 71708 - DNA, 813 bp, Kluyveromyces lactis NRRL Y-1140
  CDS (1)..(813)
atgaagttcaaagggttcgtttcttcgttatcgttgcttttcttattgggttctggtttgttgacgttttttgttatattgtctggtgctaggactactggtgtattggacaaattctattggtttgaggctgacaccagtgggttacctggtgctccagatactacaagatggttcaattaccattggtgtgcttatgagaatggtgaaatcggaagttgttcaggcaaacaagcggacttaccattttcccctagagacaattttggaaacagtcctgatcttccagcatcatttagagataatcgtaatacctactattatttaagtcgtgttggttgggcaatgttgttgattggtttattcttcgtggtactcgcattgattcctgtgttgctatcctttttcaaggttggtgtcggtgcggtattgtctactgtttctatttggctggctttatttttcatcacattggcagcctgtttgtacacagcttgttacgtgaaaggtcgtaacactttccgtgatgccggtcgttcagcatcgatgaacaccaagatgttcgcatttttatggacctcagtgttcttattattattaagttcgttctggtcaataattttgagtgtcacaattggtgttcagaaagtcaaaggagcaaacacttatcaaccgtatgagggtactagctctcatgatgatagttacaacgtcgacaagcacacatatgaaagcggtgtcaatgacaacaaccgtcaaaatatcaaatggtggaaacttcgctacaagaagaaagacaccgttgctgtttaa

SEQ ID NO: 71709 - protein, 270 aa, Kluyveromyces lactis NRRL Y-1140
MKFKGFVSSLSLLFLLGSGLLTFFVILSGARTTGVLDKFYWFEADTSGLPGAPDTTRWFNYHWCAYENGEIGSCSGKQADLPFSPRDNFGNSPDLPASFRDNRNTYYYLSRVGWAMLLIGLFFVVLALIPVLLSFFKVGVGAVLSTVSIWLALFFITLAACLYTACYVKGRNTFRDAGRSASMNTKMFAFLWTSVFLLLLSSFWSIILSVTIGVQKVKGANTYQPYEGTSSHDDSYNVDKHTYESGVNDNNRQNIKWWKLRYKKKDTVAV

SEQ ID NO: 71710 - DNA, 906 bp, Saccharomyces cerevisiae
  CDS (1)..(906)
atgtcctacaaaaagtttgtgtactttattaaccttttctttctactaggggctacattgttgactttttttctgatactagcaggtggcaggaccacaggagtgttgaagaatttttattggtttcaggcatccacttcgggctttaactcggcgccctccgtaaccagatggtacaattataactggtgcggctgggaaagccgcggaatagcagtcaactgctcttctaagatggcagctcagccgttttcaccaagggacaactttggcagttcccccctcatgccctcaacttttttaaacaacagaaatgcctactattatctttcaagagtgggctgggcaatgcttctaatcgggcttttctttttgttaatcacgttagtttcggttattgccagtttaatcagatacaatagacgtaccgccgctctggcaactgcaatgagctggatcacgcttttcttcataaccctatccgcttgtctgtacacaggatgttacgctaaggcagtaaaggcgtttcaccatgagaatcgtgatgctagactaggtcccaagaattttgggcttatttggaccacagtatttttgttaattgtaaacgccatttgctgtactatcatggtggctactcataaaagaaacgagtacatctatgaccgcagtttcgcttctaccaagacagtggactcacaaactccaactccagttccaacaaatggaggaataccttcctcggtgcctgtaactgaggtccaacaatctcaatcccaccagaatcataggttctttaagaaattgagaacgaaaaagagaactgtgactagcgcaggcgatgaaccagaccgggttcaagaggaacgcgtctatactgaacagaatgttcctgttgtatcatag

SEQ ID NO: 71711 - protein, 301 aa, Saccharomyces cerevisiae
MSYKKFVYFINLFFLLGATLLTFFLILAGGRTTGVLKNFYWFQASTSGFNSAPSVTRWYNYNWCGWESRGIAVNCSSKMAAQPFSPRDNFGSSPLMPSTFLNNRNAYYYLSRVGWAMLLIGLFFLLITLVSVIASLIRYNRRTAALATAMSWITLFFITLSACLYTGCYAKAVKAFHHENRDARLGPKNFGLIWTTVFLLIVNAICCTIMVATHKRNEYIYDRSFASTKTVDSQTPTPVPTNGGIPSSVPVTEVQQSQSHQNHRFFKKLRTKKRTVTSAGDEPDRVQEERVYTEQNVPVVS

SEQ ID NO: 71712 - DNA, 27 bp, Artificial sequence
  primer
atgattttcaaaaggttcgttaatttg

SEQ ID NO: 71713 - DNA, 21 bp, Artificial sequence
  primer
ctagtcgcgtaccgtcactgg

SEQ ID NO: 71714 - protein, 357 aa, Artificial sequence
  consensus sequence
  Variant (2)..(3): Xaa in position 2 to 3 is any amino acid
  Variant (5)..(5): Xaa in position 5 is any amino acid
  Variant (8)..(12): Xaa in position 8 to 12 is any amino acid
  Variant (18)..(19): Xaa in position 18 to 19 is any amino acid
  Variant (22)..(22): Xaa in position 22 is any amino acid
  Variant (25)..(25): Xaa in position 25 is any amino acid
  Variant (30)..(30): Xaa in position 30 is any amino acid
  Variant (32)..(33): Xaa in position 32 to 33 is any amino acid
  Variant (35)..(35): Xaa in position 35 is any amino acid
  Variant (42)..(43): Xaa in position 42 to 43 is any amino acid
  Variant (45)..(45): Xaa in position 45 is any amino acid
  Variant (47)..(47): Xaa in position 47 is any amino acid
  Variant (51)..(51): Xaa in position 51 is any amino acid
  Variant (54)..(55): Xaa in position 54 to 55 is any amino acid
  Variant (62)..(62): Xaa in position 62 is any amino acid
  Variant (65)..(65): Xaa in position 65 is any amino acid
  Variant (67)..(73): Xaa in position 67 to 73 is any amino acid
  Variant (74)..(74): Xaa in position 74 is any or no amino acid
  Variant (77)..(81): Xaa in position 77 to 81 is any amino acid
  Variant (82)..(82): Xaa in position 82 is any or no amino acid
  Variant (92)..(92): Xaa in position 92 is any amino acid
  Variant (94)..(96): Xaa in position 94 to 96 is any amino acid
  Variant (98)..(99): Xaa in position 98 to 99 is any amino acid
  Variant (101)..(103): Xaa in position 101 to 103 is any amino acid
  Variant (105)..(105): Xaa in position 105 is any amino acid
  Variant (121)..(121): Xaa in position 121 is any amino acid
  Variant (125)..(125): Xaa in position 125 is any amino acid
  Variant (129)..(130): Xaa in position 129 to 130 is any amino acid
  Variant (132)..(134): Xaa in position 132 to 134 is any amino acid
  Variant (136)..(136): Xaa in position 136 is any amino acid
  Variant (138)..(149): Xaa in position 138 to 149 is any amino acid
  Variant (150)..(151): Xaa in position 150 to 151 is any or no amino acid
  Variant (154)..(155): Xaa in position 154 to 155 is any amino acid
  Variant (167)..(167): Xaa in position 167 is any amino acid
  Variant (170)..(170): Xaa in position 170 is any amino acid
  Variant (173)..(175): Xaa in position 173 to 175 is any amino acid
  Variant (177)..(180): Xaa in position 177 to 180 is any amino acid
  Variant (182)..(182): Xaa in position 182 is any amino acid
  Variant (184)..(185): Xaa in position 184 to 185 is any amino acid
  Variant (187)..(187): Xaa in position 187 is any amino acid
  Variant (193)..(193): Xaa in position 193 is any amino acid
  Variant (196)..(196): Xaa in position 196 is any amino acid
  Variant (200)..(205): Xaa in position 200 to 205 is any amino acid
  Variant (207)..(208): Xaa in position 207 to 208 is any amino acid
  Variant (210)..(212): Xaa in position 210 to 212 is any amino acid
  Variant (214)..(218): Xaa in position 214 to 218 is any amino acid
  Variant (219)..(228): Xaa in position 219 to 228 is any or no amino acid
  Variant (230)..(262): Xaa in position 230 to 262 is any amino acid
  Variant (263)..(351): Xaa in position 263 to 351 is any or no amino acid
  Variant (354)..(355): Xaa in position 354 to 355 is any amino acid
MXXKXFVXXXXXLFLLGXXLLXFFXILSGXRXXGXLKNFYWXXAXTXGFNXAPXXTRWYNYXWCXYXXXXXXXXCSXXXXXXPFSPRDNFGXSXXXPXXFXXXRXTYYYLSRVGWAMLLIXLFFXVLAXXPXXXSXFXXXXXXXXXXXXXXWLXXFFITLAACLYTXCYXKAXXXFXXXXRXAXXGXKNFAFXWTXVFLXXXXXXWXXIXXXTXXXXXXXXXXXXXXXYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKLXXKK

SEQ ID NO: 71715 - protein, 60 aa, Artificial sequence
  protein pattern
  Variant (2)..(2): Xaa in position 2 is Ala or Ser
  Variant (3)..(3): Xaa in position 3 is Cys or Gly
  Variant (6)..(6): Xaa in position 6 is Gly, Ser or Thr
  Variant (9)..(9): Xaa in position 9 is any amino acid
  Variant (14)..(14): Xaa in position 14 is Ala or Gly
  Variant (15)..(15): Xaa in position 15 is Lys or Arg
  Variant (16)..(16): Xaa in position 16 is any amino acid
  Variant (17)..(17): Xaa in position 17 is Ser or Thr
  Variant (19)..(19): Xaa in position 19 is Thr or Val
  Variant (21)..(21): Xaa in position 21 is any or no amino acid
  Variant (23)..(23): Xaa in position 23 is any or no amino acid
  Variant (27)..(27): Xaa in position 27 is Phe or Leu
  Variant (28)..(28): Xaa in position 28 is Glu or Gln
  Variant (30)..(30): Xaa in position 30 is Asp or Asn
  Variant (32)..(32): Xaa in position 32 is any amino acid
  Variant (33)..(33): Xaa in position 33 is Gly or Asn
  Variant (34)..(34): Xaa in position 34 is Phe or Leu
  Variant (35)..(35): Xaa in position 35 is Asn or Pro
  Variant (36)..(36): Xaa in position 36 is Asp, Gly, Gln or Ser
  Variant (39)..(39): Xaa in position 39 is Asp, Pro or Ser
  Variant (40)..(40): Xaa in position 40 is Asn, Thr or Val
  Variant (44)..(44): Xaa in position 44 is Phe or Tyr
  Variant (47)..(47): Xaa in position 47 is any amino acid
  Variant (48)..(48): Xaa in position 48 is Trp or Tyr
  Variant (50)..(50): Xaa in position 50 is Ala, Glu or Gly
  Variant (52)..(52): Xaa in position 52 is Ala, Glu or Gly
  Variant (53)..(53): Xaa in position 53 is Asp or Asn
  Variant (54)..(57): Xaa in position 54 to 57 is any amino acid
  Variant (58)..(58): Xaa in position 58 is Asp, Asn, Ser or Val
GXXLLXFFXILSGXXXXGXLXKXFYWXXAXTXXXXXAPXXTRWXNYXXCXYXXXXXXXCS

SEQ ID NO: 71716 - protein, 58 aa, Artificial sequence
  protein pattern
  Variant (3)..(3): Xaa in position 3 is Ala or Ser
  Variant (4)..(4): Xaa in position 4 is any amino acid
  Variant (7)..(7): Xaa in position 7 is Ile or Val
  Variant (8)..(8): Xaa in position 8 is any amino acid
  Variant (16)..(16): Xaa in position 16 is Ala or Gly
  Variant (19)..(19): Xaa in position 19 is Ala or Val
  Variant (21)..(21): Xaa in position 21 is Ala or Gly
  Variant (22)..(22): Xaa in position 22 is Lys or Arg
  Variant (23)..(23): Xaa in position 23 is any amino acid
  Variant (24)..(24): Xaa in position 24 is Ala or Thr
  Variant (26)..(26): Xaa in position 26 is His or Arg
  Variant (27)..(28): Xaa in position 27 to 28 is any amino acid
  Variant (29)..(29): Xaa in position 29 is Asp, Gly or Asn
  Variant (31)..(31): Xaa in position 31 is any amino acid
  Variant (33)..(33): Xaa in position 33 is any amino acid
  Variant (34)..(34): Xaa in position 34 is Leu or Met
  Variant (35)..(35): Xaa in position 35 is Gly or Asn
  Variant (36)..(36): Xaa in position 36 is Ala, Pro or Thr
  Variant (37)..(37): Xaa in position 37 is Lys or Arg
  Variant (38)..(38): Xaa in position 38 is any amino acid
  Variant (42)..(42): Xaa in position 42 is Ile or Leu
  Variant (45)..(45): Xaa in position 45 is Ala, Ser or Thr
  Variant (49)..(49): Xaa in position 49 is Leu or Met
  Variant (50)..(50): Xaa in position 50 is any amino acid
  Variant (51)..(51): Xaa in position 51 is Leu or Val
  Variant (52)..(52): Xaa in position 52 is Asn or Ser
  Variant (53)..(53): Xaa in position 53 is Ala, Cys or Ser
  Variant (54)..(54): Xaa in position 54 is Phe, Ile or Val
  Variant (56)..(56): Xaa in position 56 is Ser or Thr
  Variant (57)..(57): Xaa in position 57 is any amino acid
  Variant (58)..(58): Xaa in position 58 is Phe or Ile
WLXXFFXXLAACLYTXCYXKXXXXFXXXXRXAXXXXXXFAFXWTXVFLXXXXXXWXXX

SEQ ID NO: 71717 - protein, 60 aa, Artificial sequence
  protein pattern
  Variant (2)..(5): Xaa in position 2 to 5 is any or no amino acid
  Variant (10)..(10): Xaa in position 10 is Lys or Arg
  Variant (15)..(15): Xaa in position 15 is Glu, Asn or Ser
  Variant (17)..(17): Xaa in position 17 is Pro or Val
  Variant (18)..(18): Xaa in position 18 is any amino acid
  Variant (19)..(19): Xaa in position 19 is Leu or Met
  Variant (21)..(21): Xaa in position 21 is any amino acid
  Variant (22)..(22): Xaa in position 22 is Ser or Thr
  Variant (24)..(24): Xaa in position 24 is any amino acid
  Variant (25)..(25): Xaa in position 25 is Asp or Asn
  Variant (26)..(26): Xaa in position 26 is any amino acid
  Variant (28)..(28): Xaa in position 28 is any amino acid
  Variant (29)..(29): Xaa in position 29 is Ala or Thr
  Variant (35)..(35): Xaa in position 35 is Lys or Arg
  Variant (44)..(44): Xaa in position 44 is Gly or Ser
  Variant (48)..(48): Xaa in position 48 is any amino acid
  Variant (49)..(49): Xaa in position 49 is any or no amino acid
  Variant (51)..(51): Xaa in position 51 is Ala or Ile
  Variant (52)..(52): Xaa in position 52 is any amino acid
  Variant (53)..(53): Xaa in position 53 is Ile, Leu or Val
  Variant (54)..(54): Xaa in position 54 is Pro or Val
  Variant (55)..(55): Xaa in position 55 is any amino acid
  Variant (56)..(56): Xaa in position 56 is Phe, Leu or Val
  Variant (57)..(57): Xaa in position 57 is Ile or Leu
  Variant (58)..(58): Xaa in position 58 is Ala or Ser
  Variant (59)..(59): Xaa in position 59 is any amino acid
  Variant (60)..(60): Xaa in position 60 is Phe or Leu
KXXXXPFSPXDNFGXSXXXPXXFXXXRXXYYYLSXVGWAMLLIXLFFXXLXXXXXXXXXX

SEQ ID NO: 71718 - protein, 15 aa, Artificial sequence
  protein pattern
  Variant (2)..(2): Xaa in position 2 is any amino acid
  Variant (3)..(3): Xaa in position 3 is Phe or Tyr
  Variant (5)..(5): Xaa in position 5 is any amino acid
  Variant (8)..(11): Xaa in position 8 to 11 is any amino acid
  Variant (12)..(12): Xaa in position 12 is any or no amino acid
  Variant (15)..(15): Xaa in position 15 is Phe, Ile or Leu
MXXKXFVXXXXXLFX

SEQ ID NO: 71719 - DNA, 4767 bp, Saccharomyces cerevisiae; identical to SEQ ID NO: 22343
  CDS (1)..(4767)

SEQ ID NO: 71720 - protein, 1588 aa, Saccharomyces cerevisiae; identical to SEQ ID NO: 22344

SEQ ID NO: 71721 - DNA, 4836 bp, Aspergillus fumigatus
  CDS (1)..(4818)
atgaccggacccacgaaaatcagcatcctgggccaggagagtatagtcgctgactttggtctctggcgcaactatgtcgccaaagacctgattagcggctgtccctctacaacctacgtcctgatcaccgacacgaatatcggatcgatctacacccccggcttccagaagtccttcgaggaggccgccgcctcggtctctccgtctccccgcctattgatctacaatgctcctccaggggaagtctccaagtcgagacagacaaaggcagatatcgaggattggatgttgagtcagagcccgccatgcggccgagatactgtggtcattgcgctgggtggaggggtcattggagacctaacaggtttcgtcgctgcgacctatatgcgcggtgttcgctttgtacaggttcctactacgctgctggctatggtggactcctcgatcggtggaaagacggctattgatacccctttgggaaagaacctgatcggcgcgatctggcaaccgtcaaggatctatattgacctggaattcttggagactcttcccgtcagggagttcatcaacggtatggctgaggttatcaagacagccgccatctctagcgaagaagagttcaccgctctcgaagacaatgccgaaactattttgagcgctgttcggcgtgaggttaagccgggtcaacggcgattcgaggggatcgaggagatcctgaaggcgagaatccttgcgtcggcgcgtcacaaagcctttgttgtttccgcggacgagcgtgaaggaggtctgcgcaaccttctaaactggggtcactcaatcggtcacgctattgaggctattcttactcctcaaatcctccacggagagtgcgttgccattggtatggtcaaggaagcggagttggcgagacatcttggtatcttgaagggtgttgccgtggcccgcattgtcaagtgtattgccgcctacggcttgcctacatctctgaaggactcgcgaattcgcaaactgaccgccggtaagcactgctctgttgaccagattctttttaacatggctttggacaagaagaacgacggtcccaagaaaaaaatcgttcttctgtcagcaatcggtcgcacttacgaaccacgggctagtgttgtgccgaatgaggatattggtgtcgttcttgcccctagtattgaggtgcaccctggcgtatcaacgacctcagaagtggtttgtgcgcctccgggctcgaagagcatctccaaccgagctctggtacttgccgctctcggttcgggcactgtccgtatcaaaaacctgctgcattccgatgacaccgaggtcatgctgaacgccttggaacgccttggcgctgccaccttctcatgggaagaggaaggcgaagtccttgttgtcaatggcaaaggaggtgctcttcaagctcatccttctccgctctacctgggcaacgcgggtacagcatcgcgtttcttgaccactgtcgcaacccttgccactgccagcagcgtcgactcgagcgttcttaccggcaataaccgcatgaagcagagacctattggcgacttggtggatgccctgaccgcaaatggtgcgcagattgagtacgtcgagaacaagggcagtctgccgctcaagatcgccgcctcaggcgggttcaccggtggccaaatcaacctcgccgctaaagtgtcgtcgcaatatgtgtcctccctgctcatgtgcgccccatacgctaaggagcctgtgaccttgaagctggtgggcggtaagcccatctcgcagccttacattgacatgacgacggctatgatgagatctttcggcattgatgtgaagaaatctaccactgaggagcatacctatcacattcctcagggacgttacatcaaccctgcagagtacgttgtggagagcgacgcgagctccgccacctaccccttggcgattgcagcagtcactggcaccacgtgcactattccgaacattggatctaagtctcttcaaggcgacgctcgtttcgccgttgatgttctgagacccatgggttgcactgtggaacagaccgacacgtcgaccaccgttaccggtcccgccgatggtgtcttgcggcctttgcccaacgtcgatatggagcctatgactgatgcattccttggggcgtcggttcttgcggccattgccagaggcaaggactcgaaccacacaactcgcatctatggtatcgcgaaccagcgtgtcaaagaatgtaaccgcattaaggccatgcacgatgagcttgccaagtttggtgtcgtctgtcgggaacacgatgatggacttgagatcgacggcattgaccgctccacccttcggcagccggccggcggcgtattttgctacgatgaccaccgagtcgcgttcagcttcagcgttttatctctcattgcccctaagcccacgctgattctagaaaaagaatgtgtgggtaagacatggcccggctggtgggatactctgcgacagaaattcgccgtcaagctggagggcaaggagctgaaggaagccgagtcacccgttcttacccgtgccgaaaaggcaagtgcgtcggtgttcattatcggtatgcgtggtgctggaaagaccacaagtggacactgggttgcgtctacgctcaagcgacccttcattgatctagacgacgaactcgagcgcatagaaggcatgaccatcccggacatcatcaagcagcgtggctggcaaggtttccgagatgccgagcttaatcttctgcaacgaacgatgaaggagcgcccgaccggccatgttttcgcatgcggcggaggagtagtagagattcctgaagcgagaaagctgcttatcgattggcacaaaaccaaaggaaatgttctgcttatcatgcgcgacatcaagcaggtgatggcattcttgaacatcgataagacccgcccagcttacgttgaggatatgctgggagtgtggctgcgccgcaagccatggttccaggagtgcagcaatattcagtactacagtcagcacgccagcgcaggacttccccgggcgtctgaggactttgcgcgttttatcaagtttgtcacgggactagaggacagcctcggtaccatcaagaagaagcagcattcgttcttcgtgtcgctgactcttcctgacgtgcgtggtgcggatcagatcttggagcaagcatgtgtgggctctgatgctgtcgaattgcgtgtcgatctactggaggatccagactcgtcgaacggcattccgacggtcgattttgttgctgatcaaatttcctacctgcgcagtcgcatcacactgcccgtgatcttcaccattcgcacgaagggacagggtggtcggttccccgacgatgctcatgcggaggcgatgcagctctaccggcttgctgtccggtcagggtgcgagtttgttgatctcgaaattgctttcccagatgagatgctgcgcgcggttactgaaatgaaggggtactcgaagatcatcgcttcgcaccacgaccctaacggcgaactttcgtgggcaaacatgtcctggatgaagtactacaacagggcgctcgagtacggcgatgtgatcaagcttgtaggcgtggctaggaacctcgatgacaacacggctctgaggaagttcaagaactgggccgaagaggctcacgacgtgccactgatcgcgatcaacatgggaggcaacgggcaactgagtcgcatcttgaatggattcatgacaccagtatcgcatcctgctctcccgttcagggctgctccaggccagctgtctgcgaccgatattcgcaagggcctgtcactgatgggcgagatcaagaagaagcgctttgccctctttggaagccctatttccgagtcccgctcgccggcactgcacaacactcttttcgccgagatgggacttccccatgagtacacccggttggagactgccaatgtggaagatgtcaaggacttcatccgcgctcccgacttcggaggagcctcggtgacgattcctctgaaactggatatcatgcccctacttgatgagattactgcggaggccgagatcattggtgccgtgaacaccgtcgtgccagtttccgatggtgagggcaagccgcagcggctggtcggtcacaacaccgactggcagggcatggtccaatgccttcgtaacgcgggcgcctacggagccgacggcagcgccagtgcacttgtggttggtggcggaggcacatcccgcgctgccatctacgctctccaccagatgggtttctctcccatctacattgtgggacggaaccctgccaagctggagagtatggtctccaccttccccaccagctacaacatccaaatcgtcgagggcaacgagaaactggagcatgttccccatgtggcaatcggcaccatccccgccgaccggcccatcgatcccgggatgcgggagattctctgccacatgttcgaacgtgcccaggaggcagacgccgacgcctcccggacaatcgagggatcccctcgcgtactgctggagatggcttacaagccgcgggtgacggcgctgatgcagcttgccgtcgatgcagggtggactactattcctgggttggaggccctgatcgggcaaggggtacaccaggtagggttgatcgacctgttacagatggacattactgatggagtacagttccaacattggacgggtattcgccctctctacgaacgtgcacgggtatgttgtgacatcttgttatccggtcgaactatgctaacatgctcgtaggctattgtcctggaatga

SEQ ID NO: 71722 - protein, 1605 aa, Aspergillus fumigatus
MTGPTKISILGQESIVADFGLWRNYVAKDLISGCPSTTYVLITDTNIGSIYTPGFQKSFEEAAASVSPSPRLLIYNAPPGEVSKSRQTKADIEDWMLSQSPPCGRDTVVIALGGGVIGDLTGFVAATYMRGVRFVQVPTTLLAMVDSSIGGKTAIDTPLGKNLIGAIWQPSRIYIDLEFLETLPVREFINGMAEVIKTAAISSEEEFTALEDNAETILSAVRREVKPGQRRFEGIEEILKARILASARHKAFVVSADEREGGLRNLLNWGHSIGHAIEAILTPQILHGECVAIGMVKEAELARHLGILKGVAVARIVKCIAAYGLPTSLKDSRIRKLTAGKHCSVDQILFNMALDKKNDGPKKKIVLLSAIGRTYEPRASVVPNEDIGVVLAPSIEVHPGVSTTSEVVCAPPGSKSISNRALVLAALGSGTVRIKNLLHSDDTEVMLNALERLGAATFSWEEEGEVLVVNGKGGALQAHPSPLYLGNAGTASRFLTTVATLATASSVDSSVLTGNNRMKQRPIGDLVDALTANGAQIEYVENKGSLPLKIAASGGFTGGQINLAAKVSSQYVSSLLMCAPYAKEPVTLKLVGGKPISQPYIDMTTAMMRSFGIDVKKSTTEEHTYHIPQGRYINPAEYVVESDASSATYPLAIAAVTGTTCTIPNIGSKSLQGDARFAVDVLRPMGCTVEQTDTSTTVTGPADGVLRPLPNVDMEPMTDAFLGASVLAAIARGKDSNHTTRIYGIANQRVKECNRIKAMHDELAKFGVVCREHDDGLEIDGIDRSTLRQPAGGVFCYDDHRVAFSFSVLSLIAPKPTLILEKECVGKTWPGWWDTLRQKFAVKLEGKELKEAESPVLTRAEKASASVFIIGMRGAGKTTSGHWVASTLKRPFIDLDDELERIEGMTIPDIIKQRGWQGFRDAELNLLQRTMKERPTGHVFACGGGVVEIPEARKLLIDWHKTKGNVLLIMRDIKQVMAFLNIDKTRPAYVEDMLGVWLRRKPWFQECSNIQYYSQHASAGLPRASEDFARFIKFVTGLEDSLGTIKKKQHSFFVSLTLPDVRGADQILEQACVGSDAVELRVDLLEDPDSSNGIPTVDFVADQISYLRSRITLPVIFTIRTKGQGGRFPDDAHAEAMQLYRLAVRSGCEFVDLEIAFPDEMLRAVTEMKGYSKIIASHHDPNGELSWANMSWMKYYNRALEYGDVIKLVGVARNLDDNTALRKFKNWAEEAHDVPLIAINMGGNGQLSRILNGFMTPVSHPALPFRAAPGQLSATDIRKGLSLMGEIKKKRFALFGSPISESRSPALHNTLFAEMGLPHEYTRLETANVEDVKDFIRAPDFGGASVTIPLKLDIMPLLDEITAEAEIIGAVNTVVPVSDGEGKPQRLVGHNTDWQGMVQCLRNAGAYGADGSASALVVGGGGTSRAAIYALHQMGFSPIYIVGRNPAKLESMVSTFPTSYNIQIVEGNEKLEHVPHVAIGTIPADRPIDPGMREILCHMFERAQEADADASRTIEGSPRVLLEMAYKPRVTALMQLAVDAGWTTIPGLEALIGQGVHQVGLIDLLQMDITDGVQFQHWTGIRPLYERARVCCDILLSGRTMLTCS

SEQ ID NO: 71723 - DNA, 4656 bp, Candida albicans
  CDS (1)..(4656)
atgtctattgaaaaggtgccaattttgggtaaggaaactatccatgttggttatggtattgccgaccatattgtcagggaagtgatagccaacttggcttcttcaacttatgttatagtgactgacacaaacatggcaagaactccccaatattccaaattgactgatgatttcaaaactaatttgtctgaaaaacgtcctgaatccagattattgacttattgtgtatcaccgggtgaaaacaacaaaaacagagctaccaaagctgcagtggaagattttcttttacaacaaggttgtaccagagacaccgtcatattggctgttggtgggggtgttattggtgacatgattgggtttgttgccgccacatttatgagaggtgtcagagttgttcaagttccaactacattgttagccatggtagattcatctgttggtgggaaaaccgccattgatactccattaggtaagaatttcattggtgctttccatcaacccgaatacgttttctgtgatgtatcctttttagagactttacctgctagacaatttattaatggtatggctgaagttgtgaaaactgcggccatttggaatgaagaagaattcaccagattagaaaacttttccaagaagtttctttctgtcgttacctccaaaaaaccagatttacagtcaattaaggctgaattagtgaaaaccgttttggaatctgttagagtgaaagctggtgttgtgtcatctgatgaaaaggaagctggtcttagaaatttacttaattttggccatactattggtcatgcaattgaagcggttttaactccagaagcattacatggagaatgtgtttctattggtatgattaaggaagctgagttgtctagatatttgggtatactaccacctgttgcagttgccagattgtcgaaatgtctcgttgcttacggcttacctgtgtctattgacgataaagaattcttgaaaaaagtgggaccaaaacgtcattatgttgaaatcgatattttgttgaaaaaaatggccattgacaagaaaaatgatggtagtaagattagatgtgtcttgttagagaaaattggtaaatgttaccaattgaaagcacatcaagtatccaaacaagatttaagttttgtgttgactgatgaagtgttggttcacccattcaccaatccacctaaagaaaacataattgttccacctggttccaaatctatctccaatagagcattgattttagctgctttgggtaatggtactgttcgtgtgaaaaatttgttacattcagacgatactaagcatatgttagatgctgttgcttctttaaagggagctgaaatatccactgaagataatggtgaaaccattgtagttaaaggaaatggtggcaacttggtcacatctggcgaagaattgtacttgggtaatgctggtactgcttccagatttttgactactgtagcttcattagtgggcaaatcacaagctagtgatgatgttattttaactggtaacgcaagaatgcaagaaagacctattggaccattagtggatgccttgggatctaatggttctgagattgagtatttgaataagcagggttcattgccattgaaaatcagtgctggcaatggattgaaaggtggaagaatagaattggctgcaacaatctcttcgcagtatgtttcttcaattttaatgtgtgcaccatatgctaaggagccagttactttggctttagtcggaggtaaaccaatttctcaattatacatagatatgacatgtgcaatgatgaaatcatttggtattgaagttaccaaatcaactactaaggaatacacctatcatattccaaaggggacatacaagaatccatctgaatatgtcattgaatcagatgcgtcatctgcaacttatccattagcatttgctgctatgactggaacatcctgtactattccgaacataggttcttcctcattacaaggagatgccaaatttgctgttgatgtgttgaaaccaatggggtgtaaagttgaacaaaccacaacttcaacaactgtaactggtccgccgagaggtcacttgaaaccattacctcatgttgatatggagccaatgactgatgcatttttgactgcttctgttgttgctgctgttgctaaaggcggttcttctacttctataactggtattgctaaccaaagagttaaagaatgtaatagaattgaagctatggttactgaattggcaaaatttggtgtgccagcaaatgaattacccgatggaattgaaatacatggtattgatattgaagatttgaaaacaccagaaatttctaaaagaggtgtttcctcctatgatgatcatagagtgggtatgtcattttcattattggcaggtttgtgtaaagaacccgttttgattttggaaagatcaaccactggtaagacttggccaggttggtgggatatcttacattccaaatttaagattgagcttgatggttatgaaccaccattcaatactgataaacatgtggataaatctagtgataaaagtatcattgtcattggtatgagaggcactggaaaatctactttatctgaatggttggcttcctttttggggttcaagatgttagatatggacaaatatcttgaagagaaattgggcactggtatcaaatcattgattaaagccaaaggttgggaatatttccgtcaagaagaagcaattgttgctaaagaatgtttcaccaagttttccaaggggtatgtactttccactggtggaggaattgttgaaggtgaagatgccagacagcaattgaaatcttatgctgataatggagggattgttttgcacttgcatcgtgatttagatgaaactgtcactttcttggctgctgatacaaccagacctgcttatagcagtgaagttcaagaagtatggttaagaagagaaaaatggtaccatgaatgttctaactaccacttctattccagtcactgtagtactgaggatgaattcaaccatttgagaagatcctttgtaaactacattaaacttatcactggtgctgaaagacctgttgtgccagctggtagatcagctgctgttgtcttgacatcaccggatttgaatgaagttgttggagatttggaatctattacaattggtgctgatgcagttgaattaagagttgatttatttaaggatacttctgctgaatttgttgctgcccaaattgctgtaataagaaagcatgccgatttaccaattatttacactgtgagaactgtgtcgcaaggtggtaaattcccagatgaaaatgttgacgaattaaagagtttgttgttacttggtatcagattaggtgttgcatacgttgatcttcaattgactgctccgaatgaactcattgaagagattagcagtaagaagggtttcactagagtcattggtacttatcaagatataaatggtgaattgaaatggaacaatgttgaatggaaaaacaaatataatcaaggtgtttccatgaatgctgatattgtgagactagtcggtaaagcaaactcaattcaagataatttagatttggaaaactttaaaaagcagaatactttaaaaccattgattgctttcaatttaggttctcaaggtaagttgtcacaagtattgaatggaacattcacccctatttcccacaaattacttccaaatgatgaagagttcttaacaatcggcgaattaaatcaaacttattttgatattggaggtttcactgctaaaaaattttgggtcattggttcacccattgaacattcaagatcaccaaacttgcacaatgcagggtataaagcattgaatttgccttaccaatttggcagatttgaagctacagatgttgatgttgtttatgataacttgatcaataaaccagactttggtggtttagccatcactatgccattgaaattggatatcatgaagtttgccactaaactatctgatgcagcagagaccattggagccgtcaacacattgattccaattgaaggcggatattttggtgataacactgattgggtgggtattagtaattctttcataagagcaggtgttccacctaagctgagctcgaatgggttagttgttggtgcaggcggcacttctagagctgccatttatgccttacatcaaatgggatgtgcaaagatttacttggtgaatcgtactgctgctaaattggaggaacttgtcaagtcattccctaaagactataatcttgagattgtcgaaaccgaacaacaagccgataaagcaagtaaagtcctgttggcagtgtcttgtattcctgctgataaaccattagatggagaagtgttgaagaaaattgagcgaattttatctaatggaagtgaacaatctgctggtttcaagccaaccttattggaagctagttacaaaccaagagtgacaccaattatgaagcttgctgaagaacaatataaatggaaagttatcccaggtgttgagatgttggtaaatcaaggtgatagacagtttaaacttcatactggttttactgcaccatatgagattattcatcgtgctgttgttgaggaataa

SEQ ID NO: 71724 - protein, 1551 aa, Candida albicans
MSIEKVPILGKETIHVGYGIADHIVREVIANLASSTYVIVTDTNMARTPQYSKLTDDFKTNLSEKRPESRLLTYCVSPGENNKNRATKAAVEDFLLQQGCTRDTVILAVGGGVIGDMIGFVAATFMRGVRVVQVPTTLLAMVDSSVGGKTAIDTPLGKNFIGAFHQPEYVFCDVSFLETLPARQFINGMAEVVKTAAIWNEEEFTRLENFSKKFLSVVTSKKPDLQSIKAELVKTVLESVRVKAGVVSSDEKEAGLRNLLNFGHTIGHAIEAVLTPEALHGECVSIGMIKEAELSRYLGILPPVAVARLSKCLVAYGLPVSIDDKEFLKKVGPKRHYVEIDILLKKMAIDKKNDGSKIRCVLLEKIGKCYQLKAHQVSKQDLSFVLTDEVLVHPFTNPPKENIIVPPGSKSISNRALILAALGNGTVRVKNLLHSDDTKHMLDAVASLKGAEISTEDNGETIVVKGNGGNLVTSGEELYLGNAGTASRFLTTVASLVGKSQASDDVILTGNARMQERPIGPLVDALGSNGSEIEYLNKQGSLPLKISAGNGLKGGRIELAATISSQYVSSILMCAPYAKEPVTLALVGGKPISQLYIDMTCAMMKSFGIEVTKSTTKEYTYHIPKGTYKNPSEYVIESDASSATYPLAFAAMTGTSCTIPNIGSSSLQGDAKFAVDVLKPMGCKVEQTTTSTTVTGPPRGHLKPLPHVDMEPMTDAFLTASVVAAVAKGGSSTSITGIANQRVKECNRIEAMVTELAKFGVPANELPDGIEIHGIDIEDLKTPEISKRGVSSYDDHRVGMSFSLLAGLCKEPVLILERSTTGKTWPGWWDILHSKFKIELDGYEPPFNTDKHVDKSSDKSIIVIGMRGTGKSTLSEWLASFLGFKMLDMDKYLEEKLGTGIKSLIKAKGWEYFRQEEAIVAKECFTKFSKGYVLSTGGGIVEGEDARQQLKSYADNGGIVLHLHRDLDETVTFLAADTTRPAYSSEVQEVWLRREKWYHECSNYHFYSSHCSTEDEFNHLRRSFVNYIKLITGAERPVVPAGRSAAVVLTSPDLNEVVGDLESITIGADAVELRVDLFKDTSAEFVAAQIAVIRKHADLPIIYTVRTVSQGGKFPDENVDELKSLLLLGIRLGVAYVDLQLTAPNELIEEISSKKGFTRVIGTYQDINGELKWNNVEWKNKYNQGVSMNADIVRLVGKANSIQDNLDLENFKKQNTLKPLIAFNLGSQGKLSQVLNGTFTPISHKLLPNDEEFLTIGELNQTYFDIGGFTAKKFWVIGSPIEHSRSPNLHNAGYKALNLPYQFGRFEATDVDVVYDNLINKPDFGGLAITMPLKLDIMKFATKLSDAAETIGAVNTLIPIEGGYFGDNTDWVGISNSFIRAGVPPKLSSNGLVVGAGGTSRAAIYALHQMGCAKIYLVNRTAAKLEELVKSFPKDYNLEIVETEQQADKASKVLLAVSCIPADKPLDGEVLKKIERILSNGSEQSAGFKPTLLEASYKPRVTPIMKLAEEQYKWKVIPGVEMLVNQGDRQFKLHTGFTAPYEIIHRAVVEE

SEQ ID NO: 71725 - DNA, 4737 bp, Aspergillus fumigatus
  CDS (1)..(4737)
atgaccggacccacgaaaatcagcatcctgggccaggagagtatagtcgctgactttggtctctggcgcaactatgtcgccaaagacctgattagcggctgtccctctacaacctacgtcctgatcaccgacacgaatatcggatcgatctacacccccggcttccagaagtccttcgaggaggccgccgcctcggtctctccgtctccccgcctattgatctacaatgctcctccaggggaagtctccaagtcgagacagacaaaggcagatatcgaggattggatgttgagtcagagcccgccatgcggccgagatactgtggtcattgcgctgggtggaggggtcattggagacctaacaggtttcgtcgctgcgacctatatgcgcggtgttcgctttgtacaggttcctactacgctgctggctatggtggactcctcgatcggtggaaagacggctattgatacccctttgggaaagaacctgatcggcgcgatctggcaaccgtcaaggatctatattgacctggaattcttggagactcttcccgtcagggagttcatcaacggtatggctgaggttatcaagacagccgccatctctagcgaagaagagttcaccgctctcgaagacaatgccgaaactattttgagcgctgttcggcgtgaggttaagccgggtcaacggcgattcgaggggatcgaggagatcctgaaggcgagaatccttgcgtcggcgcgtcacaaagcctttgttgtttccgcggacgagcgtgaaggaggtctgcgcaaccttctaaactggggtcactcaatcggtcacgctattgaggctattcttactcctcaaatcctccacggagagtgcgttgccattggtatggtcaaggaagcggagttggcgagacatcttggtatcttgaagggtgttgccgtggcccgcattgtcaagtgtattgccgcctacggcttgcctacatctctgaaggactcgcgaattcgcaaactgaccgccggtaagcactgctctgttgaccagattctttttaacatggctttggacaagaagaacgacggtcccaagaaaaaaatcgttcttctgtcagcaatcggtcgcacttacgaaccacgggctagtgttgtgccgaatgaggatattggtgtcgttcttgcccctagtattgaggtgcaccctggcgtatcaacgacctcagaagtggtttgtgcgcctccgggctcgaagagcatctccaaccgagctctggtacttgccgctctcggttcgggcactgtccgtatcaaaaacctgctgcattccgatgacaccgaggtcatgctgaacgccttggaacgccttggcgctgccaccttctcatgggaagaggaaggcgaagtccttgttgtcaatggcaaaggaggtgctcttcaagctcatccttctccgctctacctgggcaacgcgggtacagcatcgcgtttcttgaccactgtcgcaacccttgccactgccagcagcgtcgactcgagcgttcttaccggcaataaccgcatgaagcagagacctattggcgacttggtggatgccctgaccgcaaatggtgcgcagattgagtacgtcgagaacaagggcagtctgccgctcaagatcgccgcctcaggcgggttcaccggtggccaaatcaacctcgccgctaaagtgtcgtcgcaatatgtgtcctccctgctcatgtgcgccccatacgctaaggagcctgtgaccttgaagctggtgggcggtaagcccatctcgcagccttacattgacatgacgacggctatgatgagatctttcggcattgatgtgaagaaatctaccactgaggagcatacctatcacattcctcagggacgttacatcaaccctgcagagtacgttgtggagagcgacgcgagctccgccacctaccccttggcgattgcagcagtcactggcaccacgtgcactattccgaacattggatctaagtctcttcaaggcgacgctcgtttcgccgttgatgttctgagacccatgggttgcactgtggaacagaccgacacgtcgaccaccgttaccggtcccgccgatggtgtcttgcggcctttgcccaacgtcgatatggagcctatgactgatgcattccttggggcgtcggttcttgcggccattgccagaggcaaggactcgaaccacacaactcgcatctatggtatcgcgaaccagcgtgtcaaagaatgtaaccgcattaaggccatgcacgatgagcttgccaagtttggtgtcgtctgtcgggaacacgatgatggacttgagatcgacggcattgaccgctccacccttcggcagccggccggcggcgtattttgctacgatgaccaccgagtcgcgttcagcttcagcgttttatctctcattgcccctaagcccacgctgattctagaaaaagaatgtgtgggtaagacatggcccggctggtgggatactctgcgacagaaattcgccgtcaagctggagggcaaggagctgaaggaagccgagtcacccgttcttacccgtgccgaaaaggcaagtgcgtcggtgttcattatcggtatgcgtggtgctggaaagaccacaagtggacactgggttgcgtctacgctcaagcgacccttcattgatctagacgacgaactcgagcgcatagaaggcatgaccatcccggacatcatcaagcagcgtggctggcaaggtttccgagatgccgagcttaatcttctgcaacgaacgatgaaggagcgcccgaccggccatgttttcgcatgcggcggaggagtagtagagattcctgaagcgagaaagctgcttatcgattggcacaaaaccaaaggaaatgttctgcttatcatgcgcgacatcaagcaggtgatggcattcttgaacatcgataagacccgcccagcttacgttgaggatatgctgggagtgtggctgcgccgcaagccatggttccaggagtgcagcaatattcagtactacagtcagcacgccagcgcaggacttccccgggcgtctgaggactttgcgcgttttatcaagtttgtcacgggactagaggacagcctcggtaccatcaagaagaagcagcattcgttcttcgtgtcgctgactcttcctgacgtgcgtggtgcggatcagatcttggagcaagcatgtgtgggctctgatgctgtcgaattgcgtgtcgatctactggaggatccagactcgtcgaacggcattccgacggtcgattttgttgctgatcaaatttcctacctgcgcagtcgcatcacactgcccgtgatcttcaccattcgcacgaagggacagggtggtcggttccccgacgatgctcatgcggaggcgatgcagctctaccggcttgctgtccggtcagggtgcgagtttgttgatctcgaaattgctttcccagatgagatgctgcgcgcggttactgaaatgaaggggtactcgaagatcatcgcttcgcaccacgaccctaacggcgaactttcgtgggcaaacatgtcctggatgaagtactacaacagggcgctcgagtacggcgatgtgatcaagcttgtaggcgtggctaggaacctcgatgacaacacggctctgaggaagttcaagaactgggccgaagaggctcacgacgtgccactgatcgcgatcaacatgggaggcaacgggcaactgagtcgcatcttgaatggattcatgacaccagtatcgcatcctgctctcccgttcagggctgctccaggccagctgtctgcgaccgatattcgcaagggcctgtcactgatgggcgagatcaagaagaagcgctttgccctctttggaagccctatttccgagtcccgctcgccggcactgcacaacactcttttcgccgagatgggacttccccatgagtacacccggttggagactgccaatgtggaagatgtcaaggacttcatccgcgctcccgacttcggaggagcctcggtgacgattcctctgaaactggatatcatgcccctacttgatgagattactgcggaggccgagatcattggtgccgtgaacaccgtcgtgccagtttccgatggtgagggcaagccgcagcggctggtcggtcacaacaccgactggcagggcatggtccaatgccttcgtaacgcgggcgcctacggagccgacggcagcgccagtgcacttgtggttggtggcggaggcacatcccgcgctgccatctacgctctccaccagatgggtttctctcccatctacattgtgggacggaaccctgccaagctggagagtatggtctccaccttccccaccagctacaacatccaaatcgtcgagggcaacgagaaactggagcatgttccccatgtggcaatcggcaccatccccgccgaccggcccatcgatcccgggatgcgggagattctctgccacatgttcgaacgtgcccaggaggcagacgccgacgcctcccggacaatcgagggatcccctcgcgtactgctggagatggcttacaagccgcgggtgacggcgctgatgcagcttgccgtcgatgcagggtggactactattcctgggttggaggccctgatcgggcaaggggtacaccagttccaacattggacgggtattcgccctctctacgaacgtgcacgggctattgtcctggaatga

SEQ ID NO: 71726 - protein, 1578 aa, Aspergillus fumigatus
MTGPTKISILGQESIVADFGLWRNYVAKDLISGCPSTTYVLITDTNIGSIYTPGFQKSFEEAAASVSPSPRLLIYNAPPGEVSKSRQTKADIEDWMLSQSPPCGRDTVVIALGGGVIGDLTGFVAATYMRGVRFVQVPTTLLAMVDSSIGGKTAIDTPLGKNLIGAIWQPSRIYIDLEFLETLPVREFINGMAEVIKTAAISSEEEFTALEDNAETILSAVRREVKPGQRRFEGIEEILKARILASARHKAFVVSADEREGGLRNLLNWGHSIGHAIEAILTPQILHGECVAIGMVKEAELARHLGILKGVAVARIVKCIAAYGLPTSLKDSRIRKLTAGKHCSVDQILFNMALDKKNDGPKKKIVLLSAIGRTYEPRASVVPNEDIGVVLAPSIEVHPGVSTTSEVVCAPPGSKSISNRALVLAALGSGTVRIKNLLHSDDTEVMLNALERLGAATFSWEEEGEVLVVNGKGGALQAHPSPLYLGNAGTASRFLTTVATLATASSVDSSVLTGNNRMKQRPIGDLVDALTANGAQIEYVENKGSLPLKIAASGGFTGGQINLAAKVSSQYVSSLLMCAPYAKEPVTLKLVGGKPISQPYIDMTTAMMRSFGIDVKKSTTEEHTYHIPQGRYINPAEYVVESDASSATYPLAIAAVTGTTCTIPNIGSKSLQGDARFAVDVLRPMGCTVEQTDTSTTVTGPADGVLRPLPNVDMEPMTDAFLGASVLAAIARGKDSNHTTRIYGIANQRVKECNRIKAMHDELAKFGVVCREHDDGLEIDGIDRSTLRQPAGGVFCYDDHRVAFSFSVLSLIAPKPTLILEKECVGKTWPGWWDTLRQKFAVKLEGKELKEAESPVLTRAEKASASVFIIGMRGAGKTTSGHWVASTLKRPFIDLDDELERIEGMTIPDIIKQRGWQGFRDAELNLLQRTMKERPTGHVFACGGGVVEIPEARKLLIDWHKTKGNVLLIMRDIKQVMAFLNIDKTRPAYVEDMLGVWLRRKPWFQECSNIQYYSQHASAGLPRASEDFARFIKFVTGLEDSLGTIKKKQHSFFVSLTLPDVRGADQILEQACVGSDAVELRVDLLEDPDSSNGIPTVDFVADQISYLRSRITLPVIFTIRTKGQGGRFPDDAHAEAMQLYRLAVRSGCEFVDLEIAFPDEMLRAVTEMKGYSKIIASHHDPNGELSWANMSWMKYYNRALEYGDVIKLVGVARNLDDNTALRKFKNWAEEAHDVPLIAINMGGNGQLSRILNGFMTPVSHPALPFRAAPGQLSATDIRKGLSLMGEIKKKRFALFGSPISESRSPALHNTLFAEMGLPHEYTRLETANVEDVKDFIRAPDFGGASVTIPLKLDIMPLLDEITAEAEIIGAVNTVVPVSDGEGKPQRLVGHNTDWQGMVQCLRNAGAYGADGSASALVVGGGGTSRAAIYALHQMGFSPIYIVGRNPAKLESMVSTFPTSYNIQIVEGNEKLEHVPHVAIGTIPADRPIDPGMREILCHMFERAQEADADASRTIEGSPRVLLEMAYKPRVTALMQLAVDAGWTTIPGLEALIGQGVHQFQHWTGIRPLYERARAIVLE

SEQ ID NO: 71727 - DNA, 4734 bp, Eremothecium gossypii; identical to SEQ ID NO: 22501
  CDS (1)..(4734)
  misc_feature <1276>..<1276>: n is a, c, g, or t

SEQ ID NO: 71728 - protein, 1577 aa, Eremothecium gossypii; identical to SEQ ID NO: 22502
  misc_feature <426>..<426>: The Xaa at location 426 stands for Ala, Pro, Ser, or Thr.

SEQ ID NO: 71729 - DNA, 4773 bp, Magnaporthe grisea 70-15
  CDS (1)..(4773)
atgtcgacggccaatgggtcgagcccaacccggatttcgatcctgggcgaggaaagcatcatagtcgactatggcctctggctcaactacgtgactcacgatctgctcaacaacatcccttcctccacctacgtgctcatcaccgacaccaaccttcactcgctctacgtgcctcagttcgagaccgcatttacaagtgcttccgctgccgctacgtcgaattcttcggccacaccgccaccaccccgcgccccacgcctgttgacctacgccatcccgcctggcgagggatccaagagccgtgacaccaaggccgagatcgaggactggctgctcgagcagcaatgcacccgcgacactgtcatcatcgccctcggcggcggcgtcattggtgacatgattggttacgttgcggccacattcatgcgtggtgttcgcttcgtccaagtccccacgacgctgctggccatggtggactcgtccatcggcggcaagacagccatcgataccccaatgggcaagaatttggtcggcgccttctggcagccgcgccgcatctacatagacctggcattcctcaacacactacctgcccgcgagttcatcaacggcatggctgaggtgatcaagaccgctgccatctgggacgccgaggagttctctgccctcgagcaaaatgccccggctatcttgtcggctgtccgcactcctgcatctgctgcggctgacccgaatgcaaggctgctccccattagcgacatcctgaagcgcatagtcctgggatcggcacgtgttaaggcccacattgtctctgccgacgagaaggagggcggcctgcgcaacctcctgaactttggccactcgattggccatgcctttgaggccatactgactcctcaggtgctgcacggtgaggccgtcgccgttggaatggtcaaggaggcagagcttgcacgccacctgggtattctgcgcccggctgccgtcgcccgccttgtcaagtgcattgccagctacgatcttcccatctcgcttgaggacaagcgtttggtcaggatgactggtggaaagagctgcccagtggatattgtgctcgcaaagatggccgtcgacaagaaaaacgaaggcaagcagaagaagatcgtcttgctgtcggccattggcaaaacccacgagcccaaggctagcagtgtagacgaccgtgccatccgcgtggttctctcggccgctgttcgagtccaacctggcgtccgccctggtctcaaggttgatgtgaccccaccaggatccaagagtatttcgaacagagctctcattttggccgcccttggcaagggaccatgccgtataaagaacctcctccattcggatgacactgaacacatgttaaacgctattggcaagcttcgcggtgcttcattttcctgggaggacgacggcgagatcctcgtcgtggagggtcgtggaggtcagctctttgcccctagtgaaggggagctctacctgggcaacgcaggaacggcatcccgcttcctcactacggttgcggcactctgctcaccatcatccgatggtgatgccacctcaactgtgctgactggcaacgcccggatgaagctgcgtcctattggagccttggttgatgctctgcgatccaacggaatcaacatcgaatatatgggcaaggagagcagcctgccaataagggttgacgctgcgggtggcttcggtggtggcgtcattgagctggctgccactgtttcgtcacagtatgtatcatcgttgcttatggccgcaccttacgccaaggaaccggtgacgctgcgcttggtaggcggcaaacccatctcgcagccttacattgatatgacaattgccatgatgcgttctttcggcatcgatgtccaaaggtccaccaccgaggcggacacttaccacattccccagggtatttacacaaacccagctgaatacactgttgagagtgacgccagttccgccacgtacccgctggccgtcgcggcaatcactggtaccacgtgcaccatcccaaacattggctccgcatcacttcagggtgatgctcggtttgctgtcgaggtgctccgccccatgggctgcactgttgaacaatcagccagctcaacaaccgtcaccggcccgcctcttggtcagctgaagggaatcccgcatgtcgacatggaacctatgaccgacgctttcctcacagcctccgtacttgcagctgtggccagtggaaccacccagatcaccggaatcgcaaaccaaagggttaaagaatgcaaccgcatcaaggccatgaaggaccagcttgccaagtttggcgtgcattgcaatgagttggacgacggcatcgaagtcaccggcaattcctggactgaattgacagagccgagggagatctactgctatgatgaccaccgtgtggccatgagcttcagcgtcctctcggtgatttcaccgcaccctgttctgattttggagcgtgagtgcactggcaagacgtggcccggctggtgggatgtgctctctggggtctttggagtggccatggacggcgaggagcctctttcgcactctactgtgactggctctggtcccaataaccgctccgttttcgtcattggtatgcgcggtgccggcaagtctactgcaggaaaatggatggcgtcaaccctcggtcgtacattcatggatcttgacacagagcttgagaggagacacaacacgacaattcctgacatggttaaaagtgaagtgggctgggaaggattcagaaaattcgaggtggagctacttcgcgagatgatggagacaaagccggaaggctacatcttttcatgcggcggcggcattgtcgagacgccagaggctcgggaggcacttatttcgtactgccgcgccgggggagctgtgctgcttgtgcaccgagacacaactcacgtgcttgaatatcttaaccgtgacaagagtcggccggcgtggtctgaggagatcgaaaaggtctacatccggcggaagccctggtaccaggagtgtagcaacttcgagtatcacagcccgcacttgggtgtcgaagaaagtgctgtcgaaatgccagttgactttgcacggtttgtgtcgctgatctgcggaaagagttctcatctgcgcgaggtcaaggcaaagccgcactctttctttgtgtccctgaccgtaccaaacatcacagcacacacggcaacaatccccaaggctgttgtaggctctgatgctgtggaactccgtgtcgatctgttgcaggaccactcgccagagtttgtggtccggcaggttgctcttctgaggtcgttgtgcaagatgcctatcatcttcactgtacgtactgtcagccagggcggccgcttcccagacgcagaccacgccggggcactggctctctaccgcgtagcactccggatgggagtcgagtacgtcgatgtggaaatgacgatgccagaggatgtcattgagacggtgacgaaagccaagggctacacaagcatcattgcgtctcatcacgaccccaagggcacactgtcgtggcgcaatggagcgtggatgcagtactacaacaaggcgttgcactacggcgacgtgatcaaactggttgggtggtgccgcactgacgaagataacttctcgctgctgaccttcaagacacgcatgctggcggctcacgaatcaacacctatcattgctcttaatatgggcgagcagggaaagctcagccgcgtgctgaacggtttcatgacgcccgtcacccacgccgcgctacctgctgctgctgcccccggtcagctgacggcagctgagattcgccaggcgctttcgctccttagcaagattcctaagcgcaagttttatctgttcggcaagcccatctccaagtcgaggtccccgatccttcataacacattattccaacagacgggtctgccacacacgtactcacgccttgagactgacaaggtggccgaggtcgagaccaccatccgcgcgtcagactttggcggtgcttcggtcacaatcccgctcaagttggacattatgccgatgcttgatgaaattaccgacgcggccaagaccattggtgctgtcaatactatcatcccggtccctgttcaggctggtaagcagcgtctgcgtggtgacaacaccgactggtgcggcatggtgcattcgctccggatggccggagttacaggcaaacgcgcctgtccagcttcgggagtggtagttggttcgggtggtacgacgcgcgcggccatttttgccctccactcacttggcttctcgcccatctacattattgcacgcaacgcaacgtctgtcgaaaccattgcgtcttctttcccagcagaatacgacatccgaaacctgcagggcacgctagcctacactgagggtatggcgcgaccagaggtggttatcagcacgatcccggcgacgggtgatgttgatgaaggaattctaatggccgtcgattcggtgctcactttgcccatgggtacaagcaacactggagcggctagggtgctgctagagatggcgtacacgcctaccttcaccaatatgatggcccgcgcaaaggatgccggctggggaactgtccctggattcgaggtccttgcagcacagggttggttccagttccagttgtggacggacatcaagccggtctacagcactgccagttcgatcgtgatgaatggcacaagcgattcctcctga

SEQ ID NO: 71730 - protein, 1590 aa, Magnaporthe grisea 70-15
MSTANGSSPTRISILGEESIIVDYGLWLNYVTHDLLNNIPSSTYVLITDTNLHSLYVPQFETAFTSASAAATSNSSATPPPPRAPRLLTYAIPPGEGSKSRDTKAEIEDWLLEQQCTRDTVIIALGGGVIGDMIGYVAATFMRGVRFVQVPTTLLAMVDSSIGGKTAIDTPMGKNLVGAFWQPRRIYIDLAFLNTLPAREFINGMAEVIKTAAIWDAEEFSALEQNAPAILSAVRTPASAAADPNARLLPISDILKRIVLGSARVKAHIVSADEKEGGLRNLLNFGHSIGHAFEAILTPQVLHGEAVAVGMVKEAELARHLGILRPAAVARLVKCIASYDLPISLEDKRLVRMTGGKSCPVDIVLAKMAVDKKNEGKQKKIVLLSAIGKTHEPKASSVDDRAIRVVLSAAVRVQPGVRPGLKVDVTPPGSKSISNRALILAALGKGPCRIKNLLHSDDTEHMLNAIGKLRGASFSWEDDGEILVVEGRGGQLFAPSEGELYLGNAGTASRFLTTVAALCSPSSDGDATSTVLTGNARMKLRPIGALVDALRSNGINIEYMGKESSLPIRVDAAGGFGGGVIELAATVSSQYVSSLLMAAPYAKEPVTLRLVGGKPISQPYIDMTIAMMRSFGIDVQRSTTEADTYHIPQGIYTNPAEYTVESDASSATYPLAVAAITGTTCTIPNIGSASLQGDARFAVEVLRPMGCTVEQSASSTTVTGPPLGQLKGIPHVDMEPMTDAFLTASVLAAVASGTTQITGIANQRVKECNRIKAMKDQLAKFGVHCNELDDGIEVTGNSWTELTEPREIYCYDDHRVAMSFSVLSVISPHPVLILERECTGKTWPGWWDVLSGVFGVAMDGEEPLSHSTVTGSGPNNRSVFVIGMRGAGKSTAGKWMASTLGRTFMDLDTELERRHNTTIPDMVKSEVGWEGFRKFEVELLREMMETKPEGYIFSCGGGIVETPEAREALISYCRAGGAVLLVHRDTTHVLEYLNRDKSRPAWSEEIEKVYIRRKPWYQECSNFEYHSPHLGVEESAVEMPVDFARFVSLICGKSSHLREVKAKPHSFFVSLTVPNITAHTATIPKAVVGSDAVELRVDLLQDHSPEFVVRQVALLRSLCKMPIIFTVRTVSQGGRFPDADHAGALALYRVALRMGVEYVDVEMTMPEDVIETVTKAKGYTSIIASHHDPKGTLSWRNGAWMQYYNKALHYGDVIKLVGWCRTDEDNFSLLTFKTRMLAAHESTPIIALNMGEQGKLSRVLNGFMTPVTHAALPAAAAPGQLTAAEIRQALSLLSKIPKRKFYLFGKPISKSRSPILHNTLFQQTGLPHTYSRLETDKVAEVETTIRASDFGGASVTIPLKLDIMPMLDEITDAAKTIGAVNTIIPVPVQAGKQRLRGDNTDWCGMVHSLRMAGVTGKRACPASGVVVGSGGTTRAAIFALHSLGFSPIYIIARNATSVETIASSFPAEYDIRNLQGTLAYTEGMARPEVVISTIPATGDVDEGILMAVDSVLTLPMGTSNTGAARVLLEMAYTPTFTNMMARAKDAGWGTVPGFEVLAAQGWFQFQLWTDIKPVYSTASSIVMNGTSDSS

SEQ ID NO: 71731 - DNA, 4707 bp, Gibberella zeae PH-1
  CDS (1)..(4707)
atggctcaagccagtggacaagatcccacccggatctcaatcctcggagaacccaacatcatcgttaatcatgggctgtggctgaactttgtcgtcgatgatctacttcagaatattgcaacgtcaacctacgtccttattaccgacacaaacctcttcaattcctacgttcctgccttccaaagtcgctttgaacatgcgtctcaaggaaaggatacaaggcttctcacatatacaattcctcccggcgaggcttctaagagccgtgacaccaaggccgaaatcgaagactggatgctttctcaacaatgcactcgcgataccgtcattatagctctgggtggtggcgtaatgggagatatgatcggttacgttgcagcaaccttcatgcgtggtgtccgctttgtccaagtacccaccaccttgctcgccatggtcgactcttccatcggtggaaagactgccattgatacaccaatgggcaaaaatcttgtcggcgctttctggcagccaaagcgtatttacatcgacttgactttcctcgagactctgccggtccgtgagttcatcaatggcatggctgaagtgattaagactgccgccatttggaacgagactgagttcagtgtcctcgaggaatcagcagcccacatccttgaatgtgttcgttcaaaaggcgagggtcgacttacccccatcaaagatgtgctgaagcgaattgtcatcggttctgctggtgtcaaagcagaggtcgtgtccagtgatgaacgagaaggcggtcttcgcaatcttctcaacttcggtcactccattggccacgcattcgaagctattttgacacctcaacttctccacggcgaagctgttgccattggcatggtgaaggaagctgagctcgcccgctttcttggtgttctgcgtccaggagctgttgcaagactagtcaagtgcattgccagttacgacctcccgacctcactacaagacaagcgtgtcactaaattgacagctggtaagaaatgccccgtcgacgttctgttggaaaagatgggtgtcgataagaagaacgacggcaagaagaagaagatcgtcctgctgtctgccattggcaagtgtcacgagccacgtgccagcgtcgtagacgacaagacaatccgaaccattctatcatcgtcggttcaagtgacacctggtgtccccaaggacttggccgtcacagttgccccgccaggctcaaaaagtatctccaaccgagctctggtcttagcagctcttggttcgggaacttgtcgcatcaagaacctccttcattcggacgacacccagtacatgctgtcagctattcaccaacttggcggtgcatcttactcctggcaagacgctggagaggtcctggttgtggaaggcaaaggtggcaatctacaagctagcaaagagcctctttatttgggaaatgccggaacagcatcccgtttcctgaccactgtcgtggctctggcctctcctggacaggatgcgaccaccaatgtcctgaccggtaacgcgcggatgaaggttcgtcctatcggtgcgttggttgatgctctgcgctcgaacggccttgagattgagtatcttggcaaagagaacagtctgcctctgcggatcgatgctgctggtggtttcaagggaggcgacatcgagcttgctgcaaccatttcctcccagtatgtctcttccattctcatggccgctccttatgcgaagaaccctgtcacactgcgcctcgtaggaggcaagccaatttctcagctttacattgatatgactattgcgatgatggcatccttcggtattgacgtcgaggtctcctctaaggagcccaatacctaccatatccccaagggtgcttacaagaaccctcccgagtatacgatcgagagtgacgcaagctcagcgacttaccctctggcggtcgccgccatcactggcacaaagtgtacgattcccaacattggctcgaagtctctgcagggcgatgctcgctttgccgtcgatgtgttgcgacccatgggttgctctgtcgagcaatctgactactctacaactgtcacaggaccagctcctggtcaactcaaggctctggcccatgttgacatggaacccatgacagatgcgtttcttacagcatccgtcttggctgcagtggcttctggcacaactcaaattacaggcatcgcgaatcaacgggtcaaggaatgcaatcgtatcgccgctatgaaagaccagctcgcgaagttcggtgtgcaatgtaacgagcttgaagacggtattgaagtgatcggaaagggccaagatggcggtgtctcgacgccagaggccagcatccattgttacgacgaccaccgtgttgcgatgagcttcagcgttctggctgttgcttcaccaggccccgtcattgtcactgaaagagaatgcgtcggcaagacatggcctggatggtgggatatcctgtttcaagtcttcaaggttgacatggttggccacgagtcacatgctgacacccatgacgaagagatttcagagaagacattggaaagctccgttttcatcattggtatgagaggcgctggtaaaactactgctggtaactggatggctaagattcttggctggaaattcatcgacctagaccaggagctcgagaggagagcgggatgcaccatccccgaaatgattaggggtgaccgtgggtgggatggtttccgcgcggacgagctggctcttttgcgagacgttatggaaaggaacaaaaccgggcacgtcttttcgtgcggcggtggtcttgtcgaaacccccgaggctagagagctgctcaacagctacggagcaaatggcggccatgtgctgttagttcatcgtgacaccgaccaagtggttgagtatctcaaccgggataagactcggccagcttacacaagcgagattctacaagtctatctacgccgcaaggacttttacaacgagtgcagcacccacctgtactacagcccgcactccgagtcatctggccgtcaaagccatattcctcatgatttccggcaattcgtccattctatcgcaggcaagaccacccacttcaaggatgtcttggacaaggaccacagcttctttgtatctttgactgtgcctgatgtggaccaagctgtcaatcttctaccagaggttgtagttggctccgatgcagtcgaactccgagtagatctcctccaagatcgttcaatcgactccgttattcgtcaagtttctactctccgagcgtccgcaaagaaacctatcgttttcactttgcgaaccgagtcgcaaggtggaaagttccctgacagtgcttacgatgagggtctcgaactctaccgcttggccgtacggatgggaatggagtacatcgacgttgaaatgactctcccagacgaaatgatcaagactgtaacagagtcccgtggttattcacgcatcattgcctcgcatcatgaccccaagggtaccatgtcatggaagaatgcctcttggattcaatactacaaccgtgctttacaatacggtgacattatcaaacttgtcggtattgctcgtactcctgaagataacttcgatctagccagattcaagtccaggatgcaggaagcgcagaagacacccatgatttccatgaacatgggcaaagcaggcaagttgagccgtgtgctcaaccgcttcctgacaccagtgtcccacccagctcttcccttcaaggctgcacctggacaaatgtctgcggctgagattcgtcaagctctggcattactgggtgacttggaacctcataacttctacttgttcggaaagccaatctcagcttcacgatcacctgctctccacaacactctgttcaagcagactggtctgcctcatcagtatcaccgtcttgaaactgacaatattgaggacgtgcgtgatgttcttaagtctcccgattttggcggcgcctcagtcaccattcctctcaagctggatatcatgggcaaacttgatgagctatcggacgcagcccgcaccattggggctgttaacaccgtggtaccattcggtaagcccgacgataacggttgtcgacgtctcctgggagacaacaccgactggaggggtatggtccacgctctccgtcacgctggtattcaaggacaagacacagacaacaagggcgctgccatggtggtaggctcagggggcaccactcgagctgctatttttgcgcttcactcattagggttcgggccaatctacattgccgctcgcaaccaggaaaaggctgatgcgattgctgcggacttcccgaaggagtatcagcttgaaggtctcagtagggcttcagatgctgagaaggtgtcagaaaacttgaaggtcgtcattagcactattcccgctgatcgacccattgacccaactctgcaagagctagttggtgccgttctcagcaggccagctcctgctggagagcgcagggtcctcctcgagatggcatacaagcctagccataccccaattatgcagctggcagatgatgcaggcaactggactacgattccagggctcgaggtgctttcatctcagggctggtaccagtttgagttgtggacaggcattaccccactgtacaaggacgcccgcgcagctgtcctaggcgagtaa

SEQ ID NO: 71732 - protein, 1568 aa, Gibberella zeae PH-1
MAQASGQDPTRISILGEPNIIVNHGLWLNFVVDDLLQNIATSTYVLITDTNLFNSYVPAFQSRFEHASQGKDTRLLTYTIPPGEASKSRDTKAEIEDWMLSQQCTRDTVIIALGGGVMGDMIGYVAATFMRGVRFVQVPTTLLAMVDSSIGGKTAIDTPMGKNLVGAFWQPKRIYIDLTFLETLPVREFINGMAEVIKTAAIWNETEFSVLEESAAHILECVRSKGEGRLTPIKDVLKRIVIGSAGVKAEVVSSDEREGGLRNLLNFGHSIGHAFEAILTPQLLHGEAVAIGMVKEAELARFLGVLRPGAVARLVKCIASYDLPTSLQDKRVTKLTAGKKCPVDVLLEKMGVDKKNDGKKKKIVLLSAIGKCHEPRASVVDDKTIRTILSSSVQVTPGVPKDLAVTVAPPGSKSISNRALVLAALGSGTCRIKNLLHSDDTQYMLSAIHQLGGASYSWQDAGEVLVVEGKGGNLQASKEPLYLGNAGTASRFLTTVVALASPGQDATTNVLTGNARMKVRPIGALVDALRSNGLEIEYLGKENSLPLRIDAAGGFKGGDIELAATISSQYVSSILMAAPYAKNPVTLRLVGGKPISQLYIDMTIAMMASFGIDVEVSSKEPNTYHIPKGAYKNPPEYTIESDASSATYPLAVAAITGTKCTIPNIGSKSLQGDARFAVDVLRPMGCSVEQSDYSTTVTGPAPGQLKALAHVDMEPMTDAFLTASVLAAVASGTTQITGIANQRVKECNRIAAMKDQLAKFGVQCNELEDGIEVIGKGQDGGVSTPEASIHCYDDHRVAMSFSVLAVASPGPVIVTERECVGKTWPGWWDILFQVFKVDMVGHESHADTHDEEISEKTLESSVFIIGMRGAGKTTAGNWMAKILGWKFIDLDQELERRAGCTIPEMIRGDRGWDGFRADELALLRDVMERNKTGHVFSCGGGLVETPEARELLNSYGANGGHVLLVHRDTDQVVEYLNRDKTRPAYTSEILQVYLRRKDFYNECSTHLYYSPHSESSGRQSHIPHDFRQFVHSIAGKTTHFKDVLDKDHSFFVSLTVPDVDQAVNLLPEVVVGSDAVELRVDLLQDRSIDSVIRQVSTLRASAKKPIVFTLRTESQGGKFPDSAYDEGLELYRLAVRMGMEYIDVEMTLPDEMIKTVTESRGYSRIIASHHDPKGTMSWKNASWIQYYNRALQYGDIIKLVGIARTPEDNFDLARFKSRMQEAQKTPMISMNMGKAGKLSRVLNRFLTPVSHPALPFKAAPGQMSAAEIRQALALLGDLEPHNFYLFGKPISASRSPALHNTLFKQTGLPHQYHRLETDNIEDVRDVLKSPDFGGASVTIPLKLDIMGKLDELSDAARTIGAVNTVVPFGKPDDNGCRRLLGDNTDWRGMVHALRHAGIQGQDTDNKGAAMVVGSGGTTRAAIFALHSLGFGPIYIAARNQEKADAIAADFPKEYQLEGLSRASDAEKVSENLKVVISTIPADRPIDPTLQELVGAVLSRPAPAGERRVLLEMAYKPSHTPIMQLADDAGNWTTIPGLEVLSSQGWYQFELWTGITPLYKDARAAVLGE

SEQ ID NO: 71733 - DNA, 4740 bp, Candida glabrata CBS 138; identical to SEQ ID NO: 22457
  CDS (1)..(4740)

SEQ ID NO: 71734 - protein, 1579 aa, Candida glabrata CBS 138; identical to SEQ ID NO: 22458

SEQ ID NO: 71735 - DNA, 4737 bp, Kluyveromyces lactis NRRL Y-1140; identical to SEQ ID NO: 22451
  CDS (1)..(4737)

SEQ ID NO: 71736 - protein, 1578 aa, Kluyveromyces lactis NRRL Y-1140; identical to SEQ ID NO: 22452

SEQ ID NO: 71737 - DNA, 4713 bp, Debaryomyces hansenii CBS767; identical to SEQ ID NO: 22447
  CDS (1)..(4713)

SEQ ID NO: 71738 - protein, 1570 aa, Debaryomyces hansenii CBS767; identical to SEQ ID NO: 22448

SEQ ID NO: 71739 - DNA, 4671 bp, Yarrowia lipolytica CLIB122; identical to SEQ ID NO: 22449
  CDS (1)..(4671)

SEQ ID NO: 71740 - protein, 1556 aa, Yarrowia lipolytica CLIB122; identical to SEQ ID NO: 22450

SEQ ID NO: 71741 - DNA, 4656 bp, Candida albicans SC5314
  CDS (1)..(4656): transl_table=12
atgtctattgaaaaggtgccaattttgggtaaggaaactatccatgttggttatggtattgccgaccatattgtcagggaagtgatagccaacttggcttcttcaacttatgttatagtgactgacacaaacatggcaagaactccccaatattccaaattgactgatgatttcaaaactaatttgtctgaaaaacgtcctgaatccagattattgacttattgtgtatcaccgggtgaaaacaacaaaaacagagctaccaaagctgcagtggaagattttcttttacaacaaggttgtaccagagacaccgtcatattggctgttggtgggggtgttattggtgacatgattgggtttgttgccgccacatttatgagaggtgtcagagttgttcaagttccaactacattgttagccatggtagattcatctgttggtgggaaaaccgccattgatactccattaggtaagaatttcattggtgctttccatcaacccgaatacgttttctgtgatgtatcctttttagagactttacctgctagacaatttattaatggtatggctgaagttgtgaaaactgcggccatttggaatgaagaagaattcaccagattagaaaacttttccaagaagtttctttctgtcgttacctccaaaaaaccagatttacagtcaattaaggctgaattagtgaaaaccgttttggaatctgttagagtgaaagctggtgttgtgtcatctgatgaaaaggaagctggtcttagaaatttacttaattttggccatactattggtcatgcaattgaagcggttttaactccagaagcattacatggagaatgtgtttccattggtatgattaaggaagctgagttgtctagatatttgggtatactaccacctgttgcagttgccagattgtcgaaatgtctcgttgcatacggtttacctgtgtctattgacgataaagaattcttgaaaaaagtgggaccaaaacgtcattatgttgaaatcgatattttgttgaaaaaaatggccattgacaagaaaaatgatggtagtaagattagatgtgtcttgttagagaaaattggtaaatgttaccaattgaaagcacatcaagtatccaaacaagatttaagttttgtgttgactgatgaagtgttggttcacccattcaccaatccacctaaagaaaacataattgttccacctggttccaaatctatctccaatagagcattgattttagctgctttgggtaatggtactgttcgtgtgaaaaatttgttacattcagacgatactaagcatatgttagatgctgttgcttctttaaagggagctgaaatatccactgaagataatggtgaaaccattgtagttaaaggaaatggtggcaacttggtcacatctggcgaagaattgtacttgggtaatgctggtactgcttccagatttttgactactgtagcttcattagtgggcaaatcacaagctagtgatgatgttattttaactggtaacgcaagaatgcaagaaagacctattggaccattagtggatgccttgggatctaatggttctgagattgagtatttgaataagcagggttcattgccattgaaaatcagtgctggcaatggattgaaaggtggaagaatagaattggctgcaacaatctcttcgcagtatgtttcttcaattttaatgtgtgcaccatatgctaaggagccagttactttggctttagtcggaggtaaaccaatttctcaattatacatagatatgacatgtgcaatgatgaaatcatttggtattgaagttaccaaatcaactactgaggaatacacctatcatattccaaaggggacatacaagaatccatctgaatatgtcattgaatcagatgcgtcatctgcaacttatccattagcatttgctgctatgactggaacatcctgtactattccgaacataggttcttcctcattacaaggagatgccaaatttgctgttgatgtgttgaaaccaatggggtgtaaagttgaacaaaccacaacttcaacaactgtaactggtccgccgagaggtcacttgaaaccattacctcatgttgatatggagccaatgactgatgcatttttgactgcttctgttgttgctgctgttgctaaaggcggttcttctacttctataactggtattgctaaccaaagagttaaagaatgtaatagaattgaagctatggttactgaattggcaaaatttggtgtgccagcaaatgaattacccgatggaattgaaatacatggtattgatattgaagatttgaaaacaccagaaatttctaaaagaggtgtttcctcctatgatgatcatagagtgggtatgtcattttcattattggcaggtttgtgtaaagaacccgttttgattttggaaagatcaaccactggtaagacttggccaggttggtgggatatcttacattccaaatttaagattgagcttgatggttatgaaccaccattcaatactgataaacatgtggataaatctagtgataaaagtatcattgtcattggtatgagaggcactggaaaatctactttatctgaatggttggcttcctttttggggttcaagatgttagatatggacaaatatcttgaagagaaattgggcactggtatcaaatcattgattaaagctaaaggttgggaatatttccgtcaagaagaagcaattgttgctaaagaatgtttcaccaagttttccaaggggtatgtactttccactggtggaggaattgttgaaggtgaagatgccagacagcaattgaaatcttatgctgataatggagggattgttttgcacttgcatcgtgatttagatgaaactgtcactttcttggctgctgatacaaccagacctgcttatagcagtgaagttcaagaagtatggttaagaagagaaaaatggtaccatgaatgttctaactaccacttctattccagtcactgtagtactgaggatgaattcaaccatttgagaagatcctttgtaaactacattaaacttatcactggtgctgaaagacctgttgtgccagttggtagatcagctgctgttgtcttgacatcaccggatttgaatgaagttgttagagatttggaatctattacaattggtgctgatgcagttgaattaagagttgatttatttaaggatacttctgctgaatttgttgctgcccaaattgctgtaataagaaagcatgccgatttaccaattatttacactgtgagaactatgtcgcaaggtggtaaattcccagatgaaaatgttgacgaattaaagagtttgttgttacttggtatcagattaggtgttgcatacgttgatcttcaattgactgctccgaatgaactcattgaagagattagcagtaagaagggtttcactagagtcattggtacttatcaagatataaatggtgaattgaaatggaacaatgttgaatggaaaaacaaatataatcaaggtgtttccatgaatgctgatattgtgagactagtcggtaaggcaaactcaattcaagataatttagatttggaaaactttaaaaagcagaatactttaaaaccattgattgctttcaatttaggttctcaaggtaagttgtcacaagtattaaatggaacattcacccctatttcccacaaattacttccaaatgatgaagagttcttaacaatcggcgaattaaatcaaacttattttgatattggaggtttcactgctaaaaaattttgggtcattggttcacccattgaacattcaagatcaccaaacttgcacaatgcagggtataaagcattgaatttgccttaccaatttggcagatttgaagctacagatgttgatgttgtttatgataacttgatcaataaaccagactttggtggtttagccatcactatgccattgaaattggatatcatgaagtttgccactaaactatctgatgcagcagagaccattggagccgtcaacacattgattccaattgaaggcggatattttggtgataacactgattgggtgggtattagtaattctttcataagagcaggtgttccacctaagctgagctcgaatgggttagttgttggtgcaggcggcacttctagagctgccatttatgccttacatcaaatgggatgtgcaaagatttacttggtgaatcgtactgctgctaaattggaggaacttgtcaagtcattccctaaagactataatcttgagattgtcgaaaccgaacaacaagccgataaagcaagtaaagtcctgttggcagtgtcttgtattcctgctgataaaccattagatggagaagtgttgaagaaaattgagcgaattttatctaatggaagtgaacaatctgctggtttcaagccaaccttattggaagctagttacaaaccaagagtgacaccaattatgaagcttgctgaagaacaatataaatggaaagttatcccaggtgttgagatgttggtaaatcaaggtgatagacagtttaaacttcatactggttttactgcaccatatgagattattcatcgtgctgttgttgaggaataa

SEQ ID NO: 71742 - protein, 1551 aa, Candida albicans SC5314
MSIEKVPILGKETIHVGYGIADHIVREVIANLASSTYVIVTDTNMARTPQYSKLTDDFKTNLSEKRPESRLLTYCVSPGENNKNRATKAAVEDFLLQQGCTRDTVILAVGGGVIGDMIGFVAATFMRGVRVVQVPTTLLAMVDSSVGGKTAIDTPLGKNFIGAFHQPEYVFCDVSFLETLPARQFINGMAEVVKTAAIWNEEEFTRLENFSKKFLSVVTSKKPDLQSIKAELVKTVLESVRVKAGVVSSDEKEAGLRNLLNFGHTIGHAIEAVLTPEALHGECVSIGMIKEAELSRYLGILPPVAVARLSKCLVAYGLPVSIDDKEFLKKVGPKRHYVEIDILLKKMAIDKKNDGSKIRCVLLEKIGKCYQLKAHQVSKQDLSFVLTDEVLVHPFTNPPKENIIVPPGSKSISNRALILAALGNGTVRVKNLLHSDDTKHMLDAVASLKGAEISTEDNGETIVVKGNGGNLVTSGEELYLGNAGTASRFLTTVASLVGKSQASDDVILTGNARMQERPIGPLVDALGSNGSEIEYLNKQGSLPLKISAGNGLKGGRIELAATISSQYVSSILMCAPYAKEPVTLALVGGKPISQLYIDMTCAMMKSFGIEVTKSTTEEYTYHIPKGTYKNPSEYVIESDASSATYPLAFAAMTGTSCTIPNIGSSSLQGDAKFAVDVLKPMGCKVEQTTTSTTVTGPPRGHLKPLPHVDMEPMTDAFLTASVVAAVAKGGSSTSITGIANQRVKECNRIEAMVTELAKFGVPANELPDGIEIHGIDIEDLKTPEISKRGVSSYDDHRVGMSFSLLAGLCKEPVLILERSTTGKTWPGWWDILHSKFKIELDGYEPPFNTDKHVDKSSDKSIIVIGMRGTGKSTLSEWLASFLGFKMLDMDKYLEEKLGTGIKSLIKAKGWEYFRQEEAIVAKECFTKFSKGYVLSTGGGIVEGEDARQQLKSYADNGGIVLHLHRDLDETVTFLAADTTRPAYSSEVQEVWLRREKWYHECSNYHFYSSHCSTEDEFNHLRRSFVNYIKLITGAERPVVPVGRSAAVVLTSPDLNEVVRDLESITIGADAVELRVDLFKDTSAEFVAAQIAVIRKHADLPIIYTVRTMSQGGKFPDENVDELKSLLLLGIRLGVAYVDLQLTAPNELIEEISSKKGFTRVIGTYQDINGELKWNNVEWKNKYNQGVSMNADIVRLVGKANSIQDNLDLENFKKQNTLKPLIAFNLGSQGKLSQVLNGTFTPISHKLLPNDEEFLTIGELNQTYFDIGGFTAKKFWVIGSPIEHSRSPNLHNAGYKALNLPYQFGRFEATDVDVVYDNLINKPDFGGLAITMPLKLDIMKFATKLSDAAETIGAVNTLIPIEGGYFGDNTDWVGISNSFIRAGVPPKSSSNGLVVGAGGTSRAAIYALHQMGCAKIYLVNRTAAKLEELVKSFPKDYNLEIVETEQQADKASKVSLAVSCIPADKPLDGEVLKKIERILSNGSEQSAGFKPTLLEASYKPRVTPIMKLAEEQYKWKVIPGVEMLVNQGDRQFKLHTGFTAPYEIIHRAVVEE

SEQ ID NO: 71743 - DNA, 4656 bp, Candida albicans SC5314
  CDS (1)..(4656): transl_table=12
atgtctattgaaaaggtgccaattttgggtaaggaaactatccatgttggttatggtattgccgaccatattgtcagggaagtgatagccaacttggcttcttcaacttatgttatagtgactgacacaaacatggcaagaactccccaatattccaaattgactgatgatttcaaaactaatttgtctgaaaaacgtcctgaatccagattattgacttattgtgtatcaccgggtgaaaacaacaaaaacagagctaccaaagctgcagtggaagattttcttttacaacaaggttgtaccagagacaccgtcatattggctgttggtgggggtgttattggtgacatgattgggtttgttgccgccacatttatgagaggtgtcagagttgttcaagttccaactacattgttagccatggtagattcatctgttggtgggaaaaccgccattgatactccattaggtaagaatttcattggtgctttccatcaacccgaatacgttttctgtgatgtatcctttttagagactttacctgctagacaatttattaatggtatggctgaagttgtgaaaactgcggccatttggaatgaagaagaattcaccagattagaaaacttttccaagaagtttctttctgtcgttacctccaaaaaaccagatttacagtcaattaaggctgaattagtgaaaaccgttttggaatctgttagagtgaaagctggtgttgtgtcatctgatgaaaaggaagctggtcttagaaatttacttaattttggccatactattggtcatgcaattgaagcggttttaactccagaagcattacatggagaatgtgtttccattggtatgattaaggaagctgagttgtctagatatttgggtatactaccacctgttgcagttgccagattgtcgaaatgtctcgttgcatacggtttacctgtgtctattgacgataaagaattcttgaaaaaagtgggaccaaaacgtcattatgttgaaatcgatattttgttgaaaaaaatggccattgacaagaaaaatgatggtagtaagattagatgtgtcttgttagagaaaattggtaaatgttaccaattgaaagcacatcaagtatccaaacaagatttaagttttgtgttgactgatgaagtgttggttcacccattcaccaatccacctaaagaaaacataattgttccacctggttccaaatctatctccaatagagcattgattttagctgctttgggtaatggtactgttcgtgtgaaaaatttgttacattcagacgatactaagcatatgttagatgctgttgcttctttaaagggagctgaaatatccactgaagataatggtgaaaccattgtagttaaaggaaatggtggcaacttggtcacatctggcgaagaattgtacttgggtaatgctggtactgcttccagatttttgactactgtagcttcattagtgggcaaatcacaagctagtgatgatgttattttaactggtaacgcaagaatgcaagaaagacctattggaccattagtggatgccttgggatctaatggttctgagattgagtatttgaataagcagggttcattgccattgaaaatcagtgctggcaatggattgaaaggtggaagaatagaattggctgcaacaatctcttcgcagtatgtttcttcaattttaatgtgtgcaccatatgctaaggagccagttactttggctttagtcggaggtaaaccaatttctcaattatacatagatatgacatgtgcaatgatgaaatcatttggtattgaagttaccaaatcaactactgaggaatacacctatcatattccaaaggggacatacaagaatccatctgaatatgtcattgaatcagatgcgtcatctgcaacttatccattagcatttgctgctatgactggaacatcctgtactattccgaacataggttcttcctcattacaaggagatgccaaatttgctgttgatgtgttgaaaccaatggggtgtaaagttgaacaaaccacaacttcaacaactgtaactggtccgccgagaggtcacttgaaaccattacctcatgttgatatggagccaatgactgatgcatttttgactgcttctgttgttgctgctgttgctaaaggcggttcttctacttctataactggtattgctaaccaaagagttaaagaatgtaatagaattgaagctatggttactgaattggcaaaatttggtgtgccagcaaatgaattacccgatggaattgaaatacatggtattgatattgaagatttgaaaacaccagaaatttctaaaagaggtgtttcctcctatgatgatcatagagtgggtatgtcattttcattattggcaggtttgtgtaaagaacccgttttgattttggaaagatcaaccactggtaagacttggccaggttggtgggatatcttacattccaaatttaagattgagcttgatggttatgaaccaccattcaatactgataaacatgtggataaatctagtgataaaagtatcattgtcattggtatgagaggcactggaaaatctactttatctgaatggttggcttcctttttggggttcaagatgttagatatggacaaatatcttgaagagaaattgggcactggtatcaaatcattgattaaagctaaaggttgggaatatttccgtcaagaagaagcaattgttgctaaagaatgtttcaccaagttttccaaggggtatgtactttccactggtggaggaattgttgaaggtgaagatgccagacagcaattgaaatcttatgctgataatggagggattgttttgcacttgcatcgtgatttagatgaaactgtcactttcttggctgctgatacaaccagacctgcttatagcagtgaagttcaagaagtatggttaagaagagaaaaatggtaccatgaatgttctaactaccacttctattccagtcactgtagtactgaggatgaattcaaccatttgagaagatcctttgtaaactacattaaacttatcactggtgctgaaagacctgttgtgccagttggtagatcagctgctgttgtcttgacatcaccggatttgaatgaagttgttagagatttggaatctattacaattggtgctgatgcagttgaattaagagttgatttatttaaggatacttctgctgaatttgttgctgcccaaattgctgtaataagaaagcatgccgatttaccaattatttacactgtgagaactatgtcgcaaggtggtaaattcccagatgaaaatgttgacgaattaaagagtttgttgttacttggtatcagattaggtgttgcatacgttgatcttcaattgactgctccgaatgaactcattgaagagattagcagtaagaagggtttcactagagtcattggtacttatcaagatataaatggtgaattgaaatggaacaatgttgaatggaaaaacaaatataatcaaggtgtttccatgaatgctgatattgtgagactagtcggtaaggcaaactcaattcaagataatttagatttggaaaactttaaaaagcagaatactttaaaaccattgattgctttcaatttaggttctcaaggtaagttgtcacaagtattaaatggaacattcacccctatttcccacaaattacttccaaatgatgaagagttcttaacaatcggcgaattaaatcaaacttattttgatattggaggtttcactgctaaaaaattttgggtcattggttcacccattgaacattcaagatcaccaaacttgcacaatgcagggtataaagcattgaatttgccttaccaatttggcagatttgaagctacagatgttgatgttgtttatgataacttgatcaataaaccagactttggtggtttagccatcactatgccattgaaattggatatcatgaagtttgccactaaactatctgatgcagcagagaccattggagccgtcaacacattgattccaattgaaggcggatattttggtgataacactgattgggtgggtattagtaattctttcataagagcaggtgttccacctaagctgagctcgaatgggttagttgttggtgcaggcggcacttctagagctgccatttatgccttacatcaaatgggatgtgcaaagatttacttggtgaatcgtactgctgctaaattggaggaacttgtcaagtcattccctaaagactataatcttgagattgtcgaaaccgaacaacaagccgataaagcaagtaaagtcctgttggcagtgtcttgtattcctgctgataaaccattagatggagaagtgttgaagaaaattgagcgaattttatctaatggaagtgaacaatctgctggtttcaagccaacattattggaagctagttacaaaccaagagtgacaccaattatgaagcttactgaagaacaatataaatggaaagttatcccaggtgttgagatgttggtaaatcaaggtgatagacagtttaaacttcatactggttttactgcaccatatgagattattcatcgtgctgttgttgaggaataa

SEQ ID NO: 71744 - protein, 1551 aa, Candida albicans SC5314
MSIEKVPILGKETIHVGYGIADHIVREVIANLASSTYVIVTDTNMARTPQYSKLTDDFKTNLSEKRPESRLLTYCVSPGENNKNRATKAAVEDFLLQQGCTRDTVILAVGGGVIGDMIGFVAATFMRGVRVVQVPTTLLAMVDSSVGGKTAIDTPLGKNFIGAFHQPEYVFCDVSFLETLPARQFINGMAEVVKTAAIWNEEEFTRLENFSKKFLSVVTSKKPDLQSIKAELVKTVLESVRVKAGVVSSDEKEAGLRNLLNFGHTIGHAIEAVLTPEALHGECVSIGMIKEAELSRYLGILPPVAVARLSKCLVAYGLPVSIDDKEFLKKVGPKRHYVEIDILLKKMAIDKKNDGSKIRCVLLEKIGKCYQLKAHQVSKQDLSFVLTDEVLVHPFTNPPKENIIVPPGSKSISNRALILAALGNGTVRVKNLLHSDDTKHMLDAVASLKGAEISTEDNGETIVVKGNGGNLVTSGEELYLGNAGTASRFLTTVASLVGKSQASDDVILTGNARMQERPIGPLVDALGSNGSEIEYLNKQGSLPLKISAGNGLKGGRIELAATISSQYVSSILMCAPYAKEPVTLALVGGKPISQLYIDMTCAMMKSFGIEVTKSTTEEYTYHIPKGTYKNPSEYVIESDASSATYPLAFAAMTGTSCTIPNIGSSSLQGDAKFAVDVLKPMGCKVEQTTTSTTVTGPPRGHLKPLPHVDMEPMTDAFLTASVVAAVAKGGSSTSITGIANQRVKECNRIEAMVTELAKFGVPANELPDGIEIHGIDIEDLKTPEISKRGVSSYDDHRVGMSFSLLAGLCKEPVLILERSTTGKTWPGWWDILHSKFKIELDGYEPPFNTDKHVDKSSDKSIIVIGMRGTGKSTLSEWLASFLGFKMLDMDKYLEEKLGTGIKSLIKAKGWEYFRQEEAIVAKECFTKFSKGYVLSTGGGIVEGEDARQQLKSYADNGGIVLHLHRDLDETVTFLAADTTRPAYSSEVQEVWLRREKWYHECSNYHFYSSHCSTEDEFNHLRRSFVNYIKLITGAERPVVPVGRSAAVVLTSPDLNEVVRDLESITIGADAVELRVDLFKDTSAEFVAAQIAVIRKHADLPIIYTVRTMSQGGKFPDENVDELKSLLLLGIRLGVAYVDLQLTAPNELIEEISSKKGFTRVIGTYQDINGELKWNNVEWKNKYNQGVSMNADIVRLVGKANSIQDNLDLENFKKQNTLKPLIAFNLGSQGKLSQVLNGTFTPISHKLLPNDEEFLTIGELNQTYFDIGGFTAKKFWVIGSPIEHSRSPNLHNAGYKALNLPYQFGRFEATDVDVVYDNLINKPDFGGLAITMPLKLDIMKFATKLSDAAETIGAVNTLIPIEGGYFGDNTDWVGISNSFIRAGVPPKSSSNGLVVGAGGTSRAAIYALHQMGCAKIYLVNRTAAKLEELVKSFPKDYNLEIVETEQQADKASKVSLAVSCIPADKPLDGEVLKKIERILSNGSEQSAGFKPTLLEASYKPRVTPIMKLTEEQYKWKVIPGVEMLVNQGDRQFKLHTGFTAPYEIIHRAVVEE

SEQ ID NO: 71745 - DNA, 5148 bp, Ustilago maydis 521
  CDS (1)..(5148)
atgacgtccacagcgtcagcacaacagcctgtgcttaggacaaaaacgccctcctaccacgctccgccctccaccgacccgctctctggtgccaccatccacacgctccgatgcttggatactcccattcatctcggctatcacctcattcctcatatcgccaagacgcttctctccacgcttccatcttccacctacgtcctcatcacggaccaaaaccttgaagcaagatgcagcgtcaccaccgcctttcgtcgtgaattcgaaaaggctgccgtccatctttcctcgtctcactcttggaggctcctcaccaaggtcatccctcccggcgaagcttccaagagccgagatggcaagaatgcgatcgaggattggatgtttgagcatcgtgtcacccgagatgccgtcgtccttgctgttggtggtggtgtcatcggcgacctggttggctttgtagctgccaccttcatgcgcggcctcaagtttgtccagattcccaccaccctccttgccatggtcgactcggccgtcggtggcaagaccgccatcgaccatccgcttggcaaaaacctcatcggaagcttccaccagcccaactatgtctttatcgacgctgcctggctcaaaacgcttcccgtccgcgaattcagcaacggcatggccgaggtcgtcaaaaccgccgccatctgggaccccatcgactttgccaaactcgagtcaagcgcccccgccattcgatccgctgtgcttgggccctttgccaaagacgctccgctcgaccaaggtaggacgctcgagactcgcaccgagtctcagtctctgctgctcgacgtcatccgtggctcggtcggtgtcaaggcccacattgtcaccatcgacgaaaaggagactggcctccgcaaccttgtcaactttggccataccatcggtcatgccatcgaggccgtcttgactcccgaaatgctacacggagagtgcatctcgatcggtatgatcctcgaagccgaggtcgcccgctacatgcacggcctcagccaagtcgccatcggccgtctcacccgctgtctcaaggagtacgacttgcccgtctcgctctccgactcgcgcgtcacccgtcttgcaaagtcactcgatgtcaccgtcgatcgtcttctcgatatcatgaaggtcgacaagaaaaactcgggtaccaacaaaaagattgtcctcctcagctccatcggcgacacggtccaaaacatggcttccaccgtcagcgaccacattatccgccgcgttctttcgctcgccgccactgtcacgcccatccacgagcaacccaacaagcccaaggtcaccctttccactcctggctccaagtccatctcgaaccgcgctcttgtcctcgctgctctggccaccaacacctgccgtcttcgcaatatgctccactcggacgacacccaggtcatgatggctggtctccacgatcttcaagccgcacgcttcgagttcgaagacggtggagagaccatcgtcgtccacggcaacgccggtgctcttgctcgccccgccaacgacaagcagatctacctgcagaacgcaggtacagctgctcgtttcatggccaccgtcgtcagcctggttcacaacgacggcaaccagcaccccgtcgtcattaccggaaacaagcgtatgaaggaacgccccatcgctgcacttgtcgacgcactccgatccaacggcacctcgatcgactatctcgagggccacggttgcttgccactcgccgtcaagggcaccacacacggtttcaagggaggcaagatccagctctcggccaccatctcatcccagtacgtctcgtccatcctcctgtgcgccccctacgctgctgagcaagtcgtgctcgagctcgtaggcggccaggtgatttcacagctctacatcgatatgaccatcgccatgatggccactttcggtatcaaggtcgagcgtctcctcgatcccactaccggtcgtccctccaacacctaccgcatccccaagggccactacgtatcgcccgacgtctacgatatcgagagcgacgccagcagcgccacttatcctttggccatcgctgctatcactggcaccgagtgcaccgtccccaacatcggctcggcttcgcttcagggcgacgctcgcttcgccaaagaggtcctcgaaccaatgggctgcactgtggtccaaaccgccacctccaccactgtcattggccccaagctcggtcagctccgtcagatcggcttggtagacatggagcccatgaccgatgctttcctcaccgcatccgttttgctcgccgtcgctgctcactcgcccgccaacggttccacctcgaacgctcgaccttcgactcgcatcaccggaatcgccaaccaacgagtcaaggagtgcaatcgtattcgtgccatgatggacgagctcgccaagttcggcgtcaacaccaaggagcacgacgacggcctcgagatttttggcatcgactaccgtcaactgcacgccaacgtccgcgtgcactgctacgacgaccatcgcgtcgccatggccttctccgtgctcgccagtttggcgcctggtgccatcttggaggagaagcgatgtgtcgaaaagacgtggcccaactggtgggacgatctggagcgcaaactcggcatccgtgttcacggcgtcgatccagaatgctcgccaagcctctgcatctcgccttcgcactttaccaaggccagcgctgcgagcaccaacggcaagccgcccacttgcctctcccagctgacttgtggcaaggcactgaccccacgcaagtacagcaagcatgcgaccatcatctgtatcggcatgcgtgcttccggaaagacgttcctgggcgcaatcggtgctgctgcattgtcacgaactttcatcgacgccgacgtcgtcttcaacgagaagctcggcgccaaggacggtctgggcgactttgtccgagagcacggatggcctgcgttccgtcaaaaggagctcgagattttgcaagaactcatcgctcgtcatcctagcggcgcgctcatctcgctcggcggtggagtcgtcgaaacggaagcctgcaggcagatcctggccgaatatgcgcagaccaagggtccggtgatctacattgtccgtgacacgaatgcgatcgtcaagttcctggctaccagcgatcgccctgcttacggtgaaccagtaatggacgtctatcgccgccgtaacccttggtttagcgagtgctcgtcggccgaactcgtctcgtactccgaaggcgaatctttggccatccagccctgtgcgatgaacgtgcccgacccttcgttcaccatccagaagaagtttggtctcgagaccgaagtggcacgcttcttcaagtttgtggtgggacaagacacgaatcagatcagagatcttgtggtcgacagtcgcaagggtggacgacgcacctactttcttagtctcacgttcccggacgtggtgcctaagctcgagctgattcgaagcatggagagcggctcggacgctctcgagttccgcgcagatctgctcaacccgtctggccaaccagtgaccacgccccaaattcctccgaccgagtacgtcaagaaccagctcgccgcgctccgtcaccgcacttcgctgcctatcgtcttcaccgtgcgcacgcactcgcagggcggaatgttccccgatggcaagcaacacgagtattttgaactgatcagcctcgcgcttcgtcacgcttgcgagtacatcgacctcgagcttggatgggatgacgatctgctctcggccgtcgtgcaagccaagggcaacagtcagatcattgcctcctggcacgattggtcgggccgtctggattgggagagcgagtcgacagccaagatctacgagaaagcatgccgcttcggcgatattgccaagatcatcggcaaggctactacgatggaggataactacagcttggaacgctttcgcgccaaggtgtcggcgacggcgaccaaacctctgctcgccgtcaacatggggtccgtcggtcagctcagtcggatcgtcaacccggtgttcacgcccatcacgcacgaagccatgccgttcaaagctgcgcctggacagctgtcgttccgacaggtgcaaaccgctctgtctctgatcggacaggctgatgcgcgtcgatttgcgctgtttggcagccccatcggccacagtctgagcccgttgttgcacaacaccggtttcgcagctctcggtctaccgcaccagtacgagctgttggagtcgaccgagattaatgatgccgtagctgcgtttgtgcgatcgcccgactttggcggcgctagcgtcacgatccctcacaagctcaacattatcaagctgttggacgaggtgacagacgaggcgaaaacgatcggtgctgtcaacacaatcatcccaattcgagatgctcagggcgtcgtgacttcgctcgttggagacaacacggactggattgcgattgagacgttggcaaggcgatcgttgcgaacggtgcatttggcggatcccaacctgacgggtttggtgatcggtgctggcggatcggcgcgtgctgccttgttcgcgctgtacaggctgggcgtgaagcggattctactgttcaaccgaacacttgccaacgccgagaagctcgctcgcgaggtaccgccggaatggaatgtcagcgtcctcacttcgctcgacgaggttgctcagctttctgcggaccaatcgccgtctgtggtggtctccaacatcccggctgaaggctctaccctggacgcatcttcgcgcggtctgatccatctcccgacgtgcatgctccgaaatcctgctggaggtgtggtgatcgacatgagctacaaaccgcactacacgtctctgctgcaacttgcacaacaggtcaacaccaaccacgagctagctattggtaccaatgctaccaaggctcccacaaggaagctgtgggccgccgttccgggcataacaattctcttggagcaggggtgtcatcagttccaccgatggacaggtagggaggcgcctagggcgcagatcgaggctgctgcttgggacgtttatctgcagcgttgctag

SEQ ID NO: 71746 - protein, 1715 aa, Ustilago maydis 521
MTSTASAQQPVLRTKTPSYHAPPSTDPLSGATIHTLRCLDTPIHLGYHLIPHIAKTLLSTLPSSTYVLITDQNLEARCSVTTAFRREFEKAAVHLSSSHSWRLLTKVIPPGEASKSRDGKNAIEDWMFEHRVTRDAVVLAVGGGVIGDLVGFVAATFMRGLKFVQIPTTLLAMVDSAVGGKTAIDHPLGKNLIGSFHQPNYVFIDAAWLKTLPVREFSNGMAEVVKTAAIWDPIDFAKLESSAPAIRSAVLGPFAKDAPLDQGRTLETRTESQSLLLDVIRGSVGVKAHIVTIDEKETGLRNLVNFGHTIGHAIEAVLTPEMLHGECISIGMILEAEVARYMHGLSQVAIGRLTRCLKEYDLPVSLSDSRVTRLAKSLDVTVDRLLDIMKVDKKNSGTNKKIVLLSSIGDTVQNMASTVSDHIIRRVLSLAATVTPIHEQPNKPKVTLSTPGSKSISNRALVLAALATNTCRLRNMLHSDDTQVMMAGLHDLQAARFEFEDGGETIVVHGNAGALARPANDKQIYLQNAGTAARFMATVVSLVHNDGNQHPVVITGNKRMKERPIAALVDALRSNGTSIDYLEGHGCLPLAVKGTTHGFKGGKIQLSATISSQYVSSILLCAPYAAEQVVLELVGGQVISQLYIDMTIAMMATFGIKVERLLDPTTGRPSNTYRIPKGHYVSPDVYDIESDASSATYPLAIAAITGTECTVPNIGSASLQGDARFAKEVLEPMGCTVVQTATSTTVIGPKLGQLRQIGLVDMEPMTDAFLTASVLLAVAAHSPANGSTSNARPSTRITGIANQRVKECNRIRAMMDELAKFGVNTKEHDDGLEIFGIDYRQLHANVRVHCYDDHRVAMAFSVLASLAPGAILEEKRCVEKTWPNWWDDLERKLGIRVHGVDPECSPSLCISPSHFTKASAASTNGKPPTCLSQLTCGKALTPRKYSKHATIICIGMRASGKTFLGAIGAAALSRTFIDADVVFNEKLGAKDGLGDFVREHGWPAFRQKELEILQELIARHPSGALISLGGGVVETEACRQILAEYAQTKGPVIYIVRDTNAIVKFLATSDRPAYGEPVMDVYRRRNPWFSECSSAELVSYSEGESLAIQPCAMNVPDPSFTIQKKFGLETEVARFFKFVVGQDTNQIRDLVVDSRKGGRRTYFLSLTFPDVVPKLELIRSMESGSDALEFRADLLNPSGQPVTTPQIPPTEYVKNQLAALRHRTSLPIVFTVRTHSQGGMFPDGKQHEYFELISLALRHACEYIDLELGWDDDLLSAVVQAKGNSQIIASWHDWSGRLDWESESTAKIYEKACRFGDIAKIIGKATTMEDNYSLERFRAKVSATATKPLLAVNMGSVGQLSRIVNPVFTPITHEAMPFKAAPGQLSFRQVQTALSLIGQADARRFALFGSPIGHSLSPLLHNTGFAALGLPHQYELLESTEINDAVAAFVRSPDFGGASVTIPHKLNIIKLLDEVTDEAKTIGAVNTIIPIRDAQGVVTSLVGDNTDWIAIETLARRSLRTVHLADPNLTGLVIGAGGSARAALFALYRLGVKRILLFNRTLANAEKLAREVPPEWNVSVLTSLDEVAQLSADQSPSVVVSNIPAEGSTLDASSRGLIHLPTCMLRNPAGGVVIDMSYKPHYTSLLQLAQQVNTNHELAIGTNATKAPTRKLWAAVPGITILLEQGCHQFHRWTGREAPRAQIEAAAWDVYLQRC

SEQ ID NO: 71747 - DNA, 4788 bp, Aspergillus oryzae
  CDS (1)..(4788)
atggccgaacccactaagataaagattttgggacaggagagtataatcgctgatttcggtctttggcgcaactatgtcgctaaggacctgattagcggctgtccctccacaacctacgttctcatcaccgatacgaacattggatcgatatatacccccggcttccaaaaaaccttcgaagatgccgccaccgccgtttcccccgcgccacggttgttagtatatcattgccccccgggggaggtctctaaatcccggcagaccaaagcagatattgaagattggatgttgagccaaagccccccgtgtggccgtgacactgtggttatcgcgctgggcggaggtgtcattggagatctgactgggtttgttgcctcgacctatatgcgtggtgttcgatatgtccaggttccgacgaccctcctggctatggtggattcgtcaattggtggaaagactgcgattgatactccgctaggaaagaacttgatcggcgcaatctggcagccgacaaggatctacattgacctggaattcttggaaacacttcccgttagggaattcgtcaacggcatggctgaggttatcaaaacggctgccatttctagtgaagaagaatttactgcattggaggacaatgctgaggcgatcttgactgctgtccgaagcgagcgtaagccgggccagcgttggtttgagggtattgaggacattttgaaggcgcggattcttgcatcggcacgtcacaaagcctacgttgtctctgcagatgaacgagagggcggcctccgaaaccttctcaactggggtcactccattggccatgctatcgaagcaattctcactcctcaggttcttcacggagagtgtgttgctattggtatggtaaaagaagcagagctcgcccggcatcttggcattctcaagggggttgctgtagcccgtattgtcaagtgcatcgccgcttacggtttgcccacctcgttgaaagactcgcgcattagaaaactcaccgccggaaagcattgctcagttgatcagctgcttttcaacatggctctcgataagaagaacgatggtccgaagaagaagatcgttcttttgtcggctattggacgcacgtacgagccaaaggctagtgtagttcccaatgaggatatcggcgttgtccttgcccccagcatcgaagtacatcctggcgtagagccagcatctaacattatctgcattcctccaggctcaaagagtatctccaaccgagctttggttcttgctgctcttggttctggaacttgccgcgtcaagaatctccttcattcggacgacactgaagttatgctgaacgctttggagagactcggtgccgcaactttctcctgggaagaggagggcgaagtgcttgtagtaaacggtaaaggcggaaatcttcaagcaagcccctctgagctctacctcggtaacgcaggtactgcctcgaggttcctcaccactgtcgcaacccttgccaatgcaagcagcgtagattcaagcattctcactggcaacaatcgcatgaagcaaagacccattggcgacctggtggatgcactgacagcgaatggtgcatcggtcgaatatgtggagcggaaaggcagtcttcctctcaaggtagctgcgtctggcgggtttgcgggaggaagaatcaaccttgctgctaaagtttcttctcaatacgtatcgtctttgcttatgtgtgccccgtacgccaaggagcctgtcacattgaaactggtgggtggtaagcccatctctcagccttacattgatatgacaacggcaatgatgagatccttcggtatcgatgtgcaaaagtccacgactgaggaacacacataccatatccctcagggccgttacgttaaccctgccgagtacgttattgaaagcgatgctagctctgcaacctaccctctcgcaattgcagcgattactggaacgacatgcactgttccgaacattggatccaaatccctccaaggtgatgcccgttttgctgtcgaggtcttggggcccatgggctgtaccgtcaagcagactgacacttcgaccactgtcgtcggaccatccgatggtatcctgcggccgctgccgaatgtggatatggagcctatgacggacgcatttcttactgcatctgttctcgctgctgtcgctcgtggagacggcgcgagccataccactcgtatttatggaatcgcaaaccagcgtgtaaaggaatgcaatcgtatcaaggccatgaaggatgaactcgccaaattcggcgtcgtctgccgggagcacgatgatggtcttgagattgacggaattgaccgctcaactcttcggcagccggccggcggcgtctactgctatgatgaccaccgcgttgctttcagcttcagtgtcctctctcttgtggctcctcagccgaccctcatcttagaaaaggaatgtgtaggcaagacatggcctggctggtgggacaccttgaggcagaagttctcggccaagttggagggtaaagaactgaaagaagaggaatcatcacctcttgctggtgccggaagggctactgcttcagtcttcataatcggaatgcgtggcgccgggaagactactactgggcgctgggtcgcgaagaccttgaatcgtcctttcgtcgatcttgataccgaactggaaaacgttgaaggtcagacaattccagacattgtcaagcagcgcggctggcaagggtttagagatgccgagcttagcctcttacaacgcactttgaaggaacgttccagtggttatgttctcgcatgtggtgggggtatagttgagattccggaggccaggaagttgctcattgattatcataagaacaaaggtaacgtcatgctaatcatgcgcgatattaaacaagtgatggacttcctcaacatcgacaagacccgccccgcttacgttgaggatatgatgggtgtatggttgcgcaggaaaccatggttccaagagtgtagcaacatccagtattacagccaacatgctacgggtaagctcgctaaggcttcagaggatttcactcgtttcttcaatgtcgtcaccggcgaggcggacagcctgagcatcatcaagcgcaagaagcattccttcttcgtgtctttgaccttgcccgacttacgaactgctggcgatatcttagagaaagtatgcgtgggatccgatgccgtggaactccgcgtcgatctgttgaaggacccagcatcggatagtgacattccgtcagtcgactatgtggccgagcagatggctttcctgcgcagctatgtttcgcttccgttgatatttacgattcgcactaagagccaaggtggtcgattcccagacgatgcgcacgacgctgcaatggagctgtatcgcctcgcattcagatctggcagtgaatttgtggacctcgaaatcgctttccctgacgaaatgctgcgcgctgtcacagagatgaagggctattcgaagatcatcgcatcacaccacgaccctaagggagaattgtcatgggcgaacatgtcttggatgaagtactacaacagggctcttgaatacggcgacatcatcaagcttgtcggtgttgcaaagaatctagatgataacacggcgctcaggaaatttaagagctgggcagaggaagcacacgagactccattaatcgctatcaacatgggcgacaatggacaactcagtcgtatcctaaatggtttcatgaccccagtgtctcaccctagcctacctttcaaagctgctcctggtcaactctctgcgaccgaaatccgcaaggggttgtccctgatgggagagataaagcaaaagaagtttgcagtgtttggcacccccgtctcaggctctcgctccccggtcctccataacaccctcttctcccaggcgggccttcctcatgagtatggtcgtttggagacggcgaacgttgaagacgtcaaggacttcattcggtcccctgattttgggggcgcttctgtaacaatccctttgaagttggacatcatgcccttactagaccacatcacaccagaagccgaaatcattggcgccgtgaacactatcatccctgtcgctgatggagacaagccagcgcgcttagtgggatccaacactgactggcaaggaatgaccctctctctccataacgccggtgttgagactgccaataaggatgccagtgctctcgttatcggtggcggtggtactgcccgggctgccatctacgctctccacagcatgggattctctcccatctatgttattggacggtcggctcccaagctccagagcatggtctcgaccttcccctccagctacaatatccaggtcatcgacagcccggagacactaaaaacaattcccaccgtggccatcggcactattcctgccgacaagccgatcgaccccgttatgcgtgagaccctctgccatatgttcgagcgcgcccaagaggccgatgccgatgtggtcaagacgggggagaaggcacaccgtgttcttcttgagatggcctacaaaccatccgtgacggcattgatgcagttggcttccgattccaattggcacactattcccggacttgaggtcctggttggtcagggatggtatcaggtaagctccaaaccgtatacgtactcgattcaatatcagaagctgactcggtatatagttcaaacattggactgggatttctcccctctacgaggatgcaagagccgccgtgcttag

SEQ ID NO: 71748 - protein, 1595 aa, Aspergillus oryzae
MAEPTKIKILGQESIIADFGLWRNYVAKDLISGCPSTTYVLITDTNIGSIYTPGFQKTFEDAATAVSPAPRLLVYHCPPGEVSKSRQTKADIEDWMLSQSPPCGRDTVVIALGGGVIGDLTGFVASTYMRGVRYVQVPTTLLAMVDSSIGGKTAIDTPLGKNLIGAIWQPTRIYIDLEFLETLPVREFVNGMAEVIKTAAISSEEEFTALEDNAEAILTAVRSERKPGQRWFEGIEDILKARILASARHKAYVVSADEREGGLRNLLNWGHSIGHAIEAILTPQVLHGECVAIGMVKEAELARHLGILKGVAVARIVKCIAAYGLPTSLKDSRIRKLTAGKHCSVDQLLFNMALDKKNDGPKKKIVLLSAIGRTYEPKASVVPNEDIGVVLAPSIEVHPGVEPASNIICIPPGSKSISNRALVLAALGSGTCRVKNLLHSDDTEVMLNALERLGAATFSWEEEGEVLVVNGKGGNLQASPSELYLGNAGTASRFLTTVATLANASSVDSSILTGNNRMKQRPIGDLVDALTANGASVEYVERKGSLPLKVAASGGFAGGRINLAAKVSSQYVSSLLMCAPYAKEPVTLKLVGGKPISQPYIDMTTAMMRSFGIDVQKSTTEEHTYHIPQGRYVNPAEYVIESDASSATYPLAIAAITGTTCTVPNIGSKSLQGDARFAVEVLGPMGCTVKQTDTSTTVVGPSDGILRPLPNVDMEPMTDAFLTASVLAAVARGDGASHTTRIYGIANQRVKECNRIKAMKDELAKFGVVCREHDDGLEIDGIDRSTLRQPAGGVYCYDDHRVAFSFSVLSLVAPQPTLILEKECVGKTWPGWWDTLRQKFSAKLEGKELKEEESSPLAGAGRATASVFIIGMRGAGKTTTGRWVAKTLNRPFVDLDTELENVEGQTIPDIVKQRGWQGFRDAELSLLQRTLKERSSGYVLACGGGIVEIPEARKLLIDYHKNKGNVMLIMRDIKQVMDFLNIDKTRPAYVEDMMGVWLRRKPWFQECSNIQYYSQHATGKLAKASEDFTRFFNVVTGEADSLSIIKRKKHSFFVSLTLPDLRTAGDILEKVCVGSDAVELRVDLLKDPASDSDIPSVDYVAEQMAFLRSYVSLPLIFTIRTKSQGGRFPDDAHDAAMELYRLAFRSGSEFVDLEIAFPDEMLRAVTEMKGYSKIIASHHDPKGELSWANMSWMKYYNRALEYGDIIKLVGVAKNLDDNTALRKFKSWAEEAHETPLIAINMGDNGQLSRILNGFMTPVSHPSLPFKAAPGQLSATEIRKGLSLMGEIKQKKFAVFGTPVSGSRSPVLHNTLFSQAGLPHEYGRLETANVEDVKDFIRSPDFGGASVTIPLKLDIMPLLDHITPEAEIIGAVNTIIPVADGDKPARLVGSNTDWQGMTLSLHNAGVETANKDASALVIGGGGTARAAIYALHSMGFSPIYVIGRSAPKLQSMVSTFPSSYNIQVIDSPETLKTIPTVAIGTIPADKPIDPVMRETLCHMFERAQEADADVVKTGEKAHRVLLEMAYKPSVTALMQLASDSNWHTIPGLEVLVGQGWYQVSSKPYTYSIQYQKLTRYIVQTLDWDFSPLRGCKSRRA

SEQ ID NO: 71749 - DNA, 4773 bp, Sclerotinia sclerotiorum
  CDS (1)..(4773)
atgggatctacaacttttgaaaatcccacgcggattgaaattttagggaaggaagatatcatcgtcgatttcgatatctggcgcaatttcgttgcagaagatttgctttcagacctcccctcatctacctatgtcctcatcacagataccaatctctcccctctctacgtcccagctttccaacagtccttcgaggcacttgctgccaaatcgagctcaacacctcgacttcttacctacgaaatacctccaggggagaattccaagagtagagaaacaaaagccgagattgaggactggatgttgtcgcaccaatgtacaagggattcggtcataattgctttggggggaggagtcattggtgatatgattggctatgttgcagcaacttttatgagaggtgtacgattcgtacaggtcccaacaacgttgctggccatggtcgactcctccattggtggaaagacggcaatcgatacgcctttgggaaagaatttggttggtgcattttggcaaccgcagagaatctacatagatttgcgatttctagaaaccctacctgtgcgcgaattcatcaatggcatggcagaagtggtcaaaactgccgccatctgggacgaggcggagttctctgcactcgaggataatgcgaatctcattatgactacaattcgagccaagaatacagactgctctacaagattaggcccaatccgagatatattgaaaagaatagtactaggctcggcgaagaccaaggccgatgttgtgtcagccgatgagagagaaggtggattgcgaaatattttaaactttggtcactcaattgggcatgcatttgaagcaatcctgacgccgcaagtgctacatggagaagctgtagctattggaatggtgaaggaagcagaattggctaggcatttgggagttttgaaaccaggagcagtcgcccgtctggtcaaatgcatagcgagttatggactacctacctctcttgcagacaaacgcattcagaagctcacggcagggaagctatgtcctgttgacgtactattagagaagatgggcgtcgacaagaagaatgatggaagaaaaaagaagattgttttactttctgccattggtaaaacatatgaacccaaggctagtgtcgtggaggaccgatcaatcagagtcgtcttatctgactcggtcgaggttagacctagcgtacccgagactttgaatgtcgaggtgacaccaccaggctcaaagagtatctctaacagggctcttgttcttgcggctcttggcactggcccttgccgcatcaagaacctcctccactcggatgatgtagagttcatgcttacttcaattggtaagcttggtggtgcgacatacgcatgggaagatgcgggtgaagtgctctgtgttcaaggtaagggtggcgacttgcatgccagccctacggaactctatattggaaacgcaggtactgcatctcgtttccttacaactgtggtttcgttgtgcaagccttcagcctcaacaaagtctaccattcttactgggaatgcacgaatgaaagttagacctattggtccattagtcgactcgctacgtgcaaatggtgttgatatcgaataccttgagaaagagcacagtctcccgctcaatgttgctgcttccggtggtttcactggaggtgacatcaatttagcagccaccgtatcatctcaatatgtctcgtctctcctcatgtgcgctccttacgctaagaatccggtgactctgcgtcttgttggtgggaaacccatttcgcaactttacattgatatgacaacagcgatgatggcagctttcgggatccacgtcgtccgatcgcagacgggagagcatacttaccatataccacaaggagtttacaagaaccctgaagagtatgtagttgagagtgatgctagctcagcgacttatccactcgctgtagctgccacctctggaactacttgcacaattccaaacatcggatgcaagtctattcaaggcgatgctcgatttgcgatcgatgttttaaaaccaacgggatgtaaagtagtccagacagattattctactaccgtgactggtccccccatcggatcgcttcaagctattgaggaagttgatatggagccaatgacggatgctttcttgactgcttccgtattaggcgcagtggcaaaaggcacgactaagataaggggaatcgccaaccagcgtgttaaggaatgcaatcggatcaaagcaatgaaggatgaacttgcaaaatttggtgtcacatgtcgtgaactcgaagatggaatcgaggtcgatggtgtaccaataaaagacttgaagcacccagctgaaggaattcactgttacgacgatcatcgcgtggcaatgagtttcagcgtattgtctgtcgctgcaagccagcccgttctcatcgaagagcgcgaatgtgttgggaagacctggccgggatggtgggatatcctctccaagtcattccaagtagagcttgctggcaaggaagtcaaagctacgcacagcaaaaaaattggaatcccaacgctaccagataagtccatcttcataatcggtatgcgcggagctggaaagactacggctggtgcgtgggctgcgaaaattcttggtcgaccttacaaagatcttgatgtagagctggagcgcatctcagggatgtcaatacctgatatggtcagatcgaagggctgggatttcttcagagccgctgaattggatcttctaaagcactgtctgactgaccagccagagaagcatgtgtttgcctgtggcggtggagtcgttgaaatgcccgaggcacgagaacttttgatcaatttccataaatccggcggaattgtacttttggttcatcgagatacagagcaggtcatggattatcttcgcatagacaagactcgacctgcttatgttgaggatatgatgggagtctactctcgccgcaaaccttggttcaacgaatgcagtaatttccaatatcatagcaagggcagcggtgccagcgcactgtctgttgcggaacaggatttcgccaggttcctgcatcacatttccggaaagagtttacactttgacgagatgcgaaacaaaccacagtcattctttgtttccctcacaatgccggacatatcaggagcagcatatatattacctagtgttgctgtaggatctgatgctgtggaagtgcgggttgatttactggaggatccatcttccacgaatggaattccaggcactgatttcttgagtgttcaaattgcacatttgagatcagtggttcatttacctgtaattttcactgtgcgaacagttagtcagggaggtcgcttcccggacgctgcacatgaagaggcactgaaactttataaacttgccgtaaagatgggcatcgaatatatcgacttggaaattgctttccctgatgagcttctacaggaagttaccgaggctaaaggattctcgagaatcatagcttcacatcatgatcctcaaggaactttgtcatggaagaacggtggttggtttcaacattataatagagcccttcagtatggagatatcatcaagcttgttgggtctgccaagagtattgaagataactttgcgcttgcaaaatttaagaagacgatggcggcagctcatgataccccgttgatcgccataaacatgggcgttacgggaaaactgagtcgtgtcctaaacggtttcatgacaccagtttcgcacccgtcattgccattcaaagcagcgcctggccagctttctgctgccgagatcagatcaactttgtcgacccttggagaaatagagccaaagtcattttacctttttggtactcctatctcccaatcgcgatcacctgcgcttcacaacactcttttcaagcagacaggattgcctcatcgatattccagactggaaactgatcgcgttgctgacgtacaagatgtcattcgcgctccagatttcggtggtgcatctgttactattccgctaaaactcgacatcataccacttctcgactcggttaccgatgcagtcaaggttataggagccgtgaataccatcatccctacgccagacaacccacctcgtcttgttggtgagaacaccgactggcttggaatgactcactccctcatgtccgcatctcatacgccatcgcctgtcgactctccttcccctgctctcgtcatcggcgccggaggtacagcacgcgctgctatctacgcccttcactctctcggccactcccccatctatatggtcgcgcgtacgccttccaaactcgacactctgataaattcattcccttcatccttcaacatcatcccactcccaagcaccacctcggccacagaactgactactcctcctgccgtcgcgattagtacgattcctgctgatcgcccgatcgaaagcaatatgcgagaaactctcgccgtcctgctgagacacgagaagaaggacgagggaaaacagagaactttgttggagatggcatacaaaccatctcaaaccccactcatgagaatggcggaagatgctggctgggttgcaattcctggactggaggttttgagtgcacagggatggtatcaggttagtttgttcccttttcacctcctcgtatgttacgaggtaatatttctgaatggttttactaagatatatcgtctagtttcaaaaatggacaagcatccaacctttgtatgttga

SEQ ID NO: 71750 - protein, 1590 aa, Sclerotinia sclerotiorum
MGSTTFENPTRIEILGKEDIIVDFDIWRNFVAEDLLSDLPSSTYVLITDTNLSPLYVPAFQQSFEALAAKSSSTPRLLTYEIPPGENSKSRETKAEIEDWMLSHQCTRDSVIIALGGGVIGDMIGYVAATFMRGVRFVQVPTTLLAMVDSSIGGKTAIDTPLGKNLVGAFWQPQRIYIDLRFLETLPVREFINGMAEVVKTAAIWDEAEFSALEDNANLIMTTIRAKNTDCSTRLGPIRDILKRIVLGSAKTKADVVSADEREGGLRNILNFGHSIGHAFEAILTPQVLHGEAVAIGMVKEAELARHLGVLKPGAVARLVKCIASYGLPTSLADKRIQKLTAGKLCPVDVLLEKMGVDKKNDGRKKKIVLLSAIGKTYEPKASVVEDRSIRVVLSDSVEVRPSVPETLNVEVTPPGSKSISNRALVLAALGTGPCRIKNLLHSDDVEFMLTSIGKLGGATYAWEDAGEVLCVQGKGGDLHASPTELYIGNAGTASRFLTTVVSLCKPSASTKSTILTGNARMKVRPIGPLVDSLRANGVDIEYLEKEHSLPLNVAASGGFTGGDINLAATVSSQYVSSLLMCAPYAKNPVTLRLVGGKPISQLYIDMTTAMMAAFGIHVVRSQTGEHTYHIPQGVYKNPEEYVVESDASSATYPLAVAATSGTTCTIPNIGCKSIQGDARFAIDVLKPTGCKVVQTDYSTTVTGPPIGSLQAIEEVDMEPMTDAFLTASVLGAVAKGTTKIRGIANQRVKECNRIKAMKDELAKFGVTCRELEDGIEVDGVPIKDLKHPAEGIHCYDDHRVAMSFSVLSVAASQPVLIEERECVGKTWPGWWDILSKSFQVELAGKEVKATHSKKIGIPTLPDKSIFIIGMRGAGKTTAGAWAAKILGRPYKDLDVELERISGMSIPDMVRSKGWDFFRAAELDLLKHCLTDQPEKHVFACGGGVVEMPEARELLINFHKSGGIVLLVHRDTEQVMDYLRIDKTRPAYVEDMMGVYSRRKPWFNECSNFQYHSKGSGASALSVAEQDFARFLHHISGKSLHFDEMRNKPQSFFVSLTMPDISGAAYILPSVAVGSDAVEVRVDLLEDPSSTNGIPGTDFLSVQIAHLRSVVHLPVIFTVRTVSQGGRFPDAAHEEALKLYKLAVKMGIEYIDLEIAFPDELLQEVTEAKGFSRIIASHHDPQGTLSWKNGGWFQHYNRALQYGDIIKLVGSAKSIEDNFALAKFKKTMAAAHDTPLIAINMGVTGKLSRVLNGFMTPVSHPSLPFKAAPGQLSAAEIRSTLSTLGEIEPKSFYLFGTPISQSRSPALHNTLFKQTGLPHRYSRLETDRVADVQDVIRAPDFGGASVTIPLKLDIIPLLDSVTDAVKVIGAVNTIIPTPDNPPRLVGENTDWLGMTHSLMSASHTPSPVDSPSPALVIGAGGTARAAIYALHSLGHSPIYMVARTPSKLDTLINSFPSSFNIIPLPSTTSATELTTPPAVAISTIPADRPIESNMRETLAVLLRHEKKDEGKQRTLLEMAYKPSQTPLMRMAEDAGWVAIPGLEVLSAQGWYQVSLFPFHLLVCYEVIFLNGFTKIYRLVSKMDKHPTFVC

SEQ ID NO: 71751 - DNA, 4857 bp, Thanatephorus cucumeris; identical to SEQ ID NO: 22605
  CDS (1)..(4857)

SEQ ID NO: 71752 - protein, 1618 aa, Thanatephorus cucumeris; identical to SEQ ID NO: 22606

SEQ ID NO: 71753 - DNA, 4749 bp, Aspergillus fumigatus
  CDS (1)..(4749)
atgaccggacccacgaaaatcagcatcctgggccaggagagtatagtcgctgactttggtctctggcgcaactatgtcgccaaagacctgattagcggctgtccctctacaacctacgtcctgatcaccgacacgaatatcggatcgatctacacccccggcttccagaagtccttcgaggaggccgccgcctcggtctctccgtctccccgcctattgatctacaatgctcctccaggggaagtctccaagtcgagacagacaaaggcagatatcgaggattggatgttgagtcagagcccgccatgcggccgagatactgtggtcattgcgctgggtggaggggtcattggagacctaacaggtttcgtcgctgcgacctatatgcgcggtgttcgctttgtacaggttcctactacgctgctggctatggtggactcctcgatcggtggaaagacggctattgatacccctttgggaaagaacctgatcggcgcgatctggcaaccgtcaaggatctatattgacctggaattcttggagactcttcccgtcagggagttcatcaacggtatggctgaggttatcaagacagccgccatctctagcgaagaagagttcaccgctctcgaagacaatgccgaaactattttgagcgctgttcggcgtgaggttaagccgggtcaacggcgattcgaggggatcgaggagatcctgaaggcgagaatccttgcgtcggcgcgtcacaaagcctttgttgtttccgcggacgagcgtgaaggaggtctgcgcaaccttctaaactggggtcactcaatcggtcacgctattgaggctattcttactcctcaaatcctccacggagagtgcgttgccattggtatggtcaaggaagcggagttggcgagacatcttggtatcttgaagggtgttgccgtggcccgcattgtcaagtgtattgccgcctacggcttgcctacatctctgaaggactcgcgaattcgcaaactgaccgccggtaaacactgctctgttgaccagattctttttaacatggctttggacaagaagaacgacggtcccaagaaaaaaatcgttcttctgtcagcaatcggtcgcacttacgaaccacgggctagtgttgtgccgaatgaggatattggtgtcgttcttgcccctagtattgaggtgcaccctggcgtatcaacgacctcagaagtggtttgtgcgcctccgggctcgaagagcatctccaaccgagctctggtacttgccgctctcggttcgggcactgtccgtatcaaaaacctgctgcattccgatgacaccgaggtcatgctgaacgccttggaacgccttggcgctgccaccttctcatgggaagaggaaggcgaagtccttgttgtcaatggcaaaggaggtgctcttcaagctcatccttctccgctctacctgggcaacgcgggtacagcatcgcgtttcttgaccactgtcgcaacccttgccactgccagcagcgtcgactcgagcgttcttaccggcaataaccgcatgaagcagagacctattggcgacttggtggatgccctgaccgcaaatggtgcgcagattgagtacgtcgagaacaagggcagtctgccgctcaagatcgccgcctcaggcgggttcaccggtggccaaatcaacctcgccgctaaagtgtcgtcgcaatatgtgtcctccctgctcatgtgcgccccatacgctaaggagcctgtgaccttgaagctggtgggcggtaagcccatctcgcagccttacattgacatgacgacggctatgatgagatctttcggcattgatgtgaagaaatctaccactgaggagcatacctatcacattcctcagggacgttacatcaaccctgcagagtacgttgtggagagcgacgcgagctccgccacctaccccttggcgattgcagcagtcactggcaccacgtgcactattccgaacattggatctaagtctcttcaaggcgacgctcgtttcgccgttgatgttctgagacccatgggttgcactgtggaacagaccgacacgtcgaccaccgttaccggtcccgccgatggtgtcttgcggcctttgcccaacgtcgatatggagcctatgactgatgcattccttggggcgtcggttcttgcggccattgccagaggcaaggactcgaaccacacaactcgcatctatggtatcgcgaaccagcgtgtcaaagaatgtaaccgcattaaggccatgcacgatgagcttgccaagtttggtgtcgtctgtcgggaacacgatgatggacttgagatcgacggcattgaccgctccacccttcggcagccggccggcggcgtattttgctacgatgaccaccgagtcgcgttcagcttcagcgttttatctctcattgcccctaagcccacgctgattctagaaaaagaatgtgtgggtaagacatggcccggctggtgggatactctgcgacagaaattcgccgtcaagctggagggcaaggagctgaaggaagccgagtcacccgttcttacccgtgccgaaaaggcaagtgcgtcggtgttcattatcggtatgcgtggtgctggaaagaccacaagtggacactgggttgcgtctacgctcaagcgacccttcattgatctagacgacgaactcgagcgcatagaaggcatgaccatcccggacatcatcaagcagcgtggctggcaaggtttccgagatgccgagcttaatcttctgcaacgaacgatgaaggagcgcccgaccggccatgttttcgcatgcggcggaggagtagtagagattcctgaagcgagaaagctgcttatcgattggcacaaaaccaaaggaaatgttctgcttatcatgcgcgacatcaagcaggtgatggcattcttgaacatcgataagacccgcccagcttacgttgaggatatgctgggagtgtggctgcgccgcaagccatggttccaggagtgcagcaatattcagtactacagtcagcacgccagcgcaggacttccccgggcgtctgaggactttgcgcgttttatcaagtttgtcacgggactagatgacagcctcggtaccatcaagaagaagcagcattcgttcttcgtgtcgctgactcttcctgacgtgcgtggtgcggatcagatcttggagcaagcatgtgtgggctctgatgctgtcgaattgcgtgtcgatctactggaggatccagactcgtcgaacggcattccgacggtcgattttgttgctgatcaaatttcctacctgcgcagtcgcatcacactgcccgtgatcttcaccattcgcacgaagggacagggtggtcggttccccgacgatgctcatgcggaggcgatgcagctctaccggcttgctgtccggtcagggtgcgagtttgttgatctcgaaattgctttcccagatgagatgctgcgcgcggttactgaaatgaaggggtactcgaagatcatcgcttcgcaccacgaccctaacggcgaactttcgtgggcaaacatgtcctggatgaagtactacaacagggcgctcgagtacggcgatgtgatcaagcttgtaggcgtggctaggaacctcgatgacaacacggctctgaggaagttcaagaactgggccgaagaggctcacgacgtgccactgatcgcgatcaacatgggaggcaacgggcaactgagtcgcatcttgaatggattcatgacaccagtatcgcatcctgctctcccgttcagggctgctccaggccagctgtctgcgaccgatattcgcaagggcctgtcactgatgggcgagatcaagaagaagcgctttgccctctttggaagccctatttccgagtcccgctcgccggcactgcacaacactcttttcgccgagatgggacttccccatgagtacacccggttggagactgccaatgtggaagatgtcaaggacttcatccgcgctcccgacttcggaggagcctcggtgacgattcctctgaaactggatatcatgcccctacttgatgagattactgcggaggccgagatcattggtgccgtgaacaccgtcgtgccagtttccgatggtgagggcaagccgcagcggctggtcggtcacaacaccgactggcagggcatggtccaatgccttcgtaacgcgggcgcctacggagccgacggcagcgccagtgcacttgtggttggtggcggaggcacatcccgcgctgccatctacgctctccaccagatgggtttctctcccatctacattgtgggacggaaccctgccaagctggagagtatggtctccaccttccccaccagctacaacatccaaatcgtcgagggcaacgagaaactggagcatgttccccatgtggcaatcggcaccatccccgccgaccggcccatcgatcccgggatgcgggagattctctgccacatgttcgaacgtgcccaggaggcagacgccgacgcctcccggacaatcgagggatcccctcgcgtactgctggagatggcttacaagccgcgggtgacggcgctgatgcagcttgccgtcgatgcagggtggactactattcctggatggacattactgatggagtacagttccaacattggacgggtattcgccctctctacgaacgtgcacgggtatgttgtgacatcttgttatccggtcgaactatgctaa

SEQ ID NO: 71754 - protein, 1582 aa, Aspergillus fumigatus
MTGPTKISILGQESIVADFGLWRNYVAKDLISGCPSTTYVLITDTNIGSIYTPGFQKSFEEAAASVSPSPRLLIYNAPPGEVSKSRQTKADIEDWMLSQSPPCGRDTVVIALGGGVIGDLTGFVAATYMRGVRFVQVPTTLLAMVDSSIGGKTAIDTPLGKNLIGAIWQPSRIYIDLEFLETLPVREFINGMAEVIKTAAISSEEEFTALEDNAETILSAVRREVKPGQRRFEGIEEILKARILASARHKAFVVSADEREGGLRNLLNWGHSIGHAIEAILTPQILHGECVAIGMVKEAELARHLGILKGVAVARIVKCIAAYGLPTSLKDSRIRKLTAGKHCSVDQILFNMALDKKNDGPKKKIVLLSAIGRTYEPRASVVPNEDIGVVLAPSIEVHPGVSTTSEVVCAPPGSKSISNRALVLAALGSGTVRIKNLLHSDDTEVMLNALERLGAATFSWEEEGEVLVVNGKGGALQAHPSPLYLGNAGTASRFLTTVATLATASSVDSSVLTGNNRMKQRPIGDLVDALTANGAQIEYVENKGSLPLKIAASGGFTGGQINLAAKVSSQYVSSLLMCAPYAKEPVTLKLVGGKPISQPYIDMTTAMMRSFGIDVKKSTTEEHTYHIPQGRYINPAEYVVESDASSATYPLAIAAVTGTTCTIPNIGSKSLQGDARFAVDVLRPMGCTVEQTDTSTTVTGPADGVLRPLPNVDMEPMTDAFLGASVLAAIARGKDSNHTTRIYGIANQRVKECNRIKAMHDELAKFGVVCREHDDGLEIDGIDRSTLRQPAGGVFCYDDHRVAFSFSVLSLIAPKPTLILEKECVGKTWPGWWDTLRQKFAVKLEGKELKEAESPVLTRAEKASASVFIIGMRGAGKTTSGHWVASTLKRPFIDLDDELERIEGMTIPDIIKQRGWQGFRDAELNLLQRTMKERPTGHVFACGGGVVEIPEARKLLIDWHKTKGNVLLIMRDIKQVMAFLNIDKTRPAYVEDMLGVWLRRKPWFQECSNIQYYSQHASAGLPRASEDFARFIKFVTGLDDSLGTIKKKQHSFFVSLTLPDVRGADQILEQACVGSDAVELRVDLLEDPDSSNGIPTVDFVADQISYLRSRITLPVIFTIRTKGQGGRFPDDAHAEAMQLYRLAVRSGCEFVDLEIAFPDEMLRAVTEMKGYSKIIASHHDPNGELSWANMSWMKYYNRALEYGDVIKLVGVARNLDDNTALRKFKNWAEEAHDVPLIAINMGGNGQLSRILNGFMTPVSHPALPFRAAPGQLSATDIRKGLSLMGEIKKKRFALFGSPISESRSPALHNTLFAEMGLPHEYTRLETANVEDVKDFIRAPDFGGASVTIPLKLDIMPLLDEITAEAEIIGAVNTVVPVSDGEGKPQRLVGHNTDWQGMVQCLRNAGAYGADGSASALVVGGGGTSRAAIYALHQMGFSPIYIVGRNPAKLESMVSTFPTSYNIQIVEGNEKLEHVPHVAIGTIPADRPIDPGMREILCHMFERAQEADADASRTIEGSPRVLLEMAYKPRVTALMQLAVDAGWTTIPGWTLLMEYSSNIGRVFALSTNVHGYVVTSCYPVELC

SEQ ID NO: 71755 - DNA, 4761 bp, Emericella nidulans; identical to SEQ ID NO: 22645
  CDS (1)..(4761)

SEQ ID NO: 71756 - protein, 1586 aa, Emericella nidulans; identical to SEQ ID NO: 22646

SEQ ID NO: 71757 - DNA, 4746 bp, Pneumocystis carinii; identical to SEQ ID NO: 22407
  CDS (1)..(4746)

SEQ ID NO: 71758 - protein, 1581 aa, Pneumocystis carinii; identical to SEQ ID NO: 22408

SEQ ID NO: 71759 - DNA, 4722 bp, Schizosaccharomyces pombe; identical to SEQ ID NO: 22409
  CDS (1)..(4722)

SEQ ID NO: 71760 - protein, 1573 aa, Schizosaccharomyces pombe; identical to SEQ ID NO: 22410

SEQ ID NO: 71761 - DNA, 23 bp, Artificial sequence
  primer
atggtgcagttagccaaagtccc

SEQ ID NO: 71762 - DNA, 25 bp, Artificial sequence
  primer
ctactctttcgtaacggcatcaaaa

SEQ ID NO: 71763 - protein, 1745 aa, Artificial sequence
  consensus sequence
  Variant (4)..(6): Xaa in position 4 to 6 is any amino acid
  Variant (7)..(7): Xaa in position 7 is any or no amino acid
  Variant (9)..(26): Xaa in position 9 to 26 is any amino acid
  Variant (27)..(28): Xaa in position 27 to 28 is any or no amino acid
  Variant (30)..(30): Xaa in position 30 is any amino acid
  Variant (34)..(35): Xaa in position 34 to 35 is any amino acid
  Variant (38)..(38): Xaa in position 38 is any amino acid
  Variant (40)..(51): Xaa in position 40 to 51 is any amino acid
  Variant (52)..(53): Xaa in position 52 to 53 is any or no amino acid
  Variant (55)..(62): Xaa in position 55 to 62 is any amino acid
  Variant (63)..(75): Xaa in position 63 to 75 is any or no amino acid
  Variant (79)..(79): Xaa in position 79 is any amino acid
  Variant (81)..(83): Xaa in position 81 to 83 is any amino acid
  Variant (87)..(88): Xaa in position 87 to 88 is any amino acid
  Variant (90)..(90): Xaa in position 90 is any amino acid
  Variant (92)..(92): Xaa in position 92 is any amino acid
  Variant (96)..(97): Xaa in position 96 to 97 is any amino acid
  Variant (100)..(101): Xaa in position 100 to 101 is any amino acid
  Variant (103)..(105): Xaa in position 103 to 105 is any amino acid
  Variant (106)..(107): Xaa in position 106 to 107 is any or no amino acid
  Variant (109)..(109): Xaa in position 109 is any amino acid
  Variant (114)..(115): Xaa in position 114 to 115 is any amino acid
  Variant (117)..(117): Xaa in position 117 is any amino acid
  Variant (125)..(126): Xaa in position 125 to 126 is any amino acid
  Variant (128)..(128): Xaa in position 128 is any amino acid
  Variant (133)..(133): Xaa in position 133 is any amino acid
  Variant (139)..(139): Xaa in position 139 is any amino acid
  Variant (142)..(142): Xaa in position 142 is any amino acid
  Variant (145)..(145): Xaa in position 145 is any amino acid
  Variant (154)..(154): Xaa in position 154 is any amino acid
  Variant (164)..(164): Xaa in position 164 is any amino acid
  Variant (168)..(169): Xaa in position 168 to 169 is any amino acid
  Variant (172)..(173): Xaa in position 172 to 173 is any amino acid
  Variant (176)..(180): Xaa in position 176 to 180 is any amino acid
  Variant (182)..(184): Xaa in position 182 to 184 is any amino acid
  Variant (186)..(186): Xaa in position 186 is any amino acid
  Variant (190)..(190): Xaa in position 190 is any amino acid
  Variant (192)..(192): Xaa in position 192 is any amino acid
  Variant (201)..(201): Xaa in position 201 is any amino acid
  Variant (205)..(205): Xaa in position 205 is any amino acid
  Variant (207)..(210): Xaa in position 207 to 210 is any amino acid
  Variant (213)..(214): Xaa in position 213 to 214 is any amino acid
  Variant (217)..(225): Xaa in position 217 to 225 is any amino acid
  Variant (227)..(244): Xaa in position 227 to 244 is any amino acid
  Variant (245)..(261): Xaa in position 245 to 261 is any or no amino acid
  Variant (263)..(263): Xaa in position 263 is any amino acid
  Variant (265)..(267): Xaa in position 265 to 267 is any amino acid
  Variant (270)..(270): Xaa in position 270 is any amino acid
  Variant (274)..(274): Xaa in position 274 is any amino acid
  Variant (277)..(277): Xaa in position 277 is any amino acid
  Variant (279)..(279): Xaa in position 279 is any amino acid
  Variant (287)..(287): Xaa in position 287 is any amino acid
  Variant (290)..(290): Xaa in position 290 is any amino acid
  Variant (295)..(295): Xaa in position 295 is any amino acid
  Variant (298)..(298): Xaa in position 298 is any amino acid
  Variant (302)..(303): Xaa in position 302 to 303 is any amino acid
  Variant (310)..(310): Xaa in position 310 is any amino acid
  Variant (314)..(314): Xaa in position 314 is any amino acid
  Variant (320)..(320): Xaa in position 320 is any amino acid
  Variant (322)..(322): Xaa in position 322 is any amino acid
  Variant (327)..(330): Xaa in position 327 to 330 is any amino acid
  Variant (332)..(332): Xaa in position 332 is any amino acid
  Variant (334)..(335): Xaa in position 334 to 335 is any amino acid
  Variant (337)..(340): Xaa in position 337 to 340 is any amino acid
  Variant (342)..(342): Xaa in position 342 is any amino acid
  Variant (345)..(345): Xaa in position 345 is any amino acid
  Variant (347)..(348): Xaa in position 347 to 348 is any amino acid
  Variant (350)..(358): Xaa in position 350 to 358 is any amino acid
  Variant (360)..(363): Xaa in position 360 to 363 is any amino acid
  Variant (364)..(365): Xaa in position 364 to 365 is any or no amino acid
  Variant (367)..(368): Xaa in position 367 to 368 is any amino acid
  Variant (370)..(371): Xaa in position 370 to 371 is any amino acid
  Variant (373)..(374): Xaa in position 373 to 374 is any amino acid
  Variant (379)..(379): Xaa in position 379 is any amino acid
  Variant (381)..(382): Xaa in position 381 to 382 is any amino acid
  Variant (384)..(385): Xaa in position 384 to 385 is any amino acid
  Variant (387)..(387): Xaa in position 387 is any amino acid
  Variant (389)..(390): Xaa in position 389 to 390 is any amino acid
  Variant (393)..(394): Xaa in position 393 to 394 is any amino acid
  Variant (396)..(398): Xaa in position 396 to 398 is any amino acid
  Variant (400)..(401): Xaa in position 400 to 401 is any amino acid
  Variant (403)..(409): Xaa in position 403 to 409 is any amino acid
  Variant (412)..(416): Xaa in position 412 to 416 is any amino acid
  Variant (418)..(418): Xaa in position 418 is any amino acid
  Variant (420)..(430): Xaa in position 420 to 430 is any amino acid
  Variant (431)..(432): Xaa in position 431 to 432 is any or no amino acid
  Variant (445)..(445): Xaa in position 445 is any amino acid
  Variant (451)..(451): Xaa in position 451 is any amino acid
  Variant (453)..(454): Xaa in position 453 to 454 is any amino acid
  Variant (456)..(457): Xaa in position 456 to 457 is any amino acid
  Variant (466)..(467): Xaa in position 466 to 467 is any amino acid
  Variant (470)..(470): Xaa in position 470 is any amino acid
  Variant (472)..(474): Xaa in position 472 to 474 is any amino acid
  Variant (476)..(477): Xaa in position 476 to 477 is any amino acid
  Variant (479)..(482): Xaa in position 479 to 482 is any amino acid
  Variant (484)..(485): Xaa in position 484 to 485 is any amino acid
  Variant (488)..(489): Xaa in position 488 to 489 is any amino acid
  Variant (492)..(492): Xaa in position 492 is any amino acid
  Variant (494)..(494): Xaa in position 494 is any amino acid
  Variant (497)..(504): Xaa in position 497 to 504 is any amino acid
  Variant (505)..(506): Xaa in position 505 to 506 is any or no amino acid
  Variant (521)..(521): Xaa in position 521 is any amino acid
  Variant (523)..(524): Xaa in position 523 to 524 is any amino acid
  Variant (526)..(535): Xaa in position 526 to 535 is any amino acid
  Variant (536)..(545): Xaa in position 536 to 545 is any or no amino acid
  Variant (550)..(550): Xaa in position 550 is any amino acid
  Variant (553)..(554): Xaa in position 553 to 554 is any amino acid
  Variant (559)..(559): Xaa in position 559 is any amino acid
  Variant (563)..(563): Xaa in position 563 is any amino acid
  Variant (565)..(566): Xaa in position 565 to 566 is any amino acid
  Variant (569)..(570): Xaa in position 569 to 570 is any amino acid
  Variant (572)..(572): Xaa in position 572 is any amino acid
  Variant (574)..(578): Xaa in position 574 to 578 is any amino acid
  Variant (583)..(587): Xaa in position 583 to 587 is any amino acid
  Variant (588)..(589): Xaa in position 588 to 589 is any or no amino acid
  Variant (591)..(592): Xaa in position 591 to 592 is any amino acid
  Variant (595)..(595): Xaa in position 595 is any amino acid
  Variant (597)..(597): Xaa in position 597 is any amino acid
  Variant (601)..(602): Xaa in position 601 to 602 is any amino acid
  Variant (610)..(610): Xaa in position 610 is any amino acid
  Variant (618)..(619): Xaa in position 618 to 619 is any amino acid
  Variant (620)..(620): Xaa in position 620 is any or no amino acid
  Variant (625)..(625): Xaa in position 625 is any amino acid
  Variant (635)..(635): Xaa in position 635 is any amino acid
  Variant (641)..(642): Xaa in position 641 to 642 is any amino acid
  Variant (645)..(646): Xaa in position 645 to 646 is any amino acid
  Variant (650)..(650): Xaa in position 650 is any amino acid
  Variant (652)..(653): Xaa in position 652 to 653 is any amino acid
  Variant (655)..(655): Xaa in position 655 is any amino acid
  Variant (656)..(660): Xaa in position 656 to 660 is any or no amino acid
  Variant (662)..(664): Xaa in position 662 to 664 is any amino acid
  Variant (667)..(667): Xaa in position 667 is any amino acid
  Variant (670)..(670): Xaa in position 670 is any amino acid
  Variant (672)..(672): Xaa in position 672 is any amino acid
  Variant (674)..(674): Xaa in position 674 is any amino acid
  Variant (677)..(677): Xaa in position 677 is any amino acid
  Variant (680)..(681): Xaa in position 680 to 681 is any amino acid
  Variant (694)..(694): Xaa in position 694 is any amino acid
  Variant (697)..(697): Xaa in position 697 is any amino acid
  Variant (701)..(702): Xaa in position 701 to 702 is any amino acid
  Variant (704)..(704): Xaa in position 704 is any amino acid
  Variant (710)..(710): Xaa in position 710 is any amino acid
  Variant (717)..(717): Xaa in position 717 is any amino acid
  Variant (720)..(721): Xaa in position 720 to 721 is any amino acid
  Variant (724)..(724): Xaa in position 724 is any amino acid
  Variant (729)..(729): Xaa in position 729 is any amino acid
  Variant (731)..(731): Xaa in position 731 is any amino acid
  Variant (734)..(734): Xaa in position 734 is any amino acid
  Variant (740)..(740): Xaa in position 740 is any amino acid
  Variant (743)..(743): Xaa in position 743 is any amino acid
  Variant (744)..(744): Xaa in position 744 is any or no amino acid
  Variant (746)..(746): Xaa in position 746 is any amino acid
  Variant (748)..(751): Xaa in position 748 to 751 is any amino acid
  Variant (752)..(752): Xaa in position 752 is any or no amino acid
  Variant (766)..(766): Xaa in position 766 is any amino acid
  Variant (768)..(768): Xaa in position 768 is any amino acid
  Variant (771)..(777): Xaa in position 771 to 777 is any amino acid
  Variant (778)..(790): Xaa in position 778 to 790 is any or no amino acid
  Variant (792)..(792): Xaa in position 792 is any amino acid
  Variant (806)..(806): Xaa in position 806 is any amino acid
  Variant (809)..(811): Xaa in position 809 to 811 is any amino acid
  Variant (818)..(820): Xaa in position 818 to 820 is any amino acid
  Variant (822)..(823): Xaa in position 822 to 823 is any amino acid
  Variant (826)..(829): Xaa in position 826 to 829 is any amino acid
  Variant (831)..(834): Xaa in position 831 to 834 is any amino acid
  Variant (835)..(836): Xaa in position 835 to 836 is any or no amino acid
  Variant (838)..(839): Xaa in position 838 to 839 is any amino acid
  Variant (841)..(845): Xaa in position 841 to 845 is any amino acid
  Variant (846)..(851): Xaa in position 846 to 851 is any or no amino acid
  Variant (859)..(859): Xaa in position 859 is any amino acid
  Variant (863)..(863): Xaa in position 863 is any amino acid
  Variant (865)..(869): Xaa in position 865 to 869 is any amino acid
  Variant (870)..(879): Xaa in position 870 to 879 is any or no amino acid
  Variant (881)..(882): Xaa in position 881 to 882 is any amino acid
  Variant (884)..(884): Xaa in position 884 is any amino acid
  Variant (886)..(887): Xaa in position 886 to 887 is any amino acid
  Variant (889)..(890): Xaa in position 889 to 890 is any amino acid
  Variant (899)..(899): Xaa in position 899 is any amino acid
  Variant (901)..(909): Xaa in position 901 to 909 is any amino acid
  Variant (911)..(911): Xaa in position 911 is any amino acid
  Variant (913)..(923): Xaa in position 913 to 923 is any amino acid
  Variant (924)..(960): Xaa in position 924 to 960 is any or no amino acid
  Variant (962)..(964): Xaa in position 962 to 964 is any amino acid
  Variant (969)..(969): Xaa in position 969 is any amino acid
  Variant (973)..(973): Xaa in position 973 is any amino acid
  Variant (975)..(979): Xaa in position 975 to 979 is any amino acid
  Variant (981)..(982): Xaa in position 981 to 982 is any amino acid
  Variant (984)..(988): Xaa in position 984 to 988 is any amino acid
  Variant (990)..(990): Xaa in position 990 is any amino acid
  Variant (992)..(994): Xaa in position 992 to 994 is any amino acid
  Variant (996)..(1009): Xaa in position 996 to 1009 is any amino acid
  Variant (1010)..(1011): Xaa in position 1010 to 1011 is any or no amino acid
  Variant (1014)..(1015): Xaa in position 1014 to 1015 is any amino acid
  Variant (1018)..(1019): Xaa in position 1018 to 1019 is any amino acid
  Variant (1021)..(1033): Xaa in position 1021 to 1033 is any amino acid
  Variant (1034)..(1034): Xaa in position 1034 is any or no amino acid
  Variant (1036)..(1036): Xaa in position 1036 is any amino acid
  Variant (1038)..(1040): Xaa in position 1038 to 1040 is any amino acid
  Variant (1044)..(1044): Xaa in position 1044 is any amino acid
  Variant (1047)..(1050): Xaa in position 1047 to 1050 is any amino acid
  Variant (1052)..(1053): Xaa in position 1052 to 1053 is any amino acid
  Variant (1055)..(1061): Xaa in position 1055 to 1061 is any amino acid
  Variant (1063)..(1063): Xaa in position 1063 is any amino acid
  Variant (1066)..(1068): Xaa in position 1066 to 1068 is any amino acid
  Variant (1071)..(1077): Xaa in position 1071 to 1077 is any amino acid
  Variant (1079)..(1080): Xaa in position 1079 to 1080 is any amino acid
  Variant (1082)..(1082): Xaa in position 1082 is any amino acid
  Variant (1083)..(1083): Xaa in position 1083 is any or no amino acid
  Variant (1088)..(1093): Xaa in position 1088 to 1093 is any amino acid
  Variant (1094)..(1095): Xaa in position 1094 to 1095 is any or no amino acid
  Variant (1097)..(1098): Xaa in position 1097 to 1098 is any amino acid
  Variant (1101)..(1102): Xaa in position 1101 to 1102 is any amino acid
  Variant (1104)..(1105): Xaa in position 1104 to 1105 is any amino acid
  Variant (1109)..(1127): Xaa in position 1109 to 1127 is any amino acid
  Variant (1128)..(1146): Xaa in position 1128 to 1146 is any or no amino acid
  Variant (1148)..(1155): Xaa in position 1148 to 1155 is any amino acid
  Variant (1157)..(1166): Xaa in position 1157 to 1166 is any amino acid
  Variant (1167)..(1175): Xaa in position 1167 to 1175 is any or no amino acid
  Variant (1177)..(1177): Xaa in position 1177 is any amino acid
  Variant (1179)..(1180): Xaa in position 1179 to 1180 is any amino acid
  Variant (1183)..(1184): Xaa in position 1183 to 1184 is any amino acid
  Variant (1186)..(1192): Xaa in position 1186 to 1192 is any amino acid
  Variant (1194)..(1198): Xaa in position 1194 to 1198 is any amino acid
  Variant (1200)..(1201): Xaa in position 1200 to 1201 is any amino acid
  Variant (1203)..(1203): Xaa in position 1203 is any amino acid
  Variant (1205)..(1205): Xaa in position 1205 is any amino acid
  Variant (1209)..(1209): Xaa in position 1209 is any amino acid
  Variant (1211)..(1217): Xaa in position 1211 to 1217 is any amino acid
  Variant (1218)..(1228): Xaa in position 1218 to 1228 is any or no amino acid
  Variant (1230)..(1231): Xaa in position 1230 to 1231 is any amino acid
  Variant (1233)..(1235): Xaa in position 1233 to 1235 is any amino acid
  Variant (1238)..(1241): Xaa in position 1238 to 1241 is any amino acid
  Variant (1242)..(1242): Xaa in position 1242 is any or no amino acid
  Variant (1245)..(1247): Xaa in position 1245 to 1247 is any amino acid
  Variant (1249)..(1249): Xaa in position 1249 is any amino acid
  Variant (1252)..(1253): Xaa in position 1252 to 1253 is any amino acid
  Variant (1257)..(1257): Xaa in position 1257 is any amino acid
  Variant (1261)..(1268): Xaa in position 1261 to 1268 is any amino acid
  Variant (1270)..(1276): Xaa in position 1270 to 1276 is any amino acid
  Variant (1278)..(1281): Xaa in position 1278 to 1281 is any amino acid
  Variant (1283)..(1287): Xaa in position 1283 to 1287 is any amino acid
  Variant (1289)..(1304): Xaa in position 1289 to 1304 is any amino acid
  Variant (1306)..(1306): Xaa in position 1306 is any amino acid
  Variant (1308)..(1308): Xaa in position 1308 is any amino acid
  Variant (1311)..(1312): Xaa in position 1311 to 1312 is any amino acid
  Variant (1314)..(1316): Xaa in position 1314 to 1316 is any amino acid
  Variant (1318)..(1321): Xaa in position 1318 to 1321 is any amino acid
  Variant (1322)..(1322): Xaa in position 1322 is any or no amino acid
  Variant (1324)..(1326): Xaa in position 1324 to 1326 is any amino acid
  Variant (1328)..(1329): Xaa in position 1328 to 1329 is any amino acid
  Variant (1331)..(1334): Xaa in position 1331 to 1334 is any amino acid
  Variant (1335)..(1335): Xaa in position 1335 is any or no amino acid
  Variant (1337)..(1338): Xaa in position 1337 to 1338 is any amino acid
  Variant (1340)..(1340): Xaa in position 1340 is any amino acid
  Variant (1343)..(1343): Xaa in position 1343 is any amino acid
  Variant (1345)..(1348): Xaa in position 1345 to 1348 is any amino acid
  Variant (1351)..(1352): Xaa in position 1351 to 1352 is any amino acid
  Variant (1354)..(1354): Xaa in position 1354 is any amino acid
  Variant (1355)..(1355): Xaa in position 1355 is any or no amino acid
  Variant (1357)..(1363): Xaa in position 1357 to 1363 is any amino acid
  Variant (1364)..(1367): Xaa in position 1364 to 1367 is any or no amino acid
  Variant (1372)..(1372): Xaa in position 1372 is any amino acid
  Variant (1374)..(1374): Xaa in position 1374 is any amino acid
  Variant (1376)..(1377): Xaa in position 1376 to 1377 is any amino acid
  Variant (1379)..(1379): Xaa in position 1379 is any amino acid
  Variant (1383)..(1383): Xaa in position 1383 is any amino acid
  Variant (1386)..(1388): Xaa in position 1386 to 1388 is any amino acid
  Variant (1391)..(1392): Xaa in position 1391 to 1392 is any amino acid
  Variant (1394)..(1395): Xaa in position 1394 to 1395 is any amino acid
  Variant (1398)..(1399): Xaa in position 1398 to 1399 is any amino acid
  Variant (1406)..(1417): Xaa in position 1406 to 1417 is any amino acid
  Variant (1419)..(1424): Xaa in position 1419 to 1424 is any amino acid
  Variant (1425)..(1425): Xaa in position 1425 is any or no amino acid
  Variant (1427)..(1429): Xaa in position 1427 to 1429 is any amino acid
  Variant (1431)..(1431): Xaa in position 1431 is any amino acid
  Variant (1434)..(1435): Xaa in position 1434 to 1435 is any amino acid
  Variant (1440)..(1440): Xaa in position 1440 is any amino acid
  Variant (1444)..(1449): Xaa in position 1444 to 1449 is any amino acid
  Variant (1453)..(1458): Xaa in position 1453 to 1458 is any amino acid
  Variant (1461)..(1465): Xaa in position 1461 to 1465 is any amino acid
  Variant (1467)..(1474): Xaa in position 1467 to 1474 is any amino acid
  Variant (1475)..(1478): Xaa in position 1475 to 1478 is any or no amino acid
  Variant (1482)..(1483): Xaa in position 1482 to 1483 is any amino acid
  Variant (1486)..(1486): Xaa in position 1486 is any amino acid
  Variant (1493)..(1502): Xaa in position 1493 to 1502 is any amino acid
  Variant (1504)..(1505): Xaa in position 1504 to 1505 is any amino acid
  Variant (1512)..(1513): Xaa in position 1512 to 1513 is any amino acid
  Variant (1515)..(1520): Xaa in position 1515 to 1520 is any amino acid
  Variant (1521)..(1527): Xaa in position 1521 to 1527 is any or no amino acid
  Variant (1529)..(1529): Xaa in position 1529 is any amino acid
  Variant (1534)..(1534): Xaa in position 1534 is any amino acid
  Variant (1536)..(1553): Xaa in position 1536 to 1553 is any amino acid
  Variant (1554)..(1557): Xaa in position 1554 to 1557 is any or no amino acid
  Variant (1560)..(1560): Xaa in position 1560 is any amino acid
  Variant (1562)..(1562): Xaa in position 1562 is any amino acid
  Variant (1566)..(1566): Xaa in position 1566 is any amino acid
  Variant (1570)..(1571): Xaa in position 1570 to 1571 is any amino acid
  Variant (1575)..(1576): Xaa in position 1575 to 1576 is any amino acid
  Variant (1578)..(1580): Xaa in position 1578 to 1580 is any amino acid
  Variant (1583)..(1585): Xaa in position 1583 to 1585 is any amino acid
  Variant (1587)..(1597): Xaa in position 1587 to 1597 is any amino acid
  Variant (1600)..(1623): Xaa in position 1600 to 1623 is any amino acid
  Variant (1624)..(1629): Xaa in position 1624 to 1629 is any or no amino acid
  Variant (1633)..(1656): Xaa in position 1633 to 1656 is any amino acid
  Variant (1657)..(1668): Xaa in position 1657 to 1668 is any or no amino acid
  Variant (1670)..(1672): Xaa in position 1670 to 1672 is any amino acid
  Variant (1676)..(1677): Xaa in position 1676 to 1677 is any amino acid
  Variant (1679)..(1683): Xaa in position 1679 to 1683 is any amino acid
  Variant (1685)..(1688): Xaa in position 1685 to 1688 is any amino acid
  Variant (1689)..(1707): Xaa in position 1689 to 1707 is any or no amino acid
  Variant (1709)..(1712): Xaa in position 1709 to 1712 is any amino acid
  Variant (1714)..(1716): Xaa in position 1714 to 1716 is any amino acid
  Variant (1718)..(1719): Xaa in position 1718 to 1719 is any amino acid
  Variant (1722)..(1724): Xaa in position 1722 to 1724 is any amino acid
  Variant (1725)..(1740): Xaa in position 1725 to 1740 is any or no amino acid
  Variant (1742)..(1744): Xaa in position 1742 to 1744 is any amino acid
ILGXXXXIXXXXXXXXXXXXXXXXXXXXSXTYVXXTDXNXXXXXXXXXXXXXXFXXXXXXXXXXXXXXXXXXXXXRLLXYXXXPGEXXKXRXTKAXXEDXXLXXXXXCXRDTVXXAXGGGVIGDXXGXVAATXMRGVRXVQXPTXLLAMVDSSXGGKTAIDTPXGKNXXGAXXQPXXXXXDXXXLXTLPXRXFINGMAEVXKTAXIXXXXEFXXLEXXXXXXXXXVXXXXXXXXXXXXXXXXXXXXXXXXXXXXXXXXXXXLXSXXXKAXVVSXDEXEXGLRNLLNXGHXIGHAXEAXLTPXXLHGECVXIGMXKEAELXRXLGILXXXXVXRXXKXXXXYXLPXSXXDXXXXXXXXXKXXXXXXDXXLXXMXXDKKNXGXXKXXVXLXXIGXXYXXXAXXVXXXXXXXVLXXXXXVXPXXXXXXXXXXXXXPPGSKSISNRALXLAALGXGXXRXXNLLHSDDTXXMLXAXXXLXXAXXXXEXXGEXXVVXGXGGXXXXXXXXXXLYLGNAGTASRFLTXVXXLXXXXXXXXXXXXXXXXXXXXLTGNXRMXXRPIGXLVDXLXXNGXXIXYXXXXXSLPLXXXXXXXGXXGGXIXLAAXXSSQYVSSXLMCAPYAXXXPVTLXLVGGKPISQXYIDMTXXMMXXFGIXVXXSXXXXXXTXXXTYXIPXGXYXNPXEYXXESDASSATYPLAXAAXTGTXXTXPNIGSXSLQGDAXFAXXVLXPMGCXVXQTXTSTTVXGPXXGXLXXXXXVDMEPMTDAFLTAXVXAAXXXXXXXXXXXXXXXXXXXXIXGIANQRVKECNRIXAMXXXLAKFGVXXXEXXDGXXXXGXXXXXXLXXPXXXXXXXXXXXYDDHRVAXSFSXLXXXXXXXXXXXXXXXPXXIXEXXCXXKTWPGWWDXLXXXXXXXXXGXEXXXXXXXXXXXXXXXXXXXXXXXXXXXXXXXXXXXXXXXXXXXXXXXXSXXXIGMRXAGKXTXXXXXAXXLXXXXXDXDXXXEXXXXXXXXXXXXXXXXGWXXFRXXEXXXXXXXXXXXXXXGXVXXXGGGXVEXXXXRXXLXXXXXXXGXVLXXXRDXXXXXXXLXXDXXRPAYXXXXXXXXVXXRRXXWXXECSXXXXXXXXXXXXXXXXXXXXXXXXXXXXXXXXXXXXXXFXXXXXXXXGXXXXXXXXXXXXXXXXXXXSXFXXLTXXDXXXXXXXLXXXXXGXXAXEXRVDXLXXXXXXXXXXXXXXXXXXVXXQXXXLRXXXXXLPXXXTXRTXXQGGXFPDXXXXXXXXLXXXXXXXGXXXXDXXXXXPXXXXXXXXXXXXXXXXIXSXHDXXGXXXWXXXXXWXXXYXXAXXXXXDXXKXVGXAXXXXDNXXLXXFXXXXXXXXXXXPLIAXNXGXXGXLSRXLNXXXTPXXHXXLPXXAAPGQLXXXXXXXXXXXXGXXXXXXXFXXXGXPIXXSRSPXLHNXXXXXXGLPXXXXXXETXXXXXVXXXXXXXXXXXXFGGXXVTXPLKLDIXXXXXXXXXXAXXIGAVNTXXPXXXXXXXXXXXXXGXNTDWXGXXXXXXXXXXXXXXXXXXXXXXLVXGXGGTXRAAXXALHXXGXXXIYXXXRXXXXXXXXXXXFPXXXXXXXXXXXXXXXXXXXXXXXXXXXXXXPADXXXXXXXXXXXXXXXXXXXXXXXXXXXXXXXXXXXXLXXXYKPXXTXXXXXAXXXXXXXXXXXXXXXXXXXXXXXWXXXXGXXXLXXQGXXXXXXXXXXXXXXXXXXXFXXXT

SEQ ID NO: 71764 - protein, 58 aa, Artificial sequence
  protein pattern
  Variant (8)..(8): Xaa in position 8 is Leu or Met
  Variant (9)..(9): Xaa in position 9 is any amino acid
  Variant (11)..(11): Xaa in position 11 is Phe or Tyr
  Variant (14)..(14): Xaa in position 14 is Ala or Ser
  Variant (16)..(16): Xaa in position 16 is Phe or Tyr
  Variant (20)..(20): Xaa in position 20 is Leu or Val
  Variant (21)..(21): Xaa in position 21 is Lys or Arg
  Variant (22)..(22): Xaa in position 22 is any amino acid
  Variant (23)..(23): Xaa in position 23 is Ile or Val
  Variant (25)..(25): Xaa in position 25 is Ile or Val
  Variant (28)..(28): Xaa in position 28 is Ser or Thr
  Variant (31)..(31): Xaa in position 31 is Ala or Ser
  Variant (34)..(34): Xaa in position 34 is Asp or Arg
  Variant (36)..(36): Xaa in position 36 is Ala or Ser
  Variant (37)..(37): Xaa in position 37 is Ile, Met or Val
  Variant (38)..(38): Xaa in position 38 is Gly or Val
  Variant (42)..(42): Xaa in position 42 is Ala or Thr
  Variant (43)..(43): Xaa in position 43 is Ile or Val
  Variant (44)..(47): Xaa in position 44 to 47 is any amino acid
  Variant (48)..(48): Xaa in position 48 is Gly or Val
  Variant (50)..(50): Xaa in position 50 is any amino acid
  Variant (51)..(51): Xaa in position 51 is Phe or Leu
  Variant (52)..(52): Xaa in position 52 is Ile or Val
  Variant (54)..(54): Xaa in position 54 is Ala or Ser
  Variant (55)..(55): Xaa in position 55 is Phe or Ile
  Variant (56)..(56): Xaa in position 56 is His, Trp or Tyr
GGGVIGDXXGXVAXTXMRGXXXXQXPTXLLXMVXSXXXGKTXXXXXXXKXXXGXXXQP

SEQ ID NO: 71765 - protein, 60 aa, Artificial sequence
  protein pattern
  Variant (2)..(2): Xaa in position 2 is any amino acid
  Variant (5)..(5): Xaa in position 5 is any amino acid
  Variant (8)..(8): Xaa in position 8 is Thr or Val
  Variant (9)..(9): Xaa in position 9 is Ile or Val
  Variant (15)..(15): Xaa in position 15 is Cys or Ser
  Variant (21)..(21): Xaa in position 21 is Ala or Ser
  Variant (22)..(22): Xaa in position 22 is any amino acid
  Variant (25)..(25): Xaa in position 25 is any amino acid
  Variant (26)..(26): Xaa in position 26 is Ser or Thr
  Variant (28)..(29): Xaa in position 28 to 29 is any amino acid
  Variant (30)..(30): Xaa in position 30 is Cys or Val
  Variant (32)..(32): Xaa in position 32 is Ile or Val
  Variant (37)..(38): Xaa in position 37 to 38 is any amino acid
  Variant (40)..(40): Xaa in position 40 is Ile or Leu
  Variant (44)..(44): Xaa in position 44 is Ala or Ser
  Variant (45)..(45): Xaa in position 45 is Lys or Arg
  Variant (48)..(48): Xaa in position 48 is any amino acid
  Variant (49)..(49): Xaa in position 49 is Asp or Glu
  Variant (52)..(52): Xaa in position 52 is any amino acid
  Variant (53)..(53): Xaa in position 53 is Ala or Pro
  Variant (54)..(54): Xaa in position 54 is any amino acid
  Variant (57)..(57): Xaa in position 57 is any amino acid
  Variant (58)..(58): Xaa in position 58 is Ile or Val
  Variant (59)..(59): Xaa in position 59 is any amino acid
YXNPXEYXXESDASXATYPLXXAAXXGXXXTXPNIGXXSXQGDXXFAXXVLXXXGCXXXQ

SEQ ID NO: 71766 - protein, 59 aa, Artificial sequence
  protein pattern
  Variant (2)..(2): Xaa in position 2 is any amino acid
  Variant (3)..(3): Xaa in position 3 is any or no amino acid
  Variant (5)..(5): Xaa in position 5 is any or no amino acid
  Variant (7)..(7): Xaa in position 7 is Ala or Ser
  Variant (10)..(10): Xaa in position 10 is Lys or Arg
  Variant (12)..(12): Xaa in position 12 is Ala, Gly or Ser
  Variant (13)..(13): Xaa in position 13 is Gly or Ser
  Variant (17)..(17): Xaa in position 17 is Ile or Leu
  Variant (20)..(20): Xaa in position 20 is Phe or Trp
  Variant (23)..(23): Xaa in position 23 is Ser or Thr
  Variant (28)..(28): Xaa in position 28 is any amino acid
  Variant (31)..(31): Xaa in position 31 is Ile, Leu or Val
  Variant (35)..(35): Xaa in position 35 is any amino acid
  Variant (36)..(36): Xaa in position 36 is Ala, Ile, Leu or Val
  Variant (41)..(41): Xaa in position 41 is Ala or Cys
  Variant (43)..(43): Xaa in position 43 is Ala or Ser
  Variant (44)..(44): Xaa in position 44 is Ile or Val
  Variant (47)..(47): Xaa in position 47 is Ile or Val
  Variant (53)..(53): Xaa in position 53 is Ala or Ser
  Variant (55)..(55): Xaa in position 55 is Phe, His or Tyr
  Variant (56)..(56): Xaa in position 56 is Phe, Leu or Met
  Variant (57)..(57): Xaa in position 57 is Gly or Asn
  Variant (58)..(58): Xaa in position 58 is Ile or Val
AXXVXSXDEXEXXLRNXLNXGHXIGHAXEAXLTPXXLHGEXVXXGMXKEAELXRXXXXL

SEQ ID NO: 71767 - protein, 27 aa, Artificial sequence
  protein pattern
  Variant (2)..(2): Xaa in position 2 is any amino acid
  Variant (16)..(16): Xaa in position 16 is any amino acid
  Variant (19)..(20): Xaa in position 19 to 20 is any amino acid
  Variant (21)..(21): Xaa in position 21 is Glu or Gln
IXGIANQRVKECNRIXAMXXXLAKFGV

SEQ ID NO: 71768 - protein, 25 aa, Artificial sequence
  protein pattern
  Variant (3)..(3): Xaa in position 3 is any amino acid
  Variant (4)..(4): Xaa in position 4 is Ile or Val
  Variant (5)..(5): Xaa in position 5 is Glu, Asn or Gln
  Variant (9)..(9): Xaa in position 9 is any amino acid
  Variant (10)..(10): Xaa in position 10 is Ile or Val
  Variant (18)..(18): Xaa in position 18 is Ile or Leu
  Variant (20)..(20): Xaa in position 20 is Leu or Met
  Variant (21)..(21): Xaa in position 21 is Ala or Cys
GGXXXLAAXXSSQYVSSXLXXAPYA

SEQ ID NO: 71769 - protein, 61 aa, Artificial sequence
  protein pattern
  Variant (12)..(12): Xaa in position 12 is Ile or Val
  Variant (17)..(17): Xaa in position 17 is Ala or Gly
  Variant (18)..(18): Xaa in position 18 is any amino acid
  Variant (19)..(19): Xaa in position 19 is Gly or Asn
  Variant (20)..(20): Xaa in position 20 is Pro, Gln or Thr
  Variant (21)..(21): Xaa in position 21 is Cys or Val
  Variant (22)..(22): Xaa in position 22 is Lys or Arg
  Variant (23)..(23): Xaa in position 23 is Ile, Leu or Val
  Variant (24)..(24): Xaa in position 24 is Lys or Arg
  Variant (26)..(26): Xaa in position 26 is any or no amino acid
  Variant (28)..(28): Xaa in position 28 is any or no amino acid
  Variant (33)..(33): Xaa in position 33 is Thr or Val
  Variant (34)..(35): Xaa in position 34 to 35 is any amino acid
  Variant (37)..(37): Xaa in position 37 is Leu or Met
  Variant (38)..(38): Xaa in position 38 is Ala, Asp, Asn, Ser or Thr
  Variant (39)..(39): Xaa in position 39 is Ala, Gly or Ser
  Variant (40)..(40): Xaa in position 40 is Ile, Leu or Val
  Variant (41)..(42): Xaa in position 41 to 42 is any amino acid
  Variant (44)..(44): Xaa in position 44 is any amino acid
  Variant (45)..(45): Xaa in position 45 is any or no amino acid
  Variant (47)..(48): Xaa in position 47 to 48 is any amino acid
  Variant (49)..(49): Xaa in position 49 is Ala, Glu, Ser or Thr
  Variant (50)..(50): Xaa in position 50 is any amino acid
  Variant (51)..(51): Xaa in position 51 is Glu or Gln
  Variant (52)..(52): Xaa in position 52 is Asp, Glu or Asn
  Variant (53)..(53): Xaa in position 53 is Ala, Asp, Glu, Gly or Asn
  Variant (56)..(56): Xaa in position 56 is any amino acid
  Variant (57)..(57): Xaa in position 57 is Ile, Leu or Val
  Variant (58)..(58): Xaa in position 58 is Cys or Val
  Variant (59)..(59): Xaa in position 59 is Leu or Val
  Variant (60)..(60): Xaa in position 60 is any amino acid
PGSKSISNRALXLAALXXXXXXXXNXLXHSDDXXXMXXXXXXLXXAXXXXXXXGEXXXXXG

SEQ ID NO: 71770 - protein, 55 aa, Artificial sequence
  protein pattern
  Variant (2)..(3): Xaa in position 2 to 3 is any amino acid
  Variant (5)..(6): Xaa in position 5 to 6 is any amino acid
  Variant (8)..(8): Xaa in position 8 is any amino acid
  Variant (9)..(9): Xaa in position 9 is Ile, Leu or Val
  Variant (14)..(14): Xaa in position 14 is Asp, Glu or Ser
  Variant (16)..(16): Xaa in position 16 is any amino acid
  Variant (17)..(17): Xaa in position 17 is any or no amino acid
  Variant (19)..(20): Xaa in position 19 to 20 is any amino acid
  Variant (21)..(21): Xaa in position 21 is any or no amino acid
  Variant (23)..(23): Xaa in position 23 is Ile or Leu
  Variant (25)..(25): Xaa in position 25 is Glu or Ser
  Variant (26)..(26): Xaa in position 26 is any amino acid
  Variant (29)..(29): Xaa in position 29 is Asp, Lys or Arg
  Variant (30)..(30): Xaa in position 30 is Cys or Thr
  Variant (31)..(31): Xaa in position 31 is any amino acid
  Variant (32)..(32): Xaa in position 32 is Glu, Gly or Gln
  Variant (33)..(34): Xaa in position 33 to 34 is any amino acid
  Variant (36)..(37): Xaa in position 36 to 37 is any amino acid
  Variant (38)..(38): Xaa in position 38 is Ile or Val
  Variant (39)..(42): Xaa in position 39 to 42 is any amino acid
  Variant (43)..(43): Xaa in position 43 is Ile or Leu
  Variant (44)..(45): Xaa in position 44 to 45 is any amino acid
  Variant (46)..(46): Xaa in position 46 is Ile or Val
  Variant (48)..(48): Xaa in position 48 is Ala, Ser or Thr
  Variant (49)..(49): Xaa in position 49 is any amino acid
  Variant (50)..(50): Xaa in position 50 is Ala, Glu or Ser
  Variant (51)..(52): Xaa in position 51 to 52 is any amino acid
  Variant (54)..(54): Xaa in position 54 is any amino acid
  Variant (55)..(55): Xaa in position 55 is Glu or Pro
DXXLXXMXXDKKNXGXXKXXXVXLXXIGXXXXXXAXXXXXXXXXXXLXXXXXVXX

SEQ ID NO: 71771 - protein, 41 aa, Artificial sequence
  protein pattern
  Variant (2)..(2): Xaa in position 2 is any amino acid
  Variant (3)..(3): Xaa in position 3 is any or no amino acid
  Variant (7)..(7): Xaa in position 7 is any amino acid
  Variant (10)..(11): Xaa in position 10 to 11 is any amino acid
  Variant (15)..(15): Xaa in position 15 is Ala or Gly
  Variant (16)..(16): Xaa in position 16 is Ala, Asp or Pro
  Variant (19)..(19): Xaa in position 19 is Asp or Glu
  Variant (20)..(20): Xaa in position 20 is Ala or Ser
  Variant (22)..(23): Xaa in position 22 to 23 is any amino acid
  Variant (25)..(25): Xaa in position 25 is Gly or Val
  Variant (26)..(27): Xaa in position 26 to 27 is any amino acid
  Variant (28)..(28): Xaa in position 28 is Ile, Leu or Val
  Variant (29)..(29): Xaa in position 29 is Ala, Asp, Glu or Asn
  Variant (30)..(34): Xaa in position 30 to 34 is any amino acid
  Variant (35)..(35): Xaa in position 35 is Ala, Gly, Asn or Ser
  Variant (36)..(36): Xaa in position 36 is Cys or Ser
  Variant (39)..(39): Xaa in position 39 is Ile or Leu
  Variant (40)..(40): Xaa in position 40 is any amino acid
  Variant (41)..(41): Xaa in position 41 is Ile, Leu or Val
VXXTGNXRMXXRPIXXLVXXLXXNXXXXXXXXXXXXLPXXX

SEQ ID NO: 71772 - protein, 29 aa, Artificial sequence
  protein pattern
  Variant (2)..(3): Xaa in position 2 to 3 is any or no amino acid
  Variant (5)..(5): Xaa in position 5 is Lys or Arg
  Variant (6)..(6): Xaa in position 6 is any amino acid
  Variant (7)..(7): Xaa in position 7 is Cys or Thr
  Variant (8)..(8): Xaa in position 8 is Thr or Val
  Variant (9)..(9): Xaa in position 9 is Glu or Gly
  Variant (14)..(14): Xaa in position 14 is Gly or Asn
  Variant (18)..(18): Xaa in position 18 is any amino acid
  Variant (20)..(22): Xaa in position 20 to 22 is any amino acid
  Variant (23)..(23): Xaa in position 23 is Phe, Ile or Leu
  Variant (24)..(26): Xaa in position 24 to 26 is any amino acid
  Variant (27)..(27): Xaa in position 27 is Leu, Met or Val
  Variant (28)..(28): Xaa in position 28 is any amino acid
LXXEXXXXXKTWPXWWDXLXXXXXXXXXG

SEQ ID NO: 71773 - protein, 31 aa, Artificial sequence
  protein pattern
  Variant (2)..(2): Xaa in position 2 is Leu or Met
  Variant (4)..(4): Xaa in position 4 is any amino acid
  Variant (6)..(7): Xaa in position 6 to 7 is any amino acid
  Variant (8)..(8): Xaa in position 8 is any or no amino acid
  Variant (10)..(10): Xaa in position 10 is any or no amino acid
  Variant (13)..(13): Xaa in position 13 is Ala, Gly, Asn, Thr or Val
  Variant (14)..(14): Xaa in position 14 is any amino acid
  Variant (16)..(16): Xaa in position 16 is Asn, Ser or Thr
  Variant (18)..(18): Xaa in position 18 is Ala, Asp, Glu or Gln
  Variant (21)..(21): Xaa in position 21 is Ala, Glu or Gly
  Variant (22)..(22): Xaa in position 22 is Ala, Asp, Glu or Gln
  Variant (23)..(23): Xaa in position 23 is Ile, Leu or Val
  Variant (26)..(26): Xaa in position 26 is Phe, Trp or Tyr
  Variant (27)..(27): Xaa in position 27 is Leu or Met
  Variant (29)..(30): Xaa in position 29 to 30 is any amino acid
  Variant (31)..(31): Xaa in position 31 is Gly, Asn, Gln or Ser
RXLXYXXXPXGEXXKXRXTKXXXEDXXLXXX

SEQ ID NO: 71774 - protein, 35 aa, Artificial sequence
  protein pattern
  Variant (2)..(2): Xaa in position 2 is Ala, Ile or Leu
  Variant (3)..(3): Xaa in position 3 is Ala or Ser
  Variant (4)..(4): Xaa in position 4 is Ile or Val
  Variant (6)..(6): Xaa in position 6 is Ile or Met
  Variant (8)..(8): Xaa in position 8 is any amino acid
  Variant (10)..(10): Xaa in position 10 is any amino acid
  Variant (11)..(11): Xaa in position 11 is Asp or Asn
  Variant (13)..(13): Xaa in position 13 is Ile or Met
  Variant (14)..(17): Xaa in position 14 to 17 is any amino acid
  Variant (18)..(18): Xaa in position 18 is Glu, His or Lys
  Variant (19)..(19): Xaa in position 19 is Ile, Leu or Val
  Variant (20)..(20): Xaa in position 20 is Ser or Thr
  Variant (21)..(22): Xaa in position 21 to 22 is any amino acid
  Variant (24)..(24): Xaa in position 24 is any amino acid
  Variant (25)..(25): Xaa in position 25 is any or no amino acid
  Variant (27)..(27): Xaa in position 27 is any or no amino acid
  Variant (33)..(33): Xaa in position 33 is Ile, Leu or Val
  Variant (34)..(34): Xaa in position 34 is Ile or Val
GXXXTXPXKXXIXXXXXXXXXXAXXIXGAVNTXXP

SEQ ID NO: 71775 - protein, 20 aa, Artificial sequence
  protein pattern
  Variant (12)..(12): Xaa in position 12 is Gly or Thr
  Variant (14)..(14): Xaa in position 14 is Cys or Ser
  Variant (16)..(16): Xaa in position 16 is any amino acid
  Variant (17)..(17): Xaa in position 17 is any or no amino acid
  Variant (19)..(19): Xaa in position 19 is any or no amino acid
VDMEPMTDAFLXAXVXXAXA

SEQ ID NO: 71776 - DNA, 2655 bp, Saccharomyces cerevisiae
  CDS (1)..(2655)
atggaaccatcgaatacccaaaaagaagatcttcctaccgcttttaatggtataaaaagtcaattaaacagcatattaaaatcgaatcaattatttcaagattatgcgctattaaatgggttcttggcatttgttcattccaaattgaatgccgcaatccttacatctatagaatcacaatgtgggaaatcctttgcggctgatcttgattcttttgatcagagcagtatctcttcgattttagatttttcttgggaaagcgttcactatccaatattcaaatggtttcagatgtggaggaattatattctttttgagaaggagaataaaaaacagcagaccaaatttatcgactttagaaagatgaattcgaagatgttaaaattcttcaaaacggtgcaaaacttctatgtcaacgttatcaacacggtttataagaaatatgatatatctgtacttttgccgaaaaggattatccaagacttaaagttaagtgacatcgaaaataccactaatgttggagacattcttgcggtgaagacatttaatagtagtagcccactcgcacatctcatcccaacgcttttccatcgctgtctcttattcttaggaacagcgtatcgttataaaactctcctcgaagaaatttccaataaatacagcatatccaattttaaaaaatctctggacttctttcgtttagcttcgttggtgttaccaagtgctggtgagacgtattcgcaagcaggagcgatattccttcaaacaggaaatttggggattgcagtattcaattttgttaaaggtatgatgacgaagatgccaagccctgtttcaatcaaaaattttggggcattaatggtggacaataaaagttcattaaatcgtagcttgcatactactatcatgaacacttacttacaagaatctaaaggacccaggacacctgctaaagagatactagaattttatttcctgggcctttttgggtctgtttggtcacctaccagttggagagatgatacaaaacctaaccaattaaataacggtatcaagttaaggcatttggaaaatgcactctacgagacgatgtcagcaagatacctgaataatattaagaccatctttcacaatttgatcattacaattggtgggttccatctattattaaaaaggcgttccgatgtaagtgcaaaaaccttgaaggatttacgtagcaatgaattggattacctaaattttgcattcaagtatattgctcacattttaaatgatatcgttaaggaatcatggagcgaaaatcctgaggtttcagaaattctaggtatggtaagaattatcaattgttggataaaagcaaatcccatggttcttcaatattcacaaagtaatctagagtttgttaatgccttggcatacttgataaatgatattgtgaaaaaaaaaccaagtccttcttttagtataacagaacatattcctaaaaggacatactggttcgaagaagacttaatggtgaagggtttatcattcgttaactttcaactatctgattttgacgattatgaaaaaattcttgaaatggatcatagtctcgatagattaattggtaatccgccattatgcgacaagttatcggcatcatctgaaatgctgttaaggttgcaggctgttgtgaatataagttcgcaattattgcagaacaacaactgcggagtagaatggtcagataataaatcacgttatatctttaataagaaaattggatttaaggagaccgttaaaaatagtatgaagacatcgaagcaatccaatgaaaaggccaagttacaaagaaaaaacaaaccttcgaccactaatggctcaatatccatggcggatttggagagacaaatgagaagtagctctttggattctttttctccaactatgggttatagtggttcgtctgtacctatggccccagatacgttcaatgttaagcccagcggtacaataacggggaacaaagtaaatgtagaactgttaaaaatcgaactaagcggtcaaaacgccgatggcgctattacgaatatatctcctggttacagtaacgcagcgatctcttcttcaaattcgacagatgaatcatccttcgatttgaacaacatcctatcttcaatgcaacaaaagcacgcggaaaaatcatttgccaaatccatgcaaggggtgaatgaacaaattccagcgaatgacgtctgccatcaagcccagaggccaatgcaaggtggtctgtattcatcacagcaaccttcatcgatgtcttcattaaactccgcgtatcagaatgcctcgatgcctccatctgcctccatggtatcctatccctatccttttttgaaccagcaggggcaaggggtctttccgccttataatgcacaaaatttacaatggcagagcgaagcttactcattaaagtcaatgaattttgcaaatccaacgtggctaggtgaccagtaccagacatctgcgccgtcgtcagcatatgcgcaagcgcaacggcaaatgtttcaacaacctatgcagcaagatgtggggaagtacatgcaatttccttttgacgcccaaagcaacacggacagcatgaggggaaacagtcggaataatatgttttaa

SEQ ID NO: 71777 - protein, 884 aa, Saccharomyces cerevisiae
MEPSNTQKEDLPTAFNGIKSQLNSILKSNQLFQDYALLNGFLAFVHSKLNAAILTSIESQCGKSFAADLDSFDQSSISSILDFSWESVHYPIFKWFQMWRNYILFEKENKKQQTKFIDFRKMNSKMLKFFKTVQNFYVNVINTVYKKYDISVLLPKRIIQDLKLSDIENTTNVGDILAVKTFNSSSPLAHLIPTLFHRCLLFLGTAYRYKTLLEEISNKYSISNFKKSLDFFRLASLVLPSAGETYSQAGAIFLQTGNLGIAVFNFVKGMMTKMPSPVSIKNFGALMVDNKSSLNRSLHTTIMNTYLQESKGPRTPAKEILEFYFLGLFGSVWSPTSWRDDTKPNQLNNGIKLRHLENALYETMSARYLNNIKTIFHNLIITIGGFHLLLKRRSDVSAKTLKDLRSNELDYLNFAFKYIAHILNDIVKESWSENPEVSEILGMVRIINCWIKANPMVLQYSQSNLEFVNALAYLINDIVKKKPSPSFSITEHIPKRTYWFEEDLMVKGLSFVNFQLSDFDDYEKILEMDHSLDRLIGNPPLCDKLSASSEMLLRLQAVVNISSQLLQNNNCGVEWSDNKSRYIFNKKIGFKETVKNSMKTSKQSNEKAKLQRKNKPSTTNGSISMADLERQMRSSSLDSFSPTMGYSGSSVPMAPDTFNVKPSGTITGNKVNVELLKIELSGQNADGAITNISPGYSNAAISSSNSTDESSFDLNNILSSMQQKHAEKSFAKSMQGVNEQIPANDVCHQAQRPMQGGLYSSQQPSSMSSLNSAYQNASMPPSASMVSYPYPFLNQQGQGVFPPYNAQNLQWQSEAYSLKSMNFANPTWLGDQYQTSAPSSAYAQAQRQMFQQPMQQDVGKYMQFPFDAQSNTDSMRGNSRNNMF

SEQ ID NO: 71778 - DNA, 3072 bp, Candida glabrata CBS 138
  CDS (1)..(3072)
atgaacgcaggcacaatgagtgaatcggaagcattggtctggaatactatcaatgactttcatgaacggttgaatgaaatattaagaacaaatcaaatcacgcatgattatgcacttctcagcgggtttctcacatttgtgcattccaaattattaaaaatgacagagaacaaccttaataagcaaaagcaactgtacaggcaatacaaggaatacccgagtgagatgacagaaatatttgacaatcatactacagtgttgattcttgacgcgttatggggtaagatatactatcctattttcaaatggtttcaaactttgagaaattttattgtacctcgtaaagctggtgaacagccaaagtattttgaatttagaaaaatgagcagcaaaatttcaaaattctataaagaagttcaagctttcttgaattcgatcattagtcttatcctaatggatcccgaaattgaagctactgatggtgttcctcctcaagttttcgtgttcttcaatttgaaaaaaaaagcagctaaggcactacctaaaaagctgagactgtcactcaagtacaatgatccactagcaaatattgttagattggttctacatcggtgcatattatacttgggttcagctcaacggtacaagatcatgtatgaaaaaatttctaatagacactcggttgaagactttgtaaagtccaaagaatattttgatcttgcttctttattgcttccctcctcgggtgaaacgtatctacagagaggtatggtttatattcaaacagataatttgggaactgctgtacaagagtttatcaaaggctctctggctaaatcgccatgtccggctgcgttgtctaattttaagactattatattagaaaatgatagtactctccaccttagattggataaactgatattggatgtacattcccaggatttaaagggcaccaaaatcgtcaatagagaaataattgaactttatttcttagctatatttgggtcgtactttgcaccagatgtctggactaatccgaagaagccaggttttttacggaatgggttagctgttaaaacgcttgaacttactttatatgagaaaattgcttctagatacattaaaaatatcgagacaatttacaacgatctcataataggtataggtggctttaacttgttgcagcttttcggtaatatgggtccagactctagagtaaagatattaaaatcaaacactttgacaagaaatcaattgtcttacctgagtttcgtttttacatatatcactagaattattacagatgtgataaaggaagcctggaatggaaatcatgaggtctacctatacttggcaatgttaagaatcattggatgttggatatttgcaaatgagtctgttctggaatttgctaaatcgaatgttgcattttgtcaagcatatgcagatttattgaatgattttttggctagtggtttggtaagttatggtccagataatagtgtaaagcctaaaaggtcctatctatttgaagaggatatacaactcagagaattgggatttattggtgatgaactggacgactttaatgatacaaagattcacacatcagaagattgtatgacgagattagttggtaaacctcacatggaagataagttgtcacctaaggaagaaaaacttgcacgactctctgccataattgtcacaggtaaacaaatattatcatacaaccagtgtgatatccatttcgataccgaaaaaacgcaatataaaataccagattctggaattccggatatgaagttcaaaaataatgtgcagaagaatggtagaaataaatctggaaagcaaactggtgctgtaaggcactatcaacaagaggtgaaagatactttgaaagaaaagacactcactaagaactaccagcaaagttcgtcaaacttttccaacgctaagggtataattccaaccgagcagaattcttctgttgtttacagtggcatatcggttaaggcgcctagtacctttgacattaagccaagtttccaaatgaagcaacctggtgatacgttagctcaagatcttggaaatttaaatttaaactccccaatggtgaattctgttggtccatcttattatgcgaatactgtcactgggtctgctattcaaaatagtggatcagaaatgagtacgggacacataaatgataggtcagccttaaatgcagaagatgaacacagaaaatatctaaatgaaatattcagaccaaatatgtcaatgtcatctgtggaatccagtagacgaaattcgtccttgaaaggatatttgtcacccaatttatctgctaacatgctaagctcagtggatcaatcaattactacgccaacttctataatggatagccataggtcatcttatggtctacctagctggtcaggctcttcccatactaagggatctgaagtaaatgagttaaattcgggaaatggaataatgactggaaattctttatactatgatggacgtcatatatatccgagctatcactctcgtatgatgtcgatgaactctgaaacaacgattgttccagatgccccttcaccttttgcagaccgtaatagaacaagttttgctgatagtagggggtcaggctatgcagaacagcttctaaattctagtgtgtttcaaaagcagtcatctaataaaataaatgccagaaacttcccgacatcagctcaacagctaaatgtcagtaattcacatcagctaaatcaatcaccaaatctagcgcaagaatatggttatcaaaatagtacaaattccccatatgttaactcaagcacaaacattaatcaaaactatatgacatcaatcggtcctgattctatgtcttctttacatgagggctctcagggatattggccagatcaaaaccggaaagatccacaagccagtgccagttccttccaagcacagtatccatattcaataagaaacggacaacaaccaatggataatgcgttcataaacaccgggtttagcaacgtatatggtccgtctcattag

SEQ ID NO: 71779 - protein, 1023 aa, Candida glabrata CBS 138
MNAGTMSESEALVWNTINDFHERLNEILRTNQITHDYALLSGFLTFVHSKLLKMTENNLNKQKQLYRQYKEYPSEMTEIFDNHTTVLILDALWGKIYYPIFKWFQTLRNFIVPRKAGEQPKYFEFRKMSSKISKFYKEVQAFLNSIISLILMDPEIEATDGVPPQVFVFFNLKKKAAKALPKKLRLSLKYNDPLANIVRLVLHRCILYLGSAQRYKIMYEKISNRHSVEDFVKSKEYFDLASLLLPSSGETYLQRGMVYIQTDNLGTAVQEFIKGSLAKSPCPAALSNFKTIILENDSTLHLRLDKLILDVHSQDLKGTKIVNREIIELYFLAIFGSYFAPDVWTNPKKPGFLRNGLAVKTLELTLYEKIASRYIKNIETIYNDLIIGIGGFNLLQLFGNMGPDSRVKILKSNTLTRNQLSYLSFVFTYITRIITDVIKEAWNGNHEVYLYLAMLRIIGCWIFANESVLEFAKSNVAFCQAYADLLNDFLASGLVSYGPDNSVKPKRSYLFEEDIQLRELGFIGDELDDFNDTKIHTSEDCMTRLVGKPHMEDKLSPKEEKLARLSAIIVTGKQILSYNQCDIHFDTEKTQYKIPDSGIPDMKFKNNVQKNGRNKSGKQTGAVRHYQQEVKDTLKEKTLTKNYQQSSSNFSNAKGIIPTEQNSSVVYSGISVKAPSTFDIKPSFQMKQPGDTLAQDLGNLNLNSPMVNSVGPSYYANTVTGSAIQNSGSEMSTGHINDRSALNAEDEHRKYLNEIFRPNMSMSSVESSRRNSSLKGYLSPNLSANMLSSVDQSITTPTSIMDSHRSSYGLPSWSGSSHTKGSEVNELNSGNGIMTGNSLYYDGRHIYPSYHSRMMSMNSETTIVPDAPSPFADRNRTSFADSRGSGYAEQLLNSSVFQKQSSNKINARNFPTSAQQLNVSNSHQLNQSPNLAQEYGYQNSTNSPYVNSSTNINQNYMTSIGPDSMSSLHEGSQGYWPDQNRKDPQASASSFQAQYPYSIRNGQQPMDNAFINTGFSNVYGPSH

SEQ ID NO: 71780 - DNA, 2709 bp, Kluyveromyces lactis NRRL Y-1140
  CDS (1)..(2709)
atggatcaaaaactgaatactgatttacaggaaaccttttccgggttccaaaaacagttacaatctgtcctggaaaccgatttctttagagatgacagcttgatgaagggcgctattcaaatgatacattcaaaaatcatgcagatgttgcttcagtcgcttataccggaaggccttcatcaagatattactactgacaccggatcaaaaaaatcggagatccgctcgtcagatgcacatcgtattttggacttgacttggaagcacgtccattaccccatattcaagtatttccaaaattggagaaataggaacgttgcagagggttccagaccgaactatgctggtcacaggcaattgaactctattctacaaaaaatcttcccacagatccataaactttactattcaacgctagaacttatattcgcaaattacaaccttactgcattgattccctcggatactagatcgaaattgaacatctcaacgaagaaactgaacgatgatgcttcaaatgttttaaaaccagaggactctttttctattgattgcgtcatggcatcacaaagatgtttactctacatcggatgttcccaaagatataagatcataatggaacatttgtccgacagataccaacaggcagatttccagaaacctctgagatatctggatatcgcttccactatcgtgccatctgtaggagaaactttcttacaaagaggtatctgctacacgcataccaaaaatttcggcaatgcagcttatcaatttgttagaagctctttgtcaagattaccaagtgatgctgggatccccaacttcacaaacttgttaggtgatcccaacggatccctattcaagaaactacttaactccttagatgatttgaaagtgcaggaaactattaaaaaaagaataataaacatggaaattatggagttttatattcttccattaatcggatctcatatcttccctcagacttggaagaataatagacattcagatcgtctgaagcattttcaaactttgcttttcgataagatagaaattaggtacattaagaacatttctatgattttccaagatttgatccttctaataggtagtttccacatgtatcaaatgatcaatggtgtttcttcaaatacaacttcatctgctgcaactattatgcctaatgataaaacactgatgaacgggaacggatccgccaacagtatcaataacagtggcaacagcaatattagaagtatacaatcagaaaccaaatttttagagtttatcttcaagtttttcactcacctcattgataaagtcattatgaaggaatttaaaaactgcgagatgtttcagtatttggcaatggctagaataatgatgtgctggataaaatctcataaaaatgtgctaaaattcgcccatagatcaacttctttctgtcagtctatggtcaacctcacaaacgagttactgtctagtaatgatttgtcgatcagtttcgaacatctacatagaccgaccagagattacttctatgaagaagatatcatgttaaaagaatttggacctacgaaattcactttatctgactttaatgatgaaaagctcttatccatggataacttaccggataggttagttggaaagtcaaagaataagcttaccgcaaaggaagagcactcatcaagagtccaagtcctagtttattcgaacaaaaaattcttagagaaaaattgttgcggtttcaaattagatacggaaaagaagagatacgtccatacagctgttaaaagggttaaagccaactcactgcccaatattgctaaaccagagtccgtaacaaaaagcttctccatcgatggtgctggatcgggaaagatatacccacagaaaaatggattcagtgtggctttcactactagagagaacagtaacgcatcaggtggaagtagtatggacatgtctacatcgccacattatactgaagaagctgtgaaagataacacgactcctgctaaccctgtatggaattacagtggttcttctgctccccaaccgccactgagttttaatgtcacgccatcattttccgtctcaaccacagttgaaagaagtgagaatgaaaaatctttcagtttgtacaataggaccgagatgtcaaatcacggcaacaacagtgctagcacaaatactagcaatggctctgtttcatctcctttttcatctatccatgttcaaagttcgtcctcttcgataccactgtcttccactaacaccaatggcagttctactgattccagagaaaatagtaacggccttaatgaagctcctaaacttaatgtccagaatctgtccactttcaactatttacagaacgcttcgcatgattctcaaataagtatatttgccagggacagtgttgttatgtcatcccaggcgaacaactccgctggtctgtacgaacaagctcaacagagaacatatatgggctcccaatatgcccaattccataatccattcacttcgttctcaccacaatttgacaacttgcaaaatcaagaaaaccatcctcagaattcaactaatatcagaagggactctcaattctttcccaataacaatgtctccattgcaggggatcgtttgccttcaatggctgaaaaggctgatgatcaattcaactttttcttttattcatag

SEQ ID NO: 71781 - protein, 902 aa, Kluyveromyces lactis NRRL Y-1140
MDQKLNTDLQETFSGFQKQLQSVLETDFFRDDSLMKGAIQMIHSKIMQMLLQSLIPEGLHQDITTDTGSKKSEIRSSDAHRILDLTWKHVHYPIFKYFQNWRNRNVAEGSRPNYAGHRQLNSILQKIFPQIHKLYYSTLELIFANYNLTALIPSDTRSKLNISTKKLNDDASNVLKPEDSFSIDCVMASQRCLLYIGCSQRYKIIMEHLSDRYQQADFQKPLRYLDIASTIVPSVGETFLQRGICYTHTKNFGNAAYQFVRSSLSRLPSDAGIPNFTNLLGDPNGSLFKKLLNSLDDLKVQETIKKRIINMEIMEFYILPLIGSHIFPQTWKNNRHSDRLKHFQTLLFDKIEIRYIKNISMIFQDLILLIGSFHMYQMINGVSSNTTSSAATIMPNDKTLMNGNGSANSINNSGNSNIRSIQSETKFLEFIFKFFTHLIDKVIMKEFKNCEMFQYLAMARIMMCWIKSHKNVLKFAHRSTSFCQSMVNLTNELLSSNDLSISFEHLHRPTRDYFYEEDIMLKEFGPTKFTLSDFNDEKLLSMDNLPDRLVGKSKNKLTAKEEHSSRVQVLVYSNKKFLEKNCCGFKLDTEKKRYVHTAVKRVKANSLPNIAKPESVTKSFSIDGAGSGKIYPQKNGFSVAFTTRENSNASGGSSMDMSTSPHYTEEAVKDNTTPANPVWNYSGSSAPQPPLSFNVTPSFSVSTTVERSENEKSFSLYNRTEMSNHGNNSASTNTSNGSVSSPFSSIHVQSSSSSIPLSSTNTNGSSTDSRENSNGLNEAPKLNVQNLSTFNYLQNASHDSQISIFARDSVVMSSQANNSAGLYEQAQQRTYMGSQYAQFHNPFTSFSPQFDNLQNQENHPQNSTNIRRDSQFFPNNNVSIAGDRLPSMAEKADDQFNFFFYS

SEQ ID NO: 71782 - DNA, 2328 bp, Ashbya gossypii
  CDS (1)..(2328)
atgacgctaaccccgatggaggacaaaggcatcattcccaattttaatgatttcaagaggcaattagcggagctgctgcagtcgcgcagcactgtagaagatatcacgttgctacaaggctttttgcagctggtacattcgaagacgcagcagtggcgaggggcggaagggctgccagcgactccggacctgctggacgcagtgtggaaggagatacactacccgatatttaagtggtttcaacaatggcgcgcgcatcttctggaggcggcggaggggggacctcaggagcggacttacatcagcttccggcgcatgaatggcaagctgaacaagatttttaagataatccgccagttctataatgggctggtgcagcagttatttgaccgctacgactttgggaaactgcttcctgcgggcgtaatccgcgagctgaatgtgcagtccggcggtgagctgcagacccttgacgattcgtcctacttcacaattctgtgcgtgatgtcgctgcagcggtgcctattgtaccttggttgctgccatcgctacaagtgctgctgcagcaaactctcgaagcggttccatatttctgattttgacgattcgatgaggtattttatgctcgcgaagcaaattgtaccctctgtcggcgagacgtacctgcaggagggccttgtgtacgtacagacaggaaactatgggcacgctgcctatgctttcatgagggggtctttgtcgcggatgcccacggatgccggtataccaaaccttgagagtatcgttgcggacgcctccagtgggttgtttgcgaagcaccagggtatcttgaaacgcctgcgcagtaaggagtcggactctaataagctcattaatcgagaagtactggaattctactttctagcattgttcagctctgtgtatgcgcctgaaagctggagcaagcagggcagcgatatccgccattgcacagaaattctttttgagaaggtcaggagtcgctatgcgagaaatgttcgcctaattttgcaagatgtcttgttattcattggcggctttgacttagtgataaaaaaggcgaaggcgatggggctcaatcggtccgatacccttccatcaaactgcaccgcatttttggagacggcattcgatttcttcagtcatgtcattgactctgtagtactgaaggagtggcagagcttcgacacttgggagtacctggcgctagttcgggtaatatgtgtctggattaagagccactcaattgtgacgcagtttgcacacaggcatactcagttctgccaatccgttgcgcatttactgaataatattttggcgcatacagagtatcagcaactgatggatgttgaacataggccgaagagagactactttttccaggaagacatcatgttaaaagacttttctgcaataggacacactctcagcgacttcaatgatgtggatcttttccagatggagaatcttcctgacagattggcgggacttgttgatgataagcttaccgccaaggaagaagggctactaaaactacatgcgattgtgttcatcgggaagaaattcctcgcaaataacgatgttaatattgtatggtgcgatgaatcaaagcgcttcaactcccttaaacctgatgtgcccttgaggacatgttcaccgccaaaggcgaaaactccaccaccttcgacatccgactatacacctgcgggcgccaaacaaacgaagaagtccaaaccaaaacgcaacagcaggagagtccagtctttgagtagcctggaggcaaaattgatggaaaggaagggcttaaggcagtctgttgccgaaggcagggtatacagtggatgttctgtccctgctgctccaatgtcgtttgatgttgctccttctgcacatctctaccaagatagggcagctggtaccagcgctacgcaagaggccgcaacttattacaaccaagggtacaacgggcctatgcaattgggttctacagaaatcctgaattctagatctccctcgggcaataatcgtattgccttccatccatcccatcaggcttatatgcaaatgatacaaactcctcagccacaggcatggccaacagcatatggacacaatgcatactattcgcagcccacgcaacatccttatccgatgtcatcgcagcttgcgcaattccagaatggaccaataccatttgttgcaggaccctatgcaatgtacatgcccccgccagggccaggtatggtagtattgaacaatgggcacccaatgattccaaatgaatctccgcctcagcaacactatccataa

SEQ ID NO: 71783 - protein, 775 aa, Ashbya gossypii
MTLTPMEDKGIIPNFNDFKRQLAELLQSRSTVEDITLLQGFLQLVHSKTQQWRGAEGLPATPDLLDAVWKEIHYPIFKWFQQWRAHLLEAAEGGPQERTYISFRRMNGKLNKIFKIIRQFYNGLVQQLFDRYDFGKLLPAGVIRELNVQSGGELQTLDDSSYFTILCVMSLQRCLLYLGCCHRYKCCCSKLSKRFHISDFDDSMRYFMLAKQIVPSVGETYLQEGLVYVQTGNYGHAAYAFMRGSLSRMPTDAGIPNLESIVADASSGLFAKHQGILKRLRSKESDSNKLINREVLEFYFLALFSSVYAPESWSKQGSDIRHCTEILFEKVRSRYARNVRLILQDVLLFIGGFDLVIKKAKAMGLNRSDTLPSNCTAFLETAFDFFSHVIDSVVLKEWQSFDTWEYLALVRVICVWIKSHSIVTQFAHRHTQFCQSVAHLLNNILAHTEYQQLMDVEHRPKRDYFFQEDIMLKDFSAIGHTLSDFNDVDLFQMENLPDRLAGLVDDKLTAKEEGLLKLHAIVFIGKKFLANNDVNIVWCDESKRFNSLKPDVPLRTCSPPKAKTPPPSTSDYTPAGAKQTKKSKPKRNSRRVQSLSSLEAKLMERKGLRQSVAEGRVYSGCSVPAAPMSFDVAPSAHLYQDRAAGTSATQEAATYYNQGYNGPMQLGSTEILNSRSPSGNNRIAFHPSHQAYMQMIQTPQPQAWPTAYGHNAYYSQPTQHPYPMSSQLAQFQNGPIPFVAGPYAMYMPPPGPGMVVLNNGHPMIPNESPPQQHYP

SEQ ID NO: 71784 - DNA, 25 bp, Artificial sequence
  primer
atggaaccatcgaatacccaaaaag

SEQ ID NO: 71785 - DNA, 27 bp, Artificial sequence
  primer
ttaaaacatattattccgactgtttcc

SEQ ID NO: 71786 - protein, 1004 aa, Artificial sequence
  consensus sequence
  Variant (2)..(4): Xaa in position 2 to 4 is any amino acid
  Variant (6)..(11): Xaa in position 6 to 11 is any amino acid
  Variant (12)..(12): Xaa in position 12 is any or no amino acid
  Variant (14)..(15): Xaa in position 14 to 15 is any amino acid
  Variant (17)..(18): Xaa in position 17 to 18 is any amino acid
  Variant (20)..(24): Xaa in position 20 to 24 is any amino acid
  Variant (28)..(43): Xaa in position 28 to 43 is any amino acid
  Variant (44)..(65): Xaa in position 44 to 65 is any or no amino acid
  Variant (68)..(69): Xaa in position 68 to 69 is any amino acid
  Variant (71)..(74): Xaa in position 71 to 74 is any amino acid
  Variant (80)..(80): Xaa in position 80 is any amino acid
  Variant (83)..(84): Xaa in position 83 to 84 is any amino acid
  Variant (86)..(100): Xaa in position 86 to 100 is any amino acid
  Variant (101)..(104): Xaa in position 101 to 104 is any or no amino acid
  Variant (106)..(112): Xaa in position 106 to 112 is any amino acid
  Variant (114)..(173): Xaa in position 114 to 173 is any amino acid
  Variant (174)..(182): Xaa in position 174 to 182 is any or no amino acid
  Variant (185)..(185): Xaa in position 185 is any amino acid
  Variant (187)..(188): Xaa in position 187 to 188 is any amino acid
  Variant (190)..(192): Xaa in position 190 to 192 is any amino acid
  Variant (196)..(201): Xaa in position 196 to 201 is any amino acid
  Variant (203)..(209): Xaa in position 203 to 209 is any amino acid
  Variant (211)..(219): Xaa in position 211 to 219 is any amino acid
  Variant (221)..(224): Xaa in position 221 to 224 is any amino acid
  Variant (227)..(227): Xaa in position 227 is any amino acid
  Variant (231)..(232): Xaa in position 231 to 232 is any amino acid
  Variant (234)..(234): Xaa in position 234 is any amino acid
  Variant (236)..(240): Xaa in position 236 to 240 is any amino acid
  Variant (242)..(242): Xaa in position 242 is any amino acid
  Variant (244)..(244): Xaa in position 244 is any amino acid
  Variant (246)..(246): Xaa in position 246 is any amino acid
  Variant (248)..(250): Xaa in position 248 to 250 is any amino acid
  Variant (252)..(259): Xaa in position 252 to 259 is any amino acid
  Variant (261)..(266): Xaa in position 261 to 266 is any amino acid
  Variant (268)..(278): Xaa in position 268 to 278 is any amino acid
  Variant (280)..(303): Xaa in position 280 to 303 is any amino acid
  Variant (305)..(306): Xaa in position 305 to 306 is any amino acid
  Variant (308)..(308): Xaa in position 308 is any amino acid
  Variant (310)..(310): Xaa in position 310 is any amino acid
  Variant (312)..(315): Xaa in position 312 to 315 is any amino acid
  Variant (317)..(319): Xaa in position 317 to 319 is any amino acid
  Variant (321)..(322): Xaa in position 321 to 322 is any amino acid
  Variant (324)..(336): Xaa in position 324 to 336 is any amino acid
  Variant (337)..(344): Xaa in position 337 to 344 is any or no amino acid
  Variant (346)..(351): Xaa in position 346 to 351 is any amino acid
  Variant (354)..(355): Xaa in position 354 to 355 is any amino acid
  Variant (357)..(359): Xaa in position 357 to 359 is any amino acid
  Variant (361)..(367): Xaa in position 361 to 367 is any amino acid
  Variant (370)..(370): Xaa in position 370 is any amino acid
  Variant (372)..(396): Xaa in position 372 to 396 is any amino acid
  Variant (397)..(425): Xaa in position 397 to 425 is any or no amino acid
  Variant (427)..(429): Xaa in position 427 to 429 is any amino acid
  Variant (431)..(453): Xaa in position 431 to 453 is any amino acid
  Variant (454)..(454): Xaa in position 454 is any or no amino acid
  Variant (456)..(458): Xaa in position 456 to 458 is any amino acid
  Variant (460)..(463): Xaa in position 460 to 463 is any amino acid
  Variant (466)..(470): Xaa in position 466 to 470 is any amino acid
  Variant (472)..(480): Xaa in position 472 to 480 is any amino acid
  Variant (482)..(487): Xaa in position 482 to 487 is any amino acid
  Variant (489)..(489): Xaa in position 489 is any amino acid
  Variant (491)..(507): Xaa in position 491 to 507 is any amino acid
  Variant (509)..(509): Xaa in position 509 is any amino acid
  Variant (511)..(511): Xaa in position 511 is any amino acid
  Variant (513)..(515): Xaa in position 513 to 515 is any amino acid
  Variant (518)..(529): Xaa in position 518 to 529 is any amino acid
  Variant (531)..(531): Xaa in position 531 is any amino acid
  Variant (534)..(534): Xaa in position 534 is any amino acid
  Variant (536)..(546): Xaa in position 536 to 546 is any amino acid
  Variant (547)..(547): Xaa in position 547 is any or no amino acid
  Variant (550)..(550): Xaa in position 550 is any amino acid
  Variant (552)..(555): Xaa in position 552 to 555 is any amino acid
  Variant (556)..(557): Xaa in position 556 to 557 is any or no amino acid
  Variant (560)..(563): Xaa in position 560 to 563 is any amino acid
  Variant (565)..(579): Xaa in position 565 to 579 is any amino acid
  Variant (581)..(582): Xaa in position 581 to 582 is any amino acid
  Variant (584)..(670): Xaa in position 584 to 670 is any amino acid
  Variant (671)..(724): Xaa in position 671 to 724 is any or no amino acid
  Variant (726)..(830): Xaa in position 726 to 830 is any amino acid
  Variant (831)..(951): Xaa in position 831 to 951 is any or no amino acid
  Variant (953)..(975): Xaa in position 953 to 975 is any amino acid
  Variant (976)..(991): Xaa in position 976 to 991 is any or no amino acid
  Variant (993)..(1003): Xaa in position 993 to 1003 is any amino acid
LXXXLXXXXXXXDXXLXXGXXXXXHSKXXXXXXXXXXXXXXXXXXXXXXXXXXXXXXXXXXXXXXLDXXWXXXXYPIFKXFQXXRXXXXXXXXXXXXXXXXXXXRXXXXXXXKXXXXXXXXXXXXXXXXXXXXXXXXXXXXXXXXXXXXXXXXXXXXXXXXXXXXXXXXXXXXXXXXXXXXXRCXLXXGXXXRYKXXXXXXSXXXXXXXFXXXXXXXXXAXXXXPSXGETXXQXGXXXXXTXNXGXAXXXFXXXXXXXXPXXXXXXNXXXXXXXXXXXLXXXXXXXXXXXXXXXXXXXXXXXXEXXEXYXLXXXXSXXXPXXWXXXXXXXXXXXXXXXXXXXXXLXXXXXXRYXXNXXXIXXXXXXXIGXFXXXXXXXXXXXXXXXXXXXXXXXXXXXXXXXXXXXXXXXXXXXXXXXXXXXXXXLXXXFXXXXXXXXXXXXXXXXXXXXXXXXLXXXRXXXXWIXXXXXVXXXXXXXXXFXXXXXXLXNXXXXXXXXXXXXXXXXXPXRXYXXXEDXXXXXXXXXXXXLXDFXDXXXXXXXXXXXXRLXGXXXXXXKLXXXXEXXXXXXXXXXXXXXXLXXNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSXXXXXXXXXXXXXXXXXXXXXXXXXXXXXXXXXXXXXXXPXXXXXXXXXXXP

SEQ ID NO: 71787 - protein, 60 aa, Artificial sequence
  protein pattern
  Variant (2)..(2): Xaa in position 2 is any amino acid
  Variant (3)..(4): Xaa in position 3 to 4 is any or no amino acid
  Variant (6)..(7): Xaa in position 6 to 7 is any or no amino acid
  Variant (9)..(9): Xaa in position 9 is Cys, Ser or Thr
  Variant (10)..(10): Xaa in position 10 is Ala, Cys or Ser
  Variant (11)..(11): Xaa in position 11 is any amino acid
  Variant (15)..(17): Xaa in position 15 to 17 is any amino acid
  Variant (18)..(18): Xaa in position 18 is Glu or Ser
  Variant (19)..(19): Xaa in position 19 is Glu, His or Lys
  Variant (20)..(20): Xaa in position 20 is Ile or Leu
  Variant (22)..(22): Xaa in position 22 is any amino acid
  Variant (23)..(23): Xaa in position 23 is Lys or Arg
  Variant (24)..(24): Xaa in position 24 is Phe, His or Tyr
  Variant (25)..(26): Xaa in position 25 to 26 is any amino acid
  Variant (27)..(27): Xaa in position 27 is Ala, Glu or Ser
  Variant (28)..(28): Xaa in position 28 is Asp or Asn
  Variant (30)..(30): Xaa in position 30 is any amino acid
  Variant (31)..(31): Xaa in position 31 is Asp or Lys
  Variant (32)..(32): Xaa in position 32 is Pro or Ser
  Variant (33)..(33): Xaa in position 33 is any amino acid
  Variant (34)..(34): Xaa in position 34 is Asp, Glu or Arg
  Variant (35)..(35): Xaa in position 35 is Phe or Tyr
  Variant (36)..(36): Xaa in position 36 is Phe or Leu
  Variant (37)..(37): Xaa in position 37 is any amino acid
  Variant (38)..(38): Xaa in position 38 is Ile or Leu
  Variant (40)..(41): Xaa in position 40 to 41 is any amino acid
  Variant (42)..(42): Xaa in position 42 is Ile, Leu or Val
  Variant (43)..(43): Xaa in position 43 is Leu or Val
  Variant (46)..(46): Xaa in position 46 is Ala, Ser or Val
  Variant (50)..(50): Xaa in position 50 is Phe or Tyr
  Variant (51)..(51): Xaa in position 51 is any amino acid
  Variant (53)..(53): Xaa in position 53 is any amino acid
  Variant (55)..(56): Xaa in position 55 to 56 is any amino acid
  Variant (57)..(57): Xaa in position 57 is Phe or Tyr
  Variant (58)..(59): Xaa in position 58 to 59 is any amino acid
CXXXLXXGXXXRYKXXXXXXSXXXXXXXFXXXXXXXXXAXXXXPSXGETXXQXGXXXXXT

SEQ ID NO: 71788 - protein, 21 aa, Artificial sequence
  protein pattern
  Variant (3)..(4): Xaa in position 3 to 4 is any amino acid
  Variant (6)..(7): Xaa in position 6 to 7 is any amino acid
  Variant (8)..(8): Xaa in position 8 is Ile or Val
  Variant (9)..(9): Xaa in position 9 is His or Tyr
  Variant (15)..(18): Xaa in position 15 to 18 is any or no amino acid
  Variant (20)..(20): Xaa in position 20 is any amino acid
  Variant (21)..(21): Xaa in position 21 is Asn or Gln
LDXXWXXXXYPIFKXXXXWXX

SEQ ID NO: 71789 - protein, 42 aa, Artificial sequence
  protein pattern
  Variant (2)..(4): Xaa in position 2 to 4 is any amino acid
  Variant (5)..(5): Xaa in position 5 is any or no amino acid
  Variant (7)..(7): Xaa in position 7 is any amino acid
  Variant (8)..(9): Xaa in position 8 to 9 is any or no amino acid
  Variant (11)..(11): Xaa in position 11 is Ile or Val
  Variant (12)..(12): Xaa in position 12 is Ile or Met
  Variant (13)..(13): Xaa in position 13 is any amino acid
  Variant (14)..(14): Xaa in position 14 is Cys or Val
  Variant (17)..(17): Xaa in position 17 is any amino acid
  Variant (18)..(18): Xaa in position 18 is Ala or Ser
  Variant (19)..(21): Xaa in position 19 to 21 is any amino acid
  Variant (23)..(24): Xaa in position 23 to 24 is any amino acid
  Variant (25)..(25): Xaa in position 25 is Phe or Tyr
  Variant (26)..(26): Xaa in position 26 is Ala or Ser
  Variant (27)..(27): Xaa in position 27 is any amino acid
  Variant (28)..(28): Xaa in position 28 is Arg or Ser
  Variant (29)..(30): Xaa in position 29 to 30 is any amino acid
  Variant (31)..(31): Xaa in position 31 is Ala, Glu, Gln or Ser
  Variant (33)..(33): Xaa in position 33 is Cys or Val
  Variant (34)..(34): Xaa in position 34 is Asn or Gln
  Variant (35)..(35): Xaa in position 35 is Ala or Ser
  Variant (36)..(36): Xaa in position 36 is any amino acid
  Variant (37)..(37): Xaa in position 37 is Ala or Val
  Variant (38)..(38): Xaa in position 38 is any amino acid
  Variant (40)..(40): Xaa in position 40 is any amino acid
  Variant (42)..(42): Xaa in position 42 is Asp, Glu or Asn
EXXXXLXXXRXXXXWIXXXXXVXXXXXXXXXFXXXXXXLXNX

SEQ ID NO: 71790 - protein, 29 aa, Artificial sequence
  protein pattern
  Variant (2)..(2): Xaa in position 2 is any amino acid
  Variant (4)..(4): Xaa in position 4 is Asp, Ser or Thr
  Variant (6)..(6): Xaa in position 6 is any or no amino acid
  Variant (8)..(8): Xaa in position 8 is any amino acid
  Variant (9)..(9): Xaa in position 9 is any or no amino acid
  Variant (12)..(12): Xaa in position 12 is Ile or Leu
  Variant (13)..(13): Xaa in position 13 is any amino acid
  Variant (14)..(14): Xaa in position 14 is Leu or Val
  Variant (15)..(15): Xaa in position 15 is Lys or Arg
  Variant (16)..(16): Xaa in position 16 is Asp, Glu or Gly
  Variant (17)..(17): Xaa in position 17 is Phe or Leu
  Variant (18)..(18): Xaa in position 18 is Gly or Ser
  Variant (19)..(22): Xaa in position 19 to 22 is any amino acid
  Variant (23)..(23): Xaa in position 23 is Glu, Gln or Thr
  Variant (25)..(25): Xaa in position 25 is Asp or Ser
  Variant (28)..(28): Xaa in position 28 is Asp or Asn
PXRXYXFXXEDXXXXXXXXXXXXLXDFXD

SEQ ID NO: 71791 - protein, 32 aa, Artificial sequence
  protein pattern
  Variant (2)..(2): Xaa in position 2 is any amino acid
  Variant (3)..(10): Xaa in position 3 to 10 is any or no amino acid
  Variant (13)..(13): Xaa in position 13 is Ala, Ile or Leu
  Variant (14)..(14): Xaa in position 14 is any amino acid
  Variant (16)..(16): Xaa in position 16 is Ile or Val
  Variant (17)..(18): Xaa in position 17 to 18 is any amino acid
  Variant (20)..(21): Xaa in position 20 to 21 is any amino acid
  Variant (22)..(22): Xaa in position 22 is Asp or Asn
  Variant (23)..(23): Xaa in position 23 is Leu or Val
  Variant (24)..(25): Xaa in position 24 to 25 is Ile or Leu
  Variant (26)..(26): Xaa in position 26 is any amino acid
  Variant (29)..(29): Xaa in position 29 is Gly or Ser
  Variant (31)..(31): Xaa in position 31 is any amino acid
  Variant (32)..(32): Xaa in position 32 is Leu or Met
EXXXXXXXXXRYXXNXXXIXXXXXXXIGXFXX

SEQ ID NO: 71792 - protein, 22 aa, Artificial sequence
  protein pattern
  Variant (2)..(2): Xaa in position 2 is Ile or Val
  Variant (3)..(3): Xaa in position 3 is Ile, Leu or Met
  Variant (5)..(6): Xaa in position 5 to 6 is any or no amino acid
  Variant (8)..(9): Xaa in position 8 to 9 is any or no amino acid
  Variant (11)..(11): Xaa in position 11 is Ala, Gly or Pro
  Variant (12)..(12): Xaa in position 12 is Ile or Leu
  Variant (13)..(13): Xaa in position 13 is Phe or Ile
  Variant (14)..(14): Xaa in position 14 is Gly or Ser
  Variant (16)..(18): Xaa in position 16 to 18 is any amino acid
  Variant (20)..(20): Xaa in position 20 is Asp, Glu, Gln or Thr
  Variant (21)..(21): Xaa in position 21 is Ser, Thr or Val
EXXEXXFXXLXXXXSXXXPXXW

SEQ ID NO: 71793 - protein, 25 aa, Artificial sequence
  protein pattern
  Variant (2)..(2): Xaa in position 2 is any amino acid
  Variant (3)..(3): Xaa in position 3 is any or no amino acid
  Variant (5)..(6): Xaa in position 5 to 6 is any amino acid
  Variant (7)..(7): Xaa in position 7 is any or no amino acid
  Variant (9)..(9): Xaa in position 9 is Ile, Met or Val
  Variant (10)..(10): Xaa in position 10 is Lys or Arg
  Variant (11)..(11): Xaa in position 11 is Gly or Ser
  Variant (12)..(12): Xaa in position 12 is any amino acid
  Variant (13)..(13): Xaa in position 13 is Leu or Met
  Variant (14)..(14): Xaa in position 14 is Ala, Ser or Thr
  Variant (15)..(15): Xaa in position 15 is Lys or Arg
  Variant (16)..(16): Xaa in position 16 is any amino acid
  Variant (18)..(18): Xaa in position 18 is Cys, Ser or Thr
  Variant (19)..(19): Xaa in position 19 is Asp or Pro
  Variant (20)..(20): Xaa in position 20 is Ala or Val
  Variant (21)..(21): Xaa in position 21 is Ala, Gly or Ser
  Variant (22)..(22): Xaa in position 22 is Ile or Leu
  Variant (23)..(23): Xaa in position 23 is any amino acid
  Variant (25)..(25): Xaa in position 25 is Phe or Leu
GXXAXXXFXXXXXXXXPXXXXXXNX

SEQ ID NO: 71794 - protein, 27 aa, Artificial sequence
  protein pattern
  Variant (2)..(5): Xaa in position 2 to 5 is any amino acid
  Variant (7)..(9): Xaa in position 7 to 9 is any amino acid
  Variant (10)..(10): Xaa in position 10 is Lys or Arg
  Variant (11)..(11): Xaa in position 11 is Leu or Val
  Variant (12)..(12): Xaa in position 12 is any amino acid
  Variant (13)..(13): Xaa in position 13 is Ala or Val
  Variant (14)..(14): Xaa in position 14 is Ile, Leu or Val
  Variant (15)..(15): Xaa in position 15 is Ile or Val
  Variant (16)..(17): Xaa in position 16 to 17 is any amino acid
  Variant (18)..(18): Xaa in position 18 is Gly, Asn or Ser
  Variant (19)..(20): Xaa in position 19 to 20 is any amino acid
  Variant (21)..(21): Xaa in position 21 is Phe, Ile or Leu
  Variant (23)..(23): Xaa in position 23 is Ala, Glu, Gln or Ser
  Variant (24)..(24): Xaa in position 24 is any amino acid
  Variant (26)..(26): Xaa in position 26 is any amino acid
  Variant (27)..(27): Xaa in position 27 is Cys or Val
LXXXXEXXXXXXXXXXXXXXXLXXNXX

SEQ ID NO: 71795 - protein, 12 aa, Artificial sequence
  protein pattern
  Variant (2)..(2): Xaa in position 2 is Leu or Met
  Variant (3)..(3): Xaa in position 3 is any amino acid
  Variant (5)..(5): Xaa in position 5 is any amino acid
  Variant (6)..(6): Xaa in position 6 is Ile or Leu
  Variant (7)..(7): Xaa in position 7 is Ala, Gln or Thr
  Variant (8)..(8): Xaa in position 8 is Phe, Leu or Met
  Variant (9)..(9): Xaa in position 9 is Ile or Val
LXXGXXXXXHSK

SEQ ID NO: 71796 - DNA, 1104 bp, Saccharomyces cerevisiae
  CDS (1)..(1104)
atgccgcgaattactcaagagatatcttacaattgcgattatggcgacaatactttcaaccttgctattgatataggaggcactctggctaaagtagtcttctcgcctatacacagtaacaggctgatgttctacaccattgaaacagagaaaattgacaagttcatggaacttctgcattctattatcaaagaacataacaatggatgctatagaatgactcatataattgccactggtggtggcgccttcaagttttatgatttgttgtatgaaaattttcctcaaataaaaggtatatcgaggttcgaagaaatggaaggcttaattcacggtttagactttttcattcatgagattcccgatgaagttttcacttacaacgatcaagatggcgaaaggataatacccaccagttccggcaccatggactcaaaggctatctacccataccttctagtcaatatagggtcgggtgtctcaatattaaaagtcaccgaaccaaacaattttagtagagtaggcggttcttcactgggaggaggaactctttggggcctattatcactaattactggcgctcaaacttatgatcagatgctcgattgggcacaagagggtgacaattctagcgttgatatgctagttggagatatttatggaacagactataataaaattggtctaaagtcgtcagctattgcaagttcatttggtaaagttttccaaaatagaatgacatctaacaaatctttggaaaacaacgaaaataaattatattcctcacatgagtctattgagaaaaacaatggacaaatgtttaagaatcctgatatttgtaaaagtcttctattcgccatctccaacaatattgggcaaatagcttatttgcaagctaaaatcaataatatacagaatatatactttggcggatcttataccagaggacatttgactaccatgaacactttgagctacgctattaatttttggtcacaaggatcaaagcaagcgttttttctcaaacatgaaggctatttgggtgcaatgggtgctttcctaagcgcgtctcgtcattcatctactaagaaaacaagtacgtag

SEQ ID NO: 71797 - protein, 367 aa, Saccharomyces cerevisiae
MPRITQEISYNCDYGDNTFNLAIDIGGTLAKVVFSPIHSNRLMFYTIETEKIDKFMELLHSIIKEHNNGCYRMTHIIATGGGAFKFYDLLYENFPQIKGISRFEEMEGLIHGLDFFIHEIPDEVFTYNDQDGERIIPTSSGTMDSKAIYPYLLVNIGSGVSILKVTEPNNFSRVGGSSLGGGTLWGLLSLITGAQTYDQMLDWAQEGDNSSVDMLVGDIYGTDYNKIGLKSSAIASSFGKVFQNRMTSNKSLENNENKLYSSHESIEKNNGQMFKNPDICKSLLFAISNNIGQIAYLQAKINNIQNIYFGGSYTRGHLTTMNTLSYAINFWSQGSKQAFFLKHEGYLGAMGAFLSASRHSSTKKTST

SEQ ID NO: 71798 - DNA, 2655 bp, Arabidopsis thaliana
  CDS (1)..(2517)
atggcgggtcaagaggatgagtatgatccaattcttgacaataaaagagaagctgaagcaaaatctcaggtttctgttgctgctgataaaaatatggctccttctacttctggtactccgatccacagatcaggctctagacctcagcttgatctaagcaaagccgaaattcaggggaacctcgaggagagagatcccaccattttattgcctaatcagtctgatgatatctctcatttggctcttgatatcggaggttctttgataaagttgttgtatttttcacgacatgaggactactctaatgatgatgataagcggaagaggacgatcaaggagagattgggtattaccaatggcaacttgagaagttatcctgttcttggtggtagacttcattttgtcaagtttgagactcacaaaattaatgagtgcttggattttattcattccaagcagcttcatcgccgagatccttatccttggagttcaaagaccttgcctttggggactggtgttatcaaggtcacaggtggcggggcatttaaatttgcagacttgttcaaggaacggctgggcgttagtattgagaaagaagatgaaatgcattgtcttgtttctggagcaaattttttgctcaaggctattcgacatgaagcctttacgcacatggagggtgagaaagaatttgtacagatagatcccaatgacttgtatccttatcttcttgtgaacgttggatctggtgttagcataatcaaggttgatggtgaaggaaagtttgaacgtgtgagtggaactaatgttggcggtggtacctattggggcttaggaagacttctaacgaagtgcaagagttttgatgaattgctagaactcagccaaaagggagataatagtgccattgacatgctcgttggtgatatttatggtggcatggattactccaagattggtctctctgcttcaacaatagcttctagttttggcaaggcgatatctgaaaataaggaactggacgattacagacctgaagatatttccttgtctctgttgcggatgatttcatacaatattgggcagatatcgtacttgaatgcccttcgctttgggttgaagcgaatattttttggaggatttttcataaggggtcatgcatataccatggatacaatttcatttgctgtacatttctggtctaagggagagatgcaagctatgttcttgagacatgaaggttttctgggtgctctaggtgcgttcatgagctatgagaagcacggattggatgatttaatgtcccatcagttggttgagaggttcccaatgggtgcaccatatactggaggaaatattcacggaccaccactcggtgatttggacgagaagatttcgtggatggagaagtttgtgcgtagaggaactgaaataactgctcctgtaccaatgactccatcaaaaacgactgggcttggagggtttgaagttccatcatccagaggtagtgctttaagatctgacgccagtgctttaaatgttggtgttctccatcttgtgcccacattggaggtgttcccattactagctgatccgaaaacgtactggctcaaagttttgtccgagcatttgccagacctcgttgatacggctgtagcaagtgaaggaggaaccgaggatgcgaaaaggcggggtgatgcttttgctcgtgctttttctgctcatttggcaagattaatggaggagccagctgcatatggaaagctggggctggcaaatctcttggaacttagggaagaatgcttaagagaattccagtttgttgatgcctatagaagcatcaagcaaagggagaacgaggcatcacttgctgttttacctgatttacttgaggagcttgattcgatgagcgaggaggcaaggttgcttacacttatagaaggtgttcttgctgcaaacatatttgactggggatctcgagcatgtgtggatctatatcacaaaggaaccattattgaaatatacagaatgagtcgcaacaagatgcagagaccgtggagggtagacgattttgatgctttcaaagaaaggatgcttggatctggagatgtcattcttgggatgcttcctcttgctcgagagtttctccgtcgagggactgaagttgttctagtggcaaactctcttcctgctcttaacgacgtgaccgctatggaactgcctgatatagtcgctggggctgctaagcactgtgacatcttgaggagagcggcagaaatgggaggcttacttgtggatgcgatggtaaatccaggggatggatcaaagaaggattcaacgtcagcaccattgatggttgttgaaaatggatgtggaagtccttgtatcgacctcagacaagtcagctctgagcttgcagccgctgccaaagacgctgatcttgttgtcttggaaggtatgggaagagcacttcacaccaacttcaacgctcaattccaatgcgaggctctcaaggtttaagcaatggttaaaaatcagagattggctgagaagttgataaaaggaaacatatatgattgtgtatgcagatacgagcctccctcgctttaacaatgttatgtatcatttcttcaacctttagactactgttgtatacag

SEQ ID NO: 71799 - protein, 838 aa, Arabidopsis thaliana
MAGQEDEYDPILDNKREAEAKSQVSVAADKNMAPSTSGTPIHRSGSRPQLDLSKAEIQGNLEERDPTILLPNQSDDISHLALDIGGSLIKLLYFSRHEDYSNDDDKRKRTIKERLGITNGNLRSYPVLGGRLHFVKFETHKINECLDFIHSKQLHRRDPYPWSSKTLPLGTGVIKVTGGGAFKFADLFKERLGVSIEKEDEMHCLVSGANFLLKAIRHEAFTHMEGEKEFVQIDPNDLYPYLLVNVGSGVSIIKVDGEGKFERVSGTNVGGGTYWGLGRLLTKCKSFDELLELSQKGDNSAIDMLVGDIYGGMDYSKIGLSASTIASSFGKAISENKELDDYRPEDISLSLLRMISYNIGQISYLNALRFGLKRIFFGGFFIRGHAYTMDTISFAVHFWSKGEMQAMFLRHEGFLGALGAFMSYEKHGLDDLMSHQLVERFPMGAPYTGGNIHGPPLGDLDEKISWMEKFVRRGTEITAPVPMTPSKTTGLGGFEVPSSRGSALRSDASALNVGVLHLVPTLEVFPLLADPKTYWLKVLSEHLPDLVDTAVASEGGTEDAKRRGDAFARAFSAHLARLMEEPAAYGKLGLANLLELREECLREFQFVDAYRSIKQRENEASLAVLPDLLEELDSMSEEARLLTLIEGVLAANIFDWGSRACVDLYHKGTIIEIYRMSRNKMQRPWRVDDFDAFKERMLGSGDVILGMLPLAREFLRRGTEVVLVANSLPALNDVTAMELPDIVAGAAKHCDILRRAAEMGGLLVDAMVNPGDGSKKDSTSAPLMVVENGCGSPCIDLRQVSSELAAAAKDADLVVLEGMGRALHTNFNAQFQCEALKV

SEQ ID NO: 71800 - DNA, 1059 bp, Eremothecium gossypii
  CDS (1)..(1059)
atgagtaaagacatcgagtatccttgtgctgggtggaaggaggaaggccttctgacaattgccatcgacatcggcggatctctagcgaaacttgtgttcgcgccgcccgagtccaacaaattgatcttcgagacggtggagacggaaaagctggacgaattcatccgtttgctgcacgaggtggtggaacggtacaacaagggcgactatggatcaacaatgattgtggcgacgggcggcggggcgttcaaattctacgacgtgctgctgtcggaatttccgggcgtgtcagatatcctccggctggacgagatggactgcctgacgaaggggttggacttcttcatccacaaggtgccctacgaggtgttcacatacaacgacctggacggcgaaggcacggtggatgcggtggcggatgatgagatgtacccgtacatgctagtgaacataggatccggggtctcgattctgaaggtggagtcgcccaacgagtgcatgcgtgtgggcggctcgtcattgggcggcggcacgttgtggggactactgtcgctaattactggggcgaagacgtacgacgagatgctggcctgggcaaaccagggcaataacgcgaacgtggacatgttggtaggcgacatatacggcaccgactatgcgaagatcggcctgaaatccagtaatattgcatcgtcgttcgggaaggtcttccaacgggagagcgtcaccgcgccctcggcgggcctgacttcggcgtctgcgacctcgacgtgtgagatccgagatcgaaatgagaaattcagcaacgcggatatttccaagtccctcttgtacgcaatctccaacaacatcggccagattgcgtacctgcaggccaagatccacaacgtcaaaaagatatactttggcgggtcttatattcgcggccatttgaccaccatgaacacattgagctacgccataaacttctggtcgaaaggtagtaagcaagccttcttcctgaggcatgaaggctatctgggcgccatgggcgcatttcttgcagcacagaaaaagtag

SEQ ID NO: 71801 - protein, 352 aa, Eremothecium gossypii
MSKDIEYPCAGWKEEGLLTIAIDIGGSLAKLVFAPPESNKLIFETVETEKLDEFIRLLHEVVERYNKGDYGSTMIVATGGGAFKFYDVLLSEFPGVSDILRLDEMDCLTKGLDFFIHKVPYEVFTYNDLDGEGTVDAVADDEMYPYMLVNIGSGVSILKVESPNECMRVGGSSLGGGTLWGLLSLITGAKTYDEMLAWANQGNNANVDMLVGDIYGTDYAKIGLKSSNIASSFGKVFQRESVTAPSAGLTSASATSTCEIRDRNEKFSNADISKSLLYAISNNIGQIAYLQAKIHNVKKIYFGGSYIRGHLTTMNTLSYAINFWSKGSKQAFFLRHEGYLGAMGAFLAAQKK

SEQ ID NO: 71802 - DNA, 1371 bp, Aspergillus fumigatus
  CDS (1)..(1371)
atgtccatgtcctccccaaaatccaattcggtcggcccagatgcggtcgcacctaagcgtgtgaccaactcattcacagagcgaaccggccggcttgaacgagctatcaccaaccctggagctgtcaagatcaacgtcaaaggtgctttcattgtcgacgaagagccccggtcgaaaagtcccgcgtcatcgacggacggcgttcactacgagagccaggatattcgtctacctcatcatactggcctcgtgagccatgtcgctgtcgatattggaggctcgctggcgaagctggtatattttaccaaggaattggactctcctgacaacggtggtcgcctgaatttcatcaactttgagactcaccggatcgatttgtgcattgacttcatccggcaattaaaagatgaacatgagaggctcaatggcccctctagggatgagttgtgtgtcgtcgctacaggaggaggtgcctacaagtactacgataagctgaaagagacgctgaaagtgaacatcatacgggaagacgaaatggaatgcctcataacaggacttgacttctttattaccgagattccgaatgaagtgtttacatacagcgaagccgagccgatgcagtttgccgaggcccgaccggatgtttacccgtacctattagtcaacattggttcaggagtatcaatgatcaaagtatctggcccaaagcaatttgagcgtgtcggtggtactcaccttggcggtggcacattctggggcctgatgtcgttgctgaccggtactcggaactttgacgacatgctggctatggcggaccggggcgacaacagtggggtggacatgttagttggcgatatctatggcatggactatagcaagatcggacttaagagcactgccattgctagtacatttggcaaggtccttcgtttacaaaatgctgccgagcgacatgcggaggatggggaaggtctctgcaatggcggccctgagcaacaaaatggtgaagtcaagtttcgtcatgaagacatgagccgaagcttgctgtatgctatcagtaacaacattgggcagattgcctacttacaatctgagaagcaccaggttaagcacatatactttggaggctcgtttattcgggggcatcaccagacgatgaatacattgtcgtatgccatccgattctggtctaagggtgagaaacaagcctacttcctacgccatgaaggctacctcggcgctgttggtgcatttctcaggaggcaaccagagaactggggtcgcagaaatagtattcatgacgcatcttccgcaattcaggcggcaaaggaagccatccccaagaaagatgaagggttgagctcaacgtag

SEQ ID NO: 71803 - protein, 456 aa, Aspergillus fumigatus
MSMSSPKSNSVGPDAVAPKRVTNSFTERTGRLERAITNPGAVKINVKGAFIVDEEPRSKSPASSTDGVHYESQDIRLPHHTGLVSHVAVDIGGSLAKLVYFTKELDSPDNGGRLNFINFETHRIDLCIDFIRQLKDEHERLNGPSRDELCVVATGGGAYKYYDKLKETLKVNIIREDEMECLITGLDFFITEIPNEVFTYSEAEPMQFAEARPDVYPYLLVNIGSGVSMIKVSGPKQFERVGGTHLGGGTFWGLMSLLTGTRNFDDMLAMADRGDNSGVDMLVGDIYGMDYSKIGLKSTAIASTFGKVLRLQNAAERHAEDGEGLCNGGPEQQNGEVKFRHEDMSRSLLYAISNNIGQIAYLQSEKHQVKHIYFGGSFIRGHHQTMNTLSYAIRFWSKGEKQAYFLRHEGYLGAVGAFLRRQPENWGRRNSIHDASSAIQAAKEAIPKKDEGLSST

SEQ ID NO: 71804 - DNA, 2352 bp, Arabidopsis thaliana
  CDS (1)..(2352)
atggcgggtcaagaggatgagtatgatccaattcttgacaataaaagagaagctgaagcaaaatctcaggtttctgttgctgctgataaaaatatggctccttctacttctggtactccgatccacagatcaggctctagacctcagcttgatctaagcaaagccgaaattcaggggaacctcgaggagagagatcccaccattttattgcctaatcagtctgatgatatctctcatttggctcttgatatcggaggttctttgataaagttgttgtatttttcacgacatgaggactactctaatgatgatgataagcggaagaggacgatcaaggagagattgggtattaccaatggcaacttgagaagttatcctgttcttggtggtagacttcattttgtcaagtttgagactcacaaaattaatgagtgcttggattttattcattccaagcagcttcatcgccgagatccttatccttggagttcaaagaccttgcctttggggactggtgttatcaaggtcacaggtggcggggcatttaaatttgcagacttgttcaaggaacggctgggcgttagtattgagaaagaagatgaaatgcattgtcttgtttctggagcaaattttttgctcaaggctattcgacatgaagcctttacgcacatggagggtgagaaagaatttgtacagatagatcccaatgacttgtatccttatcttcttgtgaacgttggatctggtgttagcataatcaaggttgatggtgaaggaaagtttgaacgtgtgagtggaactaatgttggcggtggtacctattggggcttaggaagacttctaacgaagtgcaagagttttgatgaattgctagaactcagccaaaagggagataatagtgccattgacatgctcgttggtgatatttatggtggcatggattactccaagattggtctctctgcttcaacaatagcttctagttttggcaaggcgatatctgaaaataaggaactggacgattacagacctgaagatatttccttgtctctgttgcggatgatttcatacaatattgggcagatatcgtacttgaatgcccttcgctttgggttgaagcgaatattttttggaggatttttcataaggggtcatgcatataccatggatacaatttcatttgctgtacatttctggtctaagggagagatgcaagctatgttcttgagacatgaaggttttctgggtgctctaggtgcgttcatgagctatgagaagcacggattggatgatttaatgtcccatcagttggttgagaggttcccaatgggtgcaccatatactggaggaaatattcacggaccaccactcggtgatttggacgagaagatttcgtggatggagaagtttgtgcgtagaggaactgaaataactgctcctgtaccaatgactccatcaaaaacgactgggcttggagggtttgaagttccatcatccagaggtagtgctttaagatctgacgccagtgctttaaatgttggtgttctccatcttgtgcccacattggaggtgttcccattactagctgatccgaaaacgtatgagcctaacacgattgatctatcagatcaaggcgaacgagagtactggctcaaagttttgtccgagcatttgccagacctcgttgatacggctgtagcaagtgaaggaggaaccgaggatgcgaaaaggcggggtgatgcttttgctcgtgctttttctgctcatttggcaagattaatggaggagccagctgcatatggaaagctggggctggcaaatctcttggaacttagggaagaatgcttaagagaattccagtttgttgatgcctatagaagcatcaagcaaagggagaacgaggcatcacttgctgttttacctgatttacttgaggagcttgattcgatgagcgaggaggcaaggttgcttacacttatagaaggtgttcttgctgcaaacatatttgactggggatctcgagcatgtgtggatctatatcacaaaggaaccattattgaaatatacagaatgagtcgcaacaagatgcagagaccgtggagggtagacgattttgatgctttcaaagaaaggatgcttggatctggaggtaagcagcctcatcgacataaaagagcattactttttgttgataactcgggagcagatgtcattcttgggatgcttcctcttgctcgagagtttctccgtcgagggactgaagttgttctagtggcaaactctcttcctgctcttaacgacgtgaccgctatggaactgcctgatatagtcgctggggctgctaaggtttaa

SEQ ID NO: 71805 - protein, 783 aa, Arabidopsis thaliana
MAGQEDEYDPILDNKREAEAKSQVSVAADKNMAPSTSGTPIHRSGSRPQLDLSKAEIQGNLEERDPTILLPNQSDDISHLALDIGGSLIKLLYFSRHEDYSNDDDKRKRTIKERLGITNGNLRSYPVLGGRLHFVKFETHKINECLDFIHSKQLHRRDPYPWSSKTLPLGTGVIKVTGGGAFKFADLFKERLGVSIEKEDEMHCLVSGANFLLKAIRHEAFTHMEGEKEFVQIDPNDLYPYLLVNVGSGVSIIKVDGEGKFERVSGTNVGGGTYWGLGRLLTKCKSFDELLELSQKGDNSAIDMLVGDIYGGMDYSKIGLSASTIASSFGKAISENKELDDYRPEDISLSLLRMISYNIGQISYLNALRFGLKRIFFGGFFIRGHAYTMDTISFAVHFWSKGEMQAMFLRHEGFLGALGAFMSYEKHGLDDLMSHQLVERFPMGAPYTGGNIHGPPLGDLDEKISWMEKFVRRGTEITAPVPMTPSKTTGLGGFEVPSSRGSALRSDASALNVGVLHLVPTLEVFPLLADPKTYEPNTIDLSDQGEREYWLKVLSEHLPDLVDTAVASEGGTEDAKRRGDAFARAFSAHLARLMEEPAAYGKLGLANLLELREECLREFQFVDAYRSIKQRENEASLAVLPDLLEELDSMSEEARLLTLIEGVLAANIFDWGSRACVDLYHKGTIIEIYRMSRNKMQRPWRVDDFDAFKERMLGSGGKQPHRHKRALLFVDNSGADVILGMLPLAREFLRRGTEVVLVANSLPALNDVTAMELPDIVAGAAKV

SEQ ID NO: 71806 - DNA, 2706 bp, Arabidopsis thaliana
  CDS (1)..(2706)
atggcgggtcaagaggatgagtatgatccaattcttgacaataaaagagaagctgaagcaaaatctcaggtttctgttgctgctgataaaaatatggctccttctacttctggtactccgatccacagatcaggctctagacctcagcttgatctaagcaaagccgaaattcaggggaacctcgaggagagagatcccaccattttattgcctaatcagtctgatgatatctctcatttggctcttgatatcggaggttctttgataaagttgttgtatttttcacgacatgaggactactctaatgatgatgataagcggaagaggacgatcaaggagagattgggtattaccaatggcaacttgagaagttatcctgttcttggtggtagacttcattttgtcaagtttgagactcacaaaattaatgagtgcttggattttattcattccaagcagcttcatcgccgagatccttatccttggagttcaaagaccttgcctttggggactggtgttatcaaggtcacaggtggcggggcatttaaatttgcagacttgttcaaggaacggctgggcgttagtattgagaaagaagatgaaatgcattgtcttgtttctggagcaaattttttgctcaaggctattcgacatgaagcctttacgcacatggagggtgagaaagaatttgtacagatagatcccaatgacttgtatccttatcttcttgtgaacgttggatctggtgttagcataatcaaggttgatggtgaaggaaagtttgaacgtgtgagtggaactaatgttggcggtggtacctattggggcttaggaagacttctaacgaagtgcaagagttttgatgaattgctagaactcagccaaaagggagataatagtgccattgacatgctcgttggtgatatttatggtggcatggattactccaagattggtctctctgcttcaacaatagcttctagttttggcaaggcgatatctgaaaataaggaactggacgattacagacctgaagatatttccttgtctctgttgcggatgatttcatacaatattgggcagatatcgtacttgaatgcccttcgctttgggttgaagcgaatattttttggaggatttttcataaggggtcatgcatataccatggatacaatttcatttgctgtacatttctggtctaagggagagatgcaagctatgttcttgagacatgaaggttttctgggtgctctaggtgcgttcatgagctatgagaagcacggattggatgatttaatgtcccatcagttggttgagaggttcccaatgggtgcaccatatactggaggaaatattcacggaccaccactcggtgatttggacgagaagatttcgtggatggagaagtttgtgcgtagaggaactgaaataactgctcctgtaccaatgactccatcaaaaacgactgggcttggagggtttgaagttccatcatccagaggtagtgctttaagatctgacgccagtgctttaaatgttggtgttctccatcttgtgcccacattggaggtgttcccattactagctgatccgaaaacgtatgagcctaacacgattgatctatcagatcaaggcgaacgagagtactggctcaaagttttgtccgagcatttgccagacctcgttgatacggctgtagcaagtgaaggaggaaccgaggatgcgaaaaggcggggtgatgcttttgctcgtgctttttctgctcatttggcaagattaatggaggagccagctgcatatggaaagctggggctggcaaatctcttggaacttagggaagaatgcttaagagaattccagtttgttgatgcctatagaagcatcaagcaaagggagaacgaggcatcacttgctgttttacctgatttacttgaggagcttgattcgatgagcgaggaggcaaggttgcttacacttatagaaggtgttcttgctgcaaacatatttgactggggatctcgagcatgtgtggatctatatcacaaaggaaccattattgaaatatacagaatgagtcgcaacaagatgcagagaccgtggagggtagacgattttgatgctttcaaagaaaggatgcttggatctggaggtaagcagcctcatcgacataaaagagcattactttttgttgataactcgggagcagatgtcattcttgggatgcttcctcttgctcgagagtttctccgtcgagggactgaagttgttctagtggcaaactctcttcctgctcttaacgacgtgaccgctatggaactgcctgatatagtcgctggggctgctaagcactgtgacatcttgaggagagcggcagaaatgggaggcttacttgtggatgcgatggtaaatccaggggatggatcaaagaaggattcaacgtcagcaccattgatggttgttgaaaatggatgtggaagtccttgtatcgacctcagacaagtcagctctgagcttgcagccgctgccaaagacgctgatcttgttgtcttggaaggtatgggaagagcacttcacaccaacttcaacgctcaattccaatgcgaggctctcaagctagcaatggttaaaaatcagagattggctgagaagttgataaaaggaaacatatatgattgtgtatgcagatacgagcctccctcgctttaa

SEQ ID NO: 71807 - protein, 901 aa, Arabidopsis thaliana [sequence omitted]

SEQ ID NO: 71808 - DNA, 1212 bp, Schizosaccharomyces pombe 972h-
  CDS (1)..(1212)
atgagtgaaacagaatgcggaaggttcagtacaattagcagagaaacaatatcaaatgttgagcggcagttatctcaacctccttcggtatggttaaatctgacaggtgcacggatcatagagaatgaaggacaattcgataaagacattgccttacctaacaacaaatcacatgtaactcatattgcagttgatattggaggttcgttagctaaagtaatgtactatgtttgtgaaagcagttcacctagttcttcttcttcaagtatatctgaagccgaaaactatacgggtggtaggctttcgtttatgatttttgaaacagcaaagattgaagattgtattcaatttatggcgaacttaattgacaatcacgttaagaattgtaacaaaaaaaagattacattgatagctactggcggtggggcatataaattctacgataggatgtctaaacaattggacatcaaggttattagagaagatgagatggaatgtttgattatgggccttaactattttgtttcgtgtataccaagagaagtttttgtgttggacttggatacgtgcgaattaacatttcaaaaccatctgaattgctatcattacccgcacatgcttgtcaacattgggtcgggtgtcagcattcttaaggttactggtccatcacagtttgaacgaattggtggttcgtctttaggagggggaacgctttggggattgttgtcgttgttgacaccagcaaactcgtttgacgagatgttagagttgtccaagggaggagataacacaagtgtggatatgcttgtaggagatatttatggaaaggatatcggctacgaacgatttggactaaaaagcaccactattgctagttcatttggaaaagtgtttcgtgaaagaaaaccgttggaagagtttgcgcctcaggatatttccaggtctttactactggccattagcaacaacattgggcaaattgcttatttgcacgcgcaaaagcacaatgttcaaaacatctactttggcggcagcttcatccgcaaccacgttcaaactatgcacacgttgacatatgccattcagtattggagcaaccataccatgaatgcatattttttaagacatgaaggctacttgggggtgtttggagcgttcatgaagtatgcgacctctcagcccagcaacgttcctgttccctcaatatcgtag

SEQ ID NO: 71809 - protein, 403 aa, Schizosaccharomyces pombe 972h-
MSETECGRFSTISRETISNVERQLSQPPSVWLNLTGARIIENEGQFDKDIALPNNKSHVTHIAVDIGGSLAKVMYYVCESSSPSSSSSSISEAENYTGGRLSFMIFETAKIEDCIQFMANLIDNHVKNCNKKKITLIATGGGAYKFYDRMSKQLDIKVIREDEMECLIMGLNYFVSCIPREVFVLDLDTCELTFQNHLNCYHYPHMLVNIGSGVSILKVTGPSQFERIGGSSLGGGTLWGLLSLLTPANSFDEMLELSKGGDNTSVDMLVGDIYGKDIGYERFGLKSTTIASSFGKVFRERKPLEEFAPQDISRSLLLAISNNIGQIAYLHAQKHNVQNIYFGGSFIRNHVQTMHTLTYAIQYWSNHTMNAYFLRHEGYLGVFGAFMKYATSQPSNVPVPSIS

SEQ ID NO: 71810 - DNA, 1059 bp, Eremothecium gossypii
  CDS (1)..(1059)
atgagtaaagacatcgagtatccttgtgctgggtggaaggaggaaggccttctgacaattgccatcgacatcggcggatctctagcgaaacttgtgttcgcgccgcccgagtccaacaaattgatcttcgagacggtggagacggaaaagctggacgaattcatccgtttgctgcacgaggtggtggaacggtacaacaagggcgactatggatcaacaatgattgtggcgacgggcggcggggcgttcaaattctacgacgtgctgctgtcggaatttccgggcgtgtcagatatcctccggctggacgagatggactgcctgacgaaggggttggacttcttcatccacaaggtgccctacgaggtgttcacatacaacgacctggacggcgaaggcacggtggatgcggtggcggatgatgagatgtacccgtacatgctagtgaacataggatccggggtctcgattctgaaggtggagtcgcccaacgagtgcatgcgtgtgggcggctcgtcattgggcggcggcacgttgtggggactactgtcgctaattactggggcgaagacgtacgacgagatgctggcctgggcaaaccagggcaataacgcgaacgtggacatgttggtaggcgacatatacggcaccgactatgcgaagatcggcctgaaatccattaatattgcatcgtcgttcgggaaggtcttccaacgggagatcgtcaccgcgccctcgacgggcctgacttcggcgtctgcgacctcgacgtgtgagatccgagatcgaaatgagaaattcagcaacgcggatatttccaagtccctcttgtacgcaatctccaacaacatcggccagattgcgtacctgcaggccaagatccacaacgtcaaaaagatatactttggcgggtcttatattcgcggccatttgaccaccatgaacacattgagctacgccataaacttctggtcgaaaggtagtaagcaagccttcttcctgaggcatgaaggctatctgggcgccatgggcgcatttcttgcagcacagaaaaagtag

SEQ ID NO: 71811 - protein, 352 aa, Eremothecium gossypii
MSKDIEYPCAGWKEEGLLTIAIDIGGSLAKLVFAPPESNKLIFETVETEKLDEFIRLLHEVVERYNKGDYGSTMIVATGGGAFKFYDVLLSEFPGVSDILRLDEMDCLTKGLDFFIHKVPYEVFTYNDLDGEGTVDAVADDEMYPYMLVNIGSGVSILKVESPNECMRVGGSSLGGGTLWGLLSLITGAKTYDEMLAWANQGNNANVDMLVGDIYGTDYAKIGLKSINIASSFGKVFQREIVTAPSTGLTSASATSTCEIRDRNEKFSNADISKSLLYAISNNIGQIAYLQAKIHNVKKIYFGGSYIRGHLTTMNTLSYAINFWSKGSKQAFFLRHEGYLGAMGAFLAAQKK

SEQ ID NO: 71812 - DNA, 1551 bp, Gibberella zeae PH-1
  CDS (1)..(1551)
atgacgcccgccttggaacacgaagatgccattgcgcaagatcctcaagcgccggcgcattcatcaaaccacaagcatcgcagaaccatgacatcgaccgacgagatagacagcaccattatccgacctggcagtgtcaaaatcaatgtcaagggcgcctttatcgtcgaccccgacactgcgacgccagcatcgacttcaggcgcaagcgctggtgctgtcaattcgatcaacggccgaatgagtccgacgcatcccgagacgagcgacattcgacttccatatcacactgccattgtgagccacattgcgattgacattggtggttcacttatcaaggtcgtctacttttcacgtgaggttgattccacagatcctggtggccggttgaactttcaaagcttcgagacggatcgcatcgatgactgtgtcgagtttatgcgccatttgcgcgataaccagcttgtgaatggctcgcaaccaggagagctatgtgtgatggctacaggtggtggcgcatacaagtattatgacaagattcgggcggctttggaagtagatgtgtcgcaggaggacgaaatggagtgtcttattattggccttgacttcttcatcaccgaaatcccccgcgaggtctttacctactccgaaacggaccctatgcacttcgttgtgccacaagaaaacatctatccttatctccttgtcaacatcggctcgggagtttcattccttaaggttactggaccacgatcataccagagagttggcggcacatcgcttggtggcggtaccctctggggtctattgtcgctactgacaggggcgcgaacatttgacgagatgcttgaacaagctgcccatggtgacaacgccaatgtcgatatgttggttggcgacatttatggaacagactatggcaagattgggctgaagagtacgaccattgcctcatctttcggcaaggtctttcgaatgaagagagaagccgaatcagcagcggaagatggtagatcggcgacaccagaagatgcatcctttaacagtgccgatgtgtcacgttctctactctacgcgatatccaacaacattggccagatcgcctatcttcaatcacaaatccacaacctatccaacatctactttggtgggtccttcatcagaggccatcgacaaactatcaacacactaagttacgccatcaaattctggagtaagggagagaagcaagcatacttcctccgacacgagggttatcttggctcagtaggtgcctttctcaagaggaagccgaagaactggggtcggaagggcagtcttgagggaatggacgacattgctgagttgcggaggagtcttcgtgacggtgctccaagctccagcggaacggaatggttgatggcaaacatggttggtggtacaatcacaggtagcattggcggcgtacaatcaggcgttatttatttcgggacggagcatagtctttcttctgtgggttctagcgtactatacaaggaaaccatcggtgatatccgaggacatttcatttga

SEQ ID NO: 71813 - protein, 516 aa, Gibberella zeae PH-1
MTPALEHEDAIAQDPQAPAHSSNHKHRRTMTSTDEIDSTIIRPGSVKINVKGAFIVDPDTATPASTSGASAGAVNSINGRMSPTHPETSDIRLPYHTAIVSHIAIDIGGSLIKVVYFSREVDSTDPGGRLNFQSFETDRIDDCVEFMRHLRDNQLVNGSQPGELCVMATGGGAYKYYDKIRAALEVDVSQEDEMECLIIGLDFFITEIPREVFTYSETDPMHFVVPQENIYPYLLVNIGSGVSFLKVTGPRSYQRVGGTSLGGGTLWGLLSLLTGARTFDEMLEQAAHGDNANVDMLVGDIYGTDYGKIGLKSTTIASSFGKVFRMKREAESAAEDGRSATPEDASFNSADVSRSLLYAISNNIGQIAYLQSQIHNLSNIYFGGSFIRGHRQTINTLSYAIKFWSKGEKQAYFLRHEGYLGSVGAFLKRKPKNWGRKGSLEGMDDIAELRRSLRDGAPSSSGTEWLMANMVGGTITGSIGGVQSGVIYFGTEHSLSSVGSSVLYKETIGDIRGHFI

SEQ ID NO: 71814 - DNA, 1116 bp, Candida glabrata CBS 138
  CDS (1)..(1116)
atgacgctgatgcggttcaaggactgtgactacagtcgtaggctgtttaccattgctatagacataggtggctcattgatcaaagtggtttactcgccgctggatagccaggtgattcatttcgctactgtggagacggctaaagtgagtaagttgctcgagctgcttgacgatgtgatacaggaacacaacagcggtgactttagcagtacccagatagtggcgactggtggtggtgctttcaagtacaatgacctaattatagagacattcccaggtatacatagctacacaaagtttgaagaaatgcaaggccttgccaagggtctggatttctttatacaccaggtgcctgacgaggttttcacatacagtgaccacgaaggtgagaagatagttgagaccattgcctcttctcccacagcgaaaccaaccatatacccatacatgcttgtcaacatcggctcaggtgtctcgatgctaaaggtcgatgcacctaacgtctttacgcgggttggtggctcttctttaggtggtggtacgctttgggggttgttgtctctaatcacaggcgctcaaagttatgatgagatgttgaactgggcacaggaaggtgataatactactgtagatatgttagtgggtgatatatatggaacagattacaataagattggtctgaagtctacgcatattgctagttcatttgggaaagttttccaagatcgcgatcatcctatgatcaatggcaattcgaaacatcggatcagacaagaagaaattgatcatctagaggatcacgcaaaggataaccacacctgtaacgagtgcataaatcataggaataagaagtttaagaatgaggatatttgcaaaagtttactttatgctgtatcaaataacataggccaaatttcctacttacaggccaaaattcacaatgttcaaaatatttattttgggggttcatacataagagggcatttgactactatgaatactctaagttacgccattaatttctggtcacaaggatcaaaacaagcattttttttaaagcatgagggatttctgggagctatgggtgcctttttagacgcatgtgaaggtaaataa

SEQ ID NO: 71815 - protein, 371 aa, Candida glabrata CBS 138
MTLMRFKDCDYSRRLFTIAIDIGGSLIKVVYSPLDSQVIHFATVETAKVSKLLELLDDVIQEHNSGDFSSTQIVATGGGAFKYNDLIIETFPGIHSYTKFEEMQGLAKGLDFFIHQVPDEVFTYSDHEGEKIVETIASSPTAKPTIYPYMLVNIGSGVSMLKVDAPNVFTRVGGSSLGGGTLWGLLSLITGAQSYDEMLNWAQEGDNTTVDMLVGDIYGTDYNKIGLKSTHIASSFGKVFQDRDHPMINGNSKHRIRQEEIDHLEDHAKDNHTCNECINHRNKKFKNEDICKSLLYAVSNNIGQISYLQAKIHNVQNIYFGGSYIRGHLTTMNTLSYAINFWSQGSKQAFFLKHEGFLGAMGAFLDACEGK

SEQ ID NO: 71816 - DNA, 1122 bp, Kluyveromyces lactis NRRL Y-1140
  CDS (1)..(1122)
atgacttctgatatactgttgacgcactcgcaacttataccaactccgcaggaggatgaaactacgaatgggtccggtaatgttttcaccatagctgttgatattggtggcacgcttgcaaaggtggttttcatgccactcaataccaatagattgatgttcagaactttggaaactgagcggatcgaggaattcatggaactcttacatgatatcatacaagagtatcacgatgggctatacgaacgtacgctattagtagctaccggagggggctcttataaattttatgatttattagttgagcagttcccaactgtaattggtatagagcgatctgatgaaatggactgtttgatcaaagggttagatttcttcattcacgaaataccaaatgaaatttttacttataatgatctggaaggagaagaagcagtggaaccactacataattctaactccatatatccctatatgttggtaaacatagggtccggggtgtctatcttgaaagtggactctccaacgtccttcagtagagttgggggatcatctcttggaggaggcaccctttggggtctattatctttgatcacaggcgctaaatctttcgatgaaatgttaagttgggcgcataggggcgataatactaacgttgatatgctcgttggtgacatctatggcaccgcatacgataagctaggactaaaatctactcacattgcatcgtcctttgggaaagtgtttcaaaacaggtcacaggtggagcccgaggataaaaggtatccatcaccgtctgaaacttctacagaagacattcaaaaagataaaaaattcaataatgccgatatttcgaagtcgctactctatgctatctcaaataacattggccaaattgcatatttacaagctaaaattcaccacgttaaaaacatatattttggtggctcctatattagaggacactatactactatgaataccttaagctacgctatcaacttttggtcagagggcagaaagaaagcgtttttcctaaaacacgagggttatttgggagcaatgggggcttacctccttgcgtgcaaagacaaaatgagcagcaatgttgaaccatcctga

SEQ ID NO: 71817 - protein, 373 aa, Kluyveromyces lactis NRRL Y-1140
MTSDILLTHSQLIPTPQEDETTNGSGNVFTIAVDIGGTLAKVVFMPLNTNRLMFRTLETERIEEFMELLHDIIQEYHDGLYERTLLVATGGGSYKFYDLLVEQFPTVIGIERSDEMDCLIKGLDFFIHEIPNEIFTYNDLEGEEAVEPLHNSNSIYPYMLVNIGSGVSILKVDSPTSFSRVGGSSLGGGTLWGLLSLITGAKSFDEMLSWAHRGDNTNVDMLVGDIYGTAYDKLGLKSTHIASSFGKVFQNRSQVEPEDKRYPSPSETSTEDIQKDKKFNNADISKSLLYAISNNIGQIAYLQAKIHHVKNIYFGGSYIRGHYTTMNTLSYAINFWSEGRKKAFFLKHEGYLGAMGAYLLACKDKMSSNVEPS

SEQ ID NO: 71818 - DNA, 1515 bp, Debaryomyces hansenii CBS767
  CDS (1)..(1515)
atggggttattaacgcaagcaaaaccaaattccaacgatgaactagatttacagcttattaatccaggaaaaataaaaatcgattgttcaggatcctatattgccaacgatcatttgttgagagaacaatatcaatcaccgacaccttcaaccacaccatcaccacaagcatcagattcttcatccgagtctgatggagacgtggatggagagcttaacggattcaaggagggggaaagtgaaagcagcaatgagccaaaggggaatgctgtcttaccaccagatttgaagatggcggacgtttcctctaatagaattagagaaattgagttaagtaccacaaaccagaacagggagtacgatctcacgaagaatatcaccttaccgaagcacaattctgaagtgattcatgtttctgttgatattggcgggacgttgactaaacttgtgtatttcactaaaagtcatagggtagatggaaaaggtgggggaaaattacatttcaaagattttcaaactgaaacattcagcaacgaagtgttgaagtttatgatcaagttgatccagaaatcgatccacaagaaagaggttccaccaatcacctacataatggctacgggtggtggtgcgcacaaattctaccaattgatgactaaaacgtttcgtaaatacaaacttccaatgaaaattatagcgaaagacgaaatgcagtgcctcatcaaaggtttggattggttaataacgaaaattccaaacgagatctttacatacgatttggaagagaataatacaaaattcatccctaacccgtatacccatgatgaacaaatctacccttatcttttggtcaacattggaagtggtgtatctatgatcaaagttactggtccaggtcccgatggctttgaaagaatcggtggttcttcattaggaggaggtaccttgtggggtttgttgtccttacttacagatgcaaacgactacaacgaaatgttagaaatggcccagcgaggtaacaacgaaaacatcgacttgttagttggggatatttacggatcaaactacaataaaataggtttgaagtcaagccatattgcatcctccttcgccaaagtattcaaaaaattaagattcaatagtgatcccaacaaagacaacacactcaatggaagtgtcaggttgacacctgctgaaaaactagctcagttcaggccggaggacattgccagatctttgctatacctgatttcaaacaatataggccagatctcgtatttgcaagcattaagatttggcttgaagagaatatatttcggaggcagttatatctcaggccataagcagactattcatactctctcatacgctgttaatttctggtctcatggtgacatgaattcttactttttgagacacgagggttatttaggaagtgtaggtgctttcatgatggggcctaactgcgagacgttgaaaaataatgaattgaattctccaaagtccaccaaatcatga

SEQ ID NO: 71819 - protein, 504 aa, Debaryomyces hansenii CBS767
MGLLTQAKPNSNDELDLQLINPGKIKIDCSGSYIANDHLLREQYQSPTPSTTPSPQASDSSSESDGDVDGELNGFKEGESESSNEPKGNAVLPPDLKMADVSSNRIREIELSTTNQNREYDLTKNITLPKHNSEVIHVSVDIGGTLTKLVYFTKSHRVDGKGGGKLHFKDFQTETFSNEVLKFMIKLIQKSIHKKEVPPITYIMATGGGAHKFYQLMTKTFRKYKLPMKIIAKDEMQCLIKGLDWLITKIPNEIFTYDLEENNTKFIPNPYTHDEQIYPYLLVNIGSGVSMIKVTGPGPDGFERIGGSSLGGGTLWGLLSLLTDANDYNEMLEMAQRGNNENIDLLVGDIYGSNYNKIGLKSSHIASSFAKVFKKLRFNSDPNKDNTLNGSVRLTPAEKLAQFRPEDIARSLLYLISNNIGQISYLQALRFGLKRIYFGGSYISGHKQTIHTLSYAVNFWSHGDMNSYFLRHEGYLGSVGAFMMGPNCETLKNNELNSPKSTKS

SEQ ID NO: 71820 - DNA, 1437 bp, Yarrowia lipolytica CLIB122
  CDS (1)..(1437)
atgcaacaagcaacacaggaactgaaggatatcacagctcggtccagggactctccccgcacctctgccctcaaattcctccacgccggtgacattcagattaacgtggagggcgctttcattgttaataaggatcagaatggccgagaaacgccccccgacacacgagacattgttcttccccaccacacggcccatgtgtcacacattgccattgatattggcggctcactggccaaaatcgtctacttcagtcacgacgagcctaacggcgacactctagaggacgtgggtggtcgtctcaactttacagtgtttgagacggacaagatagatgacatgattgactttctcaagggcctcatgtctcgtcttcaagacaatcatcgacgcagctcccggtccaacgagcgactcacccccgacggctcgtcgatccggtcatcatcccacgactccaccattgctgcgagtcccacaaagccccaacagtccaacatgcgcatcatggcgaccggagggggcgcatacaagttctacgagcggttgcgcaacgagctgggcgccgatatctctcgtgaggacgagatggagtgtctgattgctgggctggatttcttcatcacggaaatcccggaggaggtcttttgctactcggaaacgaacccaatggtgtttgccgagccccgccagccgtccatctacccgtatctattggtgaacattggttccggcgttagcatgatcaaagttcttggtccgcaacagtttgtgcgtatcggtggctcctctcttggaggaggcactctgtggggcctgttgtcgcttcttaccgacgctacgtcttacgacgagatgcttgccaaggctgccgaaggagacaattcgaatgtggacatgcttgtgggtgatatttatggccaggactacacaaagattggcctgaaggcgacaactattgccagtagttttggacgagtgttcaaggagattcagagggaccgtgaaagtggagaaggtgatggaggcgacggcaagagtgggggtgacgtcgacgccaagagcgaagcttcggcatcgtccaccgattctgcatcttctcacgcgcccaagtcctctcgggacttgttcaagagtgaggatatctctcggtcgcttctctacgctatttccaacaacattggccagattgcatttctgcaagcgcagatccacaatctccagcacatttactttggcggatcgtacatccggggccacctgcaaaccatgcatactctgagttacgccatcaacttttggagtcagggaagtaaacaagcttactttttgcgacacgaggggtacctgggtgctgtgggtgcgttcattaagaagcaacccagcggctggggacgacggaactcggctggggagttggagcgtttcatgcagtag

SEQ ID NO: 71821 - protein, 478 aa, Yarrowia lipolytica CLIB122
MQQATQELKDITARSRDSPRTSALKFLHAGDIQINVEGAFIVNKDQNGRETPPDTRDIVLPHHTAHVSHIAIDIGGSLAKIVYFSHDEPNGDTLEDVGGRLNFTVFETDKIDDMIDFLKGLMSRLQDNHRRSSRSNERLTPDGSSIRSSSHDSTIAASPTKPQQSNMRIMATGGGAYKFYERLRNELGADISREDEMECLIAGLDFFITEIPEEVFCYSETNPMVFAEPRQPSIYPYLLVNIGSGVSMIKVLGPQQFVRIGGSSLGGGTLWGLLSLLTDATSYDEMLAKAAEGDNSNVDMLVGDIYGQDYTKIGLKATTIASSFGRVFKEIQRDRESGEGDGGDGKSGGDVDAKSEASASSTDSASSHAPKSSRDLFKSEDISRSLLYAISNNIGQIAFLQAQIHNLQHIYFGGSYIRGHLQTMHTLSYAINFWSQGSKQAYFLRHEGYLGAVGAFIKKQPSGWGRRNSAGELERFMQ

SEQ ID NO: 71822 - DNA, 3102 bp, Ustilago maydis 521
  CDS (1)..(3102)
atgaacagcaaccaacctttccctgctcctccggtcgaaatctttgtcgacacacgaggagcaaagatcatggaggatggcgcttccagcccggatcagagagatagccgcgatatctaccttcccaaccacatcgaggctgtttctcacatcgccgttgatgtcggaggctctctagcaaaagttgtctactttactcgctcacttaccaccgactccatgccgtcgtcaccgacagtcggctcgccagccagtcccatcgcgcctctgcctgctcttgcgggatcccctttgacacccaacacgctctcgcccaaacccagtacgtccagttttcgctcgcggcagccctccgccaacggtgtgactccgagcggcttccgcacacctccctcgcagctcgattatccgatcgcttccggcaccttgacaccaacggccattcttggctctccacaaatcacctcggcctccgcttctgctattcactcgacacttctcaaacgccgctctcttcccgcggcactaccaggtggcagactcaactttatcaagttcgagaccagcaacattgacaattgcatctcttttctacgtgaactcatcgagcgctcagctgctgccaatggcgtctcgatccaagacatgcgcaagggcgtcaagctcatggcaacaggcggtggtgcccacctcatgtacgacctctttgagcaagagcttggcatcgaagtcaacaaagaagacgaaatgggttgtttaatcaccggccttaactttatcaccctcattccagacgaagtcttttggtactccgacgagctcgtagcagccttgcattcgcctctaccccaaaacccagaggccagagcagacgcacaggccttgcggtcatccgtacctttgcaacatccactgcctcgcccttcgcccaacccacccctttatgcacctgtatttgactcgcatccgtctccaaagctgccctgtctgctcgtcaatattggctcaggtgtctcgattatcaaagtcgacgactttggcaagtttgagcgagtctcgggcacttcgctcggcggtggtacattgtggggtctcctctctttgctgacggatgcagaaagctttgacgagatgctcgaactctcggagcaaggagataacgcaaacgtcgacatgctcgtcggtgacatctatggctccatcggcctcaaccatctcggtctcaagagctccaccatcgcctcctccttcggaaaagtcttccgcaaagatcccagctcttctgctcctcgcaatgccgaggaacgacgcaaaaagttccgttccgaagacatctgcaaatcgctcctctacgctatctcgaacaacattggtcagattgcatacatgaacgccgaaaagtacaacctcgaccgcatttactttggagggtgtttcatccgtggccaccaggctaccatcagcactctgtcgtacgccattcgcttctggagcaaaggaagcaagcgtgcctttttcttacgccatgaaggttaccttggcgccattggcgcatggatcaaacacgtttcgcaagatccgaatgcgtcggcctcgaatttgcgtacagcggcccaagccatgggtgcgtctctcccgggcaccggagcagcaggcaaatcaacaccatccgtgccatccggattagggtcttttgtctctccagcctcgtcatcggacgagccagtcaattgggcacagatccaaaaggaagcacttcttccgccggtgctcaatggagatggcttgcccgagccagctagagctggctcctcagcattgctgcccaacccgcaagtggcacgtctgcagcgagccgaaacgtcagaggtagacagcaagacgccaacacaagaatcgactcgtcttgacaagcagttgggctcgcagcaatcagatctcgactttctgaatggtctcatgtcacaacagagtcagacgtcccagccgcctgcttctctgccgcaggcacaacaagcgaacggcgcggtagaagacgagtcagacgatgaagacctaatcgcaggcaaggatgaggcagcacagctcaacgagatcctcacatctctcaaatcccttcagatacccacaagcaacggctccgaccccgctgcagcacaggctgagcacgacgagattttgagtttgctcgccaacttggaacacaccgagcacgtggtgggtggattggaaggcaagcttgataaccttctatcgtcgcttgatacgctgattgcgaatcaggaggctcaagagctcgctcagcaggctgttggcgcgtcggaacttatccctgctgcgttcctaaacacactcgaggagcgtgatgttggtccagcagctactttgaagcttacaaacaggcttcacatgcttcgcggcgacgcgcccagccttgacgacgtttcgtgcgcctttacgtcagcacagaaacgctttgggtgtatcgatgctgttctgtttggaataggcggacgattggttttctccggcaatcctttcgcacaatcagcactatcgcctagctcggtctgcgagcgaactatacgaaatttgaccgacgctttgactgcccttgagcagcctgagcagccccgactggttgtcatctcttctaatgggcttgcaaagcaaggttgttctttgctaccataccttatgcgaccactttacgctttcctactccatgctccacgtggtgacacggagcgcatggaatcgcatctgcatgccctggctggctggccaagcgatgccttgaatccacttcaccgcgaacaattgagacgccgcccaagatcgagcgtctcgccgtccgtccgcgcagaggatatgctccggcacggccataccattcgccgatccgatgtcggcctattcatctacaacagtcttttgggaggaccgcaggataggggccaatacgtgggaaaggctgtcacagtggcatacttgtgcattgtcaatcttgccccaatatccgtcatgtccaacatccacgttatgtatcacaacaatcaccatctgttgtatctgttctttcttgatcacttgctctgctag

SEQ ID NO: 71823 - protein, 1033 aa, Ustilago maydis 521
MNSNQPFPAPPVEIFVDTRGAKIMEDGASSPDQRDSRDIYLPNHIEAVSHIAVDVGGSLAKVVYFTRSLTTDSMPSSPTVGSPASPIAPLPALAGSPLTPNTLSPKPSTSSFRSRQPSANGVTPSGFRTPPSQLDYPIASGTLTPTAILGSPQITSASASAIHSTLLKRRSLPAALPGGRLNFIKFETSNIDNCISFLRELIERSAAANGVSIQDMRKGVKLMATGGGAHLMYDLFEQELGIEVNKEDEMGCLITGLNFITLIPDEVFWYSDELVAALHSPLPQNPEARADAQALRSSVPLQHPLPRPSPNPPLYAPVFDSHPSPKLPCLLVNIGSGVSIIKVDDFGKFERVSGTSLGGGTLWGLLSLLTDAESFDEMLELSEQGDNANVDMLVGDIYGSIGLNHLGLKSSTIASSFGKVFRKDPSSSAPRNAEERRKKFRSEDICKSLLYAISNNIGQIAYMNAEKYNLDRIYFGGCFIRGHQATISTLSYAIRFWSKGSKRAFFLRHEGYLGAIGAWIKHVSQDPNASASNLRTAAQAMGASLPGTGAAGKSTPSVPSGLGSFVSPASSSDEPVNWAQIQKEALLPPVLNGDGLPEPARAGSSALLPNPQVARLQRAETSEVDSKTPTQESTRLDKQLGSQQSDLDFLNGLMSQQSQTSQPPASLPQAQQANGAVEDESDDEDLIAGKDEAAQLNEILTSLKSLQIPTSNGSDPAAAQAEHDEILSLLANLEHTEHVVGGLEGKLDNLLSSLDTLIANQEAQELAQQAVGASELIPAAFLNTLEERDVGPAATLKLTNRLHMLRGDAPSLDDVSCAFTSAQKRFGCIDAVLFGIGGRLVFSGNPFAQSALSPSSVCERTIRNLTDALTALEQPEQPRLVVISSNGLAKQGCSLLPYLMRPLYAFLLHAPRGDTERMESHLHALAGWPSDALNPLHREQLRRRPRSSVSPSVRAEDMLRHGHTIRRSDVGLFIYNSLLGGPQDRGQYVGKAVTVAYLCIVNLAPISVMSNIHVMYHNNHHLLYLFFLDHLLC

SEQ ID NO: 71824 - DNA, 1263 bp, Aspergillus nidulans FGSC A4
  CDS (1)..(1263)
atgtccgccacggatcctactcccgctcgaacccctcggcttgaacaggccatcaccaatccggggaccgtcaagatcaatgttaagggagctttcattgtggacgatgaccctcggtccaagagtcctgtaagggaagagggcgttcactacgagggtcaggacattcgcctaccccatcatactggtgtggtaagccatgttgctgtcgatatcggcggttctctagcgaagctggtatacttcacacgtgagctggactcaccagacaatggcgggcggttgaactttatcaacttcgagactgatcggataaacctttgtctggaattcatcaaacggctgaaggaagagcaccgggattccaatggaggtaccaaggaggaactttgtgttgttgctacaggtggaggcgcctacaagtattacgacaaactcaaggaaacattgaacgtggacattatgcgggaagatgagatggaatgcctcataacaggacttgactttttcatcaccgagataccgaacgaaattttcacgtacagcgagactgagccgatgcaatttgccgaggcccgaccggatgtgtatccgtacctcttagtgaacatcggctccggagtgtctatgatcaaagtgtcggggccaaaacagtttcagcgtgttggcggaacgcacctgggtggtggaacattctggggcatcatgtcattattgactggcgcccgaacttttgacgacatgctagcaatggcggaccgaggggataacagcggcgtggacatgttagttggcgacatctacgggatggactacggaaagataggtctcaagagcacggccatcgccagcacatttgggaaggtcttccggctacagaaccgcgagcgggtggcgagcgatggggaggcaccgcaggacgggtctcgccaaaaggccgacgagccgatatttaagcacgaagatatgagcagaagcctactatacgccataagtaataatattggacaaatcgcatacttgcagtccgaaaagcaccaggtcaagcacatctacttcggtggctcgttcattcgaggacaccgacaaactatgaacacattatcctacgctatccgtttctggtccaaaggcgaaaagcaggcatactttctccgccatgagggctacatcggcgcagtcggcgcgtttctacgaagaaagccagttaactggggccgccggaacagtattgatgagcacgtgcctgctcaagggctctaa

SEQ ID NO: 71825 - protein, 420 aa, Aspergillus nidulans FGSC A4
MSATDPTPARTPRLEQAITNPGTVKINVKGAFIVDDDPRSKSPVREEGVHYEGQDIRLPHHTGVVSHVAVDIGGSLAKLVYFTRELDSPDNGGRLNFINFETDRINLCLEFIKRLKEEHRDSNGGTKEELCVVATGGGAYKYYDKLKETLNVDIMREDEMECLITGLDFFITEIPNEIFTYSETEPMQFAEARPDVYPYLLVNIGSGVSMIKVSGPKQFQRVGGTHLGGGTFWGIMSLLTGARTFDDMLAMADRGDNSGVDMLVGDIYGMDYGKIGLKSTAIASTFGKVFRLQNRERVASDGEAPQDGSRQKADEPIFKHEDMSRSLLYAISNNIGQIAYLQSEKHQVKHIYFGGSFIRGHRQTMNTLSYAIRFWSKGEKQAYFLRHEGYIGAVGAFLRRKPVNWGRRNSIDEHVPAQGL

SEQ ID NO: 71826 - DNA, 1281 bp, Aspergillus oryzae
  CDS (1)..(1281)
atgtcgtctacaaactacaatccgccctcgcgcgccacccggctagaaaaagctatcaccaaccccggtgctgtgaagattaatgttaagggtgctttcattgtcgacgaagatccgcgatccaagagtcccgtgagattggatggtgtgcactatgaaggccatgatatccggcttccccatcacactggagtagtgagccatgttgctgtcgacatcggtggttctcttgcgaaattaatttattttacacgagagctggactccgtggataatggcggccgattgaactttatcaatttcgacactcatcgcatagatctgtgcatcaacttcataaaagaactgaaagaagaataccagaaagcccacggtccttccagcgatgagctatgtgttgtggcgaccggaggcggcgccttcaagtattacgacaagctgaaggagacactgaaagtgaatatcatacgcgaggatgagatggaatgcctcattactggactcgatttctttatcactgaaataccgaacgaagtctttacctacagcgaaaccgacccgatgcaatttgccgaggcccgaccggacgtttacccgtacctattagtcaacattggctccggtgtatccatgatcaaagtgtcgggccctaggcaataccagcgtgtggggggtacccatctgggtggcggcaccttctggggcatcatgtcgctcctgactggtgctcggaccttcgacgacatgctggcgatggcggacagcggtgataacagtggggtagacatgttagttggcgatatctacggcatggactataaccggatcggtctgaagagcactgcgattgctagcacattcggcaaggtctttcgattgaagaatgatgtgcacgaagaggatggagaagacaaaccccacggtgaagatggacaaaccaatggtgaagttacgttcaagcctgaggatatgagccgaagccttctttatgccatcagtaacaacatcggacaaatcgcatatctgcagtccgagaagcaccaagtgaagcacatatacttcggtgggtcgttcatccgaggccaccggcaaaccatgaacacactatcctacgctatccggttctggtccaaaggcgaaaagcaagcctacttcctgcgccacgaaggctacattggcgccgtcggggccttcctccgcagacagccagccaactggggtcgcaggaatagtctcgacggtagtgccatgccacaggagctcaggagtagctctagttga

SEQ ID NO: 71827 - protein, 426 aa, Aspergillus oryzae
MSSTNYNPPSRATRLEKAITNPGAVKINVKGAFIVDEDPRSKSPVRLDGVHYEGHDIRLPHHTGVVSHVAVDIGGSLAKLIYFTRELDSVDNGGRLNFINFDTHRIDLCINFIKELKEEYQKAHGPSSDELCVVATGGGAFKYYDKLKETLKVNIIREDEMECLITGLDFFITEIPNEVFTYSETDPMQFAEARPDVYPYLLVNIGSGVSMIKVSGPRQYQRVGGTHLGGGTFWGIMSLLTGARTFDDMLAMADSGDNSGVDMLVGDIYGMDYNRIGLKSTAIASTFGKVFRLKNDVHEEDGEDKPHGEDGQTNGEVTFKPEDMSRSLLYAISNNIGQIAYLQSEKHQVKHIYFGGSFIRGHRQTMNTLSYAIRFWSKGEKQAYFLRHEGYIGAVGAFLRRQPANWGRRNSLDGSAMPQELRSSSS

SEQ ID NO: 71828 - DNA, 1281 bp, Lycopersicon esculentum
  CDS (1)..(1281)
atggaggtgaagggaattgatgggaaattagaaaagagtgattccacttctgctgatgaaatttcacatttgtctatcgacattggaggctccctcatcaagattgtatacttttcaaccaacagtaagtgcagcacaaatgatgaggcaccaacgttatcaaaagaaagacaggaagttcccaatggagaccttaaccatcacattctcagtggcaggctttatttcattaaattcgagactagcaagattgaggactgcataaagtttttgtcttccaagaaacttcaaaaatgcggtgctcaatgtcatcattctcacgctgttgacaagatcaagattaaggcaacaggtggtggagctttcaagtttgccgatctattcaaagaaaaacttggcctaactctggacaaggtagaggaaatggagtctcttgttaccggagcaaattttctgcttaaggctgccaatcatgaagtttatacatatattggaggtcaaaaggagtatgtgcagatagatcagaatgatttatatccctacctccttgtcaacattgggtctggggttagcatgataaaggtagatggagatgggaaatttcagagagttagtggaactagcgtcggtggtggcactttcttgggactagggaaacttttgactaaatgccaaagttttgatgagttgctggaactgagccatctgggaaataacagagtgatagacatgctcgttggagatatttacgggggattggactattcaaagattggccttgcatcaacagccatagcgtctagcttcggtaaggcgatctcagaaaacaaagagctcgaagactacaaaccagaagacattgcccggtccctcttaaggatgatctcaaataacatcggacagattgcatacttgaatgctcttcgttttgggctcaagcggatctttttgggaggattcttcatccgcgaccatgcttatacaatggacacaatctccgttgcagttgatttctggtcgaagggtgaggccaaagcaatgttcttgcggcatgagggatttcttggagccctaggagctttcatgaactacaaagatggaagtacagattccatgccccctcagttagttgagcaacaagccgccaagaggagttcaagttgcatagtcgataggattcataactctacgcatgtgcaggaaaatgaaaatggcgccacagactgtagattgcgagttagtagctcatttaaaatttatgatgaggtcaaaaggtgttga

SEQ ID NO: 71829 - protein, 426 aa, Lycopersicon esculentum
MEVKGIDGKLEKSDSTSADEISHLSIDIGGSLIKIVYFSTNSKCSTNDEAPTLSKERQEVPNGDLNHHILSGRLYFIKFETSKIEDCIKFLSSKKLQKCGAQCHHSHAVDKIKIKATGGGAFKFADLFKEKLGLTLDKVEEMESLVTGANFLLKAANHEVYTYIGGQKEYVQIDQNDLYPYLLVNIGSGVSMIKVDGDGKFQRVSGTSVGGGTFLGLGKLLTKCQSFDELLELSHLGNNRVIDMLVGDIYGGLDYSKIGLASTAIASSFGKAISENKELEDYKPEDIARSLLRMISNNIGQIAYLNALRFGLKRIFLGGFFIRDHAYTMDTISVAVDFWSKGEAKAMFLRHEGFLGALGAFMNYKDGSTDSMPPQLVEQQAAKRSSSCIVDRIHNSTHVQENENGATDCRLRVSSSFKIYDEVKRC

SEQ ID NO: 71830 - DNA, 2001 bp, Oryza sativa
  CDS (1)..(2001)
atgggtgggcttcgtgtcgacctctccggcgcggagatccgcgtggaccccgcgtgcggcgccgccgccgacgatggcgggagcccgcccgtgttcctcccccgccagcccgccgcgcccccgctcctcgcgctcgacatcggagggactctgataaagctggtgtacacggcgagctgcggtggcggaggcgcggagctgcggttcgccaagttcgagaggcggaggatgcaggagtgcttcgacttcgtcagggcgcagggtctcgtccaccgcaatggatcaactatgggttcaagcaaagaaaatatagcattgaaggcctcaggtggtggagcatataaatatactgaagattttcgtgagaaattaggagtttgtcttgacaaggttgatgaaatggatagtgttgtttctggagcaaactttttgttacagagtgttcctggagcagccttcacacacatgaatggaaagaaaagttctgttgatatttccccaaataacttgtttccttaccttcttgtcaacattggctctggagttagcatattaaaggtcactggaaataggaaatttgaaagggtaactgggacacatattggtggcggaacaatgtttggtttagcaaaacttttaacaggctgtaagagttatgacgagttcttacaattaagccagaaaggggacaattttgttcttgatctaattgtgaaggatatatgtggggaacttgtttgccagaagcaaggactttcaacttcaactcttgcttctagttttgggaaagttatcacttctaagaagaagttaacagattacagacctgaagatctagcatccacattgttgagcgcttttacctataacattgcacaaatttctttccttgttgcatcaatcttgcatctcagaagagtgttctttggtggatcttatatacgtggacataagagcacgatgcaaaatatttcttatgcaattgacttctggtcgcagagtaaaatgcaagctgtcttcttgcaacatgaagggtatttaggagctcttggtgccttaatgagttatggtgattctggagataaaaacatgaaccttgaggaaatgaaagaggaggagaacatccatgaatcagcaacacctattgatgagacatcaacagatgaacataatgatggaaacatatttccttatctccttgttaatattggatcaggtgtcagcatgatagaggtaactggaaatgggaagtttgagcggattataggatctcacctaggtgggggcactatccttggtctggcgaggcttttgactggttgttcaagttatgatgaattcttggagttgagccagagaggcaataatttagctgttgatttgactgttggtgacatatatggggagcatggttacccaaagattggtcttcctgcgtccactactgcagctagctttggaaaagtgagttcaagtagactttcggaatacaaagtagaggatcttgcggcagctctattgaattctttcacctacaacattgggcagatagcctactttgtagctaatctttctggtctgaagagaattttcttccgaggtgcttatatctgtggccatgagaagactatggacaagatttcccattccctcaagtattggtccaaaggccaagttcaaacaacatttctgtgccatgaggggttcttgggaacactaggtgcattttggagctatgagaacatgggtattgacggcttggcagcacatgaagtcataagggaggtcttgcttggcgctccttacactgggcagcttccatctctgcctctgactcaccaacaggacaatggagaagatacgaccattgaaggagaagtagaacggcttcgacatgacaatgctgtgctgaaggctgagcttgaacggttacaaagggagaacacagagctcaaagcgaagctggtaaaatctggcaaaccaaataccttttatcattaa

SEQ ID NO: 71831 - protein, 666 aa, Oryza sativa
MGGLRVDLSGAEIRVDPACGAAADDGGSPPVFLPRQPAAPPLLALDIGGTLIKLVYTASCGGGGAELRFAKFERRRMQECFDFVRAQGLVHRNGSTMGSSKENIALKASGGGAYKYTEDFREKLGVCLDKVDEMDSVVSGANFLLQSVPGAAFTHMNGKKSSVDISPNNLFPYLLVNIGSGVSILKVTGNRKFERVTGTHIGGGTMFGLAKLLTGCKSYDEFLQLSQKGDNFVLDLIVKDICGELVCQKQGLSTSTLASSFGKVITSKKKLTDYRPEDLASTLLSAFTYNIAQISFLVASILHLRRVFFGGSYIRGHKSTMQNISYAIDFWSQSKMQAVFLQHEGYLGALGALMSYGDSGDKNMNLEEMKEEENIHESATPIDETSTDEHNDGNIFPYLLVNIGSGVSMIEVTGNGKFERIIGSHLGGGTILGLARLLTGCSSYDEFLELSQRGNNLAVDLTVGDIYGEHGYPKIGLPASTTAASFGKVSSSRLSEYKVEDLAAALLNSFTYNIGQIAYFVANLSGLKRIFFRGAYICGHEKTMDKISHSLKYWSKGQVQTTFLCHEGFLGTLGAFWSYENMGIDGLAAHEVIREVLLGAPYTGQLPSLPLTHQQDNGEDTTIEGEVERLRHDNAVLKAELERLQRENTELKAKLVKSGKPNTFYH

SEQ ID NO: 71832 - DNA, 1152 bp, Arabidopsis thaliana
  CDS (1)..(1152)
atggatccgactcaaatctctcatttggctctcgacatcggagggactctgatcaagcttgtgtatttctctgcaaatggagattatagcgaagagtctcgtaatggttgctctgttgtgaaaggaaggctttgtttcgctaagtttgagactagaaagattgatgattgtttggagtttattcgattcaatatccttcatcattccggtgtacagcaaccgaatggcgaaggtcatgataaactttatgttaaggccacaggtggtggggcatttaagtttgctgatctctttaaggagaaacttggtattcttttcgataaggaagatgagatgtgttctcttgttggtggtgttaattttctactaaagactgtcccaagggaagcttttacctacttagatggccaaaagaagtttgtcgagatcgaccataatgatttgtatccatatctactagtcaacatcggttctggcgttagcatgatcaaggtcgatggagatggaaaatatgagaggataagtggaacaagccttggcggaggcacatttttaggtcttgggaagcttttaacaaaatgcaagagttttgatgagctgctagagttaagccaccatggaaataacagagtaattgacatgcttgtgggggatatctacggtggaacagattattcaaagattggtctctcctcaacagctatcgcttccagctttgggaaagcgatttctgatggtaaagaacttgaagattaccagccagaagatgtggcaaggtcccttctaagaatgatatcaaataacatcggtcagattgcttatttgaatgctctcagattcggtcttaagcgtattttctttggtggatttttcatccgtgggcttgagtacaccatggacacaatctccgttgctgttcacttttggtcgagaggtgaggcaaaggcaatgtttttacgacatgaagggtttcttggagcattaggcgctttcacgagctacaatgaccagagccataacgatttaaaaccgcatcatcacactgtgcaaagagcaattctcaactgttcaggtcataactttcggcacatcccagtaacttcaaatttaaacgaaagcgagaccatagaatgtagcatcaatttagtttag

SEQ ID NO: 71833 - protein, 383 aa, Arabidopsis thaliana
MDPTQISHLALDIGGTLIKLVYFSANGDYSEESRNGCSVVKGRLCFAKFETRKIDDCLEFIRFNILHHSGVQQPNGEGHDKLYVKATGGGAFKFADLFKEKLGILFDKEDEMCSLVGGVNFLLKTVPREAFTYLDGQKKFVEIDHNDLYPYLLVNIGSGVSMIKVDGDGKYERISGTSLGGGTFLGLGKLLTKCKSFDELLELSHHGNNRVIDMLVGDIYGGTDYSKIGLSSTAIASSFGKAISDGKELEDYQPEDVARSLLRMISNNIGQIAYLNALRFGLKRIFFGGFFIRGLEYTMDTISVAVHFWSRGEAKAMFLRHEGFLGALGAFTSYNDQSHNDLKPHHHTVQRAILNCSGHNFRHIPVTSNLNESETIECSINLV

SEQ ID NO: 71834 - DNA, 25 bp, Artificial sequence
  primer
atgccgcgaattactcaagagatat

SEQ ID NO: 71835 - DNA, 26 bp, Artificial sequence
  primer
ctacgtacttgttttcttagtagatg

SEQ ID NO: 71836 - protein, 534 aa, Artificial sequence
  consensus sequence
  Variant (2)..(2): Xaa in position 2 is any amino acid
  Variant (7)..(7): Xaa in position 7 is any amino acid
  Variant (9)..(9): Xaa in position 9 is any amino acid
  Variant (11)..(20): Xaa in position 11 to 20 is any amino acid
  Variant (21)..(129): Xaa in position 21 to 129 is any or no amino acid
  Variant (131)..(131): Xaa in position 131 is any amino acid
  Variant (133)..(135): Xaa in position 133 to 135 is any amino acid
  Variant (138)..(165): Xaa in position 138 to 165 is any amino acid
  Variant (166)..(199): Xaa in position 166 to 199 is any or no amino acid
  Variant (206)..(206): Xaa in position 206 is any amino acid
  Variant (208)..(209): Xaa in position 208 to 209 is any amino acid
  Variant (211)..(223): Xaa in position 211 to 223 is any amino acid
  Variant (224)..(228): Xaa in position 224 to 228 is any or no amino acid
  Variant (232)..(233): Xaa in position 232 to 233 is any amino acid
  Variant (235)..(236): Xaa in position 235 to 236 is any amino acid
  Variant (238)..(239): Xaa in position 238 to 239 is any amino acid
  Variant (241)..(247): Xaa in position 241 to 247 is any amino acid
  Variant (249)..(249): Xaa in position 249 is any amino acid
  Variant (252)..(267): Xaa in position 252 to 267 is any amino acid
  Variant (268)..(308): Xaa in position 268 to 308 is any or no amino acid
  Variant (312)..(312): Xaa in position 312 is any amino acid
  Variant (322)..(323): Xaa in position 322 to 323 is any amino acid
  Variant (326)..(332): Xaa in position 326 to 332 is any amino acid
  Variant (333)..(334): Xaa in position 333 to 334 is any or no amino acid
  Variant (336)..(337): Xaa in position 336 to 337 is any amino acid
  Variant (339)..(341): Xaa in position 339 to 341 is any amino acid
  Variant (346)..(346): Xaa in position 346 is any amino acid
  Variant (350)..(351): Xaa in position 350 to 351 is any amino acid
  Variant (353)..(353): Xaa in position 353 is any amino acid
  Variant (355)..(359): Xaa in position 355 to 359 is any amino acid
  Variant (361)..(362): Xaa in position 361 to 362 is any amino acid
  Variant (364)..(368): Xaa in position 364 to 368 is any amino acid
  Variant (370)..(370): Xaa in position 370 is any amino acid
  Variant (372)..(374): Xaa in position 372 to 374 is any amino acid
  Variant (384)..(385): Xaa in position 384 to 385 is any amino acid
  Variant (386)..(387): Xaa in position 386 to 387 is any or no amino acid
  Variant (389)..(389): Xaa in position 389 is any amino acid
  Variant (391)..(391): Xaa in position 391 is any amino acid
  Variant (394)..(397): Xaa in position 394 to 397 is any amino acid
  Variant (405)..(418): Xaa in position 405 to 418 is any amino acid
  Variant (419)..(458): Xaa in position 419 to 458 is any or no amino acid
  Variant (460)..(462): Xaa in position 460 to 462 is any amino acid
  Variant (466)..(467): Xaa in position 466 to 467 is any amino acid
  Variant (470)..(470): Xaa in position 470 is any amino acid
  Variant (476)..(476): Xaa in position 476 is any amino acid
  Variant (479)..(487): Xaa in position 479 to 487 is any amino acid
  Variant (489)..(489): Xaa in position 489 is any amino acid
  Variant (493)..(494): Xaa in position 493 to 494 is any amino acid
  Variant (499)..(500): Xaa in position 499 to 500 is any amino acid
  Variant (503)..(503): Xaa in position 503 is any amino acid
  Variant (505)..(505): Xaa in position 505 is any amino acid
  Variant (507)..(507): Xaa in position 507 is any amino acid
  Variant (509)..(510): Xaa in position 509 to 510 is any amino acid
  Variant (514)..(514): Xaa in position 514 is any amino acid
  Variant (516)..(518): Xaa in position 516 to 518 is any amino acid
  Variant (520)..(520): Xaa in position 520 is any amino acid
  Variant (523)..(523): Xaa in position 523 is any amino acid
  Variant (527)..(527): Xaa in position 527 is any amino acid
  Variant (531)..(531): Xaa in position 531 is any amino acid
AXDIGGXLXKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLXFXXXETXXXXXXXXXXXXXXXXXXXXXXXXXXXXXXXXXXXXXXXXXXXXXXXXXXXXXXXXXXXXXXATGGGAXKXXDXXXXXXXXXXXXXXXXXXDEMXXLXXGXXFXXXXXXXEXFTXXXXXXXXXXXXXXXXXXXXXXXXXXXXXXXXXXXXXXXXXXXXXXXXXXXXXXXXXYPYXLVNIGSGVSXXKVXXXXXXXXXRXXGXXXGGGTXWGLXXLXTXXXXXDXXLXXXXXGXNXXXDMLVGDIYGXXXXYXKXGLXXXXIASSFGKXXXXXXXXXXXXXXXXXXXXXXXXXXXXXXXXXXXXXXXXXXXXXXXXXXXXXXDXXXSLLXXISXNIGQIXYLXXXXXXXXXIXFGGXXIRGHXXTMXTXSXAXXFWSXGXXXAXFLXHEGXLGAXGAF

SEQ ID NO: 71837 - protein, 61 aa, Artificial sequence
  protein pattern
  Variant (3)..(3): Xaa in position 3 is any or no amino acid
  Variant (5)..(5): Xaa in position 5 is any or no amino acid
  Variant (10)..(10): Xaa in position 10 is Ala or Ser
  Variant (12)..(12): Xaa in position 12 is Leu or Met
  Variant (13)..(13): Xaa in position 13 is any amino acid
  Variant (14)..(14): Xaa in position 14 is Ala or Ser
  Variant (15)..(18): Xaa in position 15 to 18 is any amino acid
  Variant (19)..(19): Xaa in position 19 is Ile, Leu or Val
  Variant (20)..(21): Xaa in position 20 to 21 is any amino acid
  Variant (23)..(23): Xaa in position 23 is Phe or Tyr
  Variant (24)..(24): Xaa in position 24 is Phe or Leu
  Variant (27)..(27): Xaa in position 27 is any amino acid
  Variant (28)..(28): Xaa in position 28 is Phe or Tyr
  Variant (29)..(29): Xaa in position 29 is any amino acid
  Variant (30)..(30): Xaa in position 30 is Arg or Ser
  Variant (31)..(31): Xaa in position 31 is Asp, Gly or Asn
  Variant (32)..(34): Xaa in position 32 to 34 is any amino acid
  Variant (36)..(36): Xaa in position 36 is Ile or Met
  Variant (37)..(37): Xaa in position 37 is any amino acid
  Variant (39)..(39): Xaa in position 39 is Ile or Leu
  Variant (40)..(40): Xaa in position 40 is Ser or Thr
  Variant (41)..(41): Xaa in position 41 is any amino acid
  Variant (43)..(43): Xaa in position 43 is Ile or Val
  Variant (44)..(44): Xaa in position 44 is any amino acid
  Variant (45)..(45): Xaa in position 45 is Phe or Tyr
  Variant (48)..(52): Xaa in position 48 to 52 is any amino acid
  Variant (53)..(53): Xaa in position 53 is Ala or Ser
  Variant (54)..(54): Xaa in position 54 is any amino acid
  Variant (57)..(57): Xaa in position 57 is Lys or Arg
  Variant (61)..(61): Xaa in position 61 is Phe or Tyr
ISXNXIGQIXYXXXXXXXXXXIXXGGXXXXXXXXTXXTXXXAXXXWSXXXXXXXFLXHEGX

SEQ ID NO: 71838 - protein, 38 aa, Artificial sequence
  protein pattern
  Variant (2)..(2): Xaa in position 2 is any amino acid
  Variant (5)..(5): Xaa in position 5 is Ile or Leu
  Variant (6)..(6): Xaa in position 6 is any amino acid
  Variant (7)..(7): Xaa in position 7 is Arg or Ser
  Variant (9)..(9): Xaa in position 9 is Ile or Leu
  Variant (11)..(11): Xaa in position 11 is any amino acid
  Variant (12)..(12): Xaa in position 12 is Ala, Cys or Thr
  Variant (13)..(13): Xaa in position 13 is any amino acid
  Variant (14)..(14): Xaa in position 14 is Asp, Asn, Ser or Thr
  Variant (15)..(15): Xaa in position 15 is Phe or Tyr
  Variant (16)..(16): Xaa in position 16 is Asp or Asn
  Variant (17)..(17): Xaa in position 17 is Asp, Glu or Gln
  Variant (18)..(18): Xaa in position 18 is Leu or Met
  Variant (20)..(20): Xaa in position 20 is Ala, Asp, Glu, Asn or Ser
  Variant (21)..(21): Xaa in position 21 is any amino acid
  Variant (22)..(22): Xaa in position 22 is Ala or Ser
  Variant (23)..(24): Xaa in position 23 to 24 is any amino acid
  Variant (26)..(26): Xaa in position 26 is Asp or Asn
  Variant (28)..(28): Xaa in position 28 is Ala, Glu, Ser or Thr
  Variant (29)..(29): Xaa in position 29 is Ala, Gly, Asn, Ser or Thr
  Variant (30)..(30): Xaa in position 30 is Ile or Val
  Variant (32)..(32): Xaa in position 32 is Leu or Met
TXWGXXXLXTXXXXXXXXLXXXXXGXNXXXDXLVGDIY

SEQ ID NO: 71839 - protein, 21 aa, Artificial sequence
  protein pattern
  Variant (4)..(4): Xaa in position 4 is any or no amino acid
  Variant (6)..(6): Xaa in position 6 is any or no amino acid
  Variant (9)..(9): Xaa in position 9 is Ile or Val
  Variant (15)..(15): Xaa in position 15 is Phe, Ile or Met
  Variant (16)..(16): Xaa in position 16 is Ile or Leu
  Variant (19)..(19): Xaa in position 19 is any amino acid
  Variant (20)..(20): Xaa in position 20 is Ala, Glu, Gly or Ser
  Variant (21)..(21): Xaa in position 21 is Asp, Glu or Pro
YPYXLXVNXGSGVSXXKVXXX

SEQ ID NO: 71840 - protein, 20 aa, Artificial sequence
  protein pattern
  Variant (2)..(2): Xaa in position 2 is Ala, Asp, Glu, Gly, Asn or Ser
  Variant (3)..(3): Xaa in position 3 is Lys or Arg
  Variant (4)..(4): Xaa in position 4 is Phe, Ile or Leu
  Variant (7)..(7): Xaa in position 7 is any amino acid
  Variant (8)..(8): Xaa in position 8 is any or no amino acid
  Variant (10)..(10): Xaa in position 10 is any amino acid
  Variant (11)..(11): Xaa in position 11 is any or no amino acid
  Variant (15)..(15): Xaa in position 15 is Ser or Thr
  Variant (17)..(17): Xaa in position 17 is Ala or Gly
  Variant (19)..(19): Xaa in position 19 is Ala or Val
  Variant (20)..(20): Xaa in position 20 is Phe, Ile or Leu
YXXXGLXXSXXIASXFXKXX

SEQ ID NO: 71841 - protein, 13 aa, Artificial sequence
  protein pattern
  Variant (2)..(2): Xaa in position 2 is Ile, Leu or Val
  Variant (7)..(7): Xaa in position 7 is Ser or Thr
  Variant (9)..(9): Xaa in position 9 is Ala or Ile
  Variant (11)..(11): Xaa in position 11 is Ile, Leu or Val
  Variant (12)..(12): Xaa in position 12 is Ile, Leu, Met or Val
  Variant (13)..(13): Xaa in position 13 is Phe or Tyr
AXDIGGXLXKXXX

SEQ ID NO: 71842 - protein, 14 aa, Artificial sequence
  protein pattern
  Variant (2)..(3): Xaa in position 2 to 3 is any or no amino acid
  Variant (5)..(5): Xaa in position 5 is any amino acid
  Variant (6)..(6): Xaa in position 6 is Cys, Gly or Ser
  Variant (8)..(9): Xaa in position 8 to 9 is any amino acid
  Variant (11)..(11): Xaa in position 11 is Ala, Leu or Val
  Variant (12)..(12): Xaa in position 12 is Asp or Asn
  Variant (14)..(14): Xaa in position 14 is Phe, Ile or Leu
EXXMXXLXXGXXFX

SEQ ID NO: 71843 - protein, 16 aa, Artificial sequence
  protein pattern
  Variant (6)..(6): Xaa in position 6 is Phe, His or Tyr
  Variant (8)..(10): Xaa in position 8 to 10 is any amino acid
  Variant (11)..(15): Xaa in position 11 to 15 is any or no amino acid
TGGGAXKXXXXXXXXL

SEQ ID NO: 71844 - DNA, 1329 bp, Saccharomyces cerevisiae; identical to SEQ ID NO: 19630
  CDS (1)..(1329)

SEQ ID NO: 71845 - protein, 442 aa, Saccharomyces cerevisiae; identical to SEQ ID NO: 19631

SEQ ID NO: 71846 - DNA, 1284 bp, Brassica napus
  CDS (1)..(1284)
atggagaaggatgctatggttagcaagaaacctcctttcgagccacgccgagttgttgtcactggcatgggagttgaaacgccactaggtcacgaccctcatactttttatgacaacctgcttctaggcaacagtggtataagccatatagagagtttcgactgttctgcatttcccactagaatcgctggagagattaaatctttttcgacccaaggattggttgctcctaaactttccaaaaggatggacaagttcatgctttaccttctcaccgccggcaagaaggcgttggaggatggtgtggtgactgaggatgtgatggcagagttcgacaaatcaagatgtggtgtcttgattggctcagcaatgggaggcatgaaggtcttctacgatgcgcttgaagctttgaaaatctcttacaggaagatgagccctttttgtgtaccttttgccaccacaaacatgggttccgctatgcttgccttggatctgggatggatgggtccaaactactctatttcaaccgcatgtgccacgggaaacttctgtattctcaatgcagcaaaccacatcacaagaggtgaagctgatgtaatgctctgcggtggctctgactcagttattattccaatagggttgggaggttttgttgcctgccgggctctttcagaaaataatgatgatcccaccaaagcttctcgtccttgggatagtaaccgagatggttttgttatgggagagggagccggagttctacttttagaagaacttgagcatgccaagaaaagaggagcaactatatacgcagagttccttgggggtagtttcacatgtgatgcataccatataaccgaaccacgtcctgatggtgctggtgtcattctcgctatcgagaaagcgttagctcatgccgggatttctaaggaagacataaattacgtgaatgctcatgctacctctacaccagctggagaccttaaggagtaccacgccctttctcactgttttggccaaaatcctgagctaagggtaaactcaacaaaatctatgattggacacttgctgggagcttctggggccgtggaggctgttgcaaccgttcaggcaataaagacaggatgggttcatccaaatatcaacctcgagaatccagacaaagcagtggatacaaagcttctggtgggtcttaagaaggagaggctggatatcaaagcagctttgtcaaactctttcggctttggtggccagaactctagcatcattttcgcgccctacaactga

SEQ ID NO: 71847 - protein, 427 aa, Brassica napus
MEKDAMVSKKPPFEPRRVVVTGMGVETPLGHDPHTFYDNLLLGNSGISHIESFDCSAFPTRIAGEIKSFSTQGLVAPKLSKRMDKFMLYLLTAGKKALEDGVVTEDVMAEFDKSRCGVLIGSAMGGMKVFYDALEALKISYRKMSPFCVPFATTNMGSAMLALDLGWMGPNYSISTACATGNFCILNAANHITRGEADVMLCGGSDSVIIPIGLGGFVACRALSENNDDPTKASRPWDSNRDGFVMGEGAGVLLLEELEHAKKRGATIYAEFLGGSFTCDAYHITEPRPDGAGVILAIEKALAHAGISKEDINYVNAHATSTPAGDLKEYHALSHCFGQNPELRVNSTKSMIGHLLGASGAVEAVATVQAIKTGWVHPNINLENPDKAVDTKLLVGLKKERLDIKAALSNSFGFGGQNSSIIFAPYN

SEQ ID NO: 71848 - DNA, 2058 bp, Zea mays
  CDS (30)..(1520)
cggcacgagcggcacgagggaggggggcaatggcggccgtggcaggcccactctgcacgtggctcgtcgccgcgtgcttatctgcggcatgcgacgctgaagagcacaagcagaagcatttctgcgcaggcggaagccgcgctgggggcggtgtcatgctcggccagcgccgccgcctcggcgcgcggcgtcgcggcttggcgcgctctggaatgactatggctgttgccttacaagctgaaagaagtgtcattgaaaagaagaaacccgatatcaaacaaaggagggtggttgtcactggcatgggtgtagtgacaccattgggccatgatcctgacgtgttttacaacaatcttcttgatggtgttagcggaataagtgagattgagaggtttgactgttccaacttccccacgagaattgcaggagagataaaatccttctctactgatggttgggttgcacctaaacttgcaaagcggatggacaagtttatgctatatctgataactgctggaaagaaggcattagaaaatggtggactcactgaagaactaaggaatgagttggacaaaaccaggtgtggggttcttattggttctgcaatgggtggcatgaaggtttttaatgatgcaattgaagcactgagggtctcttacaagaaaatgaacccattttgtgttccttttgcaactacgaatatgggctctgcgatccttgcaatggatctgggatggatgggaccaaactattctatttccacagcttgtgctaccagtaacttctgtatccttaatgcagcaaaccacatcagaagaggcgaagctgacgttatgctctgcggtggttctgatgcacctcttatcccaatcggattgggaggttttgtggcatgcagagctctttcacagaggaacagtgacccaacaaaagcttctcggccttgggacatgggacgtgatggttttgttatgggggaaggggctggtgtcctcgtattggaagaacttgagcatgccaaggaaagaggtgcaacaatatatgctgaatttcttggtggaagcttcacatgtgatgcttaccacatgactgagccacatcctgaaggaagagggattgctctctgcatcgaaaaggcactagctgatgcaggggtagcaagggaagaaatcaactacgtgaatgcccatgcaacatctacacaagcaggtgacttgaaggagtatgaggctatcgtgcgctgttttcgccagaaccctcaactgagggtgaactcgaccaaatcaatgactgggcatcttataggagcagctggtggaatagaagcagttgcttctatacaagctataagaactggttgggtccatccaaatttgaatttagaaaatccagaggacaccgtggacgtgggcgtcttggtagggtcacagaaggagagatgtgaagtgaaggtggcgttgtccaactcattcggattcggtgggcacaactcatcgattctctttgccccctttaagtgaacatgaccgaggcgaagaaccgacatcttcatcatcgcgcaaatggcttcatatatctggaactccacatagaaatctggtggattctgcaacttcctccgtgccacacatactgcatatggaggtccaaagtgagggtacaatactatgccacacacatttgagcgaacaaaacatcagcccccctacatgtttcatctactatcacaaagttgcaaaatatatatggtaactatcaaagaacttaccgtacctgggccagtgttttcgccttcaccatacctgcccattgtcagtactatttcctacatttggtgtagtcccgtagcttaatcctcttccctgcggaggtgatgggatcttatgttgtattgttgttgccaacagtatcgttattagccatgaattgctggttcccactgtaagcatcactggacgttttcgctttggttgtttctgtttcctgctgttcataaccgagttaaagatatgtaaatggcgaccctgttcggcctttaatcaaaaaaaaaaaaaaaaa

SEQ ID NO: 71849 - protein, 496 aa, Zea mays
MAAVAGPLCTWLVAACLSAACDAEEHKQKHFCAGGSRAGGGVMLGQRRRLGARRRGLARSGMTMAVALQAERSVIEKKKPDIKQRRVVVTGMGVVTPLGHDPDVFYNNLLDGVSGISEIERFDCSNFPTRIAGEIKSFSTDGWVAPKLAKRMDKFMLYLITAGKKALENGGLTEELRNELDKTRCGVLIGSAMGGMKVFNDAIEALRVSYKKMNPFCVPFATTNMGSAILAMDLGWMGPNYSISTACATSNFCILNAANHIRRGEADVMLCGGSDAPLIPIGLGGFVACRALSQRNSDPTKASRPWDMGRDGFVMGEGAGVLVLEELEHAKERGATIYAEFLGGSFTCDAYHMTEPHPEGRGIALCIEKALADAGVAREEINYVNAHATSTQAGDLKEYEAIVRCFRQNPQLRVNSTKSMTGHLIGAAGGIEAVASIQAIRTGWVHPNLNLENPEDTVDVGVLVGSQKERCEVKVALSNSFGFGGHNSSILFAPFK

SEQ ID NO: 71850 - DNA, 1302 bp, Zea mays
  CDS (1)..(1302)
atggctgttgccttacaagctgaaagaagtgtcattgaaaagaagaaacccgatatcaaacaaaggagggtggttgtcactggcatgggtgtagtgacaccattgggccatgatcctgacgtgttttacaacaatcttcttgatggtgttagcggaataagtgagattgagaggtttgactgttccaacttccccacgagaattgcaggagagataaaatccttctctactgatggttgggttgcacctaaacttgcaaagcggatggacaagtttatgctatatctgataactgctggaaagaaggcattagaaaatggtggactcactgaagaactaaggaatgagttggacaaaaccaggtgtggggttcttattggttctgcaatgggtggcatgaaggtttttaatgatgcaattgaagcactgagggtctcttacaagaaaatgaacccattttgtgttccttttgcaactacgaatatgggctctgcgatccttgcaatggatctgggatggatgggaccaaactattctatttccacagcttgtgctaccagtaacttctgtatccttaatgcagcaaaccacatcagaagaggcgaagctgacgttatgctctgcggtggttctgatgcacctcttatcccaatcggattgggaggttttgtggcatgcagagctctttcacagaggaacagtgacccaacaaaagcttctcggccttgggacatgggacgtgatggttttgttatgggggaaggggctggtgtcctcgtattggaagaacttgagcatgccaaggaaagaggtgcaacaatatatgctgaatttcttggtggaagcttcacatgtgatgcttaccacatgactgagccacatcctgaaggaagagggattgctctctgcatcgaaaaggcactagctgatgcaggggtagcaagggaagaaatcaactacgtgaatgcccatgcaacatctacacaagcaggtgacttgaaggagtatgaggctatcgtgcgctgttttcgccagaaccctcaactgagggtgaactcgaccaaatcaatgactgggcatcttataggagcagctggtggaatagaagcagttgcttctatacaagctataagaactggttgggtccatccaaatttgaatttagaaaatccagaggacaccgtggacgtgggcgtcttggtagggtcacagaaggagagatgtgaagtgaaggtggcgttgtccaactcattcggattcggtgggcacaactcatcgattctctttgccccctttaagtga

SEQ ID NO: 71851 - protein, 433 aa, Zea mays
MAVALQAERSVIEKKKPDIKQRRVVVTGMGVVTPLGHDPDVFYNNLLDGVSGISEIERFDCSNFPTRIAGEIKSFSTDGWVAPKLAKRMDKFMLYLITAGKKALENGGLTEELRNELDKTRCGVLIGSAMGGMKVFNDAIEALRVSYKKMNPFCVPFATTNMGSAILAMDLGWMGPNYSISTACATSNFCILNAANHIRRGEADVMLCGGSDAPLIPIGLGGFVACRALSQRNSDPTKASRPWDMGRDGFVMGEGAGVLVLEELEHAKERGATIYAEFLGGSFTCDAYHMTEPHPEGRGIALCIEKALADAGVAREEINYVNAHATSTQAGDLKEYEAIVRCFRQNPQLRVNSTKSMTGHLIGAAGGIEAVASIQAIRTGWVHPNLNLENPEDTVDVGVLVGSQKERCEVKVALSNSFGFGGHNSSILFAPFK

SEQ ID NO: 71852 - DNA, 1302 bp, Glycine max
  CDS (1)..(1302)
atggctgtagctttgcaacctacccaagaggtcacaacaataaaaaaacctcctacaaagcaaaggcgagtagttgtgacaggattgggtgtggttacaccacttgggcatgagccagatatcttctacaataatttgcttgatggtgttagtggcataagtgagattgaaacatttgactgtgcagaatatccaacaaggattgctggtgaaatcaagtctttctcaactgatggctgggtagcaccaaaactttctaagagaatggataaatttatgctctatatgctgacagctggcaaaaaagccttggttgatggtggaattactgatgatgtaatggatgagttaaataaagataagtgtggagttctgattggctcagcaatgggtggcatgaaggttttcaatgatgccattgaagctttacgaatctcatataagaagatgaatcctttttgtgtaccttttgcaacaacaaatatgggttctgccatgcttgcaatggatctgggatggatgggccctaattattctatctctacagcttgtgctacaagtaacttttgtatattgaatgcagcaaaccatatcattagaggtgaagctgatgtgatgctttgtggtggctcagatgctgctattataccaattggtttgggaggctttgtggcatgcagggcactctcacaaaggaatactgatcctaccaaagcttcacgcccttgggacattaaccgtgatggatttgtcatgggagaaggggctggagttttgcttttagaagaactggagcatgctaagaaaagaggtgcaaccatatatgctgaattccttggtggaagtttcacctgtgatgcatatcatgtgactgagccgcgtcctgatggggctggtgttattctttgcattgaaaaggcattagctcagtctggagtatcaaaagaggatgtgaattacataaatgcacatgccacatccacaccagctggagatcttaaggagtaccaagctctaatgcattgttttggtcaaaaccccaagttacgagtgaattctacaaaatctatgattggtcatctactaggggcagctggcgctgtggaagctgtggccacaatacaggcaattaggacagggtgggttcatcccaatatcaacctagaaaagccagataatggagtggatgctaaagtgcttgttggctcaaagaaagagagactggatgtcaaggcagccttgtcgaattcatttggttttgggggtcacaattcttcaatcatatttgcaccttacaagtga

SEQ ID NO: 71853 - protein, 433 aa, Glycine max
MAVALQPTQEVTTIKKPPTKQRRVVVTGLGVVTPLGHEPDIFYNNLLDGVSGISEIETFDCAEYPTRIAGEIKSFSTDGWVAPKLSKRMDKFMLYMLTAGKKALVDGGITDDVMDELNKDKCGVLIGSAMGGMKVFNDAIEALRISYKKMNPFCVPFATTNMGSAMLAMDLGWMGPNYSISTACATSNFCILNAANHIIRGEADVMLCGGSDAAIIPIGLGGFVACRALSQRNTDPTKASRPWDINRDGFVMGEGAGVLLLEELEHAKKRGATIYAEFLGGSFTCDAYHVTEPRPDGAGVILCIEKALAQSGVSKEDVNYINAHATSTPAGDLKEYQALMHCFGQNPKLRVNSTKSMIGHLLGAAGAVEAVATIQAIRTGWVHPNINLEKPDNGVDAKVLVGSKKERLDVKAALSNSFGFGGHNSSIIFAPYK

SEQ ID NO: 71854 - DNA, 2232 bp, Glycine max
  CDS (213)..(1679)
agcagaaacgcagcagcatcgtgttggagagtgagacggaatgcattagtgaagaccgaggtttctcagaatctcaataacccccttcgttgaaaccaaaacgacgacgcgtcacttcactttgatgtgtctcgtcgtttctactttctgttgattagcctcattcactctctcgctcgcttgcaaccacacccttggatttaatttcattcatggcttcgaccaccacctcctccctctgcacgtggctcgttgctgcttgcatgtcagtcacgtgccacgccgaccgcaccaaaacccctcacgcaatgttccgctcctccaaaaagtctcgctactctcaattcaacgtttgtcgatccactcattctggtaaaacaatggctgtagctttgcaacctacccaagagatcacgacaataaaaaaacctcccacgaagcaaaggcgagtggttgtgacaggattgggtgtggttacaccacttgggcatgagccagatatcttctacaataatttgcttgatggtgctagtggcataagcgagattgaaacatttgattgtgcagaatatccaacaaggattgctggtgaaatcaagtctttctcaactgatggctgggtagcaccaaaactttctaagagaatggataaatttatgctctatatgctgacagctggcaaaaaagccttggttgatggtggaattactgatgatgtaatggatgagttaaataaagaaaagtgtggagttctgattgggtcagcaatgggtggcatgaaggttttcaatgatgccatcgaagctttacgaatctcatataagaagatgaagcctttttgtgtaccttttgcaacaacaaatatgggttctgccatgcttgcaatggatctgggatggatgggccctaattattctatctctacagcttgtgctacaagtaacttttgtatattgaatgcagcaaaccatatcattagaggtgaagctgatgtgatgctttgtggaggctcagatgctgctattataccaattggtttgggaggctttgtggcatgcagggcactctcacaaaggaatactgatcctaccaaagcttcacgcccttgggacattaaccgtgatggatttgtcatgggtgaaggggctggagttttgcttttagaggaactggagcatgctaaggaaagaggtgcaaccatatatgctgaattccttggtggaagtttcacctgtgatgcatatcatgtgactgagccgcgtcctgatggggctggtgttatactgtgcattgaaaaggcattagctcagtctggagtatcaaaagaggatgtgaattacataaatgcacatgccacatccacaccagctggagatcttaaggagtaccaagctctaatgcattgttttggtcaaaaccccgagttaagagtgaattctacaaaatctatgattggtcatctactaggggcagctggcggtgtggcagctgtggccacaatacaggcaattaggacagggtgggttcatcccaatatcaacctagaaaacccagataacggagtggatgctaaagtgcttgttggctcaaagaaagagagactggatgtcaaggcagccttgtcgaattcatttggttttgggggtcacaattcttcaatcatatttgcaccatactagtgaaacagatttcagagcagtactttcttattattataagttactgagtacccagacaatgtttattgcatactaactccagtgttttggttggttgagaatatatgcggtgtggattagttggttggatcagtaactgttgagaaacattgttttttgggatggggttggttgtgtgcctacagaatcagagtgttgatagattatcattatctggtgctcctggtgggagagagtgagtcgctatctatccactaccataaaatcctatctttaccatgaatggctagagtaggagttgacccacttttgatgtaaccgtttaacaaccattttgatgggatggatacagtcttttgttttattcccatgtacaaatagaccctcatggctctgggcattgggcaataaccaaatttcagtgattgtttagcggactcgtcgaatagattatgccttttcagtttcactggaatttatataccctggagggtgatttcaattttatgagggttttgagttttccaaaaaaaaaaaaaaaaaaaaaaaaaaa

SEQ ID NO: 71855 - protein, 488 aa, Glycine max
MASTTTSSLCTWLVAACMSVTCHADRTKTPHAMFRSSKKSRYSQFNVCRSTHSGKTMAVALQPTQEITTIKKPPTKQRRVVVTGLGVVTPLGHEPDIFYNNLLDGASGISEIETFDCAEYPTRIAGEIKSFSTDGWVAPKLSKRMDKFMLYMLTAGKKALVDGGITDDVMDELNKEKCGVLIGSAMGGMKVFNDAIEALRISYKKMKPFCVPFATTNMGSAMLAMDLGWMGPNYSISTACATSNFCILNAANHIIRGEADVMLCGGSDAAIIPIGLGGFVACRALSQRNTDPTKASRPWDINRDGFVMGEGAGVLLLEELEHAKERGATIYAEFLGGSFTCDAYHVTEPRPDGAGVILCIEKALAQSGVSKEDVNYINAHATSTPAGDLKEYQALMHCFGQNPELRVNSTKSMIGHLLGAAGGVAAVATIQAIRTGWVHPNINLENPDNGVDAKVLVGSKKERLDVKAALSNSFGFGGHNSSIIFAPY

SEQ ID NO: 71856 - DNA, 1299 bp, Glycine max
  CDS (1)..(1299)
atggctgtagctttgcaacctacccaagagatcacgacaataaaaaaacctcccacgaagcaaaggcgagtggttgtgacaggattgggtgtggttacaccacttgggcatgagccagatatcttctacaataatttgcttgatggtgctagtggcataagcgagattgaaacatttgattgtgcagaatatccaacaaggattgctggtgaaatcaagtctttctcaactgatggctgggtagcaccaaaactttctaagagaatggataaatttatgctctatatgctgacagctggcaaaaaagccttggttgatggtggaattactgatgatgtaatggatgagttaaataaagaaaagtgtggagttctgattgggtcagcaatgggtggcatgaaggttttcaatgatgccatcgaagctttacgaatctcatataagaagatgaagcctttttgtgtaccttttgcaacaacaaatatgggttctgccatgcttgcaatggatctgggatggatgggccctaattattctatctctacagcttgtgctacaagtaacttttgtatattgaatgcagcaaaccatatcattagaggtgaagctgatgtgatgctttgtggaggctcagatgctgctattataccaattggtttgggaggctttgtggcatgcagggcactctcacaaaggaatactgatcctaccaaagcttcacgcccttgggacattaaccgtgatggatttgtcatgggtgaaggggctggagttttgcttttagaggaactggagcatgctaaggaaagaggtgcaaccatatatgctgaattccttggtggaagtttcacctgtgatgcatatcatgtgactgagccgcgtcctgatggggctggtgttatactgtgcattgaaaaggcattagctcagtctggagtatcaaaagaggatgtgaattacataaatgcacatgccacatccacaccagctggagatcttaaggagtaccaagctctaatgcattgttttggtcaaaaccccgagttaagagtgaattctacaaaatctatgattggtcatctactaggggcagctggcggtgtggcagctgtggccacaatacaggcaattaggacagggtgggttcatcccaatatcaacctagaaaacccagataacggagtggatgctaaagtgcttgttggctcaaagaaagagagactggatgtcaaggcagccttgtcgaattcatttggttttgggggtcacaattcttcaatcatatttgcaccatactag

SEQ ID NO: 71857 - protein, 432 aa, Glycine max
MAVALQPTQEITTIKKPPTKQRRVVVTGLGVVTPLGHEPDIFYNNLLDGASGISEIETFDCAEYPTRIAGEIKSFSTDGWVAPKLSKRMDKFMLYMLTAGKKALVDGGITDDVMDELNKEKCGVLIGSAMGGMKVFNDAIEALRISYKKMKPFCVPFATTNMGSAMLAMDLGWMGPNYSISTACATSNFCILNAANHIIRGEADVMLCGGSDAAIIPIGLGGFVACRALSQRNTDPTKASRPWDINRDGFVMGEGAGVLLLEELEHAKERGATIYAEFLGGSFTCDAYHVTEPRPDGAGVILCIEKALAQSGVSKEDVNYINAHATSTPAGDLKEYQALMHCFGQNPELRVNSTKSMIGHLLGAAGGVAAVATIQAIRTGWVHPNINLENPDNGVDAKVLVGSKKERLDVKAALSNSFGFGGHNSSIIFAPY

SEQ ID NO: 71858 - DNA, 1221 bp, Escherichia coli O157:H7 EDL933
  CDS (1)..(1221): transl_table=11
atgaaacgtgcagtgattactggcctgggcattgtttccagcatcggtaataaccagcaggaagtcctggcatctctgcgtgaaggacgttcagggatcactttctctcaggagctgaaggattccggcatgcgtagccacgtctggggcaacgtaaaactggataccactggcctcattgaccgcaaagttgtgcgctttatgagcgacgcatccatttatgcattcctttctatggagcaggcaatcgcagatgcgggcctctctccggaagcttaccagaataatccgcgtgttggcctgattgcaggttctggcggcggttccccgcgtttccaggtgttcggcgctgacgcaatgcgcggcccgcgcggcctgaaarcggttggccygtatgtggtcaccaaagcgatggcatccggcgtttctgcctgcctcgccacgccgtttaaaattcatggcgttaactactccatcagctccgcgtgtgcgacttccgcacactgtatcggtaacgcagtagagcagatccaactgggcaaacaggacatcgtgtttgctggcggcggcgaagagctgtgctgggaaatggcttgcgaattcgacgcaatgggtgcgctgtctactaaatacaacgacaccccggaaaaagcctcccgtacttacgatgctcaccgtgacggtttcgttatcgctggcggcggcggtatggtggtggttgaagagctggaacacgcgctggcgcgtggtgctcacatctatgctgaaatcgttggctacggcgcaacgtctgatggcgcagacatggttgctccctctggcgaaggcgcagtacgttgtatgcagatggcgatgcatggcgttgataccccaatcgattacctgaactcccacggcacttcgactccggttggcgacgtgaaagagctggcagctatccgtgaagtgttcgrcgataagagcccggcgatttctgcaaccaaagccatgaccggtcactctctgggcgctgctggcgtacaggaagctatctactctctgctgatgctggaacacggctttatcgccccgagcatcaacattgaagagctggacgagcaggctgcgggtctgaacatcgtgaccgaaacgaccgatcgcgaactgaccactgttatgtctaacagcttcggcttcggcggcaccaacgccacgctggtaatgcgcaagctgaaagattaa

SEQ ID NO: 71859 - protein, 406 aa, Escherichia coli O157:H7 EDL933
  misc_feature <128>..<128>: The Xaa at location 128 stands for Ala, or Thr.
  misc_feature <131>..<131>: The Xaa at location 131 stands for Leu, or Pro.
  misc_feature <318>..<318>: The Xaa at location 318 stands for Asp, or Gly.
MKRAVITGLGIVSSIGNNQQEVLASLREGRSGITFSQELKDSGMRSHVWGNVKLDTTGLIDRKVVRFMSDASIYAFLSMEQAIADAGLSPEAYQNNPRVGLIAGSGGGSPRFQVFGADAMRGPRGLKXVGXYVVTKAMASGVSACLATPFKIHGVNYSISSACATSAHCIGNAVEQIQLGKQDIVFAGGGEELCWEMACEFDAMGALSTKYNDTPEKASRTYDAHRDGFVIAGGGGMVVVEELEHALARGAHIYAEIVGYGATSDGADMVAPSGEGAVRCMQMAMHGVDTPIDYLNSHGTSTPVGDVKELAAIREVFXDKSPAISATKAMTGHSLGAAGVQEAIYSLLMLEHGFIAPSINIEELDEQAAGLNIVTETTDRELTTVMSNSFGFGGTNATLVMRKLKD

SEQ ID NO: 71860 - DNA, 1230 bp, Escherichia coli O157:H7 EDL933
  CDS (1)..(1230): transl_table=11
atgacacgtcgcgtagtgattacaggaatgggcggcgtgactgcctttggtgaaaactggcaggacgtttctgcacgcttactggcatatgaaaatgcggtgcgcaaaatgccggagtggcaggtctacgatgggctgcacaccctgcttggcgcgcctgttgatgatttcacgctaccggagcactacacccgcaagcgtatccgtgcgatgggccgcgtgtcgcaaatgtcgacccgtgccagcgagctggcgttagagcaggcagggttgattggcgatccgatattaaccagcggcgaaacgggcattgcgtacggttcatcgaccggcagtaccggcccggtaagcgagttcgccaccatgctgacggaaaagcacaccaataacatcactggcaccacctatgtgcagatgatgccgcacaccaccgccgttaatactggcctctttttcggcctgcgcgggcgggtgatcccaacctccagcgcctgtacttccggcagccaggcaatcggttatgcgtgggaagccattcgccacggttatcaaacggtgatggttgctggtggtgccgaagagttatgtccttcagaagcagcggtatttgatacgcttttcgccaccagccagcacaatgatgcgccgaaaaccacaccttcaccgttcgatgaaaaccgcgacgggctggtgattggtgaaggcgcaggtacgctcattctcgaagaactggagcacgccaaagcgcgcggcgcgaccatttacggtgaaatcgtcggctttgcgactaactgcgacgcggcacatattacccagccgcagcgcgaaaccatgcagtattgtatggagcaatcgctgaaaatcgccgggttaagcgcacaagatatcggctatatttcagcgcatggtacggcgaccgatcgcggtgatatggcagaaagtctggcgacagcaaccatttacggtgataatgtgccgctctcctcgctgaaaagttattttggtcatacgcttggtgcctgtggcgcgctcgaagcctggatgagtctgcaaatgatgcgcgaaggttggtttgcgcctacgctaaacctgaataaaccagacccgaattgtggcgcgctggattacatyatgcatgaagcccgcaaggttgattgtgagtttttgcagagtaacaactttgcctttggcggcattaatacatccatcatcattaaacgttggccctga

SEQ ID NO: 71861 - protein, 409 aa, Escherichia coli O157:H7 EDL933
MTRRVVITGMGGVTAFGENWQDVSARLLAYENAVRKMPEWQVYDGLHTLLGAPVDDFTLPEHYTRKRIRAMGRVSQMSTRASELALEQAGLIGDPILTSGETGIAYGSSTGSTGPVSEFATMLTEKHTNNITGTTYVQMMPHTTAVNTGLFFGLRGRVIPTSSACTSGSQAIGYAWEAIRHGYQTVMVAGGAEELCPSEAAVFDTLFATSQHNDAPKTTPSPFDENRDGLVIGEGAGTLILEELEHAKARGATIYGEIVGFATNCDAAHITQPQRETMQYCMEQSLKIAGLSAQDIGYISAHGTATDRGDMAESLATATIYGDNVPLSSLKSYFGHTLGACGALEAWMSLQMMREGWFAPTLNLNKPDPNCGALDYIMHEARKVDCEFLQSNNFAFGGINTSIIIKRWP

SEQ ID NO: 71862 - DNA, 1329 bp, Agrobacterium tumefaciens str. C58; identical to SEQ ID NO: 19682
  CDS (1)..(1329): transl_table=11

SEQ ID NO: 71863 - protein, 442 aa, Agrobacterium tumefaciens str. C58; identical to SEQ ID NO: 19683

SEQ ID NO: 71864 - DNA, 1383 bp, Agrobacterium tumefaciens str. C58; identical to SEQ ID NO: 19684
  CDS (1)..(1383): transl_table=11

SEQ ID NO: 71865 - protein, 460 aa, Agrobacterium tumefaciens str. C58; identical to SEQ ID NO: 19685

SEQ ID NO: 71866 - DNA, 1242 bp, Escherichia coli K12; identical to SEQ ID NO: 19626
  CDS (1)..(1242): transl_table=11

SEQ ID NO: 71867 - protein, 413 aa, Escherichia coli K12; identical to SEQ ID NO: 19627

SEQ ID NO: 71868 - DNA, 1242 bp, Salmonella typhimurium LT2
  CDS (1)..(1242): transl_table=11
gtgtctaagcgtcgtgtagttgtgaccggactgggcatgttgtctcctgtcggcaataccgtagagtctacctggaaagctctccttgccggtcagagtggcatcagcctgatcgaccatttcgatactagcgcctatgcaacgaaatttgctggcttagtaaaggattttaactgtgatgacattatctcgcgcaaagaacagcgcaagatggatgccttcattcaatatggaattgtcgctggcgtacaggccatgcaggattctggccttgaagtgacggaagagaacgcaagccgtattggcgccgctatcggctccggtatcggtggtctcggtctgatcgaagaaaaccacagttcgctggtaaaaggcggaccgcgtaagattagcccgttctttgtcccgtcgacgattgttaacatggtagcaggccatctgactatcatgtatggcctgcgtgggccaagcatctctattgcgactgcctgtacttcaggcgtgcataacatcggccatgccgcgcgtatcatcgcctatggcgatgcggacgcgatggtggcaggtggcgcagaaaaagccagtacgccgctgggtgtaggtggttttggcgcagcgcgcgcgctgtcgacccgcaacgataacccacaggcggcgagccgtccgtgggataaagaacgcgatggttttgtactgggcgacggtgccggtatgttggtgcttgaagagtacgaacatgcaaaagcgcgtggtgcgaaaatctatgccgaaatcgtcggctttggtatgagcagcgatgcttaccatatgacgtcgccgccggaaaatggcgcaggcgctgcgctggcgatggttaacgcgttgcgtgatgccgcgattgagcctgctcagattggctacgtcaacgcgcacggcacgtcgacgcctgccggcgacaaagctgagacgcaggcggttaagtcagtctttggcgatgctgcaagccgagtgatggtgagctcgaccaaatcgatgaccggccatctgttgggcgccgcaggcgcagtagagtctattttctctattctggcgctgcgcgatcaggccattccgccaaccattaatctggataacccggatgaaggttgcgatctggacttcgtgccgcatgaagcgcgccaggtcagcgatctggagtacgctctgtgcaactcctttggttttggcggaactaacggttccttgatctttaaaaagatctaa

SEQ ID NO: 71869 - protein, 413 aa, Salmonella typhimurium LT2; identical to SEQ ID NO: 19923

SEQ ID NO: 71870 - DNA, 1215 bp, Salmonella typhimurium LT2
  CDS (1)..(1215): transl_table=11
atgaaacgtgcagtgattactggcctgggcatcgtttccagcatcggtaataaccagcaggaagtcctggcatctctgcgtgaaggacgttcagggatcactttctctcaggagctgaaggacgccggcatgcgtagccaggtatggggcaacgtaaaactggataccactggcctcattgaccgcaaagtcgtgcgctttatgagcgacgcctccatctatgcttatctgtctatggagcaggcagtggccgacgccggtctggcgccggaagtctatcagaataacccgcgtgtcggcctgattgcaggttccggcggcggctccccgaaattccaggtctttggcgcagacgccatgcgtagcccgcgtggtttgaaagccgtgggcccgtatgtggtgacgaaagcaatggcatccggcgtttccgcctgcctcgctacgccgtttaaaatttatggcgtgaactactccattagctccgcttgcgcgacctccgcacactgtatcggcaatgcggttgaacagatccaactgggcaaacaggacatcgtttttgctggcggcggcgaagagctgtgctgggaaatggcctgtgagttcgacgcgatgggcgcactgtccaccaaatataacgatacgcctgaaaaagcgtcccgtacctatgatgcgcaccgtgatgggtttgtcatcgcgggcggtggcggtatggttgttgtcgaagagctggagcacgctctggcgcgcggcgcgcatatctatgcggaaatcgtcggctatggcgcaacatccgatggcgcagacatggttgctccgtctggtgaaggcgcagtacgttgcatgcagatggcgatgcacggcgtagacacgccgatcgactacctgaactctcacggtacctctactccggtaggcgacgtgaaagaactcggtgcaatccgtgaagtgtttggcgataacagcccggctatctccgcgaccaaagcgatgaccggccactcgctgggtgcggctggcgtgcaggaagccatctactctctgctgatgctggagcacggttttatcgcgccgagcatcaacatcgaagagctggatgagcaggctgcgggtctgaacatcgtgaccgaaacgaccgagcgtgaactgactaccgtaatgtctaacagcttcggttttggcggcaccaacgccacgctggtgatgcgtaagttgtaa

SEQ ID NO: 71871 - protein, 404 aa, Salmonella typhimurium LT2
MKRAVITGLGIVSSIGNNQQEVLASLREGRSGITFSQELKDAGMRSQVWGNVKLDTTGLIDRKVVRFMSDASIYAYLSMEQAVADAGLAPEVYQNNPRVGLIAGSGGGSPKFQVFGADAMRSPRGLKAVGPYVVTKAMASGVSACLATPFKIYGVNYSISSACATSAHCIGNAVEQIQLGKQDIVFAGGGEELCWEMACEFDAMGALSTKYNDTPEKASRTYDAHRDGFVIAGGGGMVVVEELEHALARGAHIYAEIVGYGATSDGADMVAPSGEGAVRCMQMAMHGVDTPIDYLNSHGTSTPVGDVKELGAIREVFGDNSPAISATKAMTGHSLGAAGVQEAIYSLLMLEHGFIAPSINIEELDEQAAGLNIVTETTERELTTVMSNSFGFGGTNATLVMRKL

SEQ ID NO: 71872 - DNA, 1224 bp, Agrobacterium tumefaciens str. C58
  CDS (1)..(1224): transl_table=11
atgagacgagttgttgtcaccggcctcggtattgtttcctccatcggcggtgatgccgctgaggtcaccgcgtcgctgcgccaagccaagtccggcatttcattttcgccggattttgccgagcacggtttcaaatgccaggtctggggcaagccctctctcgacccgaccgatctggtcgaccgccgcgccatgcgcttcctgtcgcagggtggcgcgtggaaccatgtggccatgaagcaggcgatcgccgattccggtctcgaagagagcgatatcagcggcaatgagcgcactggcatcatcatgggttcgggcggcccttccacccgcaccatcgtcgaagccgccgatattacgctcaagaacaacagcccgaagcgcatcggccccttcgccgtgccgaaggccatgtcatcgaccgcctcggccacgctcgcgacctggttcaagatccacggcgtcaactattcgatctcgtcggcctgctccacctcggcgcattgcatcggcaacgccgccgagatgatccagtggggcaaacaggacgtgatgtttgcgggcggccatgaggatctcgactggtcgatgtccaacctcttcgacgccatgggcgcaatgtcgtccaaatacaatgaaacacccggcgtcgcctcgcgcgcctatgacgtcaaccgcgacggtttcgtgatcgccggcggtgcaggcgtgctggttctcgaagaactggaacatgccaaggcgcgcggcgccaagatttacgccgagatcgtcggttatggcgcaacctctgatggttacgacatggtggctccttcaggcgaaggcgcgatccgctgcatgcgtcaggcgcttgccaccgtcaagggtgacattgactacatcaacacccacggcacctccacgccggttggcgacagcaaggaaatcggcgcgatccgcgaagtcttcggcgacaagattccgcatatccagtcgaccaagtcgctcaccggccattcgcttggtgctgctggcgtgcaggaatcgatctacggcctgttgatgatgcaggaacgtttcatcggcgaaagcgcgcatatttccgaactcgatccggaatttgcgggcgttccgattgttcgcagccgcatcgacgacgccaagatcgacaccatcctttccaattccttcggcttcggcggcaccaacgccacgctcgtcttccagcgtcataacggataa

SEQ ID NO: 71873 - protein, 407 aa, Agrobacterium tumefaciens str. C58
MRRVVVTGLGIVSSIGGDAAEVTASLRQAKSGISFSPDFAEHGFKCQVWGKPSLDPTDLVDRRAMRFLSQGGAWNHVAMKQAIADSGLEESDISGNERTGIIMGSGGPSTRTIVEAADITLKNNSPKRIGPFAVPKAMSSTASATLATWFKIHGVNYSISSACSTSAHCIGNAAEMIQWGKQDVMFAGGHEDLDWSMSNLFDAMGAMSSKYNETPGVASRAYDVNRDGFVIAGGAGVLVLEELEHAKARGAKIYAEIVGYGATSDGYDMVAPSGEGAIRCMRQALATVKGDIDYINTHGTSTPVGDSKEIGAIREVFGDKIPHIQSTKSLTGHSLGAAGVQESIYGLLMMQERFIGESAHISELDPEFAGVPIVRSRIDDAKIDTILSNSFGFGGTNATLVFQRHNG

SEQ ID NO: 71874 - DNA, 1263 bp, Agrobacterium tumefaciens str. C58; identical to SEQ ID NO: 19706
  CDS (1)..(1263): transl_table=11

SEQ ID NO: 71875 - protein, 420 aa, Agrobacterium tumefaciens str. C58; identical to SEQ ID NO: 19707

SEQ ID NO: 71876 - DNA, 1281 bp, Agrobacterium tumefaciens str. C58
  CDS (1)..(1281): transl_table=11
atgaccaattttaaggatcatctcggtcgcccgatcgttgccgtgaccggcatgggcatcatcacctcgctcggtcagggacttgccgacaactgggcagcgctgacatcaggcaagtcgggtattcacaagatcacccgcttcccgactgaagggctttcgacccgcatcagcggcacggtggatttcatcgatatcccggttcccaactccgtcgagcgttcttatgctttcgcgcgtgaaaccaccatcgaggcgctggcgcaggccggtatatcgggtgatttcgatgggccgctgtttctcgcagcgccaccgattgagccggaatggagcgcccgtttcgagcttgccgaccggtctccgccagccgcaaagccgggtgacgcctatgagcggttcatgacggcgttgcgccagcgtcccgatccggcattccaggaagccgcattgttcggcgcgatttccgaacgtctttccgaccgttttggcacgcgcggcctgccggtcacgctgtctacggcctgtgcttcgggtgcgactgcgatccagctcggcgtcgaggcgatccgccagggccgcacggagcgcgctctgacggttgcgactgacggttccgtcagcgccgaagccctgatccgcttctcgcttctgtctgcgctttcgacccagaacgatccgcccgaaaaggcctccaagccgttcagcaaggatcgcgatggtttcgtgatcgctgaaggtgcggcgacgctggtgttggaatcgctcgaagctgccgttgcccgtggcgccaaggttctcggcatcatcaagggcgccggcgaaaaggccgacagcttccaccgcacgcgttcttcgcccgatggcggcccggcgatcgcgacgatccgtgcggcacttgccgatgcgggcgtggccgaaagcgatatcggctatatcaacgctcacggcacctcgacgcctgagaatgacaagatggaatatggctcgatgctggccgtcttcggcgaaggcctgaagaatattccgctgtcgtctaacaagtcgatgattggccatacgctgacggccgcaggcgccgtggaagcggtgttctcgctgcagaccatgctgaccgggaccctgccgccgacgatcaactacaacaatcccgatccgaccatcaccctcgacgtggtgccgaatgtgaagcgggatgcgcaggtgggtgcggttctctccaactccttcgggtttggcgggcagaatgcaagccttgtcatgacgcgggaaccggcttaa

SEQ ID NO: 71877 - protein, 426 aa, Agrobacterium tumefaciens str. C58
MTNFKDHLGRPIVAVTGMGIITSLGQGLADNWAALTSGKSGIHKITRFPTEGLSTRISGTVDFIDIPVPNSVERSYAFARETTIEALAQAGISGDFDGPLFLAAPPIEPEWSARFELADRSPPAAKPGDAYERFMTALRQRPDPAFQEAALFGAISERLSDRFGTRGLPVTLSTACASGATAIQLGVEAIRQGRTERALTVATDGSVSAEALIRFSLLSALSTQNDPPEKASKPFSKDRDGFVIAEGAATLVLESLEAAVARGAKVLGIIKGAGEKADSFHRTRSSPDGGPAIATIRAALADAGVAESDIGYINAHGTSTPENDKMEYGSMLAVFGEGLKNIPLSSNKSMIGHTLTAAGAVEAVFSLQTMLTGTLPPTINYNNPDPTITLDVVPNVKRDAQVGAVLSNSFGFGGQNASLVMTREPA

SEQ ID NO: 71878 - DNA, 1299 bp, Agrobacterium tumefaciens str. C58; identical to SEQ ID NO: 19708
  CDS (1)..(1299): transl_table=11

SEQ ID NO: 71879 - protein, 432 aa, Agrobacterium tumefaciens str. C58; identical to SEQ ID NO: 19709

SEQ ID NO: 71880 - DNA, 1287 bp, Streptomyces coelicolor A3(2); identical to SEQ ID NO: 19718
  CDS (1)..(1287): transl_table=11

SEQ ID NO: 71881 - protein, 428 aa, Streptomyces coelicolor A3(2); identical to SEQ ID NO: 19719

SEQ ID NO: 71882 - DNA, 1269 bp, Streptomyces coelicolor A3(2); identical to SEQ ID NO: 19720
  CDS (1)..(1269): transl_table=11

SEQ ID NO: 71883 - protein, 422 aa, Streptomyces coelicolor A3(2); identical to SEQ ID NO: 19721

SEQ ID NO: 71884 - DNA, 1290 bp, Streptomyces coelicolor A3(2); identical to SEQ ID NO: 19722
  CDS (1)..(1290): transl_table=11

SEQ ID NO: 71885 - protein, 429 aa, Streptomyces coelicolor A3(2); identical to SEQ ID NO: 19723

SEQ ID NO: 71886 - DNA, 1221 bp, Streptomyces coelicolor A3(2)
  CDS (1)..(1221): transl_table=11
gtgaccgaggggcccgccgccatcaccggtgtcgggctggtgacgccggccggtaccgacgccgactcgacctgggaggcgatgtgcgcagcccggtccctggagggcggtgaccccgagccgctggccgggaccggggcgtggcacagcctgcgggtgcccgcgctgcggccggggcagctgaccgggcgcgggaccgcccgtaccgatccgttcatccggttcgcgctggtggccgtggcggaggcgctggcgcagtcggggctcgacccggacagctgggacggcagccgggtcggggtcgtcgtgggcagcgccttcgggggcgtgaccacgcacgacgagcagcaccggcggctggagcggcagggggcggccatggtgtcgccgtacctgcacccccgggccctgatcaacatggcggccgggaccatcggcgcccggtacgggatcaccgggcccggtcacaccgtggccgccgcctgtgcctcgggggcctcggcgttcgggctcggcaagacgctgctggacgccggtgtctgcgacacggtcgtcgtctgcggcacggacgcggccgtcacccccctcgtcgtctccggcttcgcccggatgggcgcgctgtccgaacagaaggcgaccgacgcctcccggccgttcggcgccgaccgcgacggcttcgtgatgtcggagggtgccgccgccgtcgtcatggagaagccggccaaggcgcgggcgcggggagcggaggtgctggggcggctgctcgggcatgccgacacctccgacgcgcatcatccgacggccccccggccggacggtgcgggcgccgcggccgccgtggagcgggcgctggcggcggcgcggatgtcggtgcggaacgtgaccaccgtcaacgcgcacggcacctcgaccccgcagaacgacctgacggaggcccggctcatcgcccgcctcttcccgcacggcccgtccgtcaccgcgaacaagggcctgctgggccacacgctcggcgcggcgggcgccatcgaggccgtactgaccctgcgcagcctgcgcaccggcgtgctgccgccgatcgcgcacaccgagcgggccgaccccggcctgcccgagctggacctggtcctcggcggggtgcgccggcacgacgggaacgtcgccgtgagcacctccttcgggttcggcggcagcaactgcgcgctggtgctggacgccggctga

SEQ ID NO: 71887 - protein, 406 aa, Streptomyces coelicolor A3(2)
MTEGPAAITGVGLVTPAGTDADSTWEAMCAARSLEGGDPEPLAGTGAWHSLRVPALRPGQLTGRGTARTDPFIRFALVAVAEALAQSGLDPDSWDGSRVGVVVGSAFGGVTTHDEQHRRLERQGAAMVSPYLHPRALINMAAGTIGARYGITGPGHTVAAACASGASAFGLGKTLLDAGVCDTVVVCGTDAAVTPLVVSGFARMGALSEQKATDASRPFGADRDGFVMSEGAAAVVMEKPAKARARGAEVLGRLLGHADTSDAHHPTAPRPDGAGAAAAVERALAAARMSVRNVTTVNAHGTSTPQNDLTEARLIARLFPHGPSVTANKGLLGHTLGAAGAIEAVLTLRSLRTGVLPPIAHTERADPGLPELDLVLGGVRRHDGNVAVSTSFGFGGSNCALVLDAG

SEQ ID NO: 71888 - DNA, 1224 bp, Streptomyces coelicolor A3(2); identical to SEQ ID NO: 19724
  CDS (1)..(1224): transl_table=11

SEQ ID NO: 71889 - protein, 407 aa, Streptomyces coelicolor A3(2); identical to SEQ ID NO: 19725

SEQ ID NO: 71890 - DNA, 1245 bp, Pseudomonas putida KT2440; identical to SEQ ID NO: 19748
  CDS (1)..(1245): transl_table=11

SEQ ID NO: 71891 - protein, 414 aa, Pseudomonas putida KT2440; identical to SEQ ID NO: 19749

SEQ ID NO: 71892 - DNA, 1299 bp, Pseudomonas putida KT2440
  CDS (1)..(1299): transl_table=11
atgagccccacacggatcgtgatcacgggcatgggcgccgtcaccggcttcggtttcgagtggcagtccatgtggcaaagaatgttggccggcgagcattgcattcggccatggcaaccggaaggcgtcgaggcgggtgcgttccccgtgcgttacgcagcgcccgtggatatgggcttgatgccggcacacttgaaagaccatccggcctggggattgtcgctggaaaaacgcacccgctttggctggatcgcggccacccaagccattgccgatagtggtctgagccccgaacagttgcgtggcgcggcggtattgtcagcgtccggcgcacctgctcatcgtttgcaggacatgctgctcagcctggcggataacccggcgcaggcgccgtcctgggctcaattgatggcgcgacaggcgcaggtcgatcctgacagttcactgcgtcagagcaacgaccgccttgcgcgggtgattgccgatggcatcggcagtgaaggcccggtgatcaatgtcagcagcgcctgcgcgggagcgtcccaggccatcggcaatgcattccagatgatccgtcgcggcgaggtcgagctggccattgccgggggcgccgattcggtgcttagcctggacaccatgaccgcgctgtatctgctcggcgccgccagcagcgaacagcgttggggcaccgaactgtgtcggccgttcgatcgccatcgcagtggcttgattgcgggtgagggcggtggttttgtcgtgctcgaaaccctcgaacgggcgctcgcccgaggggcaacgccgtacgccgaagtgctgggtttcggcagcagcctggatgcctacaaaatcaccgcacccgacccgcagggccggggcgcggtgctggcgatgcaggcggccctgacggatgccgggctggcgccgcaacaggtcgatctgatcaatgcccacggtacgtcgacacccctcaacgatgccgccgaaaccctggcgatcaagaccctgttcgccgagcgcgaacattatcggcggttgctggtgacggccaacaaatcccagttcggccacctgattgcggccgccggagcaccggagttcatgctcacggccctggcctgccgggatgatcgggtcacgccgaccctgaacttgcaggatgccgacgaacaatgcgacctcgactactgcgcccaccaagcggtcaagcgcaaggtcgacgttgccctgagcaactccttcggtttcggcggcctcaacacttcactggcgcttggcaagtaccgggaggcgccgcgatga

SEQ ID NO: 71893 - protein, 432 aa, Pseudomonas putida KT2440
MSPTRIVITGMGAVTGFGFEWQSMWQRMLAGEHCIRPWQPEGVEAGAFPVRYAAPVDMGLMPAHLKDHPAWGLSLEKRTRFGWIAATQAIADSGLSPEQLRGAAVLSASGAPAHRLQDMLLSLADNPAQAPSWAQLMARQAQVDPDSSLRQSNDRLARVIADGIGSEGPVINVSSACAGASQAIGNAFQMIRRGEVELAIAGGADSVLSLDTMTALYLLGAASSEQRWGTELCRPFDRHRSGLIAGEGGGFVVLETLERALARGATPYAEVLGFGSSLDAYKITAPDPQGRGAVLAMQAALTDAGLAPQQVDLINAHGTSTPLNDAAETLAIKTLFAEREHYRRLLVTANKSQFGHLIAAAGAPEFMLTALACRDDRVTPTLNLQDADEQCDLDYCAHQAVKRKVDVALSNSFGFGGLNTSLALGKYREAPR

SEQ ID NO: 71894 - DNA, 1314 bp, Pseudomonas putida KT2440; identical to SEQ ID NO: 19750
  CDS (1)..(1314): transl_table=11

SEQ ID NO: 71895 - protein, 437 aa, Pseudomonas putida KT2440; identical to SEQ ID NO: 19751

SEQ ID NO: 71896 - DNA, 1221 bp, Pseudomonas putida KT2440
  CDS (1)..(1221): transl_table=11
atgcgccgcgtcgttatcactggtctgggcatcgtatcgtgcctgggcaatgacaaagctaccgtcaccgaaaacctgcgcaacagccgtccgggtatccgtttcaacccggaatacaaggaaatggggctgcgtagccaggtttccgggtccatcgacctcaacctcgaagaactgatcgaccgcaaggtttaccgcttcgtcggccatgcggctgcctacgcctacctggccatgcaggacgcgatcaaggacgctggcctgaccgaagagcaggtttccaacccgcgtaccggcctggtggcgggttccggcggcgcctcgaccctgaaccagatggaagcgctggacaccctgcgtgagaaaggcgtcaagcgcgtcggcccataccgcgttacccgcaccatgggcagcaccgtgtcggcatgcctggccaccccgttcaagatcaagggcatcaactactcgatctcgtcggcctgcgccacctcggctcactgcatcggtaccgcactggagcagatccagtggggcaagcaggacatcgtcttcgccggtggcggtgaagaagagcactggagccagtcgttcctgttcgatgccatgggcgccctgtcgaccaagcgcaacgaaaccccggaactggcctcgcgcgcctacgacgctgaccgtgatggcttcgtcatcgctggcggtggcggcatggtcgtggtcgaggaactggaacacgccctggcccgcggcgccaagatctacgccgaaatcgttggctacggtgccacttccgacggctacgacatggttgcaccgagcggcgaaggcgccatccgctgcatgcagcaggcgctctccactgtcgacaccccgatcgactacctgaacacccacggtacctcgactccggtcggtgacgtggccgagatcaagggcgtgcgtgccgtgttcggcgacaaggctccgaagatcagctctaccaaaagcctgtcgggtcactcgctgggcgctgccggcgtgcacgaggcgatctactgcctgctgatgatggaaaacaacttcatcgccggctctgccaacatcgacgagctggacgcggaagtcgccgacttgccaatcctgcgtaaaaccgaagaaaacgccaagatcgacacggtcatgagcaacagcttcggcttcggcggcaccaacgccaccctggtgctcaagcgctgggaaggcaagtaa

SEQ ID NO: 71897 - protein, 406 aa, Pseudomonas putida KT2440
MRRVVITGLGIVSCLGNDKATVTENLRNSRPGIRFNPEYKEMGLRSQVSGSIDLNLEELIDRKVYRFVGHAAAYAYLAMQDAIKDAGLTEEQVSNPRTGLVAGSGGASTLNQMEALDTLREKGVKRVGPYRVTRTMGSTVSACLATPFKIKGINYSISSACATSAHCIGTALEQIQWGKQDIVFAGGGEEEHWSQSFLFDAMGALSTKRNETPELASRAYDADRDGFVIAGGGGMVVVEELEHALARGAKIYAEIVGYGATSDGYDMVAPSGEGAIRCMQQALSTVDTPIDYLNTHGTSTPVGDVAEIKGVRAVFGDKAPKISSTKSLSGHSLGAAGVHEAIYCLLMMENNFIAGSANIDELDAEVADLPILRKTEENAKIDTVMSNSFGFGGTNATLVLKRWEGK

SEQ ID NO: 71898 - DNA, 1626 bp, Arabidopsis thaliana; identical to SEQ ID NO: 19794
  CDS (1)..(1626)

SEQ ID NO: 71899 - protein, 541 aa, Arabidopsis thaliana; identical to SEQ ID NO: 19795

SEQ ID NO: 71900 - DNA, 1266 bp, Streptomyces rochei; identical to SEQ ID NO: 19796
  CDS (1)..(1266): transl_table=11

SEQ ID NO: 71901 - protein, 421 aa, Streptomyces rochei; identical to SEQ ID NO: 19797

SEQ ID NO: 71902 - DNA, 1329 bp, Oryza sativa (japonica cultivar-group)
  CDS (1)..(1329)
atgcaggcgcacgcccacacgctcgggctccgcatctccccgccgccgcctgcgccgccgcggcgccgcacggacccgaggaagcgggtggtgatcacggggatggggctggtgtccgtgttcgggaacgaggtggacgccttctacgagcggctgctcgccggggagagcggggtcggcgccatcgaccgcttcgacgccggcggcttccccacgaggttcgccggccagatacgcgggttctcctcggaggggtacatcgacggcaagaacgaccggaggctcgacgactgcctccgctactgcatcgtcagcggcaagaaggcgctcgagaacgccggcctcggcaagggctccgatggccacaccaagcttgacaaagtccgggctggtgttcttgtgggaactggcatgggtggcctcactgtgttttccgatggtgttcaaaaccttattgagaagggatacaagaaaatttcgcctttctttatcccatacgctataactaacatgggctcggcattgctagcaatggatgctggttttatgggtccaaactactcaatttcaacagcttgtgcgacctccaactactgcttctatgctgctgccaaccatatacgtcggggtgaggctgatgttatcgttgctggtggtactgaagctgcaattattccaattggccttggaggttttgtggcctgtagagcactatcgcagaggaacgatgacccagaaactgcatctaggccatgggacaaagagcgagatggttttgttatgggcgaaggtgctggtgtactggtcatggagagcctggagcatgcgatgaagcgggatgcaccaataattgctgaatatttgggaggtgcagtaaactgtgatgcttaccatatgactgatcctaggtcagatggactgggtgtatcgtcctgtattactcagagccttgaagatgcaggtgttgcgccagaggaggtaaattacatcaatgcacatgcaacttcaactcttgctggtgacttggctgaagtaagagccattaagcaagtcttcaagaatccatctgatattaaaatcaattcaacgaagtctatgataggccattgcctaggtgccgctggtgggttagaagctattgccgttgtcaaagccataactactggatgggtgcatcctactattaaccaatttaaccccgagcctgaagttgattttgatacagtagccaacgagaagcagcagcacgaagtgaatgttgctatctctaattcatttggatttggaggtcacaattcagtggtagtatttgcgccattcaagccatga

SEQ ID NO: 71903 - protein, 442 aa, Oryza sativa (japonica cultivar-group)
MQAHAHTLGLRISPPPPAPPRRRTDPRKRVVITGMGLVSVFGNEVDAFYERLLAGESGVGAIDRFDAGGFPTRFAGQIRGFSSEGYIDGKNDRRLDDCLRYCIVSGKKALENAGLGKGSDGHTKLDKVRAGVLVGTGMGGLTVFSDGVQNLIEKGYKKISPFFIPYAITNMGSALLAMDAGFMGPNYSISTACATSNYCFYAAANHIRRGEADVIVAGGTEAAIIPIGLGGFVACRALSQRNDDPETASRPWDKERDGFVMGEGAGVLVMESLEHAMKRDAPIIAEYLGGAVNCDAYHMTDPRSDGLGVSSCITQSLEDAGVAPEEVNYINAHATSTLAGDLAEVRAIKQVFKNPSDIKINSTKSMIGHCLGAAGGLEAIAVVKAITTGWVHPTINQFNPEPEVDFDTVANEKQQHEVNVAISNSFGFGGHNSVVVFAPFKP

SEQ ID NO: 71904 - DNA, 1524 bp, Oryza sativa (japonica cultivar-group); identical to SEQ ID NO: 19846
  CDS (1)..(1524)

SEQ ID NO: 71905 - protein, 507 aa, Oryza sativa (japonica cultivar-group); identical to SEQ ID NO: 19847

SEQ ID NO: 71906 - DNA, 1308 bp, Neurospora crassa; identical to SEQ ID NO: 20012
  CDS (1)..(1308)
  misc_feature <251>..<251>: n is a, c, g, or t
  misc_feature <463>..<463>: n is a, c, g, or t
  misc_feature <522>..<522>: n is a, c, g, or t
  misc_feature <669>..<669>: n is a, c, g, or t
  misc_feature <677>..<677>: n is a, c, g, or t
  misc_feature <908>..<908>: n is a, c, g, or t
  misc_feature <982>..<982>: n is a, c, g, or t
  misc_feature <996>..<996>: n is a, c, g, or t
  misc_feature <1033>..<1033>: n is a, c, g, or t
  misc_feature <1036>..<1036>: n is a, c, g, or t
  misc_feature <1047>..<1047>: n is a, c, g, or t
  misc_feature <1067>..<1067>: n is a, c, g, or t
  misc_feature <1150>..<1150>: n is a, c, g, or t
  misc_feature <1263>..<1263>: n is a, c, g, or t
  misc_feature <1266>..<1266>: n is a, c, g, or t
  misc_feature <1302>..<1302>: n is a, c, g, or t

SEQ ID NO: 71907 - protein, 435 aa, Neurospora crassa; identical to SEQ ID NO: 20013
  misc_feature <84>..<84>: The Xaa at location 84 stands for Arg, Ile, Lys, or Thr.
  misc_feature <155>..<155>: The Xaa at location 155 stands for Ile, Leu, Phe, or Val.
  misc_feature <174>..<174>: The Xaa at location 174 stands for Gln, or His.
  misc_feature <226>..<226>: The Xaa at location 226 stands for Cys, Phe, Ser, or Tyr.
  misc_feature <303>..<303>: The Xaa at location 303 stands for Arg, Lys, Met, or Thr.
  misc_feature <328>..<328>: The Xaa at location 328 stands for    , Arg, or Gly.
  misc_feature <332>..<332>: The Xaa at location 332 stands for Asp, or Glu.
  misc_feature <345>..<345>: The Xaa at location 345 stands for    , Arg, or Gly.
  misc_feature <346>..<346>: The Xaa at location 346 stands for Leu, Met, or Val.
  misc_feature <349>..<349>: The Xaa at location 349 stands for Asp, or Glu.
  misc_feature <356>..<356>: The Xaa at location 356 stands for Asn, Ile, Ser, or Thr.
  misc_feature <384>..<384>: The Xaa at location 384 stands for Ala, Pro, Ser, or Thr.
  misc_feature <422>..<422>: The Xaa at location 422 stands for Leu, or Phe.
  misc_feature <434>..<434>: The Xaa at location 434 stands for Leu, or Phe.

SEQ ID NO: 71908 - DNA, 1425 bp, Perilla frutescens; identical to SEQ ID NO: 20014
  CDS (1)..(1425)

SEQ ID NO: 71909 - protein, 474 aa, Perilla frutescens; identical to SEQ ID NO: 20015

SEQ ID NO: 71910 - DNA, 1593 bp, Perilla frutescens; identical to SEQ ID NO: 20016
  CDS (1)..(1593)

SEQ ID NO: 71911 - protein, 530 aa, Perilla frutescens; identical to SEQ ID NO: 20017

SEQ ID NO: 71912 - DNA, 1467 bp, Capsicum chinense; identical to SEQ ID NO: 20020
  CDS (1)..(1467)

SEQ ID NO: 71913 - protein, 488 aa, Capsicum chinense; identical to SEQ ID NO: 20021

SEQ ID NO: 71914 - DNA, 1554 bp, Cuphea wrightii; identical to SEQ ID NO: 20022
  CDS (1)..(1554)

SEQ ID NO: 71915 - protein, 517 aa, Cuphea wrightii; identical to SEQ ID NO: 20023

SEQ ID NO: 71916 - DNA, 1623 bp, Cuphea wrightii; identical to SEQ ID NO: 20024
  CDS (1)..(1623)

SEQ ID NO: 71917 - protein, 540 aa, Cuphea wrightii; identical to SEQ ID NO: 20025

SEQ ID NO: 71918 - DNA, 1413 bp, Medicago truncatula
  CDS (1)..(1413)
atgcaatcacttcagcatcaactacccttcactcttcgcccttcaccactcgaaccacttcgcaaaaaaccctccaatgcggccaccaccgccgccagaaccccaaagagactctccgtcgtctcttcctccgtcaccaccgccgctcctcaaagagagaaggatcccaagaagcgtgtcgtgatcactggcatgggtggcgtcactgtacatggcaacgatgtcgacattttctacgaaaagcttctcgccggtgatagtgggatcacattgattgataggtttgatgcttccaaattccctactcggttcgctggtcagatccgtgggtttagctccgagggttacatcgacgggaagaatgaccggaggcaggatgattgtctccggtactgcaatgtcgccgggaagaaagcacttgaagatgctggtctcggtgccgaaaatcttgataagattgataaagaacgtgctggtgttttggttgggtcaggaatgggtggtttaacggtgttttctgatggagttaagaatctgattgaaaagggacatagaaagatatcacctttttttattccctatgctattaccaatatggcttcagctttacttgggattgatttaggtttcagaggtccaaattattctatttcaactgcttgtgctacttcaaattattgctttgttgctgctgccaatcacattcgtaggggtgaagctgatttgatgattgcgggtggtactgaagctgctattattcctattggtttggggggttttgttgcttgcagggcactttctcagagaaatgatgaccctaaaacggcttctaggccttgggataaagaccgtgatggatttgttatgggtgaaggtgctggagttttggtgatggaaagcctggaacatgccatgaagcgaggtgcgcctatcattgctgaatacttgggaggtgctgtaaactgtgatgcttatcatatgactgatccaagatctgatgggcttggcgtgtcttcatgcatccagagcagtcttgtagatgccggtgtgtcacccgaggaggtcaattacataaatgcacatgcaacttccactcttgttggtgacttggcagagatcaatgctatcaaaaaggttttcaagaacccatctggcatcaaaattaatgccaccaagtctatgatagggcactgccttggcgcagctgggggtttggaagctattgccacaataaaagccataacaacaggatggctgcatccatcaatcaatcaattcaatccagaacctgcagttgattttgatacggtggcaaatgtcaagcagcagcatgaaatcaatgttggcatttcaaattcatttggatttggtggacacaactctgtcgtggctttttccgctttcagaccctga

SEQ ID NO: 71919 - protein, 470 aa, Medicago truncatula
MQSLQHQLPFTLRPSPLEPLRKKPSNAATTAARTPKRLSVVSSSVTTAAPQREKDPKKRVVITGMGGVTVHGNDVDIFYEKLLAGDSGITLIDRFDASKFPTRFAGQIRGFSSEGYIDGKNDRRQDDCLRYCNVAGKKALEDAGLGAENLDKIDKERAGVLVGSGMGGLTVFSDGVKNLIEKGHRKISPFFIPYAITNMASALLGIDLGFRGPNYSISTACATSNYCFVAAANHIRRGEADLMIAGGTEAAIIPIGLGGFVACRALSQRNDDPKTASRPWDKDRDGFVMGEGAGVLVMESLEHAMKRGAPIIAEYLGGAVNCDAYHMTDPRSDGLGVSSCIQSSLVDAGVSPEEVNYINAHATSTLVGDLAEINAIKKVFKNPSGIKINATKSMIGHCLGAAGGLEAIATIKAITTGWLHPSINQFNPEPAVDFDTVANVKQQHEINVGISNSFGFGGHNSVVAFSAFRP

SEQ ID NO: 71920 - DNA, 1476 bp, Medicago truncatula
  CDS (1)..(1476)
atggctaccacttcttcttcactctacacgtggcttgaaccatcttgcatgtcagtcacgtgcgaagctgaccgtatcagaacatcttttcactctcgcagaacccacaacaacactctttttcgatccaatttcaatactaaacaaaaaccattcattcattctggtaaaacaatggcagtagctttggaacctgcccaagaggtcacaataaagaaaaaacttcctacaaagcaaagacgggtagttgtgacaggcttgggcgtggttacaccacttggtcatgatccagatatcttctacaataatttactcaatggtgttagtggtataagtgagattgagaattttgattgtgcagaatttccgacaaggattgctggtgaaattaagtctttttcaactgacggatgggtagcaccaaaatttgtaaagagaatggataaatttatgctctatctgctaacagctggaaaaaaagcattggtgaatgctggaattactgaagatgtgatggatgagttagataaaaccaaatgtggagttttaatcggctcagcattaggtggcttcaaggttataagtgattccatcgaagctttacgaatatcatataggaagatgaatcctttctgtattccttttgcaacaacaaatatgggctctgccatgcttgcaatggatctgggatggatgggcccaaattattctatctctacagcttgtgcgacaagtaactattgtatattgaatgcagcaaaccatatcatcagaggtgaagccgatgtgatgctttgtgggggctcagactctgctattattccaattggtttgggaggctttgtggcatgcagggcactctcccaaaggaataccgatccttctaaagcgtcacgcccttgggatactaatcgtgatggatttgtcatgggggaaggggctggtgttttggttttagaagaattggagcatgctaagaaaagaggtgcaaacatatatgcagaatttcttggtggaagtttcacctgcgatgcatatcacgtgactgagccacatcctgatggggctggtgtaatactttgcattgaaagggcattggtccaatcgggagtttcaaaagaggatgtgaattacataaatgctcatgctacatcaacaccatctggtgatcttaaggaataccaagctctgattcattgttttggtaaaaaccctgagcttagagtgaattctacgaaatctatgatcggtcatctactaggtgcatccggtggtgtagaagctgtagcaacagtacaggcaatcaggacagggtgggttcatcctaacatcaaccttgaaaacccagataaagatgtggatactaaagtgcttgtaggcccaacaaaagagagattgaaaatcaaggctgccttgtccaattcatttggatttgggggacacaattcttcaattgtatttgccccttataaatga

SEQ ID NO: 71921 - protein, 491 aa, Medicago truncatula
MATTSSSLYTWLEPSCMSVTCEADRIRTSFHSRRTHNNTLFRSNFNTKQKPFIHSGKTMAVALEPAQEVTIKKKLPTKQRRVVVTGLGVVTPLGHDPDIFYNNLLNGVSGISEIENFDCAEFPTRIAGEIKSFSTDGWVAPKFVKRMDKFMLYLLTAGKKALVNAGITEDVMDELDKTKCGVLIGSALGGFKVISDSIEALRISYRKMNPFCIPFATTNMGSAMLAMDLGWMGPNYSISTACATSNYCILNAANHIIRGEADVMLCGGSDSAIIPIGLGGFVACRALSQRNTDPSKASRPWDTNRDGFVMGEGAGVLVLEELEHAKKRGANIYAEFLGGSFTCDAYHVTEPHPDGAGVILCIERALVQSGVSKEDVNYINAHATSTPSGDLKEYQALIHCFGKNPELRVNSTKSMIGHLLGASGGVEAVATVQAIRTGWVHPNINLENPDKDVDTKVLVGPTKERLKIKAALSNSFGFGGHNSSIVFAPYK

SEQ ID NO: 71922 - DNA, 1269 bp, Streptomyces steffisburgensis
  CDS (1)..(1269): transl_table=11
atgaaccgacgagtcgtgatcaccggcatcggtgtggtcgcgccagggggcaccggtgccaagaagttctgggacctgatctccgcggggcgtaccgcgacccggcgcatcaccttcttcgacccggccccgttccgctcgcaggtggcggccgaatgcgacttcgacccgagggacgaggggctctccccccagcagatccggcggacggaccggtcggcccagctggcgctggtgagcgcacgggagtgcgtagaggacagcggcctggatctcgcggccctcgacccggcacgcaccggcgcggtcgtgggcagcgcggtgggctgcacgatgggcctggaggaggagtacgtcgtcgtcagcgacggcggccgcacctggcaggtctccgaggagtacgccgtcccccacctcttcaactactacgtgccgagttccctcgcggccgaggtcgcttgggacgtcggcgcggagggccccgtcgcgacggtgtccaccggctgtacgtcaggcctggactcggtcggacaggccgtcgagctgatcgcggagggctcggccgacgtgatggtggccggtgcggccgacgcgccgatctcaccgatcaccatggcctgcttcgacgcgatcaaggcgaccactccgcgcaacgacgacccgtcgacggcgtcccgtcccttcgaccgcacccgcaacgggttcgtgctgggggagggatccgccatgttcgtcctggaggacctcgaccacgcgctccggcgcggcgcgtacgtgtacgccgagatcgccggcttcgcctcccgctgcaacgccttccacatgaccggcctgaggccggacgggaaggagatggccgaggcgatccgggtcgccctggcccggtccgggaccgcgccggaggacatcgactacatcaacgcccacggctcgggcaccctgcagaacgaccggcacgagacggcggccttcaagcgcagcctcggggcccacgcctaccggacaccggtcagctccatcaagtcgatgatcgggcactcgctgggcgccatcggctcgctggagatcgccgcctgcgcgctcgccatgcgcaacgggatggtgccgcccaccgccaacctgcatacgccggaccccgactgcgatctggactacgtgccgctcgtggcccgtgagcggcgcgtggacacggtgctcagcgtgggcagcgggttcggcggcttccagagcgcgatgatcctgcgcaggccggaagggaagccggcatga

SEQ ID NO: 71923 - protein, 422 aa, Streptomyces steffisburgensis
MNRRVVITGIGVVAPGGTGAKKFWDLISAGRTATRRITFFDPAPFRSQVAAECDFDPRDEGLSPQQIRRTDRSAQLALVSARECVEDSGLDLAALDPARTGAVVGSAVGCTMGLEEEYVVVSDGGRTWQVSEEYAVPHLFNYYVPSSLAAEVAWDVGAEGPVATVSTGCTSGLDSVGQAVELIAEGSADVMVAGAADAPISPITMACFDAIKATTPRNDDPSTASRPFDRTRNGFVLGEGSAMFVLEDLDHALRRGAYVYAEIAGFASRCNAFHMTGLRPDGKEMAEAIRVALARSGTAPEDIDYINAHGSGTLQNDRHETAAFKRSLGAHAYRTPVSSIKSMIGHSLGAIGSLEIAACALAMRNGMVPPTANLHTPDPDCDLDYVPLVARERRVDTVLSVGSGFGGFQSAMILRRPEGKPA

SEQ ID NO: 71924 - DNA, 1269 bp, Mycobacterium aurum
  CDS (1)..(1269): transl_table=11
atggcaggggtcaagggactctcgacggggaacgggtttcccaacgtcgtcgtcacgggatacaccatgacgacggcgctggcgaccgacgctgacaccacctggaggaaactgctcgacggggagagcggcatccgcacgctcaccgatcccttcgtcgaggaatacgacctcccggtgcgcatcggtggtcgccttctggaggatttcgacgacgagctgacgcgggtggaactgcgtcggctgtcgtacctgcagaagatgtcgacggtgctcagccggcgggtctgggagcacgccggcaatcccgacgtcgaccccaaacgcctgatggtgtccatcggtaccgggatgggctccaccgagcagctcctgttcgcctgcgagggcatgaaggccaaaggcctgcgcgcggtgtccccgttggcggtccagatgtacatgcccaacgccgccgcggcggcggtgggtctggagcgcaaggcccgggccggggtgatcaccccggtctcggcctgcgcctcgggctccgaaggcgtggcgcaggcatggcgcaacatcgttctcggtgaggctgatgtcgcgatctgcggcggcgtcgagacccggatcgaagcagtgccgatcgccggcttcgcccagatgcgcatcgtgttgtcgaccaccaacgacgaccccccgggtgcctgcaagccgttcgacaaggaccgcaacggcttcgtcttcggtgaaggcggcgcgctgatggtcatcgagactgaggagcacgccaaggcccgcggcgccaccatcatgccaaggctgatgggcgcctccatcacctccgacggctaccacatcgtggctcccgaccccaacggcgagcaggccggctacgcgatgacgcgggccatccagctcgccgggctgcagccgtcggacatcgaccacatcaacgcccacgccaccgggacctctgtcggcgatgtcgccgagagcaaggcgatccgcaatgccatcggcgaccaccagcccgcggtctacgcacccaaggcgccactgggtcactccgtcggcgccgtgggcgcggtggaagtccaatcctcaccgtcctcgccattcgcgagggcatcaattccgccgacccggaaccttgaagaacctcgacccggagatcgaacctcgacggtcgtggccgggtcgcctcgcccgggcaattacgagtacgcgatcaacaattccttcggattcggcgggcacaacgtcgcactcgccttcggcaagtactga

SEQ ID NO: 71925 - protein, 422 aa, Mycobacterium aurum
MAGVKGLSTGNGFPNVVVTGYTMTTALATDADTTWRKLLDGESGIRTLTDPFVEEYDLPVRIGGRLLEDFDDELTRVELRRLSYLQKMSTVLSRRVWEHAGNPDVDPKRLMVSIGTGMGSTEQLLFACEGMKAKGLRAVSPLAVQMYMPNAAAAAVGLERKARAGVITPVSACASGSEGVAQAWRNIVLGEADVAICGGVETRIEAVPIAGFAQMRIVLSTTNDDPPGACKPFDKDRNGFVFGEGGALMVIETEEHAKARGATIMPRLMGASITSDGYHIVAPDPNGEQAGYAMTRAIQLAGLQPSDIDHINAHATGTSVGDVAESKAIRNAIGDHQPAVYAPKAPLGHSVGAVGAVEVQSSPSSPFARASIPPTRNLEEPRPGDRTSTVVAGSPRPGNYEYAINNSFGFGGHNVALAFGKY

SEQ ID NO: 71926 - DNA, 1254 bp, Mycobacterium aurum
  CDS (1)..(1254): transl_table=11
atgagccggccttccactgctaacggcggtttccccaatgtcgtggttaccgctgtagaagccacgacctcggttgcggccgacgccgagggcacgtggaaggcactgctcaccggccagagcggtatccgcgagctcaccgacgacttcgtcacgaagtgggacctgccggttcgcatcggcggtcacctggtcgacggtgtcgacgagcacatgacccgcctggacatgcgccgcatgtcgtacgtccagcgcatgggcaaactgctgggcaaccggctctgggagaacgcgggcaagcccgaggtcgacccagaccggttcgccgtggtgatcggcacgggcatcggcggcggcgagaagatcgtcgagacctacgactcgatgaacgagggcggcatccgcaggtgtcaccgctcgcccgaggtcgaccttgatcatgcccaatggcgctgcgcggtcgtcggcctggaagctcggggcgcgcgccggggtcatcacccggtctccgcctgttcgtcgggttcggaagccattgcccacgcgtggcgccagatcgtcatgggtgacgcggacttcgccgtctgcggcggcgtcgaaggcgggatcgaggcactgcccatcgcggcgttctcgatgatgcgcgcgatgtcgacccgtaacgacaacccggaaggcgcgtcgcgcccgttcgacaagaacagggacggcttcgtcttcggtgaagccggcgcgctgatgatcatcgagaccgaagaacatgccctggcccgtggcgccaagccgctggcccggatcatgggcgcgggcatcacgtcggacgcctaccacatggtggcgccggccgcggacggcctgcgggccggccaggcgatgaagcgggcgatggagacggcgggcttggcccccgaggacatcaaccacgtcaacgcccaccccacctcgacgtcgatcggcgacaccgccgaggccaacgctatccgggtcgccggggtggggcacgccgcggtgtacgcgccgaagtcggcgctgggtcactcgatcggcgcggtgggtgcgctggaatcgatcctgaccgtgctggcgctgcgtgacgacgtgattcccccgacactgaactacgagacgcccgaccccgagatcgatctcgatgtcgttgcgggtgagcctcggtatggcgactaccagtacgccatcaacaactcgttcggcttcggtggacacaatgtcgccctggcgttcggtcgctattaa

SEQ ID NO: 71927 - protein, 417 aa, Mycobacterium aurum
MSRPSTANGGFPNVVVTAVEATTSVAADAEGTWKALLTGQSGIRELTDDFVTKWDLPVRIGGHLVDGVDEHMTRLDMRRMSYVQRMGKLLGNRLWENAGKPEVDPDRFAVVIGTGIGGGEKIVETYDSMNEGGIRRCHRSPEVDLDHAQWRCAVVGLEARGARRGHHPVSACSSGSEAIAHAWRQIVMGDADFAVCGGVEGGIEALPIAAFSMMRAMSTRNDNPEGASRPFDKNRDGFVFGEAGALMIIETEEHALARGAKPLARIMGAGITSDAYHMVAPAADGLRAGQAMKRAMETAGLAPEDINHVNAHPTSTSIGDTAEANAIRVAGVGHAAVYAPKSALGHSIGAVGALESILTVLALRDDVIPPTLNYETPDPEIDLDVVAGEPRYGDYQYAINNSFGFGGHNVALAFGRY

SEQ ID NO: 71928 - DNA, 1488 bp, Hordeum vulgare; identical to SEQ ID NO: 20026
  CDS (1)..(1488)

SEQ ID NO: 71929 - protein, 495 aa, Hordeum vulgare; identical to SEQ ID NO: 20027

SEQ ID NO: 71930 - DNA, 1470 bp, Hordeum vulgare; identical to SEQ ID NO: 20028
  CDS (1)..(1470)

SEQ ID NO: 71931 - protein, 489 aa, Hordeum vulgare; identical to SEQ ID NO: 20029

SEQ ID NO: 71932 - DNA, 1608 bp, Ricinus communis; identical to SEQ ID NO: 20030
  CDS (1)..(1608)

SEQ ID NO: 71933 - protein, 535 aa, Ricinus communis; identical to SEQ ID NO: 20031

SEQ ID NO: 71934 - DNA, 1410 bp, Ricinus communis; identical to SEQ ID NO: 20032
  CDS (1)..(1410)

SEQ ID NO: 71935 - protein, 469 aa, Ricinus communis; identical to SEQ ID NO: 20033

SEQ ID NO: 71936 - DNA, 1272 bp, Streptomyces glaucescens; identical to SEQ ID NO: 20036
  CDS (1)..(1272): transl_table=11

SEQ ID NO: 71937 - protein, 423 aa, Streptomyces glaucescens; identical to SEQ ID NO: 20037

SEQ ID NO: 71938 - DNA, 1260 bp, Streptomyces peucetius; identical to SEQ ID NO: 20042
  CDS (1)..(1260): transl_table=11

SEQ ID NO: 71939 - protein, 419 aa, Streptomyces peucetius; identical to SEQ ID NO: 20043

SEQ ID NO: 71940 - DNA, 1257 bp, Streptomyces sp
  CDS (1)..(1257): transl_table=11
gtgaaccgacgggtcgtcatcaccgggatgggtgtggtggccccgggagccatcggcatcaagtcgttctgggagctgctgctgtccgggaccaccgccacccgggccatcaccacgttcgacgccacgcccttccgttcccggatcgccgccgagtgcgacttcgatccggtcgcggcagggctgtccgcggagcaggcccggcgcctcgaccgggccgggcagttcgcgctggtcgccggtcaggaggcgctcactgacagcgggctgcgcatcggggaggactccgcccaccgggtcggggtgtgcgtgggtaccgctgtcggctgcacgcagaaactggagtccgagtacgtggctctcagcgcgggcggtgcgaactgggtcgtggacccccaccggggggcgcccgagctgtacgactacttcgtgccgagttccctcgccgccgaagtggcttggctcgccggggcggaagggcccgtgaacatcgtctcggccgggtgcacctcggggatcgactccatcgggtacgcctgcgaactcatccgcgaggggacggtggacgtcatgctcgcgggaggcgtggacgcccccatcgcaccgatcactgtggcctgcttcgacgccatcagggtgacctccgaccacaacgacacacccgagacgctcgcgcccttcagccgcagccgcaacggcttcgtgctgggcgagggtggtgcgatcgtggttctggaagaggcagaggcggccgtgcgcaggggcgcacgaatctacgccgagatcggcgggtacgcctcacgcggcaacgcataccacatgacggggctgcgcgcagacggcgccgagatggctgcggcgattaccgcggccctcgacgaagcccgccgcgacccctcggacgtggactatgtcaacgcccacggaacagcgacgcgacagaacgaccggcacgaaacctccgcgttcaagcgctcgctgggggatcacgcgtaccgggttcccatcagctccgtgaagtcgatgatcggtcactccctgggggccgccggctcgctcgaagtggcggcgaccgcactggcggtggagtacggggcgatcccgccgaccgcgaatctgcacgacccggatcccgaactcgacctggactacgtgccgttgacggcgcgagaaaagcgggtgcggcatgcgctgacggtgggcagcggcttcggcggcttccagagcgccatgctgttgagccgtcccgagaggtga

SEQ ID NO: 71941 - protein, 418 aa, Streptomyces sp
MNRRVVITGMGVVAPGAIGIKSFWELLLSGTTATRAITTFDATPFRSRIAAECDFDPVAAGLSAEQARRLDRAGQFALVAGQEALTDSGLRIGEDSAHRVGVCVGTAVGCTQKLESEYVALSAGGANWVVDPHRGAPELYDYFVPSSLAAEVAWLAGAEGPVNIVSAGCTSGIDSIGYACELIREGTVDVMLAGGVDAPIAPITVACFDAIRVTSDHNDTPETLAPFSRSRNGFVLGEGGAIVVLEEAEAAVRRGARIYAEIGGYASRGNAYHMTGLRADGAEMAAAITAALDEARRDPSDVDYVNAHGTATRQNDRHETSAFKRSLGDHAYRVPISSVKSMIGHSLGAAGSLEVAATALAVEYGAIPPTANLHDPDPELDLDYVPLTAREKRVRHALTVGSGFGGFQSAMLLSRPER

SEQ ID NO: 71942 - DNA, 1269 bp, Streptomyces aureofaciens
  CDS (1)..(1269): transl_table=11
gtgacccgtcgggtagtgatcacggggatcggagtgctggcgccgggtggcatcggcaccaccgccttctggaacctgctgagttcgggccgcacggccacccgcgggatcaccctcttcgatcccgcccccttccgctcccgggtggccgcggaggtggacttccaccccgaacggcacgggctgacctccctggaggtccgccgcatggaccgcgccgcccagttcggtgtggtcgccacccgtgaggcgctcgccgacagcggcctcgacctcgcggcattcgacccgtaccgcatcggcatcgccatgggcaccggtgtcggggccatcagcggcctcgacaccgcctaccgggtggccagcgacgagggacggatcgcccaggtcgaccacatgtacgcgccgggccacctctacgaccacttcgtgcccagctccttcgccaccgaagtagcctgggccgtcggcgccgagggcccctccacggtggtctccaccggctgcacctccggcatcgactcggtcgcgcacgcggtcgacctgatccgcgagggcagtgccgacatcatgatcacgggcgccaccgacgccccgatcagcccgctcaccctggcctgcttcgacgcgatcaaggcgacgacggcgctcaacgaggaaccggagacggcctcgcgccccttcgacgccacccgcaagggcttcgtcctgggcgagggcgcggcggcgttcgtcctggaggagctcggcgccgcccgccgccgcggcgcacacgtctacgcggagatcgccggctacgcctcccgctccagcgccttccacatgacgggtctgcgccccgacggccgggagatggccgaggccatcacggtggccctggacgaggcccggctggaccccggcgacctcgactacgtcaacgcacacggctccggcacccggcagaacgacctccacgagaccgccgcgtacaagctggccctgggcccgcacgcccaccggacccccgtgagctcggtcaaatcgatgatcgggcactcgctgggatccgtcggctcgatggagatcgccgcctccgtcctcgcgatggagcaccacgtggtgccgcccacggccaacctgcgcacccccgacccggagtgcgacctcgactacgtaccgctcgtcgcgcgggaccaccgcaccgatgccgtcctcaccgtcagcagcggattcggcgggttccagagcgcgatggtgctggccaggcccgacaggaggaccgcatga

SEQ ID NO: 71943 - protein, 422 aa, Streptomyces aureofaciens
MTRRVVITGIGVLAPGGIGTTAFWNLLSSGRTATRGITLFDPAPFRSRVAAEVDFHPERHGLTSLEVRRMDRAAQFGVVATREALADSGLDLAAFDPYRIGIAMGTGVGAISGLDTAYRVASDEGRIAQVDHMYAPGHLYDHFVPSSFATEVAWAVGAEGPSTVVSTGCTSGIDSVAHAVDLIREGSADIMITGATDAPISPLTLACFDAIKATTALNEEPETASRPFDATRKGFVLGEGAAAFVLEELGAARRRGAHVYAEIAGYASRSSAFHMTGLRPDGREMAEAITVALDEARLDPGDLDYVNAHGSGTRQNDLHETAAYKLALGPHAHRTPVSSVKSMIGHSLGSVGSMEIAASVLAMEHHVVPPTANLRTPDPECDLDYVPLVARDHRTDAVLTVSSGFGGFQSAMVLARPDRRTA

SEQ ID NO: 71944 - DNA, 1467 bp, Glycine max; identical to SEQ ID NO: 20046
  CDS (1)..(1467)

SEQ ID NO: 71945 - protein, 488 aa, Glycine max; identical to SEQ ID NO: 20047

SEQ ID NO: 71946 - DNA, 1470 bp, Glycine max; identical to SEQ ID NO: 20048
  CDS (1)..(1470)

SEQ ID NO: 71947 - protein, 489 aa, Glycine max; identical to SEQ ID NO: 20049

SEQ ID NO: 71948 - DNA, 1218 bp, Saccharopolyspora erythraea; identical to SEQ ID NO: 20052
  CDS (1)..(1218): transl_table=11

SEQ ID NO: 71949 - protein, 405 aa, Saccharopolyspora erythraea; identical to SEQ ID NO: 20053

SEQ ID NO: 71950 - DNA, 1398 bp, Oryza sativa; identical to SEQ ID NO: 20056
  CDS (1)..(1398)

SEQ ID NO: 71951 - protein, 465 aa, Oryza sativa; identical to SEQ ID NO: 20057

SEQ ID NO: 71952 - DNA, 1272 bp, Streptomyces ambofaciens
  CDS (1)..(1272): transl_table=11
ttgagcaggcgacgtgtcgtgatcaccgggatcgaggtgatcgcgccgggcggggtgggccgggagaacttctggaacctgctcagctcggggcgcaccgcgacccgcggcatcaccttcttcgaccccgcccccttccgctcccgggtggccgccgaggccgacttcgaccccttcgcgcacggtctgagcccccaggaggtccgccgcctggaccgggccgcgcagttcgccgtcgtcgcctcgcgcggcgcggtcgccgacagcggcctggacgtcgccgccctggacccgcaccgcgtcggtgtcaccgtcggcagcgccgtcggcgccacgatgggcctggacgaggagtaccgcgtcgtcagcgacggcggccgcctggaggcggtcgaccacacctacgccgtcccgcacctgtacgactacatggtgcccagctcgttcgcggccgaagtcgcctgggcggtgggcgccgagggccccagcacggtggtctccaccggctgcacctccggcatcgactccgtgggctacgccgtggaactggtccgcgagggctccgccgacgtcgtgatcgccggctcctccgacgcgccgatctccccgatcaccatggcctgcttcgacgcgatcaaggcgaccaccccccgccacgacgaacccgagtgcgcctcgcgccccttcgacaagacccgcaacggtttcgtcctgggcgagggctgcgccttcttcgtgctggaggagctggacagcgcccgcaagcgcggcgcccacatctacgccgagatcgccgggtactccacccgctccaacgcctaccacatgacggggctgcgccccgacggcgcggagatggccgaggcgatcgacctggcgctggccgaggcccgcctgaacccgcaggccatcgactacgtcaacgcccacggctcgggcaccaagcagaacgaccggcacgagacggccgcgttcaagcgcagcctgggcgaacacgccttccgcaccccggtcagctccatcaagtccatggtcgggcactcgctgggcgcgatcggctccatcgagatcgccgcctcggccctggccatggagtacgacgtcgtcccgcccaccgccaacctgcacaccgccgaccccgagtgcgacctcgactacgtgcccctggtcgcccgcgaccagctgatcgacgcggtcctgaccgtcggcagcggattcggcggcttccagagcgccatggtgctcgccagcccggaaaggagcctggtatga

SEQ ID NO: 71953 - protein, 423 aa, Streptomyces ambofaciens
MSRRRVVITGIEVIAPGGVGRENFWNLLSSGRTATRGITFFDPAPFRSRVAAEADFDPFAHGLSPQEVRRLDRAAQFAVVASRGAVADSGLDVAALDPHRVGVTVGSAVGATMGLDEEYRVVSDGGRLEAVDHTYAVPHLYDYMVPSSFAAEVAWAVGAEGPSTVVSTGCTSGIDSVGYAVELVREGSADVVIAGSSDAPISPITMACFDAIKATTPRHDEPECASRPFDKTRNGFVLGEGCAFFVLEELDSARKRGAHIYAEIAGYSTRSNAYHMTGLRPDGAEMAEAIDLALAEARLNPQAIDYVNAHGSGTKQNDRHETAAFKRSLGEHAFRTPVSSIKSMVGHSLGAIGSIEIAASALAMEYDVVPPTANLHTADPECDLDYVPLVARDQLIDAVLTVGSGFGGFQSAMVLASPERSLV

SEQ ID NO: 71954 - DNA, 1287 bp, Rhizobium leguminosarum bv
  CDS (1)..(1287): transl_table=11
atgacagcttccgcttatagagatcacctcggccgtccgatcgtggctgttaccggcatgggcatcatcacctcgctcggccagggcctcagcgacaactgggcagcgctttcgtcaggcacgtcgggcatccacgaaatcaaccgcttcccgaccgagggcctgtcgacgcggatcgccggcaccgtcgatttcatcggcatcccggtgccgaacgccgtcgagcgctcctatgcctttgcccgcgaaacgacgatcgaggcgctggccgatgccggcctgtccggcgatttcaatggcccgctattcctcgccgctccaccgatcgagccggaatggagcgcgcgcttcgaacttgccgaccgttcaccggcctccgaccatccgggtgacgcttatgagcgcttcctgacggcgctgcgccagcgaccggacccggccttccatgaagcagcgttgttcggcgcgatttccgagcggcttgccgaccggttcggtacgcgtggccttccggtcacgctgtcgaccgcctgcgcctctggtgtcaccgcgatccagctgggcatcgaggcaatccgccagggccgtacgacgcgggcactgacggttgctaccgacggctcgctgagtgccgaagcgctgatccgcttctcgctgctatcagctctttcgacacagaacgatccgccgactagggcctccaagccgttcagcaaggatcgcgacggcttcgtcatcgccgaaggtgcagcgaccctggtgctggaatcgctggaatcagcggtcgcccgcggcgccaaggtgctcggcatcatgaagggcgccggcgacaaggccgacagcttccaccgcacccggtcgtcgcccgatggcggcccggcgattgcgacgatccgcgcagcgctcgccgatgccggcatgagcgagggcgatatcggctatatcaatgcccacggcacctcgacgcctgagaatgacaagatggaatatggttcgatgtctgccgtcttcggtgagaaactggtcggcattccggtctcgtcgaacaagtcgatgatcggccacacgctgaccgcagcgggcgccgtcgaggcggtgttctcgctgcagacgatgctgaccggaacgctgccgccgacgatcaattacaacaatcccgatccgtcgatcattctcgatgtcgtgccgaacaagaagcgcgaagcccaggtttcggccgtgctttccaactctttcggcttcggcgggcagaatgccagccttgtcatggcgctcgaaccggcttaa

SEQ ID NO: 71955 - protein, 428 aa, Rhizobium leguminosarum bv
MTASAYRDHLGRPIVAVTGMGIITSLGQGLSDNWAALSSGTSGIHEINRFPTEGLSTRIAGTVDFIGIPVPNAVERSYAFARETTIEALADAGLSGDFNGPLFLAAPPIEPEWSARFELADRSPASDHPGDAYERFLTALRQRPDPAFHEAALFGAISERLADRFGTRGLPVTLSTACASGVTAIQLGIEAIRQGRTTRALTVATDGSLSAEALIRFSLLSALSTQNDPPTRASKPFSKDRDGFVIAEGAATLVLESLESAVARGAKVLGIMKGAGDKADSFHRTRSSPDGGPAIATIRAALADAGMSEGDIGYINAHGTSTPENDKMEYGSMSAVFGEKLVGIPVSSNKSMIGHTLTAAGAVEAVFSLQTMLTGTLPPTINYNNPDPSIILDVVPNKKREAQVSAVLSNSFGFGGQNASLVMALEPA

SEQ ID NO: 71956 - DNA, 1626 bp, Arabidopsis thaliana; identical to SEQ ID NO: 20070
  CDS (1)..(1626)

SEQ ID NO: 71957 - protein, 541 aa, Arabidopsis thaliana; identical to SEQ ID NO: 20071

SEQ ID NO: 71958 - DNA, 1617 bp, Cuphea lanceolata; identical to SEQ ID NO: 20074
  CDS (1)..(1617)

SEQ ID NO: 71959 - protein, 538 aa, Cuphea lanceolata; identical to SEQ ID NO: 20075

SEQ ID NO: 71960 - DNA, 1371 bp, Coriandrum sativum; identical to SEQ ID NO: 20076
  CDS (1)..(1371)

SEQ ID NO: 71961 - protein, 456 aa, Coriandrum sativum; identical to SEQ ID NO: 20077

SEQ ID NO: 71962 - DNA, 1269 bp, Streptomyces antibioticus
  CDS (1)..(1269): transl_table=11
gtgaggcgccgtgtcgtcatcaccggggtcggtgtcatggcgccgggcggcatcggcgtcaagaacttctggagcctgctgagcgaggggcgtaccgccacccgcgggatcaccttcttcgatccggcgcccttccgctcccgggtggccgcggagatcgacttcttcccggagaagcacggcctgggcccgcagaagattcgtcggatggaccgcgccgctcagctcgcggtgatcgccacgcgcgaggccgtggccgacagcggcctcgacctggacgccacggacccgcaccgcaggggcgtgaccgtcggcagcgcggtcggtgccaccaccggcctcgaccaggagtaccgggtcgtcagcgacgacggccgactcgggctggtcgaccaccggtacgcgccgccgcatctgtacggccacttcgtccccagctccttcgccgccgaggtcgcctgggcgtccggctccgaggggccgagcaccgtggtctccaccgggtgtacctcagggctggactccctgggccacgctgtagaactgatccgggaaggcagcgccgacgtgatgatcgccggagcgacggacgcgccgatctccccgatcaccatggcctgcttcgacgcgatcaaggcgaccacgccgcgcaacgacgatccggcgcacgcctcccgtccgttcgaccggtcccgcaacggcttcgtcctcggcgagggccacgcggtgctcgtcctggaggagctcggcgccgcccagcggcgcggggcgcgcatctacgccgagatcggtggatacgcgtcgcggtgcaatgccttccacatgactggtctgcgccccgacgggcgggagatggcggaggccatccgggtcgcgctggacgaggcccgactgaaccccgaggacatcgactacatcaacgcccacgggtccggtaccaagcagaacgaccggcacgagaccgcggccttcaagcgcagcctcggcgaccacgcgtaccggacgccggtcagctcgatcaagtcgatggtcgggcactcgctcggcgccatcgggtccatcgagatcgcagcctgcgtcctcgcgatggccgagagcgtgatcccgccgacggccaacctgcacgatcccgagcccgagtgcgacctcgactacgtgccgatcaccgcccgcgaagcgcggctggaccgcgtgctgagtgtgggcagcggattcggaggcttccagagtgccatggtgctcactcgtccggagaggaacacggcatga

SEQ ID NO: 71963 - protein, 422 aa, Streptomyces antibioticus
MRRRVVITGVGVMAPGGIGVKNFWSLLSEGRTATRGITFFDPAPFRSRVAAEIDFFPEKHGLGPQKIRRMDRAAQLAVIATREAVADSGLDLDATDPHRRGVTVGSAVGATTGLDQEYRVVSDDGRLGLVDHRYAPPHLYGHFVPSSFAAEVAWASGSEGPSTVVSTGCTSGLDSLGHAVELIREGSADVMIAGATDAPISPITMACFDAIKATTPRNDDPAHASRPFDRSRNGFVLGEGHAVLVLEELGAAQRRGARIYAEIGGYASRCNAFHMTGLRPDGREMAEAIRVALDEARLNPEDIDYINAHGSGTKQNDRHETAAFKRSLGDHAYRTPVSSIKSMVGHSLGAIGSIEIAACVLAMAESVIPPTANLHDPEPECDLDYVPITAREARLDRVLSVGSGFGGFQSAMVLTRPERNTA

SEQ ID NO: 71964 - DNA, 1284 bp, Streptomyces aureofaciens
  CDS (1)..(1284): transl_table=11
gtggtgggagttgacgacggccgccggcgcgtggtggtcaccgggatcggcgtggtggcaccgggcgaggtgggcaccaaggcgttctgggagctgctgacggccggccggaccgcgacccggacgatctcgaccttcgacccctcgccgttccggtccagggtcgccgccgagtgcgacttcgacccgcaggccgcagggttgacgcagcgtcagatccgtcaatgggaccgcaccgcgcagttcgcggtggtcgccgcgcgcgaggcgctggacgactcgggggtgtcgggcgtcaacgacccgatccgcaccggggtgatggccggcaccgcctgtgggatgacgatcagtctggaccgcgagttcgccgtggtgagcgacgagggccgcaagcggctggtcgacgacgcgcacggcgtcccgtacctctacgactacttcgtcccgtcctcgatggccaccgaactggcctggctggtcgaggcggagggtccggtgggcgtggtgtcgaccggatgcacctcggggatcgacgtgatcgcgcacgcctgcgacctgatccgcgacgacgcggccgacgtgatgctggccggcgcctcggacgcggcgatctccccgatcacggtggcctgcttcgacgcgatcaaggcgaccaccccgcgcaacgacgaacccgagagcgcctcgcgccccttcgacctgacccgcaacggcttcgccctcggcgagggcgcggcgatgttcgtgctggaggagcgggagcacgcgatccggcgcggcgcgcacatctacgccgaggtcaccggctacgccgggcgctgcaactcctacagcatgaccgggctgcgggtcgacgggaacgagatggccgaggctatccgggtcgcgctcgaccgcagccggatgaaccccgaggacgtcggctacgtcaacgcgcacggctcggcgaccaagcagaacgaccggcacgagaccgccgcgttcaagaagagcctgggcgaccacgcctaccgggtgccggtcagctcgatcaagtcgatgatcggacactcgctgggcgcggtctgcgccctggagttcgccgccagcgcgctggcgatcgagcactcggtggtgccgcccacggccaacctgcacgtgcccgatcccgagtgcgacctcgactacgtgccgctggtggcgcgggaacagcgggtgcgcacggtgctcagcgtggcgagcggcttcggcggcttccagagcgcgatcgtgctcgccgagccggagtggagccggggatga

SEQ ID NO: 71965 - protein, 427 aa, Streptomyces aureofaciens
MVGVDDGRRRVVVTGIGVVAPGEVGTKAFWELLTAGRTATRTISTFDPSPFRSRVAAECDFDPQAAGLTQRQIRQWDRTAQFAVVAAREALDDSGVSGVNDPIRTGVMAGTACGMTISLDREFAVVSDEGRKRLVDDAHGVPYLYDYFVPSSMATELAWLVEAEGPVGVVSTGCTSGIDVIAHACDLIRDDAADVMLAGASDAAISPITVACFDAIKATTPRNDEPESASRPFDLTRNGFALGEGAAMFVLEEREHAIRRGAHIYAEVTGYAGRCNSYSMTGLRVDGNEMAEAIRVALDRSRMNPEDVGYVNAHGSATKQNDRHETAAFKKSLGDHAYRVPVSSIKSMIGHSLGAVCALEFAASALAIEHSVVPPTANLHVPDPECDLDYVPLVAREQRVRTVLSVASGFGGFQSAIVLAEPEWSRG

SEQ ID NO: 71966 - DNA, 1302 bp, Brassica napus; identical to SEQ ID NO: 20086
  CDS (1)..(1302)

SEQ ID NO: 71967 - protein, 433 aa, Brassica napus; identical to SEQ ID NO: 20087

SEQ ID NO: 71968 - DNA, 1467 bp, Glycine max; identical to SEQ ID NO: 20088
  CDS (1)..(1467)

SEQ ID NO: 71969 - protein, 488 aa, Glycine max; identical to SEQ ID NO: 20089

SEQ ID NO: 71970 - DNA, 1410 bp, Glycine max; identical to SEQ ID NO: 20090
  CDS (1)..(1410)

SEQ ID NO: 71971 - protein, 469 aa, Glycine max; identical to SEQ ID NO: 20091

SEQ ID NO: 71972 - DNA, 1410 bp, Glycine max; identical to SEQ ID NO: 20092
  CDS (1)..(1410)

SEQ ID NO: 71973 - protein, 469 aa, Glycine max; identical to SEQ ID NO: 20093

SEQ ID NO: 71974 - DNA, 1722 bp, Elaeis guineensis var; identical to SEQ ID NO: 20094
  CDS (1)..(1722)

SEQ ID NO: 71975 - protein, 573 aa, Elaeis guineensis var; identical to SEQ ID NO: 20095

SEQ ID NO: 71976 - DNA, 1260 bp, Streptomyces rochei; identical to SEQ ID NO: 20098
  CDS (1)..(1260): transl_table=11

SEQ ID NO: 71977 - protein, 419 aa, Streptomyces rochei; identical to SEQ ID NO: 20099

SEQ ID NO: 71978 - DNA, 1689 bp, Arabidopsis thaliana; identical to SEQ ID NO: 20100
  CDS (1)..(1689)

SEQ ID NO: 71979 - protein, 562 aa, Arabidopsis thaliana; identical to SEQ ID NO: 20101

SEQ ID NO: 71980 - DNA, 1605 bp, Cuphea hookeriana; identical to SEQ ID NO: 20102
  CDS (1)..(1605)

SEQ ID NO: 71981 - protein, 534 aa, Cuphea hookeriana; identical to SEQ ID NO: 20103

SEQ ID NO: 71982 - DNA, 1641 bp, Cuphea pulcherrima; identical to SEQ ID NO: 20104
  CDS (1)..(1641)

SEQ ID NO: 71983 - protein, 546 aa, Cuphea pulcherrima; identical to SEQ ID NO: 20105

SEQ ID NO: 71984 - DNA, 1266 bp, Rhizobium meliloti; identical to SEQ ID NO: 20112
  CDS (1)..(1266): transl_table=11

SEQ ID NO: 71985 - protein, 421 aa, Rhizobium meliloti; identical to SEQ ID NO: 20113

SEQ ID NO: 71986 - DNA, 1272 bp, Streptomyces coelicolor; identical to SEQ ID NO: 20120
  CDS (1)..(1272): transl_table=11

SEQ ID NO: 71987 - protein, 423 aa, Streptomyces coelicolor; identical to SEQ ID NO: 20121

SEQ ID NO: 71988 - DNA, 1422 bp, Arabidopsis thaliana; identical to SEQ ID NO: 20124
  CDS (1)..(1422)

SEQ ID NO: 71989 - protein, 473 aa, Arabidopsis thaliana; identical to SEQ ID NO: 20125

SEQ ID NO: 71990 - DNA, 1389 bp, Hordeum vulgare; identical to SEQ ID NO: 20126
  CDS (1)..(1389)

SEQ ID NO: 71991 - protein, 462 aa, Hordeum vulgare; identical to SEQ ID NO: 20127

SEQ ID NO: 71992 - DNA, 1386 bp, Arabidopsis thaliana; identical to SEQ ID NO: 20128
  CDS (1)..(1386)

SEQ ID NO: 71993 - protein, 461 aa, Arabidopsis thaliana; identical to SEQ ID NO: 20129

SEQ ID NO: 71994 - DNA, 1206 bp, Rhizobium leguminosarum bv
  CDS (1)..(1206): transl_table=11
atggacaggcgcgtcgtaatcacggggattggcggactatgcggattaggaacgaatgccgcatctatttggaaagaaatgcgcgaaggcccgtccgcaatcagcccgatcatcacgacagatctttatgatctggagggcaccgttggcctggagatcaaggcgataccggaacacgacatcccgcgcaaacagcttgtctctatggaccgcttcagccttctcgcggtgattgctgcaaccgaagccatgaagcaggccggactttcctgcgatgagcaaaatgcccaccgcttcggcgccgcgatggggctcggcggacccggctgggatacgatcgaagaaacctaccgtagtatccttttagatggagtgacccgggcgcgcatcttcactgcaccgaagggaatgccaagtgcggctgccggccacgtcagcatttttttggggctacgcggccccgtcttcggcgtcacctctgcctgcgctgccggaaatcatgccatcgcttccgcggtagatcagatcaggctgggccgtgcagacgtcatgcttgccgggggaagcgatgcgccgctcacatggggagtcctgaaatcatgggaagcactgcgcgtgcttgcccctgatacctgtcgcccgttctccgccgacagaaaaggtgttgtccttggcgagggtgccggaatggctgtcctggaaagctacgagcacgccgctgcccgcggtgcgactatgcttgccgaggttgccggaatcggactctccggcgatgcctacgacatcgtcatgccgtccatcgagggaccggaggccgcaatgcgcagctgcctcgccgatgccgagctaaacccggacgatgtagattacctgaacgcgcacggcaccggcaccgttgcgaatgacgagatggagacggcggcgatcaagcgcgttttcggagaccacgcttttcagatgtccgtctcctccaccaagtccatgcacgcccattgcctgggtgccgccagcgcacttgaaatgattgcctgcgtcatggcgatccaagaaggtgtcataccgcccaccgccaactatcgtgagcctgacccccagtgcgatctcgacgtcacgcccaatgtcccgcgtgagcaacggtgcggtagcatgagcaatgcgttcgccatgggaggcactaacgccgtcctggcattcagacaagtgtga

SEQ ID NO: 71995 - protein, 401 aa, Rhizobium leguminosarum bv
MDRRVVITGIGGLCGLGTNAASIWKEMREGPSAISPIITTDLYDLEGTVGLEIKAIPEHDIPRKQLVSMDRFSLLAVIAATEAMKQAGLSCDEQNAHRFGAAMGLGGPGWDTIEETYRSILLDGVTRARIFTAPKGMPSAAAGHVSIFLGLRGPVFGVTSACAAGNHAIASAVDQIRLGRADVMLAGGSDAPLTWGVLKSWEALRVLAPDTCRPFSADRKGVVLGEGAGMAVLESYEHAAARGATMLAEVAGIGLSGDAYDIVMPSIEGPEAAMRSCLADAELNPDDVDYLNAHGTGTVANDEMETAAIKRVFGDHAFQMSVSSTKSMHAHCLGAASALEMIACVMAIQEGVIPPTANYREPDPQCDLDVTPNVPREQRCGSMSNAFAMGGTNAVLAFRQV

SEQ ID NO: 71996 - DNA, 1209 bp, Rhizobium meliloti
  CDS (1)..(1209): transl_table=11
atggacaggcgcgttgtcatcaccggaatgggcggcctatgcggactgggcaccgacaccacctccatctggaaatggatgcgcgaaggccgctccgccatcgggccgcttctcaatacagagcttcacggcctgaagggcatagtgggcgctgaggtcaaggcgctgcctgaccacaacatcgaccgcaagcagctcgtatcgatggatcgcattagcgtgcttgccgtgattgcagcgcacgaagccatgcgccaggccgggctttcctgcaatgaaggaaatgcccttcggttcggcgcgaccgtgggcgtcggcttgggaggatgggacgctaccgaaaaagcataccgtaccctccttgtcgacggggggacccgtactgaaatcttcactggtgtaaaggctatgccgagtgccgccgcctgccaggtcagcatgagcctcggcctgcggggcccggtcttcggcgtcacctccgcctgttcctcggccaaccatgcgatcgcttcggcggtagaccagatcaagtgcggccgggccgacgtcatgctcgcggggggcagcgacgcgccactagtctggattgtgctgaaggcatgggaagctatgcgcgcactcgctccggatacttgccgacccttctccgccggcaggaaaggcgtggtactgggcgagggtgcaggcatggccgtgctggaaagctatgaacatgccaccgctcgcggtgcaacaatactcgcggaggtcgccggcgtcggcctttccgccgatgcgttccatatcacagcgccggctgtccatgggccggagtcggcgatgcgcgcttgccttgccgatgcaggactgaatgccgaggacgtcgactacctcaacgcgcacggcaccggcaccaaggccaacgatcaaaacgaaactacggctatcaagcgcgtcttcggagaccatgcttattcgatgtccatatcttccaccaagtccacccacgcgcactgtatcggcgcagcgagtgcgcttgaaatgatcgcctgtgtgatggcgatccaagaaggagtcgtgccgccgaccgccaactatcgtgagccagatcccgattgcgatctagacgtgacgccaaacgtgccgcgtgagcgtaaggtgcgcgttgccatgagcaacgccttcgccatgggtggcacgaacgcagttctggcattcaagcaggtatga

SEQ ID NO: 71997 - protein, 402 aa, Rhizobium meliloti
MDRRVVITGMGGLCGLGTDTTSIWKWMREGRSAIGPLLNTELHGLKGIVGAEVKALPDHNIDRKQLVSMDRISVLAVIAAHEAMRQAGLSCNEGNALRFGATVGVGLGGWDATEKAYRTLLVDGGTRTEIFTGVKAMPSAAACQVSMSLGLRGPVFGVTSACSSANHAIASAVDQIKCGRADVMLAGGSDAPLVWIVLKAWEAMRALAPDTCRPFSAGRKGVVLGEGAGMAVLESYEHATARGATILAEVAGVGLSADAFHITAPAVHGPESAMRACLADAGLNAEDVDYLNAHGTGTKANDQNETTAIKRVFGDHAYSMSISSTKSTHAHCIGAASALEMIACVMAIQEGVVPPTANYREPDPDCDLDVTPNVPRERKVRVAMSNAFAMGGTNAVLAFKQV

SEQ ID NO: 71998 - DNA, 1206 bp, Rhizobium meliloti
  CDS (1)..(1206): transl_table=11
atggacaggcgcgttgtcatcaccggaatgggcggcctatgcggactgggcaccgacaccacctccatctggaaatggtctgcgcgaaggcgctccgccatcgggccggttctcaatacagagcttcacggcctgaagggcatagtgggcgctgagatcaaggcgctgcctgaccacaacatcgaccgcaagcagctcgtatcgatggatcgcattagcgtgcttgccgtgattgcagcgcacgaagccatgcgccaggccgggctttcctgcaatgaaggaaatgcccttcggttcggcgcgaccgtgggcgtcggcttgggaggatgggacgctaccgaaaaagcataccgaccctccttgtcgacggggggacgtactgaaatcttcactggtgtaaaggctatgccgagtgccgccgcctgccaggtcagcatgagcctcggcctgcggggcccggtcttcggcgtcacctccgcctgttcctcggccaaccatgcgatcgcttcggcggtagaccagatcaagtgcggccgggccgacgtcatgctcgcggggggcagcgacgcgccactagtctggattgtgctgaaggcatgggaagctatgcgcgcactcgctccggatacttgccgacccttctccgccggcaggaaaggcgtggtactgggcgagggtgcaggcatggccgtgctggaaagctatgaacatgccaccgctcgcggtgcaacaatactcgcggaggtcgccggcgtcggcctttccgccgatgcgttccatatcacagcgccggctgtccatgggccggagtcggcgatgcgcgcttgccttgccgatgcaggactgaatgccgaggacgtcgactacctcaacgcgcacggcaccggcaccaaggccaacgatcaaaacgaaactacggctatcaagcgcgtcttcggagaccatgcttattcgatgtccatatcttccaccaagtccacccacgcgcactgtatcggcgcagcgagtgcgcttgaaatgatcgcctgtgtgatggcgatccaagaaggagtcgtgccgccgaccgccaactatcgtgagccagatcccgattgcgatctagacgtgacgccaaacgtgccgcgtgagcgtaaggtgcgcgttgccatgagcaacgccttcgccatgggtggcacgaacgcagttctggcattcaagcaggtatga

SEQ ID NO: 71999 - protein, 401 aa, Rhizobium meliloti
MDRRVVITGMGGLCGLGTDTTSIWKWSARRRSAIGPVLNTELHGLKGIVGAEIKALPDHNIDRKQLVSMDRISVLAVIAAHEAMRQAGLSCNEGNALRFGATVGVGLGGWDATEKAYRPSLSTGGRTEIFTGVKAMPSAAACQVSMSLGLRGPVFGVTSACSSANHAIASAVDQIKCGRADVMLAGGSDAPLVWIVLKAWEAMRALAPDTCRPFSAGRKGVVLGEGAGMAVLESYEHATARGATILAEVAGVGLSADAFHITAPAVHGPESAMRACLADAGLNAEDVDYLNAHGTGTKANDQNETTAIKRVFGDHAYSMSISSTKSTHAHCIGAASALEMIACVMAIQEGVVPPTANYREPDPDCDLDVTPNVPRERKVRVAMSNAFAMGGTNAVLAFKQV

SEQ ID NO: 72000 - DNA, 25 bp, Artificial sequence
  primer
atgtcaagaagagtggttatcacag

SEQ ID NO: 72001 - DNA, 25 bp, Artificial sequence
  primer
ttaactcccttcccatttcttgaag

SEQ ID NO: 72002 - protein, 464 aa, Artificial sequence
  consensus sequence
  Variant (4)..(4): Xaa in position 4 is any amino acid
  Variant (7)..(7): Xaa in position 7 is any amino acid
  Variant (9)..(13): Xaa in position 9 to 13 is any amino acid
  Variant (15)..(23): Xaa in position 15 to 23 is any amino acid
  Variant (25)..(26): Xaa in position 25 to 26 is any amino acid
  Variant (28)..(61): Xaa in position 28 to 61 is any amino acid
  Variant (62)..(84): Xaa in position 62 to 84 is any or no amino acid
  Variant (86)..(93): Xaa in position 86 to 93 is any amino acid
  Variant (95)..(97): Xaa in position 95 to 97 is any amino acid
  Variant (99)..(102): Xaa in position 99 to 102 is any amino acid
  Variant (104)..(112): Xaa in position 104 to 112 is any amino acid
  Variant (113)..(125): Xaa in position 113 to 125 is any or no amino acid
  Variant (127)..(129): Xaa in position 127 to 129 is any amino acid
  Variant (131)..(133): Xaa in position 131 to 133 is any amino acid
  Variant (135)..(174): Xaa in position 135 to 174 is any amino acid
  Variant (175)..(186): Xaa in position 175 to 186 is any or no amino acid
  Variant (188)..(189): Xaa in position 188 to 189 is any amino acid
  Variant (192)..(197): Xaa in position 192 to 197 is any amino acid
  Variant (200)..(208): Xaa in position 200 to 208 is any amino acid
  Variant (210)..(212): Xaa in position 210 to 212 is any amino acid
  Variant (214)..(215): Xaa in position 214 to 215 is any amino acid
  Variant (217)..(218): Xaa in position 217 to 218 is any amino acid
  Variant (219)..(229): Xaa in position 219 to 229 is any or no amino acid
  Variant (231)..(234): Xaa in position 231 to 234 is any amino acid
  Variant (237)..(248): Xaa in position 237 to 248 is any amino acid
  Variant (250)..(257): Xaa in position 250 to 257 is any amino acid
  Variant (258)..(262): Xaa in position 258 to 262 is any or no amino acid
  Variant (264)..(264): Xaa in position 264 is any amino acid
  Variant (265)..(265): Xaa in position 265 is any or no amino acid
  Variant (270)..(270): Xaa in position 270 is any amino acid
  Variant (272)..(273): Xaa in position 272 to 273 is any amino acid
  Variant (275)..(275): Xaa in position 275 is any amino acid
  Variant (279)..(279): Xaa in position 279 is any amino acid
  Variant (283)..(288): Xaa in position 283 to 288 is any amino acid
  Variant (290)..(291): Xaa in position 290 to 291 is any amino acid
  Variant (295)..(296): Xaa in position 295 to 296 is any amino acid
  Variant (300)..(302): Xaa in position 300 to 302 is any amino acid
  Variant (305)..(306): Xaa in position 305 to 306 is any amino acid
  Variant (308)..(312): Xaa in position 308 to 312 is any amino acid
  Variant (315)..(315): Xaa in position 315 is any amino acid
  Variant (317)..(317): Xaa in position 317 is any amino acid
  Variant (319)..(319): Xaa in position 319 is any amino acid
  Variant (321)..(321): Xaa in position 321 is any amino acid
  Variant (322)..(323): Xaa in position 322 to 323 is any or no amino acid
  Variant (325)..(332): Xaa in position 325 to 332 is any amino acid
  Variant (333)..(334): Xaa in position 333 to 334 is any or no amino acid
  Variant (336)..(343): Xaa in position 336 to 343 is any amino acid
  Variant (344)..(347): Xaa in position 344 to 347 is any or no amino acid
  Variant (349)..(349): Xaa in position 349 is any amino acid
  Variant (353)..(353): Xaa in position 353 is any amino acid
  Variant (355)..(355): Xaa in position 355 is any amino acid
  Variant (357)..(358): Xaa in position 357 to 358 is any amino acid
  Variant (359)..(359): Xaa in position 359 is any or no amino acid
  Variant (361)..(362): Xaa in position 361 to 362 is any amino acid
  Variant (364)..(365): Xaa in position 364 to 365 is any amino acid
  Variant (367)..(379): Xaa in position 367 to 379 is any amino acid
  Variant (380)..(388): Xaa in position 380 to 388 is any or no amino acid
  Variant (391)..(392): Xaa in position 391 to 392 is any amino acid
  Variant (395)..(395): Xaa in position 395 is any amino acid
  Variant (399)..(399): Xaa in position 399 is any amino acid
  Variant (401)..(402): Xaa in position 401 to 402 is any amino acid
  Variant (404)..(409): Xaa in position 404 to 409 is any amino acid
  Variant (410)..(410): Xaa in position 410 is any or no amino acid
  Variant (412)..(418): Xaa in position 412 to 418 is any amino acid
  Variant (420)..(421): Xaa in position 420 to 421 is any amino acid
  Variant (423)..(447): Xaa in position 423 to 447 is any amino acid
  Variant (448)..(454): Xaa in position 448 to 454 is any or no amino acid
  Variant (457)..(457): Xaa in position 457 is any amino acid
  Variant (463)..(463): Xaa in position 463 is any amino acid
RVVXTGXGXXXXXGXXXXXXXXXLXXGXXXXXXXXXXXXXXXXXXXXXXXXXXXXXXXXXXXXXXXXXXXXXXXXXXXXXXXXXDXXXXXXXXAXXXAXXXXGXXXXXXXXXXXXXXXXXXXXXXGXXXGXXXGXXXXXXXXXXXXXXXXXXXXXXXXXXXXXXXXXXXXXXXXXXXXXXXXXXXXGXXGPXXXXXXACXXXXXXXXXAXXXIXXGXXXXXXXXXXXXXDXXXXGGXXXXXXXXXXXXFXXXXXXXXXXXXXPXXASRPXDXXRXGFVXGEGXXXXXXEXXEHAXXRGAXXXAEXXGXXXXXDAXHXTXPXXXGXXXXXXXXXXLXXXXXXXXXXXXYXNAHXTXTXXXDXXEXXAXXXXXXXXXXXXXXXXXXXXXXKSXXGHXLGAXGXXEXXXXXXXAXXXXXXXPXXNXXXXXXXXXXXXXXXXXXXXXXXXXXXXXXXXSNXFGFGGXN

SEQ ID NO: 72003 - protein, 22 aa, Artificial sequence
  protein pattern
  Variant (2)..(2): Xaa in position 2 is Ile, Leu or Val
  Variant (3)..(3): Xaa in position 3 is Asn or Ser
  Variant (4)..(4): Xaa in position 4 is Ala, Ser or Thr
  Variant (6)..(6): Xaa in position 6 is Ala or Gly
  Variant (7)..(7): Xaa in position 7 is Ser or Thr
  Variant (8)..(8): Xaa in position 8 is Ala, Gly or Ser
  Variant (10)..(11): Xaa in position 10 to 11 is any amino acid
  Variant (12)..(12): Xaa in position 12 is any or no amino acid
  Variant (14)..(15): Xaa in position 14 to 15 is any amino acid
  Variant (17)..(18): Xaa in position 17 to 18 is any amino acid
  Variant (19)..(21): Xaa in position 19 to 21 is any or no amino acid
YXXXHXXXTXXXDXXEXXXXXA

SEQ ID NO: 72004 - protein, 24 aa, Artificial sequence
  protein pattern
  Variant (2)..(2): Xaa in position 2 is Ala, Gly or Ser
  Variant (3)..(4): Xaa in position 3 to 4 is any amino acid
  Variant (7)..(7): Xaa in position 7 is any or no amino acid
  Variant (9)..(9): Xaa in position 9 is any or no amino acid
  Variant (12)..(12): Xaa in position 12 is any amino acid
  Variant (14)..(14): Xaa in position 14 is any amino acid
  Variant (15)..(15): Xaa in position 15 is any or no amino acid
  Variant (17)..(17): Xaa in position 17 is any amino acid
  Variant (18)..(18): Xaa in position 18 is Ala, Ile or Val
  Variant (19)..(19): Xaa in position 19 is any amino acid
  Variant (20)..(20): Xaa in position 20 is Ala, Cys, Gly, Ser, Thr or Val
  Variant (21)..(23): Xaa in position 21 to 23 is any amino acid
  Variant (24)..(24): Xaa in position 24 is Ile, Leu, Met or Val
KXXXGHXLXGAXGXXEXXXXXXXX

SEQ ID NO: 72005 - protein, 14 aa, Artificial sequence
  protein pattern
  Variant (2)..(2): Xaa in position 2 is Ala, Gly, Asn or Ser
  Variant (4)..(4): Xaa in position 4 is Ala or Gly
  Variant (5)..(5): Xaa in position 5 is any amino acid
  Variant (8)..(8): Xaa in position 8 is any amino acid
  Variant (10)..(10): Xaa in position 10 is Ala, Gly, Ser, Thr or Val
  Variant (11)..(11): Xaa in position 11 is Ala, Ser, Thr or Val
  Variant (12)..(12): Xaa in position 12 is Ile, Leu or Val
  Variant (13)..(13): Xaa in position 13 is Ala, Ile, Leu or Val
  Variant (14)..(14): Xaa in position 14 is Phe, Ile, Leu or Met
NXFXXGGXNXXXXX

SEQ ID NO: 72006 - protein, 14 aa, Artificial sequence
  protein pattern
  Variant (2)..(2): Xaa in position 2 is Ala, Ile or Val
  Variant (4)..(4): Xaa in position 4 is Ile or Val
  Variant (7)..(7): Xaa in position 7 is any amino acid
  Variant (9)..(12): Xaa in position 9 to 12 is any amino acid
  Variant (13)..(13): Xaa in position 13 is any or no amino acid
RXVXTGXGXXXXXG

SEQ ID NO: 72007 - DNA, 1215 bp, Saccharomyces cerevisiae
  CDS (1)..(1215)
atgcctaacaaagtgtttaacgtggccgttttcttcgttgtgttcagagagtgcttggaagcagtgattgttatttccgtgctgctatcgtttttgaaacaggcaatcggggaacatgaccgggcgctgtaccgtaaattaaggattcaggtttgggtcggtgtgttactcgggttcatcatttgtctggccatcggtgcaggtttcatcggtgcgtactattcgctgcagaaggatattttcggaagcgcggaagacttgtgggaaggtatcttttgtatgattgcgacgataatgatctcgatgatgggtattcctatgttgagaatgaataagatgcagagtaagtggagagtgaagattgcgcggtcgttggtggagattcctcaccgtaagagagactatttcaagattgggttcttgagtagaagatatgctatgttccttttgccgtttattactgtcttgagagaaggtttggaagctgttgtgttcgttgccggtgcaggtattaccacacagggctcgcacgcctctgcttacccattgcccgttgtggttggtttgatatgtggtggtcttgttgggtatttgttgtactatggtgcttcgaaatcctcgctgcagattttcttgattttgtctacttcgatcttgtacctgatctccgccggtcttttctctcgtggtgcgtggtactttgaaaattacagattcaaccttgccagtggtggtgatgcttccgaaggcggtgatggtaatgggtcttataacatcagaaaggccgtttaccatgtcaattgttgcaacccagaactggacaatgggtgggatatcttcaatgctttgcttggatggcagaacaccggctacttgtcatccatgctttgttacaacatctattggttggttcttatcattgtgttgagtttaatgatattcgaagaaaggcgtggtcacttgcctttcaccaaaaacttacaattgaaacacttgaacccaggatactggatcaagaacaagaaaaagcaggagttgacggaagagcaaaagagacaactgtttgccaagatggagaacatcaacttcaatgaagatggtgagatcaatgtgcaagagaactacgaacttcccgagcaaactaccagtcattcctcgtctcaaaacgtcgccacagacaaggaagtcctccacgttaaagccgactctctttga

SEQ ID NO: 72008 - protein, 404 aa, Saccharomyces cerevisiae
MPNKVFNVAVFFVVFRECLEAVIVISVLLSFLKQAIGEHDRALYRKLRIQVWVGVLLGFIICLAIGAGFIGAYYSLQKDIFGSAEDLWEGIFCMIATIMISMMGIPMLRMNKMQSKWRVKIARSLVEIPHRKRDYFKIGFLSRRYAMFLLPFITVLREGLEAVVFVAGAGITTQGSHASAYPLPVVVGLICGGLVGYLLYYGASKSSLQIFLILSTSILYLISAGLFSRGAWYFENYRFNLASGGDASEGGDGNGSYNIRKAVYHVNCCNPELDNGWDIFNALLGWQNTGYLSSMLCYNIYWLVLIIVLSLMIFEERRGHLPFTKNLQLKHLNPGYWIKNKKKQELTEEQKRQLFAKMENINFNEDGEINVQENYELPEQTTSHSSSQNVATDKEVLHVKADSL

SEQ ID NO: 72009 - DNA, 1113 bp, Aspergillus fumigatus
  CDS (1)..(1113)
atggcaaaagacgtatttgctgttccagtcttttttatctgtttccgagaatgtgtcgagaccagcatcattgtctctgtgttactctcatttatcaagcagaccttgggacaagagcaagatgctaccactcgtaagaggctgatcagacaggtgtggtggggggttgccattgggttgttcatcagtgtttgcatcggagctggcatgatcggagcgttctatggatatggtaaggatcacttcgctagcacggaggacctgtgggagggcatcttctccctgatcgccagtgtcatcatcaccattatgggtgctgccctgcttcgtgtcaccaagttgcaggagaagtggcgcgtcaagctagctcaagccctggaagcaaagccgttgactggcggcacattcaaaaacaacctcaaactttgggcggagaaatacgccatgtttctcctccccttcatcaccgttctccgagaaggcctggaagcagtggtgttcattggaggcgtcagtctcagttttcctgcaactgccttccctctacctgtttttactggcattctcgcaggagtggccattgggtacctactgtatggaggaggaaaccaagcctccctccagatcttcctgatcatctccacttgcatcctctacctggttgctgccggcctcttctcccgaggcgtctggtatctggagaacaatacttggaaccacgtaattggtggtgatgctgccgagacaggtgccggtccgggatcgtatgacatccgacagagcgtctggcatgtcaactgctgtagtcctctcgttaatggtggcgggggatggggtatcttcaacgccatccttggctggacaaactcggcaacctatggctccgttctttcatacaacctttactggattgcggtgatcgtctggtttgtggctatgcgtcacaaggaacgccatggacgattgcctgtggtcgaccctctgctgaatcggctgcgaggccgaaagtctgccgaacctgggaatggagagcaagatgtcgaggtcagcacgataccatctgatttgcagacggagtccaaaataccgaaaagcggagcatcccttgtctga

SEQ ID NO: 72010 - protein, 370 aa, Aspergillus fumigatus
MAKDVFAVPVFFICFRECVETSIIVSVLLSFIKQTLGQEQDATTRKRLIRQVWWGVAIGLFISVCIGAGMIGAFYGYGKDHFASTEDLWEGIFSLIASVIITIMGAALLRVTKLQEKWRVKLAQALEAKPLTGGTFKNNLKLWAEKYAMFLLPFITVLREGLEAVVFIGGVSLSFPATAFPLPVFTGILAGVAIGYLLYGGGNQASLQIFLIISTCILYLVAAGLFSRGVWYLENNTWNHVIGGDAAETGAGPGSYDIRQSVWHVNCCSPLVNGGGGWGIFNAILGWTNSATYGSVLSYNLYWIAVIVWFVAMRHKERHGRLPVVDPLLNRLRGRKSAEPGNGEQDVEVSTIPSDLQTESKIPKSGASLV

SEQ ID NO: 72011 - DNA, 1167 bp, Aspergillus fumigatus
  CDS (1)..(1167)
atggcaaaagacgtatttgctgttccaatcttttttatctgtttccgagaatgtgtcgagaccagcatcattgtctctgtgttactctcatttatcaagcagaccttgggacaagagcaagatgctaccactcgtaagaggctgatcagacaggtaggccgattttattcgttggccctctcattctccgaactccaggctgattcggtgtggtggggggttgccattgggttgttcatcagtgtttgcatcggagctggcatgatcggagcgttctatggatatggtaaggatcacttcgctagcacggaggacctgtgggagggcatcttctccctgatcgccagtgtcatcatcaccattatgggtgctgccctgcttcgtgtcaccaagttgcaggagaagtggcgcgtcaagctagctcaagccctggaagcaaagccgttgactggcggcacattcaaaaacaacctcaaactttgggcggagaaatacgccatgtttctcctccccttcatcaccgttctccgagaaggcctggaagcagtggtgttcattggaggcgtcagtctcagttttcctgcaactgccttccctctacctgtttttactggcattctcgcaggagtggccattgggtacctactgtatcgaggaggaaaccaagcctccctccagatcttcctgatcatctccacttgcatcctctacctggttgctgccggcctcttctcccgaggcgtctggtatctggagaacaatacttggaaccacgtaattggtggtgatgctgccgagacaggtgccggtccgggatcgtatgacatccgacagagcgtctggcatgtcaactgctgtagtcctctcgttaatggtggcgggggatggggtatcttcaacgccatccttggctggacaaactcggcaacctatggctccgttctttcatacaacctttactggattgcggtgatcgtctggtttgtggctatgcgtcacaaggaacgccatggacgattgcctgtggtcgaccctctgctgaatcggctgcgaggccgaaagtctgccgaacctgggaatggagagcaagatgtcgaggtcagcacgataccatctgatttgcagacggagtccaaaataccgaaaagcggagcatcccttgtctga

SEQ ID NO: 72012 - protein, 388 aa, Aspergillus fumigatus
MAKDVFAVPIFFICFRECVETSIIVSVLLSFIKQTLGQEQDATTRKRLIRQVGRFYSLALSFSELQADSVWWGVAIGLFISVCIGAGMIGAFYGYGKDHFASTEDLWEGIFSLIASVIITIMGAALLRVTKLQEKWRVKLAQALEAKPLTGGTFKNNLKLWAEKYAMFLLPFITVLREGLEAVVFIGGVSLSFPATAFPLPVFTGILAGVAIGYLLYRGGNQASLQIFLIISTCILYLVAAGLFSRGVWYLENNTWNHVIGGDAAETGAGPGSYDIRQSVWHVNCCSPLVNGGGGWGIFNAILGWTNSATYGSVLSYNLYWIAVIVWFVAMRHKERHGRLPVVDPLLNRLRGRKSAEPGNGEQDVEVSTIPSDLQTESKIPKSGASLV

SEQ ID NO: 72013 - DNA, 1245 bp, Eremothecium gossypii
  CDS (1)..(1245)
atgcaggttgaaaagtacttctcgttccagatcttcttcatcttcctccgggagtcgctggagatcgtgatcatcatctcgatcctgctcacgatcgtgaagcaggcgctgttgaagccggagtcggcgtccagcaagtacctgggcggcgggcggctggaggcagaggaagaggtggagctgaacgcggcgctgcaggaggcggggccgctggaggcggtggagaacagccagctgtaccggaggctgaaggtccagattctgagcgggggcgcgctagggctgctatgctgcatgctggtgggcggattgtttatcgtgctgttctactacgtgggcaaggacctgtgggccgcgagcgagcactactacgagggcgttttgagcattgtggcgtcggtaatcatctcgttcatggggctgttctttctgcggatgggccggctgcgcgacaagttccgcatcaagctggcgtcgatgctttacgcgcagagtagcgacccgctggcgccgagccggcgcgcgcggaagttcagtgagaagtacgcgctgttcatcctgccgttcgtgacgtcgctgcgggaggggctggaggcggtggtgtttgtcggcggcattggcatcgaccagccgctgagctcgatcccgctgtcgatgctgtcggcagccgttgtgagctacgcgttcggacgcttctttttcgcatcgtcggggtccttctcgctcgaggtctgcctggtgacagccacatgcctgctgtacctcgtggcagccgggctcttctcgaagggcgtgtggcagttcgagctgcagcactacgtggacctctgtaacgggcaggacatgtccgaggttgggagcgggccgggctcctacgacatctccaactcggtctggcacgtcaactgctgcaacggcgagcgcgacggcctctggatgatattcacggcgatctttggctggaccaacagtgcaacatatggctccgtcatcagctacatcatctactggctggccgtcataggcgtgctgcacgtgctgaagatcgaggagacgctcggctacatcccatacgtgcccatcaaatggcaagctaggcgaatcaagaagcgcctggcactaatcgagaaggcgagggcgctgcaaagcaggccgccatcaggatcgcccccagtataccagacggctagattgtctcaagagagcacgaatagcaataccctcctattgtcgtcgcaggaataa

SEQ ID NO: 72014 - protein, 414 aa, Eremothecium gossypii
MQVEKYFSFQIFFIFLRESLEIVIIISILLTIVKQALLKPESASSKYLGGGRLEAEEEVELNAALQEAGPLEAVENSQLYRRLKVQILSGGALGLLCCMLVGGLFIVLFYYVGKDLWAASEHYYEGVLSIVASVIISFMGLFFLRMGRLRDKFRIKLASMLYAQSSDPLAPSRRARKFSEKYALFILPFVTSLREGLEAVVFVGGIGIDQPLSSIPLSMLSAAVVSYAFGRFFFASSGSFSLEVCLVTATCLLYLVAAGLFSKGVWQFELQHYVDLCNGQDMSEVGSGPGSYDISNSVWHVNCCNGERDGLWMIFTAIFGWTNSATYGSVISYIIYWLAVIGVLHVLKIEETLGYIPYVPIKWQARRIKKRLALIEKARALQSRPPSGSPPVYQTARLSQESTNSNTLLLSSQE

SEQ ID NO: 72015 - DNA, 1101 bp, Eremothecium gossypii
  CDS (1)..(1101)
atgtcagagaaggtattcaacgttgctgtattcttcgttgtgttccgcgagtgtctggaggccgctgtcatcgtgtcggtgttgctgtcgttcgtaaaccagtcgctcggcaccaacagcccggccctgcgcaagaagctctggtggcaggtgtggctcggtgttgcgctcgggttcctcgtgtgcctgatcatcggcggcgccatgatcggcgtctactaccggtacaacagcgacatctacggcaagtccgaggacttgtgggaggccatcttctgtttcatcgcgacaatcatgatcagcgtgatgggcctgcccatgctccgtatcagcaagttgcagaccaagtggcgcgttaagctcgcccaggcgctgctcgaggtcccggagcgcaagcgcgaccgcttccgctttggagccctcatgaagcgctacgccatgttcctgctgccctgcatcaccgtccttcgtgagggcctcgaggctatcgtcttcgttgccggcgtaggcgcaacctcccagggcgccgccgcatcctcctacccgctccccgtcatcgtcggcctcatcgccggcgccgccgtcggcaccctcctttactacggcgcctcgcgctcatccatgcagatcttcctcatcttctccacctgcctgctgtacctcattgccgccggcctctgctcccgcggcgcctggtacgccgagacctaccgcttcaatatggccaccggcggcgacgcctccgaaagtggcagcggcaacggctcctacaacatcctccagaccgtctaccacatcaactgctgcaaccccagtctcgacaagggctgggacatcttcaacgcccttctgggctggcagaacaccggatacctcgctagtatcctcgcctacaacctctactggctcgtcatcatcgccatcgtgtcactcatgatctacgatgagcgccgcggccacctccccttcactcgccaccgcctgcgcgacctcaacccgctgcgtcgtcgtcgcaaggagctctcggctgccgagcaggacgaactcttcgagcgtgccggaaggctcggtttcgagcccgacggccgcgttgccaactga

SEQ ID NO: 72016 - protein, 366 aa, Eremothecium gossypii
MSEKVFNVAVFFVVFRECLEAAVIVSVLLSFVNQSLGTNSPALRKKLWWQVWLGVALGFLVCLIIGGAMIGVYYRYNSDIYGKSEDLWEAIFCFIATIMISVMGLPMLRISKLQTKWRVKLAQALLEVPERKRDRFRFGALMKRYAMFLLPCITVLREGLEAIVFVAGVGATSQGAAASSYPLPVIVGLIAGAAVGTLLYYGASRSSMQIFLIFSTCLLYLIAAGLCSRGAWYAETYRFNMATGGDASESGSGNGSYNILQTVYHINCCNPSLDKGWDIFNALLGWQNTGYLASILAYNLYWLVIIAIVSLMIYDERRGHLPFTRHRLRDLNPLRRRRKELSAAEQDELFERAGRLGFEPDGRVAN

SEQ ID NO: 72017 - DNA, 1152 bp, Eremothecium gossypii
  CDS (1)..(1152)
atggcgaacaaggtgtttaacgtggcggtgttcttcgtcgtcttccgggagtgtctggaggcggcggtaatcgtgtcggtgctgctgtcgttcgtgcagcaggccgtgggcgacgcggacaaggtggtgcaccgcaagctgaagtggcagatctggatcggcgtggcgctggggatgctcatctgcctggcggtgggcggcggcttcatcggcgcgttctactcgctcaagaaagacatcatgggcaagaccgaggacctgtgggagggcattttctgcatggttgccacggtgatgatcagcgtgatgggcgtggccatgctgcgcatcaacaagctgcaggccaagtggcgcgtgaagatcgcgcaggcgctggtcgcgctgcctgcgcgccgccgcgaccgcatgcgcctgggctttctggccaagcgctacgcaatgttcctgctgccctttgtgaccgtgctgcgcgagggcctggaggccgtggtttttgtcgcgggcgccggcgtgtcgtcctcgaccgccagcgcgtcctcctacccgctgcccgtgatcgtaggcttgctggccggcgcggccgtgggcgccctgctgtactacggcgcgtcccgctcctccatgcaggtcttcctgatcctgtccacgtgtattctatacctgatagccgccggcctgtgctcacgcggcgcctggttttttgaaaaccaccgctacaacctgggcacgggcggcgacgcatccgagagcggcagcggcaacggctcctacaacatcctgcaggccgtgtaccacgtcaactgctgcaacccggagatcgacaacggctgggacatcttcaactcgttgctgggctggcagaacaccggctacctggccagcattctggcctacaacctgtactggctcgtgctcatcgtcgtgttgctgctcatgatctacgatgagcgccacgggcacctgccgctgtgtcgcggcctgcgcctgcgccacctctctccgggctactggctgaagcgccgccgcgcggcagagctcaccgacgcacagaagcagcagctgttcagccgtgtcgatgagctggtcgtcacggaggacggcgtgcacgcccagccggcccagccggcgcagccagccgcgccgtcgcactaa

SEQ ID NO: 72018 - protein, 383 aa, Eremothecium gossypii
MANKVFNVAVFFVVFRECLEAAVIVSVLLSFVQQAVGDADKVVHRKLKWQIWIGVALGMLICLAVGGGFIGAFYSLKKDIMGKTEDLWEGIFCMVATVMISVMGVAMLRINKLQAKWRVKIAQALVALPARRRDRMRLGFLAKRYAMFLLPFVTVLREGLEAVVFVAGAGVSSSTASASSYPLPVIVGLLAGAAVGALLYYGASRSSMQVFLILSTCILYLIAAGLCSRGAWFFENHRYNLGTGGDASESGSGNGSYNILQAVYHVNCCNPEIDNGWDIFNSLLGWQNTGYLASILAYNLYWLVLIVVLLLMIYDERHGHLPLCRGLRLRHLSPGYWLKRRRAAELTDAQKQQLFSRVDELVVTEDGVHAQPAQPAQPAAPSH

SEQ ID NO: 72019 - DNA, 1131 bp, Magnaporthe grisea 70-15
  CDS (1)..(1131)
atggaaatattcgcgttacccatctttttcatcacctttcgcgagtccctcgagaccgccatcatcgtgtctgtgctcctggccctggtcaagcgaaccctcggcgacggcagcagcagcaaccaagatgaagacgccgagctgcagcgccgcatgatccggcaggtctggctcggcacctttgccggcctggccgtctgcatcctgatgggcgttctcgtcatcgccggcgccaacggcctgggcgtagacgagtgggccgtggccgaagacgtctgggagggcgcctttgccctcctggcctcggtcatcatcaccgccatgggcgccgtgctgctgcgcgtgtcgcgcctgcaggacaagtggagggacaagctgctcaaggccttccgcgcctcgtcggccgggcgtgacgacgagtcttctgccggcgatggtgccgagtcgccgaggacggtcaagaggaatcgcttccttgatcgtcttgcctttttgggcgaggagtattcgctgttcctgctgccgttcatcacggtcttgcgtgaggggtttgagggtgtcatctttatcgctggcgtcgggctcggctatcccgtctcggctctcatctttacagccgctgtaggactgctagccggtgcagtctttggctatgccatttacaatctcgacatcaggggctccaactttgcatcgatgcaaaagttcctcgctgcgtctacatgcttcctgtacttggtcgcagccggtcttttctccaagggagtatggcatctcgaggccaatgagtggaacaagattgtcggcggcgatgctgccgagctcggctcggggcctggctcatacgacataaccaagagcgtgtggcatgtgaactgctgcaacccagactttgaaggaggcggactctggggagtcttcaactccatcctaggctggaccaattcggccactgtcggctcagttgtctcatacaacctctattggatcgtcgtctccataggcttcctttgcatggcacacaaagaaaagacgggccactaccctttcctgcagagggctagcaagatcactaggagtgttttggatggggatcgccaaccgcttctctcgaatgctcgaacagcctag

SEQ ID NO: 72020 - protein, 376 aa, Magnaporthe grisea 70-15
MEIFALPIFFITFRESLETAIIVSVLLALVKRTLGDGSSSNQDEDAELQRRMIRQVWLGTFAGLAVCILMGVLVIAGANGLGVDEWAVAEDVWEGAFALLASVIITAMGAVLLRVSRLQDKWRDKLLKAFRASSAGRDDESSAGDGAESPRTVKRNRFLDRLAFLGEEYSLFLLPFITVLREGFEGVIFIAGVGLGYPVSALIFTAAVGLLAGAVFGYAIYNLDIRGSNFASMQKFLAASTCFLYLVAAGLFSKGVWHLEANEWNKIVGGDAAELGSGPGSYDITKSVWHVNCCNPDFEGGGLWGVFNSILGWTNSATVGSVVSYNLYWIVVSIGFLCMAHKEKTGHYPFLQRASKITRSVLDGDRQPLLSNARTA

SEQ ID NO: 72021 - DNA, 1020 bp, Gibberella zeae PH-1
  CDS (1)..(1020)
atgctcgaattgttttcggtccccgtgtttgtcgttgtctttcgagagactctcgagactgccatcattgtctctgtcttgctggcttttctcaagcagacccttgatggctcacatcgcgatgccaacctttataaaaccctgcgcacacaggtctgggctggaactgcgactggcttcgctgtctgcgccattgcctctggtatcatcattggtacattctacatcctaggcagcgatacctgggcagaccatgagtactactatgaaggcgtgttttcgctcatttccgccatcatcatcaccataatgggcggcgctttgctgcgcgtcggaaagatggaggataagtggcgagccaagctatccaaggcgattgaggagcccgtcgtagctggtcacggaaaaagggcctggctgatcaacttgtttgagaagtatgccatgtttgtattgccttgtatcactgttcttcgcgagggtattgaaggcatcgttttcgttgcgggcgtgtcattctctgcgcccgcttcagctgtacctttgcccgtcattttgggtttgacactgggcgctctcgttggatatgctctctaccggggtggttcatctgcaaagctgcagtatttcctcgtcgcttcgacctgtcttttgtaccttgtcgcggcaggcttgttctcccgtgccatttggctttttgagcagcagcagtggaacaaggttgtcggtggcgatgccgcggaactcggggatggtcctggatcgtacgatattgaccgtagtatctggcacgtcaacctgacaacccagtgctgcaacccccaactcaacggcggaggaggctgggctatcctgaatgctgttgtcggatggaacaattccgccacatatggatctgttctcgcatacaacttgtactgggtgtttgtcattgcacagtttactgcaatggcatacaaggaggatcatggccattggcctcttgtcaaggccaaggaagtgcacgccaggacagactag

SEQ ID NO: 72022 - protein, 339 aa, Gibberella zeae PH-1
MLELFSVPVFVVVFRETLETAIIVSVLLAFLKQTLDGSHRDANLYKTLRTQVWAGTATGFAVCAIASGIIIGTFYILGSDTWADHEYYYEGVFSLISAIIITIMGGALLRVGKMEDKWRAKLSKAIEEPVVAGHGKRAWLINLFEKYAMFVLPCITVLREGIEGIVFVAGVSFSAPASAVPLPVILGLTLGALVGYALYRGGSSAKLQYFLVASTCLLYLVAAGLFSRAIWLFEQQQWNKVVGGDAAELGDGPGSYDIDRSIWHVNLTTQCCNPQLNGGGGWAILNAVVGWNNSATYGSVLAYNLYWVFVIAQFTAMAYKEDHGHWPLVKAKEVHARTD

SEQ ID NO: 72023 - DNA, 1035 bp, Gibberella zeae PH-1
  CDS (1)..(1035)
atggctgttgatgtctttgcggttcccgttttccttgtcgtctttcgagagactctcgagacggtcatcatcgtctccgttctccttgctttccttaagcagaccctcgacggacccaacggtgatgttaaagtatacaagcaactaaaacgccaggtttggctcggaacgggtattggtttctttatctgtatggtcgttgctgcagctctcatcggcgtcttctatactgtcggaagcaactcttgggaaaagcacgagtactactatgagggcgcattctgtctatttgcttccctcatcatctctgtcatgggcgctgctcttctccgtatcggtaagatgcagtccaagtggcgcgtcaagttagcaaaagctctcgagtccccaatcaaaactggtaacaagggctggttcaagcaatttgttgaaagatacgctatgtttgtcctgccctttgtcacagtactacgagagggtatcgaggctgttgtcttcgttgctggagtatctttctcggcttcggccaagtgtctgattcttaatgctgactgtgactctaggggtggtgcgagcaccaaacttcaattcttccttgttctgtccacctgcctcttgtaccttgttggtgctggtctcttttctcggtctgtatggagcttcgagatggccaaatggaacgagtatattggtggcgaggcagacgagttcggtaacggacccggctcctacgatattgatcaaagtgtctggcacgtcaactgttgtacttctaccgataagatccagaatggctggggcatcttcaacgctattttgggctggacaaactcggctacatatggctccgtcatttcttacaacctatactggatttgtgtcatgactggcttcattgtcatgcgtttcaaggagacacatggcaggtattctttcggaaaggcaaaggctcctgccaacgccgttgatgatgctgagagccacgcaacttcttctccaagaaatgtctccagtgaaaagaccacaacagcatag

SEQ ID NO: 72024 - protein, 344 aa, Gibberella zeae PH-1
MAVDVFAVPVFLVVFRETLETVIIVSVLLAFLKQTLDGPNGDVKVYKQLKRQVWLGTGIGFFICMVVAAALIGVFYTVGSNSWEKHEYYYEGAFCLFASLIISVMGAALLRIGKMQSKWRVKLAKALESPIKTGNKGWFKQFVERYAMFVLPFVTVLREGIEAVVFVAGVSFSASAKCLILNADCDSRGGASTKLQFFLVLSTCLLYLVGAGLFSRSVWSFEMAKWNEYIGGEADEFGNGPGSYDIDQSVWHVNCCTSTDKIQNGWGIFNAILGWTNSATYGSVISYNLYWICVMTGFIVMRFKETHGRYSFGKAKAPANAVDDAESHATSSPRNVSSEKTTTA

SEQ ID NO: 72025 - DNA, 1227 bp, Candida glabrata CBS 138
  CDS (1)..(1227)
atgcctaacaaagtatttaacgtggcagtcttctttgtcgtgttcagagaatgtttggaagctgttgttatcgtttccattctattgtctttcctgaagcaagcaattggttccaaagatattaaattatatcgcaaattgcgtaagcatgtttggattggtgtcgcactcgggttctttatctgtttagtgattggtgctggtttcattggtgcctactactctttacagaaagatatctttggttctacagaagatttatgggaaggtattttctgtatgattgctactactatgatcagtatgatgggtattccaatgttgcgtattaacaagttgcaaagtaaatggcgtgtgaagcttgctcgttcacttgttgatattccaaagagaaagcgtgattacttcaggattggttatttgactagacgttatgcgatgttcatcttacctttcatcactgttttaagagaaggtttggaagctgtcgtttttgtcgctggtgccggtattaccacgaagggttctcacgcatccgcttatcctttaccagtcgttgttggtctaattgctggttttatagttggattcctattatattacggtacttcaaagtcttccatgcaaatctttttagttatttctacctccattctttacttaattgcagccggtttgttctcaagaggtgcttggtacttcgaaaactacagattcaacaaggcaacgggtggtgatgcttctgaaggtggtgacggtaatggttcctataatatcgctaaatcagtttaccatgttaactgttgtaatcctgaactggacaacggttgggatattttcaacgctttgttgggatggcaaaatactggttatctgtccagtattctttgttacaatatttactgggttgttctaattattgtcttaggtttgatgatgcacgaagaaagatatggccacttaccatttatgagaaacgttggtatgagacacttaaacccaggttattggataaagaacaagaagaaggacgaattgactgatgaacaaaaggctgagctgctaaaccgtatggacaacattcaattcaatgaagaaggtgatattgtcgctcatgctaacgaagaagaacacgaccaggagagttctttgttgagaggcaactctaacaagatgggatccaaggaagaattgaacttcaaggttaccactaccagttccgactaa

SEQ ID NO: 72026 - protein, 408 aa, Candida glabrata CBS 138
MPNKVFNVAVFFVVFRECLEAVVIVSILLSFLKQAIGSKDIKLYRKLRKHVWIGVALGFFICLVIGAGFIGAYYSLQKDIFGSTEDLWEGIFCMIATTMISMMGIPMLRINKLQSKWRVKLARSLVDIPKRKRDYFRIGYLTRRYAMFILPFITVLREGLEAVVFVAGAGITTKGSHASAYPLPVVVGLIAGFIVGFLLYYGTSKSSMQIFLVISTSILYLIAAGLFSRGAWYFENYRFNKATGGDASEGGDGNGSYNIAKSVYHVNCCNPELDNGWDIFNALLGWQNTGYLSSILCYNIYWVVLIIVLGLMMHEERYGHLPFMRNVGMRHLNPGYWIKNKKKDELTDEQKAELLNRMDNIQFNEEGDIVAHANEEEHDQESSLLRGNSNKMGSKEELNFKVTTTSSD

SEQ ID NO: 72027 - DNA, 1161 bp, Kluyveromyces lactis NRRL Y-1140
  CDS (1)..(1161)
atggctgctaacaaggttttcaacgttgctgtgttcttcgttgtgttcagagaatgtttagaagcagcggtgattgtttccgtgttgctttctttcttgaaacaatccatcggttctaatgatatggccacttataaaaggttgagaatgcatgtctggatcggtgttgttgctggtttcatcatttgtatggccattggtggtggtttcattggtgcttactaccgttacgaaaatgatattttcggttctgctgaagatttatgggaaggtgtcttctgtatcatcgctaccttaatgatttctgtcatgggtattgctatgttaagagtcaacaagatgcaagccaaatggagagttaagattgccaaggccatgcttgaagttccaaaggacagacgtaagaaatggagtcttaaatactgggctaccagatattctatgtttttgttgccatttatcactgttttgagagaaggtttggaagccgtcgtgttcgttgctggtgccggtattaccaccaaggattccaaggccactgcgtacccattgcctgtcgtcattgggttaattgctggtatcatcgtaggtactttgttgtactacggtacttctaagtcatctctacaaatcttcttggtcatttctacttgtgttctttacttgattgcttccgggttgttctccagaggtgtgtggtacttcgataactattacttcaacaagaagaccggtggtgacgcatccgaatccggtgatggtaacgggtcctataacatcttaagaaccgtgtaccacgttaactgttgtaacccggaattggacaacggttgggatatcttcaactcgttgttgggctggcaaaacactggttatttgtcatccatccttgcttacaacttgtactggttggtcttaatgattgttatcggactaatgatgtacgaagaaagaaatggccatttaccattctgtaagaatctaaaactgagacaattgaagccaagctactatttaaaacgtaagcagaacgaagagttgaccgctgctgaacaagaggaattgttcaaacaagtcaacaatttgggcgtcgacgaagaaggtaacgtcgtcgttaacaaaggtgacactaccaaagtcaacgtcgaactcgtgaaataa

SEQ ID NO: 72028 - protein, 386 aa, Kluyveromyces lactis NRRL Y-1140
MAANKVFNVAVFFVVFRECLEAAVIVSVLLSFLKQSIGSNDMATYKRLRMHVWIGVVAGFIICMAIGGGFIGAYYRYENDIFGSAEDLWEGVFCIIATLMISVMGIAMLRVNKMQAKWRVKIAKAMLEVPKDRRKKWSLKYWATRYSMFLLPFITVLREGLEAVVFVAGAGITTKDSKATAYPLPVVIGLIAGIIVGTLLYYGTSKSSLQIFLVISTCVLYLIASGLFSRGVWYFDNYYFNKKTGGDASESGDGNGSYNILRTVYHVNCCNPELDNGWDIFNSLLGWQNTGYLSSILAYNLYWLVLMIVIGLMMYEERNGHLPFCKNLKLRQLKPSYYLKRKQNEELTAAEQEELFKQVNNLGVDEEGNVVVNKGDTTKVNVELVK

SEQ ID NO: 72029 - DNA, 1323 bp, Kluyveromyces lactis NRRL Y-1140
  CDS (1)..(1323)
atgtcaaagtcaagttttgagaattatttctcgtttcaaatttttttcatcttcttgagagagtcgttagagatcatcataatcgtttccatcttgttgacaatcgtcaaacaagccttattctcgcatgataccaccgctgaatccgatacagagtcttcaaaaaatgctgccccggttaccattcaagaggaagaagcttcagatttattattgagagttaatgactccgattctccaaatctaggtctagaagttgataaccagcagttatataaaaaactaaaacttcaaatcatttctggaggtttgttaggccttttggcatgtatgtttattggtggtggatttattgtggcattttattatgttggcacggatttgtggtctatgagtgaacattattatgaaggtgttttaagcgttattgcgtctgtcatcatttcagttatgggattgttcttcttaagaatgggtaaacttagagagaagttcagagttaaattggcatccatcatttactcagacaaattacttccgatggaaaatggcgaaagcaaagctaaaagtttcagcgagaaatactcattattcatcctaccatttgttacttctttgagagaagggctagaggctgtcgtcttcattggtggtatcggtatcgatagtccattaacctctattccactatcgatgctttctgctacggcgatctcggcaattttcggtgtattcttcttcaaatactcaaagtcgttttcattgcaaatttgccttgtggtaacaacatgtttcctatatcttattgccggcggattattctccaagggtgtatggcagtttgaacttcagaagtatgttgatgcttgtaacggtcaagatatgagcgaagttggaaacggtccaggttcttatgatatctcgcgttcggtatggcatgttaactgttgtaacggtgaaagggatggattttggatgattttgaccgccatttttggatggactaactcagctacctatggttcagttagcagttatattatgtactggttaattgttatcgctgttataaagctaatgatgctcgaagagaaacatggatatattccatttttgcctgtcagtctacaaagaaggagaatgaacaaaagattatctattattgaaaagtctcttgcactcaaatctcaatcatccacgagtggctggaactcatcttccactaccaaaaacttgcctgatattccgagagcttcatcggatactcacaatagctctagcctcctgttagattctaattcgcctgctcaaggttatcagtga

SEQ ID NO: 72030 - protein, 440 aa, Kluyveromyces lactis NRRL Y-1140
MSKSSFENYFSFQIFFIFLRESLEIIIIVSILLTIVKQALFSHDTTAESDTESSKNAAPVTIQEEEASDLLLRVNDSDSPNLGLEVDNQQLYKKLKLQIISGGLLGLLACMFIGGGFIVAFYYVGTDLWSMSEHYYEGVLSVIASVIISVMGLFFLRMGKLREKFRVKLASIIYSDKLLPMENGESKAKSFSEKYSLFILPFVTSLREGLEAVVFIGGIGIDSPLTSIPLSMLSATAISAIFGVFFFKYSKSFSLQICLVVTTCFLYLIAGGLFSKGVWQFELQKYVDACNGQDMSEVGNGPGSYDISRSVWHVNCCNGERDGFWMILTAIFGWTNSATYGSVSSYIMYWLIVIAVIKLMMLEEKHGYIPFLPVSLQRRRMNKRLSIIEKSLALKSQSSTSGWNSSSTTKNLPDIPRASSDTHNSSSLLLDSNSPAQGYQ

SEQ ID NO: 72031 - DNA, 1260 bp, Debaryomyces hansenii CBS767
  CDS (1)..(1260)
atgattcaagtttctgactatttctctattgagatatttttcataatattaagagaaacattagaaactgctattattatatcagttttgctttcatttataaaccaaagatcacattcccatgacggttcagggaattcggtaagttctcaaagacatgctgaagaacaaagaaaacttagacttcaggtgtgggcgggtgctgtcattggtttattaatatgcctcgttataggattggtctttattacatgcttttatattattggtaaggattattggtcgtacactgaaagattatgggaaggaatattttcattgatttcgtctgtaattatcaccgtaatgggcattgggttattacgaattaataaagttatgaaagttaaatggtggattaaattgggctcggcttataacaccgaagacaatagcggacgtcttgaaactagcgaagggagtgatgatatagatagtgaattatctggcactccagtaagtcaagaaaggcctcgaaaacattcctttacaaagaaatatttcttggcaatattaccattgatcactacattaagagagggtttggaagctgtggtgtttgtaggtggaattggtatgtcacaacctccaacctcaattccgctttcgattgtaggggggattctagtaggttcaggcattggctacatgttgtataaaggtggtaacaaaatgtcattacagtatttcttaattttcctgacatgtttcttgtacatagttagtgctggattgatgagcagaggtgtttggttcatggaattggaaagatatgttaggttatgtggtggcttggatgtaagtgaaacaggaagtggtcctggatcgtacgatattgcaaacagtgtttggcatgtcaattgttgtaatggattaactgatggttggtggatggtcttgaatgctattattggatggacaaattcagcaacttacggtagtgttatctcttactgtacatactggctatttgtttctttatggttggagataaaattatacgaagagaaactgggagtattaccattggttccaattaagtggcaattgaaaagaataaagaagaaagtcaaattatacgaaaccagacttaaacagcaacgtgaatctcaccagcaacatgaagtgaacaccaacgaatatcatgaactagacagtaatccatctatggagatcaaccctagagaagctgagggccaattattattgtccaatgattga

SEQ ID NO: 72032 - protein, 419 aa, Debaryomyces hansenii CBS767
MIQVSDYFSIEIFFIILRETLETAIIISVLLSFINQRSHSHDGSGNSVSSQRHAEEQRKLRLQVWAGAVIGLLICLVIGLVFITCFYIIGKDYWSYTERLWEGIFSLISSVIITVMGIGLLRINKVMKVKWWIKLGSAYNTEDNSGRLETSEGSDDIDSELSGTPVSQERPRKHSFTKKYFLAILPLITTLREGLEAVVFVGGIGMSQPPTSIPLSIVGGILVGSGIGYMLYKGGNKMSLQYFLIFLTCFLYIVSAGLMSRGVWFMELERYVRLCGGLDVSETGSGPGSYDIANSVWHVNCCNGLTDGWWMVLNAIIGWTNSATYGSVISYCTYWLFVSLWLEIKLYEEKLGVLPLVPIKWQLKRIKKKVKLYETRLKQQRESHQQHEVNTNEYHELDSNPSMEINPREAEGQLLLSND

SEQ ID NO: 72033 - DNA, 1284 bp, Debaryomyces hansenii CBS767
  CDS (1)..(1284)
atgaggacgttagacaactacttctcggtacaagtatttcttattgtgttgcgagaaacactagaactggcaattattatatcagtattattagcattcattaaacagagttttaattccaataatcttttaaattctaaccataacacgttgaataagaatcatattgttgatggtgatgaaacatcagaagtattacacgagaccggtcattcagagatctcagatgatcagcatactagcgttgctgtagacaactcgtcgatatacaattacttgaggctccagatatggatcggtgggttattaggagttacgtgttgtttaataattggatcgataatcttggcaatattttacataataggcaaagatttttggtcagtaacagagcattactgggaaggcacgttttccatactagctagtatcattatatcagtaatgggtataaaaatattgagagtaagtaaaatgcaagataaatggaaaaataagttgtcaacattgattaaccagtctaattatattgggaatataatgagacaaccaagtgataattctgaattatcaggaaaggtttctaatttttctgaaaagtacgccatgtttattttgccctttgtgaccacgctaagagaaggaatggaggctatagttttcatcggaggtattgggatcaacgaaaatacttcaatttgggctatttttaattcattggtaacagcgttaagtcttggtttgctaatcggtggtttactctaccgcctgggaaacacattatccttgcagtggtttttgatcgcatccactgggttcttatatttagttgcggcgggattattctctaagggtgtatggaattttgaattgcaaagatttatcgatttatgcgatggatttgatgtgagtgaaacgggccatagaccaggctcatatgatatatccaaaagtatatggcatgtaaactgttgtaacggcgagctacaggatgacggtcctctttggatggtccttactgcagtgttaggttggaccaatagtgctacttatgggagtgtcataagttacaacgcttattggatcacggtaattttggtatttgcttcattgttgtttgaagaaaaacatggtcgcttaccagttattccattaacctggcaaaagaagagaattgccaaaaggtcaagctctcattatgctccagtatcgctgattgatacttcagctattccccgggaaagtattgattccgtaaattcaaagactcccttaaatagctaa

SEQ ID NO: 72034 - protein, 427 aa, Debaryomyces hansenii CBS767
MRTLDNYFSVQVFLIVLRETLELAIIISVLLAFIKQSFNSNNLLNSNHNTLNKNHIVDGDETSEVLHETGHSEISDDQHTSVAVDNSSIYNYLRLQIWIGGLLGVTCCLIIGSIILAIFYIIGKDFWSVTEHYWEGTFSILASIIISVMGIKILRVSKMQDKWKNKLSTLINQSNYIGNIMRQPSDNSELSGKVSNFSEKYAMFILPFVTTLREGMEAIVFIGGIGINENTSIWAIFNSLVTALSLGLLIGGLLYRLGNTLSLQWFLIASTGFLYLVAAGLFSKGVWNFELQRFIDLCDGFDVSETGHRPGSYDISKSIWHVNCCNGELQDDGPLWMVLTAVLGWTNSATYGSVISYNAYWITVILVFASLLFEEKHGRLPVIPLTWQKKRIAKRSSSHYAPVSLIDTSAIPRESIDSVNSKTPLNS

SEQ ID NO: 72035 - DNA, 1155 bp, Debaryomyces hansenii CBS767
  CDS (1)..(1155)
atggttaacgtatttaacgttcagatttttttcattgtctttcgtgaaaccttagaagctgttgtcgtcgtttcggtcttattagccttcttaaagcaaggtttagggggagcaacaaatgacccagctgtatataaaaagttagtcagacaggtttgggtaggggcgcttctagggttgttgatatgtcttattttgggaggtgcttttattggtacattctattcgttaggtaaagatatttggggtaattctgaagatttatgggaagggattttctgtataattgcgacggtattaatttcgatgatgggtattgctatgttgcgtgttaataagatgaaagaaaaatggagagttaaattggcacaggctttaatcaaggaaccaccaaagggaaaagacagattcagaattgggtacttgactaagaaatactgtatgtttatcttgccattcattaccactctcagagaagggttagaagctgtcgttttcgttggtggtgttggtttagacagtcctgcatcatctttcccacttccagttgtctgtggtttgatcgcaggtctttttgtcggtaccttgttgtattattttggttctactgtttctttacaagttttcttgatcatttccactggtatcttgtacttgattgctgcagggttattttccagaggtgtttggttctttgaaaccaacacttataataaggcgactggtggtgatgcttctgaaaatggttcaggtcctggtacttacgatatttccaaatcggtctggcacgttaattgttgcaaccctgaaaccgataatggttgggatgtcttcaacgctcttttgggatggcaaaattctgccacatacggttcagtcatttcttacaacatctactggattgctgtgattgtaaccttgttattgatgatgtacgaagaaaagacaggacatttaccattcttgaagaatgtcacattagtcaaattgaacccaatgtatcacattaaaaataagaagaagcatgaacttactaaagaacaacaagaagaattgttcgaaaaagtcagaaatcaaaggattgtggctgacggtgagtcaaacgagagttctatgctttctaataaggaagctattaatgcagttgagaaataa

SEQ ID NO: 72036 - protein, 384 aa, Debaryomyces hansenii CBS767
MVNVFNVQIFFIVFRETLEAVVVVSVLLAFLKQGLGGATNDPAVYKKLVRQVWVGALLGLLICLILGGAFIGTFYSLGKDIWGNSEDLWEGIFCIIATVLISMMGIAMLRVNKMKEKWRVKLAQALIKEPPKGKDRFRIGYLTKKYCMFILPFITTLREGLEAVVFVGGVGLDSPASSFPLPVVCGLIAGLFVGTLLYYFGSTVSLQVFLIISTGILYLIAAGLFSRGVWFFETNTYNKATGGDASENGSGPGTYDISKSVWHVNCCNPETDNGWDVFNALLGWQNSATYGSVISYNIYWIAVIVTLLLMMYEEKTGHLPFLKNVTLVKLNPMYHIKNKKKHELTKEQQEELFEKVRNQRIVADGESNESSMLSNKEAINAVEK

SEQ ID NO: 72037 - DNA, 1140 bp, Debaryomyces hansenii CBS767
  CDS (1)..(1140)
atggttgatgtattcaatattcaaattttcttcgttttattcagagaaacattggaaggcgtcgtcattatttctattttgcttgccttcttgaagcagggattagcaggcccttcaaatgacgcagttgtatataagaaattagtacgacaggtctggtttgggactatattaggggtggtattttgtctcattgtaggtagtatttttattggcatattctacactgttggaagtgacgtatggcaaaaatctgaagacttatggaccggagtcttttgtatgattgcgtctgttttaatttcaatgatgggcattgctatgttacgtgttaataaaatgaaagaaaaatggagaatcaagatagcacaggcattgcttaatgttccagaaaagaaacttgatcgctttaagttaggttatttgacaaaaaagtactgtttttttattttgccatttgttacttgtatacgtgaaggtttagaggctgttgtatttgttgggggagtaggattaaatcgacctgtttcttctttcccgcttccagttatctgtggtttacttgctggaattgcagttggttttgcattatactactgggggtcaacaatctcagtacaaatatttttgatcatttccacttgtatcttgtatttaatagcttccggtttgttctctagaggtgtgtggtattttgaaacaaatacttataatcagaaaactgggggagatgcatctgaaaatggatctggtccaggtacctatgatattagcaaatctgtgtggcacgtcaattgctgtaatccacagaaagataatggttgggatgtatttaatgcactactaggttggcaaaattctgccacgtacggctcagttatatcgtactgtgtctattggctctgcatgatagtagttttattgttgatgtcatacgaagagaaacatggacacctaccattctccaagaacttgactttggctcaattgaatccaatgtatcatattaaaggcaagaagaataataacctttctaggagagagaaagacgagttattcgccaaagtaaagattaaaaatattgttattagtaaaaattttgattttgaagaatcaaattcaaatatttctcgcctgtaa

SEQ ID NO: 72038 - protein, 379 aa, Debaryomyces hansenii CBS767
MVDVFNIQIFFVLFRETLEGVVIISILLAFLKQGLAGPSNDAVVYKKLVRQVWFGTILGVVFCLIVGSIFIGIFYTVGSDVWQKSEDLWTGVFCMIASVLISMMGIAMLRVNKMKEKWRIKIAQALLNVPEKKLDRFKLGYLTKKYCFFILPFVTCIREGLEAVVFVGGVGLNRPVSSFPLPVICGLLAGIAVGFALYYWGSTISVQIFLIISTCILYLIASGLFSRGVWYFETNTYNQKTGGDASENGSGPGTYDISKSVWHVNCCNPQKDNGWDVFNALLGWQNSATYGSVISYCVYWLCMIVVLLLMSYEEKHGHLPFSKNLTLAQLNPMYHIKGKKNNNLSRREKDELFAKVKIKNIVISKNFDFEESNSNISRL

SEQ ID NO: 72039 - DNA, 1221 bp, Yarrowia lipolytica CLIB122
  CDS (1)..(1221)
atggtcaactacgcggactttttcgagaattatttctcggttcaggtcttcttcatcatcttccgagagaccattgagacggcgattatcatctccgtgcttctggcgttcctcaaccagggtctgggcgataatgtgtcccagaaggacttgcaagtgtatcgacggcttgttacccaggtatggctgggtggaatcttcggtctgctcatctgtctggccgtgggaggtgcgttcattgccaccttttacatctacggacacgatctgtggggcatgactgagaacgtgtgggagggcgtcttctccattgtctcgtccatcattatcaccatcatgggagccgccatgctgcgaatcaacaagatgcgagaaaagtggcgacacaagattgccaagattctggtcgagacccacgagggccacggcggctggggcctcaagtacctgtctcgaaagtacgctctggccatcctaccgtttgtgaccacccttcgagagggaatggaggccgtggttttcctcggcggtatcggtgtcaaccagcctttctctgctttcccccttcccgtcatcaccgccattgcccttggtgctttcattggttacgccatgtacaagtatggcaacgccatctccatcaactacttcctcattggctccacgtgcttcctgtacctggtggccgccggtcttttctcccgtggagtgtggttcctggagctgcagcagttcgttaacagagttggtatggacgtatctgagaccggctctggacccggctcctacgacatcaccaagtccgtgtggcacgtcaactgctgcaacggtcagaccgatggaggatggatgattgccaacgcgctgtttggatggaccaactcggccacctacggctctgtcatctcctacaacttttactggatcttcatcattgtggccgtctacgtgtctttggtcaaggagaagactggctacaaccccctgtaccctcgagcgtggcagtccaagaagtttactcgacttcctcagaacgacgacgaggaccgactcttccagcgagcctcggctgtttactccgctgatatgaacgttgagggccagggcactaacaagagctcccagtacggcaccaacagcatgcccaactcggccaacaccgcggccgagaaccgagagtctgtggactctgacgctcctcttcttgccagcacttcttaa

SEQ ID NO: 72040 - protein, 406 aa, Yarrowia lipolytica CLIB122
MVNYADFFENYFSVQVFFIIFRETIETAIIISVLLAFLNQGLGDNVSQKDLQVYRRLVTQVWLGGIFGLLICLAVGGAFIATFYIYGHDLWGMTENVWEGVFSIVSSIIITIMGAAMLRINKMREKWRHKIAKILVETHEGHGGWGLKYLSRKYALAILPFVTTLREGMEAVVFLGGIGVNQPFSAFPLPVITAIALGAFIGYAMYKYGNAISINYFLIGSTCFLYLVAAGLFSRGVWFLELQQFVNRVGMDVSETGSGPGSYDITKSVWHVNCCNGQTDGGWMIANALFGWTNSATYGSVISYNFYWIFIIVAVYVSLVKEKTGYNPLYPRAWQSKKFTRLPQNDDEDRLFQRASAVYSADMNVEGQGTNKSSQYGTNSMPNSANTAAENRESVDSDAPLLASTS

SEQ ID NO: 72041 - DNA, 1245 bp, Yarrowia lipolytica CLIB122
  CDS (1)..(1245)
atggccaacgcgttttccgttccggtcttcttcattgtctttcgagagactctggaggccgccatcatcatttcggtgctgctggccttcatcaagcagtctctgggcccggctcctgtgacggaccatcccgattatgaccccgaaaaccccgagaaggatctcagtcccgtggcaacctccgccgatgacgcctttgccggccagtccgaggctgacaaggctctgctgcagaagaagctcatcaagcaggtgtggattggcgccgctcttggtcttctcatctgtttcattctcggaggcaccttcatcggtgtcttctactcgctggacaaggatctctgggcttcgtttgaagacctgtgggaaggtatcttctgtatcattgctaccatcatgatcaccttcatgggtctggccatgctgcgaatcaacaagatgaaggagaagtggcgaatcaagattgccaagaccctgctgcagaacaagggcgagtacaaggacacttccttcaagggccgactcaagagtctcttcaacttccgatacaactccaagaagtacgctctgggcattctcgccttcgttactaccctgcgagaaggtattgaggccgtggtctttgtcggaggtgttggactcggtgaggatgccaccgcattccctcttcccgtcttttgtggtctggcagccggcggtctgatcggatacttcatctaccgaggaggtaacttcatgtctatccagatcttcctcatcgcctccacctgtttcctctacctcattgctgccggtctcttctcccgagctatctggtacttccagatgtaccgattctccaagaagtctggtggagatgtcgccgagggaggctccggccctggctcctacaacatcaaggaggtggtctggcacgtcaactgctgcgaccctctcaacgacggtggctggcagatcttcaacgcgctgtttggatggcaaaactcccccacctacggctccgtcatctcatacaatgtgtactggatctgcatcattctcgccattttcgccatgctcttcaacgagaagcacggctactaccccatgctcaagcgatgggccaagactgaggacaagactgccgacaatgccatgtacgaccgggccgtgttccatgctcgacaggatgctggcgtcgagaagaatgctgtcgtgacggagaactccgcgtctagcagcgacgaacgaaaggaggttgcctaa

SEQ ID NO: 72042 - protein, 414 aa, Yarrowia lipolytica CLIB122
MANAFSVPVFFIVFRETLEAAIIISVLLAFIKQSLGPAPVTDHPDYDPENPEKDLSPVATSADDAFAGQSEADKALLQKKLIKQVWIGAALGLLICFILGGTFIGVFYSLDKDLWASFEDLWEGIFCIIATIMITFMGLAMLRINKMKEKWRIKIAKTLLQNKGEYKDTSFKGRLKSLFNFRYNSKKYALGILAFVTTLREGIEAVVFVGGVGLGEDATAFPLPVFCGLAAGGLIGYFIYRGGNFMSIQIFLIASTCFLYLIAAGLFSRAIWYFQMYRFSKKSGGDVAEGGSGPGSYNIKEVVWHVNCCDPLNDGGWQIFNALFGWQNSPTYGSVISYNVYWICIILAIFAMLFNEKHGYYPMLKRWAKTEDKTADNAMYDRAVFHARQDAGVEKNAVVTENSASSSDERKEVA

SEQ ID NO: 72043 - DNA, 1221 bp, Yarrowia lipolytica CLIB122
  CDS (1)..(1221)
atgactgccgacgtcttttccgtcgaagtcttcttcatctgtttccgagaatgtctcgaggctgccattgtcatttcggtgctcctgtcctttgtcaagcagggtcttggcggcggagaggacaagactctctacaaaaagctgcttaagcagatctggatcggtgccgctggaggcattgtcatctgtctgtgtatcggtggaggtttcatcggcgcctactactcgtttgaagatgatatctggtccaagtccgaggatctgtgggagggtatcttctccgtcattgctaccattctgatcaccgttatgggcctggccatgctgcgaatcaacaagatgaaggaaaagtggcgaatgaagatcgccaaggcgctgctggaagaccaccagcaagtcaaggggttcaaaaagttcctcaacttccgcttctactccaaaaagtacgccatggccattctgcctttcatcaccacccttcgagagggagtcgaagccattgtgttcattggtggagtcgctgtcggtagacctgccaccgccttccctctcgctgtcttttgcggtcttctggccggatgtgcctgtggatatctcatttaccgaggaggtaacatgatgtctattcagatcttcctcatcgcctccacttgcttcctctatctcattgccgccggtcttatctctcgagccgtgtggtacttccagatgtaccgattttcgctcaagactggcggggacgtggccgagcagggctccggaccgggctcgtacaatgtccacgaggtggtgtggcacgtcaactgctgcaaccccgagacggacaacggctgggagatttttaacgctctgtttggctggcaaaactcccccacctacggctccgtcatcatctacaacctctactggctgtgcatcattggcgccatcttcgccatgctgttccaggagaagcacggctactaccccggcttcaagtgggccaagcggttccagaagaaggagtactccaaggaggagattgatgagatgttccaccgggccgccgccacccagatcaacgaggctgcccagtaccacgccggctcgtcgtcagaggacctcgacaagggcgtcaacgatgtggagagcaagggcgtcgacgatatttctcctggctcctccaaccccgaggtgtctcgagttcagatcgagatgaccgacaagtcgcaggagaaataa

SEQ ID NO: 72044 - protein, 406 aa, Yarrowia lipolytica CLIB122
MTADVFSVEVFFICFRECLEAAIVISVLLSFVKQGLGGGEDKTLYKKLLKQIWIGAAGGIVICLCIGGGFIGAYYSFEDDIWSKSEDLWEGIFSVIATILITVMGLAMLRINKMKEKWRMKIAKALLEDHQQVKGFKKFLNFRFYSKKYAMAILPFITTLREGVEAIVFIGGVAVGRPATAFPLAVFCGLLAGCACGYLIYRGGNMMSIQIFLIASTCFLYLIAAGLISRAVWYFQMYRFSLKTGGDVAEQGSGPGSYNVHEVVWHVNCCNPETDNGWEIFNALFGWQNSPTYGSVIIYNLYWLCIIGAIFAMLFQEKHGYYPGFKWAKRFQKKEYSKEEIDEMFHRAAATQINEAAQYHAGSSSEDLDKGVNDVESKGVDDISPGSSNPEVSRVQIEMTDKSQEK

SEQ ID NO: 72045 - DNA, 1146 bp, Candida albicans SC5314
  CDS (1)..(1146): transl_table=12
atggttgacgtatttaacgttcaaattttcttcatcgttttcagagaatctttggaagctatcattgttgtttcagtgcttttggcattcgttaagcaatctatgggtggtagttccgaccctcaattgaaaaaacgattgtatcgtcagatttggctaggggcggggctaggggttctagtctgtcttattattggttgtgctttcatcggtgcgttctacggtttaggtaaagatatttggggtaattccgaagatctatgggaaggtatcttttgtatcattgccacggtcttgatcactgctatgggtattccaatgttgagaatcaacaagatgaaagaaaaatggagagtcaaattagctcaagctttaattaaatctccaactaacaaaaaagatagatttaaattgggttaccttggtaagaaatatgctcttttcattttaccattcattacttgtttgcgtgaaggtttagaagctgttgtcttcgttggtggtgttggtttgaatagtccagccacctctttcccaattccagtcattgttggtttaattgccggtatcgttgttggtgcattattgtactactttggttccagtatgtccatgcaaatcttcttaattatttccacctgtattttgtacttgattgctgctggtttgttctccagaggtatttggtatttcgaaaccaacacttacaataaaaaaactggtggtgatgcttctgaaaacggttctggtccaggtacttacgacatttctaaatctgtttggcacgtcaactgttgtaatccagaaaccgataacggttgggatatcttcaatgccattttgggatggcaaaactctgccacttacggttctgtcatttcctacaacatttactggctctttattatctgtgttttgttgttaatggtttacgaagaaaaacacggccacttgccattcaccaagaatttgactttggtccaattgaacccaatgtaccacatcaagggtaagaagaagttagaattaaacaaagctgaaaaggatgaattgttcactaaacttcaacaacaaaactttggtcaagctgcagaagttgatgaaacttcatcaaacaaattgatcgaatccaaagaaaacaaataa

SEQ ID NO: 72046 - protein, 381 aa, Candida albicans SC5314
MVDVFNVQIFFIVFRESLEAIIVVSVLLAFVKQSMGGSSDPQLKKRLYRQIWLGAGLGVLVCLIIGCAFIGAFYGLGKDIWGNSEDLWEGIFCIIATVLITAMGIPMLRINKMKEKWRVKLAQALIKSPTNKKDRFKLGYLGKKYALFILPFITCLREGLEAVVFVGGVGLNSPATSFPIPVIVGLIAGIVVGALLYYFGSSMSMQIFLIISTCILYLIAAGLFSRGIWYFETNTYNKKTGGDASENGSGPGTYDISKSVWHVNCCNPETDNGWDIFNAILGWQNSATYGSVISYNIYWLFIICVLLLMVYEEKHGHLPFTKNLTLVQLNPMYHIKGKKKLELNKAEKDELFTKLQQQNFGQAAEVDETSSNKLIESKENK

SEQ ID NO: 72047 - DNA, 1149 bp, Candida albicans SC5314
  CDS (1)..(1149): transl_table=12
atggttgatcttttcaatgttcaagtcttttttgttgttttcagagaagccttggaagcagttattgttgtttcagtgcttttagcatttgtcaaacaatcaatgggctcctcagcaaacggtccagagttgaagaaaaagttgtatcgtcagatttggctaggggcggggctaggtgttcttatttgtataatcattggtggcgcttttattggtaccttttacgggttgggtaaagatatctggggaaaatcagaagacttgtgggaagggatattttgtatcattgccacagtcttgatcactgctatgggtattccaatgttgagaatcaacaagatgaaagaaaaatggagagttaaattagcacaagctttaatcaaatctccagaaaataagaagaaccgattcaaattgggatatcttgggaaaaagtacgcactttttattttgccattcatcacttgcttgcgtgaaggtttagaagctgttgttttcgttggtggggtcggtattactagtcctgcttcatctttcccaatcccagttattgttggtataatttgtggtcttgcagtgggtgccttgttgtactactttggttccaatatgtcgatgcaaatcttcttgatcatctccacttgtatcttgtacttgatcgctgctggtttgttctccagaggtgtctggttctttgagagttatcaatacaataaaaaaactggtggtgatgcggctgagaatggttctggcccgggtacatatgacatttccaaatctgtttggcatgtcaactgctgtaacccattgaccgacaatggttgggatatcttcaacgccattttgggatggcaaaactctgccacttacggttctgtcatttcctacaatgtttactggattttcatcatttctgttttgttattgatggtctatgaagaaaaacacggacatttaccgttaaccaaaaacttaactttggtccaattgaatccaatgtaccacatcaaaggtaagaagaagttagaattaaacaaagctgaaaaggaagaattgttcaccaaacttcaaaaacaaaagtttggtgatgttcaagaaattgacgaaacttcttctaacaaattagtcgaaactcaagaaaataaataa

SEQ ID NO: 72048 - protein, 382 aa, Candida albicans SC5314
MVDLFNVQVFFVVFREALEAVIVVSVLLAFVKQSMGSSANGPELKKKLYRQIWLGAGLGVLICIIIGGAFIGTFYGLGKDIWGKSEDLWEGIFCIIATVLITAMGIPMLRINKMKEKWRVKLAQALIKSPENKKNRFKLGYLGKKYALFILPFITCLREGLEAVVFVGGVGITSPASSFPIPVIVGIICGLAVGALLYYFGSNMSMQIFLIISTCILYLIAAGLFSRGVWFFESYQYNKKTGGDAAENGSGPGTYDISKSVWHVNCCNPLTDNGWDIFNAILGWQNSATYGSVISYNVYWIFIISVLLLMVYEEKHGHLPLTKNLTLVQLNPMYHIKGKKKLELNKAEKEELFTKLQKQKFGDVQEIDETSSNKLVETQENK

SEQ ID NO: 72049 - DNA, 1536 bp, Candida albicans SC5314
  CDS (1)..(1536): transl_table=12
atgattaaatttgaagattatttttccattcaaatatttttcattatattacgtgaaactttagaaacggcaattattatatctgttttattatcattcatcaatcaacgatctcataaacaagaagaggaatcacctttatctacaaataataataataataatgataataatgataataatgagaatgagaatgagaatgagaatgccgttcatccaatatctatatctcaaggtagaaaagctgatatgaatcgaaaattaaaatttcaagtttggataggagctatattaggattaatcatttgttttataattgggataatttttgttttaattttttattttgttggacaagattattggtcatatactgaaagagtatgggaaggattattttcaattttatcgagtataataatcactattatggggattggattattaagaattaataaagtgatgaaattaaaatggtggataaaattaggtgatgcctataactataatggacaacaagacgagagggaggatgatgaagagatttctgctttgactgataatgatattttatttgatgggaataacaatggtgaggaagaagatattatgaattatgggggaacgagatcaagttctgaatcaaatgaaataatcacccataacaataataatgactctaattttagttttagttctagttctagttctaattctaattctaattttaattctaattctaatccgggaattttgaataatgataatgaggaaaatatacctttaacggcatcttctaatttttttactccattcaaaaataaacatcaatcaactgcaaaaaattcgaaacagcttcaccgccagtcatttagtaagaaatattttttggcaatattaccattagtcaccacattaagagaaggattggaagcagtggtattcattggtggtagtgctatgagttcatcacctcattctattccattatcggtaatttgtgggatttctatgggttcaataattggttattttttatatcaaggaggtaataaattatcattacaatattttttgattttttcaacatgttttctttatattgtcagtgctggattaatgagtcgaggtatttggtttttggaattagaacaatatgttagacaatgtaatggattagatgtgagtgaaactggtagtggacctggttcttatgatattgtcaaaagtgtttggcatgttaattgttgtaatggattaactgatggttggtggatggtttttaatgctatttttggttggacaaattctgcaacttatggtagtgttttcagttatatgatttattggaccatggttattatttggttgaaaattaaattatatgaagaacgtcatggtatattaccattggttccattaaaatggcaattgaaaagaattcaaaaaagaattagattatatgaattaagaaaaaatcatgaacaagaacatcaagggcagcaacaagaagaagggcaacaagaagcaagttga

SEQ ID NO: 72050 - protein, 511 aa, Candida albicans SC5314
MIKFEDYFSIQIFFIILRETLETAIIISVLLSFINQRSHKQEEESPLSTNNNNNNDNNDNNENENENENAVHPISISQGRKADMNRKLKFQVWIGAILGLIICFIIGIIFVLIFYFVGQDYWSYTERVWEGLFSILSSIIITIMGIGLLRINKVMKLKWWIKLGDAYNYNGQQDEREDDEEISALTDNDILFDGNNNGEEEDIMNYGGTRSSSESNEIITHNNNNDSNFSFSSSSSSNSNSNFNSNSNPGILNNDNEENIPLTASSNFFTPFKNKHQSTAKNSKQLHRQSFSKKYFLAILPLVTTLREGLEAVVFIGGSAMSSSPHSIPLSVICGISMGSIIGYFLYQGGNKLSLQYFLIFSTCFLYIVSAGLMSRGIWFLELEQYVRQCNGLDVSETGSGPGSYDIVKSVWHVNCCNGLTDGWWMVFNAIFGWTNSATYGSVFSYMIYWTMVIIWLKIKLYEERHGILPLVPLKWQLKRIQKRIRLYELRKNHEQEHQGQQQEEGQQEAS

SEQ ID NO: 72051 - DNA, 1275 bp, Candida albicans SC5314
  CDS (1)..(1275): transl_table=12
atggcgggtacttcatttgaagagtacttctcaatccagacattcttaattgtctttagagaaacacttgaatctgctattatcatctcagtattgctttcatttgtgcatcaaacattcaatggcaacaccaaaaaatcaaatcgtgacactcgcaaccaaacttataacagcactgaaagttcaagttcattgatcccaactgaatctgatgaccttacttttgaaaaaaatgatgctaaactttgcagatatttacaattgcaaatatggattggtggattattaggacttttggtttgtctaataattggtgctatcattcttggtatattctatattattggtaatgatttgtggaccgtagctgaacactattgggaaggcacattttcaataattgccagtattatcatctcagtaatggggatcaaaatccttcgtgtgaataaaatgcaagaaaaatggaaattgaagcttggcaaaatattgcaaagttcgggatacttgaataactcaaacaatcaacaatcttttaacaaagctggtcgtacatgggcaactagaattgaattatggtcagaaaaatacaatatgttcatattgccatttgtcactactttaagagaaggtttggaagcaatagctgtcatcggaggtatcggtatcaatgaaaatacttcagtgatggctcttgtaaatgctgctgtgttggccattatgctggggattttggtaggagctatattgtatcgttatggtaatactttgtcgttgaagatgttcttaatcacatcaacgtgtttcttatatttagttgcagctggtttgttctccaaaggagtttggaatttcgaattacagagatttattgataaatgtgggggattagatgtgagtgagactggtcacggtccagggtcatatgatattgcaatatctgtttggcatgtcaattgctgcaatggagaaatgcaagaagacggagttttctggatggttttcactgctatcttaggatggacaaattctgctactattggtagtgttgttagttataatgtttattggattgttatcatattggtattctggtctttgatttatgaagaaaagaacggatttttacctttgatccctatttcctggcaattgaaaagaattcaaaagagaaagaacttgtaccaacctttagatgctcctgagattggtgtacacgaggaagttagagaaagtatggactcgttgaattcagaaacccctttacaaagatga

SEQ ID NO: 72052 - protein, 424 aa, Candida albicans SC5314
MAGTSFEEYFSIQTFLIVFRETLESAIIISVLLSFVHQTFNGNTKKSNRDTRNQTYNSTESSSSLIPTESDDLTFEKNDAKLCRYLQLQIWIGGLLGLLVCLIIGAIILGIFYIIGNDLWTVAEHYWEGTFSIIASIIISVMGIKILRVNKMQEKWKLKLGKILQSSGYLNNSNNQQSFNKAGRTWATRIELWSEKYNMFILPFVTTLREGLEAIAVIGGIGINENTSVMALVNAAVLAIMSGILVGAILYRYGNTLSLKMFLITSTCFLYLVAAGLFSKGVWNFELQRFIDKCGGLDVSETGHGPGSYDIAISVWHVNCCNGEMQEDGVFWMVFTAILGWTNSATIGSVVSYNVYWIVIILVFWSLIYEEKNGFLPLIPISWQLKRIQKRKNLYQPLDAPEIGVHEEVRESMDSLNSETPLQR

SEQ ID NO: 72053 - DNA, 1275 bp, Candida albicans SC5314
  CDS (1)..(1275): transl_table=12
atggcgggtacttcatttgaagagtacttctcaatccagacattcttaattgtctttagagaaacacttgaatctgctattatcatctcagtattgctttcatttgtgcatcaaacattcaatggcaacaccaaaaaatcaaaccgtgacactcgcaaccaaacttataacagcactgaaagttcaagttcattgatcccaactgaatctgatgaccttacttttgaaaaaaatgatgctaaactttgcagatatttacaattgcaaatatggattggtggattattaggacttttggtttgtctaataattggtgctatcattcttggtatattctatattattggtaatgatttgtggaccgtagctgaacattattgggaaggcacattttcaataattgccagtattatcatctcagtaatggggatcaaaatccttcgtgtgaataaaatgcaagaacaatggaaattgaagcttggcaaaatattgcaaagttcgggatacttgaataactcaaacaatcaacaatcttttaacaaagctggtcgtacatgggcaactagaattgaattatggtcagaaaaatacaatatgttcatattgccatttgtcactactttaagagaaggtttggaagcaatagctgtcatcggaggtatcggtatcaatgaaaatacttcagtgatggctcttgtaaatgctgctgtgttggccattatgctggggattttggtaggagctatattgtatcgttatggtaatactttgtcgttgaagatgtttttaatcacatcaacgtgtttcttatatttagttgcagctggtttgttctccaaaggagtttggaatttcgaattacagagatttattgataaatgtggtggattagatgtgagtgagactggtcacggtccagggtcatatgatatcgcaatatctgtttggcatgtcaattgctgcaatggagaaatgcaagaagacggagttttctggatggttttcactgctatcttaggatggacaaattctgctactattggtagtgttgttagttataatgtttattggattgttatcatattggtattctggtctttgatttatgaagaaaagaacggatttttacctttgattcctatttcctggcaattgaaaagaattcaaaagagaaagaacttgtaccaacctttagatgctcctgagattggtgtacacgaggaagttagagaaagtatggactcgttgaattcagaaacccctttacaaagatga

SEQ ID NO: 72054 - protein, 424 aa, Candida albicans SC5314
MAGTSFEEYFSIQTFLIVFRETLESAIIISVLLSFVHQTFNGNTKKSNRDTRNQTYNSTESSSSLIPTESDDLTFEKNDAKLCRYLQLQIWIGGLLGLLVCLIIGAIILGIFYIIGNDLWTVAEHYWEGTFSIIASIIISVMGIKILRVNKMQEQWKLKLGKILQSSGYLNNSNNQQSFNKAGRTWATRIELWSEKYNMFILPFVTTLREGLEAIAVIGGIGINENTSVMALVNAAVLAIMSGILVGAILYRYGNTLSLKMFLITSTCFLYLVAAGLFSKGVWNFELQRFIDKCGGLDVSETGHGPGSYDIAISVWHVNCCNGEMQEDGVFWMVFTAILGWTNSATIGSVVSYNVYWIVIILVFWSLIYEEKNGFLPLIPISWQLKRIQKRKNLYQPLDAPEIGVHEEVRESMDSLNSETPLQR

SEQ ID NO: 72055 - DNA, 1440 bp, Ustilago maydis 521
  CDS (1)..(1440)
atgtcggcaacgggcaacaaagtgtttgcgccagccatcttcttcatcgccgccagggaggcgctcgaggcctccctcgtgattggcattctctctgtgcacacaaagtcggccgaagacctcgccgctcacgactcgcttaccgagtctgagaagcacgaggtcgaacaaaagaagcgtgcgctcgttcgtaagcttcgaaagattgtgctattgggagctttgaccggtctgttgatcgcatttgctatcggagctgcgttcctggccgttttctacactcaagtcaacgacctctacggtaaagcagaagagctttgggaaggaatcttcaacctggtcgctgtgttgcttattacacccatgtcacttgccattctgcgcgctggtaacagcaagcgcaaatggaagcgcaagctcgaaaacgctttcagccatcaaaacatccagcccaaccaccgcagagatgaagagggcgaggcaaccgttgtcaatgctaaccactcggatgattccgcttctgcttcatcctcgtctgctcgtcaggcagccgaggaagaggctggtacaaagacgacgcgaaccgagaagctgaaccctctggaagctgtcgacgttgttcccagcatgtctggcgaccagcgtcgaaagcgcggcggcttgcgtggtcttttttccaagccatccggagcagtcaacgatctcaagcttcgaatgaatcgcggaacattggccttgttcacgatccccctcatcaccacacttcgagaaggcctcgaaggtgtcgtcttcatcggtggtgtctctctcggtctgcccgcaacctcgatcccgcttcctgccatcgttggcctcgccgtcggtttgggaatcggattcctcatcttccgttcgggcaacttggtctcggttcgaatcttcctcgtcttctccacttgcttcctcctcctcatcgcctctggtatggcttctcgatccgtttactacctccaattctacgcttacgtccaacttgtaggggattcagctgccgaatccggcgacggtccaggatcctacaactcgcaaggttacatttggcactttaactgctgcaacccagaggccaacaagggtggaacaggatggggtatcttgaactcgcttgtgggttggaacaacaccgccacctacggatcagtcttcatgtacatcgggtactggtttgccgtcgctggctatctgtggtaccagatctggagcgagggcagactggcactgaggttcggcggaaagacctactgggagtccaaccgttcaatccaggccaggcagaggaaacaggagaaggctcaccagcgccaactgagagaagccgaccaggaggagcatggccactcgtcgaacagcgacaagcaacagcacccctccgaggctggcccaagtaccctctctcactga

SEQ ID NO: 72056 - protein, 479 aa, Ustilago maydis 521
MSATGNKVFAPAIFFIAAREALEASLVIGILSVHTKSAEDLAAHDSLTESEKHEVEQKKRALVRKLRKIVLLGALTGLLIAFAIGAAFLAVFYTQVNDLYGKAEELWEGIFNLVAVLLITPMSLAILRAGNSKRKWKRKLENAFSHQNIQPNHRRDEEGEATVVNANHSDDSASASSSSARQAAEEEAGTKTTRTEKLNPLEAVDVVPSMSGDQRRKRGGLRGLFSKPSGAVNDLKLRMNRGTLALFTIPLITTLREGLEGVVFIGGVSLGLPATSIPLPAIVGLAVGLGIGFLIFRSGNLVSVRIFLVFSTCFLLLIASGMASRSVYYLQFYAYVQLVGDSAAESGDGPGSYNSQGYIWHFNCCNPEANKGGTGWGILNSLVGWNNTATYGSVFMYIGYWFAVAGYLWYQIWSEGRLALRFGGKTYWESNRSIQARQRKQEKAHQRQLREADQEEHGHSSNSDKQQHPSEAGPSTLSH

SEQ ID NO: 72057 - DNA, 1182 bp, Phanerochaete chrysosporium
  CDS (1)..(1182)
atgggcaagaacgtcttctccgtccccattttcttcatcgtcttccgtgagaccctcgaggccgccatcatcgtctccgtcctctgctccctcgtcgagcagatcgcgaccgacgacaagccgctctcgcaggccaccaccgtcgccggcgccctccaggacaagcccgagtcccccgccgccgacgcgctcgccgaccagccggagctcgagagccccgaggatgccctcgtccgccagcgccgcttcatccgccgcatgcggtggcagatcttcctcggctcgttcctcggtctcctcatcgccctcgccgtcggcgccgccttcatcgccgtctggttcaccaaggccagcgatctctggtccaagtccgaggagctctgggagggtatcttcgagctcatcgcgtgtatcatgattttcgtcatgggagtcaccatgctcaagatggaccgtgccaaggctaaatggcgcgtcaagcttcagcgtgcgttcgagggcaaacacgtcgacaaaggtgccaagagtggcaagtgggtgctgttcatcctcccgctcattaccgtccttcgtgaaggtatggaggccgtcatcttcgttggtggtgtctcgctcggccagcccgcgacgtcgatccccatcgccgccatcgtcggtctcgtctgcggactcgtctgcggcttcctgatctacacctttgcgagccgcacgacgctcaccgtcttcctgattgcgatgacgaacttcatcctgctcatcggcgcgggtctgttcagccgcgcgatcggctcgttccaggagcagcgcttcaacacgctgctcggcgcggacgtcgacgacgcgggcgcggcgggcgacggcccgggctcgtacgacgtgcgcggcaacgtctggcacctcgactgctgcaaccccgacaacaactttgactcgcagggttggtcgatcttcaacgccatcttcggctggacgaacagcgcgacgatcggcaccatcctcggctacgtcttttactggcttgcggccatggtcgtgctggtctacatgaagtacaaggagggccgcacgaagctcttcggcatggagtctgccgcgggcgtgcgccgccgcgagcgcgccgccctccaccgcggcgactctgagatgagcgcggctgcgtcggagacggatgagaagcactaa

SEQ ID NO: 72058 - protein, 393 aa, Phanerochaete chrysosporium
MGKNVFSVPIFFIVFRETLEAAIIVSVLCSLVEQIATDDKPLSQATTVAGALQDKPESPAADALADQPELESPEDALVRQRRFIRRMRWQIFLGSFLGLLIALAVGAAFIAVWFTKASDLWSKSEELWEGIFELIACIMIFVMGVTMLKMDRAKAKWRVKLQRAFEGKHVDKGAKSGKWVLFILPLITVLREGMEAVIFVGGVSLGQPATSIPIAAIVGLVCGLVCGFLIYTFASRTTLTVFLIAMTNFILLIGAGLFSRAIGSFQEQRFNTLLGADVDDAGAAGDGPGSYDVRGNVWHLDCCNPDNNFDSQGWSIFNAIFGWTNSATIGTILGYVFYWLAAMVVLVYMKYKEGRTKLFGMESAAGVRRRERAALHRGDSEMSAAASETDEKH

SEQ ID NO: 72059 - DNA, 1113 bp, Aspergillus oryzae
  CDS (1)..(1113)
atggcaaatcaagtctttgcagtcactgtctttttcatttgcttccgagaatgtctcgaaagcagtatcattgtatcggtgcttcttgccttcctcacccaaactttgggtgctgaaggagacaaggcagctctgaagagattgcgaatacaggtatggtgtggagtaggtttaggtctattcttgtgcctatgtatcggtgcaggtatgatcggagctttctacgggttggaaaaagataccttcacgaacacagaggatatctgggaaggcatttttggctttatagcatccatcattatttctatcatgggggcgggccttttgcgtgtgaacaaaatgcgcgagaaatggcgcgtcaagctctcccgtgccttggagaaaaaggaaaagtctacgaccataatgggtcgtctgaaggactggtccgagaaatatgtcatgttcatcttgccattcgttaccgttcttcgagagggacttgaggctatcgtttatgtcggtggtgtgggactgggattgtcagcgtcttcattccccttggccgtgttctgtggccttttggctggtgttgcagtaggctatgtgatgtatcggggtggaagctcaacttccttacagtactttctgattatatctacttgcttcctctacttggtcgccgcaggcttgttttcccgcgctgtctggtacctggagaataatacctggaaccatgtcattggtggagatgcttctgagaccggctcaggccctggatcttacgatattcgccagagtgtctggcatgtaaactgctgtaacccagagcttggcggtggtggtggttggggtatcttcaacgctctgtttgggtggaccaattccgccacctatggatcagtgctatcttacaacctttactgggtagtgatcattacctcatacgtctgcatgaggtacaatgagaagcacggctacattcccgtcttaacaccgatcgcaaggaagctgaagcttggtcgattcaagaagggctctgaggaagaacatgtccccgaggttgtcgaagagaggaaggaggttaaccatctggcccggcaaattgttaccagaacaatgagtgaagcatag

SEQ ID NO: 72060 - protein, 370 aa, Aspergillus oryzae
MANQVFAVTVFFICFRECLESSIIVSVLLAFLTQTLGAEGDKAALKRLRIQVWCGVGLGLFLCLCIGAGMIGAFYGLEKDTFTNTEDIWEGIFGFIASIIISIMGAGLLRVNKMREKWRVKLSRALEKKEKSTTIMGRLKDWSEKYVMFILPFVTVLREGLEAIVYVGGVGLGLSASSFPLAVFCGLLAGVAVGYVMYRGGSSTSLQYFLIISTCFLYLVAAGLFSRAVWYLENNTWNHVIGGDASETGSGPGSYDIRQSVWHVNCCNPELGGGGGWGIFNALFGWTNSATYGSVLSYNLYWVVIITSYVCMRYNEKHGYIPVLTPIARKLKLGRFKKGSEEEHVPEVVEERKEVNHLARQIVTRTMSEA

SEQ ID NO: 72061 - DNA, 1098 bp, Pichia pastoris
  CDS (1)..(1098)
atggtgaatgtttttaatgtcgaaatcttctttgttgtttttagagaaaccttagaggcagtaattgtcgtgtctgtgcttcttgcatttattaagcaaggtctctccgaagatgagacagtttataaacgacttcgaaaacagatttggattggtgctatttcaggtttcctgatttgtttaatcttgggttgtgccttcattggagctttctattctttaggaaaggatgtttgggctaaatcagaggatctttgggaaggcatattttgcgtaattgcaactgtaatgatttcacttatgggtattccaatgctgagaattaacaaaatgcagactaaatggaggttgaagcttgctcgtgctctggtggtttccaaaaacgaaaagaaaggtcgttttgcttttggtcattggacaaagaaatacgctatgttccttttgccttttgtaacaacattaagagaggggttagaagctgttgtgttcataggtggtgttggcctgggatctccagctacatcttttcccatccctgtgattgttggtcttattgctggtatttctgtcggtgtgcttttgtactattcaggatcaactctttctttgcaagttttcttatgtatatcgacggctattttgtacttgattgctgctgggttgttttctagggctatctggttctttgaaacctacaaatacaaccaaaagactggaggagatgcttctgaaaatggttcgggacccggtacttatgacattaagacttctgtttggcatgtgaactgctgtaaccctgaaactgataatggttgggatatttttaacgcgttgttgggatggcaaaactctgccacttatggctcagtcataggctacaacatatactggctggcggtaatgatcactttgtatttactctggttcgaagaaaagaataaccacttgccatttatgaaaaatctgaagttgagacaactgaacccattatactggatgaagggtaaaaacaagaaggaggtctccaaggaagatcaggaaaaattatttgagcaattgaagagtaaggagtttgccaataaacttgcggaggaataa

SEQ ID NO: 72062 - protein, 365 aa, Pichia pastoris
MVNVFNVEIFFVVFRETLEAVIVVSVLLAFIKQGLSEDETVYKRLRKQIWIGAISGFLICLILGCAFIGAFYSLGKDVWAKSEDLWEGIFCVIATVMISLMGIPMLRINKMQTKWRLKLARALVVSKNEKKGRFAFGHWTKKYAMFLLPFVTTLREGLEAVVFIGGVGLGSPATSFPIPVIVGLIAGISVGVLLYYSGSTLSLQVFLCISTAILYLIAAGLFSRAIWFFETYKYNQKTGGDASENGSGPGTYDIKTSVWHVNCCNPETDNGWDIFNALLGWQNSATYGSVIGYNIYWLAVMITLYLLWFEEKNNHLPFMKNLKLRQLNPLYWMKGKNKKEVSKEDQEKLFEQLKSKEFANKLAEE

SEQ ID NO: 72063 - DNA, 1113 bp, Aspergillus fumigatus
  CDS (1)..(1113)
atggcaaaagacgtatttgctgttccaatcttttttatctgtttccgagaatgtgtcgagaccagcatcattgtctctgtgttactctcatttatcaagcagaccttgggacaagagcaagatgctaccactcgtaagaggctgatcagacaggtgtggtggggggttgccattgggttgttcatcagtgtttgcatcggagctggcatgatcggagcgttctatggatatggtaaggatcacttcgctagcacggaggacctgtgggagggcatcttctccctgatcgccagtgtcatcatcaccattatgggtgctgccctgcttcgtgtcaccaagttgcaggagaagtggcgcgtcaagctagctcaagccctggaagcaaagccgttgactggcggcacattcaaaaacaacctcaaactttgggcggagaaatacgccatgtttctcctccccttcatcaccgttctccgagaaggcctggaagcagtggtgttcattggaggcgtcagtctcagttttcctgcaactgccttccctctacctgtttttactggcattctcgcaggagtggccattgggtacctactgtatcgaggaggaaaccaagcctccctccagatcttcctgatcatctccacttgcatcctctacctggttgctgccggcctcttctcccgaggcgtctggtatctggagaacaatacttggaaccacgtaattggtggtgatgctgccgagacaggtgccggtccgggatcgtatgacatccgacagagcgtctggcatgtcaactgctgtagtcctctcgttaatggtggcgggggatggggtatcttcaacgccatccttggctggacaaactcggcaacctatggctccgttctttcatacaacctttactggattgcggtgatcgtctggtttgtggctatgcgtcacaaggaacgccatggacgattgcctgtggtcgaccctctgctgaatcggctgcgaggccgaaagtctgccgaacctgggaatggagagcaagatgtcgaggtcagcacgataccatctgatttgcagacggagtccaaaataccgaaaagcggagcatcccttgtctga

SEQ ID NO: 72064 - protein, 370 aa, Aspergillus fumigatus
MAKDVFAVPIFFICFRECVETSIIVSVLLSFIKQTLGQEQDATTRKRLIRQVWWGVAIGLFISVCIGAGMIGAFYGYGKDHFASTEDLWEGIFSLIASVIITIMGAALLRVTKLQEKWRVKLAQALEAKPLTGGTFKNNLKLWAEKYAMFLLPFITVLREGLEAVVFIGGVSLSFPATAFPLPVFTGILAGVAIGYLLYRGGNQASLQIFLIISTCILYLVAAGLFSRGVWYLENNTWNHVIGGDAAETGAGPGSYDIRQSVWHVNCCSPLVNGGGGWGIFNAILGWTNSATYGSVLSYNLYWIAVIVWFVAMRHKERHGRLPVVDPLLNRLRGRKSAEPGNGEQDVEVSTIPSDLQTESKIPKSGASLV

SEQ ID NO: 72065 - DNA, 1107 bp, Rhizopus oryzae
  CDS (1)..(1107)
atgtctcaagatctcttcaacgtaccgatcttctttatcctttttcgtgaaacgactgaggcagccatcattatttctgtcctcttgtcattcttgaagagaatgtttaatacagaatctcctgtttataaacgtctcagaaatcaagtctggattggtggtgcagctggtctgtttatctgtttatgtatcggtgctgccttcattgccgtttactacactgtccttaatgacttgtggggaaattctgaagatatctgggaaggtgtcttctctctggttgctgtgatcatgatcactgccatgggtcttgctatgctcaagactgaacgtatgcaagaaaagtggaaggtcaagttggctaaagcaatgcaaaagtccaacagtgaaaagtcatcctttaaagaaaaacttcaaaaatacgcgttctttgtcttgccttttatcaccgttctcagagaaggacttgaagctgttgtctttattggtggtgtctccttgggtatccaaggaaaatcaattcctattgctgccatcatgggtatcatctgtggttgtttggtcggtttccttatttaccgtggtggttccttgattcaacttcgttggttctttgtgttctctactgtcgttctttaccttgtcgctgctggtttgatggctaaaggtgttggttaccttgaacaaaatgcttggaatcaagtcattggtggtgaagctgctgatgtcattagttacagagtctcaaccgctgtctggcacgtttcttggggagacccagaagccaacaatgatacctctggtggttggcaaatctttaacgccattcttggttggaacaatacggctacttatggttctatcatcagttactgtctctactggctctttgtctgctgttatcttgtctttagttactttaaggaaaagcgtgctgctatccgtaaagccgaggctggtgaatgggatgatggtgatgaagctttggagaatgccaaacaatacattggtaatgatggtgaattcatcgttgaagacaaagaatctgatgaagaagccaacaatcatcccaaggaaaaaatcgaatctgatgctattaaggcttaa

SEQ ID NO: 72066 - protein, 368 aa, Rhizopus oryzae
MSQDLFNVPIFFILFRETTEAAIIISVLLSFLKRMFNTESPVYKRLRNQVWIGGAAGLFICLCIGAAFIAVYYTVLNDLWGNSEDIWEGVFSLVAVIMITAMGLAMLKTERMQEKWKVKLAKAMQKSNSEKSSFKEKLQKYAFFVLPFITVLREGLEAVVFIGGVSLGIQGKSIPIAAIMGIICGCLVGFLIYRGGSLIQLRWFFVFSTVVLYLVAAGLMAKGVGYLEQNAWNQVIGGEAADVISYRVSTAVWHVSWGDPEANNDTSGGWQIFNAILGWNNTATYGSIISYCLYWLFVCCYLVFSYFKEKRAAIRKAEAGEWDDGDEALENAKQYIGNDGEFIVEDKESDEEANNHPKEKIESDAIKA

SEQ ID NO: 72067 - DNA, 1080 bp, Claviceps purpurea
  CDS (1)..(1080)
atggccaaggacgtgttttccgtgcccgtcttcctcgttgtctttcgagagacgctggagacggtcattattgtgtccgtgctgctggcctttctcaagcagacgctggatggaccaaatcgcgatgtcaagacctacaaggctctgcgtcggcagatctggcttggtgtagccgctggcttcttggtctgcatgattgttgccggcgccttgattggcgtcttctacactgtcggttccaatgcatgggaaaacaacgagaattactacgagggtgcgttttgtctctttgccgccgccatcatcaccgtcatgggggctgctctgttgcgcattggaaaaatgcaggcaaagtggcgtgtcaagcttgccaaggcaattgagtcgcccatcaagacacgggcgcgaggctgcgttgcacactggctggagaaatacgccatgtttgtgttgcccttcatcacggtgctgcgtgagggtatcgaggcggtcgtgtttgtcgccggtgtcaccttttctgcgccggcttatgcagtgccgttgcctgttgttgtcggtctccttgtcggaggcttcatcggctggctcttgtacaaaggtggttcaactgccaagctgcaaatattcctggtggcctcgacctgtatcttgtatctggtctctgctggtctcttttcccgcggtgtatggcatctgcaggcacagaaatggaataatgccatcggcggtgatgccagtgagacgggcagtggcccaggctcttacgacattgaccagagcgtttggcacgtcaactgctgttcaccgaccgccaccaacgacggcggctggggcgtcttcaacgccattctcggctggcaaaactcggccacctacggctccgtcatctcgtacaacctctactggctctttgtcatggccggcttcgccaccatgcgcttcaaggagaccaagggccactaccccttcttcaaggccaaggcgaccgctccatccgtggcggattcgcaaagtagcagctcacagcatgagattggggacaaggcgcctgcagtcaaggtagctgtaccaaggacatga

SEQ ID NO: 72068 - protein, 359 aa, Claviceps purpurea
MAKDVFSVPVFLVVFRETLETVIIVSVLLAFLKQTLDGPNRDVKTYKALRRQIWLGVAAGFLVCMIVAGALIGVFYTVGSNAWENNENYYEGAFCLFAAAIITVMGAALLRIGKMQAKWRVKLAKAIESPIKTRARGCVAHWLEKYAMFVLPFITVLREGIEAVVFVAGVTFSAPAYAVPLPVVVGLLVGGFIGWLLYKGGSTAKLQIFLVASTCILYLVSAGLFSRGVWHLQAQKWNNAIGGDASETGSGPGSYDIDQSVWHVNCCSPTATNDGGWGVFNAILGWQNSATYGSVISYNLYWLFVMAGFATMRFKETKGHYPFFKAKATAPSVADSQSSSSQHEIGDKAPAVKVAVPRT

SEQ ID NO: 72069 - DNA, 1080 bp, Claviceps purpurea; identical to SEQ ID NO: 72067
  CDS (1)..(1080)

SEQ ID NO: 72070 - protein, 359 aa, Claviceps purpurea; identical to SEQ ID NO: 72068

SEQ ID NO: 72071 - DNA, 1149 bp, Candida albicans
  CDS (1)..(1149): transl_table=12
atggttgatgttttcaatgttcaagtcttttttgttgttttcagagaagccttggaagcagttattgttgtttcagtgcttttagcatttgtcaaacaatcaatgggctcctcagcaaacggtccagagttgaagaaaaagttgtatcgtcagatttggctaggggcggggctaggtgttcttatttgtataatcattggtggcgcttttattggtaccttttacgggttgggtaaagatatctggggaaaatcagaagacttgtgggaagggatattttgtatcattgccacagtcttgatcactgctatgggtattccaatgttgagaatcaacaagatgaaagaaaaatggagagttaaattagcacaagctttaatcaaatctccagaaaataagaagaaccgattcaaattgggatatcttgggaaaaagtacgcactttttattttgccattcatcacttgcttgcgtgaaggtttagaagctgttgttttcgttggtggggtcggtattactagtcctgcttcatctttcccaatcccagttattgttggtataatttgtggtcttgcagtgggtgccttgttgtactactttggttccaatatgtcgatgcaaatcttcttgatcatctccacttgtatcttgtacttgatcgctgctggtttgttctccagaggtgtctggttctttgagagttatcaatacaataaaaaaactggtggtgatgcggctgagaatggttctggcccgggtacatatgacatttccaaatctgtttggcatgtcaactgctgtaacccattgaccgacaatggttgggatatcttcaacgccattttgggatggcaaaactctgccacttacggttctgtcatttcctacaatgtttactggattttcatcatttctgttttgttattgatggtctatgaagaaaaacacggacatttaccgttaaccaaaaacttaactttggtccaattgaatccaatgtaccacatcaaaggtaagaagaagttagaattaaacaaagctgaaaaggaagaattgttcaccaaacttcaaaaacaaaagtttggtgatgttcaagaaattgacgaaacttcttctaacaaattagtcgaaactcaagaaaataaataa

SEQ ID NO: 72072 - protein, 382 aa, Candida albicans
MVDVFNVQVFFVVFREALEAVIVVSVLLAFVKQSMGSSANGPELKKKLYRQIWLGAGLGVLICIIIGGAFIGTFYGLGKDIWGKSEDLWEGIFCIIATVLITAMGIPMLRINKMKEKWRVKLAQALIKSPENKKNRFKLGYLGKKYALFILPFITCLREGLEAVVFVGGVGITSPASSFPIPVIVGIICGLAVGALLYYFGSNMSMQIFLIISTCILYLIAAGLFSRGVWFFESYQYNKKTGGDAAENGSGPGTYDISKSVWHVNCCNPLTDNGWDIFNAILGWQNSATYGSVISYNVYWIFIISVLLLMVYEEKHGHLPLTKNLTLVQLNPMYHIKGKKKLELNKAEKEELFTKLQKQKFGDVQEIDETSSNKLVETQENK

SEQ ID NO: 72073 - DNA, 1146 bp, Candida albicans
  CDS (1)..(1146): transl_table=12
atggttgacgtatttaacgttcaaattttcttcatcgttttcagagaatctttggaagctatcattgttgtttcagtgcttttggcattcgttaagcaatctatgggtggtagttccgaccctcaattgaaaaaacgattgtatcgtcagatttggctaggggcggggctaggggttctagtctgtctatatggtgtgctttccatcggtgcgtcctacggtttaggtaaagatatttttggggtaatctccgaagatctatgggaaggtatcttttgtatcattgccacggtcttgatcactgctatgggtattccaatgttgagaatcaacaagatgaaagaaaaatggagagtcaaattagctcaagctttaattaaatctccaactaacaaaaaagatagatttaaattgggttaccttggtaagaaatatgctcttttcattttaccattccttcaagttttgcgtgaaggtttagaagctgttgtcttcgttggtggtgttggtttgaatagtccagccacctctttcccaattccagtcattgttggtttaattgccggtatcgttgttggtgcattattgtactactttggttccagtatgtccatgcaaatcttcttgattatttccacctgtatcttgtacttgattgctgctggtttgttctccagaggtatttggtatttcgaaaccaacacttacaataaaaaaactggtggtgatgcttctgaaaacggttctggtccaggtacttacgacatttctaaatctgtctggcacgtcaactgtcgtaatccagaaaccgataacggttgggatatcttcaatgccattttgggatggcaaaactctgccacttacggttctgtcatttcctacaacatttactggctctttattatctgtgttttgttgttaatggtttacgaagaaaaacacggccacttgccattcaccaagaatttgactttggtccaattgaacccaatgtaccacatcaagggtaagaagaagttagaattaaacaaagctgaaaaggatgaattgttcactaaacttcaacaacaaaactttggtcaagctgcagaagttgatgaaacttcatcaaacaaatggatggattcccaagaaaacagttag

SEQ ID NO: 72074 - protein, 381 aa, Candida albicans
MVDVFNVQIFFIVFRESLEAIIVVSVLLAFVKQSMGGSSDPQLKKRLYRQIWLGAGLGVLVCLYGVLSIGASYGLGKDIFGVISEDLWEGIFCIIATVLITAMGIPMLRINKMKEKWRVKLAQALIKSPTNKKDRFKLGYLGKKYALFILPFLQVLREGLEAVVFVGGVGLNSPATSFPIPVIVGLIAGIVVGALLYYFGSSMSMQIFLIISTCILYLIAAGLFSRGIWYFETNTYNKKTGGDASENGSGPGTYDISKSVWHVNCRNPETDNGWDIFNAILGWQNSATYGSVISYNIYWLFIICVLLLMVYEEKHGHLPFTKNLTLVQLNPMYHIKGKKKLELNKAEKDELFTKLQQQNFGQAAEVDETSSNKWMDSQENS

SEQ ID NO: 72075 - DNA, 1194 bp, Schizosaccharomyces pombe
  CDS (1)..(1194)
atggcaaaagacgtcttttccgtcgctatcttcttcatcgtccttcgtgagacccttgaggcttccatcatcgtctcagtcttgatgtccttcatctcccaaacactcatggataaagatggaaacgtgacggatccaaaactaaagcgaaaatttatgctgcaggtttggatcggttcgtttactgctttgttcatttgtttagccattggcggtggctttatcggtgctttttatgccctcgacaaagatatttggagtggttccgaagaaatttgggaaggtgtcttctctctcatcgctgtcgtcttgatcaccgtaatggggttcgctatgcttcgtgtctcgcatttacaggagaaatggcgcaagaaacttatgaaaagtatcgccaatcgcaaggccaaaggtatctccaattggggtaaaaagtattccatgtttctccttccctttttcaccgttctgcgtgagggtttggaagtcgtcgtctttgtcggtggtgtcggtttggaaacacctgccaccgctttccctcttccagtcatttgcggtctcatcgttggttgtcttatcggttactttatctatcgtggtggtaatgtgatgaacttgcaatggttcttgattgcctcaacatgtatcctctaccttatctccgccggtcttatgtccaaggccaccttttactttgaaatgaataagtggaatcatcaaactggtggtgatgctggtgagctcggtgatggtcccggttcctatcccttcaaatccgccgtttggcacgtcaactatggtaatccagagatgaattccaatggtggttacatgatcttcaatgccattctaggttggaacaacactggtacctatggttccatccttagctacatcatctattggcttttcgtagccttcatcatgttcctcatgtggtacaaggaacgtcgtgctgcaagactccttattgccaagctcggcgacaaagttgtcgacttggaggctgcctcttcacacactcccgtgcaatcctcctcctctgaagatgaattcaaaatcaattctcctaccgatgataaaggcgacaaagccatcgatatcgttaccgaagttcgcgagtcttcttctcccgtcgaagaacataaagacgacaaaactgtcgatgtcatcaatgaaattcgtgagtctcattaa

SEQ ID NO: 72076 - protein, 397 aa, Schizosaccharomyces pombe
MAKDVFSVAIFFIVLRETLEASIIVSVLMSFISQTLMDKDGNVTDPKLKRKFMLQVWIGSFTALFICLAIGGGFIGAFYALDKDIWSGSEEIWEGVFSLIAVVLITVMGFAMLRVSHLQEKWRKKLMKSIANRKAKGISNWGKKYSMFLLPFFTVLREGLEVVVFVGGVGLETPATAFPLPVICGLIVGCLIGYFIYRGGNVMNLQWFLIASTCILYLISAGLMSKATFYFEMNKWNHQTGGDAGELGDGPGSYPFKSAVWHVNYGNPEMNSNGGYMIFNAILGWNNTGTYGSILSYIIYWLFVAFIMFLMWYKERRAARLLIAKLGDKVVDLEAASSHTPVQSSSSEDEFKINSPTDDKGDKAIDIVTEVRESSSPVEEHKDDKTVDVINEIRESH

SEQ ID NO: 72077 - DNA, 1194 bp, Schizosaccharomyces pombe; identical to SEQ ID NO: 72075
  CDS (1)..(1194)

SEQ ID NO: 72078 - protein, 397 aa, Schizosaccharomyces pombe; identical to SEQ ID NO: 72076

SEQ ID NO: 72079 - DNA, 25 bp, Artificial sequence
  primer
atgcctaacaaagtgtttaacgtgg

SEQ ID NO: 72080 - DNA, 24 bp, Artificial sequence
  primer
tcaaagagagtcggctttaacgtg

SEQ ID NO: 72081 - protein, 505 aa, Artificial sequence
  consensus sequence
  Variant (2)..(5): Xaa in position 2 to 5 is any amino acid
  Variant (8)..(10): Xaa in position 8 to 10 is any amino acid
  Variant (13)..(13): Xaa in position 13 is any amino acid
  Variant (16)..(17): Xaa in position 16 to 17 is any amino acid
  Variant (19)..(20): Xaa in position 19 to 20 is any amino acid
  Variant (25)..(25): Xaa in position 25 is any amino acid
  Variant (27)..(28): Xaa in position 27 to 28 is any amino acid
  Variant (30)..(40): Xaa in position 30 to 40 is any amino acid
  Variant (41)..(85): Xaa in position 41 to 85 is any or no amino acid
  Variant (87)..(88): Xaa in position 87 to 88 is any amino acid
  Variant (90)..(90): Xaa in position 90 is any amino acid
  Variant (91)..(108): Xaa in position 91 to 108 is any or no amino acid
  Variant (110)..(110): Xaa in position 110 is any amino acid
  Variant (112)..(114): Xaa in position 112 to 114 is any amino acid
  Variant (116)..(118): Xaa in position 116 to 118 is any amino acid
  Variant (120)..(121): Xaa in position 120 to 121 is any amino acid
  Variant (122)..(122): Xaa in position 122 is any or no amino acid
  Variant (124)..(126): Xaa in position 124 to 126 is any amino acid
  Variant (128)..(130): Xaa in position 128 to 130 is any amino acid
  Variant (132)..(135): Xaa in position 132 to 135 is any amino acid
  Variant (137)..(141): Xaa in position 137 to 141 is any amino acid
  Variant (142)..(142): Xaa in position 142 is any or no amino acid
  Variant (144)..(145): Xaa in position 144 to 145 is any amino acid
  Variant (149)..(149): Xaa in position 149 is any amino acid
  Variant (151)..(153): Xaa in position 151 to 153 is any amino acid
  Variant (155)..(157): Xaa in position 155 to 157 is any amino acid
  Variant (159)..(160): Xaa in position 159 to 160 is any amino acid
  Variant (163)..(165): Xaa in position 163 to 165 is any amino acid
  Variant (168)..(169): Xaa in position 168 to 169 is any amino acid
  Variant (171)..(173): Xaa in position 171 to 173 is any amino acid
  Variant (174)..(174): Xaa in position 174 is any or no amino acid
  Variant (178)..(178): Xaa in position 178 is any amino acid
  Variant (181)..(197): Xaa in position 181 to 197 is any amino acid
  Variant (198)..(311): Xaa in position 198 to 311 is any or no amino acid
  Variant (313)..(314): Xaa in position 313 to 314 is any amino acid
  Variant (316)..(316): Xaa in position 316 is any amino acid
  Variant (320)..(320): Xaa in position 320 is any amino acid
  Variant (322)..(322): Xaa in position 322 is any amino acid
  Variant (327)..(327): Xaa in position 327 is any amino acid
  Variant (333)..(334): Xaa in position 333 to 334 is any amino acid
  Variant (336)..(345): Xaa in position 336 to 345 is any amino acid
  Variant (346)..(348): Xaa in position 346 to 348 is any or no amino acid
  Variant (350)..(354): Xaa in position 350 to 354 is any amino acid
  Variant (356)..(358): Xaa in position 356 to 358 is any amino acid
  Variant (360)..(362): Xaa in position 360 to 362 is any amino acid
  Variant (364)..(366): Xaa in position 364 to 366 is any amino acid
  Variant (368)..(375): Xaa in position 368 to 375 is any amino acid
  Variant (376)..(379): Xaa in position 376 to 379 is any or no amino acid
  Variant (381)..(381): Xaa in position 381 is any amino acid
  Variant (384)..(385): Xaa in position 384 to 385 is any amino acid
  Variant (389)..(389): Xaa in position 389 is any amino acid
  Variant (393)..(394): Xaa in position 393 to 394 is any amino acid
  Variant (398)..(398): Xaa in position 398 is any amino acid
  Variant (400)..(402): Xaa in position 400 to 402 is any amino acid
  Variant (404)..(405): Xaa in position 404 to 405 is any amino acid
  Variant (407)..(414): Xaa in position 407 to 414 is any amino acid
  Variant (415)..(415): Xaa in position 415 is any or no amino acid
  Variant (417)..(417): Xaa in position 417 is any amino acid
  Variant (418)..(420): Xaa in position 418 to 420 is any or no amino acid
  Variant (422)..(422): Xaa in position 422 is any amino acid
  Variant (423)..(423): Xaa in position 423 is any or no amino acid
  Variant (425)..(425): Xaa in position 425 is any amino acid
  Variant (427)..(427): Xaa in position 427 is any amino acid
  Variant (433)..(433): Xaa in position 433 is any amino acid
  Variant (435)..(437): Xaa in position 435 to 437 is any amino acid
  Variant (443)..(446): Xaa in position 443 to 446 is any amino acid
  Variant (449)..(455): Xaa in position 449 to 455 is any amino acid
  Variant (456)..(459): Xaa in position 456 to 459 is any or no amino acid
  Variant (461)..(462): Xaa in position 461 to 462 is any amino acid
  Variant (466)..(467): Xaa in position 466 to 467 is any amino acid
  Variant (470)..(470): Xaa in position 470 is any amino acid
  Variant (472)..(473): Xaa in position 472 to 473 is any amino acid
  Variant (475)..(475): Xaa in position 475 is any amino acid
  Variant (478)..(480): Xaa in position 478 to 480 is any amino acid
  Variant (482)..(483): Xaa in position 482 to 483 is any amino acid
  Variant (486)..(498): Xaa in position 486 to 498 is any amino acid
  Variant (500)..(501): Xaa in position 500 to 501 is any amino acid
  Variant (503)..(504): Xaa in position 503 to 504 is any amino acid
FXXXXFFXXXREXLEXXIXXSVLLXFXXQXXXXXXXXXXXXXXXXXXXXXXXXXXXXXXXXXXXXXXXXXXXXXXXXXXXXXXXXLXXQXXXXXXXXXXXXXXXXXXXWXGXXXGXXXCXXXGXXXIXXXYXXXXDXXXXXXEXXWEGXFXXXAXXXIXXMGXXXLRXXKXXXXKWRXKLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYXXFXLPFXTXLREGXEAVVFXXGXXXXXXXXXXXXXPXXXXXGXXXGXXXGXXXYXXXXXXXXXXXXQXFLXXSTCXLYLXXAGLXSXXXWXXEXXXXXXXXXGXXXXDXXEXGXGPGSYXIXXXVWHVNXXXXCCXXXXXXXXXXXWXXFNAXXGWXNXXTXGSXXXYXXYWXXXXXXXXXXXXXEXXGXXP

SEQ ID NO: 72082 - protein, 23 aa, Artificial sequence
  protein pattern
  Variant (2)..(2): Xaa in position 2 is Asn or Thr
  Variant (3)..(3): Xaa in position 3 is Ala or Ser
  Variant (4)..(4): Xaa in position 4 is Ile or Leu
  Variant (5)..(5): Xaa in position 5 is Phe or Leu
  Variant (8)..(8): Xaa in position 8 is Asn, Gln or Thr
  Variant (10)..(10): Xaa in position 10 is Ser or Thr
  Variant (11)..(11): Xaa in position 11 is Ala, Gly or Pro
  Variant (12)..(13): Xaa in position 12 to 13 is any amino acid
  Variant (14)..(14): Xaa in position 14 is Ala, Gly or Ser
  Variant (16)..(16): Xaa in position 16 is Ile, Met or Val
  Variant (17)..(17): Xaa in position 17 is Phe, Ile, Leu or Val
  Variant (18)..(18): Xaa in position 18 is any amino acid
  Variant (20)..(20): Xaa in position 20 is any amino acid
  Variant (21)..(21): Xaa in position 21 is Ile, Leu or Val
FXXXXGWXNXXXXXSXXXYXXYW

SEQ ID NO: 72083 - protein, 20 aa, Artificial sequence
  protein pattern
  Variant (2)..(4): Xaa in position 2 to 4 is any amino acid
  Variant (6)..(6): Xaa in position 6 is Ser or Thr
  Variant (8)..(8): Xaa in position 8 is Asp or Asn
  Variant (10)..(11): Xaa in position 10 to 11 is any amino acid
  Variant (12)..(12): Xaa in position 12 is Ala, Ser, Thr or Val
  Variant (13)..(13): Xaa in position 13 is Ile or Val
  Variant (14)..(14): Xaa in position 14 is Trp or Tyr
  Variant (18)..(19): Xaa in position 18 to 19 is any amino acid
  Variant (20)..(20): Xaa in position 20 is Asp, Asn, Ser or Thr
GXXXGXYXIXXXXXHVNXXX

SEQ ID NO: 72084 - protein, 25 aa, Artificial sequence
  protein pattern
  Variant (2)..(3): Xaa in position 2 to 3 is any or no amino acid
  Variant (5)..(5): Xaa in position 5 is any or no amino acid
  Variant (7)..(7): Xaa in position 7 is any amino acid
  Variant (8)..(8): Xaa in position 8 is Phe, Ile or Val
  Variant (10)..(10): Xaa in position 10 is Cys, Ser, Thr or Val
  Variant (11)..(11): Xaa in position 11 is Ile or Leu
  Variant (15)..(15): Xaa in position 15 is Phe, Ile, Leu or Met
  Variant (17)..(17): Xaa in position 17 is Ala, Gly or Val
  Variant (18)..(18): Xaa in position 18 is Ile or Val
  Variant (19)..(19): Xaa in position 19 is Ala, Ile or Val
  Variant (20)..(20): Xaa in position 20 is any amino acid
  Variant (21)..(21): Xaa in position 21 is Ile or Val
  Variant (22)..(22): Xaa in position 22 is Ala or Gly
  Variant (24)..(24): Xaa in position 24 is Ala, Ile or Val
  Variant (25)..(25): Xaa in position 25 is Gly, Ser or Thr
FXXLXPXXTXXREGXEXXXXXXGXX

SEQ ID NO: 72085 - protein, 26 aa, Artificial sequence
  protein pattern
  Variant (3)..(4): Xaa in position 3 to 4 is any amino acid
  Variant (7)..(7): Xaa in position 7 is Ala, Cys, Gly or Ser
  Variant (8)..(8): Xaa in position 8 is Phe, Ile, Leu or Val
  Variant (12)..(12): Xaa in position 12 is any amino acid
  Variant (13)..(13): Xaa in position 13 is any or no amino acid
  Variant (15)..(15): Xaa in position 15 is any or no amino acid
  Variant (18)..(18): Xaa in position 18 is any amino acid
  Variant (20)..(20): Xaa in position 20 is Lys or Arg
  Variant (21)..(21): Xaa in position 21 is Ala, Gly or Ser
  Variant (22)..(22): Xaa in position 22 is any amino acid
  Variant (23)..(23): Xaa in position 23 is Phe or Trp
  Variant (24)..(25): Xaa in position 24 to 25 is any amino acid
  Variant (26)..(26): Xaa in position 26 is Asp, Glu or Gln
FLXXSTXXLYLXXAXGLXSXXXXXXX

SEQ ID NO: 72086 - protein, 31 aa, Artificial sequence
  protein pattern
  Variant (2)..(5): Xaa in position 2 to 5 is any amino acid
  Variant (6)..(6): Xaa in position 6 is any or no amino acid
  Variant (8)..(9): Xaa in position 8 to 9 is any amino acid
  Variant (10)..(10): Xaa in position 10 is any or no amino acid
  Variant (12)..(12): Xaa in position 12 is any or no amino acid
  Variant (15)..(15): Xaa in position 15 is Ala, Cys, Ser or Thr
  Variant (16)..(16): Xaa in position 16 is any amino acid
  Variant (18)..(19): Xaa in position 18 to 19 is any amino acid
  Variant (20)..(22): Xaa in position 20 to 22 is Ile or Val
  Variant (24)..(24): Xaa in position 24 is Ile or Val
  Variant (27)..(27): Xaa in position 27 is Ala, Ser or Thr
  Variant (28)..(28): Xaa in position 28 is Phe, Ile or Leu
  Variant (29)..(29): Xaa in position 29 is Ile, Leu or Val
  Variant (30)..(30): Xaa in position 30 is any amino acid
  Variant (31)..(31): Xaa in position 31 is Gln or Arg
FXXXXXFXXXFXREXXEXXXXXSXLLXXXXX

SEQ ID NO: 72087 - protein, 30 aa, Artificial sequence
  protein pattern
  Variant (2)..(3): Xaa in position 2 to 3 is any amino acid
  Variant (4)..(4): Xaa in position 4 is Trp or Tyr
  Variant (5)..(5): Xaa in position 5 is Glu or Thr
  Variant (6)..(6): Xaa in position 6 is Ala or Gly
  Variant (7)..(7): Xaa in position 7 is any amino acid
  Variant (8)..(8): Xaa in position 8 is Phe or Leu
  Variant (9)..(9): Xaa in position 9 is Cys, Gly or Ser
  Variant (10)..(10): Xaa in position 10 is Phe, Ile, Leu, Met or Val
  Variant (11)..(11): Xaa in position 11 is Phe, Ile, Leu or Val
  Variant (12)..(12): Xaa in position 12 is Ala or Ser
  Variant (13)..(13): Xaa in position 13 is Ala, Ser or Thr
  Variant (14)..(14): Xaa in position 14 is any amino acid
  Variant (15)..(15): Xaa in position 15 is Ile, Leu or Met
  Variant (17)..(17): Xaa in position 17 is any amino acid
  Variant (18)..(18): Xaa in position 18 is any or no amino acid
  Variant (20)..(20): Xaa in position 20 is any or no amino acid
  Variant (22)..(22): Xaa in position 22 is Ala, Gly, Ile, Leu or Val
  Variant (23)..(23): Xaa in position 23 is any amino acid
  Variant (24)..(24): Xaa in position 24 is Phe, Ile, Leu or Met
  Variant (27)..(27): Xaa in position 27 is Ile, Met or Val
  Variant (28)..(28): Xaa in position 28 is Gly, Asn, Ser or Thr
  Variant (30)..(30): Xaa in position 30 is Leu, Met or Val
EXXXXXXXXXXXXXXIXXMXGXXXLRXXKX

SEQ ID NO: 72088 - protein, 20 aa, Artificial sequence
  protein pattern
  Variant (2)..(5): Xaa in position 2 to 5 is any amino acid
  Variant (6)..(6): Xaa in position 6 is any or no amino acid
  Variant (8)..(8): Xaa in position 8 is any amino acid
  Variant (10)..(10): Xaa in position 10 is Ala, Gly, Thr or Val
  Variant (11)..(11): Xaa in position 11 is Ala, Gly, Ile, Leu or Val
  Variant (12)..(12): Xaa in position 12 is any amino acid
  Variant (14)..(14): Xaa in position 14 is Phe, Ile, Leu, Met or Val
  Variant (15)..(16): Xaa in position 15 to 16 is any amino acid
  Variant (17)..(17): Xaa in position 17 is Cys or Ser
  Variant (18)..(19): Xaa in position 18 to 19 is any amino acid
  Variant (20)..(20): Xaa in position 20 is Ala, Gly, Ile, Leu or Val
LXXXXXWXGXXXGXXXXXXX

SEQ ID NO: 72089 - protein, 19 aa, Artificial sequence
  protein pattern
  Variant (2)..(2): Xaa in position 2 is Ile or Leu
  Variant (3)..(3): Xaa in position 3 is Ala, Pro or Ser
  Variant (4)..(4): Xaa in position 4 is Ala, Ile or Val
  Variant (5)..(5): Xaa in position 5 is Phe, Ile or Val
  Variant (6)..(6): Xaa in position 6 is any amino acid
  Variant (7)..(7): Xaa in position 7 is Ala or Gly
  Variant (8)..(8): Xaa in position 8 is Ile or Leu
  Variant (9)..(10): Xaa in position 9 to 10 is any amino acid
  Variant (12)..(14): Xaa in position 12 to 14 is any amino acid
  Variant (16)..(17): Xaa in position 16 to 17 is any amino acid
  Variant (18)..(18): Xaa in position 18 is Ile, Leu or Met
  Variant (19)..(19): Xaa in position 19 is Phe or Tyr
PXXXXXXXXXGXXXGXXXX

SEQ ID NO: 72090 - DNA, 1047 bp, Saccharomyces cerevisiae
  CDS (1)..(1047)
atgactactgaaaaaaccgttgtttttgtttctggtgctactggtttcattgctctacacgtagtggacgatttattaaaaactggttacaaggtcatcggttcgggtaggtcccaagaaaagaatgatggattgctgaaaaaatttaagagcaatcccaacctttcaatggagattgtcgaagacattgctgctccaaacgcttttgacaaagtttttcaaaagcacggcaaagagatcaaggttgtcttgcacatagcttctccggttcacttcaacaccactgatttcgaaaaggatctgctaattcctgctgtgaatggtaccaagtccattctagaagcaatcaaaaattatgccgcagacacagtcgaaaaagtcgttattacttcttctgttgctgcccttgcatctcccggagatatgaaggacactagtttcgttgtcaatgaggaaagttggaacaaagatacttgggaaagttgtcaagctaacgcggtttccgcatactgtggttccaagaaatttgctgaaaaaactgcttgggattttctcgaggaaaaccaatcaagcatcaaatttacgctatcaaccatcaacccaggatttgtttttggccctcagctatttgccgactctcttagaaatggaataaatagctcttcagccattattgccaatttggttagttataaattaggcgacaatttttataattacagtggtccttttattgacgttcgcgatgtttcaaaagctcatttacttgcatttgagaaacccgaatgcgctggccaaagactattcttatgtgaagatatgttttgctctcaagaagcgctggatatcttgaatgaggaatttccacagttaaaaggcaagatagcaactggcgaacctggtagcggctcaacctttttgacaaaaaactgctgcaagtgcgacaaccgcaaaaccaaaaatttattaggattccaatttaataagttcagagattgcattgtcgatactgcctcgcaattactagaagttcaaagtaaaagctaa

SEQ ID NO: 72091 - protein, 348 aa, Saccharomyces cerevisiae
MTTEKTVVFVSGATGFIALHVVDDLLKTGYKVIGSGRSQEKNDGLLKKFKSNPNLSMEIVEDIAAPNAFDKVFQKHGKEIKVVLHIASPVHFNTTDFEKDLLIPAVNGTKSILEAIKNYAADTVEKVVITSSVAALASPGDMKDTSFVVNEESWNKDTWESCQANAVSAYCGSKKFAEKTAWDFLEENQSSIKFTLSTINPGFVFGPQLFADSLRNGINSSSAIIANLVSYKLGDNFYNYSGPFIDVRDVSKAHLLAFEKPECAGQRLFLCEDMFCSQEALDILNEEFPQLKGKIATGEPGSGSTFLTKNCCKCDNRKTKNLLGFQFNKFRDCIVDTASQLLEVQSKS

SEQ ID NO: 72092 - DNA, 1032 bp, Synthetic
  CDS (1)..(1032)
atgggctctgtatttgtatctggcgctaacggttttatcgctcaacacatcgtcgatctgctgctgaaagaagattacaaagttatcggttccgcacgttcccaggaaaaagctgaaaacctgactgaagcatttggtaacaacccgaagttctctatggaagtagtaccggacatttctaaactggacgcattcgaccacgtattccaaaagcacggtaaggatatcaagatcgtactgcacactgcatctccattctgttttgacatcactgattctgagcgcgacctgctgattccggctgttaacggtgttaaaggtattctgcactctattaagaaatatgctgctgattccgtagaacgcgtagttctgacttcctcttatgctgcagtattcgatatggctaaagagaacgacaaatccctgacttttaacgaagaatcttggaacccggctacctgggaatcttgccagtctgacccggttaacgcttattgtggctctaagaagtttgctgaaaaagctgcttgggaattcctggaagaaaaccgtgactctgtaaagttcgagctgaccgctgtaaacccggtatacgtttttggcccgcagatgttcgataaagatgtaaagaagcacctgaacacttcctgtgaactggtaaactctctgatgcacctgtctccagaagataaaatcccggagctgttcggcggttacatcgacgttcgtgacgtagcaaaagcacatctggtagctttccagaagcgtgagactatcggccagcgtctgattgtttccgaggctcgtttcaccatgcaggatgttctggatattctgaacgaagacttcccggtactgaaaggtaacattccggtgggtaaaccaggctctggtgcaactcataacactctgggtgcaactctggataacaagaagtctaagaaactgctgggttttaaattccgtaacctgaaagaaactattgacgacactgcatctcagatcctgaaattcgaaggtcgcatctaa

SEQ ID NO: 72093 - protein, 343 aa, Synthetic
MGSVFVSGANGFIAQHIVDLLLKEDYKVIGSARSQEKAENLTEAFGNNPKFSMEVVPDISKLDAFDHVFQKHGKDIKIVLHTASPFCFDITDSERDLLIPAVNGVKGILHSIKKYAADSVERVVLTSSYAAVFDMAKENDKSLTFNEESWNPATWESCQSDPVNAYCGSKKFAEKAAWEFLEENRDSVKFELTAVNPVYVFGPQMFDKDVKKHLNTSCELVNSLMHLSPEDKIPELFGGYIDVRDVAKAHLVAFQKRETIGQRLIVSEARFTMQDVLDILNEDFPVLKGNIPVGKPGSGATHNTLGATLDNKKSKKLLGFKFRNLKETIDDTASQILKFEGRI

SEQ ID NO: 72094 - DNA, 1038 bp, Issatchenkia scutulata
  CDS (1)..(1038)
atgtcgaacaaaacagttctagtcaccggggctaccggttttattgcactacacatcattgataatttattgtctaagggttattccgttattggtacagctagatcccaatctaaatatcaaccaatccttgatgctttcaagaaaaaataccctgatgcaaatttgacttttgaagttgtccctgacatctccactgaaaacgcattcgatgatgttttgaagaagcatccagaaattactgctgtccttcacacagcatctccattctcttttggtttgaacaaggatctgaaggaagcatatttgaagcctgccgttgatggtactttgaatattctcaaggcaattgagaagtatgcaccacaggttactaaagttgttatcacatcttcttatgctgcaattatgacaggtaatccaagtcatgtccacaccagtgaaacctggaacccaattaattgggaaaacgatgtgaagaatgaatactttgcatatattgcctccaagacgtatgctgaaaaagctgcgagagattttgtcaaggagcataaggtcaatttcaagttagcaactgttaacccaccatacgttctgggtccacaattatttgacttctcagttggtccagtcttgaacacttccaaccaattgatcacggatgcgactaaaattgataagaactctactaagccggaattaggtacaccagctttagcagtcgatgttagagatgttgctgcgttccatgttttaccattggaagatgataaagttgcaagtgaaagattatttattgttgctggtccagcagttgttcaaacattcttaaacatcatcaacgagaacattccagaacttaaaggtaaggttgccctaggagatccagcttcagagaaggagttgattgaaaagcacacagataagtatgatttgacaaatcttcacaacgttattggtaaatatgatttcattccagttgaaaagtccgttgtcgacgtcttagaacaatattacaaaatcaataaaattgattag

SEQ ID NO: 72095 - protein, 345 aa, Issatchenkia scutulata
MSNKTVLVTGATGFIALHIIDNLLSKGYSVIGTARSQSKYQPILDAFKKKYPDANLTFEVVPDISTENAFDDVLKKHPEITAVLHTASPFSFGLNKDLKEAYLKPAVDGTLNILKAIEKYAPQVTKVVITSSYAAIMTGNPSHVHTSETWNPINWENDVKNEYFAYIASKTYAEKAARDFVKEHKVNFKLATVNPPYVLGPQLFDFSVGPVLNTSNQLITDATKIDKNSTKPELGTPALAVDVRDVAAFHVLPLEDDKVASERLFIVAGPAVVQTFLNIINENIPELKGKVALGDPASEKELIEKHTDKYDLTNLHNVIGKYDFIPVEKSVVDVLEQYYKINKID

SEQ ID NO: 72096 - DNA, 1155 bp, Metschnikowia zobellii
  CDS (65)..(1081)
tgagcggatacaattcccctctagaaataattttgtttaactttaagaaggagatatacatatgatgaccacttcagtctttgtctctggtgccaccggcttcattgcccagcacgtcgtcaaactccttctctcgaaaggctacaacgtcgttggctccgtcagaaccgccgagaaaggcaagaacctagcaaagctatttggcaccggctccttcacctacgaggtggtgcccaaactcgaagcgcctggtgcctttgacgaggccttggaaaagcatccagaggtgtctgtgtttttgcacacggcctcgcccgtcacctttgacgtcaaggacattgagaaagagttgcttctccccgccgtcgagggcaccaaaaacgtctttagtgccatcaaagcccacggcccgcagatcaaaaacgtcgtggtgacgtcctctgttgctgcggcactcgatcccgctagaaacctggaccccacgttcactgtgaatgaagactcttggaacccaatctcgtgggaggactcgaagcagaacgccatgaccgggtactttggctccaagaagtttgcagagaaggccgcgtgggattttgtggaagccgagaagcccaactttctgttgaacaccgtgttgcccgtgtacgtctttggcccccaggcgtttgactccgaggtcaagggcgagctcaactactctgccgaaatcatcaacaagttgttgaagttgggacccaacgacgaagtgccctcgcaactggggggtttcgtcgacgtgagagacgtggccaaggctcacttggccgcattcgagggcggactctcgaaccagcgccttttgcttagaacggcagcgtttaatgcgcaacgcgtgcttgacataatcaacaataagtttgttaacttgagaggacagttgcccactggaacgccttgtaaaggcgagcctgaaagcactggctctgtgacggacaattcgagaaccaagaagttattgaacttcccagccatcgacttggagaactgtgtggtggactcggttacccagctcatgaagtcccagaagaaggttttgtaagcgaagcttgcggccgcactcgagcaccaccaccaccaccactgagatccggctgctaacaaagcccgaaagga

SEQ ID NO: 72097 - protein, 338 aa, Metschnikowia zobellii
MTTSVFVSGATGFIAQHVVKLLLSKGYNVVGSVRTAEKGKNLAKLFGTGSFTYEVVPKLEAPGAFDEALEKHPEVSVFLHTASPVTFDVKDIEKELLLPAVEGTKNVFSAIKAHGPQIKNVVVTSSVAAALDPARNLDPTFTVNEDSWNPISWEDSKQNAMTGYFGSKKFAEKAAWDFVEAEKPNFLLNTVLPVYVFGPQAFDSEVKGELNYSAEIINKLLKLGPNDEVPSQLGGFVDVRDVAKAHLAAFEGGLSNQRLLLRTAAFNAQRVLDIINNKFVNLRGQLPTGTPCKGEPESTGSVTDNSRTKKLLNFPAIDLENCVVDSVTQLMKSQKKVL

SEQ ID NO: 72098 - DNA, 1035 bp, Torulaspora delbrueckii
  CDS (1)..(1035)
atgtctattctagtttctggtgctactggttttattgctctacatgttgtcagtgatttgttgaagcaggattacaaagttattggtactgttagatctcaagaaaaagctgataaattgcgtaagcaatttggcaacaatcccaatctttcctttgaattggtttcagatattgctgctcctgaagcttttgacaaagtctttcagaaacatggcaaggacatcaaagtggtgttgcacacagcttctcctttcactctagaaaccacaaattatgagaaagatctgttgcttccagcagtgaatggtacaaagagtatcctggagtcgattaagaaatacgctgctgattctgtcgagagagtagtcatcacatcgtcttacgctgccgtcatgaatgtttcgaaagaaggcgacggctcaatagtctacactgagaaggattggaaccctgccacttgggaaaactgtcagatagatggtttgaatgcttattgtgggtccaagaagctagcagaaaaggctgcatgggacttctttgaagataataaaaacgttgtcaagttcaaactgagcatgatcaatcctacttacgttttcgggcctcagctatttgatgaggacgtgaaggataaattgaatacttcctgtgagctaattaactcaattataaagaataatcctcaggtgggatatctattagagaatattaaaggtcatttcgttgatgtcagagatgttgctaaggctcacttggtggcattccaaaaggatgaagctattggacagagactgctcacctcaaatggtcgtttcgcttaccaagacctcgtagatattatcaatgaggatttcccacaattgaagggtaaggtcattgtaggaaagccaggtgccggtaaacaattgtatggcactttcccagacatcaacaacaccagatcgaaggagattttgggcttcgaattcatctctctgcataaatccgtccatgacactgctgctcaagttttgaaaaaagaaggcaaattgtaa

SEQ ID NO: 72099 - protein, 344 aa, Torulaspora delbrueckii
MSILVSGATGFIALHVVSDLLKQDYKVIGTVRSQEKADKLRKQFGNNPNLSFELVSDIAAPEAFDKVFQKHGKDIKVVLHTASPFTLETTNYEKDLLLPAVNGTKSILESIKKYAADSVERVVITSSYAAVMNVSKEGDGSIVYTEKDWNPATWENCQIDGLNAYCGSKKLAEKAAWDFFEDNKNVVKFKLSMINPTYVFGPQLFDEDVKDKLNTSCELINSIIKNNPQVGYLLENIKGHFVDVRDVAKAHLVAFQKDEAIGQRLLTSNGRFAYQDLVDIINEDFPQLKGKVIVGKPGAGKQLYGTFPDINNTRSKEILGFEFISLHKSVHDTAAQVLKKEGKL

SEQ ID NO: 72100 - DNA, 837 bp, Arabidopsis thaliana
  CDS (1)..(837)
atggctgatggaggaaaggtggtctgcgtaaccggagcttccggttacatagcgtcttggatcgtcaagcttttgctcttccgtggctacaccatcaatgccaccgttcgagacccaaaagatcgaaagaaaacagatcaccttctagcacttgacggcgcaaaagaaagactcaaattattcaaagcagatcttctagatgaaggttcttttgagctcgcaattgatggatgcgagactgtcttccacactgcttcaccggttgcaatcactgtcaagactgatcctcaggttgagctgatcaatccagccgtcaatggtactattaacgtcctaagaacttgcactaaagtgtcttctgtcaagagggtcatcttaacatcgtccatggccgcagttcttgcgcctgagaccaagttgggaccaaacgatgtagtagacgaaaccttcttcactaatccaagttttgctgaggagagaaagcaatggtatgtactttctaagactttggccgaagatgcagcatggcgatttgccaaggacaatgagatcgacttgatcgtactgaatccgggacttgtgactggaccaatcttgcagccaactcttaatttctcggtagctgtgattgtggaacttatgaaaggcaagaatccttttaatactacacatcataggttcgtggacgtgagagatgttgctctagctcatgtaaaggcactcgagactccttcagccaatggcagatatatcattgatggtccggttgtgacaataaaagacattgaaaacgttttgcgcgaattctttcctgatttgtgtattgctgataggtga

SEQ ID NO: 72101 - protein, 278 aa, Arabidopsis thaliana
MADGGKVVCVTGASGYIASWIVKLLLFRGYTINATVRDPKDRKKTDHLLALDGAKERLKLFKADLLDEGSFELAIDGCETVFHTASPVAITVKTDPQVELINPAVNGTINVLRTCTKVSSVKRVILTSSMAAVLAPETKLGPNDVVDETFFTNPSFAEERKQWYVLSKTLAEDAAWRFAKDNEIDLIVLNPGLVTGPILQPTLNFSVAVIVELMKGKNPFNTTHHRFVDVRDVALAHVKALETPSANGRYIIDGPVVTIKDIENVLREFFPDLCIADR

SEQ ID NO: 72102 - DNA, 1035 bp, Saccharomyces cerevisiae
  CDS (1)..(1035)
atgtctaatacagttctagtttctggcgcttcaggttttattgccttgcatatcctgtcacaattgttaaaacaagattataaggttattggaactgtgagatcccatgaaaaagaagcaaaattgctaagacaatttcaacataaccctaatttaactttagaaattgttccggacatttctcatccaaatgctttcgataaggttctgcagaaacgtggacgtgagattaggtatgttctacacacggcctctccttttcattatgatactaccgaatatgaaaaagacttattgattcccgcgttagaaggtacaaaaaacatcctaaattctatcaagaaatatgcagcagacactgtagagcgtgttgttgtgacttcttcttgtactgctattataacccttgcaaagatggacgatcccagtgtggtttttacagaagagagttggaacgaagcaacctgggaaagctgtcaaattgatgggataaatgcttactttgcatccaagaagtttgctgaaaaggctgcctgggagttcacaaaagagaatgaagatcacatcaaattcaaactaacaacagtcaacccttctcttctttttggtcctcaacttttcgatgaagatgtgcatggccatttgaatacttcttgcgaaatgatcaatggcctaattcataccccagtaaatgccagtgttcctgattttcattccatttttattgatgtaagggatgtggccctagctcatctgtatgctttccagaaggaaaataccgcgggtaaaagattagtggtaactaacggtaaatttggaaaccaagatatcctggatattttgaacgaagattttccacaattaagaggtctcattcctttgggtaagcctggcacaggtgatcaagtcattgaccgcggttcaactacagataatagtgcaacgaggaaaatacttggctttgagttcagaagtttacacgaaagtgtccatgatactgctgcccaaattttgaagaaggagaacagattatga

SEQ ID NO: 72103 - protein, 344 aa, Saccharomyces cerevisiae
MSNTVLVSGASGFIALHILSQLLKQDYKVIGTVRSHEKEAKLLRQFQHNPNLTLEIVPDISHPNAFDKVLQKRGREIRYVLHTASPFHYDTTEYEKDLLIPALEGTKNILNSIKKYAADTVERVVVTSSCTAIITLAKMDDPSVVFTEESWNEATWESCQIDGINAYFASKKFAEKAAWEFTKENEDHIKFKLTTVNPSLLFGPQLFDEDVHGHLNTSCEMINGLIHTPVNASVPDFHSIFIDVRDVALAHLYAFQKENTAGKRLVVTNGKFGNQDILDILNEDFPQLRGLIPLGKPGTGDQVIDRGSTTDNSATRKILGFEFRSLHESVHDTAAQILKKENRL

SEQ ID NO: 72104 - DNA, 1110 bp, Arabidopsis thaliana
  CDS (1)..(1110)
atgatgcatgaaatggcatacaaagtgtgtgtggagaaagtgaagagtttgggaattgagttcactactcctatagaagaaaccctcagagacactattgttagccttatggaggattataaagagaggtcaaaggagattatgaacggcggaggaaagttggtctgcgtcaccggagcttccggttacatagcgtcttggattgtcaagcttttgctcctccgtggctacaccgtcaaggccactgttcgagatctaacggacaggaagaaaacagaacatcttcttgcacttgatggtgcaaaagaaagactcaaattgttcaaagcagatcttttggaagaatcttctttcgaacaagctattgaaggatgtgacgctgtcttccacaccgcatctccagttttcttcaccgtcaaagatcctcagactgagctgattgatccagccttaaagggtactatgaacgtccttaatacatgcaaagaaactccctctgtcagaagggtcattctgacatcatccacggctgcggttctctttcgtcagccacctgtggaggcaagcgatgtggtggacgagactttcttctccgatccaagtctatgcagggagacaaagaattggtatccactctccaaaattttggcagagaatgcagcgtgggaatttgccaaagacaacggaatcgacatggtcgtgttgaatccaggatttatattcggaccactcttgcaaccaactctgaacttttcggtagagctaattgtggatttcataaatggtaagaatcctttcaatagtagattctacaggttcgtggacgtaagagatgttgccttagctcatatcaaagctctggagactccttcagccaatggcagatacatcattgatggtccaattatgagtgtaagtgacattatagatattctgcgggagctacttccagacttgtgtattgctgatacgaatgaagaaagtgtgatgaatgaaatgttatgcaaagtgtgtgtggagaaagtgaagaatttgggagttgagttcactccaatgaaatcgagccttagagacactattgttagcctcaaggagaaatgtcttttatga

SEQ ID NO: 72105 - protein, 369 aa, Arabidopsis thaliana
MMHEMAYKVCVEKVKSLGIEFTTPIEETLRDTIVSLMEDYKERSKEIMNGGGKLVCVTGASGYIASWIVKLLLLRGYTVKATVRDLTDRKKTEHLLALDGAKERLKLFKADLLEESSFEQAIEGCDAVFHTASPVFFTVKDPQTELIDPALKGTMNVLNTCKETPSVRRVILTSSTAAVLFRQPPVEASDVVDETFFSDPSLCRETKNWYPLSKILAENAAWEFAKDNGIDMVVLNPGFIFGPLLQPTLNFSVELIVDFINGKNPFNSRFYRFVDVRDVALAHIKALETPSANGRYIIDGPIMSVSDIIDILRELLPDLCIADTNEESVMNEMLCKVCVEKVKNLGVEFTPMKSSLRDTIVSLKEKCLL

SEQ ID NO: 72106 - DNA, 969 bp, Arabidopsis thaliana
  CDS (1)..(969)
atgaactgcggaggaaaggtggtctgcgttaccggagcttccggctacatagcgtcttggattgtcaagcttttgctcctccgtggctacaccgtcaatgccactgttcgagatccaaaggacaagaagaaaacagaacatcttcttgcactagacggtgcaaaagaaagactcaaattgttcaaagcagatcttttggaagaatcttcttttgatcaagctatcgatggttgtgatgctgtcttccacactgcttctccagttctattcactgtcacagatcctcagactgagctgattgatccagccttaaagggtactattaacgtccttaatacatgcaaacaagtttcttctgtcaagagggtcattctgacatcttccacggctgcggttctctctcgtcagcctcctattgggccaaacgacctggtggacgagactttcttctccgatccaagtctatgcagggagacaaagaattggtattcactctccaagattttggccgagaatgcagcgtggcaatttgccaaagacaatggaatcgacatggttgtgttgaatcctggatttatttgcggaccactcttgcaaccaactcttaacatgtcggtagagctaattgtggatttcataaatggtaagaaccctttcaataaaagatactacaggttctcggacgtaagagatgtcgccttggttcatatcaaagcgttggagactccttcagccaatggcagatacatcatcgatggtccaaatatgagtgtaaacgacattatagacattcttcggaagctgttcccagatttgtctattgctgatacgaatgaagaaagtgagatgaatgagatgatatgccaagtgtgtgtggagaaagtgaaaaatttgggagtagagttcactcctatgaaatcaagccttagagacactattgttagcctcaaggagaaatgtcttttatga

SEQ ID NO: 72107 - protein, 322 aa, Arabidopsis thaliana
MNCGGKVVCVTGASGYIASWIVKLLLLRGYTVNATVRDPKDKKKTEHLLALDGAKERLKLFKADLLEESSFDQAIDGCDAVFHTASPVLFTVTDPQTELIDPALKGTINVLNTCKQVSSVKRVILTSSTAAVLSRQPPIGPNDLVDETFFSDPSLCRETKNWYSLSKILAENAAWQFAKDNGIDMVVLNPGFICGPLLQPTLNMSVELIVDFINGKNPFNKRYYRFSDVRDVALVHIKALETPSANGRYIIDGPNMSVNDIIDILRKLFPDLSIADTNEESEMNEMICQVCVEKVKNLGVEFTPMKSSLRDTIVSLKEKCLL

SEQ ID NO: 72108 - DNA, 978 bp, Arabidopsis thaliana
  CDS (1)..(978)
atggctgatggaggaaaggtggtctgcgtaaccggagcttccggttacatagcgtcttggatcgtcaagcttttgctcttccgtggctacaccatcaatgccaccgttcgagacccaaaagatcgaaagaaaacagatcaccttctagcacttgacggcgcaaaagaaagactcaaattattcaaagcagatcttctagatgaaggttcttttgagctcgcaattgatggatgcgagactgtcttccacactgcttcaccggttgcaatcactgtcaagactgatcctcaggttgagctgatcaatccagccgtcaatggtactattaacgtcctaagaacttgcactaaagtgtcttctgtcaagagggtcatcttaacatcgtccatggccgcagttcttgcgcctgagaccaagttgggaccaaacgatgtagtagacgaaaccttcttcactaatccaagttttgctgaggagagaaagcaatggtatgtactttctaagactttggccgaagatgcagcatggcgatttgccaaggacaatgagatcgacttgatcgtactgaatccgggacttgtgactggaccaatcttgcagccaactcttaatttctcggtagctgtgattgtggaacttatgaaaggcaagaatccttttaatactacacatcataggttcgtggacgtgagagatgttgctctagctcatgtaaaggcactcgagactccttcagccaatggcagatatatcattgatggtccggttgtgacaataaaagacattgaaaacgttttgcgcgaattctttcctgatttgtgtattgctgataggaatgaagacattactgagctgaattcagtgactttcaatgtgtgtctggataaagtgaaaagtttgggaataattgagttcactcctacagaaacaagccttagagacactgttcttagtctcaaggagaaatgtcttgtgtga

SEQ ID NO: 72109 - protein, 325 aa, Arabidopsis thaliana
MADGGKVVCVTGASGYIASWIVKLLLFRGYTINATVRDPKDRKKTDHLLALDGAKERLKLFKADLLDEGSFELAIDGCETVFHTASPVAITVKTDPQVELINPAVNGTINVLRTCTKVSSVKRVILTSSMAAVLAPETKLGPNDVVDETFFTNPSFAEERKQWYVLSKTLAEDAAWRFAKDNEIDLIVLNPGLVTGPILQPTLNFSVAVIVELMKGKNPFNTTHHRFVDVRDVALAHVKALETPSANGRYIIDGPVVTIKDIENVLREFFPDLCIADRNEDITELNSVTFNVCLDKVKSLGIIEFTPTETSLRDTVLSLKEKCLV

SEQ ID NO: 72110 - DNA, 969 bp, Arabidopsis thaliana
  CDS (1)..(969)
atggctgacggaggaaaaatggtttgcgtcactggagcgtccggttacgttgcgtcttggattgttaagcttttgctcctccgtggctacactgttagggccaccgttcgagacccaagtgatgaaaagaaaacagaacatcttcttgcactagacggtgcaaaagaaaaactcaaactgttcaaagcagatcttctggaagaaggttctttcgagcaagctattgaaggttgtgacgctgtcttccataccgcttctccagtttcactaactgtaactgatcctcagattgagctgattgacccggcagtaaagggaacacttaacgtccttaaaacttgcgctaaagtttcatctgttaagagggtcatcgtaacatcgtccatggccgcagttctctttcgtgagcctaccttgggaccaaacgacttagtagacgagagttgcttctcggatccaaacttttgcactgagaaaaagctttggtatgcgctctcaaagactttggccgaagatgaagcatggcgattcgcaaaggaaaaagggctcgacttggtcgtaataaatccaggacttgtgctcggaccgctcttgaaaccaagccttactttctcagtaaatgtgattgtggaacttattacaggtaaggacaatttcatcaacaaggattttaggctcgtcgatgtgagggatgttgccctcgctcatatcaaagcgttcgagactccttcagccaacggtagatatattattgagggtccggttgtgacgataaatgacattgagaagattttgcgtgaattctttcctgacttgaatctcggtaacaagggtgaagcaagtgagatcattccagtgatatacaagctatgtgttgagaaagtgaagagtttgggaattgagttcactcccacagaagcaacccttagagacactattcttagcctcaaagagaaatgtcttgtgtga

SEQ ID NO: 72111 - protein, 322 aa, Arabidopsis thaliana
MADGGKMVCVTGASGYVASWIVKLLLLRGYTVRATVRDPSDEKKTEHLLALDGAKEKLKLFKADLLEEGSFEQAIEGCDAVFHTASPVSLTVTDPQIELIDPAVKGTLNVLKTCAKVSSVKRVIVTSSMAAVLFREPTLGPNDLVDESCFSDPNFCTEKKLWYALSKTLAEDEAWRFAKEKGLDLVVINPGLVLGPLLKPSLTFSVNVIVELITGKDNFINKDFRLVDVRDVALAHIKAFETPSANGRYIIEGPVVTINDIEKILREFFPDLNLGNKGEASEIIPVIYKLCVEKVKSLGIEFTPTEATLRDTILSLKEKCLV

SEQ ID NO: 72112 - DNA, 1035 bp, Arabidopsis thaliana
  CDS (1)..(1035)
atgccagtcgacgtagcctcaccggccggaaaaaccgtctgcgtcaccggagctggtggatacatcgcttcttggattgttaagatacttctcgagagaggttacacagtcaaaggaaccgtacggaatccagatgatccgaagaacacacatttgagagaactagaaggaggaaaggagagactgattctgtgcaaagcagatcttcaggactacgaggctcttaaggcggcgattgatggttgcgacggcgtctttcacacggcttctcctgtcaccgacgatccggaacaaatggtggagccggccgtgaatggagccaagtttgtaattaatgctgcggctgaggccaaggtcaagcgcgtggtcatcacctcctccattggtgccgtctacatggacccgaaccgtgaccctgaggctgtcgttgacgaaagttgttggagtgatcttgacttctgcaaaaacaccaagaattggtattgttacggcaagatggtggcggaacaagcggcgtgggagacagcaaaggagaaaggtgttgacttggtggtgttgaatccggtgctggttcttggaccgccgttacagccgacgatcaacgccagtctttaccacgtcctcaaatatctaaccggctcggctaagacttatgctaatttgactcaagcttatgtggatgttcgcgatgtcgcgctggctcatgttctggtctatgaggcaccctcggcctccggacgttatctcctagccgagagtgctcgccaccgcggggaagttgttgagattctggctaagctattcccggagtatcctcttccgaccaagtgcaaggacgagaagaaccctagagccaagccatacaaattcactaaccagaagattaaggacttaggcttagagttcacttccaccaagcaaagcctctacgacacagtcaagagcttacaagagaaaggccatcttgctcctcctcctcctcctccttcagcatcgcaagaatccgtggaaaatggcattaagatcgggtcttga

SEQ ID NO: 72113 - protein, 344 aa, Arabidopsis thaliana
MPVDVASPAGKTVCVTGAGGYIASWIVKILLERGYTVKGTVRNPDDPKNTHLRELEGGKERLILCKADLQDYEALKAAIDGCDGVFHTASPVTDDPEQMVEPAVNGAKFVINAAAEAKVKRVVITSSIGAVYMDPNRDPEAVVDESCWSDLDFCKNTKNWYCYGKMVAEQAAWETAKEKGVDLVVLNPVLVLGPPLQPTINASLYHVLKYLTGSAKTYANLTQAYVDVRDVALAHVLVYEAPSASGRYLLAESARHRGEVVEILAKLFPEYPLPTKCKDEKNPRAKPYKFTNQKIKDLGLEFTSTKQSLYDTVKSLQEKGHLAPPPPPPSASQESVENGIKIGS

SEQ ID NO: 72114 - DNA, 978 bp, Arabidopsis thaliana
  CDS (1)..(978)
atgagcagcgaagaagagaagacagtgtgtgtgacaggagcttcaggttacattgcttcatggatcgttaagcttcttcttctccgtggttacaccgttaaagcctctgttcgtgatccaaatgatccaaggaaaacagagcatttgcttgcattggaaggagcagaggaaaggcttaaattgttcaaagcaaacttgttagaagaaggctctttcgattcagcaatcgatggttgcgaaggagttttccacaccgcatcgccattctatcatgacgtcaaggaccctcaggctgagttacttgatccggcagtgaaaggaacaatcaatgttctaagctcttgtttgaagacttcctcggttaagagagtcgtcttaacctcatcgatagcagctgttgctttcaatggaatgcctcgaacacccgaaaccatagttgacgaaacttggttcgccgatcctgactattgcagagcttccaagctatggtatgtactctcgaagacattagctgaaaacgcagcgtggaaattcgcaaaagagaacaatttacagctggtttcgataaatccggctatggtgattggtcctctcttacagccaacgctaaacactagtgctgctgcagtactaagcttgatcaaaggagcacaaacgtttcctaatgcgacgttcgggtgggttaacgttaaagatgtagcgaacgctcatattcaagcgtttgagaatccagatgctgatgggagatactgtttagtggagagagttgctcattactctgaagttgttaacattttgcatgatctttaccctgattttcaactccctgagaagtgtgcagatgaaaagatatatattccaacatataaagtgtctaaagagaaagcagagtctcttggggttgagtttgtgccattggaagttagcattaaagagactgtagagagcttgagagataaagggttcatcagattttga

SEQ ID NO: 72115 - protein, 325 aa, Arabidopsis thaliana
MSSEEEKTVCVTGASGYIASWIVKLLLLRGYTVKASVRDPNDPRKTEHLLALEGAEERLKLFKANLLEEGSFDSAIDGCEGVFHTASPFYHDVKDPQAELLDPAVKGTINVLSSCLKTSSVKRVVLTSSIAAVAFNGMPRTPETIVDETWFADPDYCRASKLWYVLSKTLAENAAWKFAKENNLQLVSINPAMVIGPLLQPTLNTSAAAVLSLIKGAQTFPNATFGWVNVKDVANAHIQAFENPDADGRYCLVERVAHYSEVVNILHDLYPDFQLPEKCADEKIYIPTYKVSKEKAESLGVEFVPLEVSIKETVESLRDKGFIRF

SEQ ID NO: 72116 - DNA, 960 bp, Arabidopsis thaliana
  CDS (1)..(960)
atgaacggcgaaggaaaggttgtttgcgtcaccggagcttccggatacatagcttcttggattgttaagcttttgctcctccgtggctacaccgtcagggccaccgtccgaaacccaatggatacaaagaaaacaaatcatcttcttacacttgaaggtgcaagtgaaagactaaaactgttcaaatcagatcttttggaagaaggttctttcgatcaagctatagagggatgcgacggtgtcttccatactgcctctccagtttcattaaccgttacagatcctcagactgagatgatcgatccggcggttaatggtactttgaacgttttgagaacgtgcgccaaagtttcttctgtgaagagggtcattgtaacatcgtccactgctgctactctttctattaacccaaacgacgtggtggacgaaaccgtcttcaccgatctaagtgtttacttagcgatgaaggcatggtatggatattcaaaaactttggctgaggaaacagcgtggcggtttgctaaagaaaacgggatcgatttggttgtaatgaatccaggaaacgtgatcggaccagttttgcagccaactcttaattactctgtagaagtgattgtggatctgataaatggtaaaaacccttccaatagtttttactataggttcatggacgtgagagatgtttctcttgctcatatcaaagcgttcgaggtcccttctgctagtggcagatacatacttgctgatccagatgtaacaatgaaagacattcaaaagcttttacatgaactgtttcctgatttgtgccgtgttgataaggataatgagaatgaggtgggtgaaatggcatacaaagtgtgtgtcgataaattgaaaagtttgggaattgagttcactcctatcaaagaatctctcaaggatactgttgttagccttaaggagaggtgtcttcttatatga

SEQ ID NO: 72117 - protein, 319 aa, Arabidopsis thaliana
MNGEGKVVCVTGASGYIASWIVKLLLLRGYTVRATVRNPMDTKKTNHLLTLEGASERLKLFKSDLLEEGSFDQAIEGCDGVFHTASPVSLTVTDPQTEMIDPAVNGTLNVLRTCAKVSSVKRVIVTSSTAATLSINPNDVVDETVFTDLSVYLAMKAWYGYSKTLAEETAWRFAKENGIDLVVMNPGNVIGPVLQPTLNYSVEVIVDLINGKNPSNSFYYRFMDVRDVSLAHIKAFEVPSASGRYILADPDVTMKDIQKLLHELFPDLCRVDKDNENEVGEMAYKVCVDKLKSLGIEFTPIKESLKDTVVSLKERCLLI

SEQ ID NO: 72118 - DNA, 966 bp, Arabidopsis thaliana
  CDS (1)..(966)
atgtctgagtatttggtaactggaggaacaggtttcattgcttcttacatcatcaaatcacttctcgaactcggacacaccgttcgaacaactgtccgaaacccacgtgatgaagaaaaggttggatttttatgggaatttcaaggagcaaaacagaggctaaagattctccaagctgatctaacggtagaaggaagttttgatgaagcagtgaatggtgttgatggagtattccacactgcttctcctgttcttgttccacaggatcataacattcaggagactttggttgatcctattataaagggtacaacaaatgtgatgagctcttgtgccaagtctaaagccacattgaaaaggattgttcttacgtcttcttgctcttcgatacgctaccgtttcgatgcaactgaagcttctcctctcaatgagtctcattggagtgatcctgaatattgcaaacgtttcaatctttggtatggatatgcaaagactttaggagaaagagaggcttggaggatagctgaagagaaaggattagacttggttgttgtgaatccttcgtttgtggttggtccattgcttggaccaaaaccaacaagtactctgcttatgattcttgctattgctaaaggtcttgctggagagtatccaaatttcactgtcgggtttgtgcatatagatgatgttgttgctgcacatgtattggctatggaagagcctaaagcatcagggagaatcatatgttcgagttctgttgctcattggtctgagatcattgagttgatgagaaataagtatcctaattacccatttgagaacaagtgtagtaacaaagaaggagacaatagtccacatagtatggatacaaggaagatacatgagttgggatttggatccttcaagtcactacctgagatgtttgatgattgcatcatcagttttcagaagaagggtctgctctaa

SEQ ID NO: 72119 - protein, 321 aa, Arabidopsis thaliana
MSEYLVTGGTGFIASYIIKSLLELGHTVRTTVRNPRDEEKVGFLWEFQGAKQRLKILQADLTVEGSFDEAVNGVDGVFHTASPVLVPQDHNIQETLVDPIIKGTTNVMSSCAKSKATLKRIVLTSSCSSIRYRFDATEASPLNESHWSDPEYCKRFNLWYGYAKTLGEREAWRIAEEKGLDLVVVNPSFVVGPLLGPKPTSTLLMILAIAKGLAGEYPNFTVGFVHIDDVVAAHVLAMEEPKASGRIICSSSVAHWSEIIELMRNKYPNYPFENKCSNKEGDNSPHSMDTRKIHELGFGSFKSLPEMFDDCIISFQKKGLL

SEQ ID NO: 72120 - DNA, 954 bp, Arabidopsis thaliana
  CDS (1)..(954)
atggctgtaaagcaaaaggtctgtgttactggtgcaggagggtttattgcttcatggctcgtcaagtttcttctctctcgtggctacactgtccatggaaccgttcgagatccttgtgatgaaaagaatgaccatttgaggaaactggataatgcttcaaaaaatctgaaacttttcaaggcagatttgtttgatgatgaaggtcttttctcagccattgatggttgctctggcgttttccatatcgcttctcctgtgccttttgaaggagaagaactgattaaaccagctctcactggcaccaagaatgttctagaagcatgcacagaaaccaaagtgcagaaagttgtggttgtatcatcaatcgctgcagttgtttacaatccaaaatggcctcaagatgttgctaaggacgaggattgttggtcagacactcaataccttcactcacttgagcgttattactatcttgccaaaacattaacggaacgtgaagctttagagtggagtaagagaaactttgctgatgttgttacgctctgtccgtctgtcattataggccctaggcttcaatccacgcttaactctagtagtttgggacttctcaagttcataaaaggtggtataaagtccttgttgagcgatgaactgtatcttgtggatgtgcgtgatgttgcggatgcgcttttgttggtgtatgaaaatcgagaagcaacaggaagatacatatgtaattctcattcactttacactgattctcttatggagaagctcaagaatatgtatcctaaacgcaacttccctgaaagtttcacggaggtaaaagagaaggaagtgaggcctctaagtgcagagaagttgaaaaacttggggtggaagtttaggccattagaagaaaccattgatgattctgttgtgagctttgaagcagctggtgatcttccaaaggcataa

SEQ ID NO: 72121 - protein, 317 aa, Arabidopsis thaliana
MAVKQKVCVTGAGGFIASWLVKFLLSRGYTVHGTVRDPCDEKNDHLRKLDNASKNLKLFKADLFDDEGLFSAIDGCSGVFHIASPVPFEGEELIKPALTGTKNVLEACTETKVQKVVVVSSIAAVVYNPKWPQDVAKDEDCWSDTQYLHSLERYYYLAKTLTEREALEWSKRNFADVVTLCPSVIIGPRLQSTLNSSSLGLLKFIKGGIKSLLSDELYLVDVRDVADALLLVYENREATGRYICNSHSLYTDSLMEKLKNMYPKRNFPESFTEVKEKEVRPLSAEKLKNLGWKFRPLEETIDDSVVSFEAAGDLPKA

SEQ ID NO: 72122 - DNA, 999 bp, Arabidopsis thaliana
  CDS (1)..(999)
atgcttgtcgacgggaaactcgtctgcgtcaccggagccggcggctacattgcttcttggatcgttaagttactcttagagagaggctacaccgttagaggaaccgtaaggaacccaactgatcccaagaacaaccatctcagagagcttcaaggagccaaggaaagactcactcttcacagtgcagatcttctcgactacgaagctctctgtgccacaatcgacggttgcgatggcgttttccacactgcctctccgatgaccgacgatcccgagacaatgttggagccggcggtgaacggagccaagttcgtgattgacgcagcggctaaagccaaggtcaagcgcgtggttttcacgtcatcaattggtgcagtttacatgaaccctaaccgtgacactcaagccattgttgacgaaaactgctggagtgatcttgatttctgcaaaaacactaagaattggtattgctacgggaagatgttggcggaacaatcggcatgggagacggccaaagcaaaaggtgtggacttagtggtgctaaatccggttttggttctcggaccaccgctccagtcagcgatcaacgctagtctagtccatattctcaagtacctcaccggctcagccaagacctacgctaacttgactcaggtctacgtggacgtccgtgacgtggcactaggccatgttctggtctacgaagcaccctccgcctcaggccgttacatcctcgccgagaccgcacttcaccgcggagaggttgttgagattctggccaaattcttcccggagtatccacttcccaccaagtgttcggacgagaagaatccgagggctaagccatacaagtttactacccaaaagataaaagacttaggcttggaatttaaacccatcaagcaatctctttacgaatctgtcaagagcttgcaagagaaaggccatcttcctctacctcaagattcgaaccaaaacgaagtcatcatcgaatcttag

SEQ ID NO: 72123 - protein, 332 aa, Arabidopsis thaliana
MLVDGKLVCVTGAGGYIASWIVKLLLERGYTVRGTVRNPTDPKNNHLRELQGAKERLTLHSADLLDYEALCATIDGCDGVFHTASPMTDDPETMLEPAVNGAKFVIDAAAKAKVKRVVFTSSIGAVYMNPNRDTQAIVDENCWSDLDFCKNTKNWYCYGKMLAEQSAWETAKAKGVDLVVLNPVLVLGPPLQSAINASLVHILKYLTGSAKTYANLTQVYVDVRDVALGHVLVYEAPSASGRYILAETALHRGEVVEILAKFFPEYPLPTKCSDEKNPRAKPYKFTTQKIKDLGLEFKPIKQSLYESVKSLQEKGHLPLPQDSNQNEVIIES

SEQ ID NO: 72124 - DNA, 957 bp, Arabidopsis thaliana
  CDS (1)..(957)
atggcgaaagagacagtgtgtgtaaccggagctaatggtttcatcggatcttggataatccgaacgttaattgagaaaggatatactaaaatccacgcttcgatttacccaggatccgacccgactcatcttctgcaactacccggatccgattctaagatcaagatctttgaagcggatctcttagactctgatgcaatctccagagctattgatggatgtgcgggagtgttccacgtggcgtcaccttgtacgttggatccaccggtagatccagagaaggagctggtcgaaccggcggttaagggaacgatcaatgtgttggaagctgctaagaggtttaatgtgagacgcgtggtgatcacgtcatctatctccgcattggttcctaaccctaattggccggaaaaagttcccgtcgatgagtcgtcgtggtccgatcttgatttttgcaagtcgaggcagaaatggtatccaatttcgaagacattagctgagaaagcagcttgggaattttcggagaagcatggaaccaacattgtgacgattcatccatcaacatgtctcggaccgcttctgcaaccgaacctaaacgcaagctgtgctgttctgctacagcttttacaaggctcgaccgagacgcaagagcatcactggctcggtgtggttcacgtgaaagatgtggctaaaggtcatgtgatgctattcgaaacacctgacgcttctggacggtttttatgcactaatgggatttatcagttcagtgagtttgctgctcttgtgtctaagctcttccctgagtttgctgttcacaagtttgataaagagactcaacctgggcttacgtcgtgtaatgatgcggctaagcgattgattgagctcgggctggtttttactgcggttgaagatgcggttaaggagacggtccagagtcttagagacaaaggcttcctctga

SEQ ID NO: 72125 - protein, 318 aa, Arabidopsis thaliana
MAKETVCVTGANGFIGSWIIRTLIEKGYTKIHASIYPGSDPTHLLQLPGSDSKIKIFEADLLDSDAISRAIDGCAGVFHVASPCTLDPPVDPEKELVEPAVKGTINVLEAAKRFNVRRVVITSSISALVPNPNWPEKVPVDESSWSDLDFCKSRQKWYPISKTLAEKAAWEFSEKHGTNIVTIHPSTCLGPLLQPNLNASCAVLLQLLQGSTETQEHHWLGVVHVKDVAKGHVMLFETPDASGRFLCTNGIYQFSEFAALVSKLFPEFAVHKFDKETQPGLTSCNDAAKRLIELGLVFTAVEDAVKETVQSLRDKGFL

SEQ ID NO: 72126 - DNA, 981 bp, Arabidopsis thaliana
  CDS (1)..(981)
atggcaaacagtggtgaaggtaaagtggtgtgtgtaacaggagcctccggttacatcgcctcatggctcgtcaagttcctacttagccgtggctacactgttaaggcctccgtccgtgatcccagtgatccgaaaaagacacaacacttagtttcactagaaggtgcaaaggaaagacttcacttgttcaaagcagaccttttggaacaaggttctttcgactctgctattgatggttgccatggagttttccacactgcttctccattttttaatgatgccaaagacccacaggctgaacttattgatcctgcggtcaaggggacgcttaacgttttgaattcgtgcgccaaagcctcttcggttaagagggttgttgtaacctcctccatggctgccgttggttacaatggaaaaccacgcacacctgatgttaccgtcgatgaaacttggttctctgatcctgagctttgcgaggcctccaagatgtggtatgttctatccaagactttggcggaagatgcagcttggaaactcgctaaagagaaaggcttagacattgttactattaacccggctatggtgatcggtcctctcctacagccaactctgaacacgagtgctgctgctatattaaacttaatcaatggtgcaaagactttcccaaacttgagtttcggatgggttaatgtaaaagacgtagccaatgcgcacatccaagcatttgaggtcccttcagctaatgggcgttattgtttggtcgagcgtgtcgttcaccactccgagattgttaacattctacgtgagctttacccaaatctcccactacctgaaaggtgtgtggacgagaatccctacgtgccaacgtatcaagtgtccaaggataaaacgaggagccttggcatagactacatacccttgaaggttagcatcaaggagaccgtcgagtccttgaaggaaaaaggtttcgcacagttctga

SEQ ID NO: 72127 - protein, 326 aa, Arabidopsis thaliana
MANSGEGKVVCVTGASGYIASWLVKFLLSRGYTVKASVRDPSDPKKTQHLVSLEGAKERLHLFKADLLEQGSFDSAIDGCHGVFHTASPFFNDAKDPQAELIDPAVKGTLNVLNSCAKASSVKRVVVTSSMAAVGYNGKPRTPDVTVDETWFSDPELCEASKMWYVLSKTLAEDAAWKLAKEKGLDIVTINPAMVIGPLLQPTLNTSAAAILNLINGAKTFPNLSFGWVNVKDVANAHIQAFEVPSANGRYCLVERVVHHSEIVNILRELYPNLPLPERCVDENPYVPTYQVSKDKTRSLGIDYIPLKVSIKETVESLKEKGFAQF

SEQ ID NO: 72128 - DNA, 981 bp, Oryza sativa (japonica cultivar-group)
  CDS (1)..(981)
atggtcaccggcgtcgagcagatggtgtgcgtgaccggcgccggtggcttcatcgggtcatggctggtgaaggagctcctccaccgcggatacgccgtgagggcagccgtgagagaccctgagggcagaaagaatgctcatttgcatgctctggagagagctaaaagaaggttgtccctccacagagctgatgtgttggactgcaacagccttcgtgctgcgttcaacttatgcgatggtgttttccacgtggcatcaccagtctcagatgaccctgaacttctgccaactgctatcgagggaacaaagaatgtcatcaatgctgctgcggacatgggcatcaagcgtgtggtgtttacttcgtcttatggtgctgcccatatgaaccctaacaggagatcagatcagactcttgatgagacttgttggagtgaccttgagttctgcaaacaaacacagaattggtactgctacgcgaagacggtggccgagaagacggcgacggaggaggcgtcgaagagaggtgtgcagctgttggtggtggtgcctgccgtcaccgtgggggagatgctgcagccgacgctgaacgccagcgtctacagggtggccacctacatgaggggcaccaagagtgcgtacccgaacgccgtcgccgcgtacgtcgacgtgcgcgacgtcgcccgcgcgcacgcgctggtgtacgagcaccccgacgcgcgtggccgctacctctgcatcggcagcgtgctgcaccggtccgagtttgttcgcttgcttagggagctcttcccccagtaccctatcaccaccaggtgtgaggacaacagtaagccaatggtgaaaccttaccaattctctgtacaaaggctggaggctttaggcatgcagttcactcctttgaaagagagcttgtacaagacagtgataagcttacaggacaagggtcacctaccagcaatctcacctcgttcagccctgtga

SEQ ID NO: 72129 - protein, 326 aa, Oryza sativa (japonica cultivar-group)
MVTGVEQMVCVTGAGGFIGSWLVKELLHRGYAVRAAVRDPEGRKNAHLHALERAKRRLSLHRADVLDCNSLRAAFNLCDGVFHVASPVSDDPELLPTAIEGTKNVINAAADMGIKRVVFTSSYGAAHMNPNRRSDQTLDETCWSDLEFCKQTQNWYCYAKTVAEKTATEEASKRGVQLLVVVPAVTVGEMLQPTLNASVYRVATYMRGTKSAYPNAVAAYVDVRDVARAHALVYEHPDARGRYLCIGSVLHRSEFVRLLRELFPQYPITTRCEDNSKPMVKPYQFSVQRLEALGMQFTPLKESLYKTVISLQDKGHLPAISPRSAL

SEQ ID NO: 72130 - DNA, 987 bp, Oryza sativa (japonica cultivar-group)
  CDS (1)..(987)
atggtcaccggccggagcgagcagatggtgtgcgtgaccggcgccggtggcttcatcgggtcgtggctggtgaaggagctcctccaccgcggatacttcgtgaggggagccatgagagaacctgcggacatcaagaatgctcatttgcatgttctggatggagctagagaaggcctgtccctctaccgagctgatgtgctcgaccgcaacagccttcgtgctgcgttcgccttatgcgatggcgttttccacgtggcatcgccagtctcaaatgaccctgaacttctgccagctgctatcgagggaaccaagaatgtcatcaacgctgctgcggacatgggcgtcaagcgtgtggtgtttacttcgtcttatggtgctgtccatatgaaccctaacagaagatctgaccagattgttgatgagagctgttggagtgaccttgagttctgcaaacaaacacagaactggtattgctacgcgaagatgttggccgagaggacggcgatggaggaggcgtcgaagagaggtgtgaatctgttggtggtcgtgccggccgtcaccgtgggggagatgctgcagccgacgctgaacgccagcgtccacagggtggccacctacatgaggggcaccaagagtgcgtacccgaacgccgtcgccgcgtacgtcgacgtgcgcgacgtcgcccgcgcgcacgcgctggtgtacgagcaccccgacgcgcgtggccgctacctctgcatcggcagcgtgctgcaccggtccgagtttgttcgcttgcttagggagctcttcccccagtaccctatcacctccagatgtaaggacaacagtaagccaatggtgaaaccatacaaattctctgtacaaaggctggagactttaggcatgcagttcactcctttgaaagagagtttatacagaacggtaataagcttacaagacaagggtcatctacctgcagcaatctcacgccgttcagccctgtga

SEQ ID NO: 72131 - protein, 328 aa, Oryza sativa (japonica cultivar-group)
MVTGRSEQMVCVTGAGGFIGSWLVKELLHRGYFVRGAMREPADIKNAHLHVLDGAREGLSLYRADVLDRNSLRAAFALCDGVFHVASPVSNDPELLPAAIEGTKNVINAAADMGVKRVVFTSSYGAVHMNPNRRSDQIVDESCWSDLEFCKQTQNWYCYAKMLAERTAMEEASKRGVNLLVVVPAVTVGEMLQPTLNASVHRVATYMRGTKSAYPNAVAAYVDVRDVARAHALVYEHPDARGRYLCIGSVLHRSEFVRLLRELFPQYPITSRCKDNSKPMVKPYKFSVQRLETLGMQFTPLKESLYRTVISLQDKGHLPAAISRRSAL

SEQ ID NO: 72132 - DNA, 1359 bp, Oryza sativa (japonica cultivar-group)
  CDS (1)..(1359)
atgaaggaaaaagatgttatgaaaatcatcccatgcaagccagggcacataaatagaatgactcggcctaaggctccggtagtcgtatgccttgtggactatatccatgaatcacctgcttcagccctagaaaagaagcataattttggaagacaggttattaaaccacttgccacttgtgttggaataagtttcacggtgatcatgaataatggtttgaaaagaaacaaaacgataatccaaggcgaggaggcggcggcggcggcggcggcggcggtgcgagacgagatcgtcgagtccggcaccccacccccgtccttcgcttcacacgaaaaggaagggaggaagatgagctccgagtctgaggcggcgcccgggaccgggaagctggtgtgcgtcaccggcgcgtcggggtacatcgcgtcgtggctcgtcaggctgctcctcgcccgcggctacacggtccgcgccaccatccgggacacctctgacccaaagaaaacactacacctgcgtgccctggatggagccaacgaaagactccatttgttcgaagcaaatctgctggaagagggctctttcgatgctgcggtcaatggttgtgattgtgttttccatacggcttctcccttttaccacaatgttaaagatcctaaggctgagttacttgaccctgcagtcaaaggaacccttaatgttctaggctcctgcaagaaagcttccattagaagagttatcgtgacatcatccatggctgctgttgcctacaatgggaaaccaagaactcctgatgtagttgttgatgagacatggttttcagttccagagatttgtgaaaagcatcagcaatggtatgttctgtccaagaccctagcagaggaggctgcttggaagttttcaaaagataatggatttgaaatagttacggtgaacccagcaatggtcattggtcccctgctgcagccttcactgaatactagtgctgaagcaattctgaagctaatcaatggatcatcctcgacatatcctaatttcagctttggctggataaacgttaaggatgttgccctggcacatatccttgcatatgaagttccttcagcaaatggaagatattgcatggttgaaagagttgcgcactactcagagctcgtccaaatcattcgtgagatgtatcccaatattcctctgccagacaagtgtgcagatgacaagccatcagtgccaatctaccaggtatcaaaggaaaagataaaaagcttgggcctggaactgactcccctgcacacgagcatcaaggagaccatcgagagcttgaaagagaaaggatttgttacttttgattcaagcaacctgtaa

SEQ ID NO: 72133 - protein, 452 aa, Oryza sativa (japonica cultivar-group)
MKEKDVMKIIPCKPGHINRMTRPKAPVVVCLVDYIHESPASALEKKHNFGRQVIKPLATCVGISFTVIMNNGLKRNKTIIQGEEAAAAAAAAVRDEIVESGTPPPSFASHEKEGRKMSSESEAAPGTGKLVCVTGASGYIASWLVRLLLARGYTVRATIRDTSDPKKTLHLRALDGANERLHLFEANLLEEGSFDAAVNGCDCVFHTASPFYHNVKDPKAELLDPAVKGTLNVLGSCKKASIRRVIVTSSMAAVAYNGKPRTPDVVVDETWFSVPEICEKHQQWYVLSKTLAEEAAWKFSKDNGFEIVTVNPAMVIGPLLQPSLNTSAEAILKLINGSSSTYPNFSFGWINVKDVALAHILAYEVPSANGRYCMVERVAHYSELVQIIREMYPNIPLPDKCADDKPSVPIYQVSKEKIKSLGLELTPLHTSIKETIESLKEKGFVTFDSSNL

SEQ ID NO: 72134 - DNA, 1059 bp, Candida glabrata CBS 138
  CDS (1)..(1059)
atggcttctgataacagcaacacaactgtctttgtctctggtgctactggtttcattgctcagcacgtagttagacaattgcttgaccagaactacaaggttattggttctgttagatctgctgagaagggtgaccacttgaagaatgttatcttcaaaggtggtgacttcaactatgagattgtcaaagacatctctgatccaaccgcatttgaccacgtcttcgagaagcatggcaaggatatcaaggtagtcttacacaccgcctctccattccacttcaacactactgacattgaaaaggatttgttgattccagctgtcaacggtaccaagggtatcttagaatccatcaagaagtacgctgctcaaacagttgagagagttgttgttacttcctcctttgctgccaacacctccacagttgacatgttctacgctaaggattcttccaagacaattactgaagaatcttggaaccaagacacttgggaaagttgtcaatccgatccaatcagaggttactgtggttcaaagaagtttgccgaaaaggcggcttgggacttctacaacgccaacaaggactctgtcaaatttaagttgtctatcatcaacccagtatacgtcttcggtccacaaaactatgtggaaccaggtaagaagattctaaacacttcttctgaagtcatcaacagcttggtccacttgaagaaggatgacccattgccagagtttgcaggtggtcacatcgacgtccgtgatgttgccaaggctcatatcctagcgttccaaaaggacgagttgatcgagcaaagattgatgcttcatgctggtctattcactacccaaaccctgctagatatcattaatgaacaattcccagaactgaaaggtaagattccagctggtaagccaggtaccggtaacccagatgatgcattgactccagttgacaactccaagaccaagaaattgctgggcttcgagtttattgatttgaagaaggacctttacgacaccatctctcaaattttggaagccgagaagaactctaattaa

SEQ ID NO: 72135 - protein, 352 aa, Candida glabrata CBS 138
MASDNSNTTVFVSGATGFIAQHVVRQLLDQNYKVIGSVRSAEKGDHLKNVIFKGGDFNYEIVKDISDPTAFDHVFEKHGKDIKVVLHTASPFHFNTTDIEKDLLIPAVNGTKGILESIKKYAAQTVERVVVTSSFAANTSTVDMFYAKDSSKTITEESWNQDTWESCQSDPIRGYCGSKKFAEKAAWDFYNANKDSVKFKLSIINPVYVFGPQNYVEPGKKILNTSSEVINSLVHLKKDDPLPEFAGGHIDVRDVAKAHILAFQKDELIEQRLMLHAGLFTTQTLLDIINEQFPELKGKIPAGKPGTGNPDDALTPVDNSKTKKLLGFEFIDLKKDLYDTISQILEAEKNSN

SEQ ID NO: 72136 - DNA, 1056 bp, Candida glabrata CBS 138
  CDS (1)..(1056)
atgactgctgctaataacaacactactgtttttgtctccggtgcttccggtttcattgctcaacacatcatcagacaattgctagaccagaactacaaggtcattggttctgttagatctacagagaagggtgacaacctgaagaatgctatcttcaaaagtgctaacttcaactatgagatcgtcaaggatatcgctgatctaaatgcttttgaccctgtcttcgagaagcacggtaaggatatcaaggttgtcctacacaccgcctctcctttaaacttcactactaccgaatacgaaaaggatttgttgattccagctgtcaacggtaccaagggtatcttagagtccatcaagaagtacgctgcccaaacagttgagagagttgttgttacttcctcctttgcttctcacacttccactgttgacatgtgcaacaccaagggtaagataactgaagactcctggaaccaagactcctgggaaaactgtcaaacggatgccgttagagcttacttcggttccaagaaatttgctgaagaagctgcatgggaattcttgaacaagaacaaagatgcagttaagttcaagttggccactgttgacccagtgtacgtcttcggtcctcaaaaccacatcgagcctggcaagaaggtattgaacgtctcatccgaagtcattaaccaattggtacacctgaagaaagacgacccattgccacaagtagcatgtggttacatcgatgtccgtgacattgctaaggctcatatcctagcgttccaaaaggatgaattaatcggtcaaagactgttgctacactctggtttgttcaccgtccaaaccctactggatgctatcaacgagcaattcccagagctaagaggtaagatcccagctggtgagccaggttccaacaagccagaagatctactgactccaattgacaacaccaagaccaagaagctgctaggattcgagttccgtgacctgaagaccatcatccaggacaccgtctctcaaatcctagaagctgagaatgccagtgccaagttgtaa

SEQ ID NO: 72137 - protein, 351 aa, Candida glabrata CBS 138
MTAANNNTTVFVSGASGFIAQHIIRQLLDQNYKVIGSVRSTEKGDNLKNAIFKSANFNYEIVKDIADLNAFDPVFEKHGKDIKVVLHTASPLNFTTTEYEKDLLIPAVNGTKGILESIKKYAAQTVERVVVTSSFASHTSTVDMCNTKGKITEDSWNQDSWENCQTDAVRAYFGSKKFAEEAAWEFLNKNKDAVKFKLATVDPVYVFGPQNHIEPGKKVLNVSSEVINQLVHLKKDDPLPQVACGYIDVRDIAKAHILAFQKDELIGQRLLLHSGLFTVQTLLDAINEQFPELRGKIPAGEPGSNKPEDLLTPIDNTKTKKLLGFEFRDLKTIIQDTVSQILEAENASAKL

SEQ ID NO: 72138 - DNA, 1044 bp, Oryza sativa (japonica cultivar-group)
  CDS (1)..(1044)
atgccgactgacgagacagccgcggcggcgccggccaccaccgcgctctccggccatgggtgcaccgtgtgcgtcaccggcgccggcgggttcatcgcgtcgtggctcgtcaagcgcctcctcgagaagggctacaccgtgcgtggcaccgtccggaaccctatggacccgaagaacgaccacctgagagccctggacggcgccggcgagcgcctcgtcctcctccgcgccgacctcctcgaccccgacagcctcgtcgccgccttcaccggctgcgagggcgtcttccacgctgcctcccccgtcaccgatgatcctgagaagatgatagagccggcgatcagggggacgagatacgtgataacggcggcggccgacaccggcatcaagcgagtggtgttcacgtcctccatcggcactgtctacatgaacccctacagggaccccaacaagcccgtcgacgacacctgctggagtgacctcgaatactgcaagaggacagagaactggtactgctacgcgaagacggtggcggagcagggtgcgtgggaggtggcgcggcggcgtggggtggacctggtcgtagtgaacccggtgctggtgctgggaccgctgctgcaggcgacggtgaacgcgagcacggagcacgtgatgaagtacctgacggggtcggccaagacgtacgtgaacgcagcgcaggcgtacgtccacgtccgcgacgtcgccgaggcgcacgtccgcgtgtacgactgcggcggcgcgcggggccggtacatctgcgccgagagcaccctgcaccgcggcgacctctgccgcgccctcgccaagcttttcccggagtaccccgtcccgagcaggtgcaaggacgaggcggcgccgccggtgaaggggtacctcttctccaaccagcgcctccgtgacctcggcatggacttcgtccccgtccgccagtgcctctacgaaaccgtgcgaagcctccaggacaagggcttgctgccggtgctgccgcccaccgccgacgaccaccaccacccttcctcgtga

SEQ ID NO: 72139 - protein, 347 aa, Oryza sativa (japonica cultivar-group)
MPTDETAAAAPATTALSGHGCTVCVTGAGGFIASWLVKRLLEKGYTVRGTVRNPMDPKNDHLRALDGAGERLVLLRADLLDPDSLVAAFTGCEGVFHAASPVTDDPEKMIEPAIRGTRYVITAAADTGIKRVVFTSSIGTVYMNPYRDPNKPVDDTCWSDLEYCKRTENWYCYAKTVAEQGAWEVARRRGVDLVVVNPVLVLGPLLQATVNASTEHVMKYLTGSAKTYVNAAQAYVHVRDVAEAHVRVYDCGGARGRYICAESTLHRGDLCRALAKLFPEYPVPSRCKDEAAPPVKGYLFSNQRLRDLGMDFVPVRQCLYETVRSLQDKGLLPVLPPTADDHHHPSS

SEQ ID NO: 72140 - DNA, 1080 bp, Kluyveromyces lactis NRRL Y-1140
  CDS (1)..(1080)
atgtctgcaaaggttttattgacaggtgcttcaggttttattgcgctgcatgttttagatcagctgctagctgctggttatgaagtcgttggtacagttcgttctgaagaaaaagctgagccaattaagaaggaattggctaaggaacacccaaatggtaagtaccaattcgaagtcgttgttgatatcgcagctccaaacgctttcgatgctgttttccaaaagcacactgacttgaaatacgtcctgcacactgcttctccattctcgtttggtttgacaaagagcaacgaagaaaactacttgattccggccactcacggtaccaagtctgtccttgagtctattcaaaaatacggtaagaacgtcgaacatgtaattgttacatcttcctatgcagctatcatgcgcttagatcatgccggtgacccaaatttcattcatgatgaaacttcttggaatcctatcacctgggaagaagctcgtgaaaactccgttactgcatacattgcttctaagaaatatgccgaaaagttggcctgggattttgtaaaggacaacaattctacattcaatttgactacagtgaaccctccatacgttttcggtccacaaaaattcactttcggtttggctaagtcttccttgaatacctctgctgatatcgttaatcaagccttgaagacaactccagaatatgaaggcccatttaaccagccagctggtcttgcttgtgatgtccgtgatgtcgccaagttacatgtcttgccattgggtaagaaagaattcaatggtcaaagactattcccggtcagtgacactggatatggaattgaggaatacgaaaaaggtaagttcaacttcgaaaagatcctacgtattttgaacgaaaagttgcctgaattgaagggtaagatttctccaggcggcatcaaggataatgaagctgaattagcgaaattggactactacagaaacaagactacaacagatttgactaagctaacgttctacaagtttgaagatactgtctatgatgccacaaagcaaatcttagattacgaagcctctcaaaagtaa

SEQ ID NO: 72141 - protein, 359 aa, Kluyveromyces lactis NRRL Y-1140
MSAKVLLTGASGFIALHVLDQLLAAGYEVVGTVRSEEKAEPIKKELAKEHPNGKYQFEVVVDIAAPNAFDAVFQKHTDLKYVLHTASPFSFGLTKSNEENYLIPATHGTKSVLESIQKYGKNVEHVIVTSSYAAIMRLDHAGDPNFIHDETSWNPITWEEARENSVTAYIASKKYAEKLAWDFVKDNNSTFNLTTVNPPYVFGPQKFTFGLAKSSLNTSADIVNQALKTTPEYEGPFNQPAGLACDVRDVAKLHVLPLGKKEFNGQRLFPVSDTGYGIEEYEKGKFNFEKILRILNEKLPELKGKISPGGIKDNEAELAKLDYYRNKTTTDLTKLTFYKFEDTVYDATKQILDYEASQK

SEQ ID NO: 72142 - DNA, 1080 bp, Kluyveromyces lactis NRRL Y-1140
  CDS (1)..(1080)
atgtctgctaaagttttattgacaggtgcgtcaggtttcatagcgttgcatgttttagatcagctgctagctgctggttatgaagtcgttggtacagttcgttctgaagaaaaagctgagccaattaagaaggaattggctaaggaacacccaaatggtaagtaccaattcgaagtcgttgttgatatcgcagctccaaacgctttcgatgctgttttccaaaagcacactgacttgaaatacgtcctgcacactgcttctccattctcgtttggtttgacaaagagcaacgaagaaaactacttgattccggccactcacggtaccaagtctgtccttgagtctattcaaaaatacggtaagaacgtcgaacatgtagtagttacttcttcctttgcagccattgtacacagacaccgctctggtgacccaactttcatcaatgatgaaactacttggaacccggtcatttgggaagacgctcgtgaagatgccgctacttcatatgttgcttctaagaaatatgccgaaaagttggcctgggatttcgtgaaggacaacaattctacattcaatttgactacagtgaaccctccatacgttttcggtccacaaaaattcactttcggtttagctagggcttccttaaacacctctgctgacttcgtcaacaaggccttgaagacaactccagaatatgaaggcccatttaaccagccagctggtgttgcttgtgatgtccgtgatgtcgccaagttacatgtcttgccattgggtaagaaagaattcaatggtcaaagactattcccggtcagtgacactggatatggaattgaggaatacgaaaaaggtaagttcaacttcgaaaagatcctacgtattttgaacgaaaagttgcctgaattgaagggtaagatctctccaggcggcatcaaggataatgaagctgaattatcgaaattgacctactacagaaataagatcaccacggattcaaccaagctaacgttctataagcttgaagatactatctatgatgcggcaaagcaaatcttggattatgaagcttctcaaaaataa

SEQ ID NO: 72143 - protein, 359 aa, Kluyveromyces lactis NRRL Y-1140
MSAKVLLTGASGFIALHVLDQLLAAGYEVVGTVRSEEKAEPIKKELAKEHPNGKYQFEVVVDIAAPNAFDAVFQKHTDLKYVLHTASPFSFGLTKSNEENYLIPATHGTKSVLESIQKYGKNVEHVVVTSSFAAIVHRHRSGDPTFINDETTWNPVIWEDAREDAATSYVASKKYAEKLAWDFVKDNNSTFNLTTVNPPYVFGPQKFTFGLARASLNTSADFVNKALKTTPEYEGPFNQPAGVACDVRDVAKLHVLPLGKKEFNGQRLFPVSDTGYGIEEYEKGKFNFEKILRILNEKLPELKGKISPGGIKDNEAELSKLTYYRNKITTDSTKLTFYKLEDTIYDAAKQILDYEASQK

SEQ ID NO: 72144 - DNA, 1014 bp, Debaryomyces hansenii CBS767
  CDS (1)..(1014)
atgacttcagtattcgtttcaggcgctacaggatacattgcacaacatattgtgaaaacattgctcgaaaaaaattataaagtggtaggatctgtgagatctacagaaaagggagaaaagttgaagaagctcttacagtcagccaacttcaactacgaagttgttaatgatattcagaaagaggggagctttaatgacgcattaaaacatcacccagaagtgacagttttcttacacacagcatccccattccatttcaaagctaaggacgtggagaaggagttgttgatccctgcggtcaacgggaccaagaatgcgttgaaggctattaaagactacgcaccgcaggtcaagagggtagttgtaacatcgtcgattgccgctatcaaggttgaggcaaaggaaaacgacagtacgtttgtaacaaccgaggaaacatggaatccaatctcatgggaagaggcactcactaatccagttttagggtaccgtggatctaaaacgtttgcggaaaaagcggcatgggagttcgttgaaatggaaaagcccctgttcatattgtcaacagtcaatccggtgattgtgtttggcccacaggcattcgacagtgaagtcaaagaaacattgaatacttcggcagaaattataaacaacttattgaagttgaaaccagatgatccagttcctcctctgaataatgcgtttatcgatgttcgcgacgttgccaaggcacacgtggtggcatttgagaatgaatatgccgctaaccagagattgttgcttagtgagtccaggtactcatcgcaactagtattggatcttatccacaagaacttccccgagttcaagtcgcggattccccttggaaccccaggtgtctatcccgacacctccaagctctccaagactgacaattccaaaaccaaggccatcgttggcttcccattcattcctctcgaaaaatctgtggtagatactgttctgcagatcgtggcagctgagaaacaccaatga

SEQ ID NO: 72145 - protein, 337 aa, Debaryomyces hansenii CBS767
MTSVFVSGATGYIAQHIVKTLLEKNYKVVGSVRSTEKGEKLKKLLQSANFNYEVVNDIQKEGSFNDALKHHPEVTVFLHTASPFHFKAKDVEKELLIPAVNGTKNALKAIKDYAPQVKRVVVTSSIAAIKVEAKENDSTFVTTEETWNPISWEEALTNPVLGYRGSKTFAEKAAWEFVEMEKPLFILSTVNPVIVFGPQAFDSEVKETLNTSAEIINNLLKLKPDDPVPPLNNAFIDVRDVAKAHVVAFENEYAANQRLLLSESRYSSQLVLDLIHKNFPEFKSRIPLGTPGVYPDTSKLSKTDNSKTKAIVGFPFIPLEKSVVDTVLQIVAAEKHQ

SEQ ID NO: 72146 - DNA, 1023 bp, Debaryomyces hansenii CBS767
  CDS (1)..(1023)
atgacaagaaccgtatttgtttcaggagcttctggatttatcgcccagaatatcgtcaagttattaatcgagaagggttataatgttattggaacggtaagaaccgctgagaaaggtgagaatttgaaaaagtgcttagctagtgaaaaattcacatatgaaatcgttccagatattagtgttgaaggtgcatttgataaggttttggaaaagcattctgagattaatgttttattgcataccgcttctccgtttttttacgacactactgatccagaaaatgatttggttcttccggctatcaacggtaccaagaacatattaaaggccgtaaagcaatacggagcacagattgaaagggttgtcatcacatcttcagatgctgcaatctactccgcagatgatgagcaaaattccgacctttcattcaacgaaagtaattggaacagcatttcttatgaggatgccattaaagatccgatcgcggcctattatggagcaaagacttttgctgaaaaagcggcgtgggacttcgttaaagaaaacaactccaatttcaagttgactgctgtcaatccagtctatgtttttggaccacaagcgtttgcaagtgaagttaagggcaagttaaatacttccaacgagttaattaatacattaatcaagttgggtccttctgatttatttgataacgataaaggggggttcattgatgtaagagatgttgctaaagcccatgtgatggcttttgaaagtgaggataccattaacaagagactttatttaactaatggccattttagtacccaaatgatgttagacatcgtgaacaaaaatttcccagaattgaagggtaaaattccaattggaaatcctggaacgggatctcaggatattctgactttagcgaagatgagcaatgatgcaaccagacaaattttaaattttgattttaattctttagaaaaggttgttgccgatactgttgcacaaattttagatgccagaaaacgtactttatag

SEQ ID NO: 72147 - protein, 340 aa, Debaryomyces hansenii CBS767
MTRTVFVSGASGFIAQNIVKLLIEKGYNVIGTVRTAEKGENLKKCLASEKFTYEIVPDISVEGAFDKVLEKHSEINVLLHTASPFFYDTTDPENDLVLPAINGTKNILKAVKQYGAQIERVVITSSDAAIYSADDEQNSDLSFNESNWNSISYEDAIKDPIAAYYGAKTFAEKAAWDFVKENNSNFKLTAVNPVYVFGPQAFASEVKGKLNTSNELINTLIKLGPSDLFDNDKGGFIDVRDVAKAHVMAFESEDTINKRLYLTNGHFSTQMMLDIVNKNFPELKGKIPIGNPGTGSQDILTLAKMSNDATRQILNFDFNSLEKVVADTVAQILDARKRTL

SEQ ID NO: 72148 - DNA, 1017 bp, Oryza sativa (japonica cultivar-group)
  CDS (1)..(1017)
atgtcgtccaattttgaggccaacaacaacaacaatggcgagaagcagctggtctgtgtgaccggagcaggtggcttcattgggtcgtgggtggtgaaggagctcctcatccgtggctaccacgtcaggggaacagccagggatcctgctgacagcaagaatgctcacctgcttgagctggagggagccgacgagaggctctccctctgccgcgccgacgtcctcgacgccgccagcctccgcgccgccttcagcgggtgccacggcgtcttccatgtcgcctccccggtgtctaacgaccctgaccttgttccggttgcagtggaggggacgaggaacgtgatcaacgcagcggcggacatgggcgtgcgccgcgtggtgttcacgtcgtcgtacggcgccgtgcacatgaaccccaaccggagccccgacgccgtcctcgacgagacctgctggagcgactacgaattctgcaagcaaacagacaacctgtactgctgcgccaagatgatggcggagatgacggcgacggaggaggcggcgaagagggggctggagctggcggtggtggtgccgtcgatgacgatgggtcccatgcttcagcagacgctcaacttcagcaccaaccacgtcgcccgctacctcatgggcaccaagaagtcctaccccaacgccgtcgcggcctacgtcgacgtccgcgacgtcgcccgcgcacacgtcctcgtctacgagcgccccgaggcacgcggccgctacctctgcatcggcaccgtgctccaccgcgccgagctcctccggatgctcagggagctcttcccacggtaccctgccactgcaaagtgtgaggatgatgggaagccgatggcgaagccgtataagttctcgaaccagaggctcaaggatttgggtttggagttcactccactgaggaagagtttgaatgaggcggtcctatgcatgcagcagaagggtcacctgcctctgatttatcccgttccaaaacgtgcttacctataa

SEQ ID NO: 72149 - protein, 338 aa, Oryza sativa (japonica cultivar-group)
MSSNFEANNNNNGEKQLVCVTGAGGFIGSWVVKELLIRGYHVRGTARDPADSKNAHLLELEGADERLSLCRADVLDAASLRAAFSGCHGVFHVASPVSNDPDLVPVAVEGTRNVINAAADMGVRRVVFTSSYGAVHMNPNRSPDAVLDETCWSDYEFCKQTDNLYCCAKMMAEMTATEEAAKRGLELAVVVPSMTMGPMLQQTLNFSTNHVARYLMGTKKSYPNAVAAYVDVRDVARAHVLVYERPEARGRYLCIGTVLHRAELLRMLRELFPRYPATAKCEDDGKPMAKPYKFSNQRLKDLGLEFTPLRKSLNEAVLCMQQKGHLPLIYPVPKRAYL

SEQ ID NO: 72150 - DNA, 1014 bp, Oryza sativa (japonica cultivar-group)
  CDS (1)..(1014)
atgtcgtccaattttgaggccaacaacaacaatggcgagaagcagctggtctgtgtgaccggagcaggtggcttcattgggtcgtgggtggtgaaggagctcctcatccgtggctaccacgtcaggggaacagccagagatcctgctgacagcaagaatgctcacctgcttgagctggagggagccgaccagaggctctccctctgccgtgccgacgtcctcgacgccgccagcctccgcgccgccttcagcgggtgccacggcgtcttccatgtcgcctccccggtgtccaacgaccctgacctggttccggttgcagtggaggggacgaggaacgtgatcaacgcggcggcggacatgggcgtgcggcgcgtggtgttcacgtcgtcctacggcgccgtgcacatgaaccccagcaggagccccgacgccgtcctcgacgagacctgctggagcgactacgaattctgccgccaaaccgacaacctgtactgctgcgccaagatgatggcagagatgacggcgacggaggaggcggcgaagagggggctggagctggcggtggtggtgccgtcgatgacgatgggtcccatgctgcagcagacgctcaacttcagcagcaaccacgtcgcccgctacctcatgggcaccaagaagtcgtaccccaacgccgtcgccgcctacgtcgacgtccgcgacgtcgcccgcgcgcacgtcctcgtctacgagcgccccgacgcacgcggccgctacctctgcatcggcaccgtgctccaccgcgccgagctcctccggatgctcagggacctcttcccccagtaccctgccactgcaaagtgtgaagatgacgggaagccgatggcgaagccgtacaagttctcgaaccagaggctcaaggatttggggttggaattcactccactgaggaagagtttgcatgaggcggtcttatgcatgcagcagaagagtcacctgcctctgatttatcccgttccaaaacgtgcttacctataa

SEQ ID NO: 72151 - protein, 337 aa, Oryza sativa (japonica cultivar-group)
MSSNFEANNNNGEKQLVCVTGAGGFIGSWVVKELLIRGYHVRGTARDPADSKNAHLLELEGADQRLSLCRADVLDAASLRAAFSGCHGVFHVASPVSNDPDLVPVAVEGTRNVINAAADMGVRRVVFTSSYGAVHMNPSRSPDAVLDETCWSDYEFCRQTDNLYCCAKMMAEMTATEEAAKRGLELAVVVPSMTMGPMLQQTLNFSSNHVARYLMGTKKSYPNAVAAYVDVRDVARAHVLVYERPDARGRYLCIGTVLHRAELLRMLRDLFPQYPATAKCEDDGKPMAKPYKFSNQRLKDLGLEFTPLRKSLHEAVLCMQQKSHLPLIYPVPKRAYL

SEQ ID NO: 72152 - DNA, 1065 bp, Oryza sativa (japonica cultivar-group)
  CDS (1)..(1065)
atgtcgtgcaattctgccgaggtcgcggccaacgacggcagcagcaatggcggtgagaagcagcagcagcaggaggaggaggtggtgtgcgtgacgggagcgggaggcttcatcggatcatgggtggtgaaggagcacctcctccgtggctaccgcgtcaggggaacagccagggatcccaccaagaacgcccacctgctcgcgctcgacggagccggcgagaggctcaccctgtgccgcgccgacgtcctggactccgagagcctgcgcgccgcgttcgccggatgccatggcgtcttccacgtcgcctccccggtgtccaatgaccctaatctggtgccgatcgcggtggaggggacgaggaacgtggtgaacgcggcggcggacatgggcgtgcggcgcgtggtgttcacgtcgtcgtacggcgccgtgcacatgaaccccaaccggagccccgacaccgtcctcgacgagacctgctggagcgaccccaaattctgccgccaaaccgacgtatactgctacgcgaagacgatggcggagaaggcggcggaggaggaggcggcaaagcgaggcgtgcagctggcggtggtgctgccctgcgtgacggtcgggccaatcttgcacccggccatcaacaccagcatcaaccacgtcgtccgctacctcacgggcgccgcgcccacctacccgaacgccgtcgcggcctacgtcgacgtccgcgacgtcgcccgcgcgcacgcactcgtctacgagcgccacgacgcccgcggccgctacctctgcatcggcgccgtgctccaccgcgcccatctcctccagatgctcaaggaacttttcccacagtaccccgtcacttccaagtgcaaggacgatgggaatccgatggtggaaccgtacaagttctcgaaccagaggctcaaggatttgggcttcgaattcacaccaatgaggaagtgtctgtatgacgcagtcgtatgcatgcaacagaaggggcacctcccgctggttggtaccgccgtaccggaccaaaatgtgacctctaatacgagctcgatcgtctaa

SEQ ID NO: 72153 - protein, 354 aa, Oryza sativa (japonica cultivar-group)
MSCNSAEVAANDGSSNGGEKQQQQEEEVVCVTGAGGFIGSWVVKEHLLRGYRVRGTARDPTKNAHLLALDGAGERLTLCRADVLDSESLRAAFAGCHGVFHVASPVSNDPNLVPIAVEGTRNVVNAAADMGVRRVVFTSSYGAVHMNPNRSPDTVLDETCWSDPKFCRQTDVYCYAKTMAEKAAEEEAAKRGVQLAVVLPCVTVGPILHPAINTSINHVVRYLTGAAPTYPNAVAAYVDVRDVARAHALVYERHDARGRYLCIGAVLHRAHLLQMLKELFPQYPVTSKCKDDGNPMVEPYKFSNQRLKDLGFEFTPMRKCLYDAVVCMQQKGHLPLVGTAVPDQNVTSNTSSIV

SEQ ID NO: 72154 - DNA, 1020 bp, Oryza sativa (japonica cultivar-group)
  CDS (1)..(1020)
atgtcgtccaacaattccatggaggccaacaatggcgatgatgagaagaagcaagagcaggtggtgtgcgtgacgggagcgggaggcttcatcgggtcgtgggtggtgaaggagctcctcctccgcggctaccgcgtgaggggaacagccagggatccccgcaagaacgcccacctgcttgatcttgagggagccaaggagaggctgacactgtgccgcgccgacgtcctggacttcgccagcctacgcgccgcgttcgccgggtgccatggcgtcttccacatcgcctccccggtgtccaaggaccctaatctggtgccggtcgcgattgaggggacgaggaacgtgatgaaggcggcggcggacatgggcgtgcggcgcgtggtgttcacgtcgtcgtacggcgccgtgcacatgaaccccaaccggagccccgacgccgtcctcgacgagtcctgctggagcgaccccgaattctgccagcgagaggacatatactgctacgccaagatgatggcggagaagacggcgacggaggaggcgtcgaggcgtcggctgcagctcgcggtggtggtgccgtgcgtgacggtgggtcccatcctgcagccgtccgtcaacttcagctgccaccacgtcgtccgctacctcaccggcgccgcggccacctaccccaacgccgtcgccgcctacgccgacgtccgcgacgtcgcccgcgcccacgtcctcgtctacgagcaccacggcgcgcgcggccgctacctctgcatcggcaccgtcatccaccgcgccgagctcctccggatgctcaaggagctcttcccccagtaccccgtcacttcaaagtgtgaggatgaggggaatcagatggtgaagccgtacaagttctcgaaccagaggctcagggatttgggtttggagtttactccactgaggaagagcttgcatgaggcgatcgaatgtctgcagcgcaagggtcacctgcctgttgtcacggtggcacaacagcgtgcatgtttgtag

SEQ ID NO: 72155 - protein, 339 aa, Oryza sativa (japonica cultivar-group)
MSSNNSMEANNGDDEKKQEQVVCVTGAGGFIGSWVVKELLLRGYRVRGTARDPRKNAHLLDLEGAKERLTLCRADVLDFASLRAAFAGCHGVFHIASPVSKDPNLVPVAIEGTRNVMKAAADMGVRRVVFTSSYGAVHMNPNRSPDAVLDESCWSDPEFCQREDIYCYAKMMAEKTATEEASRRRLQLAVVVPCVTVGPILQPSVNFSCHHVVRYLTGAAATYPNAVAAYADVRDVARAHVLVYEHHGARGRYLCIGTVIHRAELLRMLKELFPQYPVTSKCEDEGNQMVKPYKFSNQRLRDLGLEFTPLRKSLHEAIECLQRKGHLPVVTVAQQRACL

SEQ ID NO: 72156 - DNA, 1020 bp, Oryza sativa (japonica cultivar-group)
  CDS (1)..(1020)
atgtcgtccatttccaacgacaacaatggtgatcagaagcgacagcagcagcagcagctggtgtgcgtgaccggagcaggtggcttcatcgggtcatgggtggtgcgggagctcctcctccgtggctaccgcgtcagggccaccgtcagggaccccgcggaccgcaagaacgcccacctgctcgcgctggagggagcccacgagaggctctccctgcgccgcgccgatgtcctcgacttcgccggcctcctcgccgcgttcgccgggtgccatggcgtcttccacgtcgcctgcccgctgtccaaccgcgatccagagctgatggcggtcgcggtggatgggacgaggaacgtgatgaacgcggcggcggacatgggcgtgcggcgcgtggtgttcacgtcgtcctacggcgccgtgcacatgaaccccaaccggagccccgacgccgtcctcgacgagtcctgctggagcgaccccgaattctgccggcaaaaagacgtcagtctattacacatgtactgctacgcaaagacgatggcggagatggcggcgacggaggaggcggcgaagagggggctggagctggcggtggtggtgccgtcgatgacgatgggccccatgctgcagcgtgcgctcaacctcagcagcacgcacgtcgccaactacctcaccggcgccaagaagtcgtacccgaacgccgtcgcggcctacgtcgacgtccgcgacgtcgcccgcgcgcacgccctcgtctacgagcgccacgacgcgcgcggccgctacctctgcatcggcgccgtgctgcaccgcgcccagctcctccagatgctcatggacctcttcccccagtacaccatcgcttcaaagtgtgatgacaaggggaagccgatggtgaagccgtatgagttttcgaaccagaggctcaaggatttgggcttggaattcaccccgttgaggaagagtttgtacgacgcagtcatgtgcatgcaacgaaacggtcacctgcctgtcgtcttgccatag

SEQ ID NO: 72157 - protein, 339 aa, Oryza sativa (japonica cultivar-group)
MSSISNDNNGDQKRQQQQQLVCVTGAGGFIGSWVVRELLLRGYRVRATVRDPADRKNAHLLALEGAHERLSLRRADVLDFAGLLAAFAGCHGVFHVACPLSNRDPELMAVAVDGTRNVMNAAADMGVRRVVFTSSYGAVHMNPNRSPDAVLDESCWSDPEFCRQKDVSLLHMYCYAKTMAEMAATEEAAKRGLELAVVVPSMTMGPMLQRALNLSSTHVANYLTGAKKSYPNAVAAYVDVRDVARAHALVYERHDARGRYLCIGAVLHRAQLLQMLMDLFPQYTIASKCDDKGKPMVKPYEFSNQRLKDLGLEFTPLRKSLYDAVMCMQRNGHLPVVLP

SEQ ID NO: 72158 - DNA, 1008 bp, Oryza sativa (japonica cultivar-group)
  CDS (1)..(1008)
atgagccgggtgtgcgtcaccggagccgccggctacattgcgacatggctcgtcaagaagctcctcggcagaggctgcgtcgtccatgcaaccctgcgagatctcggggatgagaagaagacggcgctgctgaggaggatgcccggcgcggcggagcggctggtgctgttcgaggcggacatgtacgacgccgccaccttcgagcccgccatcgccggctgcgagttcgtcttcctcatcgccaccccgctgcagcacgaccccagcagcaccaagtacaagaacaacacggaagcggccgtggacgcgatgcgcgtcatcctgcagcagtgcgagcgatccaggacagtgcgccgtgtcatccacacggcctccgtcaccgccgcctcgccgctccgggaggacggcagcggcggctacaaggacttcatcaacgagtccttctggtctccactcaacctcacctacgacttcaccaatgctcatctggacggttatgtgtcatccaagtcgctctccgagaaggagctcctgagctacaactcctctccatcgccggcgttcgaggtggtcaccttggcgtgcgcggtcgtcggcggcgacacgctccagccgtacctgtggagcaccatcccggtgatcatgtcgccgctcaccggcgacgagctctgccacaacgtcctcaagtttctgcaggcgctgctgggctccgtgccgctggtgcacatcgacgacgtctgcgacgcgcacgtcttctgcatggatcagccgtccatcgccggccgcttcctctgcgccgccgggtaccccaacatgaaggactacatcgaccgcttcgccgctaagtacccagagatcgagatcaagctcaaagaggtcattggggagggggtgagggtgcaagctgacaccaagaagcttgtagatttagggttcaagtataagtatggggtggaggagacgctggattgcagtgtggaatgcgcgaagaggttgggagaactctga

SEQ ID NO: 72159 - protein, 335 aa, Oryza sativa (japonica cultivar-group)
MSRVCVTGAAGYIATWLVKKLLGRGCVVHATLRDLGDEKKTALLRRMPGAAERLVLFEADMYDAATFEPAIAGCEFVFLIATPLQHDPSSTKYKNNTEAAVDAMRVILQQCERSRTVRRVIHTASVTAASPLREDGSGGYKDFINESFWSPLNLTYDFTNAHLDGYVSSKSLSEKELLSYNSSPSPAFEVVTLACAVVGGDTLQPYLWSTIPVIMSPLTGDELCHNVLKFLQALLGSVPLVHIDDVCDAHVFCMDQPSIAGRFLCAAGYPNMKDYIDRFAAKYPEIEIKLKEVIGEGVRVQADTKKLVDLGFKYKYGVEETLDCSVECAKRLGEL

SEQ ID NO: 72160 - DNA, 1029 bp, Oryza sativa (japonica cultivar-group)
  CDS (1)..(1029)
atgggtgtcgagaagacgacggcgaacggcggcagtggcgccgcggcggtctccggcggagggcgcaccgtctgcgtcaccggcgccggcgggttcatcgcgtcgtggctcgtcaagctcctcctcgagaagggctacgccgtccgcggcaccgttcggaaccctgatgacgctgccaagaacgcgcatctcatggcgctggccggtgccgcggagcggctgaccctcgtccgggcggagctgctcgacaaggagagcctcgccgccgcgttcgccggctgcgagggcgtcttccacaccgcctcccccatcaccgacgacccggagaagatgatcgagccggcggtgagcggggcgaggaacgtgatcaccgcggcggcggacgcgggcggcgtccgccgcgtggtgatgacgtcgtcgatcggcgccgtgtacatgggcggcggcggcggcgaggaggtggacgagacgtgctggagcgacctcgaccactgcagggacaccggaaactggtactgctacgccaagacggtggcggagcaggcggcgtgggagctcgccaaggagcggcggctggacctcgtcgtcgtcaacccgtcgctggtgctcggcccgctgctgcagcgcggggtgaacgccagcacgtggcacgtgctcaagtacctggacggctcggcgcgcacctacgccgacgcggcgcaggcgtacgtgcacgtccgcgacgtcgcggacgcgcacgcgcgcgcctacgagtcccccgccgcgcgcggccgctacctctgcgccggccgcacgctgcaccgcggcgaggtgtgccgcatcctggccgccctcttcccggggtacccggtgcccaccaggtgcaagggcgacgccggcgagacggccgaggggtgccggttcagcagccgcaagctggcggagctcggtgtcgccgtcatgccggcgagccagtgcctgtacgacaccgtcgtcagcctccaggacaagggcctgcttcccttcgtccctgccgccgccatgccgtga

SEQ ID NO: 72161 - protein, 342 aa, Oryza sativa (japonica cultivar-group)
MGVEKTTANGGSGAAAVSGGGRTVCVTGAGGFIASWLVKLLLEKGYAVRGTVRNPDDAAKNAHLMALAGAAERLTLVRAELLDKESLAAAFAGCEGVFHTASPITDDPEKMIEPAVSGARNVITAAADAGGVRRVVMTSSIGAVYMGGGGGEEVDETCWSDLDHCRDTGNWYCYAKTVAEQAAWELAKERRLDLVVVNPSLVLGPLLQRGVNASTWHVLKYLDGSARTYADAAQAYVHVRDVADAHARAYESPAARGRYLCAGRTLHRGEVCRILAALFPGYPVPTRCKGDAGETAEGCRFSSRKLAELGVAVMPASQCLYDTVVSLQDKGLLPFVPAAAMP

SEQ ID NO: 72162 - DNA, 1086 bp, Oryza sativa (japonica cultivar-group)
  CDS (1)..(1086)
atggagaacactaccaagggcaaggtgtgtgtcactggggcttctggctatgttgcctcttggcttgtgaagcgacttcttgagtcagggtatcatgttcttgggacagtcagagacccaggcaatcacaagaaagtagggcacctgtggaatttaacaggtgcaaaggaaaggctggagcttgtgagagctgacctcttggaagaagggagctttgatgatgctgtgatggcttgtgagggtgtcttccatactgcatcacctgtcatcaccgaaactgactccagcaaggcatgctacactaactgtgaagaccactttcaccctgcaattatgcgactctcctttttatcttggaattcagatttaagatgccatctggttgcagcagtgcttgattcagcgataaacggcaccctgaacgttctgagatcatgcaagaagaacccatccctcaagagggtagtcctcacctcttcatcatcaaccgtgaggctcaaagatgaagctgatctgccacccaacgtgttgctggatgagacatcatggagctccatggagttctgcgagagtctccagatatggtacgccattgccaagacacttgcagagaaggcagcctgggagttcgccaaggagaacggcatcgaccttgtggctgttcttccaaccttcgtggttggacccaatctgtctcatgaattaagtcccactaccaccgatgtcctcggcctattccaaggtgagacaacgaagttcaccatgtacgggaggatggggtacgtccacatcgacgatgtcgcgagctgccacatcctgctctacgagacaccccgtgcagccgggaggtacatctgcaactcggctgtcctggacgtcaacgaactggtcaccttgctcgctaggcgattcccttcgtaccccatcccaaagagtttgccgtgcgtttacggggagcagacttatggtttcagcacggccaaggtgagggagctgggcatgaagttcagagatgtggaggagatgttcgacgacgccgtcgactcgctcagagctcacggctacctgctgaacagcgtaccatga

SEQ ID NO: 72163 - protein, 361 aa, Oryza sativa (japonica cultivar-group)
MENTTKGKVCVTGASGYVASWLVKRLLESGYHVLGTVRDPGNHKKVGHLWNLTGAKERLELVRADLLEEGSFDDAVMACEGVFHTASPVITETDSSKACYTNCEDHFHPAIMRLSFLSWNSDLRCHLVAAVLDSAINGTLNVLRSCKKNPSLKRVVLTSSSSTVRLKDEADLPPNVLLDETSWSSMEFCESLQIWYAIAKTLAEKAAWEFAKENGIDLVAVLPTFVVGPNLSHELSPTTTDVLGLFQGETTKFTMYGRMGYVHIDDVASCHILLYETPRAAGRYICNSAVLDVNELVTLLARRFPSYPIPKSLPCVYGEQTYGFSTAKVRELGMKFRDVEEMFDDAVDSLRAHGYLLNSVP

SEQ ID NO: 72164 - DNA, 1041 bp, Yarrowia lipolytica CLIB122
  CDS (1)..(1041)
atgtcaaccattctcgtcaccggagccaccgggtttattgctggtcaggtcattgcagatctcctgaatcacgggcacaaggtcttgggcaccgtgcgccagctcagcaaggcctccaagctccaggaggcgtttcctgaagcccacaagtccggcaagctgacttttgccacgctttccgatgttcgaagccaggacgagctcaaggcgatttttgcctcacaccccgaaattgcggttgtgatgcacacggcatcgccgtttttctacaactccgaggacgtggtcaaagacctgctggagccggcgctcgagggcacccgttcggtgctccaggtaacccaagacgccggccacaacgtgcacaaggtggtgctgacatcctcggtggcctccatgctcgacccgttcagaaacaaggaccccagctacgtggcaacggaggctacatggaaccccgtcacgtgggaccaggctgctgagtcaaacaacgccgaactggcctacgtagcctccaagacatttgccgagcaggaggcgtggaagttcgtcgagagcaccaagccgcgcttttcgctgactacagtcaaccctgcggcggtgtttggaccccatgcgaccaaaatcgaccccaaggcgctcaacacgtccagcgacgtcatcaacagcctggctctggacaccaagcctggagacacgccgggagactttgcgtttttgtgggttgacgtgcgaaacgtggcccgggcccatacgttggctatcgactccaagctcgacgacaagcggctgctcctgtgcaacggcaagtttgcggcccaggacttggttgatattctcaacaagaacttttccgacattcgaggcacaattgcggaaggtactcccgggaacggaccccgagtcgccgcccagtactttaactacgacaactccaatacccgccagttgctggatttgcagtggattgggctcgagcagtcgattgtggactttaccaagcagtacgaggctgcgaaatcggaatcacgagctgattga

SEQ ID NO: 72165 - protein, 346 aa, Yarrowia lipolytica CLIB122
MSTILVTGATGFIAGQVIADLLNHGHKVLGTVRQLSKASKLQEAFPEAHKSGKLTFATLSDVRSQDELKAIFASHPEIAVVMHTASPFFYNSEDVVKDLLEPALEGTRSVLQVTQDAGHNVHKVVLTSSVASMLDPFRNKDPSYVATEATWNPVTWDQAAESNNAELAYVASKTFAEQEAWKFVESTKPRFSLTTVNPAAVFGPHATKIDPKALNTSSDVINSLALDTKPGDTPGDFAFLWVDVRNVARAHTLAIDSKLDDKRLLLCNGKFAAQDLVDILNKNFSDIRGTIAEGTPGNGPRVAAQYFNYDNSNTRQLLDLQWIGLEQSIVDFTKQYEAAKSESRAD

SEQ ID NO: 72166 - DNA, 1017 bp, Yarrowia lipolytica CLIB122
  CDS (1)..(1017)
atgcccactacactcgtcactggagccaccggatttcttgccggccactgcgtcgaccaactgctcaaggccggccacaatgtcattggcacggttcgaaaccctgcaaaggccgagcgactgacacaggctctgcagagctctgtggactcgggaaaactcaccctggagaccgtcaaggatatccagaacgaggccgagtttgaggcactgttcaagaagcaccccaagcttgactacattcttcatacggcctctccgttcaacttcactgccgaggaccccgaggaagaaatgctcaagccggcaattcagggtactctctccgtgctcaagaccgctaaggcccatgctcccaacgtaaagaagattgtcatcacctcttctgtggccagcaacctcgatgttgccaccttctacgaccctaacaccacttacaccgagaagagctggaaccccatgacctgggagcaagcggctgagaagggcaacccgttcgccaactacatgggctccaagctgtatgctgagaaggccggcattgagttccgtgacaaggagaagccccagttctccataacctggatcaaccccacctacattctggggcccggtgttgctctcgacatgagcgctctcaacacctcgaacgaggtccttgcaaacgttctcgggtccaagaagggccaggaccccgagggagttgccggctggtttgtcgatgtccgagactgtgctcgggcccacgttgttgctctcaagcccgagcttgacggagaacgactcctgctggccaccgccaagttctgcacccaggacattgaggatatcgccaacaagatccccgagttccatggcaagattgcaattggaaaccccgccaaccgggagaaggagctaaaccacgcttcccagtgcgacgctagctactccaagaagctgcttgatatcgactggattcccttcaacaagactgtcgaggattttgccaaccagtggtacgagcagcataagtag

SEQ ID NO: 72167 - protein, 338 aa, Yarrowia lipolytica CLIB122
MPTTLVTGATGFLAGHCVDQLLKAGHNVIGTVRNPAKAERLTQALQSSVDSGKLTLETVKDIQNEAEFEALFKKHPKLDYILHTASPFNFTAEDPEEEMLKPAIQGTLSVLKTAKAHAPNVKKIVITSSVASNLDVATFYDPNTTYTEKSWNPMTWEQAAEKGNPFANYMGSKLYAEKAGIEFRDKEKPQFSITWINPTYILGPGVALDMSALNTSNEVLANVLGSKKGQDPEGVAGWFVDVRDCARAHVVALKPELDGERLLLATAKFCTQDIEDIANKIPEFHGKIAIGNPANREKELNHASQCDASYSKKLLDIDWIPFNKTVEDFANQWYEQHK

SEQ ID NO: 72168 - DNA, 1035 bp, Yarrowia lipolytica CLIB122
  CDS (1)..(1035)
atgtctactacacccaccactctcatcactggagccactggcttcattgccggccattgcatcgagcagcttctgaaggccgaccacaaggtcattggaacgattcgatcgcaggagaagggccagcgattggccgctgctttccccgaggccatcaagaccggccagctggtgtttgagactgtttccgatgtccgatccgagcaggagttcaagactctgttccagaagcacactgacatcaagtatgtgctccacaccgcctctcccttccatttcaacgtcgaggaccccgtcaaggatatgcttgagcctgcggttgagggtactctgaccgtcctcaagaccgccaagcagtacgctccccaggttgagaagttcgtcatcacttcgtctttcgccgccatgatgaactggcacgaggttggcgactcctccgccgtcgtcaccgagaagtcctggaaccccgtcacttgggacgaggctgcccagaagggcaatgttgtcgtaacctacctgggctccaagaagttcgccgagaaggccgcttgggatttcatggagtctgagaagccctcctttggcctcaccactgtcaaccctgcctacgtctttggtcctggtattgctattgatgccaaggctctcaacacctccaacgaggtcattgtccagggagctctctctaccaagcctggtcaggatgctcctgctggccctgcccagatgtgggttgacgtgcgagacgtggccaaggcccacctgtctgccatctccaagaccctagacaaccagcgtctcatgctgtgcgtgtccaagttctgtaaccaggatctccttgacgtgatcaacgagaaggtgcctgagctcaagggaaagattgctaccggaaagcctggaaccggagctgaaactgacaaggagggctttcagtttgataacgaccagacacgaaaggctctcaactacgactggattccccttgacaagtctgtggctgactttgctaaccaatggctgtcgttccagaactaa

SEQ ID NO: 72169 - protein, 344 aa, Yarrowia lipolytica CLIB122
MSTTPTTLITGATGFIAGHCIEQLLKADHKVIGTIRSQEKGQRLAAAFPEAIKTGQLVFETVSDVRSEQEFKTLFQKHTDIKYVLHTASPFHFNVEDPVKDMLEPAVEGTLTVLKTAKQYAPQVEKFVITSSFAAMMNWHEVGDSSAVVTEKSWNPVTWDEAAQKGNVVVTYLGSKKFAEKAAWDFMESEKPSFGLTTVNPAYVFGPGIAIDAKALNTSNEVIVQGALSTKPGQDAPAGPAQMWVDVRDVAKAHLSAISKTLDNQRLMLCVSKFCNQDLLDVINEKVPELKGKIATGKPGTGAETDKEGFQFDNDQTRKALNYDWIPLDKSVADFANQWLSFQN

SEQ ID NO: 72170 - DNA, 1002 bp, Yarrowia lipolytica CLIB122
  CDS (1)..(1002)
atgcccactactcttgttaccggagccaccggctttcttgccggccactgcgtcgaccagctcctcaaggacggccataccgttattggcacagttcgaaacccttccaaggctgagcgacttgccgaggcgttcaagagtgaagttgagagtggcaaactcgaactggagactctcaaggacatccagaacgaggatgagttcgaggccatcttcaagaagcaccctgagattgactacattctccacactgcctcacctcttagtttcaatgtgactgatcctgagaaggacatgttgcagccagccattcgaggcaccacagccgtgctgaaacaggccaaggcacacgctcccaacgtcaagaaggtcgtcatcacctcgtccattgctgcaatgatgaacccggatcctagccacgtccacaacgagcacagctggaaccccatgaccagagagcaggccgcccagaagggcaaccccgtggccaactacgtgggatccaagatttttgccgaaaaggccgggctggagtttctgaacgacgaaaagcccaacttctccatcacttggatcaacccagcctacattctggggcctggcatcactcttgatctgggagccatcaacgcctccaaccagctcatttccagcgtgctggagtccaagcttggcgaggaggtcaaggtgcagagcggctcgtttgtcgacgtccgggactgtgccagagcccatgtcgtggctctccagcctaagtttgacagaaagcgtctcatgctgtgcacagccaaggtgtgcacccaggacattgaggacatttgcaacaagatccccgagctcaagggcaaaattgctgttggaactcctggtgagcgagaaaagcagctgagtaagtcgatcatggatccttccgaaaccaagaagctgttggactttgagtggattccccttgacaagagtgtcactgatttcgccaagcaatggctcgagatcaagcagtga

SEQ ID NO: 72171 - protein, 333 aa, Yarrowia lipolytica CLIB122
MPTTLVTGATGFLAGHCVDQLLKDGHTVIGTVRNPSKAERLAEAFKSEVESGKLELETLKDIQNEDEFEAIFKKHPEIDYILHTASPLSFNVTDPEKDMLQPAIRGTTAVLKQAKAHAPNVKKVVITSSIAAMMNPDPSHVHNEHSWNPMTREQAAQKGNPVANYVGSKIFAEKAGLEFLNDEKPNFSITWINPAYILGPGITLDLGAINASNQLISSVLESKLGEEVKVQSGSFVDVRDCARAHVVALQPKFDRKRLMLCTAKVCTQDIEDICNKIPELKGKIAVGTPGEREKQLSKSIMDPSETKKLLDFEWIPLDKSVTDFAKQWLEIKQ

SEQ ID NO: 72172 - DNA, 1002 bp, Yarrowia lipolytica CLIB122; identical to SEQ ID NO: 72170
  CDS (1)..(1002)

SEQ ID NO: 72173 - protein, 333 aa, Yarrowia lipolytica CLIB122; identical to SEQ ID NO: 72171

SEQ ID NO: 72174 - DNA, 1002 bp, Yarrowia lipolytica CLIB122; identical to SEQ ID NO: 72170
  CDS (1)..(1002)

SEQ ID NO: 72175 - protein, 333 aa, Yarrowia lipolytica CLIB122; identical to SEQ ID NO: 72171

SEQ ID NO: 72176 - DNA, 1029 bp, Yarrowia lipolytica CLIB122
  CDS (1)..(1029)
atgccaccaacttctctcgtcaccggctccactggatttttggccagccacgtggtcgaccagctgctcagcgcaggtcatagagtcatcggtacggttcgatccccccacaaagccgcacgtctggctgaggccttcaagcagcagattgcttcaggccaattggagctggaaacgctttccgacgtgagaaacgccggtgaattcaaggccattttcgaaaaacatcccgagatcaagtacattttgcacacggcttcccccttcaactacaacacgactgaccccgagaaggagatgctccaaccagcggtcgaaggaactacaaccgtactcaaggcagccaaggaccatgcccccaacgtcgagaaggtggttatcacttcttcgctcgctgccattctcaacattgccacgttcaacgatccctccactaccctgaccgagaaggactggaaccccatcacctgggaacaggcggccgagaagggcaacccctatgccaactatattggatcaaaggccatggctgaaaaggcgtctgtggagtttgagaagatggagaaacccaagttcaagctcacctgggtcaaccccgtgctcattctcggtccaggtatcattctcgatccactggccattaacacctccaatgaagccattgtaaccaacgcttttgaaaccaagcccgggcaaaagcctcccgtcaaagctggttactttgttgacgtgcgcgactgcgccaaagcccatgtttctgctctcaaccccgagtttgacggacgaagactcttcctatccacctcaaagtactgcacccaggactttctgaacattgccaaccagctacccgaattcaagggaaagatcgccgagtttgaccctatcgagcgggagaaggagttgcattcgttagcccagatcgacaactcggccacgttgaaactgctcaactacgacctcatctccctggagcattccgtcacagattttgccaaagagtggctttcttacgagcggaacgactag

SEQ ID NO: 72177 - protein, 342 aa, Yarrowia lipolytica CLIB122
MPPTSLVTGSTGFLASHVVDQLLSAGHRVIGTVRSPHKAARLAEAFKQQIASGQLELETLSDVRNAGEFKAIFEKHPEIKYILHTASPFNYNTTDPEKEMLQPAVEGTTTVLKAAKDHAPNVEKVVITSSLAAILNIATFNDPSTTLTEKDWNPITWEQAAEKGNPYANYIGSKAMAEKASVEFEKMEKPKFKLTWVNPVLILGPGIILDPLAINTSNEAIVTNAFETKPGQKPPVKAGYFVDVRDCAKAHVSALNPEFDGRRLFLSTSKYCTQDFLNIANQLPEFKGKIAEFDPIEREKELHSLAQIDNSATLKLLNYDLISLEHSVTDFAKEWLSYERND

SEQ ID NO: 72178 - DNA, 1059 bp, Yarrowia lipolytica CLIB122
  CDS (1)..(1059)
atgtctacagttctcgtcactggagctaccggattcattgcaggtcatgtcgttggcgatctgctggcgtctggacacaaggtcattggcaccattcgacatctcgacaaggctgtcaagctgatggaggccttcccagaggccaattcgtccaaccagctgctgttcgagacgctcaccgacattcgacacgaagacgagctcaagcggatctttgagaaacacaaggacatttccgtcgtgattcacactgcctcgcccttcttcttcaactccaagaacgtggtcaaggatctactcgagccggccgtcgagggtacacgagcagttcttcaggctacccaagttgcaggcaccaacgtcaacaaggttgtggtcacctcttccattgcagcaatgctcgaccccttcaaaaagaacgaccccaactatgtcgccacagaattcacctggaaccctgtaacttggacacaggcagccgactccgacgatggagaacttgcctacgtggcctccaagacttttgccgaacgagaggcctgggactacgtcgagcgaaacaagccccggtacactctgaccaccgtcaatcctgctgcagtgtttggaccccatgcaaccaagatcgaccccaagcagctcaacacatctaatgatgtcatcaacaacctggctcttgatactaagcccggagacccaccttctgagtttgccttcgtttgggtggacgtccgagatgtagctcgagcccatactctggctatcgaccacaaactcgacaaccggcgactactcctgtgtaacggcaagtttgccgcccaggacattctcgatatcatcaacagagacttccccgatatccgaggcaagattgctactggaaaccccggcactggcaaggaggtgacatccaacatttttaactacaacaacgacgtgacccgtcaggagctgccaacgctcaagtggattggactcgagcagtccattgtggacttcaccaagcagtacgaggagattctgcatgagaagaagaagaagcattggtggaatatttag

SEQ ID NO: 72179 - protein, 352 aa, Yarrowia lipolytica CLIB122
MSTVLVTGATGFIAGHVVGDLLASGHKVIGTIRHLDKAVKLMEAFPEANSSNQLLFETLTDIRHEDELKRIFEKHKDISVVIHTASPFFFNSKNVVKDLLEPAVEGTRAVLQATQVAGTNVNKVVVTSSIAAMLDPFKKNDPNYVATEFTWNPVTWTQAADSDDGELAYVASKTFAEREAWDYVERNKPRYTLTTVNPAAVFGPHATKIDPKQLNTSNDVINNLALDTKPGDPPSEFAFVWVDVRDVARAHTLAIDHKLDNRRLLLCNGKFAAQDILDIINRDFPDIRGKIATGNPGTGKEVTSNIFNYNNDVTRQELPTLKWIGLEQSIVDFTKQYEEILHEKKKKHWWNI

SEQ ID NO: 72180 - DNA, 972 bp, Yarrowia lipolytica CLIB122
  CDS (1)..(972)
atgtctgtactgctcaccggatccacaggcttcattgccactcacgtcctcgaccaactgcttagcaagggtctctccgtggtagccacctaccgatccgagtccaaggtggactttctgaagaaacgattcgagggcaagagtgtcgagtttgtgcttctgtcagacattgaatccgagtccgaggtcaaggacatcttcaacaagaacccacaaatcaccaaagtgatccacaccgcatcaccgttccacttcaacttcaccgaccccctgacggaggttcttcagccagccgtgaacggcaccaaggcggtgctgaacgccattcccgagcacgtgactcacgtagttgtcacctcctcggtggcggccgtggtggacatcaagtatattgacgactacaacgagatcatcaccgaggactcgtggaacggaatctcgtgggaggacgccgagaagaagggaggcagcttcacgtaccgaggctccaaaacctttgccgaaaaggcagcgtgggaactgcacaagaaggccaagtacaacctggtcacaattctgcctcctctggtgtttggaccagtctacggacagactgacaccctcaacacctccaacgaacagctggtggacgcgctcaaaaaggggtctaacttcagatacgcaggaacgtatgtcgacgtccgagatacagctgctgcccacgtggctgccattgatgccacggaatcagccagatggctcactattggaggctactacacccgccaggagattctggatatcaccaacaaggagtttcccgaattccatgctgacaaggggactccgggcgactactctggtttgaaacgggccttccgatacgacaactccaagaccaacaaggtgttccctcgaaagtacatcacgttgaagcagacagtggaggacacctttcggggcattgatcccaagtatatcaacaagttgtag

SEQ ID NO: 72181 - protein, 323 aa, Yarrowia lipolytica CLIB122
MSVLLTGSTGFIATHVLDQLLSKGLSVVATYRSESKVDFLKKRFEGKSVEFVLLSDIESESEVKDIFNKNPQITKVIHTASPFHFNFTDPLTEVLQPAVNGTKAVLNAIPEHVTHVVVTSSVAAVVDIKYIDDYNEIITEDSWNGISWEDAEKKGGSFTYRGSKTFAEKAAWELHKKAKYNLVTILPPLVFGPVYGQTDTLNTSNEQLVDALKKGSNFRYAGTYVDVRDTAAAHVAAIDATESARWLTIGGYYTRQEILDITNKEFPEFHADKGTPGDYSGLKRAFRYDNSKTNKVFPRKYITLKQTVEDTFRGIDPKYINKL

SEQ ID NO: 72182 - DNA, 1029 bp, Yarrowia lipolytica CLIB122
  CDS (1)..(1029)
atgtccattcttgtcaccggcgccacgggatttattgccgcccattgcattgaccagctgctgaaaaacggccacagcgtgattggaacgatccgaagcccccagaagggcgccgctctggaagccgccttccccgacgccgttgccaacaagaagctcattctcgagacggtttccgacattcgatctgccaaggagtttgaccaactgttcgacaagcaccccgaaattggcaaagtgctgcacactgcctctcctttccacttcaacatcaaggacccaatcaaggacatgctggagccggccgtggagggcacaaacacagtgctgcagtctgtgctgaaacacggtccccaggtgaccaaggtggtggtcacgtcgtcgtttgtgtccatgctgaccgccgacgacatgttcgatccctccgtgaccgtggacgagaagagctggaaccgaatcacctgggagcagggcgccggcaatgtggagtttctgacctactttgcatccaagaagtttgccgagaaggctgcttgggactttgttgagaacgaaaagccctttttccagctcaccaccgtcaacccttctctggtgtttggcccctccatcaccaagcccgacctcaagagcctcaacacctccaacggagacattgtcactcatgctctggaggtcaaggactctgatgaaggcgtcggacagtacaactccttctgcgtcgacgtgcgagacgttgccaagggtcatgtggttgctctggacgacaagaccaatggaaagcgactcatgctctgttccgacaagttttgctcccagcgactgcttaactacatcaacgaggacttccccgagctcaagggcaagattgccgttggtcatcctgatcaggtcgaagccattgaggccaagaccttcaactttgacaacaccgagaccaagaagctgcttgggttcgagtttactcctctccgagaaaccatccacgacttcgttgcccagtggttggaagttaagaaggaggagtag

SEQ ID NO: 72183 - protein, 342 aa, Yarrowia lipolytica CLIB122
MSILVTGATGFIAAHCIDQLLKNGHSVIGTIRSPQKGAALEAAFPDAVANKKLILETVSDIRSAKEFDQLFDKHPEIGKVLHTASPFHFNIKDPIKDMLEPAVEGTNTVLQSVLKHGPQVTKVVVTSSFVSMLTADDMFDPSVTVDEKSWNRITWEQGAGNVEFLTYFASKKFAEKAAWDFVENEKPFFQLTTVNPSLVFGPSITKPDLKSLNTSNGDIVTHALEVKDSDEGVGQYNSFCVDVRDVAKGHVVALDDKTNGKRLMLCSDKFCSQRLLNYINEDFPELKGKIAVGHPDQVEAIEAKTFNFDNTETKKLLGFEFTPLRETIHDFVAQWLEVKKEE

SEQ ID NO: 72184 - DNA, 1014 bp, Yarrowia lipolytica CLIB122
  CDS (1)..(1014)
atgcctaccacccttgttactggagctaccggctttctggcaggtcattgtgttgaccaactgctcaaggctggtcataccgtcatcggaactattcgaagcccccagaaggccgagcgacttgcggaggcctttaagaacgaggtcgagtccggcaagttcgagcttgagacactcaaggacgtccaggatgaggtcgagttccaggtcatcttcgagaagcaccctgagattgactacattctgcacacggcctcgccttttaacatgaaggctgaggaccccgagaaagatatgcttcagcctgccgtcaaaggaaccactgctgttctgaaaatggccaagactcatgctcccaatgtgaagaagattgtcatcacctcttctttggccgccatcatggacgtgtccaagtacaatgaccctactcacactctgactgagaaggactggaacccaatgacccgagagcaggcggctgagaaaggcaacccctttgccaactacgtgggatccaagctgtatgccgagaaggcaggtctggaattcctgaacaacgagaaacctcacttctccatcacctggatcaacccctcctatatcttcggtcccggtattgccctggacatgtctgctctcaacacctcaaacgagctgattgctgctgttcttcagtccaagaagggccagaaccctgagggctctgcgggctggttcgtcgacgtccgagactgcgctgaggctcacgttattgctctcaagcccgagcttgaccgaaggagactgcttctgggcaccagtgctttctgcacccaagacatcgaagatattgccaacaagatcccccagctggagggtaatatcgccaccggaaaccctgccaaccgagataaggagctcaaaactgtttgtcagctcgactgctccgagacggataaattgctaggaattaagtggatccctcttcagaagagtgtcactgactttgctgagcagtggattaagtctcagtag

SEQ ID NO: 72185 - protein, 337 aa, Yarrowia lipolytica CLIB122
MPTTLVTGATGFLAGHCVDQLLKAGHTVIGTIRSPQKAERLAEAFKNEVESGKFELETLKDVQDEVEFQVIFEKHPEIDYILHTASPFNMKAEDPEKDMLQPAVKGTTAVLKMAKTHAPNVKKIVITSSLAAIMDVSKYNDPTHTLTEKDWNPMTREQAAEKGNPFANYVGSKLYAEKAGLEFLNNEKPHFSITWINPSYIFGPGIALDMSALNTSNELIAAVLQSKKGQNPEGSAGWFVDVRDCAEAHVIALKPELDRRRLLLGTSAFCTQDIEDIANKIPQLEGNIATGNPANRDKELKTVCQLDCSETDKLLGIKWIPLQKSVTDFAEQWIKSQ

SEQ ID NO: 72186 - DNA, 1086 bp, Oryza sativa (japonica cultivar-group)
  CDS (1)..(1086)
atgaccgtgatcgacggcgccgtcgctgccgacgccggcggcgcagccgcggcggtggtgcagccggggaacgggcagaccgtgtgcgtgaccggcgcggccgggtacatcgcgtcgtggctcgtgaagctgctgcttgagaagggctacactgtcaagggcaccgtcaggaacccagatgacccgaagaacgcgcacctgaaggcgctcgacggcgccggcgagcggctggtgctctgcaaggccgacctcctcgactacgacgccatctgccgcgccgtcgccggctgccacggcgtcttccacaccgcctcccccgtcaccgacgaccccgagcagatggtggagccggcggtgagggggacggagtacgtgataaacgcggcggcggaggccggcacggtgcggcgggtggtgttcacgtcgtcgatcggggcggtgaccatggaccccaaccgcgggcccgacgtcgtcgtcgacgagtcctgctggagcgaccttgactactgcaaggaaaccaggaactggtactgctacgggaaggcggtggcggagcaggcggcgtgggaggcggcgcggcggcgaggggtggagctggtggtggtgaacccggtgctggtgatcgggccgctgctgcagccgacggtgaacgccagcgtcgcccacatcctcaagtacctggacggctcggccagcaagttcgccaacgccgtccaggcctacgtcgacgtccgcgacgtcgccgccgcccacctcctcgtcttcgagtccccttccgccgccggccgcttcctctgcgccgagtctgtcctccaccgcgagggtgtcgtccgcatcctcgccaagctcttccccgagtaccctgtccccaccaggtgctccgacgagaagaaccccaggaagcagccgtacaagatgtcgaaccagaagctccgggacctggggctggagttccggccggcgagccagtcgctgtacgagacggtgaagtgcctccaggagaagggccacctgccggtgctcgccgccgagaagacggaggaggaggccggcgaggtccagggcgggattgccatccgagcatga

SEQ ID NO: 72187 - protein, 361 aa, Oryza sativa (japonica cultivar-group)
MTVIDGAVAADAGGAAAAVVQPGNGQTVCVTGAAGYIASWLVKLLLEKGYTVKGTVRNPDDPKNAHLKALDGAGERLVLCKADLLDYDAICRAVAGCHGVFHTASPVTDDPEQMVEPAVRGTEYVINAAAEAGTVRRVVFTSSIGAVTMDPNRGPDVVVDESCWSDLDYCKETRNWYCYGKAVAEQAAWEAARRRGVELVVVNPVLVIGPLLQPTVNASVAHILKYLDGSASKFANAVQAYVDVRDVAAAHLLVFESPSAAGRFLCAESVLHREGVVRILAKLFPEYPVPTRCSDEKNPRKQPYKMSNQKLRDLGLEFRPASQSLYETVKCLQEKGHLPVLAAEKTEEEAGEVQGGIAIRA

SEQ ID NO: 72188 - DNA, 1038 bp, Candida albicans SC5314
  CDS (1)..(1038): transl_table=12
atgtctggagaaacagtttttgtcactggtgcaactggatatattgctcaacatattattaaacaattattatctaaaggttattctgtaattggatcggttcgatcccaatctaaaggtgaacaattgaaagaattaattactgctcatcatcaagatactactggtgatgctaaatttgattatgttatagtcgaaagtcttattgaaccaggagcatttgattcgattttacaaaatcataaagaagttggagttttcattcatagtgcttcaccaatcccatttgctactgatagtgttgaaaaagatattttacaaccagctatagatgggacaaaaaatgttttaacatcaattaaaaaatatggtaatgagaatattaaaaagttggttataacttcatcaattgctgctgttgaaccattgggtacgggacaaactgaacctaaaacaattctggaaaaagattggaatccaattacttttgaacaaggtcttgctaatccagcagttgcttattatgcttctaaaacattagcagaaagagaagtttggaaatttgtcgatgaaaataaaaaccaattaaattttgatgttgccgtgattaatcctctgtttgtatttggacctcaagcatttggaattaaagataaatcagcagcattaagatcaacgggagaaatcattaattccgtattgaaattgaaatcaaatgatccaattccatcgttagtagcatcatttattgatgttcgtgatgttgctagagcacatattattgcctttgaggatgatgatgctattggtcaacgattaattttagataatgaaatattcactaaagaattgattgctcatttaattaaaaagaatttcccttctttggatatcccagaaggtgatattgttaaaagtgaagaagaaattgcaaattatccttggagagtagatagtaccaaaactgaaaaaattttgggattcaaatatatttcattggataaaagtgttgttgatactgttaatcaattgatttga

SEQ ID NO: 72189 - protein, 345 aa, Candida albicans SC5314
MSGETVFVTGATGYIAQHIIKQLLSKGYSVIGSVRSQSKGEQLKELITAHHQDTTGDAKFDYVIVESLIEPGAFDSILQNHKEVGVFIHSASPIPFATDSVEKDILQPAIDGTKNVLTSIKKYGNENIKKLVITSSIAAVEPLGTGQTEPKTISEKDWNPITFEQGLANPAVAYYASKTLAEREVWKFVDENKNQLNFDVAVINPSFVFGPQAFGIKDKSAALRSTGEIINSVLKLKSNDPIPSLVASFIDVRDVARAHIIAFEDDDAIGQRLILDNEIFTKELIAHLIKKNFPSLDIPEGDIVKSEEEIANYPWRVDSTKTEKILGFKYISLDKSVVDTVNQLI

SEQ ID NO: 72190 - DNA, 1167 bp, Candida albicans SC5314
  CDS (1)..(1167): transl_table=12
atgactgataaaactaattttcctactacagtatttgtatctggtgcttctggattcattgctcaagaattaatcaaacaattgataataaaaggatataatgttataggatcagtaagatccaccactaaaggagaatcaattaaatccaatttaacatcctcatcaaccacacaatcattgaatagtgatttgtttaattatacaattattaaagatatttcatcaccaggagcatttgataatgtattaaaacaatatcccgaaattgagatttttttacatacagcatcaccatttcattttaaagcaggaaatattgaacaagaattattaattccagcaattaatggtactaaaaatgccttattggcaattaaacaatttggtcataaaattaaacatgtagtgattacttcatcagtagttgccgttggaaaatttgggaaatttcctcgtaccagtacgggctcaacatcattgtcttcatcagtggtggttgctgatgaaaattcatggaatccaattacttgggaaatgtcattgaaaaatcctttttatggatattttggttcgaaaacttttgctgaaaaagaagtttggatatttttacaaattgaaaatccaaaatttaatataacgacaattaatccaggtatggtattaggaccacaagcatttcccataaacaaccataatggtggtggtgctggtgctggtggtactaacaatttagaattgaatacttcatcacaagaaatagttcgattattgaatttatcaactgttgatgatgttaataaagttaagatttcaactaaagtagagaatacatttattgatgttagagatgttgcaaaagctcatattatagcatttgaaaaacctcaactaactaaaaataaacgattactattaattgaagatatttataatgaacaaacattacttaatatcattaataacaattttcctcaattaaatttaccaaaaggtgaacctattactggtcaaattgatgaatccaaattaaataatacttggaatactacacaaactaaaaccatttttggtgataaatatattggaattgaaaaaagtgtgattgattcagttaatcaaattcttgaagctaagaatgagggtaatcctcaatgtaaattgtaa

SEQ ID NO: 72191 - protein, 388 aa, Candida albicans SC5314
MTDKTNFPTTVFVSGASGFIAQELIKQLIIKGYNVIGSVRSTTKGESIKSNLTSSSTTQSLNSDLFNYTIIKDISSPGAFDNVLKQYPEIEIFLHTASPFHFKAGNIEQELLIPAINGTKNALLAIKQFGHKIKHVVITSSVVAVGKFGKFPRTSTGSTSLSSSVVVADENSWNPITWEMSLKNPFYGYFGSKTFAEKEVWIFLQIENPKFNITTINPGMVLGPQAFPINNHNGGGAGAGGTNNLELNTSSQEIVRLLNLSTVDDVNKVKISTKVENTFIDVRDVAKAHIIAFEKPQLTKNKRLLLIEDIYNEQTLLNIINNNFPQLNLPKGEPITGQIDESKLNNTWNTTQTKTIFGDKYIGIEKSVIDSVNQILEAKNEGNPQCKL

SEQ ID NO: 72192 - DNA, 1017 bp, Candida albicans SC5314
  CDS (1)..(1017): transl_table=12
atgtccgtttcaaaatctgctacaactgtttttgtatctggggcttctggtttcattgcacaaaatgtaatcaaacaattgttggccaatggatacaaagtcataggatcagtaagatctgaatcaaaaggaaaagaattgacagatattattcaatcaaatgacttccaatttgctgcaatccctgatattagtgctgttggagcatttgatgatgttttgaaatcaaattcacaaatctcagtgtttatccacacagcttccccagtcacttattcggcaaaagatgttcaaaatgaacttatcaaacctgcagtagaaggaacaaggaatgctttgaatgcaataaaactgtatggaccccaaattaaacgagtggttgtgacttcttcatttacagccattgcactggggaaggattttgatcatgacaaatactatacggaaaaagattggaacccagttacaatagaacaggcattatcaaatcctgaagcagcatatgcttatgccaaaaaaatggcagaaaagactgtttgggattttgttgaaactgaatcaccaacttttaaagtaactgttgtcaatccaactgttgtttttggaccacaagcttttggagttaaagataaatcgaaattgaatttactgattgaaatgatcaatgatattcttactttgaaacctgacgatgaaattccaccctatgctagtcgatgtattgatgtgagagatgttgctaaagctcatttggttgcatttgaaaaagaggaggcaatcaatcaaaggttggtgttaataaaccagccattcagtaatgatttgcttgcatatattatcaaaaagagtttccccgttatcaatattccggaaggcaatttggaaagaagtcgagaatgcattgcaaaatcgtgtatcaaaacagatttgacaaagacgcaagaaattcttggatttgattacgttccagtggagaagacaatcctagatacaattcaacaactatatgacgcttga

SEQ ID NO: 72193 - protein, 338 aa, Candida albicans SC5314
MSVSKSATTVFVSGASGFIAQNVIKQLLANGYKVIGSVRSESKGKELTDIIQSNDFQFAAIPDISAVGAFDDVLKSNSQISVFIHTASPVTYSAKDVQNELIKPAVEGTRNALNAIKSYGPQIKRVVVTSSFTAIASGKDFDHDKYYTEKDWNPVTIEQALSNPEAAYAYAKKMAEKTVWDFVETESPTFKVTVVNPTVVFGPQAFGVKDKSKLNLSIEMINDILTLKPDDEIPPYASRCIDVRDVAKAHLVAFEKEEAINQRLVLINQPFSNDLLAYIIKKSFPVINIPEGNLERSRECIAKSCIKTDLTKTQEILGFDYVPVEKTILDTIQQLYDA

SEQ ID NO: 72194 - DNA, 804 bp, Candida albicans SC5314
  CDS (1)..(804): transl_table=12
atgtccactactgtttttgttgctggtgccggcggatacattggaaaacatattgtatctcaattactttcaaagggttataccgttattggatctgttagaaatgatgaaaagggagaacgtcttgtatccttgtttgaaaatgataattttacctacgtagtagttgaggaagcggaggctaaaggtgcatttgacaagccgttgaaggatcacccacatattaaagtctttattgacacagcaagtcctttaccaattggagtcaattacgaaaagcagttgattagacgtacttcaaaaggaatcaagtacattttgagctcaattaaagaccacggacccaatattacaaaggtagtggttaccagttcaattgcctcgtgtatgaatgaaaaacaaagtcatgatcccaattttgttgttgatgaaagtaaatggaatccagataaacatagtgttggtaaaaataatcccacgtcggcctacttttatgcaaaggcatctgctgaacatgaagcctgggacttcatgaaaaagaaaacacatttcacacttgcaacaattcttcctggttatacatttggtccacaatgttttgatgaagatgtttccgatcttcttgaaacctctgttgagattgtcacgaaaatatttgaattaaataagaatgaccctatccccaaagagctgggattgtttgttgatgtcagagatgttgctgctgcacatatacgggcattcgagctaaacgaagctcaaaataaacgtttgatgttagtcacagaacccttttcagcttaa

SEQ ID NO: 72195 - protein, 267 aa, Candida albicans SC5314
MSTTVFVAGAGGYIGKHIVSQLLSKGYTVIGSVRNDEKGERLVSLFENDNFTYVVVEEAEAKGAFDKPLKDHPHIKVFIDTASPLPIGVNYEKQLIRRTSKGIKYILSSIKDHGPNITKVVVTSSIASCMNEKQSHDPNFVVDESKWNPDKHSVGKNNPTSAYFYAKASAEHEAWDFMKKKTHFTLATILPGYTFGPQCFDEDVSDLLETSVEIVTKIFELNKNDPIPKESGLFVDVRDVAAAHIRAFELNEAQNKRLMLVTEPFSA

SEQ ID NO: 72196 - DNA, 1032 bp, Candida albicans SC5314
  CDS (1)..(1032): transl_table=12
atgtcaacaccaattactgttattgtttctggagccacaggatttattgctcaacacgttgttaaacaattattagctaaaaactatcaagtcattggtacagttagatcaacagccaaaggtgatcatttattaaaattattcaacaatccacaaaacttatcttatgaaattgttgaagatgttggaactaaaggtgcctttgataaagtattacaaaaacatggagaagcaaaagtgttcttacatttagcttcaccattccattttaatgtgactgatgttgaaaaagaattgttattgcctgctgttgatggtactaaaaatgtattacaagcaatttataattttggtaacaatattgaaaaagtggttatcacttcatcttatgctgccattagtaccgcttctaaagaagctgataaaaatgcaattattacagaaaaggattggaatgaaatcagttggcaagatgctttacttaatccagttaatggatatcgtggatccaaaaaatttgctgaaaaagctgcttgggattttataaaatctaatgataatgttaaattttcattgtcgacaattaatccatcatttgtatttggtccacaatcatttggttcagaaattaaacaaagtttaaacacttctagtgaaatcattaattctattttgaaattgaaaccaaatgattcaattcctgcgtcaaaaggaggttgggttgatgtaagagatgttgccaaagctcatatcattgcctttgaaaatgaggatgccaaaaatcaaagaatattgttgaattcaggtagatttacatctcaatcacttgttgatattattaatgataaatttccagatttgaaagggaaaataccagttgatgaaccaggttcagataaatctgttattgctgaaagtttggctactattgatgataccaaatctcgtgaattattaggatttgaatattataaccttgaacaatcagtttatgatactgttgaacaaattgttaatgctcataagttgtaa

SEQ ID NO: 72197 - protein, 343 aa, Candida albicans SC5314
MSTPITVIVSGATGFIAQHVVKQLLAKNYQVIGTVRSTAKGDHLLKLFNNPQNLSYEIVEDVGTKGAFDKVLQKHGEAKVFLHLASPFHFNVTDVEKELLLPAVDGTKNVLQAIYNFGNNIEKVVITSSYAAISTASKEADKNAIITEKDWNEISWQDALLNPVNGYRGSKKFAEKAAWDFIKSNDNVKFSLSTINPSFVFGPQSFGSEIKQSLNTSSEIINSILKLKPNDSIPASKGGWVDVRDVAKAHIIAFENEDAKNQRILLNSGRFTSQSLVDIINDKFPDLKGKIPVDEPGSDKSVIAESLATIDDTKSRELLGFEYYNLEQSVYDTVEQIVNAHKL

SEQ ID NO: 72198 - DNA, 1044 bp, Candida albicans SC5314
  CDS (1)..(1044): transl_table=12
atgtcaaaaactgtcattttaacaggagcttcgggttatattggtcaacacattcttggagaattattagaccaaaattataaagtaattgccatagttcgttcccaaaaatcatcagatacattatcaaaactattcaaacaaacccccaaattacaatttgaaattgttgaacaatttgacaaaccacacgcattagataaagttttggaaaaacataaagaagcaacaatttttattagtacagctgctgtggtcacttttcatgctgaagattatgaaagagatgttttagatccagcaattgatctagttaaaaacattttttcaagtatcaaagaacatgctccacaaattactagagtaatattaacatcttccagtgcttcagtagttggattagataaggcattttcatatgatgctgaatactctgataatgattggtctccatttactcgtgaaatgagtacactggatggtaccatggcctattttgcatcaaagaaattggcagagaaagaagcttggaaattccttaaagaagaaaaaccaaattttgatcttgttgtcataatgccagcattgattcttggtccagttcgttttagttctgaattgaaaaacggtaaatttccttccacatctggtatcattggaggattattacatttgaaatctgatgatcctatccaaccaatggcagcaggtgcggttgacgttagagacgttgcaaaggtgcatgttgatgtgattacttcggaaaaagcttcaaaccaaagaattttagttgaaagtggtaaagtaaccaatgataatatcattcaaaccatcattgacaattttcctagttacaaggacaagttacctacccctaacccagtgccacattctaaatttgtgaaacccaaagatgaacgctcaagaaagattattggattctcattaaggtcattaggtgattcagtagttgatttggtcaaacaaatcgatcaggagaattcagtaatcgaatcaattaagaaattagatattaaaaaatag

SEQ ID NO: 72199 - protein, 347 aa, Candida albicans SC5314
MSKTVILTGASGYIGQHILGELLDQNYKVIAIVRSQKSSDTLSKLFKQTPKLQFEIVEQFDKPHALDKVLEKHKEATIFISTAAVVTFHAEDYERDVLDPAIDLVKNIFSSIKEHAPQITRVILTSSSASVVGLDKAFSYDAEYSDNDWSPFTREMSTSDGTMAYFASKKLAEKEAWKFLKEEKPNFDLVVIMPALILGPVRFSSELKNGKFPSTSGIIGGLLHLKSDDPIQPMAAGAVDVRDVAKVHVDVITSEKASNQRILVESGKVTNDNIIQTIIDNFPSYKDKLPTPNPVPHSKFVKPKDERSRKIIGFSLRSLGDSVVDLVKQIDQENSVIESIKKLDIKK

SEQ ID NO: 72200 - DNA, 1026 bp, Candida albicans SC5314
  CDS (1)..(1026): transl_table=12
atgtcttcatctactacagttttcgtttctggtgcttctggttttattgctcaaactttagtcaaacaattgattgaaaaaggttataaagttgttggtactgttagatccaatgaaaaaggtgattccttgaaggaaaacttgaaagcagctaaattgcaatcagaaaatttcacttacgaaattgttaaagatattgctgttaaaggtgcttttgacgatgctttaaagaaacatcctgaagtcactgttttcttacataccgcatctccattccatttcaatgtcactgatattgaaaaagaattattaactccagctgttgaaggtaccaacaatgccttacaagccattaaaacacatggaccacaaattaaacgtgttgttgtcacttcatcatatgctgctgtgggaagatttgctgatttagctgatccatcaatcccagctactgaagaatcttggaatccaatcacctgggaacaatcattatcaaatccacttgctggttatgttggttccaaaaaatttgctgaaaaagctgcttgggattttgttgaaaaggaaaaaccaaatttcactctttctgtgatcaatccagtatatgtatttggtccacaagcttttgaaattaaaaacaaatcccaattgaatacatcatcagaaattattaatggattattaaattctaaaccagattctaaatttgataatttaactggttatttcattgatgttagagatgttgctaaagctcatattgtagcttttgagaaagattcaattcaaggtcaaagattaattttggccgaatctccattttcaactcaaagtattttggatttgattcgaaaagatttcccacaattggattctcaattacctaaaggtgatccatctcaagctgatgcttggaagaaagctgaaagtaagattgagaatgaaaagactagagaattacttggattcaaatttattgatttcaaaaaatccattgacgattcggttgctcaaattattggttaa

SEQ ID NO: 72201 - protein, 341 aa, Candida albicans SC5314
MSSSTTVFVSGASGFIAQTLVKQLIEKGYKVVGTVRSNEKGDSLKENLKAAKLQSENFTYEIVKDIAVKGAFDDALKKHPEVTVFLHTASPFHFNVTDIEKELLTPAVEGTNNALQAIKTHGPQIKRVVVTSSYAAVGRFADLADPSIPATEESWNPITWEQSLSNPLAGYVGSKKFAEKAAWDFVEKEKPNFTLSVINPVYVFGPQAFEIKNKSQLNTSSEIINGLLNSKPDSKFDNLTGYFIDVRDVAKAHIVAFEKDSIQGQRLILAESPFSTQSILDLIRKDFPQLDSQLPKGDPSQADAWKKAESKIENEKTRELLGFKFIDFKKSIDDSVAQIIG

SEQ ID NO: 72202 - DNA, 1014 bp, Candida albicans SC5314
  CDS (1)..(1014): transl_table=12
atgacaaaggttttcataacaggagcatcagggtttattgctcaacacattatcaaattattattatcaaaaggatacgaagttgttggcactgttcgttcaaccaccaaaggtgaacaattgaaatctttcatgccctcagatgccaaatttacatatgagatagttaaagaattgtctacacccaactcctttgatgaagcattgagtaaacacaacgacatagaatatttatttcatactgcatccccattgacatttgataccgaagacccagaaaatgttattcttcaacctgccattaaaggaacggaaaacattttgcatgcagcagctgacctttgtccaaacttgaaacgtgtagtgctcacttcttcagatgctgccatttattccaatactgatgagacaaacccgacattatctttcaatgaaggaagttggaacaatacttcatatcaagatgcattgaaggataatattacagcatattatgcatctaaggcatttgcagaaaaattggcttgggaatttgtcttgatgcaaaaaccagtgtttggattagtggttgtaaacccatcttgggtatttggtccaaaagcatatgattttgatcctaaaagatttaatagttcgaatgaaatgattgatgatttgttaaaattgaaccacgaaaataattcaacttttgagaatgttagtggtggatacatttcggcaacagatatagctaaagttcaagtgtatgcaattgaatccgatgatttggtaaacaaaagattattaatgacaaatgggtatttcacctgtcaacagattcttgatataatcaataaacatttcccagaattaaacctaccaaaaggaaatccgggaactgaagcagaggagtttaagaaactagcaagagtgaacaatgatgctaccagaaaattattgccttgggagtttgagcctttggaaactattgtcgttgatacagtaaaacaaattctagaatctaaacaaaactaa

SEQ ID NO: 72203 - protein, 337 aa, Candida albicans SC5314
MTKVFITGASGFIAQHIIKLLLSKGYEVVGTVRSTTKGEQLKSFMPSDAKFTYEIVKELSTPNSFDEALSKHNDIEYLFHTASPLTFDTEDPENVILQPAIKGTENILHAAADLCPNLKRVVLTSSDAAIYSNTDETNPTLSFNEGSWNNTSYQDALKDNITAYYASKAFAEKLAWEFVLMQKPVFGLVVVNPSWVFGPKAYDFDPKRFNSSNEMIDDLLKLNHENNSTFENVSGGYISATDIAKVQVYAIESDDLVNKRLLMTNGYFTCQQILDIINKHFPELNLPKGNPGTEAEEFKKLARVNNDATRKLLPWEFEPLETIVVDTVKQILESKQN

SEQ ID NO: 72204 - DNA, 984 bp, Eucalyptus gunnii
  CDS (1)..(984)
atgagcgctgcgggcggtgccgggaaggttgtgtgcgtgaccggggcgtcgcgttacatcgcctcgtggctcgtcaagctcctcctgcagcgcggctacaccgtcaaggcctccgtccgcgatccgaatgatccaaaaaagactgaacatttgcttggacttgatggagcgaaagatagacttcaactgttcaaagcaaacctgctggaagagggttcatttgatcctattgttgagggttgtgcaggcgtttttcacactgcctctcccttttatcatgatgtcaaggatccgcaggcagaattacttgatccggctgtgaagggaacactcaatgtcctgaagtcatgttccaaagcaccttctctgcagcgtgtggtcttgacatcatctatggctgcagttgcatacaatagacaaccgcggacacctgaagttgtggtggatgaaagttggttttctgatccagacttgtgcaggcaaaccaatgcgtggtatgtgctttccaagactttggctgaggacgctgcctggaaatttgtgaaagaaaagggcattgacatggttacaattaacccagctatggtgattggtcctcttttgcagccaacacttaacacaagcgctgcagcgatcggaaatttgataaatggtgcaccaacttttccaaatgcaagttttggatgggtcaatgtcaaagatgttgcaaatgctcatatactggcatttgaggtcccatcagccagcggaagatattgtttagttgagagaattgcacactactccgagatcgtgaggatcttacgtgagctttacccttctgcccagcttccagaaaagtccgcggacgacaagcctttcgtgccgatctatcaggtgtccaaggagaaagtgaaaagcttggggatcaactacattcctctggagcagaatttgaaggagactgttgaaagcctgaaggagaagggatttgttaagttctga

SEQ ID NO: 72205 - protein, 327 aa, Eucalyptus gunnii
MSAAGGAGKVVCVTGASRYIASWLVKLLLQRGYTVKASVRDPNDPKKTEHLLGLDGAKDRLQLFKANLLEEGSFDPIVEGCAGVFHTASPFYHDVKDPQAELLDPAVKGTLNVLKSCSKAPSLQRVVLTSSMAAVAYNRQPRTPEVVVDESWFSDPDLCRQTNAWYVLSKTLAEDAAWKFVKEKGIDMVTINPAMVIGPLLQPTLNTSAAAIGNLINGAPTFPNASFGWVNVKDVANAHILAFEVPSASGRYCLVERIAHYSEIVRILRELYPSAQLPEKSADDKPFVPIYQVSKEKVKSLGINYIPLEQNLKETVESLKEKGFVKF

SEQ ID NO: 72206 - DNA, 1011 bp, Eucalyptus gunnii
  CDS (1)..(1011)
atgcccgtcgacgccctccccggttccggccagaccgtctgcgtcaccggcgccggcgggttcatcgcctcctggattgtcaagcttctcctcgagcgaggctacaccgtgcgaggaaccgtcaggaacccagacgacccgaagaatggtcatctgagagagctggaaggagccagcgagaggctgacgctgtacaagggtgatctgatggactacgggagcttggaagaagccatcaaggggtgcgacggcgtcgtccacaccgcctctccggtcaccgacgatcctgagcaaatggtggagccagcggtgatcgggacgaaaaatgtgatcgtcgcagcggcggaggccaaggtccggcgggttgtgttcacctcctccatcggtgcagtcaccatggaccccaaccggggtccggacgttgtggtggacgagtcttgttggagcgacctcgaattttgcaagagcactaagaactggtattgctacggcaaggcagtggcggagaaggccgcttggccagaggcgaaggagagaggggttgacctcgtggtgattaaccctgtgctcgtgcttggaccgctccttcagtcgacgatcaatgcgagcatcatccacatcctcaagtacttgactggctcagccaagacctacgccaactcggtccaggcgtacgtgcacgtcaaggacgtcgcgcttgcccacgtccttgtcttggagaccccatccgcctcaggccgctatttgtgcgccgagagcgtcctccaccgtggcgatgtggtggaaatccttgccaagttcttccctgagtataatgtaccgaccaagtgctctgatgaggtgaacccaagagtaaaaccatacaagttctccaaccagaagctgagagacttggggctcgagttcaccccggtgaagcagtgcctgtacgaaactgtcaagagcttgcaggagaaaggccacctaccagtcccctccccgccggaagattcggtgcgtattcagggatga

SEQ ID NO: 72207 - protein, 336 aa, Eucalyptus gunnii
MPVDALPGSGQTVCVTGAGGFIASWIVKLLLERGYTVRGTVRNPDDPKNGHLRELEGASERLTLYKGDLMDYGSLEEAIKGCDGVVHTASPVTDDPEQMVEPAVIGTKNVIVAAAEAKVRRVVFTSSIGAVTMDPNRGPDVVVDESCWSDLEFCKSTKNWYCYGKAVAEKAAWPEAKERGVDLVVINPVLVLGPLLQSTINASIIHILKYLTGSAKTYANSVQAYVHVKDVALAHVLVLETPSASGRYLCAESVLHRGDVVEILAKFFPEYNVPTKCSDEVNPRVKPYKFSNQKLRDLGLEFTPVKQCLYETVKSLQEKGHLPVPSPPEDSVRIQG

SEQ ID NO: 72208 - DNA, 954 bp, Eucalyptus gunnii
  CDS (1)..(954)
atgcccgtcgacgccctccccggttccggccagaccgtttgcgtcaccggcgccggcggcttcatcgcctcctggattgtcaagcttctcctcgagcgaggctacaccgtgcgaggaaccgtcaggaacccagacgacccgaagaatgggcatctgagagagctggaaggagccagcgagaggctgacgctgtacaagggtgatctgatggactacgggagcttggaagaagccatcaaggggtgcgacggcgtcgtccacaccgcctctccggtcaccgacgatcctgagcaaatggtggagccagcggtgatcgggacgaaaaatgtgatcgtcgcagcggcggaggccaaggtccggcgggttgtgttcacctcctccatcggtgcagtcaccatggaccccaaccggggtccggacgttgtggtggacgagtcttgttggagcgacctcgaattttgcaagagcactaagaactggtattgctacggcaaggcagtggcggagaaggccgcttggccagaggcgaaggagagaggggttgacctcgtggtgattaaccctgtgctcgtgcttggaccgctccttcagtcgacgatcaatgctagcatcatccacatcctcaagtacttgactggctcagccaagacctacgccaactcggtccaggcgtacgtgcacgtcaaggacgtcgcgcttgcccacgtccttgtcttggagaccccatccgcctcaggccgctatttgtgcgccgagagcgtcctccaccgtggcgatgtggtggaaatccttgccaagttcttccctgagtataacgtaccgaccaagtcgaaactgtcaagagcttgcaggagaaaggccacctacccgtcccctcccccccggaagattcggtgcgtattcagggatgatcttagatccatcacggtgcacatttgtaatccggagaaatga

SEQ ID NO: 72209 - protein, 317 aa, Eucalyptus gunnii
MPVDALPGSGQTVCVTGAGGFIASWIVKLLLERGYTVRGTVRNPDDPKNGHLRELEGASERLTLYKGDLMDYGSLEEAIKGCDGVVHTASPVTDDPEQMVEPAVIGTKNVIVAAAEAKVRRVVFTSSIGAVTMDPNRGPDVVVDESCWSDLEFCKSTKNWYCYGKAVAEKAAWPEAKERGVDLVVINPVLVLGPLLQSTINASIIHILKYLTGSAKTYANSVQAYVHVKDVALAHVLVLETPSASGRYLCAESVLHRGDVVEILAKFFPEYNVPTKSKLSRACRRKATYPSPPPRKIRCVFRDDLRSITVHICNPEK

SEQ ID NO: 72210 - DNA, 1116 bp, Zea mays
  CDS (1)..(1116)
atgaccgtcgtcgacgccgtcgtctcctccaccgatgccggcgcccctgctgccgccgccaccgcggtaccggcggggaacgggcagaccgtgtgcgtgaccggcgcggccgggtacatcgcctcgtggttggtgaagctgctgctcgagaagggatacactgtgaagggcaccgtcaggaacccagatgacccgaagaacgcgcacctcaaggcgctggacggcgccgccgagcggctgatcctctgcaaggccgatctgctggactacgacgccatctgccgcgccgtgcagggctgccagggcgtcttccacaccgcctcccccgtcaccgacgacccggagcaaatggtggagccggcggtgcgcggcaccgagtacgtgatcaacgcggcggcggaggccggcacggtgcggcgggtggtgttcacgtcgtccatcggcgccgtgaccatggaccccaagcgcgggcccgacgtcgtggtcgacgagtcgtgctggagcgacctcgagttctgcgagaaaaccaggaactggtactgctacggcaaggcggtggcggagcacgcggcgtgggagacggcccggcggcggggcgtggacctggtggtggtgaaccccgtgctggtggtgggccccctgctgcaggcgacggtgaacgccagcatcgcgcacatcctcaagtacctggacggctcggcccgcaccttcgccaacgccgtgcaggcgtacgtggacgtgcgcgacgtggccgacgcgcacctccgcgtcttcgagagcccccgcgcgtccggccgccacctctgcgccgagcgcgtcctccaccgcgaggacgtcgtccgcatcctcgccaagctcttccccgagtaccccgtcccagccaggtgctccgacgaggtgaatccgcggaagcagccgtacaagttctccaaccagaagctccgggacctggggctgcagttccggccggtcagccagtcgctttacgacacggtgaagaacctccaggagaagggacacctgccggtgctcggagagcggacgacgacggaggccgccgacaaggatgcccccacggccgagatgcagcagggagggatcgccatccgtgcctga

SEQ ID NO: 72211 - protein, 371 aa, Zea mays
MTVVDAVVSSTDAGAPAAAATAVPAGNGQTVCVTGAAGYIASWLVKLLLEKGYTVKGTVRNPDDPKNAHLKALDGAAERLILCKADLLDYDAICRAVQGCQGVFHTASPVTDDPEQMVEPAVRGTEYVINAAAEAGTVRRVVFTSSIGAVTMDPKRGPDVVVDESCWSDLEFCEKTRNWYCYGKAVAEHAAWETARRRGVDLVVVNPVLVVGPLLQATVNASIAHILKYLDGSARTFANAVQAYVDVRDVADAHLRVFESPRASGRHLCAERVLHREDVVRILAKLFPEYPVPARCSDEVNPRKQPYKFSNQKLRDLGLQFRPVSQSLYDTVKNLQEKGHLPVLGERTTTEAADKDAPTAEMQQGGIAIRA

SEQ ID NO: 72212 - DNA, 978 bp, Malus domestica
  CDS (1)..(978)
atgagcagcggagcagggaaggtcgtgtgcgtcaccggtgcgtctggatacattgcttcatggctcgttaagcttcttctccagcgcggctacaccgtcaaggcctctattcgcgacccaaatgatccaactaagacagagcacctgcatgcgcttgatggagcccaagacagacttcaacttttcaaagcaaatctgttggaagaaggttcttttgactctgctgttgagggttgtgaaggcgtattccatactgcatctcccttttatcatgatgtcacagacccaaaggcagaactacttgaacctgcggtaaaggggacccttaatgttcttaattcgtgtgcgaaatcaccatcaatcaaacgggtggttttgacatcttctatagccgctgtagcatataatggaaagcctcgaactcctgatgtagtagttgatgagacttggtttacagatccagatgtttgtaaggaatcaaagctttggtacgtgctttcaaagactttggctgaagatgctgcgtggaaatttgtaaaggagaagggtattgacttggttacaattaaccccgcaatggtgataggtcctctgttacagccaactcttaatacaagtgctgcagcagttttaaatgttattaagggagctcgaacttttccaaatgcaagttttggatggattaacgttaaagatgttgccaatgcacatattcaagcatttgagaggcctaccgctagtggcagatattgtttggttgagagagttgcccacttctcagaagttgtgagaattttacgtgagctgtaccctactttgcaacttccagagaagtgtgcagacgacaagccttttgtgccaacatatcaggtgtccaaggagaaggcgaagagcttgggtgtcgaatttattccactagatgttagcctcaaggaaacagttgaaagtctgaaggaaaagggttttgtcaatttctga

SEQ ID NO: 72213 - protein, 325 aa, Malus domestica
MSSGAGKVVCVTGASGYIASWLVKLLLQRGYTVKASIRDPNDPTKTEHLHALDGAQDRLQLFKANLLEEGSFDSAVEGCEGVFHTASPFYHDVTDPKAELLEPAVKGTLNVLNSCAKSPSIKRVVLTSSIAAVAYNGKPRTPDVVVDETWFTDPDVCKESKLWYVLSKTLAEDAAWKFVKEKGIDLVTINPAMVIGPLLQPTLNTSAAAVLNVIKGARTFPNASFGWINVKDVANAHIQAFERPTASGRYCLVERVAHFSEVVRILRELYPTLQLPEKCADDKPFVPTYQVSKEKAKSLGVEFIPLDVSLKETVESLKEKGFVNF

SEQ ID NO: 72214 - DNA, 1017 bp, Populus trichocarpa
  CDS (1)..(1017)
atgcctgttgatgcttcatcactttcaggccaaggccaaactatctgtgtcaccgggggtggtggtttcattgcttcttggatggttaaacttcttttagataaaggttacactgttagaggaactgcgaggaacccagctgatcccaagaattctcatttgagggagcttgaaggagctgaagaaagattaactttatgcaaagctgatcttcttgattatgagtctcttaaagagggtattcaagggtgtgatggtgttttccacactgcttctcctgtcacagatgatccggaagaaatggtggagccagcagtgaacgggaccaaaaatgtgataattgcggcggctgaggccaaagtccgacgagtggtgttcacgtcatcaattggcgctgtgtacatggatcccaataagggcccagatgttgtcattgatgagtcttgctggagtgatcttgaattctgcaagaacaccaagaattggtattgctatggaaaggctgtggcagaacaagctgcatgggatatggctaaggagaaaggggtggacctagtggtggttaacccagtgctggtgcttggaccattgttgcagcccactgtcaatgctagcatcactcacatcctcaagtacctcaccggctcagccaagacatatgctaactctgttcaagcttatgtgcatgttagggatgtggcactagcccacattttagtctttgagacgccttccgcctccggccgttacctttgctctgagagcgttctccaccgtggagaggtggtggaaatccttgcaaagttcttccctgagtaccccatccctaccaagtgctcagatgagaagaacccaagaaaacaaccttacaagttctcaaaccagaagctaagggatctgggtttcgaattcaccccagtaaagcagtgtctgtatgaaactgttaagagtttgcaggaaaagggtcaccttccaatcccaaaacaagctgcagaagagtctttgaaaattcaataa

SEQ ID NO: 72215 - protein, 338 aa, Populus trichocarpa
MPVDASSLSGQGQTICVTGGGGFIASWMVKLLLDKGYTVRGTARNPADPKNSHLRELEGAEERLTLCKADLLDYESLKEGIQGCDGVFHTASPVTDDPEEMVEPAVNGTKNVIIAAAEAKVRRVVFTSSIGAVYMDPNKGPDVVIDESCWSDLEFCKNTKNWYCYGKAVAEQAAWDMAKEKGVDLVVVNPVLVLGPLLQPTVNASITHILKYLTGSAKTYANSVQAYVHVRDVALAHILVFETPSASGRYLCSESVLHRGEVVEILAKFFPEYPIPTKCSDEKNPRKQPYKFSNQKLRDLGFEFTPVKQCLYETVKSLQEKGHLPIPKQAAEESLKIQ

SEQ ID NO: 72216 - DNA, 1119 bp, Saccharum officinarum
  CDS (1)..(1119)
atgaccgtcgtcgacgccgtgtccactgatgccgccggcgcccctgcagccgccgcggcaccggtgcagcagcccgggaacgggcagaccgtgtgcgtcaccggtgcggccgggtacatcgcctcgtggctcgtcaagctgctgctcgagaagggatacactgtcaagggaacagtcaggaacccagatgacccgaagaacgcgcacctcaaggcgctggacggcgccgccgagcggctgatcctctgcaaggccgacctcctggactacgacgccatctgccgcgccgtgcagggctgccatggcgtcttccacaccgcctccccggtcaccgacgacccggagcaaatggtggagccggcggtgcgcggcacggagtacgtgatcaacgcggcggcggaggccggcacggtgcggcgggtggtgttcacgtcctccatcggcgcggtgaccatggaccccagccgcgggcccgacgtcgtggtcgacgagtcgtgctggagcgacctcgagttctgcaagaaaaccaggaactggtactgctacggcaaggcggtggcggagcaggcggcgtgggacgcggcccggcagcgcggcgtggacctggtggtggtgaacccggtgctggtggtgggcccgctgctgcagccgacggtgaacgccagcatcgcgcacgtggtcaagtacctggacggctccgcgcgcaccttcgccaacgccgtgcaggcgtacgtggacgtccgcgacgtcgccgacgcgcacctccgcgtcttcgagagcccgcgcgcgtccggccgatacctctgcgccgagcgcgtcctccaccgcgaggacgtcgtccgcatcctcgccaagctcttccccgagtaccccgtccccaccaggtgctccgacgaggtgaacccgcggaagcagccgtacaagttctcgaaccagaagctccgggacctgggcctggagttccggccggtgagccagtcgctgtacgacacggtgaagaaccttcaggagaagggccacctgccggtgctcggagagcagacgacggaggccgacgacaaggaggcggcccccgccgccgccgagctgcagcagggaggaatcgccatccgtgcgtaa

SEQ ID NO: 72217 - protein, 372 aa, Saccharum officinarum
MTVVDAVSTDAAGAPAAAAAPVQQPGNGQTVCVTGAAGYIASWLVKLLLEKGYTVKGTVRNPDDPKNAHLKALDGAAERLILCKADLLDYDAICRAVQGCHGVFHTASPVTDDPEQMVEPAVRGTEYVINAAAEAGTVRRVVFTSSIGAVTMDPSRGPDVVVDESCWSDLEFCKKTRNWYCYGKAVAEQAAWDAARQRGVDLVVVNPVLVVGPLLQPTVNASIAHVVKYLDGSARTFANAVQAYVDVRDVADAHLRVFESPRASGRYLCAERVLHREDVVRILAKLFPEYPVPTRCSDEVNPRKQPYKFSNQKLRDLGLEFRPVSQSLYDTVKNLQEKGHLPVLGEQTTEADDKEAAPAAAELQQGGIAIRA

SEQ ID NO: 72218 - DNA, 1116 bp, Zea mays
  CDS (1)..(1116)
atgaccgtcgtcgacgccgtcgtctcctccaccgatgccggcgcccctgccgccgccgccgcaccggtaccggcggggaacgggcagaccgtgtgcgtcaccggcgcggccgggtacatcgcctcgtggttggtgaagctgctgctcgagaagggatacactgtgaagggcaccgtgaggaacccagatgacccgaagaacgcgcacctcagggcgctggacggcgccgccgagcggctgatcctctgcaaggccgatctgctggactacgacgccatctgccgcgccgtgcagggctgccagggcgtcttccacaccgcctcccccgtcaccgacgacccggagcaaatggtggagccggcggtgcgcggcaccgagtacgtgatcaacgcggcggcggaggccggcacggtgcggcgggtggtgttcacgtcgtccatcggcgccgtgaccatggaccccaagcgcgggcccgacgtcgtggtcgacgagtcgtgctggagcgacctcgagttctgcgagaaaaccaggaactggtactgctacggcaaggcggtggcggagcaggcggcgtgggaggcggcccggcggcggggcgtggacctggtggtggtgaaccccgtgctggtggtgggccccctgctgcaggcgacggtgaacgccagcatcgcgcacatcctcaagtacctggacggctcggcccgcaccttcgccaacgccgtgcaggcgtacgtggacgtgcgcgacgtggccgacgcgcacctccgcgtcttcgagagcccccgcgcgtccggccgccacctctgcgccgagcgcgtcctccaccgcgaggacgtcgtccgcatcctcgccaagctcttccccgagtaccccgtcccagccaggtgctccgacgaggtgaatccgcggaagcagccgtacaagttctccaaccagaagctccgggacctggggctgcagttccggccggtcagccagtcgctttacgacacggtgaagaacctccaggagaagggccacctgccggtgctcggagagcggacgacgacggaggccgccgacaaggatgcccccgcggccgagatgcagcagggagggatcgccatccgtgcctga

SEQ ID NO: 72219 - protein, 371 aa, Zea mays
MTVVDAVVSSTDAGAPAAAAAPVPAGNGQTVCVTGAAGYIASWLVKLLLEKGYTVKGTVRNPDDPKNAHLRALDGAAERLILCKADLLDYDAICRAVQGCQGVFHTASPVTDDPEQMVEPAVRGTEYVINAAAEAGTVRRVVFTSSIGAVTMDPKRGPDVVVDESCWSDLEFCEKTRNWYCYGKAVAEQAAWEAARRRGVDLVVVNPVLVVGPLLQATVNASIAHILKYLDGSARTFANAVQAYVDVRDVADAHLRVFESPRASGRHLCAERVLHREDVVRILAKLFPEYPVPARCSDEVNPRKQPYKFSNQKLRDLGLQFRPVSQSLYDTVKNLQEKGHLPVLGERTTTEAADKDAPAAEMQQGGIAIRA

SEQ ID NO: 72220 - DNA, 1116 bp, Zea mays; identical to SEQ ID NO: 72218
  CDS (1)..(1116)

SEQ ID NO: 72221 - protein, 371 aa, Zea mays; identical to SEQ ID NO: 72219

SEQ ID NO: 72222 - DNA, 1041 bp, Zea mays
  CDS (1)..(1041)
atgccaacagcagaggcgacgacgcccgtgccgccggagctgtcctccgggcaagggcggacggtttgcgtgaccggagctggagggttcattgcctcctggctcgtcaagcgcctcctggagaagggctacacagtccgcggcacggtcaggaaccctgtggatccaaagaacgaccacctgagggcccttgacggcgccgtcgaccgtctcgtcctcctccgggccgacctgctggacccacagagccttgccgaggccttctccggctgtgacggcgtcttccacgccgcctccccggtcaccgatgaccctgagatgatgatcgagccagcgatccggggcacgcgctacgtgatggcggcggcggacgacgccggagtgaagcgcgtcgtgttcacgtcctccatcggcaccgtgtacatgaacccctaccgtgaccccagcaagcctgtggacgacacctgctggagcgacctcgagtattgcaagaacacccagaactggtactgctacgccaagacggtggcggagcagggcgcgtgggaggtggcgcggaagcgagggctggacctggtggtggtgaacccggtgctggtgctgggcccgctgctgcagccgacggtgaacgccagcacggaccacgtgatgaagtacctgacggggtcggccacgacctacgtgaacgcggcgcaggcgtacgtgcacgtcagggacgtggccgaggcgcacgtccgggtgtacgaggcgccccacgcgcacggccgctacatctgcgccgagagcaccctgcaccgcggcgacctctgccgcgtcctcgccaagctcttcccggagtaccccgtacccaccaagtgcaaggaccaggttaaccctccggtggtaggatacaagttcaccaaccagaggctcaaggatctggggatggacttcgtgccggtcctgcagtgcctctacgagacggtcaccagcctccaggagaaaggcatgctgcccgtgcttccgacaaaacaagaccatgaccaactcggcaaatcatga

SEQ ID NO: 72223 - protein, 346 aa, Zea mays
MPTAEATTPVPPELSSGQGRTVCVTGAGGFIASWLVKRLLEKGYTVRGTVRNPVDPKNDHLRALDGAVDRLVLLRADLLDPQSLAEAFSGCDGVFHAASPVTDDPEMMIEPAIRGTRYVMAAADDAGVKRVVFTSSIGTVYMNPYRDPSKPVDDTCWSDLEYCKNTQNWYCYAKTVAEQGAWEVARKRGLDLVVVNPVLVLGPLLQPTVNASTDHVMKYLTGSATTYVNAAQAYVHVRDVAEAHVRVYEAPHAHGRYICAESTLHRGDLCRVLAKLFPEYPVPTKCKDQVNPPVVGYKFTNQRLKDLGMDFVPVLQCLYETVTSLQEKGMLPVLPTKQDHDQLGKS

SEQ ID NO: 72224 - DNA, 996 bp, Candida albicans
  CDS (1)..(996): transl_table=12
atgtccattactgtttttgttgctggtgccggcggatacattggaaaacatattgtatctcaattactttcaaagggttataccgttattggatctgttagaaatgatgaaaagggagaacgtcttgtatccttgtttgaaaatgataattttacctacgtagtagttgaggaagcggaggctaaaggtgcatttgacaagccgttgaaggatcacccacatattaaagtctttattgacacagcaagtcctttaccaattggagtcaattacgaaaagcagttgattagacgtacttcaaaaggaatcaagtacattttgagctcaattaaagaccacggacccaatattacaaaggtagtggttaccagttcaattgcctcgtgtatgaatgaaaaacaaagtcatgatcccaattttgttgttgatgaaagtaaatggaatccagataaacatagtgttggtaaaaataatcccacgtcggcctacttttatgcaaaggcatctgctgaacatgaagcctgggacttcatgaaaaagaaaacacatttcacacttgcaacaattcttcccggttatacatttggtccacagtgttttgatgaagatgtttccgatcttcttgaaacctctgttgagattgtcacgaaaatatttgaattaaataagaatgaccctatccccaaagagctgggattatttgttgatgtcagagatgttgctgctgcacatatacgggcattcgagctaaacgaagctcaaaataaacgtttgatgttagtctcagaacccttttcagctcaggaaattgttgatattttacacgaaatgtatcccgcggttcaattgccactcggtcaccctggagacaaacctaattacaaattcaacaatatcgaaaccaaaaaaattttaaatactgacttccgctctttaagatcaagcataaaggatgattatgaccaatatttaaggactcatggtattatatcttag

SEQ ID NO: 72225 - protein, 331 aa, Candida albicans
MSITVFVAGAGGYIGKHIVSQLLSKGYTVIGSVRNDEKGERLVSLFENDNFTYVVVEEAEAKGAFDKPLKDHPHIKVFIDTASPLPIGVNYEKQLIRRTSKGIKYILSSIKDHGPNITKVVVTSSIASCMNEKQSHDPNFVVDESKWNPDKHSVGKNNPTSAYFYAKASAEHEAWDFMKKKTHFTLATILPGYTFGPQCFDEDVSDLLETSVEIVTKIFELNKNDPIPKESGLFVDVRDVAAAHIRAFELNEAQNKRLMLVSEPFSAQEIVDILHEMYPAVQLPLGHPGDKPNYKFNNIETKKILNTDFRSLRSSIKDDYDQYLRTHGIIS

SEQ ID NO: 72226 - DNA, 978 bp, Vigna unguiculata
  CDS (1)..(978)
atgagcaccggcgccggacaagtagtgtgtgttaccggagcttccggttacattgcttcctgggtcgttaagtttcttctcgaacgcggctacaccgtgaaggccaccgttcgcgacacaagtgatcccaaaaaggtagatcacttgcttagcctcgatggtgctaaggaaaggctgcatctcgtcaaggcgaatcttctagaagaaggttcctttgactctgccgttgaaggttgtcacgctgtgttccacactgcttctccctttttcgacgatgccaaggacccgcagactgagttgttggatccagctttgaaggggactctgaatgttctgaaatcgtgcgtgaactcgcccacgctgaagcgcgtggttgtcacttcttctattgctgcagtttcgttcaacgacaggcccaaaaaccctgatgtagtggttgacgagacttggtattccgacccagaatactgtaagagaaatgggatatggtataacctctcaaagactttggccgaagatgctgcctggaaatttgcgaaagaaaacaatattgacttggttacagccaaccctgcattggttgttggacctctcttgcaaccagttcttaacactagttctgcagcagttttaaatttaattaatggttcgccaacatttaaaaatgtgactttgggatgggtggacgtgagagatgttgcaattgcccatgttctggcatatgagaatgcttcagctaatggaagatatttactagttgagagagtggcacacttcggagacgttgtgaagattttgcatgatttgtacccaacattgcaacttccacagaagtgtgtagatgataggccatatgatccaatattccaggtttccaaggaaaaagcaaagagcttggggcttgaatttactcctttggaagtgagcatcaaggatactgttgaaagcttgaaggaaaagggttttatcaaattttaa

SEQ ID NO: 72227 - protein, 325 aa, Vigna unguiculata
MSTGAGQVVCVTGASGYIASWVVKFLLERGYTVKATVRDTSDPKKVDHLLSLDGAKERLHLVKANLLEEGSFDSAVEGCHAVFHTASPFFDDAKDPQTELLDPALKGTLNVLKSCVNSPTLKRVVVTSSIAAVSFNDRPKNPDVVVDETWYSDPEYCKRNGIWYNLSKTLAEDAAWKFAKENNIDLVTANPALVVGPLLQPVLNTSSAAVLNLINGSPTFKNVTLGWVDVRDVAIAHVLAYENASANGRYLLVERVAHFGDVVKILHDLYPTLQLPQKCVDDRPYDPIFQVSKEKAKSLGLEFTPLEVSIKDTVESLKEKGFIKF

SEQ ID NO: 72228 - DNA, 1014 bp, Vitis vinifera
  CDS (1)..(1014)
atgggttcacaaagtgaaaccgtgtgcgtcaccggtgcctccggtttcatcggttcatggctggtcatgaggctcctggagcgcggctatactgttcgggccaccgttcgcgatccaactaacgtgaaaaaagtgaagcatttgctggacttgcccaaagcggagacgcatctgactctctggaaggcagatcttgctgatgaaggaagtttcgatgaagctattaaaggctgcaccggcgtcttccatgttgccacacccatggattttgaatcgaaggatcctgagaatgaagtgataaagccaactattgaagggatgttgggcataatgaaatcgtgtgctgccgcaaagactgtcagaaggcttgtattcacatcctccgcaggaactgtgaacattcaagaacaccaactgccagtgtacgatgaaagctgctggagtgatatggaattttgccgggctaaaaagatgactgcatggatgtactttgtctccaagacactggctgagcaagctgcatggaagtatgccaaggaaaataacattgacttcatcactatcataccgactcttgtggttggccccttcataatgtcatcaatgcctccaagcctcataactgctctttccccgatcactggaaacgaagctcattattcaattatacggcagggccaatttgttcacctggatgacctctgcaatgctcatatttacttgtttgagaatcctaaggcagagggacgttacatttgctcctcccacgattgtatcattctcgatcttgcaaaaatgcttagagaaaaataccccgagtataatatccccacagagttcaaaggtgttgatgagaacttgaagagtgtctgtttctcctccaagaagctgacagatttggggtttgagtttaaatacagcttagaggacatgtttactggagctgtggacacatgccgggccaagggattgcttcccccttcacatgagaaacctgtagatggcaagacctag

SEQ ID NO: 72229 - protein, 337 aa, Vitis vinifera
MGSQSETVCVTGASGFIGSWLVMRLLERGYTVRATVRDPTNVKKVKHLLDLPKAETHLTLWKADLADEGSFDEAIKGCTGVFHVATPMDFESKDPENEVIKPTIEGMLGIMKSCAAAKTVRRLVFTSSAGTVNIQEHQLPVYDESCWSDMEFCRAKKMTAWMYFVSKTLAEQAAWKYAKENNIDFITIIPTLVVGPFIMSSMPPSLITALSPITGNEAHYSIIRQGQFVHLDDLCNAHIYLFENPKAEGRYICSSHDCIILDLAKMLREKYPEYNIPTEFKGVDENLKSVCFSSKKLTDLGFEFKYSLEDMFTGAVDTCRAKGLLPPSHEKPVDGKT

SEQ ID NO: 72230 - DNA, 993 bp, Medicago truncatula
  CDS (1)..(993)
atggaacacaaagtgtgtgtaacaggagcttcaggctttttggcttcttggcttattaagcgacttctattatctggatatcatgtcattggaacagttagagatttaggtaagaagcagaaagttgaacatttatggaagttggaaggagcaacagaaagactcaaactagtccaagctgatttaatggaagaaaatagcttcgacaatgcgatcatgggatgcaaaggtgtctttcacattgcctctccagtactcaatcatatatcaaatgatcctaaggcagaaatcttggaaccagcagtccaaggtacgctgaatgttttgcgttcttgtcgaaagaatccagcccttgttcgagtggtgttagcctcatcgtcttcagctgttagagtaagagctgatttcgatccaaacataccaatagacgagtcatcttggagctcattggaattgtgtgagaaactccaggcatggtacccaatgtcaaagacattggcagaaaaagcagcttgggattattgcaaagagaatggaatagacttagtgactattttaccatcattcataattggacctaacttgccaacagatttatgttccactgcatctgatgtgctaggcttgttcaaaggggaaactgagaaatttcaatggcatggaaggatgggatatgttcatatagatgatgttgcactttgtcacatccttctttatgagaacaaagcatctgatggtagatacctttgcagttcaaaaataatggataatgatgatttggttggcatgctagcaaatcgttatcctggttttcccattcccaaaaggttcaagaaactagatagaccacattatgaactaaacactggaaagcttgagagtctgggattcaagtttaaatctgttgaagaaatgtttgatgattgctttgcatcgtttgtggagcagggccatcttactactcttccccaccaaccccgtgttatactctaa

SEQ ID NO: 72231 - protein, 330 aa, Medicago truncatula
MEHKVCVTGASGFLASWLIKRLLLSGYHVIGTVRDLGKKQKVEHLWKLEGATERLKLVQADLMEENSFDNAIMGCKGVFHIASPVLNHISNDPKAEILEPAVQGTLNVLRSCRKNPALVRVVLASSSSAVRVRADFDPNIPIDESSWSSLELCEKLQAWYPMSKTLAEKAAWDYCKENGIDLVTILPSFIIGPNLPTDLCSTASDVLGLFKGETEKFQWHGRMGYVHIDDVALCHILLYENKASDGRYLCSSKIMDNDDLVGMLANRYPGFPIPKRFKKLDRPHYELNTGKLESLGFKFKSVEEMFDDCFASFVEQGHLTTLPHQPRVIL

SEQ ID NO: 72232 - DNA, 981 bp, Medicago truncatula
  CDS (1)..(981)
atgagcagcagcaacttgggaaatgttgtgtgtgtgactggcgcttcaggttacatcgcttcatggctcgtccgattgcttcttcatcgtggctacactgttaaagccaccgttcgcgatccaaatgatcccaagaaggttgaccacttggttaagcttgatggtgctaaggagagattgcaactgttcaaggcaaatctacttgaagaaggtgcctttgattctgttgttcaaggctgtcatggtgtctttcacactgcatctcccttttatcatgatgtcaaggatcctcaggctgaattgattgatcctgctctcaaagggactctcaatgttctcaactcatgtgctaaatccccatcactcaaacgtgttgttttaacttcttctattgctgctgttgcttataatgggaagcctcgaactcctgatgttgttgttgatgagacttggtttacagatgctgatttctgtgctaaatcaaatctgtggtatgtggtttcaaagacattggctgaagaagctgcctggaaatttgttaaagaaaacaacatcgatatggttactattaacccagcaatggtcatagggcctctcttgcaaccagtcctaaacacaagtgctgctgcaattctaaacctgattaatggtgcacagacatttccaaatgctagttttggatgggtcaatgtgaaagatgttgcaaatgcccatattctggcgtacgagaatgcttcagcgagtggaagacattgtttagttgagagagtagcacactactccgaagttgtgaggattttacgtgaactgtacccttcgttgcaactcccagagaagtgtgcggacgataagccatatgtgcctatatatcaggtttccaaagaaaaggcgaaaagcttgggacttgaatatactcctttggaagtgagcatcaaggagactgttgaaagtttgaaagaaaagaagttcgccaacctttaa

SEQ ID NO: 72233 - protein, 326 aa, Medicago truncatula
MSSSNLGNVVCVTGASGYIASWLVRLLLHRGYTVKATVRDPNDPKKVDHLVKLDGAKERLQLFKANLLEEGAFDSVVQGCHGVFHTASPFYHDVKDPQAELIDPALKGTLNVLNSCAKSPSLKRVVLTSSIAAVAYNGKPRTPDVVVDETWFTDADFCAKSNLWYVVSKTLAEEAAWKFVKENNIDMVTINPAMVIGPLLQPVLNTSAAAILNLINGAQTFPNASFGWVNVKDVANAHILAYENASASGRHCLVERVAHYSEVVRILRELYPSLQLPEKCADDKPYVPIYQVSKEKAKSLGLEYTPLEVSIKETVESLKEKKFANL

SEQ ID NO: 72234 - DNA, 969 bp, Medicago truncatula
  CDS (1)..(969)
atgaacagcaacgttgtgtgtgtaactggagcttcaggttacatagcttcatggctcgttcgttaccttctccatcgtggttacactgttaaagccaccgttcgcgacccaagtgatccgaagaagatcaaccacttggttaagcttgaaggtgctaaggagagattacaactgtttaaggcaaatctacttgaacagggagcttttgattctgctgttcaaggctgtcatggtgtgtttcacactgcatctcccttctatcatcatgtcaaagaccctcaggctgagttgattgatcctgcactcaacgggactctcaatgttctcaaatcatgtgccaaatcgccattactcaaacgtgttgtcttaacctcttctgctgctgctgttgcgtacaatgaaaagcctcgaactcctgatgttgttgttgatgaaacttggtttactgatgctgatttctgtgccaaattaaacctgtggtatgcggtttcgaaaacattggctgaagaagctgcatggaaatttgttaaagaaaacaacattgatatggttactattaacccagcaatggtcatagggcctctcttgcaaccagtcctaaacacaagtgctgctgcaattctaaacctgattaatggtacacaaacatttccaaattctactttgggatgggtgtatgtgaaagatgttgcaaatgcccatattctggcgtacgagaatgcttcagctagtggaagacattgtttggttgagagtgtagcgcactactcagaaattgtgaagattttacgtgaactgtacccttcgttgcaactcccagagaagtgtgcggacgataagccatatgtgcctacatatcagttttccaaagaaaaggcaacgagtttgggaattgaatatactcctttggaagtgagcatcaaggaaactgttgaaagtttgaaagaaaagaagttcgtcaacttttaa

SEQ ID NO: 72235 - protein, 322 aa, Medicago truncatula
MNSNVVCVTGASGYIASWLVRYLLHRGYTVKATVRDPSDPKKINHLVKLEGAKERLQLFKANLLEQGAFDSAVQGCHGVFHTASPFYHHVKDPQAELIDPALNGTLNVLKSCAKSPLLKRVVLTSSAAAVAYNEKPRTPDVVVDETWFTDADFCAKLNLWYAVSKTLAEEAAWKFVKENNIDMVTINPAMVIGPLLQPVLNTSAAAILNLINGTQTFPNSTLGWVYVKDVANAHILAYENASASGRHCLVESVAHYSEIVKILRELYPSLQLPEKCADDKPYVPTYQFSKEKATSLGIEYTPLEVSIKETVESLKEKKFVNF

SEQ ID NO: 72236 - DNA, 969 bp, Medicago truncatula; identical to SEQ ID NO: 72234
  CDS (1)..(969)

SEQ ID NO: 72237 - protein, 322 aa, Medicago truncatula; identical to SEQ ID NO: 72235

SEQ ID NO: 72238 - DNA, 978 bp, Ocimum basilicum
  CDS (1)..(978)
atgagtgtagcagcagccataaatgtgtgtgtaaccggagcatcgggtttcattgcatcatggctcgtcaaattcctgctccagaaaggttataccgtcaaggcatccgttcgtgaccccaatgaccctaagaagacagagcatttgcttgcacttgatggagctaaggagagactttgcttaatgaaagcaaatctgctggacgaagggtccttcgattccatagttgatggttgtgaaggtgttttccatactgcatctcctttctaccatgcagtcaaagatccacaggcagaattgattgatcctgcattgaaggggactctcaatgttcttggatcatgcgtcaaaacgtcttctgtaaaaaagattgttttgacgtcatctatagctgcggttgcatactgtggtaaacctcgcactcctgaagttatagttgatgaaacttggtggtctgatccagagatttgcaagcagatgcagctctggtatgtgctttcaaagacactggctgaggatgctgcttggaagtttgtgaaggagaaagatattgacatggttgccataaacccagcaatggtgattggcccattgttgcagccaacactaaacacaagtgctgctgcaatattgaacttgataaatggtgcggagacatacccaaattcttcatttggttggataaatgtcaaagatgttgcacatgcacatattttggcatttgagaatgcttcggcaagtggaagatactgtttagtggagagggtcgcccacttttcagaagttgtaaagatattacgtggactgtaccctacatataaacttcctgaaaagtgtgccgatgacaagccgtttgtgccgatataccaggtgtccaaagaaaaggctaagtctctgggtttggagttcactcctcttgaagagggaatcaaggaaactgttgaaaggctgaaagagaaaaatttctttaaaccttaa

SEQ ID NO: 72239 - protein, 325 aa, Ocimum basilicum
MSVAAAINVCVTGASGFIASWLVKFLLQKGYTVKASVRDPNDPKKTEHLLALDGAKERLCLMKANLLDEGSFDSIVDGCEGVFHTASPFYHAVKDPQAELIDPALKGTLNVLGSCVKTSSVKKIVLTSSIAAVAYCGKPRTPEVIVDETWWSDPEICKQMQLWYVLSKTLAEDAAWKFVKEKDIDMVAINPAMVIGPLLQPTLNTSAAAILNLINGAETYPNSSFGWINVKDVAHAHILAFENASASGRYCLVERVAHFSEVVKILRGLYPTYKLPEKCADDKPFVPIYQVSKEKAKSLGLEFTPLEEGIKETVERLKEKNFFKP

SEQ ID NO: 72240 - DNA, 1011 bp, Codonopsis lanceolata
  CDS (1)..(1011)
atgccgccagtctccaaccaagtcatatgtgtcaccggtgccggcggatttatagcttcatggatggttaaattgctcctggaaaaaggctattccgttcgaggaactgtcagaaatcctgatgatccgaagaatagccatttgagggaccttgaaggagcaaaggatagattaactctctgcaaagctgatctcctcgattatcagagtttgcttgaagctattattgggtgtgacggcgttttccacactgcatcacccgttaccgatgatcctgaacaaatggtggagccggcagtgattggaacgaagaatgtgatagtagcggcagcagaagccaaatgccggcgagtggttttcacttcatcaattggtgcggtctacatggaccctaacaggagccctgatgctgttgttgatgaaacttgctggagcgatctcgagttttgcaagaacactaagaattggtactgttacggaaaggcagtggcggagcaggcagcgtgggatgaggccaaggtgagaggagtggacctagtggtagtcaacccagtgttggtgcttggtccactgttacaacacaccgtaaatgccagcattgttcatgtccagaagtacctcactggctccgctaagacctatgccaactcggttcaggcctatgtccacgttagggacgtggcgttggcacatattcttctcttcgagactccttcagcgtctggccggtacctctgcgctgagagcgtgcttcaccgtggggaggttgtcgaaatcctggccaagtttttccctgaatacccaattcctaccaagtgcaaggatgacggcaagccaagagcaaaaccatacaagttttcgaatcaaaagctaaaagatttggggctggaattcacaccagttaaacaaggcttatacgaaaccgtaaagagcctgcaggagaaaggtcacctcccagttctttctcctcctccccaacaaactgatgactctattcgtattcagtcttaa

SEQ ID NO: 72241 - protein, 336 aa, Codonopsis lanceolata
MPPVSNQVICVTGAGGFIASWMVKLLLEKGYSVRGTVRNPDDPKNSHLRDLEGAKDRLTLCKADLLDYQSLLEAIIGCDGVFHTASPVTDDPEQMVEPAVIGTKNVIVAAAEAKCRRVVFTSSIGAVYMDPNRSPDAVVDETCWSDLEFCKNTKNWYCYGKAVAEQAAWDEAKVRGVDLVVVNPVLVLGPLLQHTVNASIVHVQKYLTGSAKTYANSVQAYVHVRDVALAHILLFETPSASGRYLCAESVLHRGEVVEILAKFFPEYPIPTKCKDDGKPRAKPYKFSNQKLKDLGLEFTPVKQGLYETVKSLQEKGHLPVLSPPPQQTDDSIRIQS

SEQ ID NO: 72242 - DNA, 978 bp, Quercus ilex
  CDS (1)..(978)
  misc_feature <370>..<370>: n is a, c, g, or t
  misc_feature <592>..<592>: n is a, c, g, or t
atgagcagtggagctgggaagattgtgtgtgtgactggtgcctctggttacatagcttcatggcttgtcaagcttcttctcaaccgtggctacacagtcaaggcctctgttcgtgaccccaatgatccaaagaaaacaaaccacttacaagtacttgatggggccaaggagagacttcacctattcaaagcaaatctactggaagaaggttcttttgattctgctgttgagggctgtgatggggttttccacactgcatctcccctctatcataatgtcacggacccagaggctgaactacttgaacctgcagtgaagggaacacttaatgttcttaattcgtgtgcgaaatttccatctgttaagcggntggttgtgacatcctctatggctgcagttcattacaataaaaaagctaaaactcctgatgtagttgttgatgagacttggttttctgatccagacctttgtaaggaaacaaagcaatggtatatgctttcaaagacgttggctgaagaaaatgcctggaagtttgcaaaagagaagggtattgacatagttacaattaaccctgcaatggtgattggtcctntcttacagccaacgcttaacacaagtgctgctgcgattttgaacttaataaatggagctcagacatttcccaatgtatcatttggatgggttaatgtcaaagatgttgccaatgcacatattcaagcatatgaaattcctacagctagtggaagatattgtttggttgagagtgttatacaccagtctgaagttgtgagggttttacggaaactttatccctccttacaacttccagagaagtgtgcagatgataagccatttgcgccaacatatcaggtgtccaaagaaaggacaagaagcttgggtattgaatacattccttttgaggtgagcctcaaggaaactgttgaaagcttgaaggaaaagaagtttgtcagtttttaa

SEQ ID NO: 72243 - protein, 325 aa, Quercus ilex
  misc_feature <124>..<124>: The Xaa at location 124 stands for Leu, Met, or Val.
  misc_feature <198>..<198>: The Xaa at location 198 stands for Ile, Leu, Phe, or Val.
MSSGAGKIVCVTGASGYIASWLVKLLLNRGYTVKASVRDPNDPKKTNHLQVLDGAKERLHLFKANLLEEGSFDSAVEGCDGVFHTASPLYHNVTDPEAELLEPAVKGTLNVLNSCAKFPSVKRXVVTSSMAAVHYNKKAKTPDVVVDETWFSDPDLCKETKQWYMLSKTLAEENAWKFAKEKGIDIVTINPAMVIGPXLQPTLNTSAAAILNLINGAQTFPNVSFGWVNVKDVANAHIQAYEIPTASGRYCLVESVIHQSEVVRVLRKLYPSLQLPEKCADDKPFAPTYQVSKERTRSLGIEYIPFEVSLKETVESLKEKKFVSF

SEQ ID NO: 72244 - DNA, 978 bp, Quercus ilex; identical to SEQ ID NO: 72242
  CDS (1)..(978)
  misc_feature <370>..<370>: n is a, c, g, or t
  misc_feature <592>..<592>: n is a, c, g, or t

SEQ ID NO: 72245 - protein, 325 aa, Quercus ilex; identical to SEQ ID NO: 72243
  misc_feature <124>..<124>: The Xaa at location 124 stands for Leu, Met, or Val.
  misc_feature <198>..<198>: The Xaa at location 198 stands for Ile, Leu, Phe, or Val.

SEQ ID NO: 72246 - DNA, 954 bp, Plantago major
  CDS (1)..(954)
atgaaaacagttgctgtaacaggaggatctggctacatagcttcatggatcatcaaattcctcctccagcgtggctacactgtcaaagcttccgttcgttatcctgatgatccgaagaagactagccacttgcttgcgcttgatggagctaaggagagactcaagctgatcaaagcagatctgcttgatgaaggatcgtttgatgctgtttttgaaggctgtgatggtgttttccacactgcctcgccttttttcctcgaaactgaaaatcctgaggatgatttgcttaccccagcgcttaaggggactttgaatgtgcttaactcagttgcaaaaaccccatctgttaaaagggttgtgctgacatcttcagaagctgcggtttctttcaatggaaaaccacgtacacctgaagtggttgttgatgagacttggttctctgacgaagtcttttgcagagagaataagctctggtatgtgctctcaaagacattggcagaatctgctgcctggaagtttgccaaggaaaaaggcattgatttgatttccatgaaccctgctttggttgttggtccccttttgcagccaacgctcaacacaagttctgctgtagtcttggatatgttgaagggttcagaaacatatgcgaacgttagtgttggatgggttaatgtgaaagatgttgcaaatggacatatcctggcatatgagactccatcagcaagtggaagatatgtcatggttgagagagttgcacattactctgaagctgtgaaaattttgcgtgacttgtaccctgatatgaaactccccactaagtgccaatctgagccattcctgccgatttaccaagtctcgaaagataggatcaaaagcctgggtattgaactcacccctcttgaagtgagcatcaaggaaactgttgacagcctgaaggagaagaacttcatctag

SEQ ID NO: 72247 - protein, 317 aa, Plantago major
MKTVAVTGGSGYIASWIIKFLLQRGYTVKASVRYPDDPKKTSHLLALDGAKERLKLIKADLLDEGSFDAVFEGCDGVFHTASPFFLETENPEDDLLTPALKGTLNVLNSVAKTPSVKRVVLTSSEAAVSFNGKPRTPEVVVDETWFSDEVFCRENKLWYVLSKTLAESAAWKFAKEKGIDLISMNPALVVGPLLQPTLNTSSAVVLDMLKGSETYANVSVGWVNVKDVANGHILAYETPSASGRYVMVERVAHYSEAVKILRDLYPDMKLPTKCQSEPFLPIYQVSKDRIKSLGIELTPLEVSIKETVDSLKEKNFI

SEQ ID NO: 72248 - DNA, 978 bp, Prunus mume
  CDS (1)..(978)
atgagcagcggggctggtaaggtcgtctgcgtcaccggtgcgtccggttacattgcttcatggctcgtgaagctccttcttcaaggcggttacactgtcaaggcctctgttcgcgacccaaatgatccaactaagacagagcacttgctcgggcttgatggagctcaagagagacttcaactcttcaaagcaaatctattggaggaaggttcttttgactctgctgttgacggttgtgaaggggttttccatactgcttctcccttttatcatgatgtcacagatccaaaggcagaactacttgaccctgcagtaaagggaacccttaatgttcttaattcgtgtgcgaaatcccagtctatcagacgggtggtcttgacatcttctatagctgcagttgcatataacggaaaacctcgaactcctgatgtagttgttgatgagacttggtttactgatgcagatttttgtaaggaatcaaagctatggtatgtgctttcaaagactttggctgaggacgctgcctggaaatttgtaaaggagaagggtattgacatggttacaattaaccctgcaatggtgattggtcctctgttacagccaacacttaatacaagtgctgcagcagttttgaatgttattaagggagctcgaacatttcccaatgcaagttttggatggattaatgttaaagatgttgccaatgcacatattcaagcatttgagattccttcagctagtggcagatattgtttggttgagagagttgcacacttctcggaagttgtgagaattttacaggagctgtaccctggtttgcaacttccagagaagtgtgcggatgataagccttttgtgccaacatatcaggtgtccaaggagaaggcaaagaagttgggtgttgaattcattccattagaggttagcctcaaggaaacagttgaaagcctgaaggaaaagaattttgtcgatttctga

SEQ ID NO: 72249 - protein, 325 aa, Prunus mume
MSSGAGKVVCVTGASGYIASWLVKLLLQGGYTVKASVRDPNDPTKTEHLLGLDGAQERLQLFKANLLEEGSFDSAVDGCEGVFHTASPFYHDVTDPKAELLDPAVKGTLNVLNSCAKSQSIRRVVLTSSIAAVAYNGKPRTPDVVVDETWFTDADFCKESKLWYVLSKTLAEDAAWKFVKEKGIDMVTINPAMVIGPLLQPTLNTSAAAVLNVIKGARTFPNASFGWINVKDVANAHIQAFEIPSASGRYCLVERVAHFSEVVRILQELYPGLQLPEKCADDKPFVPTYQVSKEKAKKLGVEFIPLEVSLKETVESLKEKNFVDF

SEQ ID NO: 72250 - DNA, 1038 bp, Kluyveromyces marxianus
  CDS (1)..(1038)
atgacatttacagtggtgacaggcgcaaatggctacattgccaagcacattcttaaatcgttattagaagatggtcatcgcgtaattgggaccgtgagaaacagcaagaaggccgaggaattgaaaaggactgtcaatgatgagaatttgatagtggagttggttcccgacatgttagtggaaaacgcatttgacgagttgttcaagaagtacaacacccaaatcaagtatgtgttccacactgcgtccccggttctcgagacgtcaaaggactatgagaaaagcttgatcgagcccgcgattaccggtgcgaagtcaatggtggaagctatcaggaagtactcattgacatcggtcgagcacattgtgtatacgtcatcgattgctgccagctcgctggaatctgagtttaccgatccaacgctcgttgtcagcgaggatagttggaacccacaaggtttggaagaggcaaagacggagtttttcaccgcttactcgtactcgaagaaaatcgccgagaagacgatgtgggattttgttgaggaatacaaggggactgagcacgaaataaagctcactacggtcaacccatgcttcaacattgggccccaggcgtacgaggcggacgttaccgagactatgaacttcacggcggagttgatcaaccacgttgtgaaaagcaaagtgggcgatccgcttcctccaacgagaattgtgccatacgtcgatgtcagggacactgcgagagcgcatgtcgatgcgttgaagaacgagaagctggcattccaaagactgttggtggtggggccctttttgtcgagccagcagatctacgatattgtgaacgagcgcttcccgcaattgcggggcaagatcgcgcggggcgagcctggcagcgacaagctggaccctgcgaagctggccaagttcgaccacgcccggaccacgcaagctctcgggtgggagttcacgcctatcgagaaggctatagctgacgaggtggcccagatcctccgtgtgggcgcgtaccgtgggtaa

SEQ ID NO: 72251 - protein, 345 aa, Kluyveromyces marxianus
MTFTVVTGANGYIAKHILKSLLEDGHRVIGTVRNSKKAEELKRTVNDENLIVELVPDMLVENAFDELFKKYNTQIKYVFHTASPVLETSKDYEKSLIEPAITGAKSMVEAIRKYSLTSVEHIVYTSSIAASSLESEFTDPTLVVSEDSWNPQGLEEAKTEFFTAYSYSKKIAEKTMWDFVEEYKGTEHEIKLTTVNPCFNIGPQAYEADVTETMNFTAELINHVVKSKVGDPLPPTRIVPYVDVRDTARAHVDALKNEKLAFQRLLVVGPFLSSQQIYDIVNERFPQLRGKIARGEPGSDKLDPAKLAKFDHARTTQALGWEFTPIEKAIADEVAQILRVGAYRG

SEQ ID NO: 72252 - DNA, 1020 bp, Malus domestica
  CDS (1)..(1020)
atggccacccaacaacccatctcaaagaagacggcttgcgtcgtcggcggaaccgggttcgtggcgtctctgctggtcaagctactgctccagaagggctacgccgtcagaaccaccgtcagagaccctgacgaccgcaagaaggtctcccacctcacagcactacaagagttgggtgagctagagattttcgcaggagatctaactgatgaagggagcttcgatgccccaatagcaggctgtgatcttgttttccatgttgcaacccctgtcaactttgcctcacaggacccggagaatgatatgatcaaaccagcaatccaaggggtactaaatgttctgaagtcgtgcgtgaaagccaaaacagttaagcgcgttgttttgacatcatcagctgctacagtttcgatcaatacacttgaaggaacaggtttggtcgtggatgaaaaggattggagtgatttggagttcttgactaatgtaaagccacccacttgggggtaccctgcctccaagacactagctgagaagacagcttggaaatttgccgaagaaaacaacattgatctaatcactgtgatcccttctcttatggccggtccttctctcaccccagacgttcccagcagtatcggccttgccatggctttaatcacaggagatgatttcctcataaatatggccctgaaaggtatgcaaatgctatcaggttcgatatccattgcacatgtggaggacgtctgccgggctcatatatttttggctgagaaagaatctgcatctggtcggtacatttgctgtgctgccaacaccggcgttcctgagcttgctaagttcctcaacaaaagatacccccagtacaaagtccccactgagtttggagattttccgtctgaggccaaactgatcatctcttcagagaagcttatcaaggaggggttcgattttaagtatggcatcgaagaaatatatgaccaaactgtggagtacttcaaggcaaaggggctgctgcagaactag

SEQ ID NO: 72253 - protein, 339 aa, Malus domestica
MATQQPISKKTACVVGGTGFVASLLVKLLLQKGYAVRTTVRDPDDRKKVSHLTALQELGELEIFAGDLTDEGSFDAPIAGCDLVFHVATPVNFASQDPENDMIKPAIQGVLNVLKSCVKAKTVKRVVLTSSAATVSINTLEGTGLVVDEKDWSDLEFLTNVKPPTWGYPASKTLAEKTAWKFAEENNIDLITVIPSLMAGPSLTPDVPSSIGLAMALITGDDFLINMALKGMQMLSGSISIAHVEDVCRAHIFLAEKESASGRYICCAANTGVPELAKFLNKRYPQYKVPTEFGDFPSEAKLIISSEKLIKEGFDFKYGIEEIYDQTVEYFKAKGLLQN

SEQ ID NO: 72254 - DNA, 1020 bp, Malus domestica
  CDS (1)..(1020)
atggccacccaacaacccatctcaaagaagacggcttgcgtcgtcggcggaaccgggttcgtggcgtctctgctggtcaagctactgctccagaagggctacgccgtcagaaccaccgtcagagaccctgacaaccacaagaaggtctcccacctcacagcactacaagagttgggtgagctagagattttggcaggagatctaactgatgaagggagcttcgatgccccaatagcaggctgtgatcttgttttccatgttgcaacccctgtcaactttgcctcacaggacccggagaatgatatgatcaaaccagcaatccaaggggtactaaatgttctgaagtcgtgcgtgaaagccaaaacagttaagcgcgttgttttgacatcatcagctgctacagtttcgatcaatacacttgaaggaacaggtttggtcgtggatgaaaaggattggagtgatttggagttcttgactaatgtaaagccacccacttgggggtaccctgcctccaagacactagctgagaagacagcttggaaatttgccgaagaaaacaacattgatctaatcactgtgatcccttctcttatggccggtccttctctcactccagacgttcccagcagtatcggccttgccatggctttaatcacaggagatgatttcctcataaatatggccctgaaaggtatgcaaatgttatcaggttcgatatccattgcacatgtggaggacgtctgccgggctcatatatttttggctgagaaagaatctgcatctggtcggtacatttgctgtgctgccaacaccggcgttcctgagcttgctaagttcctcaacaaaagatacccccagtacaaagtccccactgagtttggagattttccgtctgaggccaaactgatcatctcttcagagaagcttatcaaggaggggttcgattttaagtatggcatcgaagaaatatatgaccaaactgtggagtacttcaaggcaaaggggctgctgcagaagtag

SEQ ID NO: 72255 - protein, 339 aa, Malus domestica
MATQQPISKKTACVVGGTGFVASLLVKLLLQKGYAVRTTVRDPDNHKKVSHLTALQELGELEILAGDLTDEGSFDAPIAGCDLVFHVATPVNFASQDPENDMIKPAIQGVLNVLKSCVKAKTVKRVVLTSSAATVSINTLEGTGLVVDEKDWSDLEFLTNVKPPTWGYPASKTLAEKTAWKFAEENNIDLITVIPSLMAGPSLTPDVPSSIGLAMALITGDDFLINMALKGMQMLSGSISIAHVEDVCRAHIFLAEKESASGRYICCAANTGVPELAKFLNKRYPQYKVPTEFGDFPSEAKLIISSEKLIKEGFDFKYGIEEIYDQTVEYFKAKGLLQK

SEQ ID NO: 72256 - DNA, 1074 bp, Triticum aestivum
  CDS (1)..(1074)
atgccgatcgaggcggcagacaacgtgccggccgagcttcccggccacggccggacggtgtgcgtcaccggcgccggcggcttcatcgcctcgtggctcgtcaagcgcctcctacagaagggctacaacgtgcggggcaccgttcgcaaccctgttgatccgaagaatgaccacctgagagccttcgacggcgccgccgaccgcctcgtcctcctccgcgccgaccttatggagcccgaaaccctcgtcgaggcgttcacgggctgtgagggcatcttccacgccgcttccccggtcaccgacgaccctgagaagatgatcgagccggcgatccgggggaccaagtatgtgatcactgcagccgcggacatgggcatcaagcgtgtagtgttcacgtccaccatcggcacggtgtacatgaaccccaacagggaccccagcaagcccgtcgacgacacctgctggagcgaccttgaatactgcaaaaagacagcgaactggtactgctacgcgaagacggtggccgagcaggacgcgctggagacggcccggcagcgcggcatcgagctgatcgtggtgaacccggtgctggtgctgggcccgctgctgcagccgacggtgaacgcgagcacggagcacgtgatgaagtacctgacggggtcggccaagacgtacgtgaacgcggcgcaggcgtacgtgcacgtcaaggatgtcgccgaggcgcacgtccgcgtctacgaggcgcccggcgcgcacggccgctacatctgcgccgagggcaccacgctccaccgcggcgagctctgccgcgtcctctgcaagcttttccccgagtaccccgtacccaccaagtgcaaggacgaggtgaacccaccggtgaaagggtacaaattcacgaaccagaggctcaaggacctggggatggagttcgtgccggtgctgcagagcatatacgagacggtgaagagcctccaggagaaagggatgctgccggtgctaccgccaggcgacgacgtccgagacaacctgcatgagcagctcatgatgaagcccgcccagttgctacgtaattaa

SEQ ID NO: 72257 - protein, 357 aa, Triticum aestivum
MPIEAADNVPAELPGHGRTVCVTGAGGFIASWLVKRLLQKGYNVRGTVRNPVDPKNDHLRAFDGAADRLVLLRADLMEPETLVEAFTGCEGIFHAASPVTDDPEKMIEPAIRGTKYVITAAADMGIKRVVFTSTIGTVYMNPNRDPSKPVDDTCWSDLEYCKKTANWYCYAKTVAEQDALETARQRGIELIVVNPVLVLGPLLQPTVNASTEHVMKYLTGSAKTYVNAAQAYVHVKDVAEAHVRVYEAPGAHGRYICAEGTTLHRGELCRVLCKLFPEYPVPTKCKDEVNPPVKGYKFTNQRLKDLGMEFVPVLQSIYETVKSLQEKGMLPVLPPGDDVRDNLHEQLMMKPAQLLRN

SEQ ID NO: 72258 - DNA, 999 bp, Lycopersicon esculentum
  CDS (1)..(999)
atgccatcagaatccggcaaagttgtttgtgtcaccggcgccggcggtttcattgcctcttggctcgttaaactccttctagaaaaaggctacactgtcagaggaaccgttagaaaccctgatgattccaaaaatggtcacctgaaggaacttgaaggtgcaaaggagagactgattctgttgagagctgatcttctagactatcagagtttgagagaagcaatttatggctgtgacggagttttccacaccgcctcccctgtcactgatgatccagaacaaatggtggagccagcagttattgggaccaagaatgtgataacagcagcagcagaaaccaaagttcgcagagttgtgtttacttcttcaattggtacagtatacatggaccccaaccgggcccctgataaagttgtggacgagacttgctggagtgatcttgactactgcaagaatactaagaattggtactgctatgggaagacagtggcggaaaagacagcgcgggatgaggcaagggaaaagggagtggatttggttgtgattaatccagttttggtgcttggaccactgcttcaaccaacagtgaatgccagtgttcttcacatactaaagtacctaactggatctgctaaaacatatgccaattcaattcaggcgtatgttcatgttaaggatgtggcactagcccacatacttctctacgaagctccttctgcatctggccgctatatctgcgcggagcgcgtgcttcatcgcggtgatgtggttgaaattctcgccaaattcttcccggagtatccaatccccaccaagtgctcggatgaaacgaggccaagggcaaaaccgtacatattcacgaaccaaaagctaaaggacttgggtttggagtttacgccagtgaaacaatgcttatatgagacagtgaagagtctgcaggagaagggtcaccttccagttcctactcaaaatgatgaacctattaaaattcactcttaa

SEQ ID NO: 72259 - protein, 332 aa, Lycopersicon esculentum
MPSESGKVVCVTGAGGFIASWLVKLLLEKGYTVRGTVRNPDDSKNGHLKELEGAKERLILLRADLLDYQSLREAIYGCDGVFHTASPVTDDPEQMVEPAVIGTKNVITAAAETKVRRVVFTSSIGTVYMDPNRAPDKVVDETCWSDLDYCKNTKNWYCYGKTVAEKTARDEAREKGVDLVVINPVLVLGPLLQPTVNASVLHILKYLTGSAKTYANSIQAYVHVKDVALAHILLYEAPSASGRYICAERVLHRGDVVEILAKFFPEYPIPTKCSDETRPRAKPYIFTNQKLKDLGLEFTPVKQCLYETVKSLQEKGHLPVPTQNDEPIKIHS

SEQ ID NO: 72260 - DNA, 999 bp, Lycopersicon esculentum
  CDS (1)..(999)
atgccgtcagtctccggtcgggtcgtctgtgttaccggtgccggaggcttcatcgcctcttggctcgttaaacttcttttggaaaaaggctacactgttaggggaactgtaagaaatcctgatgatccaaagaattgtcatttgagagaacttgaaggagcaaaagagaggctaacactatgcagaggtgatcttcttgattatcagagtttgcgtgaagcaatcaatggctgtgacggagttttccacacagcttcaccagttactgatgatccagaacaaatggtggagccagcagtaattggtactaagaatgtgataacagcagcagcagaggccaatgtaagacgcgttgtgtttacttcctcaattggagctgtgtacatggacccaagcagagaccctgaaaaagtggttgacgagacttgctggagcgatcctgatttttgcaagaacactaagaattggtattgttatggtaagatggtggcagaacaagcagcgtgggatgaggcgagggagaaaggagttgatttagtcgcgataaatccagtgttggtgcttggaccattgctacaaaatactgtgaatgctagtgttcttcatatcctcaagtaccttactggctcagctaaaacatatgctaattcagttcaagcatatgtacatgttaaggatgtggctttagctcacatacttctctatgaaactccttcagcatcaggacgttacctctgtgctgagagtgtgcttcatcgtggtgacatcgttgaaattctagccaaattcttccctgaatatcccatccccacaaagtgttcggatgtgacgaagccaagggtaaaaccatacaaattctcaaaccaaaaattgaaggatttggggatggaatttacaccagtgaaacaatgcttatatgagacagtgaagagtctacaagagaaaggtcaccttccaattccaactcaaaaggacgaaattattcgaattcagacttag

SEQ ID NO: 72261 - protein, 332 aa, Lycopersicon esculentum
MPSVSGRVVCVTGAGGFIASWLVKLLLEKGYTVRGTVRNPDDPKNCHLRELEGAKERLTLCRGDLLDYQSLREAINGCDGVFHTASPVTDDPEQMVEPAVIGTKNVITAAAEANVRRVVFTSSIGAVYMDPSRDPEKVVDETCWSDPDFCKNTKNWYCYGKMVAEQAAWDEAREKGVDLVAINPVLVLGPLLQNTVNASVLHILKYLTGSAKTYANSVQAYVHVKDVALAHILLYETPSASGRYLCAESVLHRGDIVEILAKFFPEYPIPTKCSDVTKPRVKPYKFSNQKLKDLGMEFTPVKQCLYETVKSLQEKGHLPIPTQKDEIIRIQT

SEQ ID NO: 72262 - DNA, 969 bp, Eucommia ulmoides
  CDS (1)..(969)
atgagtggagcggggaagacagtgtgcgtcaccggcgcgtctggtttcatagcctcctggatcgtcaagttcttgctccaacgcggctacaccgtccgggctaccgttcgcgatcccaacgatccaaagaagacagagcacttgcgcacacttgaaggagcgagtgagagactccacctgtttaaagcagagctacttgaggatggtgcctttgatgctgtggttgatgggactgatggtgttttccatactgcttctcccttcttctacaacactgataacccacagaaagatttgattgatcctgcagtgaagggatcagttaatgttcttggatcatgtgctaaatccccttctgtcaaaagggttgtcttgacatcttcagttgctgcagttgcgatcaattccaggccaaagaaccctgatgtggttgttgacgagacctggcattctgatgtcgagttttgcacgcaaaggaagctgtggtatgtgctttcaaagacattggccgaggaggctgcctggaaatttgctaaagagaaaggacttgacttagtgactatcaaccctgcaatggttatcggtcctttattgcagccatctctcaacacaagtgctagtgcaattcttaacttcctaaatggggcaaagacgtattcaaattcctcgatggggtggatcgacgtgaggaatgttgccaatgcacatattcaggcattcgagattccttcggccaacggaagatactgtttggttgagagagttgcacattattctgaaattgtgcagattttgcgcaaccattaccctactctcccgcttccagaaaagtgtgcggatgacaaccctttccagccaacattccaggtttcgaaagaaaaggccaagagcttgggcatcgagtttatcccactcgaggtcagcattaaggataccgtcgagagcttgaaggagaagaagtttttctag

SEQ ID NO: 72263 - protein, 322 aa, Eucommia ulmoides
MSGAGKTVCVTGASGFIASWIVKFLLQRGYTVRATVRDPNDPKKTEHLRTLEGASERLHLFKAELLEDGAFDAVVDGTDGVFHTASPFFYNTDNPQKDLIDPAVKGSVNVLGSCAKSPSVKRVVLTSSVAAVAINSRPKNPDVVVDETWHSDVEFCTQRKLWYVLSKTLAEEAAWKFAKEKGLDLVTINPAMVIGPLLQPSLNTSASAILNFLNGAKTYSNSSMGWIDVRNVANAHIQAFEIPSANGRYCLVERVAHYSEIVQILRNHYPTLPLPEKCADDNPFQPTFQVSKEKAKSLGIEFIPLEVSIKDTVESLKEKKFF

SEQ ID NO: 72264 - DNA, 984 bp, Nicotiana tabacum
  CDS (1)..(984)
atgagtttagcagcgaaaacagtatgcgtaacaggagcttcaggttacatagcgtcatggctcgtcaaattcttgctccagcgtggttacactgttaaggcttccgttcgtgacccaaatgatcccaagaaaacacaacatttgctttcccttggtggcggcgcagagaggcttcacttgttcaaagcaaacctcttagaagaaggttcatttgatgctgtggttgatggatatgaaggtgtattccatacagcatctccatttccctactctgttacagatccacaggctgagttacttgcccctgctgtcaaggggacactcaatcttctcggttcatgtgccaaagcaccgtcagtaaaacgagtggttttaacatcttccatagcagttgcttatagtggtcagcctcggacacctgaggttgtggttgatgaaagctggtggaccagtccagactattgcagagaaaaacagctctggtatgttctctcaaagacattggctgaggatgctgcatggaagtttgtgaaggagaaagggattgatatggttgcaataaatcctgctatggttattggtcctttgttacagcctacactcaatactagttctggtgcagtcttgaacttggtaaatggtgccgagacatacccaaattctacctttgggtgggttaacgtcaaagatgtcgcaaatgcacatattctcgcatttgagaatccttcagctaatggaagatatttaatggttgagagagttgcccactactctgatatactgaagatattacgtgatctttaccctactatgcgacttccagaaaagtgtgctgacgacaatccgttgatgcaaaactatcaagtatcaaaggaaagggcgaaaagcttgggtgttgaattcactcctctcgaagaaagcatcaaagaaactgtcgaaagtttgaaggaaaaaaggttttttggaggctcatcggctatgtga

SEQ ID NO: 72265 - protein, 327 aa, Nicotiana tabacum
MSLAAKTVCVTGASGYIASWLVKFLLQRGYTVKASVRDPNDPKKTQHLLSLGGGAERLHLFKANLLEEGSFDAVVDGYEGVFHTASPFPYSVTDPQAELLAPAVKGTLNLLGSCAKAPSVKRVVLTSSIAVAYSGQPRTPEVVVDESWWTSPDYCREKQLWYVLSKTLAEDAAWKFVKEKGIDMVAINPAMVIGPLLQPTLNTSSGAVLNLVNGAETYPNSTFGWVNVKDVANAHILAFENPSANGRYLMVERVAHYSDILKILRDLYPTMRLPEKCADDNPLMQNYQVSKERAKSLGVEFTPLEESIKETVESLKEKRFFGGSSAM

SEQ ID NO: 72266 - DNA, 972 bp, Nicotiana tabacum
  CDS (1)..(972)
atggcgacgaaaacagtatgtgtaacaggatcttcaggctacatagcttcatggttagtgaagtttctgctccagcgtggttataccgttaaggccactgttcgcgatcccagtgatccaaagaagacagatcacttacattcccttagtggagctaaggagaggcttcacttgttcaaagcgaaccttctggaagaaggtgcctttgatgctgtggttgatgggtgtgaaggcgtatttcatacagcatctccattttaccatggagtcaaagatccacaggcagaattaattgatcctgcactgaaggggacacttaatgttcttggatcagttgcaaagacgccatcaattagaagagtggttttgacatcatctgtagcagcagttgctttcaatggaaaaccgcgaacccctgaagtggtagttgatgagacatgggggtcggatcctgacttttgcagagaatcacagctctggtatgtactttcgaagacattggctgaggatgctgcatggaagtttgtgaaagagaaagctatcgatatggttacgataaacccagcaatggttattggcggtttgttacaaccaatacttaatacaagttgcgctgctgtcttacaactgataaatggtgctgaaacatacccaaatgctacacttggatgggttaatgtgaaagatgttgccctcgcgcatattctagcatttgaaaacccttcagctaatggtagatatttaatggttgaggcagttgcacactactctgagttagtgaagatattacgcgagcattatcccacaatgaagcttccagaaaagtgtgttgatgataagccatttcctccgaagtaccaggttaacatagaaagagcaaagcaattgggtgttgagttcactcccttggctgaaagcatcaaagaaactgtcgaaagcttgaaggagaaaaaattctattcagatgcttag

SEQ ID NO: 72267 - protein, 323 aa, Nicotiana tabacum
MATKTVCVTGSSGYIASWLVKFLLQRGYTVKATVRDPSDPKKTDHLHSLSGAKERLHLFKANLLEEGAFDAVVDGCEGVFHTASPFYHGVKDPQAELIDPALKGTLNVLGSVAKTPSIRRVVLTSSVAAVAFNGKPRTPEVVVDETWGSDPDFCRESQLWYVLSKTLAEDAAWKFVKEKAIDMVTINPAMVIGGLLQPILNTSCAAVLQLINGAETYPNATLGWVNVKDVALAHILAFENPSANGRYLMVEAVAHYSELVKILREHYPTMKLPEKCVDDKPFPPKYQVNIERAKQLGVEFTPLAESIKETVESLKEKKFYSDA

SEQ ID NO: 72268 - DNA, 1020 bp, Malus domestica
  CDS (1)..(1020)
atggccacccaacaacccatctcaaagaagacggcttgcgtcgtcggcggaaccgggttcgtggcgtctctgctggtcaagctactgctccagaagggctacgccgtcagaaccaccgtcagagaccctgacaaccacaagaaggtctcccacctcacagcactacaagagttgggtgagctagagattttcgcaggagatctaactgatgaagggagcttcgatgccccaatagcaggctgtgatcttgttttccatgttgcaacccctgtcaactttgcctcacaggacccggagaatgatatgatcaaaccagcaatccaaggggtactaaatgttctgaagtcgtgcgtgaaagccaaaacagttaagcgcgttgttttgacatcatcagctgctacagtttcgatcaatacacttgaaggaacaggtttggtcgtggatgaaaaggattggagtgatttggagttcttgactaatgtaaagccacccacttgggggtaccctgcctccaagacactagctgagaagacagcttggaaatttgccgaagaaaacaacattgatctaatcactgtgatcccttctcttatggccggtccttctctcaccccagacgttcccagcagtatcggccttgccatggctttaatcacaggagatgatttcctcataaatatggccctgaaaggtatgcaaatgctatcaggttcgatatccattgcacatgtggaggacgtctgccgggctcatatatttttggctgagaaagaatctgcatctggtcggtacatttgctgtgctgccaacaccggcgttcctgagcttgctaagttcctcaacaaaagatacccccagtacaaagtccccactgagtttggagattttccgtctgaggccaaactgatcatctcttcagagaagcttatcaaggaggggttcgattttaagtatggcatcgaagaaatatatgaccaaactgtggagtacttcaaggcaaaggggctgctgcagaactag

SEQ ID NO: 72269 - protein, 339 aa, Malus domestica
MATQQPISKKTACVVGGTGFVASLLVKLLLQKGYAVRTTVRDPDNHKKVSHLTALQELGELEIFAGDLTDEGSFDAPIAGCDLVFHVATPVNFASQDPENDMIKPAIQGVLNVLKSCVKAKTVKRVVLTSSAATVSINTLEGTGLVVDEKDWSDLEFLTNVKPPTWGYPASKTLAEKTAWKFAEENNIDLITVIPSLMAGPSLTPDVPSSIGLAMALITGDDFLINMALKGMQMLSGSISIAHVEDVCRAHIFLAEKESASGRYICCAANTGVPELAKFLNKRYPQYKVPTEFGDFPSEAKLIISSEKLIKEGFDFKYGIEEIYDQTVEYFKAKGLLQN

SEQ ID NO: 72270 - DNA, 1017 bp, Vitis vinifera
  CDS (1)..(1017)
atggccacccagcaccccatcggaaagaagaccgcatgtgtcgtcggcggcaccggatttgttgcatctttgctggttaagcttttgctgcagaagggctatgctgtcaacaccactgtcagggaccctgacaatcagaaaaaagtctctcacctcctagaactacaggagttgggtgacctaaaaatctttcgagcagatctaactgacgaattgagctttgaggcccctatagcaggttgcgactttgtcttccatgttgctacgcccgtccactttgcttctgaagatccagagaatgacatgatcaagccagcaattcaaggagtagtgaatgtcatgaaagcttgtacaagggcaaaatcagttaaacgagtcattttgacatcctctgcagctgctgttaccatcaatcagcttgatgggacaggtctggttgtggatgagaagaactggactgatattgagttcttgacttccgcgaagccacctacttggggctatcctgcctccaagacactagctgagaaagcagcttggaaatttgccgaagaaaataacattgatctgatcactgtcatccctactctgatggccggttcctctcttacttcagatgtccccagcagcattggacttgcaatgtccttgattacagggaatgaattcctcataaacggtatgaaaggtatgcagatgctgtcaggttcagtctccattgcacatgtggaagatgtttgccgggcacatatatttgtagctgagaaagaatcagcttctggccgatacatctgctgtgctgccaataccagtgttcctgagctagcaaagttcctgagcaaaagataccctcagtacaaagtcccaactgattttggagacttcccccctaaatcgaagttgataatctcctcagagaagcttgtgaaagaggggttcagttttaagtacgggattgaagaaatttatgatgaaagtgtggagtatttcaaggccaaggggctattgcagaattga

SEQ ID NO: 72271 - protein, 338 aa, Vitis vinifera
MATQHPIGKKTACVVGGTGFVASLLVKLLLQKGYAVNTTVRDPDNQKKVSHLLELQELGDLKIFRADLTDELSFEAPIAGCDFVFHVATPVHFASEDPENDMIKPAIQGVVNVMKACTRAKSVKRVILTSSAAAVTINQLDGTGLVVDEKNWTDIEFLTSAKPPTWGYPASKTLAEKAAWKFAEENNIDLITVIPTLMAGSSLTSDVPSSIGLAMSLITGNEFLINGMKGMQMLSGSVSIAHVEDVCRAHIFVAEKESASGRYICCAANTSVPELAKFLSKRYPQYKVPTDFGDFPPKSKLIISSEKLVKEGFSFKYGIEEIYDESVEYFKAKGLLQN

SEQ ID NO: 72272 - DNA, 1011 bp, Oryza sativa
  CDS (1)..(1011)
atgagctccgagtctgaggcggcgcccgggaccgggaagctggtgtgcgtcaccggcgcgtcggggtacatcgcgtcgtggctcgtcaggctgctcctcgcccgcggctacacggtccgcgccaccatccgggacacctctgacccaaagaaaacactacacctgcgtgccctggatggagccaacgaaagactccatttgttcgaagcaaatctgctggaagagggctctttcgatgctgcggtcaatggttgtgattgtgttttccatacggcttctcccttttaccacaatgttaaagatcctaaggctgagttacttgaccctgcagtcaaaggaacccttaatgttctaggctcctgcaagaaagcttccattagaagagttatcgtgacatcatccatggctgctgttgcctacaatgggaaaccaagaactcctgatgtagttgttgatgagacatggttttcagttccagagatttgtgaaaagcatcagcaatggtatgttctgtccaagaccctagcagaggaggctgcttggaagttttcaaaagataatggatttgaaatagttacggtgaacccagcaatggtcattggtcccctgctgcagccttcactgaatactagtgctgaagcaattctgaagctaatcaatggatcatcctcgacatatcctaatttcagctttggctggataaacgttaaggatgttgccctggcacatatccttgcatatgaagttccttcagcaaatggaagatattgcatggttgaaagagttgcgcactactcagagctcgtccaaatcattcgtgagatgtatcccaatattcctctgccagacaagtgtgcagatgacaagccatcagtgccaatctaccaggtatcaaaggaaaagataaaaagcttgggcctggaactgactcccctgcacacgagcatcaaggagaccatcgagagcttgaaagagaaaggatttgttacttttgattcaagcaacctgtaa

SEQ ID NO: 72273 - protein, 336 aa, Oryza sativa
MSSESEAAPGTGKLVCVTGASGYIASWLVRLLLARGYTVRATIRDTSDPKKTLHLRALDGANERLHLFEANLLEEGSFDAAVNGCDCVFHTASPFYHNVKDPKAELLDPAVKGTLNVLGSCKKASIRRVIVTSSMAAVAYNGKPRTPDVVVDETWFSVPEICEKHQQWYVLSKTLAEEAAWKFSKDNGFEIVTVNPAMVIGPLLQPSLNTSAEAILKLINGSSSTYPNFSFGWINVKDVALAHILAYEVPSANGRYCMVERVAHYSELVQIIREMYPNIPLPDKCADDKPSVPIYQVSKEKIKSLGLELTPLHTSIKETIESLKEKGFVTFDSSNL

SEQ ID NO: 72274 - DNA, 975 bp, Oryza sativa
  CDS (1)..(975)
atgatggctaaggctgaagggggcaaaatggtatgtgtgacaggagcaggaggcttcattgggtcgtgggtggtgaaggagctcctgctccgtggctatgccgtgagaggaactgcaagagatccatctagtcaaaagaactcccatttgcaaaaacttgaaggagccaaagagaggctctgtctgaactatgcagatgtgatggactatgatagtctttctgttgcatttaatggatgtgaaggtgtattccatgttgcctcacctgtatctgttgatccgcgacttgtgcctgttgctgttgaaggaactaagaacgtgatcaacgctgcagcagacatgggcgtacgacgcgtggtgttcacatcaaccttcggtgctgtacacatggacccaaataggagccatgatacagtcgtggatgagagctgctggagtaaccttgagttctgcaaacaaaaagactggtactgttatgccaaaacggttgctgagatggtagcagcagagcaggcatcgaagagagggattcagctagtggtggtgcttcctgccatgacactaggccagatgttgcaatcaaccataaaccctagcatcagacatatcgccgatttcttgaacggaagcaggaaaacccaccggaatgctgtcgctgggtatgttgatgcgcgcgatgtggcccgtgcacatgcactggtgtatgaagaccccaaggcgcatgggcgttatctctgcattgctagtgtgcttcaccggtccgagcttattcagatgatcagagaactctttccacagtatccaatcacctgtaacaagtgtgaagacagcaagcagatggtccaacctttcaagttctctaatcaaaggctgagagacttgggcctcacattcacccccataaaagaaagtttgtacaacacactgatatgcctacgggagaaggggcacctaccgccttattcatctctttga

SEQ ID NO: 72275 - protein, 324 aa, Oryza sativa
MMAKAEGGKMVCVTGAGGFIGSWVVKELLLRGYAVRGTARDPSSQKNSHLQKLEGAKERLCLNYADVMDYDSLSVAFNGCEGVFHVASPVSVDPRLVPVAVEGTKNVINAAADMGVRRVVFTSTFGAVHMDPNRSHDTVVDESCWSNLEFCKQKDWYCYAKTVAEMVAAEQASKRGIQLVVVLPAMTLGQMLQSTINPSIRHIADFLNGSRKTHRNAVAGYVDARDVARAHALVYEDPKAHGRYLCIASVLHRSELIQMIRELFPQYPITCNKCEDSKQMVQPFKFSNQRLRDLGLTFTPIKESLYNTLICLREKGHLPPYSSL

SEQ ID NO: 72276 - DNA, 966 bp, Oryza sativa
  CDS (1)..(966)
atgttgggcggcgacgggagaacgaagacggtgtgcgtgaccggcgccgggggcttcgtggcgtcgtggctcgtcaagctcctcctctcccgcggctgctacaccgtccatggcaccgtccgtgatccaggcgacgccaagaacgcccacctgatgtctctggacggcgccgcggagaggctgcggctgttcaaggccgacctgctcgactacggcagcgtggcggcggccatcgccggctgcgacgacgtcttccatgtggcctgccccgtgctcctctccgcccccaacccagaggttgatatacttgctcctgctgtaacgggcacgacgaatgtgctgaaggcttgttcagaagctaaggttgggagggttgtggtggtgtcatctgtctctgctgcgatggtgaatcctaactggtctgagggcaaggccatagatgaagattgctggtctgatgtcgattactgcagagccactaagaattggtatacccttgggaaaacacttgcggagattgaggcctttgattatgcgaagagaagtggattggatcttgtgacactctgcccatcgttggtgattggacctttgctgcaaccaactgtgaatgcgagcagtacagtcatacttggatgtctgaaaggtgattgtgaggtaaaaatcaaactgaggaactttgtggatgtcagggatgttgccgatgctcttcttttactgtatgaaaccccaggggtctccggacgatacatctgcagttcacacgcaagaaggatgcctcatatcattgacttactaaagagctggtatcccggttacaaatttgccgacaagtttgtggaagtgagcgatgagccgcaattcaactcggggaagctagagaagctaggatggaaaatcaagccatttgaggaaacactcagggacagtgttgaatcttatagagctgcaggtgtcctggattga

SEQ ID NO: 72277 - protein, 321 aa, Oryza sativa
MLGGDGRTKTVCVTGAGGFVASWLVKLLLSRGCYTVHGTVRDPGDAKNAHLMSLDGAAERLRLFKADLLDYGSVAAAIAGCDDVFHVACPVLLSAPNPEVDILAPAVTGTTNVLKACSEAKVGRVVVVSSVSAAMVNPNWSEGKAIDEDCWSDVDYCRATKNWYTLGKTLAEIEAFDYAKRSGLDLVTLCPSLVIGPLLQPTVNASSTVILGCLKGDCEVKIKLRNFVDVRDVADALLLLYETPGVSGRYICSSHARRMPHIIDLLKSWYPGYKFADKFVEVSDEPQFNSGKLEKLGWKIKPFEETLRDSVESYRAAGVLD

SEQ ID NO: 72278 - DNA, 1011 bp, Eucalyptus globulus
  CDS (1)..(1011)
atgcccgtsgacgccctccccggttccggccagaccgtctgcgtcaccggcgccggcggcttcatcgcctcctggattgtcaagctgctcctcgagcgaggctacaccgtgcgaggaactgtcaggaacccagacgacccgaagaatgggcatctgagagatctggaaggagccagcgagaggctgacgctgtacaagggtgatctgatggactacgggagcttggaagaagccatcaaggggtgcgacggcgtcgtccacaccgcctctccggtcaccgacgatcctgagcaaatggtggagccagcggtgatcgggacgaaaaatgtgatcgtcgcagcggcggaggccaaggtccggcgggttgtgttcacctcctccatcggtgcagtcaccatggaccccaaccggggtccagacgttgtggtggacgagtcttgttggagcgacctcgaattttgcaagagcactaagaactggtattgytacggcaaggcagtggcggagaaggccgcttgcgcagaggcgaaggagagaggggttgacctcgtggtgattaaccctgtgctcgtgcttggaccgctccttcagtcgacgatcaatgcgagcatcatccacatcctcaagtacttgactggctcagccaagacctacgccaactcggtccaggcgtacgtgcacgtcaaggacgtcgcgcttgcccacgtccttgtcttggagaccccatccgcctcaggccgctatttgtgcgccgagagcgtcctccaccgtggcgatgtggtggaaatccttgccaagttcttccctgagtataacgtaccgaccaagtgctctgatgaggtgaacccaagagtaaaaccatacaagttctccaaccagaagctgagagacttggggctcgagttcaccccggtgaagcagtgcctgtacgaaactgtcaagagcttgcaggagaaaggccacctacccgtccctcccccgccggaagattcggtgcgtattcagggatga

SEQ ID NO: 72279 - protein, 336 aa, Eucalyptus globulus
MPVDALPGSGQTVCVTGAGGFIASWIVKLLLERGYTVRGTVRNPDDPKNGHLRDLEGASERLTLYKGDLMDYGSLEEAIKGCDGVVHTASPVTDDPEQMVEPAVIGTKNVIVAAAEAKVRRVVFTSSIGAVTMDPNRGPDVVVDESCWSDLEFCKSTKNWYCYGKAVAEKAACAEAKERGVDLVVINPVLVLGPLLQSTINASIIHILKYLTGSAKTYANSVQAYVHVKDVALAHVLVLETPSASGRYLCAESVLHRGDVVEILAKFFPEYNVPTKCSDEVNPRVKPYKFSNQKLRDLGLEFTPVKQCLYETVKSLQEKGHLPVPPPPEDSVRIQG

SEQ ID NO: 72280 - DNA, 1011 bp, Eucalyptus globulus
  CDS (1)..(1011)
atgcccgtcgacgccctccccggttccggccagaccgtctgcgtcaccggcgccggcggcttcatcgcctcctggattgtcaagctgctcctcgagcgaggctacaccgtgcgaggaaccgtcaggaacccagacgacccgaagaatgggcatctgagagagctggaaggagccagcgagaggctgacgctgtacaagggtgatctgatggactacggtagcttggaagaagccatcaaggggtgcgacggcgtcgtccacaccgcctctccggtcaccgacgatcctgagcaaatggtggagccagcggtgatcgggacgaaaaatgtgatcgtcgcagcggcggaggccaaggtccggcgggttgtgttcacctcctccatcggtgcagtcaccatggaccccaaccggggtccagacgttgtggtggacgagtcttgttggagcgacctcgaattttgcaagagcactaagaactggtattgctacggcaaggcagtggcggagaaggccgcttgcgcagaggcgaaggagagaggggttgacctcgtggtgattaaccctgtgctcgtgcttggaccgctccttcagtcgacgatcaatgcgagcatcatccacatcctcaagtacttgactggctcagccaagacctacgccaactcggtccaggcgtacgtgcacgtcaaggacgttgcgcttgcccacgtccttgtcttggagaccccatccgcctcaggccgctatttgtgcgccgagagcgtcctccaccgtggcgatgtggtggaaatccttgccaagttcttccctgaatataacgtaccgaccaagtgctctgatgaggtgaacccaagagtaaaaccatacaagttctccaaccagaagctgaaagacttggggctcgagttcaccccggtgaagcagtgcctgtacgaaactgtcaagagcttgcaggagaaaggccacctacccgtccctcccccgccggaagattcggtgcgtattcagggatga

SEQ ID NO: 72281 - protein, 336 aa, Eucalyptus globulus
MPVDALPGSGQTVCVTGAGGFIASWIVKLLLERGYTVRGTVRNPDDPKNGHLRELEGASERLTLYKGDLMDYGSLEEAIKGCDGVVHTASPVTDDPEQMVEPAVIGTKNVIVAAAEAKVRRVVFTSSIGAVTMDPNRGPDVVVDESCWSDLEFCKSTKNWYCYGKAVAEKAACAEAKERGVDLVVINPVLVLGPLLQSTINASIIHILKYLTGSAKTYANSVQAYVHVKDVALAHVLVLETPSASGRYLCAESVLHRGDVVEILAKFFPEYNVPTKCSDEVNPRVKPYKFSNQKLKDLGLEFTPVKQCLYETVKSLQEKGHLPVPPPPEDSVRIQG

SEQ ID NO: 72282 - DNA, 1011 bp, Eucalyptus globulus
  CDS (1)..(1011): n means a or g or c or t/u, s means g or c
atgcccgtcgacgccctccccggttccggccagaccgtctgcgtcaccggcgccggcggcttcatcgcctcctggattgtcaagctgctcctcgagcgaggctacaccgtgcgaggaaccgtcaggaacccagacgacccgaagaatgggcatctgagagagctggacggagccagcgagaggctgacgctgtacaagggtgatctgatggactacgagagcttgagagaagccatcatggggtgcgacggcgtcgtccacaccgcctctccggtcaccgacgatcctgagcaaatggtggagccagcggtgatcgggacgaaaaatgtgatcgtcgcagcggcggaggccaaggtccggcgggttgtgttcacctcctccatcggtgcagtcaccatggaccccaaccggggtccggacgttgtggtggacgagtcttgttggagcgacctcgaattttgcaagagcactaagaactggtattgctacggcaaggcagtggcggagaaggccgcttgcgcakaggcgaaggagagaggggttgacctcgtggtgattaaccctgtgctcgtgcttggaccgctccttcagtcgacgatcaatgcgagcatcatccacatcctcaagtacttgactggctcagccaagacctacgccaactcggtccaggcatacgtgcacgtcaaggacgtcgcgcttgcccatgtccttgtcttggagaccccatccgcctcaggccgctatttgtgcgccgagagcgtcctccaccgtggcgatgtggtggaaatccttgccaagttcttccctgagtataacgtaccgaccaagtgctctgatgaggtgaacccaagagtaaaaccatacaagttctccaaccagaagctgaaagacttggggctcgagttcaccccggtgaagcagtgcctgtacgaaactgtcaagagcttgcaggagaaaggccacctacccgtccctcccccgccggaagattcggtgcgtatccagggatga

SEQ ID NO: 72283 - protein, 336 aa, Eucalyptus globulus
  misc_feature <175>..<175>: The Xaa at location 175 stands for    , or Glu.
MPVDALPGSGQTVCVTGAGGFIASWIVKLLLERGYTVRGTVRNPDDPKNGHLRELDGASERLTLYKGDLMDYESLREAIMGCDGVVHTASPVTDDPEQMVEPAVIGTKNVIVAAAEAKVRRVVFTSSIGAVTMDPNRGPDVVVDESCWSDLEFCKSTKNWYCYGKAVAEKAACAXAKERGVDLVVINPVLVLGPLLQSTINASIIHILKYLTGSAKTYANSVQAYVHVKDVALAHVLVLETPSASGRYLCAESVLHRGDVVEILAKFFPEYNVPTKCSDEVNPRVKPYKFSNQKLKDLGLEFTPVKQCLYETVKSLQEKGHLPVPPPPEDSVRIQG

SEQ ID NO: 72284 - DNA, 1011 bp, Eucalyptus cordata
  CDS (1)..(1011): n means a or g or c or t/u, s means g or c
atgcccgtckacgccctcyccggttccsgccagaccgtstgygtcaccggcgccggcggcttcatcgcctcctggattgtcaagcttctcctckagcgaggctacaccgtgcgaggaaccgtcaggaacccagacgacccgaagaatggtcatctgagagatctggaaggagccagcgagaggctgacgctgtacaagggtgatctgatggactacgggagcttggaagaagccatcaaggggtgcgacggcgtcgtccacaccgcctctccggtcaccgacgatcctgagcaaatggtggagccagcggtgatcgggacgaaaaatgtgatcgtcgcagcggcggaggccaaggtccggcgggttgtgttcacctcctccatcggtgcagtcaccatggaccccaaccggggtccggacgttgtggtggacgagtcttgttggagcgacctcgaattttgcaagagcactaagaactggtattgctacggcaaggcagtggcggagaaggccgcttgcgcagaggcgaaggagagaggggttgacctcgtggtgattaaccctgtgctcgtgcttggaccgctccttcagtcgacgatcaatgcgagcatcatccacatcctcaagtacttgactggctcagccaagacctacgccaactcggtccaggcgtacgtgcacgtcaaggacgtcgcgcttgcccacgtccttgtcttggagaccccatccgcctcaggccgctatttgtgcgccgagagcgtcctccaccgtggcgatgtggtggaaatccttgccaagttcttccctgagtataacgtaccgaccaagtgctctgatgaggtgaacccaagagtaaaaccatacaagttctccaaccagaagctgagagacttggggctcgagttcaccccggtgaagcagtgcctgtacgaaactgtcaagagcttgcaggagaaaggccacctacccgtccctcccccgccggaagattcggtgcgtattcagggatga

SEQ ID NO: 72285 - protein, 336 aa, Eucalyptus cordata
  misc_feature <4>..<4>: The Xaa at location 4 stands for Asp, or Tyr.
  misc_feature <7>..<7>: The Xaa at location 7 stands for Pro, or Ser.
  misc_feature <10>..<10>: The Xaa at location 10 stands for Arg, or Gly.
  misc_feature <32>..<32>: The Xaa at location 32 stands for    , or Glu.
MPVXALXGSXQTVCVTGAGGFIASWIVKLLLXRGYTVRGTVRNPDDPKNGHLRDLEGASERLTLYKGDLMDYGSLEEAIKGCDGVVHTASPVTDDPEQMVEPAVIGTKNVIVAAAEAKVRRVVFTSSIGAVTMDPNRGPDVVVDESCWSDLEFCKSTKNWYCYGKAVAEKAACAEAKERGVDLVVINPVLVLGPLLQSTINASIIHILKYLTGSAKTYANSVQAYVHVKDVALAHVLVLETPSASGRYLCAESVLHRGDVVEILAKFFPEYNVPTKCSDEVNPRVKPYKFSNQKLRDLGLEFTPVKQCLYETVKSLQEKGHLPVPPPPEDSVRIQG

SEQ ID NO: 72286 - DNA, 1014 bp, Camellia sinensis
  CDS (1)..(1014)
atggaagcccaaccgacagctccgaaggccgcatgtgttgttggtggcaccggcttcgtggcggcgacgctcatcaagttgttgcttgagaaaggctatgcggtcaacaccactgtcagggacccaggcaatcagaaaaagacctctcaccttctagcactaaagggttcaggcaacctaaaaatcttccgagcagacctcaccgatgaacagagctttgacacccctgtagcgggttgtgacctggtcttccatgtcgctacaccggtcaactttgcttccgaggatccagagaatgacatgataaaaccagcaattcaaggagtagtcaatgttctaaaagcttgtgcaaaagcaggaacggttaaacgtgtcattttaacatcatcagcagctgctgtatcgatcaataagctcaatgggaccggcctggtcatggatgagagtcactggactgacaccgagtttttgaattctgcgaagccgcccacttgggggtaccctttatcgaaaacactagctgagaaagctgcttggaagtttgccgaagaaaataacattaatcttatcactgtcatccctactctcatggccggtccgtctcttactgcagatgtccctagcagtattggtcttgccatgtccttgatcacagggaatgaatttctcataaatgggttgaaaggtatgcaaatgctgtcaggctcaatctccatctcccacgtggaggacgtttgtcgtgcccacgtgtttgtggcagagaaagaatcggcctctggtcgatacatttgttgcgctgtcagcaccagtgttcccgagctagccaagttcctcaacaaaagatatccagagtacaatgtccctactgattttggagattttccatcaaaagcgaagttgatcctctcgtcagagaagcttaccaaagagggattcagtttcaagtatgggatcgaagaaatttacgatcaatctgtggagtacttcaaggctaaggggattttgaagaattga

SEQ ID NO: 72287 - protein, 337 aa, Camellia sinensis
MEAQPTAPKAACVVGGTGFVAATLIKLLLEKGYAVNTTVRDPGNQKKTSHLLALKGSGNLKIFRADLTDEQSFDTPVAGCDLVFHVATPVNFASEDPENDMIKPAIQGVVNVLKACAKAGTVKRVILTSSAAAVSINKLNGTGLVMDESHWTDTEFLNSAKPPTWGYPLSKTLAEKAAWKFAEENNINLITVIPTLMAGPSLTADVPSSIGLAMSLITGNEFLINGLKGMQMLSGSISISHVEDVCRAHVFVAEKESASGRYICCAVSTSVPELAKFLNKRYPEYNVPTDFGDFPSKAKLILSSEKLTKEGFSFKYGIEEIYDQSVEYFKAKGILKN

SEQ ID NO: 72288 - DNA, 1074 bp, Oryza sativa
  CDS (1)..(1074)
atgaccgtcgtcgtcgttgccgatgacgccgccgccgccgcagcggcggcgcagcagcaggaggagctgccgccggggcacggccaaacggtgtgtgtcaccggcgccgccgggtacatcgcgtcgtggctcgtcaagctgctgctggagaggggctacaccgtgaagggcacagtgagaaacccagatgacccgaagaacgcccacctgaaggcgctggacggcgccgacgagaggctggtcctctgcaaggccgacctcctcgactacgactccatccgcgccgccgtcgacggctgccacggcgtgttccacaccgcctcccccgtcaccgatgaccctgagcagatggtggagccggcggtgcgggggacggagtacgtgataaaggcggcggcggaggccggcacggtgcgccgggtggtgttcacgtcgtccatcggcgccgtcaccatggaccccaaccgcggccccgacgtggtcgtcgacgagtcctgctggagcgacctcgagttctgcaagaaaaccaagaactggtactgctacggtaaggcggtggcagagcaggaggcgtgcaaggcggccgaagagcgcggcgtcgacctcgtcgtcgtcagccccgtgctggtggtcggcccgctgctgcagccgacggtgaacgccagcgccgtgcacatcctcaagtacctcgacggctcggccaagaagtacgccaatgccgtgcaggcgtacgtggacgtgcgcgacgtcgcggctgcgcacgtccgcgtcttcgaggcgccggaggcctccggccggcacctctgcgccgagcgcgtcctgcaccgtgaggacgtcgtccacatcctcggcaagctcttccccgagtatcctgtgcccacaaggtgctctgacgaggtgaacccacggaagcagccgtacaagatgtccaacaagaagctgcaggatcttggcctccacttcatacctgtgagcgactcgctctacgagacggtgaagagcctccaggagaaggggcaccttccagttctgagcaaagagatcccagaagagttgaatggtgtgccagcatga

SEQ ID NO: 72289 - protein, 357 aa, Oryza sativa
MTVVVVADDAAAAAAAAQQQEELPPGHGQTVCVTGAAGYIASWLVKLLLERGYTVKGTVRNPDDPKNAHLKALDGADERLVLCKADLLDYDSIRAAVDGCHGVFHTASPVTDDPEQMVEPAVRGTEYVIKAAAEAGTVRRVVFTSSIGAVTMDPNRGPDVVVDESCWSDLEFCKKTKNWYCYGKAVAEQEACKAAEERGVDLVVVSPVLVVGPLLQPTVNASAVHILKYLDGSAKKYANAVQAYVDVRDVAAAHVRVFEAPEASGRHLCAERVLHREDVVHILGKLFPEYPVPTRCSDEVNPRKQPYKMSNKKLQDLGLHFIPVSDSLYETVKSLQEKGHLPVLSKEIPEELNGVPA

SEQ ID NO: 72290 - DNA, 1017 bp, Citrus sinensis
  CDS (1)..(1017)
atgggctctatagctgagactgtgtgcgtgactggcgcttctgggtttatcggttcatggctcatcatgagattgctcgagcgtggctatgctgttcgtgctactgttcgcgatcctgataacaaaaagaaagtgaaacatttgctggagttgccgaaggcaagcactcacctgactttatggaaagccgatttagccgaagagggaaactttgatgaagcgattcgaggctgcactggagtttttcatctggccacgcctatggactttgagtccaaggatcctgagaatgaagtgataaggccgacaataaatgggatggtaagcatcatgagagcgtgtaaaaatgcgaagactgtgaggaggttagtgttcacatcatcagcgggaactttggatgttgaggagcaccgaaagccagtttatgatgaaacctcctggagtgacttggattttgttcggtctgttaagatgactggatggatgtattttgtgtccaagacactggcagagcaagctgcgtggaagtttgctgaagaaaataacattgattttatcagtataatcccaagtcttgttgttggtccattccttacgtcgtcaatgccacccagtctcataactgcactctcgcccattacaagaaatgaagcgcattatccaattataaagcaaggccaatttgtgcatttggatgatctctgcagtgctcatatatttttgtttgagcatcctaacgcgaagggccgctacatttgctcttctcacccggcaaccattcttgagcttgcaaaattcctcagggaaaaataccccgaattcaatgtgcccacagagttcgaagatgttgatgagaatatgaaaaatatgctcttctcttctaagaagctgacagatttgggatttaagttcaagtacagcctagatgacatgttcacaggtgctgtggatacttgcagagccaagggattgcttcctcttctttgtgaaaatcatgtcagcgaagtatccatataa

SEQ ID NO: 72291 - protein, 338 aa, Citrus sinensis
MGSIAETVCVTGASGFIGSWLIMRLLERGYAVRATVRDPDNKKKVKHLLELPKASTHLTLWKADLAEEGNFDEAIRGCTGVFHLATPMDFESKDPENEVIRPTINGMVSIMRACKNAKTVRRLVFTSSAGTLDVEEHRKPVYDETSWSDLDFVRSVKMTGWMYFVSKTLAEQAAWKFAEENNIDFISIIPSLVVGPFLTSSMPPSLITALSPITRNEAHYPIIKQGQFVHLDDLCSAHIFLFEHPNAKGRYICSSHPATILELAKFLREKYPEFNVPTEFEDVDENMKNMLFSSKKLTDLGFKFKYSLDDMFTGAVDTCRAKGLLPLLCENHVSEVSI

SEQ ID NO: 72292 - DNA, 1017 bp, Populus tomentosa
  CDS (1)..(1017)
atgccggttgatgcttcatcactttcaggccaaggccaaactatctgtgtcaccggggctggtggtttcattgcttcttggatggttaaacttcttttagataaaggttacactgttagaggaactgcgaggaacccagctgatcccaagaattcccatttgagggagcttgaaggagctcaagaaagattaactttatgcaaagctgatcttcttgattatgagtctcttaaagaggctattcaagggtgtgatggtgttttccacactgcttctcccgtcacagatgatccggaagaaatggtggagccagcagtgaacgggaccaaaaatgtgatcattgcggcggctgaggccaaagtccgacgagtggtgttcacgtcctcaattggtgctgtgtacatggatcccaataagggcccagatgttgtcattgatgaatcttgctggagtgatcttgaattctgcaagaacaccaagaattggtattgccatggaaaggcggtggcagaacaagctgcgtgggatatggctaaggagaaaggggtggacctagtggtggttaacccagtgctggtgctcggaccattgttgcagcccactgtcaatgctagcatcgttcacatcctcaagtacctcaccggctcagccaagacatatgctaactctgttcaagcttatgtgcatgttagggatgtggcactagcccacattttagtctttgagacgccttccgcctccggccgttacctttgctctgagagcgttctccaccgtggagaggtggtggaaatccttgcaaagttcttccccgagtaccccatccctaccaagtgctcagatgagaagaacccaagaaaacaaccttacaagttctcaaaccagaagctaagggatctgggcttcgagttcacaccagtgaagcagtgtctgtatgaaactgttaagagcttgcaggaaaggggccaccttccaatcccaaaacaagctgcagaagagtctgtgaagattcaataa

SEQ ID NO: 72293 - protein, 338 aa, Populus tomentosa
MPVDASSLSGQGQTICVTGAGGFIASWMVKLLLDKGYTVRGTARNPADPKNSHLRELEGAQERLTLCKADLLDYESLKEAIQGCDGVFHTASPVTDDPEEMVEPAVNGTKNVIIAAAEAKVRRVVFTSSIGAVYMDPNKGPDVVIDESCWSDLEFCKNTKNWYCHGKAVAEQAAWDMAKEKGVDLVVVNPVLVLGPLLQPTVNASIVHILKYLTGSAKTYANSVQAYVHVRDVALAHILVFETPSASGRYLCSESVLHRGEVVEILAKFFPEYPIPTKCSDEKNPRKQPYKFSNQKLRDLGFEFTPVKQCLYETVKSLQERGHLPIPKQAAEESVKIQ

SEQ ID NO: 72294 - DNA, 981 bp, Quercus suber
  CDS (1)..(981)
atgagcggtggagctgggaagattgtgtgtgtgactggtgcctctggttacatagcttcatggcttgtcaagcttcttctcaaccgtggctacacagtcaaggcctctgttcgtgaccccaatgattcaaagaaaacaaaccacttacaagtacttgatggggccaaggagagacttcacctattcaaagcaaatctactggaagaaggttcttttgattctgctgttgagggctgtgatggggttttccacactgcatctcccttctatcataatgtcacagacccagaggcagaattacttgaacctgcagtgaagggaacacttaatgttcttaattcttgtgcgaaatttccatctgttaagcgggtagttgtgacatcctctatggctgcagttcattgcaataaaaaagctaaagctcctgatgtagttgttgatgagacttggttttctgatccagatgtttgtaaggaaacaaagcaatggtatatgctttcaaagacgttggctgaagaaaatgtctggaagtttgcaaaagagaagggtattgacatagttacaattaaccctgcaatggtgattggtcctctcttacagccaacgcttaacacaagtgctgctgcgattttgaacttaataaatggaactcatcagacatttcccaatgtagcatttggatgggttaatgtcaaagatgttgccaatgcacatattcaagcatatgaaattcctacagctagtggaagatattgtttggttgagagcgttatacaccattctgaagttgtgagggttttacgaaaactttatccctctgtacaacttccagagaagtgtgcagatgataagccatttgcgccaacatatcaggtgtccaaagaaaggacaagaagcttgggtattgaatacattccttttgaggtgagcctcaaggaaactgttgaaagcttgaaggaaaagaagtttatcagtttttaa

SEQ ID NO: 72295 - protein, 326 aa, Quercus suber
MSGGAGKIVCVTGASGYIASWLVKLLLNRGYTVKASVRDPNDSKKTNHLQVLDGAKERLHLFKANLLEEGSFDSAVEGCDGVFHTASPFYHNVTDPEAELLEPAVKGTLNVLNSCAKFPSVKRVVVTSSMAAVHCNKKAKAPDVVVDETWFSDPDVCKETKQWYMLSKTLAEENVWKFAKEKGIDIVTINPAMVIGPLLQPTLNTSAAAILNLINGTHQTFPNVAFGWVNVKDVANAHIQAYEIPTASGRYCLVESVIHHSEVVRVLRKLYPSVQLPEKCADDKPFAPTYQVSKERTRSLGIEYIPFEVSLKETVESLKEKKFISF

SEQ ID NO: 72296 - DNA, 1017 bp, Vitis vinifera
  CDS (1)..(1017)
atggccacccagcaccccatcggaaagaagaccgcatgtgtcgtcggcggcaccggatttgttgcatctttgctggttaagcttttgctgcagaagggctatgctgtcaacaccactgtcagggaccctgacaatcagaaaaaagtctctcacctcctagaactacaggagttgggtgacctaaaaatctttcgagcagatctaactgacgaattgagctttgaggcccctatagcaggttgcgactttgtcttccatgttgctacgcccgtccactttgcttctgaagatccagagaatgacatgatcaagccagcaattcaaggagtagtgaatgtcatgaaagcttgtacaagggcaaaatcagttaaacgagtcattttgacatcctctgcagctgctgttaccatcaatcagcttgatgggacaggtctggttgtggatgagaagaactggactgatattgagttcttgacttccgcgaagccacctacttggggctatcctgcctccaagacactagctgagaaagcagcttggaaatttgccgaagaaaataacattgatctgatcactgtcatccctactctgatggccggttcctctcttacttcagatgtccccagcagcattggacttgcaatgtccttgattacagggaatgaattcctcataaacggtatgaagggtatgcagatgctgtcaggttcagtctccattgcacatgtggaagatgtttgccaggcacatatatttgtagctgagaaagaatcagcttctggccgatacatctgctgtgctgccaataccagtgttcctgagctagcaaagttcctgagcaaaagataccctcagtacaaagtcccaactgattttggagacttcccccctaaatcgaagttgataatctcctcagagaagcttgtgaaagaggggttcagttttaagtacgggattgaagaaatttatgatgaaagtgtggagtatttcaaggccaaggggctattgcagaattga

SEQ ID NO: 72297 - protein, 338 aa, Vitis vinifera
MATQHPIGKKTACVVGGTGFVASLLVKLLLQKGYAVNTTVRDPDNQKKVSHLLELQELGDLKIFRADLTDELSFEAPIAGCDFVFHVATPVHFASEDPENDMIKPAIQGVVNVMKACTRAKSVKRVILTSSAAAVTINQLDGTGLVVDEKNWTDIEFLTSAKPPTWGYPASKTLAEKAAWKFAEENNIDLITVIPTLMAGSSLTSDVPSSIGLAMSLITGNEFLINGMKGMQMLSGSVSIAHVEDVCQAHIFVAEKESASGRYICCAANTSVPELAKFLSKRYPQYKVPTDFGDFPPKSKLIISSEKLVKEGFSFKYGIEEIYDESVEYFKAKGLLQN

SEQ ID NO: 72298 - DNA, 993 bp, Oryza sativa
  CDS (1)..(993)
atggtgatctcatccaagggcaaagtgtgtgtaactggtgcttcaggcttcgtcgcctcttggctcatcaagaggcttcttgaggcgggctatcatgtgataggaactgtgagagacccaagcaatcgcgataaagtgtcacacctttggagattaccaagtgcaaaggagaggctgcaacttgtgagagctgatctgatggaagaagggagctttgacgatgctgtgatggcttgcgaaggcgtcttccacactgcatcgcctgtccttgccaaatctgattccaattgcaaggaagaaatgcttgttcctgcgataaatggtactctgaatgtgctgaaatcttgcaagaagaatccatttctgaaaagggttgttcttacatcctcatcatccacggtaagaatcagggatgagagtaaacatccagaaatctcactggatgaaacaatatggagctctgtggcactctgtgaaaagctacagctatggtatgccctggcaaagatatctgcagagaaagcggcatgggagtttgccaaggagaacaacattgaccttgtaactgttcttccatcatttgtgattgggcccagtttatcacatgaactgtctgtcactgcttcagacatccttggcttacttcaaggtgacacagatagattcatctcgtatgggagaatgggatatgttcacatcgacgatgtggcgagctgccacattctggtgtacgaagcacctcaggctactgggagatatctctgcaactccgttgttcttgacaacaacgaattagtcgccttgcttgcgaagcaatttccaatttttcccatcccaaggagcttgaggaacccatatgagaaacagtcatatgagctaaacacatccaagatccagcagctgggtttcaagttcaaaggggtgcaagagatgtttggtgattgtgtcgagtcgctgaaagatcagggacacttgctggagtgcccgttgtaa

SEQ ID NO: 72299 - protein, 330 aa, Oryza sativa
MVISSKGKVCVTGASGFVASWLIKRLLEAGYHVIGTVRDPSNRDKVSHLWRLPSAKERLQLVRADLMEEGSFDDAVMACEGVFHTASPVLAKSDSNCKEEMLVPAINGTLNVLKSCKKNPFLKRVVLTSSSSTVRIRDESKHPEISLDETIWSSVALCEKLQLWYALAKISAEKAAWEFAKENNIDLVTVLPSFVIGPSLSHELSVTASDILGLLQGDTDRFISYGRMGYVHIDDVASCHILVYEAPQATGRYLCNSVVLDNNELVALLAKQFPIFPIPRSLRNPYEKQSYELNTSKIQQLGFKFKGVQEMFGDCVESLKDQGHLLECPL

SEQ ID NO: 72300 - DNA, 1020 bp, Fragaria ananassa
  CDS (1)..(1020)
atgcctgctgatcacagctcttcactttccggccatggccaaactgtgtgtgtcaccggagccggaggcttcatcgcttcttggttggtgaagctcctgctggagagaggctataatgtgagaggaaccgtcagaaacccagaggacccaaagaatgctcatctgagggagctggaaggagccaaagagaggctgagcttgcggaaagccgatcttctggatttcgagagcctgaaagaagccattaacggctgtgatggcgttttccacactgcatcgcctgtaactgatgatccggaacaaatggtggaaccggcagtgaatggaacaaagaatgtgatcgttgccgctgctgaagccaaggttaaacgcgtcgtcttcacgtcttcaatcggtgccgtctacatggacccagcccgaggtcccgatgtcgttgtcgacgagtcttgttggagtgacctcgagttttgcaagaacaccaagaactggtactgctacggcaaagctgtggcggagcaagcagcgtgggaagaggccaaagagagaggagtggacttggtggtggtgaacccagttctggtgcttggaccactgctccaaccaaccatcaacgccagcatcatccacatcctcaagtacttgactggctcggccaagacttatgccaattctgttcaggcctatgtgcatgtcaaggatgtggcattagcacacatactggtgtacgaaactccctcggcatctggccgttatctctgcgccgagagcgtccttcaccgtggagatgtggtcgaaatcctcgccaagttcttccctgaataccccatacccagcaagttgaaagatgatgggaaacccagagcaataccctacaagttttcaaaccagaagctacaagacttgggtttggagttcacttctgtgaaacagagcctatatgacactgtcaagagcttgcaggagaagggtcaccttaaggttcctacaaagcaagaagaagagtccatcaagatccaataa

SEQ ID NO: 72301 - protein, 339 aa, Fragaria ananassa
MPADHSSSLSGHGQTVCVTGAGGFIASWLVKLLLERGYNVRGTVRNPEDPKNAHLRELEGAKERLSLRKADLLDFESLKEAINGCDGVFHTASPVTDDPEQMVEPAVNGTKNVIVAAAEAKVKRVVFTSSIGAVYMDPARGPDVVVDESCWSDLEFCKNTKNWYCYGKAVAEQAAWEEAKERGVDLVVVNPVLVLGPLLQPTINASIIHILKYLTGSAKTYANSVQAYVHVKDVALAHILVYETPSASGRYLCAESVLHRGDVVEILAKFFPEYPIPSKLKDDGKPRAIPYKFSNQKLQDLGLEFTSVKQSLYDTVKSLQEKGHLKVPTKQEEESIKIQ

SEQ ID NO: 72302 - DNA, 1026 bp, Zea mays
  CDS (1)..(1026)
atgccaacagcagaggcgacgacgcccgtgccgccggagctgtcctccgggcaagggcggacggtttgcgtgaccggagctggagggttcattgcctcctggctcgtcaagcgcctcctggagaagggctacacagtccgcggcacggtcaggaaccctgtggatccaaagaacgaccacctgaggtcccttgacggcgccgacgaccgtctcgtcctcctccgcgccgacctgctggacccagagagccttgccgaggccttctccggctgtgacggcgtcttccacgccgcctccccggtcaccgatgaccctgagatgatgatcgagccagcgatccggggcacgcgctacgtgatggcggcggcggacgacgccggagtgaagcgcgtcgtgttcacgtcctccatcggcaccgtgtacatgaacccctaccgtgaccccagcaagcctgtggacgacacctgctggagcgacctcgagtattgcaagaacacccagaactggtactgctacgccaagacggtggcggagcagggcgcgtgggaggtggcgcggaagcgagggctggacctggtggtggtgaacccggtgctggtgctgggcccgctgctgcagccgacggtgaacgccagcacggaccacgtgatgaagtacctgacggggtcggccacgacctacgtgaacgcggcgcaggcgtacgtgcacgtcagggacgtggccgaggcgcacgtccgggtgtacgaggcgccccacgcgcacggccgctacatctgcgccgagagcaccctgcaccgcggcgacctctgccgcgtcctcgccaagctcttcccggagtaccccgtacccaccaagtgcaaggaccaggttaaccctccggtggtaggatacaagttcaccaaccagcgcctcaaggatctggggatggacttcgtgccggtcctccagtgcctctacgagacggtcaccagcctccaggagaaaggcatgctgcccgtgcttccgacaaaacacgaccatgcatga

SEQ ID NO: 72303 - protein, 341 aa, Zea mays
MPTAEATTPVPPELSSGQGRTVCVTGAGGFIASWLVKRLLEKGYTVRGTVRNPVDPKNDHLRSLDGADDRLVLLRADLLDPESLAEAFSGCDGVFHAASPVTDDPEMMIEPAIRGTRYVMAAADDAGVKRVVFTSSIGTVYMNPYRDPSKPVDDTCWSDLEYCKNTQNWYCYAKTVAEQGAWEVARKRGLDLVVVNPVLVLGPLLQPTVNASTDHVMKYLTGSATTYVNAAQAYVHVRDVAEAHVRVYEAPHAHGRYICAESTLHRGDLCRVLAKLFPEYPVPTKCKDQVNPPVVGYKFTNQRLKDLGMDFVPVLQCLYETVTSLQEKGMLPVLPTKHDHA

SEQ ID NO: 72304 - DNA, 1041 bp, Zea mays
  CDS (1)..(1041)
atgccaacagcagaggcgacgacgcccgtgccgccggagctgtcctccgggcaagggcggacggtttgcgtgaccggagctggagggttcattgcctcctggctcgtcaagcgcctcctggagaagggctacacagtccgcggcacggtcaggaaccctgtggatccaaagaacgaccacctgagggcccttgacggcgccgtcgaccgtctcgtcctcctccgcgccgacctgctggacccacagagccttgccgaggccttctccggctgtgacggcgtcttccacgccgcctccccggtcaccgatgaccctgagatgatgatcgagccagcgatccggggcacgcgctacgtgatggcggcggcggcagacgccggagtgaagcgcgtcgtgttcacgtcctccatcggcaccgtgtacatgaacccctaccgtgaccccagcaagcctgtggacgacacctgctggagcgacctcgagtattgcaagaacacccagaactggtactgctacgccaagacggtggcggagcagggcgcgtgggaggtggcgcggaagcgagggctggacctggtggtggtgaacccggtgctggtgctgggcccgctgctgcagccgacggtgaacgccagcacggaccacgtgatgaagtacctgacggggtcggccacgacctacgtgaacgcggcgcaggcgtacgtgcacgtcagggacgtggccgaggcgcacgtccgggtgtacgaggcgccccacgcgcacggccgctacatctgcgccgagagcaccctgcaccgcggcgacctctgccgcgtcctcgccaagctcttcccggagtaccccgtacccaccaagtgcaaggaccaggttaaccctccggtggtaggatacaagttcaccaaccagaggctcaaggatctggggatggacttcgtgccggtcctgcagtgcctctacgagacggtcaccagcctccaggagaaaggcatgctgcccgtgcttccgacaaaacaagaccatgaccaactcggcaaatcatga

SEQ ID NO: 72305 - protein, 346 aa, Zea mays
MPTAEATTPVPPELSSGQGRTVCVTGAGGFIASWLVKRLLEKGYTVRGTVRNPVDPKNDHLRALDGAVDRLVLLRADLLDPQSLAEAFSGCDGVFHAASPVTDDPEMMIEPAIRGTRYVMAAAADAGVKRVVFTSSIGTVYMNPYRDPSKPVDDTCWSDLEYCKNTQNWYCYAKTVAEQGAWEVARKRGLDLVVVNPVLVLGPLLQPTVNASTDHVMKYLTGSATTYVNAAQAYVHVRDVAEAHVRVYEAPHAHGRYICAESTLHRGDLCRVLAKLFPEYPVPTKCKDQVNPPVVGYKFTNQRLKDLGMDFVPVLQCLYETVTSLQEKGMLPVLPTKQDHDQLGKS

SEQ ID NO: 72306 - DNA, 1047 bp, Malus domestica
  CDS (1)..(1047)
atgggatccgagtccgaatccgtttgtgtcaccggggcgtccggtttcatcggctcttggctcgtcatgagactcctagagcacgggtacaccgtccgcgccaccgtgcgtgaccccacgaatcagaagaaggtgaagcatctgttggacttgccgaaggcggagacgcacctgacgctgtggaaggcggacttggcggatgagggaagctttgatgaagccatacaaggctgcagcggagtgttccatgttgctacacctatggactttgaatccaaggaccccgagaatgaagtgatcaagcccacaatcaatggactgttggacatcctgaaggcatgccagaaagcaaaaacagttcgaaagcttgtgttcacatcctcagcaggaaccgtgaatgtggaggagcatcaaaagccggtctacgacgagtccaactggagtgacgttgaattttgccgctccgtcaagatgactggttggatgtacttcgtctccaagactctagctgagcaagctgcatggaaatatgccaaagaaaacaacattgatttcatcaccattatcccaactcttgtgattgggccatttctcatgccatccatgccaccaagcctcatcactggactttcgccgatcttaagaaatgaatcacattatggcatcatcaagcagggccagtatgttcacttggacgacctctgcctttctcacatttatctttacgagcatccgaaagccgaaggccgttacatttgttcgtcacatgatgctacaattcacgaacttgtaaaaatgctcagagaaaaataccccgaatacaatatacccacaaagttcaagggcatcgacgacaacttagaaccagttcatttttcttcaaagaagttgagggagatagggtttgagttcaagtacagcttggaggacatgtttgtgggggctgtcgatgcgtgccgggcaaagggcttgattccgattccgattccggcagagaaaactgaggctgctgaggagagcaacctcgttgatgtcaaagctggttaa

SEQ ID NO: 72307 - protein, 348 aa, Malus domestica
MGSESESVCVTGASGFIGSWLVMRLLEHGYTVRATVRDPTNQKKVKHLLDLPKAETHLTLWKADLADEGSFDEAIQGCSGVFHVATPMDFESKDPENEVIKPTINGLLDILKACQKAKTVRKLVFTSSAGTVNVEEHQKPVYDESNWSDVEFCRSVKMTGWMYFVSKTLAEQAAWKYAKENNIDFITIIPTLVIGPFLMPSMPPSLITGLSPILRNESHYGIIKQGQYVHLDDLCLSHIYLYEHPKAEGRYICSSHDATIHELVKMLREKYPEYNIPTKFKGIDDNLEPVHFSSKKLREIGFEFKYSLEDMFVGAVDACRAKGLIPIPIPAEKTEAAEESNLVDVKAG

SEQ ID NO: 72308 - DNA, 1017 bp, Medicago truncatula
  CDS (1)..(1017)
atggctagtatcaaacaaatagaaatagaaaagaagaaggcatgtgtgataggtggcactggttttgtggcatcattgctgatcaagcagttgcttgaaaagggttatgctgttaatactactgttagagacctagatagtgcaaacaaaacatctcacctcatagcactgcaaagtttgggggaactgaatctatttaaagcagaattaacaattgaagaagattttgatgctcctatatcaggatgtgaacttgtcttccaacttgctacacctgtgaactttgcttctcaagatcctgagaatgacatgataaaaccagcaatcaaaggtgtattgaatgtgttgaaagcatgtgtaagagcaaaagaagtcaaaagagttatcttaacatcttcagcagctgctgtgactataaacgaactcgaagggactggtcatgttatggatgaaaccaattggtctgatgttgagtttttgaacactgcaaagccacccacttggggttatcctgtttcaaaagtactagctgaaaaggctgcgtggaaatttgctgaagaaaataacattgatctaatcactgtgatacctactctaacaattggtccttctctaactcaagatatcccatctagtgttgccatgggaatgtcacttctaacaggcaatgatttcctcataaatgctttgaaaggaatgcagtttctatcgggttcaatatcaattactcatgtcgaggatatttgtcgggctcatatttttgtggcagagaaagaatcaacttctggtcgatacatttgctgtgctcacaataccagtgttcccgagcttgcaaagtttctcagcaaacgataccctcagtataaagttccaactgaatttgatgatttccccagcaaggcaaagttgataatctcttctggaaagcttatcaaagaaggtttcagtttcaagcatagtattgctgaaacttttgaccaaactgtggagtatttgaagactcaggggatcaagtga

SEQ ID NO: 72309 - protein, 338 aa, Medicago truncatula
MASIKQIEIEKKKACVIGGTGFVASLLIKQLLEKGYAVNTTVRDLDSANKTSHLIALQSLGELNLFKAELTIEEDFDAPISGCELVFQLATPVNFASQDPENDMIKPAIKGVLNVLKACVRAKEVKRVILTSSAAAVTINELEGTGHVMDETNWSDVEFLNTAKPPTWGYPVSKVLAEKAAWKFAEENNIDLITVIPTLTIGPSLTQDIPSSVAMGMSLLTGNDFLINALKGMQFLSGSISITHVEDICRAHIFVAEKESTSGRYICCAHNTSVPELAKFLSKRYPQYKVPTEFDDFPSKAKLIISSGKLIKEGFSFKHSIAETFDQTVEYLKTQGIK

SEQ ID NO: 72310 - DNA, 1011 bp, Eucalyptus globulus
  CDS (1)..(1011)
atgcccgtcgacgccctccccggttccggccagaccgtctgcgtcaccggcgccggcggcttcatcgcctcctggattgtcaagcttctcctcgagcgaggctacaccgtgcgaggaaccgtcaggaacccagacgacccgaagaatgggcatctgagagagctggacggagccagcgagaggctgacgctgtacaagggtgatctgatggactacgagagcttgagagaagccatcatggggtgcgacggcgtcgtccacaccgcctctccggtcaccgacgatcctgagcaaatggtggagccagcggtgatcgggacgaaaaatgtgatcgtcgcagcagcggaggccaaggtccggcgggttgtgttcacctcctccatcggtgcagtcaccatggaccccaaccggggtccggacgttgtggtggacgagtcttgttggagcgacctcgaattttgcaagagcactaagaactggtattgctacggcaaggcagtggcggagaaggccgcttgcgcagaggcgaaggagagaggggttgacctcgtggtgattaaccctgtgctcgtgcttggaccgctccttcagtcgacgatcaatgcgagcatcatccacatcctcaagtacttgactggctcagccaagacctacgccaactcggtccaggcatacgtgcacgtcaaggacgtcgcgcttgcccatgtccttgtcttggagaccccatccgcctcaggccgctatttgtgcgccgagagcgtcctccaccgtggcgatgtggtggaaatccttgccaagttcttccctgagtataacgtaccgaccaagtgctctgatgaggtgaacccaagagtaaaaccatacaagttctccaaccagaagctgagagacttggggctcgagttcaccccggtgaagcagtgcctgtacgaaactgtcaagagcttgcaggagaaaggccacctacccgtccctcccccgccggaagattcggtgcgtattcagggatga

SEQ ID NO: 72311 - protein, 336 aa, Eucalyptus globulus
MPVDALPGSGQTVCVTGAGGFIASWIVKLLLERGYTVRGTVRNPDDPKNGHLRELDGASERLTLYKGDLMDYESLREAIMGCDGVVHTASPVTDDPEQMVEPAVIGTKNVIVAAAEAKVRRVVFTSSIGAVTMDPNRGPDVVVDESCWSDLEFCKSTKNWYCYGKAVAEKAACAEAKERGVDLVVINPVLVLGPLLQSTINASIIHILKYLTGSAKTYANSVQAYVHVKDVALAHVLVLETPSASGRYLCAESVLHRGDVVEILAKFFPEYNVPTKCSDEVNPRVKPYKFSNQKLRDLGLEFTPVKQCLYETVKSLQEKGHLPVPPPPEDSVRIQG

SEQ ID NO: 72312 - DNA, 999 bp, Solanum tuberosum
  CDS (1)..(999)
atgccatcagaatccggcaaagttgtttgtgttaccggcgccggaggtttcattgcctcttggctcgttaaactccttctagaaaaaggctacactgtcagaggaaccgttagaaaccctgatgatcctaaaaatggtcacttgaaggaacttgaaggtgcaaaggagagactgattctgctgagagctgatcttctggattatcagagtttgagagaagcaatttatggctgtgacggggttttccacaccgcctcccctgtcactgatgatccagaacaaatggtggagccagcggttatagggactaagaatgtgataacagccgcagcagaagccaaagttggaagagttgtgtttacttcgtcaattggtacagtatacatggaccccaaccgggccccggataaagttgtggacgagacttgctggagtgatcttggcttctgcaagaatactaagaattggtactgctacgggaagacggtggcggaaaagacagcatgggatgaggcaagggaaaaaggagtggatttggtggtgatcaatccagtgttggtgcttggaccactgcttcaaccaacagtgaatgctagtgttcttcacatactaaagtacctaactggctctgctaaaacatatgccaattcaattcaggcgtatgttcatgttaaggatgtggcactagcccacatacttctctatgaagctccttctgcatctggccgctatatctgtgctgagagcgtccttcatcgcggcgatgtggttgaaattctcgccaaattcttcccggagtatccaatacctaccaagtgctcggatgaaacgaggccaagggcaaaaccgtacaaattcacgaaccaaaagctaaaggacttgggtttggggtttacgccagtgaaacagtgcttatatgagacagtgaagagtctgcaggagaagggtcaccttccaattcctactcaaaatgatgaacctattaaaattcactcttaa

SEQ ID NO: 72313 - protein, 332 aa, Solanum tuberosum
MPSESGKVVCVTGAGGFIASWLVKLLLEKGYTVRGTVRNPDDPKNGHLKELEGAKERLILLRADLLDYQSLREAIYGCDGVFHTASPVTDDPEQMVEPAVIGTKNVITAAAEAKVGRVVFTSSIGTVYMDPNRAPDKVVDETCWSDLGFCKNTKNWYCYGKTVAEKTAWDEAREKGVDLVVINPVLVLGPLLQPTVNASVLHILKYLTGSAKTYANSIQAYVHVKDVALAHILLYEAPSASGRYICAESVLHRGDVVEILAKFFPEYPIPTKCSDETRPRAKPYKFTNQKLKDLGLGFTPVKQCLYETVKSLQEKGHLPIPTQNDEPIKIHS

SEQ ID NO: 72314 - DNA, 1047 bp, Hordeum vulgare
  CDS (1)..(1047)
atgaccgtcgtcgacgccgccgccgccgtcgcgcaggagctgcccgggcacgggcagaccgtgtgcgtcaccggcgccgccgggtacatcgcgtcgtggctcgtcaagctgctcctggagaggggctacaccgtcaagggcacagtgaggaacccagatgacccgaagaatgcacacctgaaggcgctggacggcgccgccgagaggctggtcctctgcaaggccgacctcctcgactacgacgccatctgcgccgccgtcgagggctgccacggcgtgttccacaccgcctcccccgtcaccgacgaccctgagcagatggtggagccggcggtgaggggcacggaatacgtgatcgacgcggcggcggacgccggcaccgtgcgccgggttgtgttcacgtcgtccatcggcgccgtcaccatggaccccaaccgcgggcccgacgtggtcgtcgacgagtcctgctggagcgatcttgagttctgcaagaaaaccaagaactggtactgctacggcaaggcggtggcggagcaggcggcgtgggagaaggcgagggcgcgcggcgtggacctggtggtggtgaacccggtgctggtggtcgggccgctgctgcagccgacggtgaacgccagcgccgcgcacatcctcaagtacctcgacggctccgccaggaagtacgccaacgcggtgcaggcgtacgtggacgtgcgcgacgtcgccggcgcgcacctccgggtcttcgaggcgccccaggcctccggccgctacctctgcgccgagcgcgtcctgcaccgccaggacgtcgtccacatcctcgccaagctcttccccgagtaccccgtcccaacaaggtgctctgacgaggtgaacccacggaagcagccttacaagatgtccaaccagaagctgcaggatcttggcctcaagttcactcctgtgaacgactctctgtacgagacggtgaagagcctccaggagaaggggcacctcccggtgccgaggaaggatatcctcgcaccacagctggacggtgcaacagcgtga

SEQ ID NO: 72315 - protein, 348 aa, Hordeum vulgare
MTVVDAAAAVAQELPGHGQTVCVTGAAGYIASWLVKLLLERGYTVKGTVRNPDDPKNAHLKALDGAAERLVLCKADLLDYDAICAAVEGCHGVFHTASPVTDDPEQMVEPAVRGTEYVIDAAADAGTVRRVVFTSSIGAVTMDPNRGPDVVVDESCWSDLEFCKKTKNWYCYGKAVAEQAAWEKARARGVDLVVVNPVLVVGPLLQPTVNASAAHILKYLDGSARKYANAVQAYVDVRDVAGAHLRVFEAPQASGRYLCAERVLHRQDVVHILAKLFPEYPVPTRCSDEVNPRKQPYKMSNQKLQDLGLKFTPVNDSLYETVKSLQEKGHLPVPRKDILAPQLDGATA

SEQ ID NO: 72316 - DNA, 981 bp, Arabidopsis thaliana
  CDS (1)..(981)
atggcaaacagtggtgaaggtaaagtggtgtgtgtaacaggagcctccggttacatcgcctcatggctcgtcaagttcctacttagccgtggctacactgttaaggcctccgtccgtgatcccagtgatccgaaaaagacacaacacttagtttcactagaaggtgcaaaggaaagacttcacttgttcaaagcagaccttttggaacaaggttctttcgactctgctattgatggttgccatggagttttccacactgcttctccattttttaatgatgccaaagacccacaggctgaacttattgatcctgcggtcaaggggacgcttaacgttttgaattcgtgcgccaaagcctcttcggttaagagggttgttgtaacctcctccatggctgccgttggttacaatggaaaaccacgcacacctgatgttaccgtcgatgaaacttggttctctgatcctgagctttgcgaggcctccaagatgtggtatgttctatccaagactttggcggaagatgcagcttggaaactcgctaaagagaaaggcttagacattgttactattaacccggctatggtgatcggtcctctcctacagccaactctgaacacgagtgctgctgctatattaaacttaatcaatggtgcaaagactttcccaaacttgagtttcggatgggttaatgtaaaagacgtagccaatgcgcacatccaaacatttgaggtcccttcagctaatgggcgttattgtttggtcgagcgtgtcgttcaccactccgagattgttaacattctacgtgagctttacccaaatctcccactacctgaaaggtgtgtggacgagaatccctacgtgccaacgtatcaagtgtccaaggataaaacgaggagccttggcatagactacatacccttgaaggttagcatcaaggagaccgtcgagtccttgaaggaaaaaggtttcgcacagttctga

SEQ ID NO: 72317 - protein, 326 aa, Arabidopsis thaliana
MANSGEGKVVCVTGASGYIASWLVKFLLSRGYTVKASVRDPSDPKKTQHLVSLEGAKERLHLFKADLLEQGSFDSAIDGCHGVFHTASPFFNDAKDPQAELIDPAVKGTLNVLNSCAKASSVKRVVVTSSMAAVGYNGKPRTPDVTVDETWFSDPELCEASKMWYVLSKTLAEDAAWKLAKEKGLDIVTINPAMVIGPLLQPTLNTSAAAILNLINGAKTFPNLSFGWVNVKDVANAHIQTFEVPSANGRYCLVERVVHHSEIVNILRELYPNLPLPERCVDENPYVPTYQVSKDKTRSLGIDYIPLKVSIKETVESLKEKGFAQF

SEQ ID NO: 72318 - DNA, 999 bp, Arabidopsis thaliana
  CDS (1)..(999)
atgcctgtcgacgggaaactcgtctgcgtcaccggagccggcggctacattgcttcttggatcgttaagttactcttagagagaggctacaccgttagaggaaccgtaaggaacccaactgatcccaagaacaaccatctcagagagcttcaaggagccaaggaaagactcactcttcacagtgcagatcttctcgactacgaagctctctgtgccgcaatcgacggttgcgatggcgttttccacactgcctctccgatgaccgacgatcccgagacaatgttggagccggcggtgaacggagccaagttcgtgattgacgcagcggctaaagccaaggtcaagcgcgtggttttcacgtcatcaattggtgcagtttacatgaaccctaaccgtgacactcaagccattgttgacgaaaactgctggagtgatcttgatttctgcaaaaacactaagaattggtattgctacgggaagatgttggcggaacaatcggcgtgggagacggccaaagcaaaaggtgtggacttagtggtgctaaatccggttttggttctcggaccaccgctccagtcagcgatcaacgctagtctagtccatattctcaagtacctcaccggctcagccaagacctacgctaacttgactcaggtctacgtggacgtccgtgacgtggcactaggccatgttctggtctacgaagcaccctccgcctcaggccgttacatcctcgccgagaccgcacttcaccgcggagaggttgttgagattctggccaaattcttcccggagtatccacttcccaccaagtgttcggacgagaagaatccgagggctaagccatacaagtttactacccaaaagataaaagacttaggcttggaatttaaacccatcaagcaatctctttacgaatatgtcaagagcttgcaagagaaaggtcatcttcctctacctcaagattcgaaccaaaacgaagtcatcatcgaaccttag

SEQ ID NO: 72319 - protein, 332 aa, Arabidopsis thaliana
MPVDGKLVCVTGAGGYIASWIVKLLLERGYTVRGTVRNPTDPKNNHLRELQGAKERLTLHSADLLDYEALCAAIDGCDGVFHTASPMTDDPETMLEPAVNGAKFVIDAAAKAKVKRVVFTSSIGAVYMNPNRDTQAIVDENCWSDLDFCKNTKNWYCYGKMLAEQSAWETAKAKGVDLVVLNPVLVLGPPLQSAINASLVHILKYLTGSAKTYANLTQVYVDVRDVALGHVLVYEAPSASGRYILAETALHRGEVVEILAKFFPEYPLPTKCSDEKNPRAKPYKFTTQKIKDLGLEFKPIKQSLYEYVKSLQEKGHLPLPQDSNQNEVIIEP

SEQ ID NO: 72320 - DNA, 1089 bp, Lolium perenne
  CDS (1)..(1089)
atgaccatcgccgaggtcgtggctgccggagacaccgccgccgcggtggtgcagcccgccgggaacgggcagaccgtgtgcgtgaccggcgccgccgggtacatcgcgtcgtggctcgtcaagctgctgctggagaaggggtacaccgtcaagggcaccgtcaggaacccagacgacccgaagaacgcgcacctgagggcgctcgacggcgccgccgaccggctggtcctctgcaaggccgacctcctcgactacgacgccatccgccgcgccatcgacggctgccacggcgtcttccacaccgcgtcccccgtcaccgacgaccccgagcaaatggtggagccggcggtgaggggcacgcagtacgtcatagacgcggcggcggaggccggcacggtgcggcggatggtgctcacctcctccatcggcgccgtcaccatggaccccaaccgcgggccggacgtggtcgtcgacgagtcgtgctggagcgacctcgacttctgcaagaaaaccaggaactggtactgctacgggaaggcggttgcggagcaggcggcatcggagttggcgcggcagcgcggcgtggaccttgtggtggtgaacccggtgctggtgatcggccccctgctgcagccgacggtgaacgccagcatcggccacatcctcaagtacctggacgggtcggccagcaagttcgccaacgccgtgcaggcgtacgtggacgtccgcgacgtggccgacgcccacctccgcgtcttcgagtgcgccgccgcgtccggccgccacctctgcgccgagcgcgtcctccaccgcgaggacgtcgtgcgcatcctcgccaagctcttccccgagtaccccgtccccaccaggtgctctgatgagacgaacccgaggaagcagccatacaagatgtcgaaccagaagctccaggacctcggactcgagttcaggccggtgagccagtccctgtacgagacggtgaagagcctccaggagaagggccaccttccggtgctcagcgagcaggcagaggcggacaaggaaaccctagctgccgagctgcaggcaggggttaccatccgagcatga

SEQ ID NO: 72321 - protein, 362 aa, Lolium perenne
MTIAEVVAAGDTAAAVVQPAGNGQTVCVTGAAGYIASWLVKLLLEKGYTVKGTVRNPDDPKNAHLRALDGAADRLVLCKADLLDYDAIRRAIDGCHGVFHTASPVTDDPEQMVEPAVRGTQYVIDAAAEAGTVRRMVLTSSIGAVTMDPNRGPDVVVDESCWSDLDFCKKTRNWYCYGKAVAEQAASELARQRGVDLVVVNPVLVIGPLLQPTVNASIGHILKYLDGSASKFANAVQAYVDVRDVADAHLRVFECAAASGRHLCAERVLHREDVVRILAKLFPEYPVPTRCSDETNPRKQPYKMSNQKLQDLGLEFRPVSQSLYETVKSLQEKGHLPVLSEQAEADKETLAAELQAGVTIRA

SEQ ID NO: 72322 - DNA, 975 bp, Pinus taeda
  CDS (1)..(975)
atgactgcaggtaaacaaaccgaggaaggccagactgtctgtgttacaggagccggaggattcatcgcctcatggctggtgaagctgctgcttgaaaggggctataccgtgcgaggaacagttcgcaaccctgaggatcagaagaatgctcatctcaagcagctggaaggtgcagaagagaggctgacattggtaaaagcagatcttatggactacaacagccttttgaatgccatcaacggctgccaaggagtcttccatgttgcttctcctgtcacagatgatcccgaagaaatggtggagccagctgtgaatggaacaaagaacgtcctggatgcttgtgcagtggctggagtgcgccgtgtggtgtttacttcctccattggggcagtttacatggacccaagtagggattatgatgctcttgtggatgagaactgttggagcaaccttgactattgcaaggagacaaagaactggtactgctatggaaaaacagtggccgagaaggctgcatgggaaagagcgaaggacaaggggttggacctggtagtggtaaatccatgtgtggtattgggtcctgtgctgcaatcctccattaactccagcataattcatatactcaagtatttgactggatctgctaagacctatgccaactcagttcaggcctatgtccatgtcagagatgttgcagaggctcacatcctggtttatgaaagcccatcagcttcaggccgctatttatgtgccgagagtgttctccaccgtggtgatgtggttgactcgctggcatcgatgttccctcaatatccaattcctaccaaggtcaaggaagatgggaagccaagggtgaagccttggaaggtttccaaccaaaagctcaaggacctcggattagaatttacaccagcgaaacaatgcctgtatgagacagttatcagcttacaagaaaaagggcatatttccaagtga

SEQ ID NO: 72323 - protein, 324 aa, Pinus taeda
MTAGKQTEEGQTVCVTGAGGFIASWLVKLLLERGYTVRGTVRNPEDQKNAHLKQLEGAEERLTLVKADLMDYNSLLNAINGCQGVFHVASPVTDDPEEMVEPAVNGTKNVLDACAVAGVRRVVFTSSIGAVYMDPSRDYDALVDENCWSNLDYCKETKNWYCYGKTVAEKAAWERAKDKGLDLVVVNPCVVLGPVLQSSINSSIIHILKYLTGSAKTYANSVQAYVHVRDVAEAHILVYESPSASGRYLCAESVLHRGDVVDSLASMFPQYPIPTKVKEDGKPRVKPWKVSNQKLKDLGLEFTPAKQCLYETVISLQEKGHISK

SEQ ID NO: 72324 - DNA, 996 bp, Zea mays
  CDS (1)..(996)
atggtgacctcaagcaagggcaaggtatgcgtaaccggggcctcaggctttgttgcctcttggcttatcaaacggctcctcgagtctggatatcatgtggtagggactgtcagggacccaggaaatcaccaaaaaacagcccacctttggaaattacctggcgctaaagagaggctgcaaatcgtgcgagctaatctgttggaagaagggagcttcgacagcgccgtgatggcctgtgagggtgtattccacactgcatcccccgtcctcgctaaacccgactctactagcaaggaggacacgctcgtccctgcggtgaacggtactctgaacgtgctgagatcgtgcaagaagaaccccttcctgaaaagggtcgtccttacgtcttcgtcgtctgcggtgaggatcagggacgacggtggccagtccagtaacatctcgctggacgaaacgacatggagctccgtgccactctgcgagaagatgcatctatggtatgccctagccaaggtatttgcagagaaagcggcgtgggagttcgccaaggagaacggcatcgaccttgtgactgtcctcccgtcgttcgtgatcgggcccagtttgtcccacgagctatgcgttaccgcttcagacgtcctaggcctattccaaggcgacacggcaaggttcagctcgtacggaagaatggggtacgtccacatcgacgacgttgcgagcagccacatcctggtgtacgaggtcccccaggccgccgggaggtacctgtgcagctcagtggtgctggacaacgacgagctggtctcctcgctcgcgaaacgctacccgatattccccataccccggaggctgaacagcccctacggcaagcagtcgtaccagctgaacacgtcgaagctgcaggggctgggcttcaagttcagaggggtgcaggagatgttcgacgactgcgtgcagtcgctcaaagaccagggccacctgctggagtgccccctgtga

SEQ ID NO: 72325 - protein, 331 aa, Zea mays
MVTSSKGKVCVTGASGFVASWLIKRLLESGYHVVGTVRDPGNHQKTAHLWKLPGAKERLQIVRANLLEEGSFDSAVMACEGVFHTASPVLAKPDSTSKEDTLVPAVNGTLNVLRSCKKNPFLKRVVLTSSSSAVRIRDDGGQSSNISLDETTWSSVPLCEKMHLWYALAKVFAEKAAWEFAKENGIDLVTVLPSFVIGPSLSHELCVTASDVLGLFQGDTARFSSYGRMGYVHIDDVASSHILVYEVPQAAGRYLCSSVVLDNDELVSSLAKRYPIFPIPRRLNSPYGKQSYQLNTSKLQGLGFKFRGVQEMFDDCVQSLKDQGHLLECPL

SEQ ID NO: 72326 - DNA, 999 bp, Arabidopsis thaliana
  CDS (1)..(999)
atgcttgtcgacgggaaactcgtctgcgtcaccggagccggcggctacattgcttcttggatcgttaagttactcttagagagaggctacaccgttagaggaaccgtaaggaacccaactgatcccaagaacaaccatctcagagagcttcaaggagccaaggaaagactcactcttcacagtgcagatcttctcgactacgaagctctctgtgccacaatcgacggttgcgatggcgttttccacactgcctctccgatgaccgacgatcccgagacaatgttggagccggcggtgaacggagccaagttcgtgattgacgcagcggctaaagccaaggtcaagcgcgtggttttcacgtcatcaattggtgcagtttacatgaaccctaaccgtgacactcaagccattgttgacgaaaactgctggagtgatcttgatttctgcaaaaacactaagaattggtattgctacgggaagatgttggcggaacaatcggcatgggagacggccaaagcaaaaggtgtggacttagtggtgctaaatccggttttggttctcggaccaccgctccagtcagcgatcaacgctagtctagtccatattctcaagtacctcaccggttcagccaagacctacgctaacttgactcaggtctacgtggacgtccgtgacgtggcactaggccatgttctggtctacgaagcaccctccgcctcaggccgttacatcttcgccgagaccgcacttgaccgcggagaggttgttgagattctggccaaattcttcccggagtatccacttcccaccaagtgttcggacgagaagaatccgagggctaagccatacaagtttactacccaaaagataaaagacttaggcttggaatttaaacccatcaagcaatctctttacgaatctgtcaagagcttgcaagagaaaggccatcttcctctacctcaagattcgaaccaaaacgaagtcatcatcgaatcttag

SEQ ID NO: 72327 - protein, 332 aa, Arabidopsis thaliana
MLVDGKLVCVTGAGGYIASWIVKLLLERGYTVRGTVRNPTDPKNNHLRELQGAKERLTLHSADLLDYEALCATIDGCDGVFHTASPMTDDPETMLEPAVNGAKFVIDAAAKAKVKRVVFTSSIGAVYMNPNRDTQAIVDENCWSDLDFCKNTKNWYCYGKMLAEQSAWETAKAKGVDLVVLNPVLVLGPPLQSAINASLVHILKYLTGSAKTYANLTQVYVDVRDVALGHVLVYEAPSASGRYIFAETALDRGEVVEILAKFFPEYPLPTKCSDEKNPRAKPYKFTTQKIKDLGLEFKPIKQSLYESVKSLQEKGHLPLPQDSNQNEVIIES

SEQ ID NO: 72328 - DNA, 2430 bp, Arabidopsis thaliana
  CDS (1)..(2430)
atggagagacgtaacgaagcgttgatgattaggaaatcgaagtggcagtacccacaagtgggttctccgacgccgaggattcttcagttgccacggaggcatagtgttcgacgaaatgcttcaaagggcttgaagacaacagtttcttcgtcgtctcagaaggatcggagagtgaaactggaggttttgtttcatcaagagaggacttttgatcggggggcatcgattgtgatggtgaatgataatggtggtgagaagaaggatgaagaagagggaaggagaagagggaaagttgcagatgggagagagattggtgtgtctgggttgtcttcttcttctgcggttgatgaagttgaggaagctaagtggaggtttcaagcggagatgttgagatcagagtgtaatttgttaagaatagaaaaagagattgctttgaagaagatggagaggaggaagaagcgaatggagcggacgctgagatctgctgttcttactcttctatctgggaaagagagaatctctgaagggacgaaagagagcaaggttttggaagatgagataagctatttggttgagaaactgaatgagttaaagtctccaaaggttaaggacatggaagctagaaacttcaaacataattttgataagcaagcttctgttttaagaagagagctagagaggttcgatgaagcagtttccgaagaggtttgtgtcaaagggattcagaaaatggcagaggctagcttctccgtccattctgatcaaaacgctcttaggaacaataatggaaatatagatacattgagtagtaaaatggaggcgttgtcaaaaggggttttgttggaaagaatggagaaagaatatggatcgagtctcgttgcaccgtcttcaagctctgtacaagacatgtattgtaagggaattaaagcgcatgaggaaaagaaagactgttctagacactgcaaagtagttatgaggaagattgcggatgaagtaagagctgaagcagagcaatggtcacaaatgcaagagatgttgaatcaagtgagaaaagaaatggaggaacttcaatcttgtcgtgatttctggcaaaaccgcgccctcgaagcagattccgagatacaaaatctacattcctctgttgaaggatggcgaagaaaggcgttatcatcagaggcaaagttgaaaaacctacaagcagaggtttgcggattacaagaagagatcaagagactgagaaaggaagataagttagaaccagagaagaacaaattgccatcagagtcagagaaaagggtattgatttgtcggttaaaagaaaaccgacatagcaacaatggagattggtccaagtacagtgaaggaagaacaacaaaaccgtcgagctcgagaccgcctttgagggaagttaagaacagttcagtcatagcaaggcagagaaactccaatatcatgaaaatcgaagaagagaagacagtgtgtgtgacaggagcttcaggttacattgcttcatggatcgttaagcttcttcttctccgtggttacaccgttaaagcctctgttcgtgatccaaatgatccaaggaaaacagagcatttgcttgcattggaaggagcagaggaaaggcttaaattgttcaaagcaaacttgttagaagaaggctctttcgattcagcaatcgatggttgcgaaggagttttccacaccgcatcgccattctatcatgacgtcaaggaccctcaggctgagttacttgatccggcagtgaaaggaacaatcaatgttctaagctcttgtttgaagacttcctcggttaagagagtcgtcttaacctcatcgatagcagctgttgctttcaatggaatgcctcgaacacccgaaaccatagttgacgaaacttggttcgccgatcctgactattgcagagcttccaagctatggtatgtactctcgaagacattagctgaaaacgcagcgtggaaattcgcaaaagagaacaatttacagctggtttcgataaatccggctatggtgattggtcctctcttacagccaacgctaaacactagtgctgctgcagtactaagcttgatcaaaggagcacaaacgtttcctaatgcgacgttcgggtgggttaacgttaaagatgtagcgaacgctcatattcaagcgtttgagaatccagatgctgatgggagatactgtttagtggagagagttgctcattactctgaagttgttaacattttgcatgatctttaccctgattttcaactccctgagaagtgtgcagatgaaaagatatatattccaacatataaagtgtctaaagagaaagcagagtctcttggggttgagtttgtgccattggaagttagcattaaagagactgtagagagcttgagagataaagggttcatcagattttga

SEQ ID NO: 72329 - protein, 809 aa, Arabidopsis thaliana
MERRNEALMIRKSKWQYPQVGSPTPRILQLPRRHSVRRNASKGLKTTVSSSSQKDRRVKLEVLFHQERTFDRGASIVMVNDNGGEKKDEEEGRRRGKVADGREIGVSGLSSSSAVDEVEEAKWRFQAEMLRSECNLLRIEKEIALKKMERRKKRMERTLRSAVLTLLSGKERISEGTKESKVLEDEISYLVEKLNELKSPKVKDMEARNFKHNFDKQASVLRRELERFDEAVSEEVCVKGIQKMAEASFSVHSDQNALRNNNGNIDTLSSKMEALSKGVLLERMEKEYGSSLVAPSSSSVQDMYCKGIKAHEEKKDCSRHCKVVMRKIADEVRAEAEQWSQMQEMLNQVRKEMEELQSCRDFWQNRALEADSEIQNLHSSVEGWRRKALSSEAKLKNLQAEVCGLQEEIKRLRKEDKLEPEKNKLPSESEKRVLICRLKENRHSNNGDWSKYSEGRTTKPSSSRPPLREVKNSSVIARQRNSNIMKIEEEKTVCVTGASGYIASWIVKLLLLRGYTVKASVRDPNDPRKTEHLLALEGAEERLKLFKANLLEEGSFDSAIDGCEGVFHTASPFYHDVKDPQAELLDPAVKGTINVLSSCLKTSSVKRVVLTSSIAAVAFNGMPRTPETIVDETWFADPDYCRASKLWYVLSKTLAENAAWKFAKENNLQLVSINPAMVIGPLLQPTLNTSAAAVLSLIKGAQTFPNATFGWVNVKDVANAHIQAFENPDADGRYCLVERVAHYSEVVNILHDLYPDFQLPEKCADEKIYIPTYKVSKEKAESLGVEFVPLEVSIKETVESLRDKGFIRF

SEQ ID NO: 72330 - DNA, 933 bp, Arabidopsis thaliana
  CDS (1)..(933)
atgaacggcgaaggaaaggttgtttgcgtcaccggagcttccggatacatagcttcttggattgttaagcttttgctcctccgtggctacaccgtcagggccaccgtccgaaacccaagtgcaagtgaaagactaaaactgttcaaatcagatcttttggaagaaggttctttcgatcaagctatagagggatgcgacggtgtcttccatactgcctctccagtttcattaaccgttacagatcctcaggctcttttgcagactgagatgatcgatccggcggttaatggtactttgaacgttttgagaacgtgcgccaaagtttcttctgtgaagagggtcattgtaacatcgtccactgctgctactctttctattaacccaaacgacgtggtggacgaaaccgtcttcaccgatctaagtgtttacttagcgatgaaggcatggtatggatattcaaaaactttggctgaggaaacagcgtggcggtttgctaaagaaaacgggatcgatttggttgtaatgaatccaggaaacgtgatcggaccagttttgcagccaactcttaattactctgtagaagtgattgtggatctgataaatggtaaaaacccttccaatagtttttactataggttcatggacgtgagagatgtttctcttgctcatatcaaagcgttcgaggtcccttctgctagtggcagatacatacttgctgatccagatgtaacaatgaaagacattcaaaagcttttacatgaactgtttcctgatttgtgccgtgttgataaggataatgagaatgaggtgggtgaaatggcatacaaagtgtgtgtcgataaattgaaaagtttgggaattgagttcactcctatcaaagaatctctcaaggatactgttgttagccttaaggagaggtgtcttcttatatga

SEQ ID NO: 72331 - protein, 310 aa, Arabidopsis thaliana
MNGEGKVVCVTGASGYIASWIVKLLLLRGYTVRATVRNPSASERLKLFKSDLLEEGSFDQAIEGCDGVFHTASPVSLTVTDPQALLQTEMIDPAVNGTLNVLRTCAKVSSVKRVIVTSSTAATLSINPNDVVDETVFTDLSVYLAMKAWYGYSKTLAEETAWRFAKENGIDLVVMNPGNVIGPVLQPTLNYSVEVIVDLINGKNPSNSFYYRFMDVRDVSLAHIKAFEVPSASGRYILADPDVTMKDIQKLLHELFPDLCRVDKDNENEVGEMAYKVCVDKLKSLGIEFTPIKESLKDTVVSLKERCLLI

SEQ ID NO: 72332 - DNA, 1035 bp, Arabidopsis thaliana
  CDS (1)..(1035)
atgccagtcgacgtagcctcaccggccggaaaaaccgtctgcgtcaccggagctggtggatacatcgcttcttggattgttaagatacttctcgagagaggttacacagtcaaaggaaccgtacggaatccagatgatccgaagaacacacatttgagagaactagaaggaggaaaggagagactgattctgtgcaaagcagatcttcaggactacgaggctcttaaggcggcgattgatggttgcgacggcgtctttcacacggcttctcctgtcaccgacgatccggaacaaatggtggagccggccgtgaatggagccaagtttgtgattaatgctgcggctgaggccaaggtcaagcgcgtggtcatcacctcctccattggtgccgtctacatggacccgaaccgtgaccctgaggctgtcgttgacgaaagttgttggagtgatcttgacttctgcaaaaacaccaagaattggtattgttacggcaagatggtggcggaacaagcggcgtgggagacagcaaaggagaaaggtgttgacttggtggtgttgaatccggtgctggttcttggaccgccgttacagccgacgatcaacgccagtctttaccacgtcctcaaatatctaaccggctcggctaagacttatgctaatttgactcaagcttatgtggatgttcgcgatgtcgcgctggctcatgttctggtctatgaggcaccctcggcctccggacgttatctcctagccgagagtgctcgccaccgcggggaagttgttgagattctggctaagctattcccggagtatcctcttccgaccaagtgcaaggacgagaagaaccctagagccaagccatacaaattcactaaccagaagattaaggacttaggcttagagttaacttccaccaagcaaagcttctacgacacagtcaagagcttacaagagaaaggccatcttgctcctcctcctcctcctccttcagcatcgcaagaatccgtggaaaatggcattaagatcgggtcttga

SEQ ID NO: 72333 - protein, 344 aa, Arabidopsis thaliana
MPVDVASPAGKTVCVTGAGGYIASWIVKILLERGYTVKGTVRNPDDPKNTHLRELEGGKERLILCKADLQDYEALKAAIDGCDGVFHTASPVTDDPEQMVEPAVNGAKFVINAAAEAKVKRVVITSSIGAVYMDPNRDPEAVVDESCWSDLDFCKNTKNWYCYGKMVAEQAAWETAKEKGVDLVVLNPVLVLGPPLQPTINASLYHVLKYLTGSAKTYANLTQAYVDVRDVALAHVLVYEAPSASGRYLLAESARHRGEVVEILAKLFPEYPLPTKCKDEKNPRAKPYKFTNQKIKDLGLELTSTKQSFYDTVKSLQEKGHLAPPPPPPSASQESVENGIKIGS

SEQ ID NO: 72334 - DNA, 1017 bp, Populus trichocarpa
  CDS (1)..(1017)
atgcctgttgatgcttcatcactttcaggccaaggccaaactatctgtgtcaccggggctggtggtttcattgcttcttggatggttaaacttcttttagataaaggttacactgttagaggaactgcgaggaacccagctgatcccaagaattctcatttgagggagcttgaaggagctgaagaaagattaactttatgcaaagctgatcttcttgattatgagtctcttaaagaggctattcaagggtgtgatggtgttttccacactgcttctcctgtcacagatgatccggaagaaatggtggagccagcagtgaacgggaccaaaaatgtgataattgcggcggctgaggccaaagtccgacgagtggtgttcacgtcatcaattggcgctgtgtacatggatcccaataagggcccagatgttgtcattgatgagtcttgctggagtgatcttgaattctgcaagaacaccaagaattggtattgctatggaaaggctgtggcagaacaagctgcatgggatatggctaaggagaaaggggtggacctagtggtggttaacccagtgctggtgcttggaccattgttgcagcccactgtcaatgctagcatcactcacatcctcaagtacctcaccggctcagccaagacatatgctaactctgttcaagcttatgtgcatgttagggatgtggcactagcccacattttagtctttgagacgccttccgcctccggccgttacctttgctctgagagcgttctccaccgtggagaggtggtggaaatccttgcaaagttcttccctgagtaccccatccctaccaagtgctcagatgagaagaacccaagaaaacaaccttacaagttctcaaaccagaagctaagggatctgggtttcgaattcaccccagtaaagcagtgtctgtatgaaactgttaagagtttgcaggaaaagggtcaccttccaatcccaaaacaagctgcagaagagtctttgaaaattcaataa

SEQ ID NO: 72335 - protein, 338 aa, Populus trichocarpa
MPVDASSLSGQGQTICVTGAGGFIASWMVKLLLDKGYTVRGTARNPADPKNSHLRELEGAEERLTLCKADLLDYESLKEAIQGCDGVFHTASPVTDDPEEMVEPAVNGTKNVIIAAAEAKVRRVVFTSSIGAVYMDPNKGPDVVIDESCWSDLEFCKNTKNWYCYGKAVAEQAAWDMAKEKGVDLVVVNPVLVLGPLLQPTVNASITHILKYLTGSAKTYANSVQAYVHVRDVALAHILVFETPSASGRYLCSESVLHRGEVVEILAKFFPEYPIPTKCSDEKNPRKQPYKFSNQKLRDLGFEFTPVKQCLYETVKSLQEKGHLPIPKQAAEESLKIQ

SEQ ID NO: 72336 - DNA, 1011 bp, Eucalyptus saligna
  CDS (1)..(1011)
atgcccgtcgacgccctccccggttccggccagaccgtctgcgtcaccggcgccggcggcttcatcgcctcctggattgtcaagcttctcctcgagcgaggctacaccgtgcgaggaaccgtcaggaacccagacgacccgaagaatgggcatctgagagatctggaaggagccagcgagaggctgacgctgtacaagggtgatctgatggactacgggagcttggaagaagccatcaaggggtgcgacggcgtcgtccacaccgcctctccggtcaccgacgatcctgagcaaatggtggagccagcggtgatcgggacgaaaaatgtgatcgtcgcagcggcggaggccaaggtccggcgggttgtgttcacctcctccatcggtgcagtcaccatggaccccaaccggggtccggacgttgtggtggacgagtcttgttggagcgacctcgaattttgcaagagcactaagaactggtattgctacggcaaggcagtggcggagaaggcccgttgcgcagaggcaaaggagagaggggttgacctcgtggtgattaaccctgtgctcgtgcttggaccgctccttcagtcgacgatcaatgcgagcatcatccacatcctcaagtacttgactggctcagccaagacctatgccaactcggtccaggcatacgtgcacgtcaaggacgtcgcgcttgcccacgtccttgtcttggagaccccatccgcctcaggccgctatttgtgcgacgagagtgtcctccaccgtggcgatgtggtggaaatccttgccaagttcttccctgagtataacgtaccgaccaagtgctctgatgaggtgaacccaagagtaaaaccatacaagttctccaaccagaagctgaaagacttggggctcgagttcaccccggtgaagcagtgcctgtacgaaactgtcaagagcttgcaggagaaaggccacctacccgtccctcccccgccggaagattcggtgcgtattcagggatga

SEQ ID NO: 72337 - protein, 336 aa, Eucalyptus saligna
MPVDALPGSGQTVCVTGAGGFIASWIVKLLLERGYTVRGTVRNPDDPKNGHLRDLEGASERLTLYKGDLMDYGSLEEAIKGCDGVVHTASPVTDDPEQMVEPAVIGTKNVIVAAAEAKVRRVVFTSSIGAVTMDPNRGPDVVVDESCWSDLEFCKSTKNWYCYGKAVAEKARCAEAKERGVDLVVINPVLVLGPLLQSTINASIIHILKYLTGSAKTYANSVQAYVHVKDVALAHVLVLETPSASGRYLCDESVLHRGDVVEILAKFFPEYNVPTKCSDEVNPRVKPYKFSNQKLKDLGLEFTPVKQCLYETVKSLQEKGHLPVPPPPEDSVRIQG

SEQ ID NO: 72338 - DNA, 1035 bp, Lolium perenne
  CDS (1)..(1035)
atgactgttgtcaacaccgtcgcgcagcaactgcctggccatgggcagaccgtgtgtgtcaccggcgctgccggatacatcgcgtcttggctcgtcaagctgctcctggagagaggctacaccgtgaagggcacagtgaggaacccagatgatcccaagaacgctcacctgaaggcgctggacggcgccgtcgagaggctgatcctctgcaaagccgacctcctcgactatgatgccatatgcgccgccgccgagggctgccatggcgtgttccacaccgcctctccggtcaccgatgatcctgagcagatggtggagccggcggtgcggggcacggagtacgtgatcaacgcagcggcggatgcaggaacggtgcgccgggtggtgttcacgtcgtccatcggcgccgtcaccatggaccccaaccgcggtcctgacgtagttgtcgacgagtcctgctggagcgacctcgaattctgcaagaagaccaagaactggtactgctacggcaaggcggtggcggagcaggctgcgtgggaggcagccaggaagcgtggcatcgacctcgttgtcgtgaaccctgtgctcgtggtcgggccactgctgcagccaacggtgaacgctagcgccgcacacatcctcaagtacctcgacggctcggccaagaagtatgccaacgccgtgcagtcatacgtggacgtgcgtgatgtagccgacgcgcacatccgcgtgttcgaggcgcccgaggcctcgggccggtacctctgcgccgagcgcgtgctgcaccgtggggacgttgtccaaatcctcagcaaactcttccctgagtaccctgtgccaacaaggtgctctgacgaagtgaacccacggaagcagccttataagatgtccaaccagaagctgcaggatcttggcctccagttcactcctgtgaacgactctctgtatgagaccgtgaagagcctccaggagaagggacacctcctagtaccaagcaaaaatataccagagggattgaacggtgtaacggcatga

SEQ ID NO: 72339 - protein, 344 aa, Lolium perenne
MTVVNTVAQQLPGHGQTVCVTGAAGYIASWLVKLLLERGYTVKGTVRNPDDPKNAHLKALDGAVERLILCKADLLDYDAICAAAEGCHGVFHTASPVTDDPEQMVEPAVRGTEYVINAAADAGTVRRVVFTSSIGAVTMDPNRGPDVVVDESCWSDLEFCKKTKNWYCYGKAVAEQAAWEAARKRGIDLVVVNPVLVVGPLLQPTVNASAAHILKYLDGSAKKYANAVQSYVDVRDVADAHIRVFEAPEASGRYLCAERVLHRGDVVQILSKLFPEYPVPTRCSDEVNPRKQPYKMSNQKLQDLGLQFTPVNDSLYETVKSLQEKGHLLVPSKNIPEGLNGVTA

SEQ ID NO: 72340 - DNA, 1014 bp, Populus tremuloides
  CDS (1)..(1014)
atgcctgttgatgcttcatcactttcaggccaaggccaaacttgtgtcaccggggctggtggtttcattgcttcttggatggttaaacttcttttagataaaggttacactgttagaggaactgcgaggaacccagctgatcccaataattctcatttgagggagcttgaaggagctcaagaaagattaactttatgcaaagctgatcttcttgattatgagtctcttaaagaggctattcaagggtgtgatggtgttttccacactgcttctcccgtcacagatgatccggaagaaatggtggagccagcagtgaacgggaccaaaaatgtgatcattgcggcggctgaggccaaagtccgacgagtggtgttcacgtcctcaattggtgctgtgtacatggatcccaataagggcccagatgttgtcattgatgaatcttgctggagtgatcttgaattctgcaagaacaccaagaattggtattgctatggaaaggctgtggcagaacaagctgcatgggatatggctaaggagaaaggggtggacctagtggtggttaacccagtgctggtgctcggaccattgttccagcccactgtcaatgctagcatcgttcacatcctcaagtacctcaccggctcagccaagacttatgctaactctgttcaagcttatgtgcatgttagggatgtggcactagcccacattttagtctttgagacgccttccgcctctggccgttacctttgctctgagagcgttctccaccgtggagaggtggtggaaattcttgcaaagttcttccccgagtaccccatccctaccaagtgctcagatgagaagaacccaagaaaacaaccttacaagttctcaaaccagaagctaagggatctgggcttcgaattcacccctgtgaagcagtgtctgtatgaaactgttaagagcttgcaggaaaggggtcaccttccaatcccaaaacaagctgcagaagagtctgtgaaaattcaataa

SEQ ID NO: 72341 - protein, 337 aa, Populus tremuloides
MPVDASSLSGQGQTCVTGAGGFIASWMVKLLLDKGYTVRGTARNPADPNNSHLRELEGAQERLTLCKADLLDYESLKEAIQGCDGVFHTASPVTDDPEEMVEPAVNGTKNVIIAAAEAKVRRVVFTSSIGAVYMDPNKGPDVVIDESCWSDLEFCKNTKNWYCYGKAVAEQAAWDMAKEKGVDLVVVNPVLVLGPLFQPTVNASIVHILKYLTGSAKTYANSVQAYVHVRDVALAHILVFETPSASGRYLCSESVLHRGEVVEILAKFFPEYPIPTKCSDEKNPRKQPYKFSNQKLRDLGFEFTPVKQCLYETVKSLQERGHLPIPKQAAEESVKIQ

SEQ ID NO: 72342 - DNA, 963 bp, Arabidopsis thaliana
  CDS (1)..(963)
atggctgtaaagcaaaaggtctgtgttactggtgcaggagggtttattgcttcatggctcgtcaagtttcttctctctcgtggctacactgtccatggaaccgttcgagatccttgtgatgaaaagaatgaccatttgaggaaactggataatgcttcaaaaaatctgaaacttttcaaggcagatttgtttgatgatgaaggtcttttctcagccattgatggttgctctggcgttttccatatcgcttctcctgtgccttttgaaggagaagaactgattaaaccagctctcactggcaccaagaatgttctagaagcatgcacagaaaccaaagtgcagaaagttgtggttgtatcatcaatcgctgcagttgtttacaatccaaaatggcctcaagatgttgctaaggacgaggattgttggtcagacactcaataccttcactcacttgagggttattggcgttattactatcttgccaaaacattaacggaacgtgaagctttagagtggagtaagagaaactttgctgatgttgttacgctctgtccgtctgtcattataggccctaggcttcaatccacgcttaactctagtagtttgggacttctcaagttcataaaaggtggtataaagtccttgttgagcgatgaactgtatcttgtggatgtgcgtgatgttgcggatgcgcttttgttggtgtatgaaaatcgagaagcaacaggaagatacatatgtaattctcattcactttacactgattctcttatggagaagctcaagaatatgtatcctaaacgcaacttccctgaaagtttcacggaggtaaaagagaaggaagtgaggcctctaagtgcagagaagttgaaaaacttggggtggaagtttaggccattagaagaaaccattgatgattctgttgtgagctttgaagcagctggtgatcttccaaaggcataa

SEQ ID NO: 72343 - protein, 320 aa, Arabidopsis thaliana
MAVKQKVCVTGAGGFIASWLVKFLLSRGYTVHGTVRDPCDEKNDHLRKLDNASKNLKLFKADLFDDEGLFSAIDGCSGVFHIASPVPFEGEELIKPALTGTKNVLEACTETKVQKVVVVSSIAAVVYNPKWPQDVAKDEDCWSDTQYLHSLEGYWRYYYLAKTLTEREALEWSKRNFADVVTLCPSVIIGPRLQSTLNSSSLGLLKFIKGGIKSLLSDELYLVDVRDVADALLLVYENREATGRYICNSHSLYTDSLMEKLKNMYPKRNFPESFTEVKEKEVRPLSAEKLKNLGWKFRPLEETIDDSVVSFEAAGDLPKA

SEQ ID NO: 72344 - DNA, 978 bp, Vigna radiata
  CDS (1)..(978)
atgagcaccgccgctggaaaactagtctgtgtcaccggcgcttccggttacatcgcttcctggctcgtcaagtttcttctcgaacgcggctacaccgtgaaggccaccgttcgcgacacgaatgatcccaaaaaggtagatcacttgctcagccttgatggtgcgaaggagagattgcatctcgtgaaggcgaatcttctagaagaaggttcctttgactctgccgttgaaggtgttcacgctgtgtttcacactgcttctccctttttcaacgatgccaaagatccgcagactgagttgttggacccggcagtgaaggggactctgaatgttctgaaatcgtgtgtgaactcgcccacgctgaaacgcgtcgttttaacttcttctattgctgcagttgcgttcagcgacaggcctaaaaaccctgatgttgtggttgacgagacttggtattctgacccggaatactgtaagagaacagggttatggtataacctttcaaagactctggccgaagatgctgcctggaaatttgcgaaagaaaacaacattgacctggttacaatgaacccagcattggttgttggacctctcttgcaaccagtgcttaatactagcgctgctatagttttaggtttagttaatggggcgaaaacatttaaaaatgcttctttgggatgggtcgacgtgaaagatgttgcattggcccatattctagcatatgagaatgcttcggctaatggaagatatttactagttgagagagtagcacactttggagatgctgccaagattttacgagatttatacccaacattgcaaattccagacaagtgtgaagacgataagccattagaaccaatatttcaggtttcgaaggaaaaagcaaagagcttggggattgactatattcctttggaagtgagcctcaaggacactgtggagagcttgaaggaaaagaagtttctgaaagtttaa

SEQ ID NO: 72345 - protein, 325 aa, Vigna radiata
MSTAAGKLVCVTGASGYIASWLVKFLLERGYTVKATVRDTNDPKKVDHLLSLDGAKERLHLVKANLLEEGSFDSAVEGVHAVFHTASPFFNDAKDPQTELLDPAVKGTLNVLKSCVNSPTLKRVVLTSSIAAVAFSDRPKNPDVVVDETWYSDPEYCKRTGLWYNLSKTLAEDAAWKFAKENNIDLVTMNPALVVGPLLQPVLNTSAAIVLGLVNGAKTFKNASLGWVDVKDVALAHILAYENASANGRYLLVERVAHFGDAAKILRDLYPTLQIPDKCEDDKPLEPIFQVSKEKAKSLGIDYIPLEVSLKDTVESLKEKKFLKV

SEQ ID NO: 72346 - DNA, 1017 bp, Zygosaccharomyces rouxii
  CDS (1)..(1017)
atgacaaaagtcttcgtaacaggtgccaacggattcgttgctcaacacgtcgttcatcaactattagaaaagaactatacagtggttggatctgtccgttcaactgagaaaggtgataaattagctaaattgctaaacaatccaaaattttcatatgagattattaaagatatggtcaattcgagagatgaattcgataaggctttacaaaaacattcagatgttgaaattgtcttacatactgcttcaccagtcttcccaggtggtattaaagatgttgaaaaagaaatgatccaaccagctgttaatggtactagaaatgtcttgttatcaatcaaggataacttaccaaatgtcaagagatttgtttacacttcttcattagctgctgtccgtactgaaggtgctggttatagtgcagacgaagttgtcaccgaagattcttggaacaatattgcattgaaagatgccaccaaggatgaaggtacagcttatgaggcttccaagacatatggtgaaaaagaagtttggaatttcttcgaaaaaactaaaaatgttaatttcgattttgccatcatcaacccagtttatgtctttggtcctcaattatttgaagaatacgttactgataaattgaacttttccagtgaaatcattaatagtataataaaaggtgaaaagaaggaaattgaaggttatgaaattgatgttagagatattgcaagagctcatatctctgctgttgaaaatccagcaactacacgtcaaagattaattccagcagttgcaccatacaatcaacaaactatcttggatgttttgaatgaaaacttcccagaattgaaaggtaaaatcgatgttgggaaaccaggttctcaaaatgaatttattaaaaaatattataaattagataactcaaagaccaaaaaagttttaggttttgaattcatttcccaagagcaaacaatcaaagatgctgctgctcaaatcttgtccgttaaaaatggaaaaaaataa

SEQ ID NO: 72347 - protein, 338 aa, Zygosaccharomyces rouxii
MTKVFVTGANGFVAQHVVHQLLEKNYTVVGSVRSTEKGDKLAKLLNNPKFSYEIIKDMVNSRDEFDKALQKHSDVEIVLHTASPVFPGGIKDVEKEMIQPAVNGTRNVLLSIKDNLPNVKRFVYTSSLAAVRTEGAGYSADEVVTEDSWNNIALKDATKDEGTAYEASKTYGEKEVWNFFEKTKNVNFDFAIINPVYVFGPQLFEEYVTDKLNFSSEIINSIIKGEKKEIEGYEIDVRDIARAHISAVENPATTRQRLIPAVAPYNQQTILDVLNENFPELKGKIDVGKPGSQNEFIKKYYKLDNSKTKKVLGFEFISQEQTIKDAAAQILSVKNGKK

SEQ ID NO: 72348 - DNA, 1047 bp, Malus domestica
  CDS (1)..(1047)
atgggatccgagtccgaatccgtttgtgtcaccggggcgtccggtttcatcggctcttggctcgtcatgagactcctagagcacgggtacaccgtccgcgccaccgtgcgtgaccccacgaatcagaagaaggtgaagcatctgttggacttgccgaaggcggagacgcacctgacgctgtggaaggcggacttggcggatgagggaagctttgatgaagccatacaaggctgcagcggagtgttccatgttgctacacctatggactttgaatccaaggaccccgagaatgaagtgatcaagcccacaatcaatggactgttggacatcctgaaggcatgccagaaagcaaaaacagttcgaaagcttgtgttcacatcctcagcaggaaccgtgaatgtggaggagcatcaaaagccggtctacgacgagtccaactggagtgacgttgaattttgccgctccgtcaagatgactggttggatgtacttcgtctccaagactctagctgagcaagctgcatggaaatatgccaaagaaaacaacattgatttcatcaccattatcccaactcttgtgattgggccatttctcatgccatccatgccaccaagcctcatcactggactttcgccgatcttaagaaatgaatcacattatggcatcatcaagcagggccagtatgttcacttggacgacctctgcctttctcacatttatctttacgagcatccgaaagccgaaggccgttacatttgttcgtcacatgatgctacaattcacgaacttgtaaaaatgctcagagaaaaataccccgaatacaatatacccacaaagttcaagggcatcgacgacaacttagaaccagttcatttttcttcaaagaagttgagggagatagggtttgagttcaagtacagcttggaggacatgtttgtgggggctgtcgatgcgtgccgggcaaagggcttgattccgattccgattccggcagagaaaactgaggctgctgaggagagcaacctcgttgatgtcaaagttggttaa

SEQ ID NO: 72349 - protein, 348 aa, Malus domestica
MGSESESVCVTGASGFIGSWLVMRLLEHGYTVRATVRDPTNQKKVKHLLDLPKAETHLTLWKADLADEGSFDEAIQGCSGVFHVATPMDFESKDPENEVIKPTINGLLDILKACQKAKTVRKLVFTSSAGTVNVEEHQKPVYDESNWSDVEFCRSVKMTGWMYFVSKTLAEQAAWKYAKENNIDFITIIPTLVIGPFLMPSMPPSLITGLSPILRNESHYGIIKQGQYVHLDDLCLSHIYLYEHPKAEGRYICSSHDATIHELVKMLREKYPEYNIPTKFKGIDDNLEPVHFSSKKLREIGFEFKYSLEDMFVGAVDACRAKGLIPIPIPAEKTEAAEESNLVDVKVG

SEQ ID NO: 72350 - DNA, 993 bp, Oryza sativa
  CDS (1)..(993)
atggtgatctcatccaagggcaaagtgtgtgtaactggtgcttcaggcttcgtcgcctcttggctcatcaagaggcttcttgaggcgggctatcatgtgataggaactgtgagagacccaagcaatcgcgagaaagtgtcacacctttggagattaccaagtgcaaaggagaggctgcaacttgtgagagctgatctgatggaagaagggagctttgacgatgctgtgatggcttgcgaaggcgtcttccacactgcatctcctgtccttgccaaatctgattccaattgcaaggaagaaatgcttgttcctgcgataaatggtactctgaatgtgctgaaatcttgcaagaagaatccatttctgaaaagggttgttcttacatcctcatcatccacggtaagaatcatggatgagagtaaacatccagaaatctcactggatgaaacaatatggagctctgtggcactctgtgaaaagctacagctatggtatgccctggcaaagatatctgcagagaaagcggcatgggagtttgccaaggagaacaacattgaccttgtaactgttcttccatcatttgtgattgggcccagtttatcacatgaactgtctgtcactgcttcagacatccttggcttacttcaaggtgacacagatagattcatctcgtatgggagaatgggatatgttcacatcgacgatgtggcgagctgccacattctggtgtacgaagcacctcaggctactgggagatatctctgcaactccgttgttcttgacaacaacgaattagtcgccttgcttgcgaagcaatttccaatttttcccatcccaaggagcttgaggaacccatatgagaaacagtcatatgagctaaacacatccaagatccagcagctgggtttcaagttcaaaggggtgcaagagatgtttggtgattgtgtcgagtcgctgaaagatcagggacacttgctggagtgcccgttgtaa

SEQ ID NO: 72351 - protein, 330 aa, Oryza sativa
MVISSKGKVCVTGASGFVASWLIKRLLEAGYHVIGTVRDPSNREKVSHLWRLPSAKERLQLVRADLMEEGSFDDAVMACEGVFHTASPVLAKSDSNCKEEMLVPAINGTLNVLKSCKKNPFLKRVVLTSSSSTVRIMDESKHPEISLDETIWSSVALCEKLQLWYALAKISAEKAAWEFAKENNIDLVTVLPSFVIGPSLSHELSVTASDILGLLQGDTDRFISYGRMGYVHIDDVASCHILVYEAPQATGRYLCNSVVLDNNELVALLAKQFPIFPIPRSLRNPYEKQSYELNTSKIQQLGFKFKGVQEMFGDCVESLKDQGHLLECPL

SEQ ID NO: 72352 - DNA, 1014 bp, Vitis vinifera
  CDS (1)..(1014)
atgggttcacaaagtgaaaccgtgtgcgtcaccggtgcctccggtttcatcggttcatggctggtcatgaggctcctggagcgccggctcactgttcgggccaccgttcgcgatccaactaacgtgaaaaaagtgaagcatttgctggacttgcccaaagcggagacgcatctgactctctggaaggcagatcttgctgatgaaggaagtttcgatgaagctattaaaggctgcaccggcgtcttccatgttgccacacccatggattttgaatcgaaggatcctgagaatgaagtgataaagccaactattgaagggatgttgggcataatgaaatcgtgtgctgccgcaaagactgtcagaaggcttgtattcacatcctccgcaggaactgtgaacattcaagaacaccaactgccagtgtacgatgaaagctgctggagtgatatggaattttgccgggctaaaaagatgactgcatggatgtactttgtctccaagacactggctgagcaagctgcatggaagtatgccaaggaaaataacattgacttcatcactatcataccgactcttgtggttggccccttcataatgtcatcaatgcctccaagcctcataactgctctttccccgatcactggaaacgaagctcattattcaattatacggcagggccaatttgttcacctggatgacctctgcaatgctcatatttacttgtttgagaatcctaaggcagagggacgttacatttgctcctcccacgattgtatcattctcgatcttgcaaaaatgcttagagaaaaataccccgagtataatatccccacagagttcaaaggtgttgatgagaacttgaagagtgtctgtttctcctccaagaagctgacagatttggggtttgagtttaaatacagcttagaggacatgtttactggagctgtggacacatgccgggccaagggattgcttcgcccttcacatgagaaacctgtagatggcaagacctag

SEQ ID NO: 72353 - protein, 337 aa, Vitis vinifera
MGSQSETVCVTGASGFIGSWLVMRLLERRLTVRATVRDPTNVKKVKHLLDLPKAETHLTLWKADLADEGSFDEAIKGCTGVFHVATPMDFESKDPENEVIKPTIEGMLGIMKSCAAAKTVRRLVFTSSAGTVNIQEHQLPVYDESCWSDMEFCRAKKMTAWMYFVSKTLAEQAAWKYAKENNIDFITIIPTLVVGPFIMSSMPPSLITALSPITGNEAHYSIIRQGQFVHLDDLCNAHIYLFENPKAEGRYICSSHDCIILDLAKMLREKYPEYNIPTEFKGVDENLKSVCFSSKKLTDLGFEFKYSLEDMFTGAVDTCRAKGLLRPSHEKPVDGKT

SEQ ID NO: 72354 - DNA, 1029 bp, Saccharomyces cerevisiae
  CDS (1)..(1029)
atgtcagttttcgtttcaggtgctaacgggttcattgcccaacacattgtcgatctcctgttgaaggaagactataaggtcatcggttctgccagaagtcaagaaaaggccgagaatttaacggaggcctttggtaacaacccaaaattctccatggaagttgtcccagacatatctaagctggacgcatttgaccatgttttccaaaagcacggcaaggatatcaagatagttctacatacggcctctccattctgctttgatatcactgacagtgaacgcgatttattaattcctgctgtgaacggtgttaagggaattctccactcaattaaaaaatacgccgctgattctgtagaacgtgtagttctcacctcttcttatgcagctgtgttcgatatggcaaaagaaaacgataagtctttaacatttaacgaagaatcctggaacccagctacctgggagagttgccaaagtgacccagttaacgcctactgtggttctaagaagtttgctgaaaaagcagcttgggaatttctagaggagaatagagactctgtaaaattcgaattaactgccgttaacccagtttacgtttttggtccgcaaatgtttgacaaagatgtgaaaaaacacttgaacacatcttgcgaactcgtcaacagcttgatgcatttatcaccagaggacaagataccggaactatttggtggatacattgatgttcgtgatgttgcaaaggctcatttagttgccttccaaaagagggaaacaattggtcaaagactaatcgtatcggaggccagatttactatgcaggatgttctcgatatccttaacgaagacttccctgttctaaaaggcaatattccagtggggaaaccaggttctggtgctacccataacacccttggtgctactcttgataataaaaagagtaagaaattgttaggtttcaagttcaggaacttgaaagagaccattgacgacactgcctcccaaattttaaaatttgagggcagaatataa

SEQ ID NO: 72355 - protein, 342 aa, Saccharomyces cerevisiae
MSVFVSGANGFIAQHIVDLLLKEDYKVIGSARSQEKAENLTEAFGNNPKFSMEVVPDISKLDAFDHVFQKHGKDIKIVLHTASPFCFDITDSERDLLIPAVNGVKGILHSIKKYAADSVERVVLTSSYAAVFDMAKENDKSLTFNEESWNPATWESCQSDPVNAYCGSKKFAEKAAWEFLEENRDSVKFELTAVNPVYVFGPQMFDKDVKKHLNTSCELVNSLMHLSPEDKIPELFGGYIDVRDVAKAHLVAFQKRETIGQRLIVSEARFTMQDVLDILNEDFPVLKGNIPVGKPGSGATHNTLGATLDNKKSKKLLGFKFRNLKETIDDTASQILKFEGRI

SEQ ID NO: 72356 - DNA, 1044 bp, Saccharomyces cerevisiae
  CDS (1)..(1044)
atgactactgataccactgttttcgtttctggcgcaaccggtttcattgctctacacattatgaacgatctgttgaaagctggctatacagtcatcggctcaggtagatctcaagaaaaaaatgatggcttgctcaaaaaatttaataacaatcccaaactatcgatggaaattgtggaagatattgctgctccaaacgcctttgatgaagttttcaaaaaacatggtaaggaaattaagattgtgctacacactgcctccccattccattttgaaactaccaattttgaaaaggatttactaacccctgcagtgaacggtacaaaatctatcttggaagcgattaaaaaatatgctgcagacactgttgaaaaagttattgttacttcgtctactgctgctctggtgacacctacagacatgaacaaaggagatttggtgatcacggaggagagttggaataaggatacatgggacagttgtcaagccaacgccgttgccgcatattgtggctcgaaaaagtttgctgaaaaaactgcttgggaatttcttaaagaaaacaagtctagtgtcaaattcacactatccactatcaatccgggattcgtttttggtcctcaaatgtttgcagattcgctaaaacatggcataaatacctcctcagggatcgtatctgagttaattcattccaaggtaggtggagaattttataattactgtggcccatttattgacgtgcgtgacgtttctaaagcccacctagttgcaattgaaaaaccagaatgtaccggccaaagattagtattgagtgaaggtttattctgctgtcaagaaatcgttgacatcttgaacgaggaattccctcaattaaagggcaagatagctacaggtgaacctgcgaccggtccaagctttttagaaaaaaactcttgcaagtttgacaattctaagacaaaaaaactactgggattccagttttacaatttaaaggattgcatagttgacaccgcggcgcaaatgttagaagttcaaaatgaagcctaa

SEQ ID NO: 72357 - protein, 347 aa, Saccharomyces cerevisiae
MTTDTTVFVSGATGFIALHIMNDLLKAGYTVIGSGRSQEKNDGLLKKFNNNPKLSMEIVEDIAAPNAFDEVFKKHGKEIKIVLHTASPFHFETTNFEKDLLTPAVNGTKSILEAIKKYAADTVEKVIVTSSTAALVTPTDMNKGDLVITEESWNKDTWDSCQANAVAAYCGSKKFAEKTAWEFLKENKSSVKFTLSTINPGFVFGPQMFADSLKHGINTSSGIVSELIHSKVGGEFYNYCGPFIDVRDVSKAHLVAIEKPECTGQRLVLSEGLFCCQEIVDILNEEFPQLKGKIATGEPATGPSFLEKNSCKFDNSKTKKLLGFQFYNLKDCIVDTAAQMLEVQNEA

SEQ ID NO: 72358 - DNA, 26 bp, Artificial sequence
  primer
atgactactgaaaaaaccgttgtttt

SEQ ID NO: 72359 - DNA, 27 bp, Artificial sequence
  primer
ttagcttttactttgaacttctagtaa

SEQ ID NO: 72360 - protein, 404 aa, Artificial sequence
  consensus sequence
  Variant (2)..(2): Xaa in position 2 is any amino acid
  Variant (7)..(7): Xaa in position 7 is any amino acid
  Variant (9)..(9): Xaa in position 9 is any amino acid
  Variant (12)..(14): Xaa in position 12 to 14 is any amino acid
  Variant (16)..(17): Xaa in position 16 to 17 is any amino acid
  Variant (20)..(21): Xaa in position 20 to 21 is any amino acid
  Variant (23)..(23): Xaa in position 23 is any amino acid
  Variant (25)..(25): Xaa in position 25 is any amino acid
  Variant (27)..(29): Xaa in position 27 to 29 is any amino acid
  Variant (32)..(61): Xaa in position 32 to 61 is any amino acid
  Variant (62)..(83): Xaa in position 62 to 83 is any or no amino acid
  Variant (85)..(85): Xaa in position 85 is any amino acid
  Variant (87)..(87): Xaa in position 87 is any amino acid
  Variant (90)..(94): Xaa in position 90 to 94 is any amino acid
  Variant (96)..(104): Xaa in position 96 to 104 is any amino acid
  Variant (105)..(140): Xaa in position 105 to 140 is any or no amino acid
  Variant (143)..(144): Xaa in position 143 to 144 is any amino acid
  Variant (147)..(148): Xaa in position 147 to 148 is any amino acid
  Variant (150)..(159): Xaa in position 150 to 159 is any amino acid
  Variant (160)..(163): Xaa in position 160 to 163 is any or no amino acid
  Variant (166)..(166): Xaa in position 166 is any amino acid
  Variant (170)..(183): Xaa in position 170 to 183 is any amino acid
  Variant (184)..(197): Xaa in position 184 to 197 is any or no amino acid
  Variant (199)..(212): Xaa in position 199 to 212 is any amino acid
  Variant (213)..(218): Xaa in position 213 to 218 is any or no amino acid
  Variant (220)..(222): Xaa in position 220 to 222 is any amino acid
  Variant (224)..(225): Xaa in position 224 to 225 is any amino acid
  Variant (228)..(229): Xaa in position 228 to 229 is any amino acid
  Variant (231)..(245): Xaa in position 231 to 245 is any amino acid
  Variant (246)..(250): Xaa in position 246 to 250 is any or no amino acid
  Variant (252)..(255): Xaa in position 252 to 255 is any amino acid
  Variant (258)..(263): Xaa in position 258 to 263 is any amino acid
  Variant (264)..(280): Xaa in position 264 to 280 is any or no amino acid
  Variant (282)..(282): Xaa in position 282 is any amino acid
  Variant (284)..(304): Xaa in position 284 to 304 is any amino acid
  Variant (305)..(316): Xaa in position 305 to 316 is any or no amino acid
  Variant (318)..(318): Xaa in position 318 is any amino acid
  Variant (322)..(322): Xaa in position 322 is any amino acid
  Variant (325)..(328): Xaa in position 325 to 328 is any amino acid
  Variant (330)..(332): Xaa in position 330 to 332 is any amino acid
  Variant (333)..(334): Xaa in position 333 to 334 is any or no amino acid
  Variant (336)..(347): Xaa in position 336 to 347 is any amino acid
  Variant (348)..(369): Xaa in position 348 to 369 is any or no amino acid
  Variant (371)..(390): Xaa in position 371 to 390 is any amino acid
  Variant (391)..(403): Xaa in position 391 to 403 is any or no amino acid
VXVTGAXGXIAXXXVXXLLXXGXYXVXXXVRXXXXXXXXXXXXXXXXXXXXXXXXXXXXXXXXXXXXXXXXXXXXXXXXXXXXVXHXASXXXXXPXXXXXXXXXXXXXXXXXXXXXXXXXXXXXXXXXXXXXXXXXXXXXPAXXGTXXVXXXXXXXXXXXXXXVVXTSSXXXXXXXXXXXXXXXXXXXXXXXXXXXXEXXXXXXXXXXXXXXXXXXXXYXXXKXXAEXXAXXXXXXXXXXXXXXXXXXXXPXXXXGPXXXXXXXXXXXXXXXXXXXXXXXNXSXXXXXXXXXXXXXXXXXXXXXXXXXXXXXXXXXVXDVAXAHXXXXEXXXXXGXXXXXXXXXXXXXXXXXXXXXXXXXXXXXXXXXXPXXXXXXXXXXXXXXXXXXXXXXXXXXXXXXXXXL

SEQ ID NO: 72361 - protein, 17 aa, Artificial sequence
  protein pattern
  Variant (2)..(2): Xaa in position 2 is Ser or Thr
  Variant (5)..(5): Xaa in position 5 is Ala, Gly, Asn, Ser or Thr
  Variant (7)..(7): Xaa in position 7 is Phe or Tyr
  Variant (8)..(8): Xaa in position 8 is Ile, Leu or Val
  Variant (9)..(9): Xaa in position 9 is Ala or Gly
  Variant (10)..(12): Xaa in position 10 to 12 is any amino acid
  Variant (13)..(13): Xaa in position 13 is Ile, Leu, Met or Val
  Variant (14)..(15): Xaa in position 14 to 15 is any amino acid
VXGAXGXXXXXXXXXLL

SEQ ID NO: 72362 - DNA, 2451 bp, Saccharomyces cerevisiae
  CDS (1)..(2451)
atgctattcaatatcaaccgtcaagaagacgacccctttacgcaattgatcaatcaatcttcggcaaatacgcaaaatcagcaagcgcatcagcaggaaagcccttatcagtttttgcaaaaggttgtgtccaatgagccaaaaggtaaggaagagtgggtctcgccatttagacaagatgccctcgccaataggcaaaacaaccgggcatatggggaagacgcaaaaaacagaaagtttcctaccgtaagtgctacttctgcctattcaaaacagcaacctaaggatttagggtacaaaaacataccaaaaaatgctaagagagccaaagatattagatttccaacttacctaactcaaaatgaagaaagacaatatcagttactaactgagttggaactaaaggagaaacatttgaaatatttgaagaagtgccagaaaattactgacttaactaaggatgaaaaagatgacactgacactactacttcttcgtccacttctacatcatcatcgtcatcgtcatcgtcatcgtcatcgtcatcgtcttcatcagatgaaggggacgttacttctactaccacatctgaggccactgaagcaactgctgacactgcaactacgacaaccactaccaccagtacttctactaccagcacttctactactaatgctgtcgaaaatagtgctgatgaagcaacttccgtggaggaagaacatgaagacaaagtgagtgagtctacttcaattggcaaaggcactgctgattcagctcaaattaatgtagcggaaccaatctcatccgagaatggggtgttggaaccacgcactacagatcaaagtggcggttcaaagtcaggtgtcgtgccaacagacgaacaaaaggaggaaaaatccgatgtaaaaaaagtcaatcctcccagtggggaagaaaaaaaggaagtggaagcggaaggggatgcagaagaggaaaccgaacaatcgtctgcagaggaatctgctgagagaacgtctactccagaaacctcggaaccggaatccgaagaagatgaaagcccaatcgatccaagcaaggctcccaaggtcccttttcaggaaccttctcgaaaggaaagaaccggaattttcgctttatggaaaagccctacttcttcatctacccaaaaaagtaagaccgccgctccatccaatccagtggccactccagaaaatcctgaattaattgtaaagacaaaagaacatggttacctatcaaaggcagtttatgataaaatcaattatgatgaaaaaattcatcaagcatggttagctgatcttcgagcaaaggaaaaggataaatatgatgctaaaaataaagaatacaaagaaaagctacaagatttacaaaatcagattgacgaaattgaaaattcaatgaaggccatgagagaagaaacttctgagaaaattgaagttagtaaaaaccggttggtcaaaaaaatcattgatgttaatgccgagcataataataagaaactaatgatattaaaagacactgaaaatatgaaaaaccaaaagttgcaggagaaaaatgaggtcttggacaaacaaaccaacgttaagtcagaaatcgatgatttgaacaatgagaaaacgaatgtccaaaaggagttcaatgactggaccacgaacttaagtaacttatctcaacagttggatgctcagatctttaagattaaccagattaatttgaaacaaggcaaagttcaaaacgaaatcgataatctggaaaagaaaaaggaggatttggttacccaaactgaagaaaataagaagctgcatgaaaaaaatgtacaagttttggaaagtgtagagaacaaggaatatcttccacaaattaatgatattgataatcaaatatcaagcttattgaacgaagtgaccataatcaagcaggaaaacgccaatgaaaaaactcaactatcggcaattaccaaaagactcgaagatgagcgccgcgctcatgaagaacagttgaagctagaagctgaagaaagaaaacgcaaagaagagaacttattggaaaaacagcgccaagagctggaggaacaagcgcatcaggctcaattagatcatgagcagcaaattactcaagtcaagcaaacctataatgaccaattgactgaactacaggataagctggcaaccgaagagaaagaactggaggcagtcaagagggaaagaacgcgattacaagctgaaaaggctatcgaggaacaaactcgccagaaaaacgctgatgaggccttgaagcaagaaatattgagtaggcagcacaaacaagctgaaggtatacacgcggctgaaaaccacaaaataccaaatgaccgttcacaaaagaatacgagcgtccttccaaaggacgattccttgtatgaatatcatactgaggaagacgtcatgtatgcctaa

SEQ ID NO: 72363 - protein, 816 aa, Saccharomyces cerevisiae
MLFNINRQEDDPFTQLINQSSANTQNQQAHQQESPYQFLQKVVSNEPKGKEEWVSPFRQDALANRQNNRAYGEDAKNRKFPTVSATSAYSKQQPKDLGYKNIPKNAKRAKDIRFPTYLTQNEERQYQLLTELELKEKHLKYLKKCQKITDLTKDEKDDTDTTTSSSTSTSSSSSSSSSSSSSSSSDEGDVTSTTTSEATEATADTATTTTTTTSTSTTSTSTTNAVENSADEATSVEEEHEDKVSESTSIGKGTADSAQINVAEPISSENGVLEPRTTDQSGGSKSGVVPTDEQKEEKSDVKKVNPPSGEEKKEVEAEGDAEEETEQSSAEESAERTSTPETSEPESEEDESPIDPSKAPKVPFQEPSRKERTGIFALWKSPTSSSTQKSKTAAPSNPVATPENPELIVKTKEHGYLSKAVYDKINYDEKIHQAWLADLRAKEKDKYDAKNKEYKEKLQDLQNQIDEIENSMKAMREETSEKIEVSKNRLVKKIIDVNAEHNNKKLMILKDTENMKNQKLQEKNEVLDKQTNVKSEIDDLNNEKTNVQKEFNDWTTNLSNLSQQLDAQIFKINQINLKQGKVQNEIDNLEKKKEDLVTQTEENKKLHEKNVQVLESVENKEYLPQINDIDNQISSLLNEVTIIKQENANEKTQLSAITKRLEDERRAHEEQLKLEAEERKRKEENLLEKQRQELEEQAHQAQLDHEQQITQVKQTYNDQLTELQDKLATEEKELEAVKRERTRLQAEKAIEEQTRQKNADEALKQEILSRQHKQAEGIHAAENHKIPNDRSQKNTSVLPKDDSLYEYHTEEDVMYA

SEQ ID NO: 72364 - DNA, 2442 bp, Candida glabrata CBS 138
  CDS (1)..(2442)
atgtctttcaaaagtgacgaccctatcggcaggttgctgcaggaaggctcccaggagaagaagaagtccatcctcaccagatcagtagaagatacaggcttcgtgtcccccttcagaagaggcctcacttctgcctctgccgctgcctctgtatcagcttccgcttccgcttccagacacagaaggttctcaaacgactccagcgactcggactcagactccagagatgctcacaatgccgccagcggtggcaggagcgactcctcccgcagcgactcctccagcgactcagacaacgagcagaagatcgctgtgaaccccttcacaaacaagccagcctacaacaagaacgcaaagcagatgaagttccccaccgtcagcgctacctctgcgctcgccaaccaggaccccaaggagctcggcttcaagaccctcgacaagtccaccaagcgcgccaaggacataaagttccccgtctacctgaccgagaacgagttcagacagcagaccatcctgaaggagctggagctcaaggagggaaagctgcagtacttgaaggacagccagaagatcatagacctcaccataagacagcctgactccgacgaagaacagcaggacgagcaggacgaacaggacgacacagaggtcgaggacaacgtcgatgccgaaaaccagcaagcccacactaaggacaacgacaccatcaccgacaaggaggacatggcctcccaggacgccccagaaaaggaaatgtccccaagagaggactccttgcctcacccagacgccgcagaaacaaagatcatgcaacacaaggacatcgacgcaccaaaattgcaagagagaaagccaaccccagatgtcgatgtcgccgccgaacaagcggaagaagtcgctgaaactgacggcgacgtcgatgcaaaagaagtcgatgcggaagccggtgcggaagccgatgccgaagccaaggctgctgacgctgttatggactcagaagctgaaccagaatctcaggaaaaaatggctccatcagttaaggacacctcttctgctcttgctagcgaggacttggaaagttacatgactgttgaaacccctcaaccatacgataaggtcccaagaattccttacactgaacaaccagaatccggtaaaaagttcagctctttcttcaagagaaatgacaatgcaggccacccagttatcactgacgtccctgtgattccagatcagagccaactcgatttcccaattgctactcctgaaaaccctgaattgatcgcaaagaccgaggaatacggttatatgtctaagcctatctacgataaggtggtctatgatgagaccaaccatagacgttggttaaagggtttcaagaaatccgaaaaggccaagtacgatgacaagatggaagagtacaacaatgagttggaagaacttcagaaggaaatagacatgatcaatgagtctatggagaacctaaagaaggaaactgctgacaagattgaagttagtgaaaataacttggtaaagaagatattcgagaggaatactttgcacaatgagcagaaaaataaaatcttcaaagaaaccgagaacatcaagaaccagaagattcaacaaaagaaagaaattcttgacaagcacgctgttgttcaagatgagatcactcaattgaatgacagaaagaaggaagtcagagaagagtttgacaagtggactacaaacatgactaccctcggccaacaattggatgccaagatcatgaaggtgactcaaataaccatgaagcaagatgaaacacaaaaggaaatcgaaaagctagagacccaaaagaaagaataccaggctcaaatagatgcagccaagaaagaacatgaagagggccaaaaggttgtggagagttatgaaaacaaggaatacttgccaaaaatccacacaatcgataaccaaatttcagaattgttgaatgaactcgcaattatcaagcaagaaaatgccaatgagcaaacagagttaagcaagataactaaggagttagaagaagagcgtcgcgctcatgaagagaaattgaaactagaggcagaagagcgtgaacgccaagagaagaacttgctagaaaagcaaagattagaattggaagaaaaggccgaacagcaaaagagagagcatgaagaacaagtgcgtaaaatgaaagaacagtatgaaaatgagttgaacaatgtcaagaaacagaaagaatctttggaaacggaaaaattagtggaggaacacaaccgtaatgagaatatcaaaaaggaagttcttgataagcaacgtaaacaagcagaggctcaacatgctgctcaaactaagtctattgctaccaatgcagcaaacgatatgcaagataactccttgtatgaattcaagacagaagaagaaatcatgtatgtttag

SEQ ID NO: 72365 - protein, 813 aa, Candida glabrata CBS 138
MSFKSDDPIGRLLQEGSQEKKKSILTRSVEDTGFVSPFRRGLTSASAAASVSASASASRHRRFSNDSSDSDSDSRDAHNAASGGRSDSSRSDSSSDSDNEQKIAVNPFTNKPAYNKNAKQMKFPTVSATSALANQDPKELGFKTLDKSTKRAKDIKFPVYLTENEFRQQTILKELELKEGKLQYLKDSQKIIDLTIRQPDSDEEQQDEQDEQDDTEVEDNVDAENQQAHTKDNDTITDKEDMASQDAPEKEMSPREDSLPHPDAAETKIMQHKDIDAPKLQERKPTPDVDVAAEQAEEVAETDGDVDAKEVDAEAGAEADAEAKAADAVMDSEAEPESQEKMAPSVKDTSSALASEDLESYMTVETPQPYDKVPRIPYTEQPESGKKFSSFFKRNDNAGHPVITDVPVIPDQSQLDFPIATPENPELIAKTEEYGYMSKPIYDKVVYDETNHRRWLKGFKKSEKAKYDDKMEEYNNELEELQKEIDMINESMENLKKETADKIEVSENNLVKKIFERNTLHNEQKNKIFKETENIKNQKIQQKKEILDKHAVVQDEITQLNDRKKEVREEFDKWTTNMTTLGQQLDAKIMKVTQITMKQDETQKEIEKLETQKKEYQAQIDAAKKEHEEGQKVVESYENKEYLPKIHTIDNQISELLNELAIIKQENANEQTELSKITKELEEERRAHEEKLKLEAEERERQEKNLLEKQRLELEEKAEQQKREHEEQVRKMKEQYENELNNVKKQKESLETEKLVEEHNRNENIKKEVLDKQRKQAEAQHAAQTKSIATNAANDMQDNSLYEFKTEEEIMYV

SEQ ID NO: 72366 - DNA, 2616 bp, Kluyveromyces lactis NRRL Y-1140
  CDS (1)..(2616)
atggtcggtttgaacttgtttaggaaacggaacgaaattgacccctttgcagggttgctcgatgacgcggaccatgccgccgaacagcaacaacagcatgatcttaccaacagtaacagtattttgaagcgagttaccacgaaacaacagcagcaccaggaagaactagatgataatgagtaccattctcccttccgtacggcggaagaaactcaacgtgcgcgtcaagtgagacaggagaagttccctactctgagccaaggtgcggtacaacttgacccggaacagatggggtacagcgttgttaccgacaagtcagtgaagaaggccaaggatattattattccttctgggttgaaggataccgaggctgagcagaaggttagattgactgcgttggaaaagaaggagaaacagttacgttattggagaaagtctcaaaagattgtggatttaaccaagccacaggaagcaattgaagcgtcggataacttggacgaactggatgaggtggaccctagtaaggaacctcccattgaagatgtagctgaagctctagaagaagccgaggctatggctgaagacgatgaagaggaaccagttgatccgaaacgcgagccaaagcctgaggccgcgctgagggcttttgaagaagctgaggcaattgttcaggacgacgaggagcctccagtggatcctgaagccgagccatcagcagcagttgctgttgaagctcttgaagaagcagaagccattgcgcagggccaagttcctccaagagtcccgttggctgaagaagaagaacaagaaaatccaaccggtgtttacaaggccccggaagatgatgctaatgaatacgtcgatccatctcgtgaggctagaccagaatcggctgtaagagccttcgaagaagccgaggctattgtccaggatgacgaggaggaaccggtcgatcctaaacgcgaaccaaaacctgaggccgctgtgagagcgttcgaagaagccgaggcgattgtccaggacaatgaggagcctccagtggatcctgaagccgaaccttccccggaagaagctgttgaggcattccaagaggccgaagctatcgcaactgagaacccagaagctatttctcctccaccagatatcaattctgcccctcgtgttccattcacacccagtggcgccaataaggccggtactgctgcagctacttctggaattgcagcttcaggcttatttgcccttttcaaacgttcgaagaaaccagagtcctcgaccaaagttgctgcaaatgccgctgctggcaccgttgttccaggcgatgatgcgccagtggccacccctgaagatccagagttaattgtcagaacacaagaaggctacgtctcgaagtctgtttacgataagttgcaatacgacgaggaccagcaccaagccaagttggccctgtactccaaggaacaagatgaaaggtatgaaactaaagcccaagagtacgaggaaaagatccaatcaattcaagctgaaattgctgaattggacgcgcaaatggaacaggttagattggaacatgaggaaaagttgaagttgaagcaagttgagaaatctcaagcattactagaaactaacgtcaagcacattaacgccaagggtgatctgtacaagcaaactgaagaaatcaagaaccaaaccatctcagataaagaggacaaagaagttgctcaccaaactgtccaatctgaaattgatgaattgttgttgttgaaagatgaagttgccaaggaaaaccaggaacacgaatcgaaggtcgaagagttgacagcagaattggataataagacatctgcattgaatgaatccttggctaagaaggatgaaactaatgctgaaattcaagctttggaagaagagaaggccagattggaacaagaaattaaagaagctcaagaacttcaccaacaaaacgtctccaagatcgaaagtatcgacaacaaggagtacttacctaaggtcaatgaaattaataccgaaatttcttcactacttgcttcgttaggtttaattcaacaagaaattgccaaccaaaaggtcgagttttctagtgttactaggagattggaggaagagcgtaaacaacatgaagaacaattgctaaaagaaaaagaggaacgtgagcgtttagaaaaggagcgtttagaaaagcaacgtaccgagtacgaaaagcaagctgaagaagctcgtttgaagcacgaagaagagctggctaacctgaagcaaactcacgacgaggcgctgaaggaggcacagttgcaacgtgaagctgcggccaaacaacttgaagaagaacaacagagacgtgaacaagtagaacgtgaaagaactcgtctacaaggtgaaaaggctattgaagcacaacaacgaggtaatcccgaagacaagagactggaagctgaacacgaagaaaagttgagaaggcaagcagaagctgccagtgcagtcgaaaatgccctgaagagtagcaacaaaaaaacgaaagcagctgttccacctgcaaacaccacaaattcttctctatatgactacgaaaccgttgaagaagtcataactgttgattga

SEQ ID NO: 72367 - protein, 871 aa, Kluyveromyces lactis NRRL Y-1140
MVGLNLFRKRNEIDPFAGLLDDADHAAEQQQQHDLTNSNSILKRVTTKQQQHQEELDDNEYHSPFRTAEETQRARQVRQEKFPTLSQGAVQLDPEQMGYSVVTDKSVKKAKDIIIPSGLKDTEAEQKVRLTALEKKEKQLRYWRKSQKIVDLTKPQEAIEASDNLDELDEVDPSKEPPIEDVAEALEEAEAMAEDDEEEPVDPKREPKPEAALRAFEEAEAIVQDDEEPPVDPEAEPSAAVAVEALEEAEAIAQGQVPPRVPLAEEEEQENPTGVYKAPEDDANEYVDPSREARPESAVRAFEEAEAIVQDDEEEPVDPKREPKPEAAVRAFEEAEAIVQDNEEPPVDPEAEPSPEEAVEAFQEAEAIATENPEAISPPPDINSAPRVPFTPSGANKAGTAAATSGIAASGLFALFKRSKKPESSTKVAANAAAGTVVPGDDAPVATPEDPELIVRTQEGYVSKSVYDKLQYDEDQHQAKLALYSKEQDERYETKAQEYEEKIQSIQAEIAELDAQMEQVRLEHEEKLKLKQVEKSQALLETNVKHINAKGDLYKQTEEIKNQTISDKEDKEVAHQTVQSEIDELLLLKDEVAKENQEHESKVEELTAELDNKTSALNESLAKKDETNAEIQALEEEKARLEQEIKEAQELHQQNVSKIESIDNKEYLPKVNEINTEISSLLASLGLIQQEIANQKVEFSSVTRRLEEERKQHEEQLLKEKEERERLEKERLEKQRTEYEKQAEEARLKHEEELANLKQTHDEALKEAQLQREAAAKQLEEEQQRREQVERERTRLQGEKAIEAQQRGNPEDKRLEAEHEEKLRRQAEAASAVENALKSSNKKTKAAVPPANTTNSSLYDYETVEEVITVD

SEQ ID NO: 72368 - DNA, 25 bp, Artificial sequence
  primer
atgctattcaatatcaaccgtcaag

SEQ ID NO: 72369 - DNA, 24 bp, Artificial sequence
  primer
ttaggcatacatgacgtcttcctc

SEQ ID NO: 72370 - protein, 883 aa, Artificial sequence
  consensus sequence
  Variant (2)..(5): Xaa in position 2 to 5 is any amino acid
  Variant (6)..(10): Xaa in position 6 to 10 is any or no amino acid
  Variant (13)..(76): Xaa in position 13 to 76 is any amino acid
  Variant (77)..(95): Xaa in position 77 to 95 is any or no amino acid
  Variant (100)..(100): Xaa in position 100 is any amino acid
  Variant (102)..(108): Xaa in position 102 to 108 is any amino acid
  Variant (109)..(110): Xaa in position 109 to 110 is any or no amino acid
  Variant (112)..(114): Xaa in position 112 to 114 is any amino acid
  Variant (116)..(120): Xaa in position 116 to 120 is any amino acid
  Variant (121)..(121): Xaa in position 121 is any or no amino acid
  Variant (123)..(124): Xaa in position 123 to 124 is any amino acid
  Variant (126)..(126): Xaa in position 126 is any amino acid
  Variant (131)..(132): Xaa in position 131 to 132 is any amino acid
  Variant (134)..(135): Xaa in position 134 to 135 is any amino acid
  Variant (137)..(139): Xaa in position 137 to 139 is any amino acid
  Variant (141)..(142): Xaa in position 141 to 142 is any amino acid
  Variant (144)..(146): Xaa in position 144 to 146 is any amino acid
  Variant (148)..(149): Xaa in position 148 to 149 is any amino acid
  Variant (152)..(152): Xaa in position 152 is any amino acid
  Variant (155)..(156): Xaa in position 155 to 156 is any amino acid
  Variant (158)..(158): Xaa in position 158 is any amino acid
  Variant (160)..(163): Xaa in position 160 to 163 is any amino acid
  Variant (167)..(167): Xaa in position 167 is any amino acid
  Variant (171)..(174): Xaa in position 171 to 174 is any amino acid
  Variant (175)..(182): Xaa in position 175 to 182 is any or no amino acid
  Variant (184)..(225): Xaa in position 184 to 225 is any amino acid
  Variant (226)..(231): Xaa in position 226 to 231 is any or no amino acid
  Variant (233)..(253): Xaa in position 233 to 253 is any amino acid
  Variant (254)..(258): Xaa in position 254 to 258 is any or no amino acid
  Variant (260)..(315): Xaa in position 260 to 315 is any amino acid
  Variant (316)..(322): Xaa in position 316 to 322 is any or no amino acid
  Variant (324)..(343): Xaa in position 324 to 343 is any amino acid
  Variant (345)..(369): Xaa in position 345 to 369 is any amino acid
  Variant (370)..(371): Xaa in position 370 to 371 is any or no amino acid
  Variant (373)..(379): Xaa in position 373 to 379 is any amino acid
  Variant (380)..(405): Xaa in position 380 to 405 is any or no amino acid
  Variant (407)..(446): Xaa in position 407 to 446 is any amino acid
  Variant (447)..(460): Xaa in position 447 to 460 is any or no amino acid
  Variant (462)..(462): Xaa in position 462 is any amino acid
  Variant (467)..(467): Xaa in position 467 is any amino acid
  Variant (472)..(473): Xaa in position 472 to 473 is any amino acid
  Variant (475)..(475): Xaa in position 475 is any amino acid
  Variant (477)..(477): Xaa in position 477 is any amino acid
  Variant (478)..(478): Xaa in position 478 is any or no amino acid
  Variant (480)..(480): Xaa in position 480 is any amino acid
  Variant (483)..(484): Xaa in position 483 to 484 is any amino acid
  Variant (488)..(489): Xaa in position 488 to 489 is any amino acid
  Variant (493)..(494): Xaa in position 493 to 494 is any amino acid
  Variant (496)..(498): Xaa in position 496 to 498 is any amino acid
  Variant (500)..(509): Xaa in position 500 to 509 is any amino acid
  Variant (511)..(512): Xaa in position 511 to 512 is any amino acid
  Variant (514)..(515): Xaa in position 514 to 515 is any amino acid
  Variant (518)..(524): Xaa in position 518 to 524 is any amino acid
  Variant (526)..(527): Xaa in position 526 to 527 is any amino acid
  Variant (529)..(534): Xaa in position 529 to 534 is any amino acid
  Variant (536)..(540): Xaa in position 536 to 540 is any amino acid
  Variant (542)..(544): Xaa in position 542 to 544 is any amino acid
  Variant (546)..(560): Xaa in position 546 to 560 is any amino acid
  Variant (562)..(563): Xaa in position 562 to 563 is any amino acid
  Variant (565)..(567): Xaa in position 565 to 567 is any amino acid
  Variant (569)..(572): Xaa in position 569 to 572 is any amino acid
  Variant (574)..(574): Xaa in position 574 is any amino acid
  Variant (577)..(578): Xaa in position 577 to 578 is any amino acid
  Variant (582)..(585): Xaa in position 582 to 585 is any amino acid
  Variant (587)..(595): Xaa in position 587 to 595 is any amino acid
  Variant (597)..(598): Xaa in position 597 to 598 is any amino acid
  Variant (601)..(602): Xaa in position 601 to 602 is any amino acid
  Variant (604)..(606): Xaa in position 604 to 606 is any amino acid
  Variant (608)..(609): Xaa in position 608 to 609 is any amino acid
  Variant (611)..(612): Xaa in position 611 to 612 is any amino acid
  Variant (614)..(623): Xaa in position 614 to 623 is any amino acid
  Variant (625)..(627): Xaa in position 625 to 627 is any amino acid
  Variant (630)..(640): Xaa in position 630 to 640 is any amino acid
  Variant (642)..(647): Xaa in position 642 to 647 is any amino acid
  Variant (650)..(651): Xaa in position 650 to 651 is any amino acid
  Variant (654)..(655): Xaa in position 654 to 655 is any amino acid
  Variant (657)..(669): Xaa in position 657 to 669 is any amino acid
  Variant (671)..(677): Xaa in position 671 to 677 is any amino acid
  Variant (680)..(681): Xaa in position 680 to 681 is any amino acid
  Variant (688)..(691): Xaa in position 688 to 691 is any amino acid
  Variant (693)..(695): Xaa in position 693 to 695 is any amino acid
  Variant (698)..(698): Xaa in position 698 is any amino acid
  Variant (701)..(705): Xaa in position 701 to 705 is any amino acid
  Variant (707)..(707): Xaa in position 707 is any amino acid
  Variant (710)..(710): Xaa in position 710 is any amino acid
  Variant (713)..(717): Xaa in position 713 to 717 is any amino acid
  Variant (719)..(720): Xaa in position 719 to 720 is any amino acid
  Variant (722)..(723): Xaa in position 722 to 723 is any amino acid
  Variant (726)..(726): Xaa in position 726 is any amino acid
  Variant (729)..(730): Xaa in position 729 to 730 is any amino acid
  Variant (734)..(734): Xaa in position 734 is any amino acid
  Variant (736)..(737): Xaa in position 736 to 737 is any amino acid
  Variant (739)..(739): Xaa in position 739 is any amino acid
  Variant (743)..(743): Xaa in position 743 is any amino acid
  Variant (745)..(745): Xaa in position 745 is any amino acid
  Variant (747)..(749): Xaa in position 747 to 749 is any amino acid
  Variant (755)..(755): Xaa in position 755 is any amino acid
  Variant (757)..(757): Xaa in position 757 is any amino acid
  Variant (759)..(760): Xaa in position 759 to 760 is any amino acid
  Variant (762)..(767): Xaa in position 762 to 767 is any amino acid
  Variant (770)..(775): Xaa in position 770 to 775 is any amino acid
  Variant (777)..(782): Xaa in position 777 to 782 is any amino acid
  Variant (783)..(796): Xaa in position 783 to 796 is any or no amino acid
  Variant (798)..(799): Xaa in position 798 to 799 is any amino acid
  Variant (800)..(806): Xaa in position 800 to 806 is any or no amino acid
  Variant (808)..(813): Xaa in position 808 to 813 is any amino acid
  Variant (815)..(816): Xaa in position 815 to 816 is any amino acid
  Variant (819)..(820): Xaa in position 819 to 820 is any amino acid
  Variant (822)..(824): Xaa in position 822 to 824 is any amino acid
  Variant (826)..(831): Xaa in position 826 to 831 is any amino acid
  Variant (832)..(835): Xaa in position 832 to 835 is any or no amino acid
  Variant (837)..(843): Xaa in position 837 to 843 is any amino acid
  Variant (847)..(849): Xaa in position 847 to 849 is any amino acid
  Variant (851)..(867): Xaa in position 851 to 867 is any amino acid
  Variant (868)..(874): Xaa in position 868 to 874 is any or no amino acid
  Variant (878)..(880): Xaa in position 878 to 880 is any amino acid
  Variant (882)..(882): Xaa in position 882 is any amino acid
RXXXXXXXXXPFXXXXXXXXXXXXXXXXXXXXXXXXXXXXXXXXXXXXXXXXXXXXXXXXXXXXXXXXXXXXXXXXXXXXXXXXXXXXXXXXXXXKFPTXSXXXXXXXXXPXXXGXXXXXXKXXKXAKDIXXPXXLXXXEXXQXXXLXXLEXKEXXLXYXXXXQKIXDLTXXXXXXXXXXXXDXXXXXXXXXXXXXXXXXXXXXXXXXXXXXXXXXXXXXXXXXXXXXXXXAXXXXXXXXXXXXXXXXXXXXXXXXXXAXXXXXXXXXXXXXXXXXXXXXXXXXXXXXXXXXXXXXXXXXXXXXXXXXXXXXXXXXXXXXXXEXXXXXXXXXXXXXXXXXXXXAXXXXXXXXXXXXXXXXXXXXXXXXXXXPXXXXXXXXXXXXXXXXXXXXXXXXXXXXXXXXXPXXXXXXXXXXXXXXXXXXXXXXXXXXXXXXXXXXXXXXXXXXXXXXXXXXXXXXPXATPEXPELIXXTXEXXYXSKXXYDKXXYDEXXHXXXLXXXXXXXXXXYXXKXXEYXXXXXXXQXXIXXXXXXMXXXXXEXXXKXXXXXXXXXXXXXXXNXXHXXXKXXXXKXTEXXKNQXXXXKXXXXXXXXXVXXEIXXLXXXKXXVXXEXXXXXXXXXXLXXXLDXXXXXXXXXXXKXXXXXXEIXXLEXXKXXXXXXXXXXXXXHXXXXXXXESXXNKEYLPXXXXIXXXISXLLXXXXXIXQEXANXXXXXSXXTXXLEXERXXHEEXLXXEXEERXRXEXXXLEKQRXEXEXXAXXXXXXHEXXXXXXKXXXXXXXXXXXXXXXXXXXXLXXXXXXXXXVXXXXXXLXXEKXXEXXXRXXXXXXXXXXEXXXXXXXQAEXXXAXXXXXXXXXXXXXXXXXXXXXXXXSLYXXXTXE

SEQ ID NO: 72371 - protein, 54 aa, Artificial sequence
  protein pattern
  Variant (3)..(3): Xaa in position 3 is any amino acid
  Variant (4)..(4): Xaa in position 4 is Asp or Glu
  Variant (11)..(11): Xaa in position 11 is any amino acid
  Variant (12)..(12): Xaa in position 12 is Ile or Val
  Variant (13)..(13): Xaa in position 13 is any amino acid
  Variant (14)..(14): Xaa in position 14 is Asp, Glu or Thr
  Variant (16)..(16): Xaa in position 16 is Asp or Asn
  Variant (17)..(17): Xaa in position 17 is Asn or Thr
  Variant (18)..(18): Xaa in position 18 is Glu or Gln
  Variant (21)..(21): Xaa in position 21 is Glu or Ser
  Variant (24)..(24): Xaa in position 24 is Ala or Asn
  Variant (25)..(25): Xaa in position 25 is Glu or Ser
  Variant (26)..(26): Xaa in position 26 is Leu or Val
  Variant (27)..(27): Xaa in position 27 is Ala, Gly or Thr
  Variant (28)..(28): Xaa in position 28 is Ile or Leu
  Variant (30)..(30): Xaa in position 30 is any amino acid
  Variant (33)..(33): Xaa in position 33 is any amino acid
  Variant (36)..(36): Xaa in position 36 is Glu or Gln
  Variant (37)..(37): Xaa in position 37 is any amino acid
  Variant (38)..(38): Xaa in position 38 is Thr or Val
  Variant (39)..(39): Xaa in position 39 is Glu or Gln
  Variant (40)..(40): Xaa in position 40 is Phe or Leu
  Variant (42)..(42): Xaa in position 42 is any amino acid
  Variant (43)..(43): Xaa in position 43 is Ile or Val
  Variant (45)..(45): Xaa in position 45 is Lys or Arg
  Variant (46)..(46): Xaa in position 46 is Glu or Arg
  Variant (49)..(49): Xaa in position 49 is Asp or Glu
  Variant (52)..(52): Xaa in position 52 is Lys or Arg
  Variant (53)..(53): Xaa in position 53 is Ala or Gln
ESXXNKEYLPXXXXIXXXISXLLXXXXXIXQEXANXXXXXSXXTXXLEXERXXH

SEQ ID NO: 72372 - protein, 57 aa, Artificial sequence
  protein pattern
  Variant (2)..(2): Xaa in position 2 is Leu, Met or Val
  Variant (5)..(5): Xaa in position 5 is Ala, Pro or Ser
  Variant (6)..(6): Xaa in position 6 is Ile or Val
  Variant (10)..(10): Xaa in position 10 is any amino acid
  Variant (11)..(16): Xaa in position 11 to 16 is any or no amino acid
  Variant (18)..(18): Xaa in position 18 is Gln or Arg
  Variant (19)..(20): Xaa in position 19 to 20 is any amino acid
  Variant (22)..(27): Xaa in position 22 to 27 is any amino acid
  Variant (28)..(28): Xaa in position 28 is Glu or Gln
  Variant (29)..(29): Xaa in position 29 is Asp or Lys
  Variant (30)..(30): Xaa in position 30 is Ala, Asp or Glu
  Variant (31)..(31): Xaa in position 31 is Lys or Arg
  Variant (33)..(33): Xaa in position 33 is Asp or Glu
  Variant (34)..(34): Xaa in position 34 is Ala, Asp or Thr
  Variant (36)..(37): Xaa in position 36 to 37 is any amino acid
  Variant (40)..(40): Xaa in position 40 is any amino acid
  Variant (41)..(41): Xaa in position 41 is Glu or Asn
  Variant (42)..(42): Xaa in position 42 is Glu or Lys
  Variant (43)..(43): Xaa in position 43 is Ile or Leu
  Variant (44)..(44): Xaa in position 44 is Glu or Gln
  Variant (45)..(45): Xaa in position 45 is Asp, Glu or Ser
  Variant (46)..(46): Xaa in position 46 is Ile or Leu
  Variant (48)..(48): Xaa in position 48 is any amino acid
  Variant (49)..(49): Xaa in position 49 is Glu or Gln
  Variant (51)..(51): Xaa in position 51 is Ala or Asp
  Variant (52)..(52): Xaa in position 52 is any amino acid
  Variant (53)..(53): Xaa in position 53 is Ile or Leu
  Variant (54)..(54): Xaa in position 54 is Asp, Glu or Asn
  Variant (55)..(55): Xaa in position 55 is Ala, Glu or Asn
  Variant (56)..(56): Xaa in position 56 is Gln or Ser
YXSKXXYDKXXXXXXXHXXXLXXXXXXXXXXYXXKXXEYXXXXXXXQXXIXXXXXXM

SEQ ID NO: 72373 - protein, 49 aa, Artificial sequence
  protein pattern
  Variant (2)..(2): Xaa in position 2 is any amino acid
  Variant (5)..(7): Xaa in position 5 to 7 is any or no amino acid
  Variant (10)..(10): Xaa in position 10 is any amino acid
  Variant (11)..(11): Xaa in position 11 is Phe or Ile
  Variant (13)..(13): Xaa in position 13 is Ser, Thr or Val
  Variant (14)..(14): Xaa in position 14 is any amino acid
  Variant (16)..(16): Xaa in position 16 is any amino acid
  Variant (17)..(17): Xaa in position 17 is Asp, Glu or Gln
  Variant (18)..(18): Xaa in position 18 is Asn or Thr
  Variant (20)..(20): Xaa in position 20 is any amino acid
  Variant (21)..(21): Xaa in position 21 is Glu or Arg
  Variant (23)..(25): Xaa in position 23 to 25 is any amino acid
  Variant (27)..(27): Xaa in position 27 is any amino acid
  Variant (28)..(28): Xaa in position 28 is Ala or Glu
  Variant (31)..(31): Xaa in position 31 is any amino acid
  Variant (34)..(35): Xaa in position 34 to 35 is any amino acid
  Variant (37)..(37): Xaa in position 37 is any amino acid
  Variant (39)..(39): Xaa in position 39 is any amino acid
  Variant (40)..(40): Xaa in position 40 is Lys or Arg
  Variant (41)..(41): Xaa in position 41 is Asp or Lys
  Variant (42)..(42): Xaa in position 42 is Cys or Ser
  Variant (46)..(46): Xaa in position 46 is any amino acid
KXAKXXXDIXXPXXLXXXEXXQXXXLXXLEXKEXXLXYXXXXQKIXDLT

SEQ ID NO: 72374 - protein, 60 aa, Artificial sequence
  protein pattern
  Variant (2)..(3): Xaa in position 2 to 3 is any amino acid
  Variant (5)..(5): Xaa in position 5 is any or no amino acid
  Variant (7)..(7): Xaa in position 7 is any amino acid
  Variant (8)..(8): Xaa in position 8 is any or no amino acid
  Variant (10)..(11): Xaa in position 10 to 11 is any amino acid
  Variant (12)..(12): Xaa in position 12 is Ile or Leu
  Variant (13)..(13): Xaa in position 13 is any amino acid
  Variant (15)..(15): Xaa in position 15 is Asp, Glu or Gln
  Variant (18)..(18): Xaa in position 18 is Glu or Asn
  Variant (19)..(19): Xaa in position 19 is Ile or Met
  Variant (23)..(23): Xaa in position 23 is any amino acid
  Variant (24)..(24): Xaa in position 24 is Ile or Leu
  Variant (25)..(25): Xaa in position 25 is Gln or Ser
  Variant (26)..(26): Xaa in position 26 is Asp, Glu or Gln
  Variant (28)..(28): Xaa in position 28 is any amino acid
  Variant (29)..(29): Xaa in position 29 is Asp or Glu
  Variant (30)..(31): Xaa in position 30 to 31 is any amino acid
  Variant (32)..(32): Xaa in position 32 is Asp or Val
  Variant (33)..(34): Xaa in position 33 to 34 is any amino acid
  Variant (35)..(35): Xaa in position 35 is Ala, Gln or Thr
  Variant (36)..(36): Xaa in position 36 is Asn, Thr or Val
  Variant (38)..(38): Xaa in position 38 is any amino acid
  Variant (39)..(39): Xaa in position 39 is Asp or Ser
  Variant (42)..(42): Xaa in position 42 is Asp or Thr
  Variant (43)..(43): Xaa in position 43 is Asp, Glu or Gln
  Variant (45)..(47): Xaa in position 45 to 47 is any amino acid
  Variant (49)..(49): Xaa in position 49 is any amino acid
  Variant (50)..(50): Xaa in position 50 is Glu or Asn
  Variant (52)..(52): Xaa in position 52 is any amino acid
  Variant (53)..(53): Xaa in position 53 is Glu or Lys
  Variant (55)..(55): Xaa in position 55 is any amino acid
  Variant (56)..(56): Xaa in position 56 is Asp, Asn or Gln
  Variant (57)..(57): Xaa in position 57 is Asp, Glu or Lys
  Variant (58)..(58): Xaa in position 58 is His or Trp
  Variant (59)..(59): Xaa in position 59 is Glu or Thr
  Variant (60)..(60): Xaa in position 60 is Ser or Thr
NXXHXNXXKXXXXKXTEXXKNQXXXXKXXXXXXXXXVXXEIXXLXXXKXXVXXEXXXXXX

SEQ ID NO: 72375 - DNA, 1644 bp, Saccharomyces cerevisiae
  CDS (1)..(1644)
atgactaaatcggttggtgatgaagagtcacagtacattgaggaccctagttttgcagcagcagctgcatttactggcggcagggacggggtttcgtacagtaatcagcgatttgctgagggttccggccattcttctgacttagcaaagtcattagaagactatcggcctcctgatgaaaagccgtcctcattgtcatctgtgggggaaggtggcgctaatgaggaagagaagggcggtaacgacggcggtcccttggcaagaattcaaacagggcttttttctccaagactgcgaaatcataggaaaaagattctctcgaagtttgttttgaacaacttcttcattgcttgtgtgtgtgtatcgctcatatcgatttactggggtgcctgttacggaacagatcgttactttttcaaagtgaaaaatattgttgtattgcaggatgcgccatctaatacttcagttcaatctatttccgcgatcataccctcattgttagcgtctgtccccgggacatggcatatatacaacgcaacatcatttcataggaaatttggtacgacgaactccaccgaaattgacagaaagatagtcgatttaatttacgatgagagatactggctggcgttaaacgttaaacctaatgctacagacactttgtataattctttgattagccaagacgcaaactcggagttcaattcatcaattttttttgaatccgtgtttgaaagtggtcgtgacccatcgagtgttaaatcgaccattctaccactcatgcaacaattggaggtccgccttcagaaatattacgtcaaggaatatcttccctcattgatgagcaacatcacttctaatgacagagatcttaatataaacatggagaactgggcgattgcaggacagttgttgttcacctacaacgattatcgtccctttgctgatcgtattctaatggcccctctgcaggtcggtctgatttattgtattttgttaaccgttttacaactgtcattatatggtaagttgcacggagaaatggccagagttctgaagccaaagcatattttaatctacaggcttctaatttcctgggcaacttattttcttctttccattggattctgtaccgtatctgcaatttttaggatcgatttcacccccgcctttggcagaggaggattcgtagtatattggatgtctacgtggttggtaatgatggctgttggtggtgccaatgaaaacgttctcagcttagttatagcttactgccctccatacctgagtatttggttgatgacgtggatcatattaaatatttctgcttcattctacccaatggttttgaacaacgaattttacaggtacggctacataatgccaatccataatgccgtggatatctataaagtgatttttttgaatttaaccaaaagaaaaatgggaagaaattacggtattctcgtggcatgggttgccctcaatacatccttgatgccattttgtatgaagtttgcaggtaaaaaaatgcaaaaaaatgctatgcaagcagcagaagccgctgtcgcagcagctacccagcgtgctagccgcccggcagaggccaatactgataaaaataacaacccgcccggaaattaa

SEQ ID NO: 72376 - protein, 547 aa, Saccharomyces cerevisiae
MTKSVGDEESQYIEDPSFAAAAAFTGGRDGVSYSNQRFAEGSGHSSDLAKSLEDYRPPDEKPSSLSSVGEGGANEEEKGGNDGGPLARIQTGLFSPRLRNHRKKILSKFVLNNFFIACVCVSLISIYWGACYGTDRYFFKVKNIVVLQDAPSNTSVQSISAIIPSLLASVPGTWHIYNATSFHRKFGTTNSTEIDRKIVDLIYDERYWLALNVKPNATDTLYNSLISQDANSEFNSSIFFESVFESGRDPSSVKSTILPLMQQLEVRLQKYYVKEYLPSLMSNITSNDRDLNINMENWAIAGQLLFTYNDYRPFADRILMAPLQVGLIYCILLTVLQLSLYGKLHGEMARVLKPKHILIYRLLISWATYFLLSIGFCTVSAIFRIDFTPAFGRGGFVVYWMSTWLVMMAVGGANENVLSLVIAYCPPYLSIWLMTWIILNISASFYPMVLNNEFYRYGYIMPIHNAVDIYKVIFLNLTKRKMGRNYGILVAWVALNTSLMPFCMKFAGKKMQKNAMQAAEAAVAAATQRASRPAEANTDKNNNPPGN

SEQ ID NO: 72377 - DNA, 1398 bp, Eremothecium gossypii
  CDS (1)..(1398)
atgaacgtgcaggaagacgagagtacggacttcgaagatgactcgcgaaccgaatcggtgcagatgtacctcggcgaatacccgaagaacgcggagcgggagggctccggggagatgctggggggcaagctggcgagattgaagacgcggttcatgtcgccgcgggtatacctggcacgcaagcggcttttggttttgtttctgtcgaacaagctgtttctggcgtgcctggtgctggtggttttctcgctgcatgtgggcgtgctggtgaatcagcagcagtacctggggcggctgccgatgctgatggtggtgcaggacgaggacgcggggatgagcgcggaattgctgcgggcggcggagcacgcggcaggacggtggaccacggtgcacggggcggcggcgtggtcgcacttcgggctggaggaggacgccgacctggatgagtacctgcagagcctgatacgcaagcaccggtactggatggcgctgcacgtgcgccccggtgcgacggaggcgctgcgacggtcgctggatgacccgggggcacctgtgttcaactccagcgagtttttcaaggtgtattatgagaccgtgcgcgacttcaacgcgatggggagtgtgcggaagctgatggagacactggaggccaacttccgtgcatactaccttgacacgtggcttccgggcgagctgcgtgagcgcgccaatacaattgacttgtcttccacagggtccaatatagtggcggccggtagcatgcggtggagctacgtcgacctagggcccttctatgatccctccttgtacgggatattacaagtgggcatgattatatgtcttctgctcacctttttccagctggcgatgatcagcgccttacacacggagctttcactgctcctgcgaacgtcgcatcttctattgtaccgctacattgtgtcatatgcctcgtacctgctgctctctctattctactctatcgtcccaattatataccatcttgacatggagaaagcatacgggcgtgccgggttccttgtcttctggatgacaacttggctattcatgaccgcacttggcggggctaatgaaaatgtaatcagtgtaatatttgagtactgtccgcgattcgttggtttctggctaatgttctggatagtgttcaatatcacccccaccttctacagcctgcacttggcgaatgacttctacaagtacgggtatatcacgccgatttacaatgccagagaatgctacaaggtgttattgtttgacactgacagaggctatttgaaagtcgcgtatgttgtattggttgcgtggactgttctgaatgcggcactcttccctttggcactgaaaattgtgaatattaagagcgggaaacagaagtga

SEQ ID NO: 72378 - protein, 465 aa, Eremothecium gossypii
MNVQEDESTDFEDDSRTESVQMYLGEYPKNAEREGSGEMLGGKLARLKTRFMSPRVYLARKRLLVLFLSNKLFLACLVLVVFSLHVGVLVNQQQYLGRLPMLMVVQDEDAGMSAELLRAAEHAAGRWTTVHGAAAWSHFGLEEDADLDEYLQSLIRKHRYWMALHVRPGATEALRRSLDDPGAPVFNSSEFFKVYYETVRDFNAMGSVRKLMETLEANFRAYYLDTWLPGELRERANTIDLSSTGSNIVAAGSMRWSYVDLGPFYDPSLYGILQVGMIICLLLTFFQLAMISALHTELSLLLRTSHLLLYRYIVSYASYLLLSLFYSIVPIIYHLDMEKAYGRAGFLVFWMTTWLFMTALGGANENVISVIFEYCPRFVGFWLMFWIVFNITPTFYSLHLANDFYKYGYITPIYNARECYKVLLFDTDRGYLKVAYVVLVAWTVLNAALFPLALKIVNIKSGKQK

SEQ ID NO: 72379 - DNA, 1899 bp, Candida glabrata CBS 138
  CDS (1)..(1899)
atgtttgagaagaagctggagaagaagtacaggaagttcaacagcaagtgttggaaggatcctgccgatgctttggctgagaccattgaaggtggtttgaaggccgctaacaagaaggaagaaaaggagaggcgcatgaggaggaaagacctagagaacatgtctttcacctctagcagtgactcttcatatagtgtggagcccaagtcggacacagccaagagtggtgccggtggcaggcataaatcgaagtctccaaaacaaatgtatagcagtgatgacatctcctataagtcgccatctcccggtcaggctaagcctaagaggcgcaaaagcacacgtacatctctcagtgatgatagtgacagtgatagcgacagcgatgatggcgattccagttcagatagtgatgacgatgatgacggtgttcctgctgtgatggcagatgacgaaggggatgtaatctcccgtgtctcttctaccgcatcgcaatggaaaaagaaaacctctttgttctccaagagaatgaaggatcataggagaagaattttggccaaattcatctctacacatatcttgctagctatctttgttataggtgcattatcattatattggggtgctatttacaattatagtggaaacctatatagggttcactcgatagctgtgattcaagatgagccatatactgcccccgacgggactgtcatacccgctcttacccgtaacgtaaccaacattataaactcgataccgggtaactggcggatcatgaatagtacagaattcaaggtgatatacaatgtgactaacgcccaggaaattgatgagaaggttgcagaattgatatttgatgaaaagttttggttggcggtgaatgttcgtgaaggcgcaacagaagcattttacaagtccgtgacagaagaaggtgcaccagttttcaattctacaaattacttccaatcgatatacgagagtggtagagatccaacaaatttgaagtcttctatatatcctattttggcaaaatttgagtcggtgttccgatcacaatatttgaagatttatgttcctgaattcattaagaacattacatccccagatttcaatgaaactgttaacactgccaacttgtatggtctaggaaattttgctactaactcttatgatttacgtccattcaccgatcgtgttttgctgggtccactaagtatgggtctgaactataacatcatgttttcggttttttctatttctatctttggtccagttaataaggaaatggcaaagtatctaaagcctagatctttgttcttttatcgtattctaatttcatggagtatgtttttcttcctatctctgttcacatgtaccgtttctgctattttccaaattgactttacacctggttttggtaaggccggtttcgttatttactggatgacctcttggcttgtcatgacggctgtcggtatggctaatgagaatattttgtctatcattttaacattctgcccgcagtatatgtcatattggatgattatttggactattttgaacattgcaccatcgctgtacccattggtgcttatcagccgcttttatagatttggttatgcgatgccaattcacaatggtgttcaaatttacagagttatatttttagatatttcaaggcatcaaatgagtagaaattatggtattttagccgcttgggtggctgtcaatactgcgatcaacccgttcgttaacaagtttatttctaaggtcgttaagaagagagaagagagaaaggaacttaagagaaagattcaagaggaaagggagcaggaaagacgtcgttatgagcataggcaaagacatgcctccagtaagcatcatgaacatgacagttaa

SEQ ID NO: 72380 - protein, 632 aa, Candida glabrata CBS 138
MFEKKLEKKYRKFNSKCWKDPADALAETIEGGLKAANKKEEKERRMRRKDLENMSFTSSSDSSYSVEPKSDTAKSGAGGRHKSKSPKQMYSSDDISYKSPSPGQAKPKRRKSTRTSLSDDSDSDSDSDDGDSSSDSDDDDDGVPAVMADDEGDVISRVSSTASQWKKKTSLFSKRMKDHRRRILAKFISTHILLAIFVIGALSLYWGAIYNYSGNLYRVHSIAVIQDEPYTAPDGTVIPALTRNVTNIINSIPGNWRIMNSTEFKVIYNVTNAQEIDEKVAELIFDEKFWLAVNVREGATEAFYKSVTEEGAPVFNSTNYFQSIYESGRDPTNLKSSIYPILAKFESVFRSQYLKIYVPEFIKNITSPDFNETVNTANLYGLGNFATNSYDLRPFTDRVLLGPLSMGLNYNIMFSVFSISIFGPVNKEMAKYLKPRSLFFYRILISWSMFFFLSLFTCTVSAIFQIDFTPGFGKAGFVIYWMTSWLVMTAVGMANENILSIILTFCPQYMSYWMIIWTILNIAPSLYPLVLISRFYRFGYAMPIHNGVQIYRVIFLDISRHQMSRNYGILAAWVAVNTAINPFVNKFISKVVKKREERKELKRKIQEEREQERRRYEHRQRHASSKHHEHDS

SEQ ID NO: 72381 - DNA, 1632 bp, Candida glabrata CBS 138
  CDS (1)..(1632)
atgtctaacgctaaccgggataggagggggagtgttcgggctggtctttcacaggttcattctacgttgaatgacggtatatatgatggtgctcttcctgagttgaactacgctgatagagaagaacttaatgatgagcattatggtggtgctccttcaataccgctagaggatgaagaaagtatcagaacgagcaatgaagattattcagaggaggcgaaagaccctcaggcatatgctccaggtcctgaaggggatgaaaagggtaaacctacacagaacaataacccagaaccaactaacactttaaccaagaccaagactagattcttttcacccaacttcaaggatcaacgtaagagggttgcttatagatggctccttgctgtattcctgctgatgtgtttctgtttcactatcttagtgctgatgtggggtgttctttataggacacctcactatgttaggcgtgctaaggtgctagcagtgatacaggaagatcaggtgtaccgttttaatgacactgtacaatttccttcggtctctagcccactttatgatatcattgccgaagtgcctctatcttgggagatatacaacgcaacctctttccagattaaatataatgttgaaggtattgaagcaatgaatcagaaagtcatagatttggtttataaagaagaattttggttggcattgaatgttcagggtaatgtcactgacactctcgttagatcactaataagtgcagattctgatgtgcagttcaattctacatcacttttcgaagtagtctacgaatccggacgtgatatcacaaaccttccttcagtattgctgccagttttccaaggtattgagggtgtcttccagaaagtttatacttatcagtacttgccccaactgttagggaatataaccaatggagataattttaatcctgctcgggttgctgctgcaggtaggatgaagtttaactacaacgactataggccagtgactgatagagttaccttgttgtctacacagattggtgctgtttattgtttgctgttgactgttttccagttcttggtgttcggtcctctgcatggtgagatgtcgaggatgattaagttctcaaatctatggatctaccgtctgattgtgttatggtctgttttgttttttgtgtcaatcttctggtgtactgtttcagccatgtaccaagttgacttcacaaaagcttttggacgggcagggtttgttgtgtactggatgagtacttacctgtatatgttggccgttggtggtctgaatgagaatgtcatcatgttaatcatcctgattagtccatcatacattgggttctggattttaagttttgtcatactgaacctggcaccagcgttctttgccattggttacgcaaatgtcttttacagatacggttatgcaatgccactgcactgtattgtcggcatcaacagagtcatcttctttgacatatcgaaacaccagctaggcagaaactacggtatcctgtgtgcctgggtgggcctcaacactatatcgatgcccttcgtgagtaagttcgtgctgaagacactgcataagagagcacgtaaagctgccatggagaagtccggctaa

SEQ ID NO: 72382 - protein, 543 aa, Candida glabrata CBS 138
MSNANRDRRGSVRAGLSQVHSTLNDGIYDGALPELNYADREELNDEHYGGAPSIPLEDEESIRTSNEDYSEEAKDPQAYAPGPEGDEKGKPTQNNNPEPTNTLTKTKTRFFSPNFKDQRKRVAYRWLLAVFLLMCFCFTILVLMWGVLYRTPHYVRRAKVLAVIQEDQVYRFNDTVQFPSVSSPLYDIIAEVPLSWEIYNATSFQIKYNVEGIEAMNQKVIDLVYKEEFWLALNVQGNVTDTLVRSLISADSDVQFNSTSLFEVVYESGRDITNLPSVLLPVFQGIEGVFQKVYTYQYLPQLLGNITNGDNFNPARVAAAGRMKFNYNDYRPVTDRVTLLSTQIGAVYCLLLTVFQFLVFGPLHGEMSRMIKFSNLWIYRLIVLWSVLFFVSIFWCTVSAMYQVDFTKAFGRAGFVVYWMSTYLYMLAVGGLNENVIMLIILISPSYIGFWILSFVILNLAPAFFAIGYANVFYRYGYAMPLHCIVGINRVIFFDISKHQLGRNYGILCAWVGLNTISMPFVSKFVLKTLHKRARKAAMEKSG

SEQ ID NO: 72383 - DNA, 1638 bp, Candida glabrata CBS 138
  CDS (1)..(1638)
atggtatctgaagctgatacagaggctcaatataacggttctgatcgtctaaggcctgcggctttcgaggcgagtgcatccgatgccctctcaagggtgatgactgagacttactcaatggaagtccgtcaagggcaggaagaagctgaaaaccaagctgcagcacataacagtgagaagcaggaggttgtattttcgagcagggactcgaactcttcaaactcttcgtcacaccaaaagggctcttactcggacacacaggggagtcatactgccgggttcttccacaagtgtgtacacttactaaagaatatacttaaccccaaattagagtcacataagtctgtactcgctttccaattctgcttcacaaacgtcctgctagcaactgtatgtctatccatcatctgtatctattggggtgcagcctataggacggaacattatttgttcaaagttaacatcctgtctgtgatccaagaccaggactataacaacattcaatcaatggcaagcacactccctgctctgatagatcaaacaccagggacatggcatctatataacagatcaagttttgtggaaaaatatggcattgagaacacttcagaggccgttgataaaaaaataaccgatctaattttcgaggaaaagtattggatgtctttaaatgttaaaacaggtgcaaccgaagcactatacaactccttgactgataacacagctccagcgttcaattcaagcgcctattttgaatgcatgtttgaaagtggaagggacccaacaaacttgaaatccgctatattaccaattatgcaacaattgcaagcggcatatgtccagtattatacttcaacttacctaccatcgatgttgagaaatgtaagtgcaactataaactctatcggtgacgttaatccattgagtctggccaactcaggtaactttgagttcaattacatcgactataggcccttttttgaccgtgttctattggcaccattacaagtcgggttaatcttcacattaattttgactgttgtacaactgtcactatatggtccaatgcatgccaagatggtaagagttttcaagcctaagcactttttgctatacagatatggtctatcgtggtcaacatattttattttatccctatttttttgcactgtatcagcaatttaccaaattgattttacactagcgttcggaaggggtggttttgtcatttattggattaccacattctatgtcatgttggccatcggtgctactaatgagaacgtcattagtttgatcgtagcatattgtccacagtacatgccaatctggttgatcagctggattatattaaatatttcgccttcattctatccaatggttcttaataaccaattttaccgctacggttatgccatgcctttgcacaacgctgttgacatctaccgtgtaatctttttggatttgagccgtaacaagttgggtagaaactatggtattttgacagcttgggttgcagtaacccatattatattcccattcgtcatgaagattgctggtaccaagatgaaatcgaacgcaatgaagcaggcgcaggctacaattgctgcatatgaagccaaaaaaaatcaaagttag

SEQ ID NO: 72384 - protein, 545 aa, Candida glabrata CBS 138
MVSEADTEAQYNGSDRLRPAAFEASASDALSRVMTETYSMEVRQGQEEAENQAAAHNSEKQEVVFSSRDSNSSNSSSHQKGSYSDTQGSHTAGFFHKCVHLLKNILNPKLESHKSVLAFQFCFTNVLLATVCLSIICIYWGAAYRTEHYLFKVNILSVIQDQDYNNIQSMASTLPALIDQTPGTWHLYNRSSFVEKYGIENTSEAVDKKITDLIFEEKYWMSLNVKTGATEALYNSLTDNTAPAFNSSAYFECMFESGRDPTNLKSAILPIMQQLQAAYVQYYTSTYLPSMLRNVSATINSIGDVNPLSLANSGNFEFNYIDYRPFFDRVLLAPLQVGLIFTLILTVVQLSLYGPMHAKMVRVFKPKHFLLYRYGLSWSTYFILSLFFCTVSAIYQIDFTLAFGRGGFVIYWITTFYVMLAIGATNENVISLIVAYCPQYMPIWLISWIILNISPSFYPMVLNNQFYRYGYAMPLHNAVDIYRVIFLDLSRNKLGRNYGILTAWVAVTHIIFPFVMKIAGTKMKSNAMKQAQATIAAYEAKKNQS

SEQ ID NO: 72385 - DNA, 1599 bp, Debaryomyces hansenii CBS767
  CDS (1)..(1599)
atggagagtcctgctattaactccttatccaagactctggaaggaattcataaggatacagattattccgaggatatgtcaagaaggcaagaaaggttagaaaattctagtcctcagccgtacgctaaagatgaggaagaacaattttattcagattctgaaggagaaatacgtgatttcagagatcaagataatcgcagtatcaatagtacacatggtagtacacacagtaaacatctgactgttttagagaaggtgcaatcacaatattcgttcttccatgagaaattgggtaagcaaagaaagggtattgttataaaatatgcattgatttatcttttgatgagttcattgatattggggatgttttcgatatattgggggtcgttttaccaaagaaactcgagactcaagaatttgaatatgttggtggtaattgaagatgaccatactgtggatggaattgaacccgtcattggaaataccattagagaaatattaaataccgatgctgccaaggcatatggtaaatggcacattttcaatcaatcagaaatccgggaacaagcagataagaacaagaatgatgttgacgccgaggtacaaagacttatacatcaccaacaatattggtcatctatatatgtgaaacctgaagcatcatataatttatacaaagcgatttctgagggtgatgcatcgtataacgttacagacaataccattttgtcatactacgaaacgggcagggactttctcagtatgaatctgtatgttaccccgagtatcaagattattgaacaaatgtggttgaagaaactggctaatgtgactttgtcgttaactaacaagttatcgtcatctgaaagatcagacgtcttgagcgattctaactcactcgaacttttatccacgccaattagcttcacatatatcgataaaatcccgttcaccgatcctgttttaacagctccatctcaagttgggttgatttatatgatcattatcactttcttccaggttaactttttcatggatgtacacaagggtgttgcttcgttaaatatcaaacccatgcatttcgttgtttacagaatactttcttctgttctttcgttctttgtcataagtttatttttctccttcccctcattggcatttcaggttgatttcactaaggcctttggcaactctggctttttaatatactggatgattacattccttacaatgtgggcagttggtatggccaacgaagtcatggcccttatctgtgttatggtatatcctccgttaatgggattttggatgttgttttgggttattataaatattgctccaacctttgctccaattgcattatgccccgaattttacagatatggttatggattacctattcataattcctacgagattacaaaagtcattctattcgatacatataagggcaatttaggaagaagctttggaattgtcattgcttgggtggtaatatttacattattacttccattcgttctcaaattattcctgaagaccatggctaagagagcccaggcagctgctcaggcagctcagaagagcgcaaataattaa

SEQ ID NO: 72386 - protein, 532 aa, Debaryomyces hansenii CBS767
MESPAINSLSKTLEGIHKDTDYSEDMSRRQERLENSSPQPYAKDEEEQFYSDSEGEIRDFRDQDNRSINSTHGSTHSKHLTVLEKVQSQYSFFHEKLGKQRKGIVIKYALIYLLMSSLILGMFSIYWGSFYQRNSRLKNLNMLVVIEDDHTVDGIEPVIGNTIREILNTDAAKAYGKWHIFNQSEIREQADKNKNDVDAEVQRLIHHQQYWSSIYVKPEASYNLYKAISEGDASYNVTDNTILSYYETGRDFLSMNLYVTPSIKIIEQMWLKKLANVTLSLTNKLSSSERSDVLSDSNSLELLSTPISFTYIDKIPFTDPVLTAPSQVGLIYMIIITFFQVNFFMDVHKGVASLNIKPMHFVVYRILSSVLSFFVISLFFSFPSLAFQVDFTKAFGNSGFLIYWMITFLTMWAVGMANEVMALICVMVYPPLMGFWMLFWVIINIAPTFAPIALCPEFYRYGYGLPIHNSYEITKVILFDTYKGNLGRSFGIVIAWVVIFTLLLPFVLKLFLKTMAKRAQAAAQAAQKSANN

SEQ ID NO: 72387 - DNA, 1512 bp, Candida albicans SC5314
  CDS (1)..(1512): transl_table=12
atgtcagagccagcagcaaattcacaatatgacacccatttgagcccacaacaacaacgacaacaaaagcacaagtacttgtcaagcagtgactccgaagcctcacccccaacacgaaatatggtcaaaaaagttaacaaaggcttctctttatttagtagaaaattgcaaaccgaaagaaggaaaattgcattaaagtatttcttgaactatttaatcatgggagttggtgttctagcaatattctcgatctactggggctccttttatggaataaatggcaggataaaaaatttgaaaatgttagtggtaatagaagatgactccataataaatggactaaaccctgtcttcggtgacaatttgaaagaaattctacagacccctgaagcaaagaccaagggcaattggaaaatatacaactcaactgaatttgctcagatagcgtccaaatccaaccggactgcggaacaagaaattatgcaccaaattcatcatcaaaagtattgggcatcactccatgtgatgccaaacgcctcctacaactatttcaatgccatgtcacagggggatgccaattatgatcctgttaaaaacacagtccattcgatttatgaaacaggaagggatttcaatggaatgactcaattcgtcatcccttccatcaatggcgtggaaaatatatggctaagcagacaacccaagatgactttcgatatagttcgcaatgtcactatcgattccgccgtaaaactgaaactacttgcccagccaattagatttgaaattgtcgatccagtaccatggaacgaccctattctaattggaccttttcatgatcttcaaatctatatgactattttgaccttattgcaatttgagtttttcagtccaattcacaaggaagtgtctaaattgggattaaagaggggtcattacatgatttatcgcttcacagcatctatattgtcgtttttcatattgagtttattttgctgcttggtgacattggctttccaagttgatctcacggttacatatgggagagctgggtttgtggtttattggatgattgctttcatgacaatgtgggctcttggctctgtaaatgaaattgtcgcgatgttgcttattacattttaccctccactagttcaattctggttgctattttggataatttgcaatatcacccccacattcacgccaatggccgtaattccaaagttcttcagatatgggtatgcattgcccatccataattcctatgaagccactaaaacagtattcttcaggacatataaggcacaattgggaagaaactttggcatattagcagcttggtttgctgttttaagcataatcttccccatcattgtctattattttataacaaccacgaacaagacctttgagcaacaagtttgtgctgtagttcatgagaggaaccaacttgaaactgaggactatcaggaatatgaccgaaatgagaaaaggacaaacaattactaa

SEQ ID NO: 72388 - protein, 503 aa, Candida albicans SC5314
MSEPAANSQYDTHLSPQQQRQQKHKYLSSSDSEASPPTRNMVKKVNKGFSLFSRKLQTERRKIALKYFLNYLIMGVGVLAIFSIYWGSFYGINGRIKNLKMLVVIEDDSIINGLNPVFGDNLKEILQTPEAKTKGNWKIYNSTEFAQIASKSNRTAEQEIMHQIHHQKYWASLHVMPNASYNYFNAMSQGDANYDPVKNTVHSIYETGRDFNGMTQFVIPSINGVENIWLSRQPKMTFDIVRNVTIDSAVKSKLLAQPIRFEIVDPVPWNDPILIGPFHDLQIYMTILTLLQFEFFSPIHKEVSKLGLKRGHYMIYRFTASILSFFILSLFCCLVTLAFQVDLTVTYGRAGFVVYWMIAFMTMWALGSVNEIVAMLLITFYPPLVQFWLLFWIICNITPTFTPMAVIPKFFRYGYALPIHNSYEATKTVFFRTYKAQLGRNFGILAAWFAVLSIIFPIIVYYFITTTNKTFEQQVCAVVHERNQLETEDYQEYDRNEKRTNNY

SEQ ID NO: 72389 - DNA, 1536 bp, Candida albicans SC5314
  CDS (1)..(1536): transl_table=12
atgtctcatgatgattcaaatctgaattcaaaccccagctcaaatccaacctccaatcctgtgtcaaagccgtctgatatgggcagatcaagcaacgacagtggctccgaaccatcaatacaacattttacgttagccccactcgaaccacaaggcgatgaagaggatatggaaatgggtgagccaatatcacgacaatcaacctttcttgagagagtacaatctcgatattcatttttccacgagaatttgcgagctcaaagaaaggaattgtccatgaaatatcttaaaatttatctagtcatggccattggttgcttaggagtgttttctatatattggggttcaatgtatcaaagagaaacccgaattaaaaacttgaaaatgttggtagttttagaagatgaagaaattaatggcatccctccactttttggcaatcagcttcgtgatttattggccaccccaacggctagaacactcggcgattggaaaatatataacactagcgaatttgaaactattgcatcaaaacacaacaacacaataaatgaagaggtcattcgtcaaattcatcatcaaaattattgggcctcgatatatgtcaagcaaaattcatcttataacatatacaatgcattagccaatggtaatcagtacaatgtcagtgactctgtgtattgttactatgaaacaggaagacacctaactagtgttggcccatatgtggtggcatctatagatgccattcaaactatgtggttggatcaaaacctggtgatgagggacattgtgagaattggtaatataactcttgacaatgcaaactcggttgctgtcgccactaccgccttggcattccaaataattgatatgagaccatctactagtggagttttagttgcagctttacaaattggtcttctttatcttgtcattgttagttttttcagtttcaatttttttgtcgatatacaccgatcagtggcattaatggtgaagcaaagaaactttttactttatcgagtttttgcatcaatcatatcgtattttgttatcagtttaatgtttggtttggttactttagcgtttcaagttgattttgctgttacatttggtaaatctggcttcttagtttactggatggtaacatttttaacaatgtggagtgttggattggctaacgaattggccgctatgctcatacttactatctatccaccaatggttgggttttggttgatcttctgggtaattataaatatcacacccacattcacaccaattgctttgttacctgaattttatcggtatggttacgccatgccattgcataatgcttttgaaatttattctgttatttttttcaacacgtataagggattaataggaagaagcattggaatcataattgcatgggtggtatttttaacattaatggcaccaatagtggtggtttactttggtagcactatgagtaaaaaagctgctgctcccgctgctgctgcaaaaaaggaaaaggaaaagtcaaagtaa

SEQ ID NO: 72390 - protein, 511 aa, Candida albicans SC5314
MSHDDSNSNSNPSSNPTSNPVSKPSDMGRSSNDSGSEPSIQHFTLAPLEPQGDEEDMEMGEPISRQSTFLERVQSRYSFFHENLRAQRKELSMKYLKIYLVMAIGCLGVFSIYWGSMYQRETRIKNLKMLVVLEDEEINGIPPLFGNQLRDLLATPTARTLGDWKIYNTSEFETIASKHNNTINEEVIRQIHHQNYWASIYVKQNSSYNIYNALANGNQYNVSDSVYCYYETGRHLTSVGPYVVASIDAIQTMWLDQNSVMRDIVRIGNITLDNANSVAVATTALAFQIIDMRPSTSGVLVAALQIGLLYLVIVSFFSFNFFVDIHRSVALMVKQRNFLLYRVFASIISYFVISLMFGLVTLAFQVDFAVTFGKSGFLVYWMVTFLTMWSVGLANELAAMLILTIYPPMVGFWLIFWVIINITPTFTPIALLPEFYRYGYAMPLHNAFEIYSVIFFNTYKGLIGRSIGIIIAWVVFLTLMAPIVVVYFGSTMSKKAAAPAAAAKKEKEKSK

SEQ ID NO: 72391 - DNA, 1536 bp, Candida albicans SC5314; identical to SEQ ID NO: 72389
  CDS (1)..(1536): transl_table=12

SEQ ID NO: 72392 - protein, 511 aa, Candida albicans SC5314; identical to SEQ ID NO: 72390

SEQ ID NO: 72393 - DNA, 1533 bp, Saccharomyces cerevisiae
  CDS (1)..(1533)
atgacttcatctctagatgatatagaaccaacagcatataataatatggaagcggacgaggaatattgcagacgcaacgatatacatgacctttccagcgtggtcggtgatgctgtctcacaaggtgtgccagacatggatggtcaaacaacggattcttcgaaggaccctgagccaaattccgaggataagaaagcgtttcctccttcgagtggctcatttttttctcctaatctacagggtcaaaggaagaaagttcttttaaagtttgttttcacaaattgcttactggccataatttgctttacaatgtttgtgttgttctggggggctctttacgacaccagcaagtatctacacaaagttaagcttctggttgttatccaggaaccccctgtggtaattttggataataacagttccatggtagtgccctccatatcgtatgctttgcctacttttatcaataaaataccatgtgattgggatatttataacagtcctaccttccaggccaagttcgacgtaaatacgccacagcaagtcaatgacaaggttgtcgatttggtttacgacgaaaaatactggtttgccattaatatcaagccaaacgccacggagactctatttgaatcactaatcaacgataccgcaccactattcaattctacgctgtttaatcaggtggtatatgaaactggtagagacccgacaaacctaaaatcaacgattttaccggttgctcagaccattgaagagtactaccatacattctacacactaaattatctgccgccgttattgacaaacataacccaggtatatcgttatgcactaactaacaatgcaaggtatatcgctgcagcaggtaaatataactacgaatactatgaccacagaccattcacagaccgtattctactggcacccacacaaatcggtgttgtttactgtttactgctaactttttcccaatttctattgtacggcccattacacgtagaaatggcaaaagtgctaagaccagccaacggtttaatttaccgtatcgctatgtcatggttcacctttttctttgcgtctttgttcttctgcacaacaaccgccatctttcaagtcgattttaccaagtcctttggtagaggtggcttcgtcgtatattggatgtctacgtggctcttcatgcttgctgcgggaggagctaacgaaaatgcggttatgcttgttattacgttaggaccccagtatctcgggttctggatcctatcatttgtcattctcaatattgcaccttctttcttcccattagcgctaaacaataatgtttatagatatgggtacatgatgcccgttcacaacgtcattgatatctacagggttattttttttgacgtgacaagacgcaagatgggtcggaattatggtattttagtcgcactcattgccttgaatacggcactgttaccatttgttggcaagtatgctagtagaaaactaaaacagaaggctttagtggcagcaaagcagagttaa

SEQ ID NO: 72394 - protein, 510 aa, Saccharomyces cerevisiae
MTSSLDDIEPTAYNNMEADEEYCRRNDIHDLSSVVGDAVSQGVPDMDGQTTDSSKDPEPNSEDKKAFPPSSGSFFSPNLQGQRKKVLLKFVFTNCLLAIICFTMFVLFWGALYDTSKYLHKVKLLVVIQEPPVVILDNNSSMVVPSISYALPTFINKIPCDWDIYNSPTFQAKFDVNTPQQVNDKVVDLVYDEKYWFAINIKPNATETLFESLINDTAPLFNSTLFNQVVYETGRDPTNLKSTILPVAQTIEEYYHTFYTLNYLPPLLTNITQVYRYALTNNARYIAAAGKYNYEYYDHRPFTDRILLAPTQIGVVYCLLLTFSQFLLYGPLHVEMAKVLRPANGLIYRIAMSWFTFFFASLFFCTTTAIFQVDFTKSFGRGGFVVYWMSTWLFMLAAGGANENAVMLVITLGPQYLGFWILSFVILNIAPSFFPLALNNNVYRYGYMMPVHNVIDIYRVIFFDVTRRKMGRNYGILVALIALNTALLPFVGKYASRKLKQKALVAAKQS

SEQ ID NO: 72395 - DNA, 1533 bp, Saccharomyces cerevisiae
  CDS (1)..(1533)
atgacttcatctctagatgatatagaaccaacagcatataataatatggaagcggacgaggaatattgcagacgcaacgatatacatgacctttccagcgtggtcggtgatgctgtctcacaaggtgtgccagacatggatggtcaaacaacggattcttcgaaggaccctgagccaaattccgaggataagaaagcgtttcctccttcgagtggctcatttttttctcctaatctacagggtcaaaggaagaaagttcttttaaagtttgttttcacaaattgcttactggccataatttgctttacaatgtttgtgttgttctggggggctctttacgacaccagcaagtatctacacaaagttaagcttctggttgttatccaggaaccccctgtggtaattttggataataacagttccatggtagtgccctccatatcgtatgctttgcctacttttatcaataaaataccatgtgattgggatatttataacagtcctaccttccaggccaagttcgacgtaaatacgccacagcaagtcaatgacaaggttgtcgatttggtttacgacgaaaaatactggtttgccattaatatcaagccaaacgccacggagactctatttgaatcactaatcaacgataccgcaccactattcaattctacgctgtttaatcaggtggtatatgaaactggtagagacccgacaaacctaaaatcaacgattttaccggttgctcagaccattgaagagtactaccatacattctacacactaaattatctgccgccgttattgacaaacataacccaggtatatcgttatgcactaactaacaatgcaaggtatatcgctgcagcaggtaaatataactacgaatactatgaccacagaccattcacagaccgtattctactggcacccacacaaatcggtgttgtttactgtttactgctaacttttttccaatttctattgtacggcccattacacgtagaaatggcaaaagtgctaagaccagccaacggtttaatttaccgtatcgctatgtcatggttcacctttttctttgcgtctttgttcttctgcacaacaaccgccatctttcaagtcgattttaccaagtcctttggtagaggtggcttcgtcgtatattggatgtctacgtggctcttcatgcttgctgcgggaggagctaacgaaaatgcggttatgcttgttattacgttaggaccccagtatctcgggttctggatcctatcatttgtcattctcaatattgcaccttctttcttcccattagcgctaaacaataatgtttatagatatgggtacatgatgcccgttcacaacgtcatcgatatctacagggttattttttttgacgtgacaagacgcaagatgggtcggaattatggtattttagtcgcactcattgccttgaatacggcactgttaccatttgttggcaagtatgctagtagaaaactaaaacagaaggctttagtggcagcaaagcagagttaa

SEQ ID NO: 72396 - protein, 510 aa, Saccharomyces cerevisiae
MTSSLDDIEPTAYNNMEADEEYCRRNDIHDLSSVVGDAVSQGVPDMDGQTTDSSKDPEPNSEDKKAFPPSSGSFFSPNLQGQRKKVLLKFVFTNCLLAIICFTMFVLFWGALYDTSKYLHKVKLLVVIQEPPVVILDNNSSMVVPSISYALPTFINKIPCDWDIYNSPTFQAKFDVNTPQQVNDKVVDLVYDEKYWFAINIKPNATETLFESLINDTAPLFNSTLFNQVVYETGRDPTNLKSTILPVAQTIEEYYHTFYTLNYLPPLLTNITQVYRYALTNNARYIAAAGKYNYEYYDHRPFTDRILLAPTQIGVVYCLLLTFFQFLLYGPLHVEMAKVLRPANGLIYRIAMSWFTFFFASLFFCTTTAIFQVDFTKSFGRGGFVVYWMSTWLFMLAAGGANENAVMLVITLGPQYLGFWILSFVILNIAPSFFPLALNNNVYRYGYMMPVHNVIDIYRVIFFDVTRRKMGRNYGILVALIALNTALLPFVGKYASRKLKQKALVAAKQS

SEQ ID NO: 72397 - DNA, 25 bp, Artificial sequence
  primer
atgactaaatcggttggtgatgaag

SEQ ID NO: 72398 - DNA, 25 bp, Artificial sequence
  primer
ttaatttccgggcgggttgttattt

SEQ ID NO: 72399 - protein, 418 aa, Artificial sequence
  consensus sequence
  Variant (2)..(8): Xaa in position 2 to 8 is any amino acid
  Variant (10)..(34): Xaa in position 10 to 34 is any amino acid
  Variant (37)..(38): Xaa in position 37 to 38 is any amino acid
  Variant (40)..(50): Xaa in position 40 to 50 is any amino acid
  Variant (52)..(52): Xaa in position 52 is any amino acid
  Variant (54)..(64): Xaa in position 54 to 64 is any amino acid
  Variant (65)..(76): Xaa in position 65 to 76 is any or no amino acid
  Variant (78)..(87): Xaa in position 78 to 87 is any amino acid
  Variant (89)..(89): Xaa in position 89 is any amino acid
  Variant (91)..(91): Xaa in position 91 is any amino acid
  Variant (93)..(95): Xaa in position 93 to 95 is any amino acid
  Variant (97)..(119): Xaa in position 97 to 119 is any amino acid
  Variant (120)..(121): Xaa in position 120 to 121 is any or no amino acid
  Variant (124)..(127): Xaa in position 124 to 127 is any amino acid
  Variant (129)..(148): Xaa in position 129 to 148 is any amino acid
  Variant (149)..(150): Xaa in position 149 to 150 is any or no amino acid
  Variant (152)..(157): Xaa in position 152 to 157 is any amino acid
  Variant (158)..(158): Xaa in position 158 is any or no amino acid
  Variant (161)..(161): Xaa in position 161 is any amino acid
  Variant (165)..(218): Xaa in position 165 to 218 is any amino acid
  Variant (219)..(225): Xaa in position 219 to 225 is any or no amino acid
  Variant (227)..(228): Xaa in position 227 to 228 is any amino acid
  Variant (230)..(231): Xaa in position 230 to 231 is any amino acid
  Variant (233)..(234): Xaa in position 233 to 234 is any amino acid
  Variant (236)..(239): Xaa in position 236 to 239 is any amino acid
  Variant (241)..(241): Xaa in position 241 is any amino acid
  Variant (243)..(244): Xaa in position 243 to 244 is any amino acid
  Variant (246)..(260): Xaa in position 246 to 260 is any amino acid
  Variant (262)..(275): Xaa in position 262 to 275 is any amino acid
  Variant (276)..(276): Xaa in position 276 is any or no amino acid
  Variant (279)..(281): Xaa in position 279 to 281 is any amino acid
  Variant (283)..(286): Xaa in position 283 to 286 is any amino acid
  Variant (288)..(289): Xaa in position 288 to 289 is any amino acid
  Variant (292)..(300): Xaa in position 292 to 300 is any amino acid
  Variant (302)..(302): Xaa in position 302 is any amino acid
  Variant (305)..(307): Xaa in position 305 to 307 is any amino acid
  Variant (310)..(311): Xaa in position 310 to 311 is any amino acid
  Variant (314)..(315): Xaa in position 314 to 315 is any amino acid
  Variant (319)..(319): Xaa in position 319 is any amino acid
  Variant (321)..(321): Xaa in position 321 is any amino acid
  Variant (323)..(323): Xaa in position 323 is any amino acid
  Variant (325)..(325): Xaa in position 325 is any amino acid
  Variant (327)..(327): Xaa in position 327 is any amino acid
  Variant (329)..(330): Xaa in position 329 to 330 is any amino acid
  Variant (333)..(342): Xaa in position 333 to 342 is any amino acid
  Variant (344)..(348): Xaa in position 344 to 348 is any amino acid
  Variant (350)..(354): Xaa in position 350 to 354 is any amino acid
  Variant (356)..(356): Xaa in position 356 is any amino acid
  Variant (359)..(359): Xaa in position 359 is any amino acid
  Variant (361)..(361): Xaa in position 361 is any amino acid
  Variant (363)..(363): Xaa in position 363 is any amino acid
  Variant (365)..(366): Xaa in position 365 to 366 is any amino acid
  Variant (368)..(370): Xaa in position 368 to 370 is any amino acid
  Variant (377)..(378): Xaa in position 377 to 378 is any amino acid
  Variant (380)..(380): Xaa in position 380 is any amino acid
  Variant (383)..(385): Xaa in position 383 to 385 is any amino acid
  Variant (387)..(388): Xaa in position 387 to 388 is any amino acid
  Variant (392)..(399): Xaa in position 392 to 399 is any amino acid
  Variant (402)..(403): Xaa in position 402 to 403 is any amino acid
  Variant (406)..(407): Xaa in position 406 to 407 is any amino acid
  Variant (410)..(417): Xaa in position 410 to 417 is any amino acid
FXXXXXXXRXXXXXXXXXXXXXXXXXXXXXXXXXWGXXYXXXXXXXXXXXLXVXXXXXXXXXXXXXXXXXXXXXXXLXXXXXXXXXXWXIXNXXXFXXXXXXXXXXXXXXXXXXXXXXXXXYWXXXXVXXXXXXXXXXXXXXXXXXXXXXSXXXXXXXYEXGRDXXXXXXXXXXXXXXXXXXXXXXXXXXXXXXXXXXXXXXXXXXXXXXXXXXXXXXXXXXXXXDXXPXXDXXLXXXXQXGXXYXXXXXXXXXXXXXXXHXXXXXXXXXXXXXXXYRXXXSXXXXFXXSLXXXXXXXXXQXDFXXXFGXXGFXXYWMXTXLXMXAXGXXNEXXXXXXXXXXPXXXXXWXXXXXIXNIXPXFXPXXLXXXFYRYGYXXPXHNXXXIXXVIFXXXXXXXXGRXXGIXXAWXXXXXXXXP

SEQ ID NO: 72400 - protein, 60 aa, Artificial sequence
  protein pattern
  Variant (3)..(4): Xaa in position 3 to 4 is any or no amino acid
  Variant (6)..(7): Xaa in position 6 to 7 is any or no amino acid
  Variant (10)..(10): Xaa in position 10 is any amino acid
  Variant (11)..(11): Xaa in position 11 is Ala, Gly or Ser
  Variant (14)..(14): Xaa in position 14 is Leu or Val
  Variant (15)..(15): Xaa in position 15 is Ile or Val
  Variant (18)..(18): Xaa in position 18 is Ile or Met
  Variant (19)..(19): Xaa in position 19 is any amino acid
  Variant (20)..(20): Xaa in position 20 is Ser or Thr
  Variant (21)..(21): Xaa in position 21 is Phe, Trp or Tyr
  Variant (22)..(23): Xaa in position 22 to 23 is any amino acid
  Variant (25)..(25): Xaa in position 25 is any amino acid
  Variant (26)..(26): Xaa in position 26 is Ala or Ser
  Variant (27)..(27): Xaa in position 27 is Ala, Ile or Val
  Variant (29)..(30): Xaa in position 29 to 30 is any amino acid
  Variant (33)..(34): Xaa in position 33 to 34 is any amino acid
  Variant (35)..(35): Xaa in position 35 is Ala, Ile, Leu or Val
  Variant (36)..(36): Xaa in position 36 is any amino acid
  Variant (37)..(37): Xaa in position 37 is Ile or Leu
  Variant (38)..(38): Xaa in position 38 is any amino acid
  Variant (39)..(39): Xaa in position 39 is Ile, Leu or Val
  Variant (40)..(42): Xaa in position 40 to 42 is any amino acid
  Variant (44)..(44): Xaa in position 44 is Pro, Gln or Ser
  Variant (45)..(45): Xaa in position 45 is any amino acid
  Variant (46)..(46): Xaa in position 46 is Ile, Leu, Met or Val
  Variant (47)..(47): Xaa in position 47 is Gly, Pro or Ser
  Variant (48)..(48): Xaa in position 48 is any amino acid
  Variant (50)..(51): Xaa in position 50 to 51 is Ile, Leu or Met
  Variant (52)..(52): Xaa in position 52 is any amino acid
  Variant (53)..(53): Xaa in position 53 is Phe or Trp
  Variant (54)..(54): Xaa in position 54 is any amino acid
  Variant (56)..(56): Xaa in position 56 is Ile or Leu
  Variant (58)..(58): Xaa in position 58 is Ile or Leu
  Variant (59)..(59): Xaa in position 59 is Ala, Ser or Thr
  Variant (60)..(60): Xaa in position 60 is Ala or Pro
DFXXTXXFGXXGFXXYWXXXXXXMXXXGXXNEXXXXXXXXXXPXXXXXWXXXXXIXNXXX

SEQ ID NO: 72401 - protein, 58 aa, Artificial sequence
  protein pattern
  Variant (2)..(2): Xaa in position 2 is Ile, Leu or Met
  Variant (3)..(3): Xaa in position 3 is Ala or Val
  Variant (4)..(4): Xaa in position 4 is Leu or Val
  Variant (5)..(5): Xaa in position 5 is any amino acid
  Variant (6)..(6): Xaa in position 6 is Asn, Pro or Ser
  Variant (7)..(7): Xaa in position 7 is any amino acid
  Variant (8)..(8): Xaa in position 8 is Phe or Val
  Variant (9)..(9): Xaa in position 9 is Phe or Tyr
  Variant (11)..(12): Xaa in position 11 to 12 is any or no amino acid
  Variant (14)..(15): Xaa in position 14 to 15 is any amino acid
  Variant (16)..(17): Xaa in position 16 to 17 is any or no amino acid
  Variant (19)..(19): Xaa in position 19 is Ile, Leu or Val
  Variant (22)..(22): Xaa in position 22 is Ala, Gly, Ser or Val
  Variant (23)..(23): Xaa in position 23 is any amino acid
  Variant (24)..(24): Xaa in position 24 is Asp, Glu or Gln
  Variant (25)..(25): Xaa in position 25 is Ala or Ile
  Variant (26)..(27): Xaa in position 26 to 27 is any amino acid
  Variant (28)..(28): Xaa in position 28 is Thr or Val
  Variant (29)..(29): Xaa in position 29 is Ile or Val
  Variant (30)..(31): Xaa in position 30 to 31 is Phe or Leu
  Variant (32)..(32): Xaa in position 32 is Asp, Asn or Arg
  Variant (33)..(34): Xaa in position 33 to 34 is any amino acid
  Variant (35)..(35): Xaa in position 35 is Lys or Arg
  Variant (36)..(37): Xaa in position 36 to 37 is any amino acid
  Variant (38)..(38): Xaa in position 38 is Ile, Leu or Met
  Variant (39)..(39): Xaa in position 39 is Gly or Ser
  Variant (41)..(41): Xaa in position 41 is Asn or Ser
  Variant (42)..(42): Xaa in position 42 is any amino acid
  Variant (45)..(45): Xaa in position 45 is Ile, Leu or Val
  Variant (46)..(46): Xaa in position 46 is any amino acid
  Variant (48)..(48): Xaa in position 48 is any amino acid
  Variant (49)..(49): Xaa in position 49 is Phe, Ile or Val
  Variant (50)..(50): Xaa in position 50 is Ala or Val
  Variant (51)..(51): Xaa in position 51 is Phe, Ile, Leu or Val
  Variant (52)..(54): Xaa in position 52 to 54 is any amino acid
  Variant (55)..(55): Xaa in position 55 is Ile, Leu or Met
  Variant (56)..(56): Xaa in position 56 is any amino acid
  Variant (58)..(58): Xaa in position 58 is Phe or Ile
PXXXXXXXXRXXYXXXXPXHNXXXXXXXXXXXXXXXXXXRXXGIXXAXXXXXXXXXPX

SEQ ID NO: 72402 - protein, 40 aa, Artificial sequence
  protein pattern
  Variant (2)..(6): Xaa in position 2 to 6 is any amino acid
  Variant (7)..(7): Xaa in position 7 is any or no amino acid
  Variant (9)..(11): Xaa in position 9 to 11 is any amino acid
  Variant (12)..(12): Xaa in position 12 is any or no amino acid
  Variant (14)..(14): Xaa in position 14 is Ile or Val
  Variant (16)..(16): Xaa in position 16 is any amino acid
  Variant (17)..(17): Xaa in position 17 is Ile, Leu or Val
  Variant (18)..(19): Xaa in position 18 to 19 is any amino acid
  Variant (20)..(20): Xaa in position 20 is Ile, Leu or Val
  Variant (21)..(21): Xaa in position 21 is Ile or Leu
  Variant (22)..(22): Xaa in position 22 is Ile, Leu or Val
  Variant (23)..(23): Xaa in position 23 is Ser or Thr
  Variant (24)..(24): Xaa in position 24 is Phe or Val
  Variant (25)..(25): Xaa in position 25 is any amino acid
  Variant (26)..(26): Xaa in position 26 is Gln or Ser
  Variant (27)..(27): Xaa in position 27 is Phe, Leu or Val
  Variant (28)..(28): Xaa in position 28 is any amino acid
  Variant (29)..(29): Xaa in position 29 is Phe, Leu, Met or Val
  Variant (30)..(32): Xaa in position 30 to 32 is any amino acid
  Variant (33)..(33): Xaa in position 33 is Ile, Leu, Met or Val
  Variant (35)..(36): Xaa in position 35 to 36 is any amino acid
  Variant (37)..(37): Xaa in position 37 is Leu, Met or Val
  Variant (38)..(38): Xaa in position 38 is Ala, Ser or Val
  Variant (39)..(39): Xaa in position 39 is any amino acid
  Variant (40)..(40): Xaa in position 40 is Leu, Met or Val
PXXXXXXLXXXXQXGXXXXXXXXXXXXXXXXXXHXXXXXX

SEQ ID NO: 72403 - protein, 18 aa, Artificial sequence
  protein pattern
  Variant (2)..(5): Xaa in position 2 to 5 is any or no amino acid
  Variant (7)..(7): Xaa in position 7 is any amino acid
  Variant (8)..(8): Xaa in position 8 is Ala or Ser
  Variant (9)..(9): Xaa in position 9 is Ile or Leu
  Variant (10)..(10): Xaa in position 10 is any amino acid
  Variant (11)..(11): Xaa in position 11 is Ile or Val
  Variant (12)..(12): Xaa in position 12 is any amino acid
  Variant (13)..(13): Xaa in position 13 is Pro, Gln or Thr
  Variant (14)..(14): Xaa in position 14 is Glu, Gly or Asn
  Variant (15)..(15): Xaa in position 15 is Ala or Ser
  Variant (16)..(16): Xaa in position 16 is Ser or Thr
  Variant (17)..(17): Xaa in position 17 is any amino acid
  Variant (18)..(18): Xaa in position 18 is Ala, Asn or Thr
YXXXXWXXXXXXXXXXXX

SEQ ID NO: 72404 - protein, 28 aa, Artificial sequence
  protein pattern
  Variant (2)..(2): Xaa in position 2 is any amino acid
  Variant (3)..(7): Xaa in position 3 to 7 is any or no amino acid
  Variant (10)..(10): Xaa in position 10 is Ala or Ser
  Variant (11)..(11): Xaa in position 11 is any amino acid
  Variant (13)..(14): Xaa in position 13 to 14 is any amino acid
  Variant (15)..(15): Xaa in position 15 is Asp, Glu, Asn or Ser
  Variant (16)..(17): Xaa in position 16 to 17 is any amino acid
  Variant (18)..(18): Xaa in position 18 is Phe, Ile or Leu
  Variant (19)..(20): Xaa in position 19 to 20 is any amino acid
  Variant (21)..(21): Xaa in position 21 is Leu or Val
  Variant (22)..(23): Xaa in position 22 to 23 is any amino acid
  Variant (24)..(24): Xaa in position 24 is Ile or Leu
  Variant (25)..(25): Xaa in position 25 is Ala, Ser or Val
  Variant (27)..(27): Xaa in position 27 is Ile or Leu
  Variant (28)..(28): Xaa in position 28 is Glu or Gln
LXXXXXXWGXXYXXXXXXXXXXXXXVXX

SEQ ID NO: 72405 - protein, 25 aa, Artificial sequence
  protein pattern
  Variant (2)..(3): Xaa in position 2 to 3 is any amino acid
  Variant (4)..(8): Xaa in position 4 to 8 is any or no amino acid
  Variant (10)..(10): Xaa in position 10 is Asp, Glu, His, Lys or Arg
  Variant (11)..(11): Xaa in position 11 is Ile or Leu
  Variant (12)..(12): Xaa in position 12 is any amino acid
  Variant (14)..(14): Xaa in position 14 is any amino acid
  Variant (15)..(15): Xaa in position 15 is Pro, Ser or Thr
  Variant (16)..(16): Xaa in position 16 is Glu, Ser or Thr
  Variant (18)..(21): Xaa in position 18 to 21 is any amino acid
  Variant (22)..(22): Xaa in position 22 is Asp, Gly, Asn or Ser
  Variant (23)..(24): Xaa in position 23 to 24 is any amino acid
  Variant (25)..(25): Xaa in position 25 is Gly, Asn or Thr
PXXXXXXXWXXXNXXXFXXXXXXXX

SEQ ID NO: 72406 - DNA, 1215 bp, Saccharomyces cerevisiae
  CDS (1)..(1215)
atgtctgaaaatcaacgtttaggattatcagaggaagaggtagaagcggctgaagtacttggggtgttgaaacaatcatgcagacagaagtcgcagccttcagaggacgtctcacaagctgacaaaatgccggcaagtgagtcgtctacgacgccgctaaacattttggatcgcgtaagtaacaaaattatcagtaacgtagtgacattctacgatgaaataaacaccaacaagaggccactgaaatcaatagggaggctgctagacgatgacgatgacgagcatgatgattacgactacaacgacgatgagttcttcaccaacaagagacagaagctgtcgcgggcgattgccaaggggaaggacaacttgaaagagtacaagctgaacatgtccatcgagtctaagaagaggcttgtaacgtgcttgcatcttttaaagctggccaataagcagctttccgataaaatctcgtgtttacaggaccttgttgaaaaggagcaggtgcatcctttgcacaagcaagatggaaatgctaggacgaccactggagctggcgaggacgagacatcgtcagacgaagacgacgacgatgaggagttttttgatgcctcagagcaggtcaacgccagcgagcagtctattgtggtgaaaatggaggtggtcggcacagtcaagaaagtctactcgctgatatcgaagttcacagcaaattcgctgccggagcccgcaagatctcaggttcgggaaagtcttctaaacttacccacaaattggttcgacagcgtccacagtacatcactgccgcatcatgcttcgtttcattatgccaactgtgaagaacaaaaagtggagcaacagcaacagcaacagcaacagcagcagcagcagcaacttttgcagcagcaactcctgcaacagcaacagcaaaaaaggaacaaggatggcgacgactcagcctcgccgtcctcctccgtaactgcgaatgggaaagtactcattctcgccaaagaatccctggaaatggtgagaaatgtcatgggcgtagtcgactccacgttgggcaaggctgaagaatgggtgaagcagaaacaggaggtaaaagaaatgatcagggagcgtttcttgcaacagcagcaacagtacaggcagcaacagcagaaggatggcaattacgtaaagccctctcaggacaacgtggatagcaaggactaa

SEQ ID NO: 72407 - protein, 404 aa, Saccharomyces cerevisiae
MSENQRLGLSEEEVEAAEVLGVLKQSCRQKSQPSEDVSQADKMPASESSTTPLNILDRVSNKIISNVVTFYDEINTNKRPLKSIGRLLDDDDDEHDDYDYNDDEFFTNKRQKLSRAIAKGKDNLKEYKLNMSIESKKRLVTCLHLLKLANKQLSDKISCLQDLVEKEQVHPLHKQDGNARTTTGAGEDETSSDEDDDDEEFFDASEQVNASEQSIVVKMEVVGTVKKVYSLISKFTANSLPEPARSQVRESLLNLPTNWFDSVHSTSLPHHASFHYANCEEQKVEQQQQQQQQQQQQQLLQQQLLQQQQQKRNKDGDDSASPSSSVTANGKVLILAKESLEMVRNVMGVVDSTLGKAEEWVKQKQEVKEMIRERFLQQQQQYRQQQQKDGNYVKPSQDNVDSKD

SEQ ID NO: 72408 - DNA, 1074 bp, Eremothecium gossypii
  CDS (1)..(1074)
atgaaccatacaaacacagagcctggcgaagaacatgagctgatagccatcgaggcgctcagccggctgtgcaatggtacgaatggcgagaccagattagagaaatcacatggtgcggagcaaggacaagctcagcaacaccaagacgacggagagacgctactgtgcagaatgcgacagaacccgatattcaccaacgctgtgagtctgtacgagcagaccaaatcacaccacccgaacttcaggcggcgagcggagttggtagagcggagcgcgtcgacgatggtgaggcgcaccagcgagctctgggccccgcgggatggggcgagcaagcaccgactggaggagagctgcgagacggggacgccgctggacgacgaggtgggcccgtcgccgcgcgtgtctaagcggcagaagatcaaggagaacctgaaggagtatcggctgacgatgtctatagagtcgaagaaacagctgattacctgcctgcacctgctgaagctcgcgaaccggcagctgtcgtcgacggtcgggtcgctgcaggacctggtgcagaaggagcgggaggacagcgggccgcgcgagcccgaggaggaggacggtgagcagtactttgacgcctcggagacgatcgtgagcgagcggtccaaggagatcaagatggaggttgtggggacggtgaagaaggtgtactcgctgatttcgaggtttgcaggaagctcgctgcccgagcccgcgcgaagccaggttcgggagaccctgctcaagatgccgacgaactggtccttgaccgtcaattccgcgtcgcgggagacgcccacgaacgcccgcctgtcggcgaacagcaagatgctcattctggcggaggagtctctggacatggtcagcaacatcatccaggttttcgacatgacgctcggacgggccgaggagtgggtgaagcacaagcaggagctcaaggagctgatcaagtcgcagtacatggaggcacagctcaagtccaaggtaaaacagcagctggagaaggagcagtccgagcaacagcgacacgagttgaagcgcagctctgtatag

SEQ ID NO: 72409 - protein, 357 aa, Eremothecium gossypii
MNHTNTEPGEEHELIAIEALSRLCNGTNGETRLEKSHGAEQGQAQQHQDDGETLLCRMRQNPIFTNAVSLYEQTKSHHPNFRRRAELVERSASTMVRRTSELWAPRDGASKHRLEESCETGTPLDDEVGPSPRVSKRQKIKENLKEYRLTMSIESKKQLITCLHLLKLANRQLSSTVGSLQDLVQKEREDSGPREPEEEDGEQYFDASETIVSERSKEIKMEVVGTVKKVYSLISRFAGSSLPEPARSQVRETLLKMPTNWSLTVNSASRETPTNARLSANSKMLILAEESLDMVSNIIQVFDMTLGRAEEWVKHKQELKELIKSQYMEAQLKSKVKQQLEKEQSEQQRHELKRSSV

SEQ ID NO: 72410 - DNA, 1464 bp, Candida glabrata CBS 138
  CDS (1)..(1464)
atggacacaaggcgtgggtggatacacaattatatctcattcagcgggctgtcggaggaggatgttgaagctgctgaggcgctggatgtcctgaggaactcgcatgtggacgcagatgttgaagtagaagaagaccgcagcaagaagcgtgtacgtgatggggaagatgaggatggtggacatgttaggaggcggaaagctagtgttcgggataggtcagactccaggatgagccaattaagtaatgtgagcaatgcgtctacggaagagcgagtagtacgagttaatagtcatgaggactctcagagtaaaagacaagaagaggaatcattgtttgataaagtttgcagaaactcgaatgagattttaacaaatatgggctctttcttcgaagagatgaacagcaacgtatttatggaaggtggaagtgatgtcccggaagaacaccctaatggctatgttagacctcgccgagattcacgttctatctcaacgacaggggcagatgctgatacagagagccaaggtacccaaggttcttacaatggcaaatgggacacttggagttcgagatcatataatgacagacaatactactcgaagcgtaaggcgctcagcgaagctctcgctaaggggagatacaacttaagagaatataaattgactatgtccattgagtcaaagaagcgtctgataacatgtttacatctactaaaattagcaaacaagcaactatcagacaaagttgcatacttacaagatgccgtagagaaggaacaagaattggccaatggagaagaagttaagaaagaaactagagctttgaatggtgagcatagcggtccccaaaacgacgacgatctcgagttttacgatgcatcagagtctgttgatcagaactctggcgatttgggacttgaaattgtgggtacagttaagaaagtgtactcgctaatatcgaaatatactggctcttctttgccagaacctgctaggtctcaagttagagaatcgttactaaatttgcctagcaattggaatacaagtgttcataatggcttcaaaaataatggtacaggaataatgacggcatcctcgtcgacagactctctaagctcatactctagtatattacccgtgtctagcaacggaaaatatctaatacttgccaaagagtctctaaacatggtgcagagtgttattgatgtagttgattcaacgttgggacgcgcagaagaatgggtaaagcaaaagcaagaactgaaagagatgataaagaagaaatttcttgaacaacaagaacatcagaaaatgcttggaattggtactgaatccttggatcaaaacgaatccagcgttaagaaggagcagccaaccacacatatttcaatcagtagtatcacaaacagtacaaacacattggacacggtgaaagaagaagatatgcatttacaaaaggtatga

SEQ ID NO: 72411 - protein, 487 aa, Candida glabrata CBS 138
MDTRRGWIHNYISFSGLSEEDVEAAEALDVLRNSHVDADVEVEEDRSKKRVRDGEDEDGGHVRRRKASVRDRSDSRMSQLSNVSNASTEERVVRVNSHEDSQSKRQEEESLFDKVCRNSNEILTNMGSFFEEMNSNVFMEGGSDVPEEHPNGYVRPRRDSRSISTTGADADTESQGTQGSYNGKWDTWSSRSYNDRQYYSKRKALSEALAKGRYNLREYKLTMSIESKKRLITCLHLLKLANKQLSDKVAYLQDAVEKEQELANGEEVKKETRALNGEHSGPQNDDDLEFYDASESVDQNSGDLGLEIVGTVKKVYSLISKYTGSSLPEPARSQVRESLLNLPSNWNTSVHNGFKNNGTGIMTASSSTDSLSSYSSILPVSSNGKYLILAKESLNMVQSVIDVVDSTLGRAEEWVKQKQELKEMIKKKFLEQQEHQKMLGIGTESLDQNESSVKKEQPTTHISISSITNSTNTLDTVKEEDMHLQKV

SEQ ID NO: 72412 - DNA, 26 bp, Artificial sequence
  primer
atgtctgaaaatcaacgtttaggatt

SEQ ID NO: 72413 - DNA, 24 bp, Artificial sequence
  primer
ttagtccttgctatccacgttgtc

SEQ ID NO: 72414 - protein, 474 aa, Artificial sequence
  consensus sequence
  Variant (2)..(10): Xaa in position 2 to 10 is any amino acid
  Variant (11)..(18): Xaa in position 11 to 18 is any or no amino acid
  Variant (20)..(23): Xaa in position 20 to 23 is any amino acid
  Variant (25)..(25): Xaa in position 25 is any amino acid
  Variant (27)..(27): Xaa in position 27 is any amino acid
  Variant (29)..(30): Xaa in position 29 to 30 is any amino acid
  Variant (32)..(60): Xaa in position 32 to 60 is any amino acid
  Variant (61)..(79): Xaa in position 61 to 79 is any or no amino acid
  Variant (81)..(85): Xaa in position 81 to 85 is any amino acid
  Variant (86)..(119): Xaa in position 86 to 119 is any or no amino acid
  Variant (121)..(121): Xaa in position 121 is any amino acid
  Variant (123)..(124): Xaa in position 123 to 124 is any amino acid
  Variant (126)..(137): Xaa in position 126 to 137 is any amino acid
  Variant (138)..(157): Xaa in position 138 to 157 is any or no amino acid
  Variant (159)..(201): Xaa in position 159 to 201 is any amino acid
  Variant (202)..(217): Xaa in position 202 to 217 is any or no amino acid
  Variant (220)..(220): Xaa in position 220 is any amino acid
  Variant (223)..(223): Xaa in position 223 is any amino acid
  Variant (225)..(225): Xaa in position 225 is any amino acid
  Variant (233)..(233): Xaa in position 233 is any amino acid
  Variant (235)..(235): Xaa in position 235 is any amino acid
  Variant (246)..(246): Xaa in position 246 is any amino acid
  Variant (250)..(254): Xaa in position 250 to 254 is any amino acid
  Variant (258)..(258): Xaa in position 258 is any amino acid
  Variant (260)..(260): Xaa in position 260 is any amino acid
  Variant (263)..(274): Xaa in position 263 to 274 is any amino acid
  Variant (275)..(291): Xaa in position 275 to 291 is any or no amino acid
  Variant (293)..(297): Xaa in position 293 to 297 is any amino acid
  Variant (302)..(306): Xaa in position 302 to 306 is any amino acid
  Variant (307)..(308): Xaa in position 307 to 308 is any or no amino acid
  Variant (310)..(314): Xaa in position 310 to 314 is any amino acid
  Variant (316)..(316): Xaa in position 316 is any amino acid
  Variant (329)..(333): Xaa in position 329 to 333 is any amino acid
  Variant (346)..(346): Xaa in position 346 is any amino acid
  Variant (349)..(350): Xaa in position 349 to 350 is any amino acid
  Variant (352)..(352): Xaa in position 352 is any amino acid
  Variant (355)..(357): Xaa in position 355 to 357 is any amino acid
  Variant (359)..(373): Xaa in position 359 to 373 is any amino acid
  Variant (374)..(423): Xaa in position 374 to 423 is any or no amino acid
  Variant (425)..(425): Xaa in position 425 is any amino acid
  Variant (427)..(427): Xaa in position 427 is any amino acid
  Variant (432)..(432): Xaa in position 432 is any amino acid
  Variant (436)..(436): Xaa in position 436 is any amino acid
  Variant (439)..(443): Xaa in position 439 to 443 is any amino acid
  Variant (445)..(445): Xaa in position 445 is any amino acid
  Variant (447)..(447): Xaa in position 447 is any amino acid
  Variant (451)..(451): Xaa in position 451 is any amino acid
  Variant (458)..(458): Xaa in position 458 is any amino acid
  Variant (462)..(462): Xaa in position 462 is any amino acid
  Variant (465)..(465): Xaa in position 465 is any amino acid
  Variant (467)..(473): Xaa in position 467 to 473 is any amino acid
MXXXXXXXXXXXXXXXXXEXXXXAXEXLXXLXXXXXXXXXXXXXXXXXXXXXXXXXXXXXXXXXXXXXXXXXXXXXXXXLXXXXXXXXXXXXXXXXXXXXXXXXXXXXXXXXXXXXXXXNXIXXNXXXXXXXXXXXXXXXXXXXXXXXXXXXXXXXXRXXXXXXXXXXXXXXXXXXXXXXXXXXXXXXXXXXXXXXXXXXXXXXXXXXXXXXXXXXXNLXEYXLXMSIESKKXLXTCLHLLKLANXQLSXXXXXLQDXVXKEXXXXXXXXXXXXXXXXXXXXXXXXXXXXXDXXXXXDASEXXXXXXXSXXXXXEXVGTVKKVYSLISXXXXXSLPEPARSQVREXLLXXPXNWXXXVXXXXXXXXXXXXXXXXXXXXXXXXXXXXXXXXXXXXXXXXXXXXXXXXXXXXXXXXXXXXXXXXXNXKXLILAXESLXMVXXXXXVXDXTLGXAEEWVKXKQEXKEXIXXXXXXXQ

SEQ ID NO: 72415 - protein, 43 aa, Artificial sequence
  protein pattern
  Variant (2)..(2): Xaa in position 2 is any or no amino acid
  Variant (14)..(14): Xaa in position 14 is Lys or Arg
  Variant (15)..(15): Xaa in position 15 is Phe or Tyr
  Variant (16)..(16): Xaa in position 16 is Ala or Thr
  Variant (17)..(17): Xaa in position 17 is Ala or Gly
  Variant (18)..(18): Xaa in position 18 is Asn or Ser
  Variant (31)..(31): Xaa in position 31 is Ser or Thr
  Variant (34)..(37): Xaa in position 34 to 37 is any or no amino acid
  Variant (40)..(41): Xaa in position 40 to 41 is any amino acid
  Variant (42)..(42): Xaa in position 42 is Ser or Thr
VXGTVKKVYSLISXXXXXSLPEPARSQVREXLLXXXXNWXXXV

SEQ ID NO: 72416 - protein, 49 aa, Artificial sequence
  protein pattern
  Variant (2)..(4): Xaa in position 2 to 4 is any amino acid
  Variant (7)..(7): Xaa in position 7 is Lys or Arg
  Variant (10)..(10): Xaa in position 10 is Lys or Arg
  Variant (12)..(12): Xaa in position 12 is Asn or Thr
  Variant (20)..(20): Xaa in position 20 is Gln or Arg
  Variant (22)..(22): Xaa in position 22 is Ile or Val
  Variant (33)..(33): Xaa in position 33 is Lys or Arg
  Variant (37)..(37): Xaa in position 37 is Asp or Ser
  Variant (38)..(38): Xaa in position 38 is any amino acid
  Variant (39)..(39): Xaa in position 39 is Ile or Val
  Variant (40)..(40): Xaa in position 40 is Ala, Gly or Ser
  Variant (41)..(41): Xaa in position 41 is any amino acid
  Variant (45)..(45): Xaa in position 45 is Ala or Leu
  Variant (47)..(48): Xaa in position 47 to 48 is any or no amino acid
KXXXNLXEYXLXMSIESKKXLXTCLHLLKLANXQLSXXXXXLQDXVXXE

SEQ ID NO: 72417 - protein, 47 aa, Artificial sequence
  protein pattern
  Variant (5)..(5): Xaa in position 5 is Glu or Lys
  Variant (9)..(9): Xaa in position 9 is Asp, Glu or Asn
  Variant (12)..(12): Xaa in position 12 is Gln, Arg or Ser
  Variant (13)..(13): Xaa in position 13 is Asn or Ser
  Variant (14)..(14): Xaa in position 14 is Ile or Val
  Variant (15)..(15): Xaa in position 15 is Ile or Met
  Variant (16)..(16): Xaa in position 16 is Asp, Gly or Gln
  Variant (18)..(18): Xaa in position 18 is Phe or Val
  Variant (20)..(20): Xaa in position 20 is any amino acid
  Variant (24)..(24): Xaa in position 24 is Lys or Arg
  Variant (31)..(32): Xaa in position 31 to 32 is any or no amino acid
  Variant (35)..(35): Xaa in position 35 is Leu or Val
  Variant (38)..(38): Xaa in position 38 is Leu or Met
  Variant (40)..(40): Xaa in position 40 is Lys or Arg
  Variant (41)..(42): Xaa in position 41 to 42 is any amino acid
  Variant (43)..(43): Xaa in position 43 is Phe or Tyr
  Variant (44)..(44): Xaa in position 44 is Leu or Met
  Variant (45)..(45): Xaa in position 45 is Glu or Gln
  Variant (46)..(46): Xaa in position 46 is Ala or Gln
LILAXESLXMVXXXXXVXDXTLGXAEEWVKXXQEXKEXIXXXXXXXQ

SEQ ID NO: 72418 - DNA, 2130 bp, Saccharomyces cerevisiae
  CDS (1)..(2130)
atgtttccctctctcttccgacttgtagtattctccaaacgttacatattccgatcaagccagcgcctttacactagtttaaaacaagaacagagccgtatgtccaaaataatggaagatttacgaagtgactacgtcccgcttatcgccagtattgatgtaggaacgacctcatccagatgcattctgttcaacagatggggccaggacgtttcaaaacaccaaattgaatattcaacttcagcatcgaagggcaagattggggtgtctggcctaaggagaccctctacagccccagctcgtgaaacaccaaacgccggtgacatcaaaaccagcggaaagcccatcttttctgcagaaggctatgccattcaagaaaccaaattcctaaaaatcgaggaattggacttggacttccataacgaacccacgttgaagttccccaaaccgggttgggttgagtgccatccgcagaaattactggtgaacgtcgtccaatgccttgcctcaagtttgctctctctgcagactatcaacagcgaacgtgtagcaaacggtctcccaccttacaaggtaatatgcatgggtatagcaaacatgagagaaaccacaattctgtggtcccgccgcacaggaaaaccaattgttaactacggtattgtttggaacgacaccagaacgatcaaaatcgttagagacaaatggcaaaacactagcgtcgataggcaactgcagcttagacagaagactggattgccattgctctccacgtatttctcctgttccaagctgcgctggttcctcgacaatgagcctctgtgtaccaaggcgtatgaggagaacgacctgatgttcggcactgtggacacatggctgatttaccaattaactaaacaaaaggcgttcgtttctgacgtaaccaacgcttccagaactggatttatgaacctctccactttaaagtacgacaacgagttgctggaattttggggtattgacaagaacctgattcacatgcccgaaattgtgtcctcatctcaatactacggtgactttggcattcctgattggataatggaaaagctacacgattcgccaaaaacagtactgcgagatctagtcaagagaaacctgcccatacagggctgtctgggcgaccaaagcgcatccatggtggggcaactcgcttacaaacccggtgctgcaaaatgtacttatggtaccggttgctttttactgtacaatacggggaccaaaaaattgatctcccaacatggcgcactgacgactctagcattttggttcccacatttgcaagagtacggtggccaaaaaccagaattgagcaagccacattttgcattagagggttccgtcgctgtggctggtgctgtggtccaatggctacgtgataatttacgattgatcgataaatcagaggatgtcggaccgattgcatctacggttcctgattctggtggcgtagttttcgtccccgcatttagtggcctattcgctccctattgggacccagatgccagagccaccataatggggatgtctcaattcactactgcctcccacatcgccagagctgccgtggaaggtgtttgctttcaagccagggctatcttgaaggcaatgagttctgacgcgtttggtgaaggttccaaagacagggactttttagaggaaatttccgacgtcacatatgaaaagtcgcccctgtcggttctggcagtggatggcgggatgtcgaggtctaatgaagtcatgcaaattcaagccgatatcttaggtccctgtgtcaaagtcagaaggtctccgacagcggaatgtaccgcattgggggcagccattgcagccaatatggctttcaaggatgtgaacgagcgcccattatggaaggacctacacgatgttaagaaatgggtcttttacaatggaatggagaaaaacgaacaaatatcaccagaggctcatccaaaccttaagatattcagaagtgaatccgacgatgctgaaaggagaaagcattggaagtattgggaagttgccgtggaaagatccaaaggttggctgaaggacatagaaggtgaacacgaacaggttctagaaaacttccaataa

SEQ ID NO: 72419 - protein, 709 aa, Saccharomyces cerevisiae
MFPSLFRLVVFSKRYIFRSSQRLYTSLKQEQSRMSKIMEDLRSDYVPLIASIDVGTTSSRCILFNRWGQDVSKHQIEYSTSASKGKIGVSGLRRPSTAPARETPNAGDIKTSGKPIFSAEGYAIQETKFLKIEELDLDFHNEPTLKFPKPGWVECHPQKLLVNVVQCLASSLLSLQTINSERVANGLPPYKVICMGIANMRETTILWSRRTGKPIVNYGIVWNDTRTIKIVRDKWQNTSVDRQLQLRQKTGLPLLSTYFSCSKLRWFLDNEPLCTKAYEENDLMFGTVDTWLIYQLTKQKAFVSDVTNASRTGFMNLSTLKYDNELLEFWGIDKNLIHMPEIVSSSQYYGDFGIPDWIMEKLHDSPKTVLRDLVKRNLPIQGCLGDQSASMVGQLAYKPGAAKCTYGTGCFLLYNTGTKKLISQHGALTTLAFWFPHLQEYGGQKPELSKPHFALEGSVAVAGAVVQWLRDNLRLIDKSEDVGPIASTVPDSGGVVFVPAFSGLFAPYWDPDARATIMGMSQFTTASHIARAAVEGVCFQARAILKAMSSDAFGEGSKDRDFLEEISDVTYEKSPLSVLAVDGGMSRSNEVMQIQADILGPCVKVRRSPTAECTALGAAIAANMAFKDVNERPLWKDLHDVKKWVFYNGMEKNEQISPEAHPNLKIFRSESDDAERRKHWKYWEVAVERSKGWLKDIEGEHEQVLENFQ

SEQ ID NO: 72420 - DNA, 1449 bp, Arabidopsis thaliana
  CDS (1)..(1449)
atggcaaaagaaaatggatttataggatcaatcgatcaaggaaccaccagcaccagattcatcatttacgaccacgatgctcgtcctgttgcttctcatcaagtcgagttcactcagttctatcccgaagctggatgggtggaacacgatccaatggagatactggaaagtgtgaaagtgtgcattgcaaaggctctcgacaaagccactgccgatggacacaacgtcgacggtggcttgaaggccattgggcttacagatcagagagagactactgttgtttggagcaaatccactggccttcctctccacaaggctattgtctggatggatgctcgtaccagctccatctgcaggagactagagaaagaactctcgggaggaagatcccattttgtggagtcttgcggcttgccaataagcacatacttctctgccatgaagctgctttggctcatggagaatgtggatgatgtcaaagacgctatcaagaaaggggatgccatctttggcactatcgacacatggttgatctggaacatgactggcggtatcaatggcggccttcatgtcactgatgtcaccaatgcttcacggacaatgctcatgaacctcaaaaccttgagctgggaccaggacactttgaagacacttggcataccggctgaaatcttgcccaagattgtcagcaattcagaagtgattggagagatctgcaaaggctggcctattcccggtatcaagattgctggatgtcttggtgatcagcatgctgcgatgttggggcaagcttgcagaaaaggcgaggcgaagagtacttatggcacaggtgctttcattcttctcaacaccggagaagtgccaatcaaatcaggtcatggtcttctgaccacgttggcctacaagctcggtcctcaagcacagacaaactatgcattggagggttcgattgccatagcaggagctgctgttcagtggcttagagacagccttgggataatcaaaagcgcctctgagatcgaagatttggcagcaatggtagattctacaggaggagtgtactttgtgccagcgttcaacggcttgtttgctccttggtggagagaagacgcacgtggtgtgtgcattggaatcacgaggttcaccaacaagtctcacattgctcgggctgtgctggagagcatgtgtttccaggtgaaagacgtccttgactccatgaacaaagatgcaggtgaaaagggttcccttaataacgggaaaggggagttcttgctcagagttgatgctgtgggattctggaaggaagcagacatattcgagtcgggagagaaggcgaagaactccaaagttttcagacccgctatggaagaaggaatcaggaagaagaaagtggcgtcttggtgcaaagcggtggaaagaacatttgatctcgctgacctctctatctaa

SEQ ID NO: 72421 - protein, 482 aa, Arabidopsis thaliana
MAKENGFIGSIDQGTTSTRFIIYDHDARPVASHQVEFTQFYPEAGWVEHDPMEILESVKVCIAKALDKATADGHNVDGGLKAIGLTDQRETTVVWSKSTGLPLHKAIVWMDARTSSICRRLEKELSGGRSHFVESCGLPISTYFSAMKLLWLMENVDDVKDAIKKGDAIFGTIDTWLIWNMTGGINGGLHVTDVTNASRTMLMNLKTLSWDQDTLKTLGIPAEILPKIVSNSEVIGEICKGWPIPGIKIAGCLGDQHAAMLGQACRKGEAKSTYGTGAFILLNTGEVPIKSGHGLLTTLAYKLGPQAQTNYALEGSIAIAGAAVQWLRDSLGIIKSASEIEDLAAMVDSTGGVYFVPAFNGLFAPWWREDARGVCIGITRFTNKSHIARAVLESMCFQVKDVLDSMNKDAGEKGSLNNGKGEFLLRVDAVGFWKEADIFESGEKAKNSKVFRPAMEEGIRKKKVASWCKAVERTFDLADLSI

SEQ ID NO: 72422 - DNA, 1569 bp, Arabidopsis thaliana
  CDS (1)..(1569)
atggcaaaagaaaatggatttataggatcaatcgatcaaggaaccaccagcaccagattcatcatttacgaccacgatgctcgtcctgttgcttctcatcaagtcgagttcactcagttctatcccgaagctggatgggtggaacacgatccaatggagatactggaaagtgtgaaagtgtgcattgcaaaggctctcgacaaagccactgccgatggacacaacgtcgacggtggcttgaaggccattgggcttacagatcagagagagactactgttgtttggagcaaatccactggccttcctctccacaaggctattgtctggatggatgctcgtaccagctccatctgcaggagactagagaaagaactctcgggaggaagatcccattttgtggagtcttgcggcttgccaataagcacatacttctctgccatgaagctgctttggctcatggagaatgtggatgatgtcaaagacgctatcaagaaaggggatgccatctttggcactatcgacacatggttgatctggaacatgactggcggtatcaatggcggccttcatgtcactgatgtcaccaatgcttcacggacaatgctcatgaacctcaaaaccttgagctgggaccaggacactttgaagacacttggcataccggctgaaatcttgcccaagattgtcagcaattcagaagtgattggagagatctgcaaaggctggcctattcccggtatcaagattgctggatgtcttggtgatcagcatgctgcgatgttggggcaagcttgcagaaaaggcgaggcgaagagtacttatggcacaggtgctttcattcttctcaacaccggagaagtgccaatcaaatcaggtcatggtcttctgaccacgttggcctacaagctcggtcctcaagcacagacaaactatgcattggagggttcgattgccatagcaggagctgctgttcagtggcttagagacagccttgggataatcaaaagcgcctctgagatcgaagatttggcagcaatggtagattctacaggaggagtgtactttgtgccagcgttcaacggcttgtttgctccttggtggagagaagacgcacgtggtgtgtgcattggaatcacgaggttcaccaacaagtctcacattgctcgggctgtgctggagagcatgtgtttccaggtgaaagacgtccttgactccatgaacaaagatgcaggtgaaaagggttcccttaataacgggaaaggggagttcttgctcagagttgatggtggtgccacagctaacaaccttctgatgcagattcaggctgatctgatgggaagtccggtggtgaggccagtggacatagagacaacagcattaggagcagcctatgcagctggattagctgtgggattctggaaggaagcagacatattcgagtcgggagagaaggcgaagaactccaaagttttcagacccgctatggaagaaggaatcaggaagaagaaagtggcgtcttggtgcaaagcggtggaaagaacatttgatctcgctgacctctctatctaa

SEQ ID NO: 72423 - protein, 522 aa, Arabidopsis thaliana
MAKENGFIGSIDQGTTSTRFIIYDHDARPVASHQVEFTQFYPEAGWVEHDPMEILESVKVCIAKALDKATADGHNVDGGLKAIGLTDQRETTVVWSKSTGLPLHKAIVWMDARTSSICRRLEKELSGGRSHFVESCGLPISTYFSAMKLLWLMENVDDVKDAIKKGDAIFGTIDTWLIWNMTGGINGGLHVTDVTNASRTMLMNLKTLSWDQDTLKTLGIPAEILPKIVSNSEVIGEICKGWPIPGIKIAGCLGDQHAAMLGQACRKGEAKSTYGTGAFILLNTGEVPIKSGHGLLTTLAYKLGPQAQTNYALEGSIAIAGAAVQWLRDSLGIIKSASEIEDLAAMVDSTGGVYFVPAFNGLFAPWWREDARGVCIGITRFTNKSHIARAVLESMCFQVKDVLDSMNKDAGEKGSLNNGKGEFLLRVDGGATANNLLMQIQADLMGSPVVRPVDIETTALGAAYAAGLAVGFWKEADIFESGEKAKNSKVFRPAMEEGIRKKKVASWCKAVERTFDLADLSI

SEQ ID NO: 72424 - DNA, 1524 bp, Photorhabdus luminescens subsp. laumondii TTO1
  CDS (1)..(1524): transl_table=11
atgacaacagaaaatatgattgagaaaaagtatattgtcgcccttgatcagggaaccaccagttcccgagcaataattcttgatcacgacgccaatattatctcaatttcccaaagagagtttacgcaaatttatcctaaaccgggttgggtagaacacgatccaatggaaatctgggcaacccaaagctcaacgctggtagaagtattggcgaaagcggatattagttctgatcagattgccggtattggtattaccaaccaacgtgaaacaacgattatttgggaaaaagagaccggtaaacctatctacaatgccatcgtttggcaatgtcgccgtaccgcggacgcgtgtactaaactaaaacaaaaagagggattggaagaatatattcgccagaatacagggctggtagtagacccttatttctccggcaccaaagtaaaatggatcttagataacgtcgcaggtgcccgtgaacgggctgaaaaaggtgagctcctattcggtactgtggatacttggctggtatggaaaatgactcaaggccgagtccacgttaccgatttcacaaacgcctcccgaacgatgctgttcaatattcacaatctggagtgggatcagcatattcttgatgaattacaaatccctcgttccctactgcctagcgttcattcatcttctgagatttatggtcagaccaacatcggcggtaaaggcggcactcggatccctatctcaggtatcgcaggtgatcaacaagctgctctatatggtcaactttgtgtccaaccgggtatggcgaaaaacacctacgggacaggctgtttcctgctgatgaacacgggtacagatgccgtacgctccaatcacggcctactgacaaccattgcctgtggtcctcgcggcgaagtgaactatgcgcttgaaggtgcggttttcgttggtggtgcctctattcagtggttgcgtgatgaactgaaacttattgcagatgcggctgactccgaatattttgccactaaagttaaaaatagtaacggcgtgtatgtggtccctgcttttaccggccttggtgccccctattgggacccctacgcccgagggtcaattttcggcctaacccgcggtaccaacagtaatcacatcattcgtgcgacgctggaatctatcgcctatcagacccgtgatgtactggatgctatgcaagctgatgcaggcacccggctgcaagcactacgggtagatggcggagccgttgccaataacttcctgatgcaattccaatcagatattcttggcacccgggtagaacgccctgtggtgcgtgaaagcacagcattgggcgcagcattcctcgcaggattggcagttggctactggaaagacctggatgaagtgaaaagtaaagccaccattgagaaagaattccgtccgggtattgaaaccaccgagcgtaattacaaatacaatggctggaaaaaagcagttgcccgtgcgcaggattgggaagataaaggctaa

SEQ ID NO: 72425 - protein, 507 aa, Photorhabdus luminescens subsp. laumondii TTO1
MTTENMIEKKYIVALDQGTTSSRAIILDHDANIISISQREFTQIYPKPGWVEHDPMEIWATQSSTLVEVLAKADISSDQIAGIGITNQRETTIIWEKETGKPIYNAIVWQCRRTADACTKLKQKEGLEEYIRQNTGLVVDPYFSGTKVKWILDNVAGARERAEKGELLFGTVDTWLVWKMTQGRVHVTDFTNASRTMLFNIHNLEWDQHILDELQIPRSLLPSVHSSSEIYGQTNIGGKGGTRIPISGIAGDQQAALYGQLCVQPGMAKNTYGTGCFLLMNTGTDAVRSNHGLLTTIACGPRGEVNYALEGAVFVGGASIQWLRDELKLIADAADSEYFATKVKNSNGVYVVPAFTGLGAPYWDPYARGSIFGLTRGTNSNHIIRATLESIAYQTRDVLDAMQADAGTRLQALRVDGGAVANNFLMQFQSDILGTRVERPVVRESTALGAAFLAGLAVGYWKDLDEVKSKATIEKEFRPGIETTERNYKYNGWKKAVARAQDWEDKG

SEQ ID NO: 72426 - DNA, 1935 bp, Eremothecium gossypii
  CDS (1)..(1935)
atgacgctgaacgtggtgccaaaaggggaaattccgctgattgcggccatcgacgtggggaccacgtcgacccgtgcgatattattcaacaagcagggacaggaggtgtccaagtaccagatcgagtactccacgacggcagccaaggacaaggaggcgtcgtcgccggggtctgcggggtctggtaagggcattattttctctgccgagggtattgccatcgaggcgaacgagtacgtggagatcgaggagctggagcaccaggacgccaccttgcgcttcccccaccccggctgggtggagtgcaagccgatgaacatcttggccaacgtcgtccagtgctttgccgctaccttgatctcgatcaacaaggtgaacgacgagcgtgtggaaaacaatctgcctccatacgtgatcaagtgcattggtgtcaccaacatgcgggagaccacgatcgtgtggtctaagaagaccggcttgccggtagtggactatggtattgtgtggaacgacacacgtaccatggatatcgtgaacacaaaaaaaagcgagaccccccctgaggagcaggagcggttgcgtgcgaagacgggtcttccgccatactccacgtacttctcgtgctccaagttgcgttggttcttggacaacgtccctgaagttctggaagcttacgaaagcggcgacttgatgttcggcaccgtcgacacctggttgatttaccatctcacaggcaaccatgcgtttgtctccgacgtcaccaatgcatccagaaccgggttcatgaacctggacactcttgactacgacgacgaactcctggagtactgggggattgacaggagcaagctcaacatgccaaagattgtcccgtctgcccagtactatggtgacttctgtgtccccgccgtgacaaagaagaagttgacagaggctgcctgggacgtgttgacgtccttcagccagtccggcattccaatccagggctgcttgggtgaccagagctcctctctagtgggccagatggcattcaaggccggctctgccaagtgtacgtacggtaccggctgcttcttggtgtacaacaccggcacaaagaaattgctttcccagcacggtgccttgaccacgttcggtttttggttcccggagttggagggctccgaagccagtaagccacatttcgtcttggaaggttccgtcgccgtcgccggctctgtggtgcagtggctaagagacaacttgagactatttccaagggcggaggacgtcgggccattggccagcagagttccggactgcggcggcgttgttttcgttccggccttcagcggcctattcgctccctactgggacgcagctgcccgtggcaccatattgggcatgtcgcagttcaccacggcctcgcacatcgcgcgtgccgcaatcgagggcgtgtgcttccaagccagagcgatcttgaaggccatgagctccgacgccttcggcgagggcgccaaggaccacgacttcttggaggagatcgtcgacacaggcacgtacgagcactcgcccttgtcggtcttggccgtcgacggcggcatgtccaagtcagacgaggtcatgcagatccaggccgacatcttgggtccctgtgtcaaggtcagacgctcgcccaccgcagagagcaccgcattgggcgccgcaatcgctgcgtgcatggcgtacaaggaccccaacgagcgtgtgtggaaggacctcaacgacgccaaaaaatggatcttctatggcgggttggaaaaagaggaggccctgcgcactccggacaacgtctcctcgaagttgaagatattcgccagccagtccgttgacaccgtccggagaaagaactggaagcgctgggaagcggccatcgaaagaaccaagggttggttacacgacgcagagggcaattaa

SEQ ID NO: 72427 - protein, 644 aa, Eremothecium gossypii
MTLNVVPKGEIPLIAAIDVGTTSTRAILFNKQGQEVSKYQIEYSTTAAKDKEASSPGSAGSGKGIIFSAEGIAIEANEYVEIEELEHQDATLRFPHPGWVECKPMNILANVVQCFAATLISINKVNDERVENNLPPYVIKCIGVTNMRETTIVWSKKTGLPVVDYGIVWNDTRTMDIVNTKKSETPPEEQERLRAKTGLPPYSTYFSCSKLRWFLDNVPEVLEAYESGDLMFGTVDTWLIYHLTGNHAFVSDVTNASRTGFMNLDTLDYDDELLEYWGIDRSKLNMPKIVPSAQYYGDFCVPAVTKKKLTEAAWDVLTSFSQSGIPIQGCLGDQSSSLVGQMAFKAGSAKCTYGTGCFLVYNTGTKKLLSQHGALTTFGFWFPELEGSEASKPHFVLEGSVAVAGSVVQWLRDNLRLFPRAEDVGPLASRVPDCGGVVFVPAFSGLFAPYWDAAARGTILGMSQFTTASHIARAAIEGVCFQARAILKAMSSDAFGEGAKDHDFLEEIVDTGTYEHSPLSVLAVDGGMSKSDEVMQIQADILGPCVKVRRSPTAESTALGAAIAACMAYKDPNERVWKDLNDAKKWIFYGGLEKEEALRTPDNVSSKLKIFASQSVDTVRRKNWKRWEAAIERTKGWLHDAEGN

SEQ ID NO: 72428 - DNA, 1734 bp, Magnaporthe grisea 70-15
  CDS (1)..(1734)
atggcagcatcagtctcaacctgtggcatcgccacgcccccttcaagaccctcaagagtacccagcactctgggctcaaaaccttcgcgtatgcatgatccagatatcatcatcaacgcactcaaggacgttgtcctaccggctgttgccttgtcggcacagcacgtggagaatgcccaagtcccatcccctgacccggagccagaagacatgtacatcggctcaatagaccagggtaccacgtcttcgcgcttcatcatcttcaaccgtgccggcgagcccgtcgaggcgcaccagattgagtttgagaaccgctatccaaactcgggctggcacgagcatgacccaatggagttgctctccagcgttgaggagtgcatagaagaggccatgatcaagttcaccgcgacgaggccaggtgccaaggttcactcggttggcatcacaaaccagagggaaacgacggtggtctgggatacggagacgggcgagccgctgtacaacgctgtagtgtggcccgacacccgcacctcgcccatcgttcatgaactgcggcaaaagccgggtgcagaggatctgctggacctgtgcggcttgcctctgtcaacctacccgtcctctgtcaagctcatgtggttattgcggaacgtagacaccgtcaaggctgcttatgacgccggccgactcgcctttggcacggttgactcgtggctcatctaccgtctgactggtaaatcggtgcacgtaactgatggttccaacgccagccgcaccatgtttatgaacctgcgcagcatgtcctatgacgaaaagctgctgtcgttcttcgagattgacgccaccaagatccgcctccctgagattgtgccctcggcacaccccactgcctttggaaaatttgcctcgggtcccctcaaggacgtcaggatagcaggctgcctgggcgaccagtccagcgccctggtgggccagcgcgccttcgcctcgggccaggccaagaacacttacggcacgggctgcttcctgctgtataacgtcggcccggagcccgtcatctcaaaggctggcctgctggccacggtagcctacgactttggcgaggagctgggcggccgcgcctacgccctcgagggcagcatcgccgttgccggcagtggcgttaagttcctgtccaacaacctgggcttcgcaccgagcagcggcgagattacggatctggccggcagcgtcgacgacaacggcggcgtggtctttgtgactgctttcagtggcctctttgcgccttactggatcgacgatgccaagggaacactctttggactcacgcagcacacacaaaagggccacatcgcgcgcgcaactctcgaggcgacgtgctaccagaccaaggcgatcctggacgccatggaacgtgacagcgggcgcaagcttgagcgcctggccgtcgacggcggcatgtccaactcggacctgtgcatgcagacccaggccgacgtcggcaacatccccgttgaccggcccgagatgcgcgagaccacggccctgggcgccgccatcgccgccggcttggccacgggcgtatggaagaacatctcagaggtcctcgaggtcggcggccgcaataggtcccagttcctaccgtctcccgatcgcgccaaggctcaaaggatgttcaagaagtgggagcaggccgtcgagatgagtagggggtggttgagggaaggtgaagaataa

SEQ ID NO: 72429 - protein, 577 aa, Magnaporthe grisea 70-15
MAASVSTCGIATPPSRPSRVPSTLGSKPSRMHDPDIIINALKDVVLPAVALSAQHVENAQVPSPDPEPEDMYIGSIDQGTTSSRFIIFNRAGEPVEAHQIEFENRYPNSGWHEHDPMELLSSVEECIEEAMIKFTATRPGAKVHSVGITNQRETTVVWDTETGEPLYNAVVWPDTRTSPIVHELRQKPGAEDLLDLCGLPLSTYPSSVKLMWLLRNVDTVKAAYDAGRLAFGTVDSWLIYRLTGKSVHVTDGSNASRTMFMNLRSMSYDEKLLSFFEIDATKIRLPEIVPSAHPTAFGKFASGPLKDVRIAGCLGDQSSALVGQRAFASGQAKNTYGTGCFLLYNVGPEPVISKAGLLATVAYDFGEELGGRAYALEGSIAVAGSGVKFLSNNLGFAPSSGEITDLAGSVDDNGGVVFVTAFSGLFAPYWIDDAKGTLFGLTQHTQKGHIARATLEATCYQTKAILDAMERDSGRKLERLAVDGGMSNSDLCMQTQADVGNIPVDRPEMRETTALGAAIAAGLATGVWKNISEVLEVGGRNRSQFLPSPDRAKAQRMFKKWEQAVEMSRGWLREGEE

SEQ ID NO: 72430 - DNA, 1551 bp, Gibberella zeae PH-1
  CDS (1)..(1551)
atgcctctcctcaacggaaaagcaaacactgcctttattggtgccattgatcagggcactacaagctcgcgcttcctgatctttgaccccagtggcgatgttgttgccacgcatcagattgagttcaagcagtactatcctcatcctggatggcacgagcatgatcctgaggagcttataagctctgttgaacagtgcattgacggtgccgttgaaacctttgagagccaaggtcactcgagagagcagatcaaggccgttggtatcacaaaccagcgagagacaactgtcgtctgggacaagactactggcaaggccctgcacaacgccattgtctggacagacacacgatcgaaagatctcgtgcgtcgtctcaagcgccgtcttggctccagcgagctgatcggacgatgtggaattcctctctccacatacccatccgtcagcaaactgctctggcttcttgacaacattcccgaagtcaaagatgcgtatgagcgcggtgttttggcgtttggaacggtcgacacatggttgacctacaagctcaacggcgcgactgatcgcgatgtctacgtttctgacccgtcaaatgcgtcacgaaccatgtttatgaatcttgagactctcaagtatgacgaggacattcttgactggttccgcatcgatgattccaagattacgctgccaagaattgtgcgctcttcagacaacaaggcctacggatcactggctggtacatctctcaagggagtcaagatcaccggatgtctgggcgaccagtctgcagctcttgtcggacagaaggcttttacccccggtctcgccaagaacacgtacggcacaggctgcttcttgctatacaatgtgggcacaaagccagtcatttcgtcgcacggcctgttgacaacggtcgcctttgactttggcgagggcaacaccatgtacgccctggaaggcagcatcgcggtggcgggctccagtgtcaagttcctcgtggacaactttggcttcatcgagtcgtcggccaagctcagcgctttggccgagacggtggaggacaatggtgggtgcacctttgttacggcctttagcggcctgtttgcgccgtactggattgacgatgcgcgaggcaccatctttggtatcacgtcgtacacgcagcgcgggcacattgcgagggcgacgctcgaggcgacgtgtttccaaacaaaggccattctcgactcgatggagaaggacagcggacatgccttgaccgagcttgctgtggacggtggcatgtgcaactcggatctcatcatgcagacccagtcagatctcattggaatcccggtcaacagacccggcatgcgtgagacgacagcactgggtgcggccattgcagcgggtttcgccgttggtatctggaagagctttgatgacttgaaggaggtcaacacccaaggccgtaccatcttcaagccgcagattgccgaggaggaggcgacgaagcggtttggacgttggaccaaggccgtcgagatgtccaagggctgggccaacgagtga

SEQ ID NO: 72431 - protein, 516 aa, Gibberella zeae PH-1
MPLLNGKANTAFIGAIDQGTTSSRFLIFDPSGDVVATHQIEFKQYYPHPGWHEHDPEELISSVEQCIDGAVETFESQGHSREQIKAVGITNQRETTVVWDKTTGKALHNAIVWTDTRSKDLVRRLKRRLGSSELIGRCGIPLSTYPSVSKLLWLLDNIPEVKDAYERGVLAFGTVDTWLTYKLNGATDRDVYVSDPSNASRTMFMNLETLKYDEDILDWFRIDDSKITLPRIVRSSDNKAYGSLAGTSLKGVKITGCLGDQSAALVGQKAFTPGLAKNTYGTGCFLLYNVGTKPVISSHGLLTTVAFDFGEGNTMYALEGSIAVAGSSVKFLVDNFGFIESSAKLSALAETVEDNGGCTFVTAFSGLFAPYWIDDARGTIFGITSYTQRGHIARATLEATCFQTKAILDSMEKDSGHALTELAVDGGMCNSDLIMQTQSDLIGIPVNRPGMRETTALGAAIAAGFAVGIWKSFDDLKEVNTQGRTIFKPQIAEEEATKRFGRWTKAVEMSKGWANE

SEQ ID NO: 72432 - DNA, 2019 bp, Candida glabrata CBS 138
  CDS (1)..(2019)
atgatttccgttaacgacggtaatatccagatggataaagacggtaacatccctctgatcgcttctattgacgtgggtactacatcttcccgtgtcattttcttcaacaaacagggtcaagaagtcgctaagcaccaaatcgaatactctacatctgcctctactcagaaatatgctgtacatggttcacgtagacagtccatcaaggaccaaaccaagatggctaacccagaaaaggacaaaccagtgttcacaagtgaaggtattgccatcaaggaaaacgagtacttgaccatcgaagaattccacggtgctaatgaaggaccaactttgaaattccctaaaccaggctgggtcgaatgtaacccaatgaatgtcttggttaacgttgttcagtgtctaggtactacttacgagctgctcgataacttgaacaacgaccgtgcccaaaacaacctgccgctatacagagtcgactgtgtcggtgtagctaatatgagagaaactactattgtttggtctaagaagaccggtatgccaattgtggattacggtattgtctggaatgacacccgtactctagacttggttaagagaaagaagaaagaaactgaaaaggagaagagattacgtatgaaggacaagaccggtttgtctgttttctctacatacttctcttgttcaaaacttgtatggcttttggagaacgaaccagaggtcaagaaggcttatgaagctggcgacttgatgttcggtactgttgatacttggctgatttaccatttgaccgctagcaacgcttttgtctctgatgtaactaatgcaagcagaactggtttcatgaacttggataccagagattatgacgatgaattagttgaattctggggtattgacagaaataagatcaacttcccaaagatcgtgtcatctgctgaatactacggtgacttgagcattccaaagttgtttaagtctcaagtcccaggacatatttgggaattgttattgaaatacaccgaaggtgaatttcaagtaccaattcaaggctgtctaggtgaccaaagtgcctcattggtaggccagatggcttttaaacctggtgccgccaaatgtacctatggtacgggttgtttcttactatacaacactggctgcaagaaattgatttctaagcatggtgctttgacaactttctcttactggttcccatacttggaagaaaaggaaaacccagagtatggtgccccacactttgccttggaaggttccgtcgctgtcgctggtgccgttgtgcaatggttacgtgacaacttgcgtttaattccaaaggctgaagatgttggaccaattgccaattctgttccagactctggtggtgttgtttttgttccagcattcagtggtctattcgcaccatactgggatccagaggctagaggtaccatcatgggtatgtctcaatacacaaccgcttctcacattgctagagcagctgttgaagctgtttgtttccaagcccgtgccattctattggctatgagtaacgatgccatgggtgaagccgagaaggatagtacttttaagactgagatcagcgaagagggttcatatcaaaagtctttactatctacattggctgttgatggtggtatgtcccgttcagatgaagtcatgcaaatccaagctgacatcttgggtccatgtgtcaaagttagaagatctccaactgctgagtgtactgctttaggtgctgcagttgccgctaacatggcctacgaaagaccacaagaccgtgtcctatggagagatcttcaagacgctaagaactggattttctatgaaggtatgactaaatccgaatatcaagctaaggagactaagcaaaacttgaagattttcagaagccaatctactgatgaagacagacacaagcactggattcaatgggaagctgctgttaagagaagcaaaggctggctaaaggatgttgaaggtgaacatcctgtagtagcatga

SEQ ID NO: 72433 - protein, 672 aa, Candida glabrata CBS 138
MISVNDGNIQMDKDGNIPLIASIDVGTTSSRVIFFNKQGQEVAKHQIEYSTSASTQKYAVHGSRRQSIKDQTKMANPEKDKPVFTSEGIAIKENEYLTIEEFHGANEGPTLKFPKPGWVECNPMNVLVNVVQCLGTTYELLDNLNNDRAQNNLPLYRVDCVGVANMRETTIVWSKKTGMPIVDYGIVWNDTRTLDLVKRKKKETEKEKRLRMKDKTGLSVFSTYFSCSKLVWLLENEPEVKKAYEAGDLMFGTVDTWLIYHLTASNAFVSDVTNASRTGFMNLDTRDYDDELVEFWGIDRNKINFPKIVSSAEYYGDLSIPKLFKSQVPGHIWELLLKYTEGEFQVPIQGCLGDQSASLVGQMAFKPGAAKCTYGTGCFLLYNTGCKKLISKHGALTTFSYWFPYLEEKENPEYGAPHFALEGSVAVAGAVVQWLRDNLRLIPKAEDVGPIANSVPDSGGVVFVPAFSGLFAPYWDPEARGTIMGMSQYTTASHIARAAVEAVCFQARAILLAMSNDAMGEAEKDSTFKTEISEEGSYQKSLLSTLAVDGGMSRSDEVMQIQADILGPCVKVRRSPTAECTALGAAVAANMAYERPQDRVLWRDLQDAKNWIFYEGMTKSEYQAKETKQNLKIFRSQSTDEDRHKHWIQWEAAVKRSKGWLKDVEGEHPVVA

SEQ ID NO: 72434 - DNA, 1986 bp, Kluyveromyces lactis NRRL Y-1140
  CDS (1)..(1986)
atgactgagaaagagttagttattaagtccgatacagaaaaagaggtggttccgttagttgctgctattgatgtcggtaccacatcttcacgtgtgattcttttcaacagattgggacaagaaatttccaagcatcagatcgagtacagtactagtgcttctcattccgcatattctgcaagcggtgaacgaagattggaagagaataagaccaatggttccagtaacgaacaaaccatcttcagcgcggaaggtattgctattgaggccacggagtatcttgagatcgaggatctagaaaaagatgtagaacctacgttaaggttcccaaaaccgggatgggtcgaatgtaaaccaatgaacattttggaaaacgtggttcaatgtttcgcagcaaacttgattacaatggatcgcgtaaacggcgatagagtctctaatggtctaccgccttatcgcatcaagtgcataggtattgctaacatgagagaaacaactttagtatggtcaaagaagaccgggaaacctttaatcgattacggtattgtatggaacgatgttagaaccacagagatagttcaaaagaaaaaagatgagacaccagaagagtaccaagaacatttaagggaattaactggattaccattgttctctacatatttctcctgttccaaacttcgctggttattagataatatccctgaagttaccaaagcttacgaagaaaatgatttggtcttcggcactgtcgacacctggttgattgccaatttgacccacaacaatgttttagttaccgatgtcactaatgcttgcaggacagggttcatgaatttaaatactaaggattacgacgatgaattgctcgattattggaacatcgacaaggcaaagattcatttgccaaagattgtttcaagttctgagtactacggtaattttgtagttccagaatgtaccaagaaatctttgacgtccacagcatgggatcttctatcagcattttcgcaaagagttcctccagtgccaatacaaggttgtcttggtgaccaaagcgcatctttggtgggtcagcttgcattcaaaccaggctctgccaaatgtacttacggtacaggttgtttccttttgtataacacaggaactactaaattgatatcaaagcacggtgcgctaacaacatttgcatactggttcccacagttagaaaatgaagaaaacgattatggtaaaccacattatgccttagaaggttcagttgctgttgctggtgccgtagttcagtggctaagagacaacttaagattgattccaagagctgaagatgttggacctctagcatcagctgtaccaaattccggtggtgttgtgtttgtaccggctttcagtggtttatttgcgccatactgggatcctgatgctcgtgcaactattatgggaatgtcacaatacacaacagcttctcacatcgctcgagctgctgtcgagggtgtctgcttccaagcgagggctattttaaaagccatgagttctgatgctttcggctcagaagataaggactttttagaagaagttgttgatgaaacttacgagaaaactttactttcgactttagctgttgacggtggtatgtctagatcagatgaagtgatgcaaattcaagctgatatcctaggcccctgtgtcaaggtaagaagatctccaacttcagaatgtactgctttaggtgctgcaattgccgctgctatggctttcaaaacagatgaagaacgtattttatggaagaatctaaaggacgtcaaaaaatgggtattctatggaggggtagagaaaggcgagaaagctcccccaagtaccaccaatgacacggatctgaaggtctttataagcaagtcttcggacaaaagtagaagaaaaggttggaagatgtgggagactgcaattgagaaatctaaaggatggatgaatgaaattcaattgtcataa

SEQ ID NO: 72435 - protein, 661 aa, Kluyveromyces lactis NRRL Y-1140
MTEKELVIKSDTEKEVVPLVAAIDVGTTSSRVILFNRLGQEISKHQIEYSTSASHSAYSASGERRLEENKTNGSSNEQTIFSAEGIAIEATEYLEIEDLEKDVEPTLRFPKPGWVECKPMNILENVVQCFAANLITMDRVNGDRVSNGLPPYRIKCIGIANMRETTLVWSKKTGKPLIDYGIVWNDVRTTEIVQKKKDETPEEYQEHLRELTGLPLFSTYFSCSKLRWLLDNIPEVTKAYEENDLVFGTVDTWLIANLTHNNVLVTDVTNACRTGFMNLNTKDYDDELLDYWNIDKAKIHLPKIVSSSEYYGNFVVPECTKKSLTSTAWDLLSAFSQRVPPVPIQGCLGDQSASLVGQLAFKPGSAKCTYGTGCFLLYNTGTTKLISKHGALTTFAYWFPQLENEENDYGKPHYALEGSVAVAGAVVQWLRDNLRLIPRAEDVGPLASAVPNSGGVVFVPAFSGLFAPYWDPDARATIMGMSQYTTASHIARAAVEGVCFQARAILKAMSSDAFGSEDKDFLEEVVDETYEKTLLSTLAVDGGMSRSDEVMQIQADILGPCVKVRRSPTSECTALGAAIAAAMAFKTDEERILWKNLKDVKKWVFYGGVEKGEKAPPSTTNDTDLKVFISKSSDKSRRKGWKMWETAIEKSKGWMNEIQLS

SEQ ID NO: 72436 - DNA, 1893 bp, Debaryomyces hansenii CBS767
  CDS (1)..(1893)
atgccacgtcgtcaaagtaatgctccatcgcagccagttgttgctacgattgatattggtacaacttcagcaagagctattttgtttaatcaaggaggtgttgaagtagccaaacatcaaatcgaatactccaccacggcatcggaagctccagcggagtcggagaataaggaacagtttagaagaagatcgtcgcttatgagacacaatgcgcctattttcactgctgaaggtattgccatttctataacagacgatgtcgaaatcgaaaataattctgcaagtgttggtcctacgttgagatttccacagcccggatgggttgagtgtatgccagttcatattttggcgaatgctgttcagtgtttgatagcttgtttgattacgttgagaaaaatcaatcagaatccggagttgaaaatcaagtataaggtcaaggctattggtattgctaacatgagagaaacaacgattgtgtggtctcgtaaaaccggtaagcctttgagtaatggtatcacatggactgatacaagaactgcagaaattgtgcagcacttggaaaggacaattgacgatgaaagaaaagaagaattaaagcaaaagaccgggttgccattatccacctatttttctgccgccaaattgcgttggttaatagataatgacgataccataaaggaggaatacgagaagggtgatggtaacttaatgtttggtacggttgatacgtggttgatttatcacttaaccaaggaaagatcctttgtatccgacgttaccaatgcatctagaacttattttatggacttagaaacaagagattatgacgatgatttattagatttttggggtattgatcctacgagggtagcgttaccaaagattgtatctagttcggaattctacggatcatttgcggctccaaatttatctaacttaggtttccacaataagatcactccagaagcatacgaaatattgaaaactattaccggcattcccatttgtgggtgtcttggtgaccagtcagcttcattagttggccaattagcatttaagcctggttctgctaaatgtacttatggtactggttgtttcttgttgtataataccggtaatcgtaagttaatctctgaacatggcacagtaacaacgataggcttttggttccctaacttaaaggacgaggacgccaatccacattatgcattagaaggttcaattgctgttgcaggttcaattattcaatggttaagagataatttgaagttgatagaacacgcgagagatgttggacctttggcctcccaagttgataatgcaggtggagttgtatttatcccagctttctcaggtttatatgctccatactgggatggtggcgctagaggtacaatttttggtatgacacaatatacctcttcatctcatatagcaagagctgcattagaaggtgtctgttatcaagttagggctatcttgagagccatggctaatgatgcgggcgcaagtgaagattttttggaagaagcgttaaataggcaaaatgagaaaaagccattatctgcattatctgttgatggtggtatgtcaaaggctgatgaggtgttgcaaattcaagcggacattttaggaccatgtgtaactgtcaaaagggcaaatatatctgaatgtacagcattgggtgcagcgattgcagccggcttatcattcaaagatgaagaagaaagagtttggaaagatttcgatgatatttatgaaaagattaatggaacggatgatgagaagaataatttcaaagcgaaattgcctgattccgatagaagaaagtattggaagaggtgggagaaagcaatcgatagagctaaaggttggttagatgaagataattag

SEQ ID NO: 72437 - protein, 630 aa, Debaryomyces hansenii CBS767
MPRRQSNAPSQPVVATIDIGTTSARAILFNQGGVEVAKHQIEYSTTASEAPAESENKEQFRRRSSLMRHNAPIFTAEGIAISITDDVEIENNSASVGPTLRFPQPGWVECMPVHILANAVQCLIACLITLRKINQNPELKIKYKVKAIGIANMRETTIVWSRKTGKPLSNGITWTDTRTAEIVQHLERTIDDERKEELKQKTGLPLSTYFSAAKLRWLIDNDDTIKEEYEKGDGNLMFGTVDTWLIYHLTKERSFVSDVTNASRTYFMDLETRDYDDDLLDFWGIDPTRVALPKIVSSSEFYGSFAAPNLSNLGFHNKITPEAYEILKTITGIPICGCLGDQSASLVGQLAFKPGSAKCTYGTGCFLLYNTGNRKLISEHGTVTTIGFWFPNLKDEDANPHYALEGSIAVAGSIIQWLRDNLKLIEHARDVGPLASQVDNAGGVVFIPAFSGLYAPYWDGGARGTIFGMTQYTSSSHIARAALEGVCYQVRAILRAMANDAGASEDFLEEALNRQNEKKPLSALSVDGGMSKADEVLQIQADILGPCVTVKRANISECTALGAAIAAGLSFKDEEERVWKDFDDIYEKINGTDDEKNNFKAKLPDSDRRKYWKRWEKAIDRAKGWLDEDN

SEQ ID NO: 72438 - DNA, 1512 bp, Yarrowia lipolytica CLIB122
  CDS (1)..(1512)
atgtcttcctacgtaggagctctcgaccagggtaccacctccacccgtttcattctcttttcgcctgacggcaagcccgtggcatcccaccagatcgaattcacccagatctacccccaccccggatgggtggagcacgaccccgaggagctcgtgagctcgtgtctggagtgcatgtcgtcggtggccaaggaaatgcgaacccagggcatcaaggtggccgacgtgaaggcgatcggaatcaccaaccagcgagaaaccaccgtgctttgggacattgagaccggccagcccctgtacaacgccattgtgtggtccgacgcccgaaccggcgacaccgtcaagaagctcgaggcccagcccggcgctgacgaaatccccaagctctgtggcctgcccctgtccacctactttgccggagtcaaggtccgatggatcctggataacgtcaaggaggcccgagagtgctacgatcgaggcaagctggccttctccaccatcgactcgtggctgctctacaacctcacgggcggcctcaacggcggcgcccacatcaccgacacctccaacgcctcccggtccatgttcatgaacattgagaccctcaagtacgacgagaagctcatcaagttctttggcgtcgagaagctcattctccccaagattgtctcgtccgccgaggtctacggccgaatcggaaccggccccttcgccaacatccccctggccggctgtctcggtgaccagtccgccgccctcgtcggccagaaggcctttgagcccggccaggccaagaacacatatggaaccggctgcttcctgctctacaacgccggcgagaagcccatcatctccaacaacggcctgctgaccaccgtcggctaccacttcaagggccagaagcccgtctacgctctggagggctccatctccgtcgccggctcgtgcatcaagtggctgcgagacaacattggtctcattgagtcttccgagcagattggagagcttgcctcccaggtcgacgactctgccggcgtggtgtttgtcaccgctctgtccggcctgtttgccccctactggcgaaccgacgcccgaggcaccattctgggtctcactcagttcaccaccaaggcccacatttgccgagccgccctggaggctacttgtttccagacccgggccattctcgacgccatggccaaggactctggtaagcccttcaccaagctgcgagtcgacggaggaatgaccaactcggacattgctatgcagatccaggccgacattcttggcattgaggtcgagcgacccgccatgcgagagaccaccgctctgggtgccgccattgctgccggctttgccgttggcgtgtggaagtccattgaggatcttaaggacatcaacaccgagggcatgaccgagtttgcttccaagaccaacgaggaggagcgggccgccatgatgaagcagtggaaccggggcattgagcgagctgttggctggcttgagtaa

SEQ ID NO: 72439 - protein, 503 aa, Yarrowia lipolytica CLIB122
MSSYVGALDQGTTSTRFILFSPDGKPVASHQIEFTQIYPHPGWVEHDPEELVSSCLECMSSVAKEMRTQGIKVADVKAIGITNQRETTVLWDIETGQPLYNAIVWSDARTGDTVKKLEAQPGADEIPKLCGLPLSTYFAGVKVRWILDNVKEARECYDRGKLAFSTIDSWLLYNLTGGLNGGAHITDTSNASRSMFMNIETLKYDEKLIKFFGVEKLILPKIVSSAEVYGRIGTGPFANIPLAGCLGDQSAALVGQKAFEPGQAKNTYGTGCFLLYNAGEKPIISNNGLLTTVGYHFKGQKPVYALEGSISVAGSCIKWLRDNIGLIESSEQIGELASQVDDSAGVVFVTALSGLFAPYWRTDARGTILGLTQFTTKAHICRAALEATCFQTRAILDAMAKDSGKPFTKLRVDGGMTNSDIAMQIQADILGIEVERPAMRETTALGAAIAAGFAVGVWKSIEDLKDINTEGMTEFASKTNEEERAAMMKQWNRGIERAVGWLE

SEQ ID NO: 72440 - DNA, 1827 bp, Aspergillus nidulans FGSC A4
  CDS (1)..(1827)
atggacccagcaaagatttttgttggttctatcgatcagggaaccaccagcacccgatttctaatctttaatcgcgagggagatcctgtcgcatcacatcaagtcgaattcaagcagatatatcctaacccgggatggcacgagcacgatccgctagagcttgtatcttctgtggaaacctgcatcgaagaagctgttaaacaattcgaaatcaacgggtacgaccaacaatctattaaggcggtgggaattaccaatcagcgagagactacagttgtttgggaccatgaaaccggggagccactttataatgcgattgtctggaccgacacccgctcgcaagctgttgttgatgagcttaaaaagaaacccggagcatcgcaacttcaacagatctgcggtctgccgctctcaacctattcctcttcctctaagctcctctggatgcttacaaatgttcccaaggtcaaagaggcatacgaaaaaggcaccttggccttcggaactgttgatgcctggttggtttaccgactgaacggcggaagcgctgccaatgttttcgtctctgattgtacgaacgcctcacgtacaatgttcatgaacctagagacactgggatacgacgacttcttgctggatttctttggcattaagggccgagtacacctgcccaaaattgttccttcttcagatgtcacagcctacggtgcactctccaacggcaggcttgcgggggttcctatcatgggatgcttgggagatcagtcctcagcccttgtagggcaaaaagggttctcccccggcatggccaagaatacatatggcacaggatgcttcctgctgtacaacgtcggggacaaaccagttatctccaagcacggccttctggcgactatagcgtataatttcgatggacgaccagtatatgcgctcgaaggaagcatagcggttggtggatctggaatcaaattccttcagaataatttagagttcttcagggagtctaaggaagttaacgacttggctttaactgtggaagacaacggcgggtgtgttttcgttaccgcgtttagcggactttacgctccgtattggatcgatgatgcaaagggaactatatttgggatcacccaatatacccagaagggccacattgcccgagcaacactggaagcgacctgcttccaaaccaaggcaattctgaatgccatggagaaagacagcggacacgccctattcgagctcgctgttgatggaggaatgagcaactcggatctcgctatgcagatccaagccgacctcatctccatccccgtttaccgccccaagatgcgcgaaacaaccgccctcggcgccgccattgccgcaggcctagctgtcggtctctggcgcaacttcgccgagctccgcgacatcaaccgtgccgggggtacagtcttccgcccgcagacgagtcaggacataagccgcgagcaattttccctctgggaaaaggcagtgagcatgtgtagagggtgggttggcgataaatcgcacgcaacggagcacagagacactgaggggaagcctactcagaaggtggatctgagtaacggtcataagggggttgttgacgcggcttctgccactgcccctagcaacattgtgtcaccattgttgtcggcgaaaatgaatggggatttggtgctatcaaagggcacgccgtggattaatatctcgggggatttggaggatgctgatgatcaggacttgtttctggagttgaggaagttagagattttacagaggctgaagaggttgggtaaggttaaggttacctacttttga

SEQ ID NO: 72441 - protein, 608 aa, Aspergillus nidulans FGSC A4
MDPAKIFVGSIDQGTTSTRFLIFNREGDPVASHQVEFKQIYPNPGWHEHDPLELVSSVETCIEEAVKQFEINGYDQQSIKAVGITNQRETTVVWDHETGEPLYNAIVWTDTRSQAVVDELKKKPGASQLQQICGLPLSTYSSSSKLLWMLTNVPKVKEAYEKGTLAFGTVDAWLVYRLNGGSAANVFVSDCTNASRTMFMNLETLGYDDFLLDFFGIKGRVHLPKIVPSSDVTAYGALSNGRLAGVPIMGCLGDQSSALVGQKGFSPGMAKNTYGTGCFLLYNVGDKPVISKHGLLATIAYNFDGRPVYALEGSIAVGGSGIKFLQNNLEFFRESKEVNDLALTVEDNGGCVFVTAFSGLYAPYWIDDAKGTIFGITQYTQKGHIARATLEATCFQTKAILNAMEKDSGHALFELAVDGGMSNSDLAMQIQADLISIPVYRPKMRETTALGAAIAAGLAVGLWRNFAELRDINRAGGTVFRPQTSQDISREQFSLWEKAVSMCRGWVGDKSHATEHRDTEGKPTQKVDLSNGHKGVVDAASATAPSNIVSPLLSAKMNGDLVLSKGTPWINISGDLEDADDQDLFLELRKLEILQRLKRLGKVKVTYF

SEQ ID NO: 72442 - DNA, 1704 bp, Aspergillus nidulans FGSC A4
  CDS (1)..(1704)
atgcgcaagaacccttttgacatgtctgagctcgacgccgaaatcgaggccaacgaagagcagcaacaccaagtccgcatccatgcccgccaatcaattgacggcgaacggtcgttgttgcaggatgaggagcgtcggcaagacgacttgaaggatcgtttcattggtgccattgaccagggtactacgagtacgcggttcattattttcgactgcgtgggcaaccccgttgccaaataccaggcggaataccgccaactccacgagcattcaggatggcacgaacaagatccgtatgagatggtagattccgtctacacgtgtattgaagaggccatgaaaacattcctcgcccttggtcattctaagtcagatattgaagcaatcggtctcactagccaacgtgagacagtcctctgctgggattgggaaactggtgaacctctatgtccctcgattgcttggcccgatacccgaacaaaagcccttgttcgagaattgaaagcacaaaaaggcgccgatgaactgaagaacatttgcggtctgccactatccacatatccttcgtctgtctcattggtctggctactccgcaacaacgaggccgtgaaacaggcgtacgaggaaggacgacttgcttttggcactgtcgattcatggctcatctacaacctgaacggtggtctagagggtcgccaccacgtaacggatgtgaccaatgcctctagaaccatgttgatgaacctcgagacgctcgattatgataaacgacttctggacttctttgggttagaccccaagaagatccggctgcccaagattcttccatcctctgaccctgaggggttcggatatgtacggtcaggccccttagaaggagttccgatcactagcgaccttggagatcagtctgcggcgcttgttggccactgtgcgtttactccgggcatggcgaagaatacctatggtactggatgcttcctcctgtacaacgttggcgagaaaccggttatttcgaagcatggcctgctcggtactgtcggatttcaattaggaaagaaccggaagcccgtgtatgcacttgaaggaagtgtggccgtcgctggtagtggtgtttcattcctcatgaacaatatgggctttttccgagactcacgtaaagtgagtgacttggcggcaatggttccagacaacggagggtgtgtcttcgtcacagccttcagtggtctctttgcgccatactggattgatgacgccaagggaacaatttttggaatcacgcaacatacccaacgtggtcacatcgcacgtgcgactatggaggccgcctgcttccaaaccaaagcgattctcgatgccatggagatggacagtgggcactccctctctcagctcgccgtcgacggaggaatgagcaactcggatatctgcatgcagacccaagcagacatcattcaaattcccgtcgaacgaccggccatgcatgagacgacagcgctgggcgcagcaatcgccgccggcttcgccatcgatatctggaaggaatttgatgaacttaaaaacatgaaccgcgccaaccgaacctcattcacccccgcaatctcccgcgaacaaagccagaagatgtataaacagtggacgaaagccgtcgaaatgtctcgcggttgggtggataccaaggagatgggaggtgaggacgactag

SEQ ID NO: 72443 - protein, 567 aa, Aspergillus nidulans FGSC A4
MRKNPFDMSELDAEIEANEEQQHQVRIHARQSIDGERSLLQDEERRQDDLKDRFIGAIDQGTTSTRFIIFDCVGNPVAKYQAEYRQLHEHSGWHEQDPYEMVDSVYTCIEEAMKTFLALGHSKSDIEAIGLTSQRETVLCWDWETGEPLCPSIAWPDTRTKALVRELKAQKGADELKNICGLPLSTYPSSVSLVWLLRNNEAVKQAYEEGRLAFGTVDSWLIYNLNGGLEGRHHVTDVTNASRTMLMNLETLDYDKRLLDFFGLDPKKIRLPKILPSSDPEGFGYVRSGPLEGVPITSDLGDQSAALVGHCAFTPGMAKNTYGTGCFLLYNVGEKPVISKHGLLGTVGFQLGKNRKPVYALEGSVAVAGSGVSFLMNNMGFFRDSRKVSDLAAMVPDNGGCVFVTAFSGLFAPYWIDDAKGTIFGITQHTQRGHIARATMEAACFQTKAILDAMEMDSGHSLSQLAVDGGMSNSDICMQTQADIIQIPVERPAMHETTALGAAIAAGFAIDIWKEFDELKNMNRANRTSFTPAISREQSQKMYKQWTKAVEMSRGWVDTKEMGGEDD

SEQ ID NO: 72444 - DNA, 1896 bp, Candida albicans SC5314
  CDS (1)..(1896): transl_table=12
atgcctcgtcgtgttagtaatgcaccatgtattcctgttgtagctacaattgatattggtactacttcagcaagagctattatattctcggcagaaggagaagaaattgccaagcatcaaattgaatattccaccactgcttcagaggccccagaaaactcgtcaaatacagatcaattcagaagaagatcttctttattaagacatgatgaacccattttctcagctgaaggtattgccattactctcaatgacaatattatgattgagaataataaatcatctgttggtcccaccattagattcccacaaccaggttgggttgaatgtatgccggttcatattttagctaatgccgttcaatgtttagtggcttgtttgatatcattgagaaaagttaaccaagatccaaatttaaaacttaaatataaagtcaaagccattggtattgccaacatgagagaaaccactattgtttggtctagaaaaactgggaaacctttgagtggaggtattacttggaccgatactagaacttcagaaattattcaacatttggaaaaaatgattgatgaagatagaaaagctgaacttaaagagaaaactggtttacccttatctacttatttttctgctgccaaattaagatggttgttggataatgatgatgttattagagaagaatatgaaaaaggtgatggcaatttaatgtttggtactgttgatacttggttgatttatcatttgaccaaagaaaaggcatttgtttcagatatcaccaatgcctctcgtacttatttcatggatttagaaactttagattatgatgatgacttgttagacttttgggggattgatcctacaaaaatcagaatgccgaaaattgtatcttcttcagaattttatggggaatttgccgcaccaaaattggacaatttggggttccataataaaatcactaaagaagcttatgatattttgaaaacaatcactggggtgccaatctgtggttgtcttggtgatcaatctgcttcacttgttggtcaattggcattcagtgctggttctgccaaatgtacttatggtactggtgccttccttttatataatactggacctcataaattgattagtaaacgtggagcattgaccacttttggattttggttcccaactttaaagggtactgatggtaaacctcattatgccatggaagggtctattgctgttgctgggtcgattattcaatggttgagagataacttgaaaatgattgataatgccaaagatataggtccattagcttcacaagtggaaaattctggtggagtggtgtttatcccagcattttctggtctttatgccccatattgggatggtggttctagaggtactattttcggtatgacacaatacacatcggctgcacacattgctcatgctgcattggaaggggtttgttatcaagtaagagctattttgaaagcaatggctagtgatgctggtgctgtagatgatttcttggaggacgcattatcatgtcaaaacaccgataaattattatctacattagctactgatggtggtatgtctaaagctgatgaagttttacaaattcaagcggatattttgggtccttgtgttactgtgaaacgtgcacaaactgctgaatgtactgcattgggtgctgctattgccgctgggttatcattcaagaatgaggaagatcgtatttggaaagatttggatgatgtagtggccaaaattagtggttcaagtgaagatgtggctgctaattcttttactgccaaattatcagatgaaaatagaagaaaagcttggaaacgttgggaaaaagctgtagatagagccaaaggttggttagaagacgaatag

SEQ ID NO: 72445 - protein, 631 aa, Candida albicans SC5314
MPRRVSNAPCIPVVATIDIGTTSARAIIFSAEGEEIAKHQIEYSTTASEAPENSSNTDQFRRRSSLLRHDEPIFSAEGIAITLNDNIMIENNKSSVGPTIRFPQPGWVECMPVHILANAVQCLVACLISLRKVNQDPNLKLKYKVKAIGIANMRETTIVWSRKTGKPLSGGITWTDTRTSEIIQHLEKMIDEDRKAELKEKTGLPLSTYFSAAKLRWLLDNDDVIREEYEKGDGNLMFGTVDTWLIYHLTKEKAFVSDITNASRTYFMDLETLDYDDDLLDFWGIDPTKIRMPKIVSSSEFYGEFAAPKLDNLGFHNKITKEAYDILKTITGVPICGCLGDQSASLVGQLAFSAGSAKCTYGTGAFLLYNTGPHKLISKRGALTTFGFWFPTLKGTDGKPHYAMEGSIAVAGSIIQWLRDNLKMIDNAKDIGPLASQVENSGGVVFIPAFSGLYAPYWDGGSRGTIFGMTQYTSAAHIAHAALEGVCYQVRAILKAMASDAGAVDDFLEDALSCQNTDKLLSTLATDGGMSKADEVLQIQADILGPCVTVKRAQTAECTALGAAIAAGLSFKNEEDRIWKDLDDVVAKISGSSEDVAANSFTAKLSDENRRKAWKRWEKAVDRAKGWLEDE

SEQ ID NO: 72446 - DNA, 1503 bp, Thermobifida fusca YX
  CDS (1)..(1503): transl_table=11
gtgaccgaacagtacgtagcggcaattgaccagggcaccacgtcgagtcgctgcatcatcttcaaccgccacggcgacgtggtcgccctcgggcagcgggagcaccgccagatcttcccccgcccgggctgggtcgagcacgacgcggaagagatctgggcgaacgtcgtcgccgtcgtggaggaggcgctcgccgcgggcgggctgcgccgccaccagttggccgcggtcgggatcaccaaccagcgggagacgaccgtggtgtgggaccggcagaccggtcaacccgtccaccacgcgatcgtgtggcaggacacccgcaccgaccgcctgctgcgagtcctgggcgggacggaaggccaggaccggttccggcagcggtgcggactcccgctcgccacctacttctccgggccgaaactgcgctggctgctcgacgaaatccccgggctgcgggagcgggcgcagcgcggcgaagtgctgttcggcaccatggacacctggctggtgtggcagctcaccgggcggcacgtcaccgacgtcaccaatgccagccgtaccatgctgatgaacctgcgcaccctggactgggatgccgaaaccctggacgcgatggggatccccgcagcgatgctcccggagatccggtccagtgcggaggtgtacggcacagccaccggccccttggcgggagtgcccgtggccgcagctctgggcgaccagcatgccgccttgttcgggcagacctgcttcgaccccggcgatgtgaaaggcacctacgggacgggggcgttcctggtgctcaacacgggtaccgagccggtcgtctccaccaacgggctgctcaccacggtgggctaccagatcggcggccagcccgcggtgtacgcgctcgaagggtcgatcgcgatggcgggctcgctcgtgcagtggctccgcgacaacctggggatgatcacgcacgccgcggagatcgaagaactcgcttcgcaggtcgcagacaacggcggctgctacatcgtgcccgcgttctccgggctgttcgcgccgcactggcggagcgacgcccgcggcatcatcgccggcctgacctcctatgtgaccaaagcgcacctggcccgcgcagtgctggaagcgacagcgtggcagacccgcgaagtggtggacgcgatgaacagcgactcagggatcccgctagcctcgctgaaagtggacggcggcatggtcgccaaccggctactgaaccagatcctcgccgacgtgctggacgtggaagtggtgcggcccaaagtggcggagacgacctgcctcggggctgcctacgcggcgggcctcgccgtgggctactggccggacttggacagtctgcgcgccaactggcagcacgacgccacgtggacgccgcagatcgacgcgcaggtgcgggaccgcgaataccgcaactggacgaaagcggtacgccgcaccttcggctgggtggaatccgaggaggacgcgtcctga

SEQ ID NO: 72447 - protein, 500 aa, Thermobifida fusca YX
MTEQYVAAIDQGTTSSRCIIFNRHGDVVALGQREHRQIFPRPGWVEHDAEEIWANVVAVVEEALAAGGLRRHQLAAVGITNQRETTVVWDRQTGQPVHHAIVWQDTRTDRLLRVLGGTEGQDRFRQRCGLPLATYFSGPKLRWLLDEIPGLRERAQRGEVLFGTMDTWLVWQLTGRHVTDVTNASRTMLMNLRTLDWDAETLDAMGIPAAMLPEIRSSAEVYGTATGPLAGVPVAAALGDQHAALFGQTCFDPGDVKGTYGTGAFLVLNTGTEPVVSTNGLLTTVGYQIGGQPAVYALEGSIAMAGSLVQWLRDNLGMITHAAEIEELASQVADNGGCYIVPAFSGLFAPHWRSDARGIIAGLTSYVTKAHLARAVLEATAWQTREVVDAMNSDSGIPLASLKVDGGMVANRLLNQILADVLDVEVVRPKVAETTCLGAAYAAGLAVGYWPDLDSLRANWQHDATWTPQIDAQVRDREYRNWTKAVRRTFGWVESEEDAS

SEQ ID NO: 72448 - DNA, 1503 bp, Carboxydothermus hydrogenoformans Z-2901
  CDS (1)..(1503): transl_table=11
gtgacgaaaaaatatgttttggcgttagaccagggaaccaccagctgccgggcaatcttatttgaccgggacagcaatatcgtgggcgtagcccaaaaagagtttacccagcattatcccaagccgggctgggtggaacatgatccggaagaaatctggagcactcagtacggggttattgccgagttaatggcccgttacaacgtaaaccctgaagaaattgcggctattggtattaccaaccagcgggaaaccacggtagtttgggatagaaataccggaaagcctgtatataatgcgattgtttggcagtgccggagaactgcagggatttgcgatgagttaaaagcaaaaggtttagaagaaaaggttcgttataagaccggtctggttattgatgcatatttctcgggtacaaagattaagtggattttagataatgtcgaaggtgcccgggaaaaagctgaaagaggcgaactgttatttggcaccattgatacctggcttgtctggaaattaaccggcggaaaagtccatgttaccgactactccaatgcttcccggacgatgatttacaatatccgggagcttaaatgggacgaagagcttttagcggagcttgggattccggcctccatgcttccggaagtaaagccttcaagttacgtttacggagaaaccgatcctaacgttttctttggtcatgctattccgatttccggtattgccggagaccagcaggcggccttatttggtcaaacctgctttgaaccgggaatggctaaaaatacctatggtaccggttgctttatgctgatgaacaccggtgacaaagtttatgaatcgaaaaacggtctcttaaccaccattgcctgggggattgacggtaaggtagaatatgccctggaaggaagtatttttattgccggtgcagttatccagtggttaagagatgggctaaaacttattgaaagcgcagccgattcggaatattttgcttctaaagtgcccgataccggtggggtatacatcgttcctgcctttgccggacttggtgctccctactgggatatgcgggcgcggggtacgattgtaggcttaacccggggtactaacaaataccaccttgtgagagctgcattagaatcaatggcctatcaaacccgggatgttttatcagcaatggaagctgactcgggcattaaacttcaggctctcaaagtagatggtggggctgttgccaacaaccttttaatgcagttccaggccgatatcctgggtgttccggtagaacgaccggtaaacattgaaactactgccatgggtgctgcttatttagcaggtttggccgttggtttctgggctgataaacaggagttagtggcaaaatataaagtaagccgccgttttgaaccgactatggatgaacaaaccagggaaaaactctacaaaggctggcagcgggcagtaacccgtgcacgggaatgggaagtagaggagtaa

SEQ ID NO: 72449 - protein, 500 aa, Carboxydothermus hydrogenoformans Z-2901
MTKKYVLALDQGTTSCRAILFDRDSNIVGVAQKEFTQHYPKPGWVEHDPEEIWSTQYGVIAELMARYNVNPEEIAAIGITNQRETTVVWDRNTGKPVYNAIVWQCRRTAGICDELKAKGLEEKVRYKTGLVIDAYFSGTKIKWILDNVEGAREKAERGELLFGTIDTWLVWKLTGGKVHVTDYSNASRTMIYNIRELKWDEELLAELGIPASMLPEVKPSSYVYGETDPNVFFGHAIPISGIAGDQQAALFGQTCFEPGMAKNTYGTGCFMLMNTGDKVYESKNGLLTTIAWGIDGKVEYALEGSIFIAGAVIQWLRDGLKLIESAADSEYFASKVPDTGGVYIVPAFAGLGAPYWDMRARGTIVGLTRGTNKYHLVRAALESMAYQTRDVLSAMEADSGIKLQALKVDGGAVANNLLMQFQADILGVPVERPVNIETTAMGAAYLAGLAVGFWADKQELVAKYKVSRRFEPTMDEQTREKLYKGWQRAVTRAREWEVEE

SEQ ID NO: 72450 - DNA, 1491 bp, Geobacter metallireducens GS-15
  CDS (1)..(1491): transl_table=11
atgagttatatccttgccctggatcagggcactaccagttcccgcgccattgtcttcgacaccaccgcaacgatccgcgccattgcccagcgggagttccgccagatatttccccggcccggctgggtggaacacgacggccgggagatctgggccacccaggtgggcgtggcggccgaagccctgacccgggccggcatctctccccgggaggtacgggccatcggcatcaccaaccagcgcgagacaacgctcctctgggaccgacgaagcggcgagccgctccacaacgccatcgtctggcaggaccgccgcaccgcggaactctgcgaccggctcaaggccgacggcctggaacccctgttccggcagaagaccggcctggtactggatgcctacttttccggcaccaagctggcctggctgctggaggccatacctggcgcccgcagccgcgccgaagcgggggagctggccttcggcacggtggattcctggctggcctggaacctgtcgggaggaaagctccatgtcaccgacgccagcaacgcctcccggacgctcctcttcaacatcactaccctggattgggacgacgagctgttggcgatcctcgggataccccgggcagtgctgccgcgggtggtggattccggcgccgtttacggcgagaccgccggggatatttttgctgcggcgattccccttgccggcatggccggggaccagcaggcggccctcttcgggcaggcctgcggcacggcagggatggccaagaacacctacggcaccggctgcttcctgctgatgcactgtggaacacggccgatagagtcccggcacaacctgctcaccaccgttgcctggcaactgggcggacgggctgaatacgcccttgaggggagcgtgtttgtggccggcgctgcggtgcagtggctccgggacggcctgggcatcatccgctcctccggcgaggtggaggcccttgcggccagcgttccggacagcggcggtgtctgcctggttcccgccttcaccggactcggcgccccccactgggatccctacgcccggggcaccatcgtcggcataacccgcggcaccaccgcggcacacatcgcccgggccaccctggagagcatcgccttccagagcgccgacctcctcaccgccatggaggccgacgccggcatcagcctggccgaattgcgggtcgacggaggcgcaacggccaacgggctcctgatgcagttccaggccgacctcctcggggtgccggtggtgcggccccggatcagcgagaccacggccctgggggctgcctacctggcgggactggcggtggggctctggcgtgaccgtcaggagattgccggccactggcaggtggaccggatcttcgagccggccatgggccgcgagcaggcggcagagctacggggaaggtgggggcgggccgtggagcgggcccgggggtgggcggcgccatga

SEQ ID NO: 72451 - protein, 496 aa, Geobacter metallireducens GS-15
MSYILALDQGTTSSRAIVFDTTATIRAIAQREFRQIFPRPGWVEHDGREIWATQVGVAAEALTRAGISPREVRAIGITNQRETTLLWDRRSGEPLHNAIVWQDRRTAELCDRLKADGLEPLFRQKTGLVLDAYFSGTKLAWLLEAIPGARSRAEAGELAFGTVDSWLAWNLSGGKLHVTDASNASRTLLFNITTLDWDDELLAILGIPRAVLPRVVDSGAVYGETAGDIFAAAIPLAGMAGDQQAALFGQACGTAGMAKNTYGTGCFLLMHCGTRPIESRHNLLTTVAWQLGGRAEYALEGSVFVAGAAVQWLRDGLGIIRSSGEVEALAASVPDSGGVCLVPAFTGLGAPHWDPYARGTIVGITRGTTAAHIARATLESIAFQSADLLTAMEADAGISLAELRVDGGATANGLLMQFQADLLGVPVVRPRISETTALGAAYLAGLAVGLWRDRQEIAGHWQVDRIFEPAMGREQAAELRGRWGRAVERARGWAAP

SEQ ID NO: 72452 - DNA, 1533 bp, Mycobacterium sp. MCS
  CDS (1)..(1533): transl_table=11
atgagggagagcgcattggccgagttcgtcgccgccatcgatcaggggaccaccagtacccggtgcatgatcttcgaccacgacggcgccgaggtcggccggcaccagctcgaacacgagcagatcctgcccagggccggctgggtcgaacacaacccggtggagatctgggagcgcaccgcatcggtcctcatgtcggcgctcaaccgcaccgacctctcggccggggacctgtgcgcgctcggtatcaccaaccagcgggagacggcgctggtgtggaaccgtcgcaccgggcggccgtactacaacgcgatcgtgtggcaggacacccgcaccgaccgcatcgccacggcgctcgaccgggacgggcgcggagacgtgatccgccgcaaggccgggttgccgccggcgacgtacttctccgcgggcaaggtgcagtggatcctcgacaacgtcgacggtgtgcgcgaggccgccgacaagggtgacgcgatcttcggcaccgccgacagctgggtggtgtggaacctgaccggcggaccgcgcggcggcgtgcacgtcaccgacgtgaccaacgccagccgcaccatgctgatggatctggagacgctggactgggacgatgaactgttgtcgttcttcgggattccgcgccagatgatgcccgagatcaaaccgtcgtcgtgcccggactgccacggtgtcacccgggaggacggaccgctcggcggtgaggtgccgatcgccggcatcctcggtgaccagcaggccgcgatggtcgggcaggtgtgcctgtcggcgggcgaggccaagaacacctacggcacaggcaatttcctgctgctcaacaccggcgagaagatcgtccgctccgagaacggtctgctcaccacggtctgctaccagttcggtgacgcgaaacccgtttacgcccttgagggttcgatcgcggtgacggggtcggccgtgcaatggctgcgcgatcagctcggcatcatcagcggtgcctcgcagagcgagtcgctggcgcgtcaggtcgaggacaacggcggggtgtacttcgtgccggcgttctccgggctgttcgcaccgtactggcgctcggatgcccgcggcgccatcgtcggcctgtcccggttcaacaccaacgcccacgtcgcgcgggcgacgctggaggcgatctgctaccagagccgcgatgtcgtcgacgcgatggaggccgactcaggtgtgcatctcgaggtgctcaaggtcgacggcggcatcaccgtcaacgatctgtgcatgcagatccaggccgatgtgctcggcgtcgacgtggtccggccggtggtggccgaaaccaccgctctcggtgcaggttacgcggccgggttggcggtcgggttctgggacggcgccgacgatctgcggcgcaactggcaggaggacaagcgctggactccgcagtggagcgacgatcagcgcgccgaggggtacgccggctggcagaaggccgtacagcgcaccctggactgggtcgacgtcgagtga

SEQ ID NO: 72453 - protein, 510 aa, Mycobacterium sp. MCS
MRESALAEFVAAIDQGTTSTRCMIFDHDGAEVGRHQLEHEQILPRAGWVEHNPVEIWERTASVLMSALNRTDLSAGDLCALGITNQRETALVWNRRTGRPYYNAIVWQDTRTDRIATALDRDGRGDVIRRKAGLPPATYFSAGKVQWILDNVDGVREAADKGDAIFGTADSWVVWNLTGGPRGGVHVTDVTNASRTMLMDLETLDWDDELLSFFGIPRQMMPEIKPSSCPDCHGVTREDGPLGGEVPIAGILGDQQAAMVGQVCLSAGEAKNTYGTGNFLLLNTGEKIVRSENGLLTTVCYQFGDAKPVYALEGSIAVTGSAVQWLRDQLGIISGASQSESLARQVEDNGGVYFVPAFSGLFAPYWRSDARGAIVGLSRFNTNAHVARATLEAICYQSRDVVDAMEADSGVHLEVLKVDGGITVNDLCMQIQADVLGVDVVRPVVAETTALGAGYAAGLAVGFWDGADDLRRNWQEDKRWTPQWSDDQRAEGYAGWQKAVQRTLDWVDVE

SEQ ID NO: 72454 - DNA, 1485 bp, Solibacter usitatus Ellin6076
  CDS (1)..(1485): transl_table=11
ttgtccaactacatcggcgccatcgaccaaggcaccaccagcacgcgattcatcgtgttcgaccacgggggccggatcgtctccgtcgcccagaaagagcacgagcagatcttcccccagcccggctgggtggagcatgacgccaacgagatctggcgccgcacccgcgaagtaatcgccgaggcgctcgagaagcgcgccctctccgcctccgacctcgccgccatcggcatcaccaaccagcgcgaaaccaccgtggtgtgggaccgccttagcggcgagcccgtgtacaacgccctcgtctggcaggatacgcgcaccgcggccgccgtggccgagctcgcccgtgacggcggcgccgaccgcttccgcgcccagaccggacttccgcttgccacctacttcagcgccctcaagatcggctggatcctcgacaacgtgcccgccgtccgcgcgcgcgccgaagcaggcgacatcctcttcggcaacatcgacaccttcctgctgtggaacctcaccggcggcctgcacctcaccgattgcaccaacgccagccgcactcacctgatgaacctgcagacgctggattgggacgacgagctgctcgctgccttccgcattccccgcgccatgctgccgcgcatcgtctccagcagcgaggtctacggcaacgcaactcttgcctccgtggccggcgtcccgatcgcgggcatcctcggcgaccagcaggcggcactcgtgggccagacctgttttcacgcgggcgaggccaaaaacacgtatggcaccggatgtttcctgctgatgaacaccggaaccaagcccacgccttcgaaacacggcatgttaaccaccgtggcctatcgcttcgccacgcagcccgctgtctatgcgctcgaaggcagcgtcgccatcacgggcgcattggtgcaatgggtccgcgacaatttcggcctgatcgaaaagagcagcgatatcgaagtgctcgcgcgcactgtcaaggataacggcggcgtatacttcgtccccgccttcagcggcctttacgcgccctactggaaggacaacgcgcgcggcgtgatcgccggcctcacgcgctataccaacaaaggccacctggcgcgcgccgtcctcgaagccaccgctttccagacgcgcgaagtagtggaagcgatggagaaggattccgccatcgcgctcgagaccctgcgcaccgatgggggcatggtctctaacgacctgctcatgcagttccagtccgatatactggatcgccccgtggtgcgtcccgcggtgcaggaaaccacggctctcggcgctgcctacgcggccggcctggcggtgggattcttccaggacaccgacgacctgcgcagccggtggagcgtggatcatacctggaagccgcagatggagcccgagcggcggcaggagttgtacagcttttggaagaaggcggttacccggtcgttcgactggctgtag

SEQ ID NO: 72455 - protein, 494 aa, Solibacter usitatus Ellin6076
MSNYIGAIDQGTTSTRFIVFDHGGRIVSVAQKEHEQIFPQPGWVEHDANEIWRRTREVIAEALEKRALSASDLAAIGITNQRETTVVWDRLSGEPVYNALVWQDTRTAAAVAELARDGGADRFRAQTGLPLATYFSALKIGWILDNVPAVRARAEAGDILFGNIDTFLLWNLTGGLHLTDCTNASRTHLMNLQTLDWDDELLAAFRIPRAMLPRIVSSSEVYGNATLASVAGVPIAGILGDQQAALVGQTCFHAGEAKNTYGTGCFLLMNTGTKPTPSKHGMLTTVAYRFATQPAVYALEGSVAITGALVQWVRDNFGLIEKSSDIEVLARTVKDNGGVYFVPAFSGLYAPYWKDNARGVIAGLTRYTNKGHLARAVLEATAFQTREVVEAMEKDSAIALETLRTDGGMVSNDLLMQFQSDILDRPVVRPAVQETTALGAAYAAGLAVGFFQDTDDLRSRWSVDHTWKPQMEPERRQELYSFWKKAVTRSFDWL

SEQ ID NO: 72456 - DNA, 1533 bp, Kineococcus radiotolerans SRS30216
  CDS (1)..(1533): transl_table=11
atggcagacaccaccggaccccagtacgtgggcgccgtcgaccagggaaccacctccagccgcttcatggtcttcgaccacggcggcaacgagatcgcgaagtaccagctcgagcacacccagatcatgcccgagccgggctgggtcgagcacgacccgatcgagatctgggagcgcaccagttccgtcatccagagcggcctgcgccaggccaacctgacggccgaggacctcgccgccctgggcatcaccaaccagcgcgagaccacggtcgtctggaacaggcacacgggccgcccgtactacaacgcgatcgtgtggcaggacacccgcaccgaccgcatcgccgccgcgctggaccgcgacgagcgcggccggacgatccggcagaagaccggcctgcccccggcaccgtacttctccggcggcaagatccagtggatcctggagaacgtccagggcgtgcgcgaggccgcggaggccggcgacgcgatcttcggcaacaccgacgcctggctcatctggaacctcaccggcggcccgcgcggcggcgtccacgtcaccgacgtcaccaacgccagccgcaccatgctcatggacctcgagaccctgcagtgggacgacgagctcctggccatcttcggcatcccccgctcgatgctccccgagatcaagccgtcctcctacaccgcgggctacggcgagaccctggagaccgggccgctgggcgggcgggtcaagctgaccggcatcctcggcgaccagcagtcggccatggtcggccaggtctgcttcgaccccggcatggccaagaacacctacggcaccggcaacttcatgctgctgaacaccggcgaggagctcgtccgctccaaggccgggctgctgaccacggtctgctaccagttcaacgacgagaagccggtctacgccctcgagggctcgatcgccgtgaccggctcggccatccagtggctgcgcgaccagctcggcatcatctccggcgcggcggagtcggagtccctggcccgccaggtgaaggactccggcggctgctacttcgtgcccgcgttctccgggctcttcgccccctactggcgttccgacgcccgcggcgccatcgtcgggctctcgcgctacaacaccaacgcgcacatcgcccgcgccgcgctggaggcgatctgctaccagagccgcgacgtcaccgaggccatgacggccgactccggcgtcgaggtcgaggtcctcaaggtcgacggcggcatcaccgccaaccagctgtgcatgcagctgcaggccgacgtcctcggcgtgcccgtctccaagcccgtcgtggccgagaccaccgcgctcggggcggcctacgcggccggcctggcggtggggttctggaagaacctcgacgagctgcgcgagaactggaacgagggcgcccgctgggagccgacctggaacgaggaccagcgcaaggacggttacgccggctggaagaaggccgtcgagcggacgttgaactgggtggacgtcgactga

SEQ ID NO: 72457 - protein, 510 aa, Kineococcus radiotolerans SRS30216
MADTTGPQYVGAVDQGTTSSRFMVFDHGGNEIAKYQLEHTQIMPEPGWVEHDPIEIWERTSSVIQSGLRQANLTAEDLAALGITNQRETTVVWNRHTGRPYYNAIVWQDTRTDRIAAALDRDERGRTIRQKTGLPPAPYFSGGKIQWILENVQGVREAAEAGDAIFGNTDAWLIWNLTGGPRGGVHVTDVTNASRTMLMDLETLQWDDELLAIFGIPRSMLPEIKPSSYTAGYGETLETGPLGGRVKLTGILGDQQSAMVGQVCFDPGMAKNTYGTGNFMLLNTGEELVRSKAGLLTTVCYQFNDEKPVYALEGSIAVTGSAIQWLRDQLGIISGAAESESLARQVKDSGGCYFVPAFSGLFAPYWRSDARGAIVGLSRYNTNAHIARAALEAICYQSRDVTEAMTADSGVEVEVLKVDGGITANQLCMQLQADVLGVPVSKPVVAETTALGAAYAAGLAVGFWKNLDELRENWNEGARWEPTWNEDQRKDGYAGWKKAVERTLNWVDVD

SEQ ID NO: 72458 - DNA, 1533 bp, Mycobacterium sp. JLS
  CDS (1)..(1533): transl_table=11
atgagggagagcgcattggccgagttcgtcgccgccattgatcaggggaccaccagtacccggtgcatgatcttcgaccacgacggcgccgaggtcggccggcaccagctcgaacacgagcagatcctgcccagggccggctgggtcgaacacaacccggtggagatctgggagcgcaccgcatcggtcctcatgtcggcgctcaaccgcaccgacctctcggccggggacctgtgcgcgctcggtatcaccaaccagcgggagacggcgctggtgtggaaccgtcgcacggggcggccgtactacaacgcgatcgtgtggcaggacacccgcaccgaccgtatcgccacggcgctcgaccgggatgggcgtggagacgtgatccgccgcaaggccgggttgccgccggcgacgtacttctccgcgggcaaggtgcagtggatcctcgacaacgtcgacggtgtgcgtgaggccgccgagaaaggtgacgcgatcttcggcaccgccgacagctgggtggtgtggaacctgaccggcgggccgcgcggcggcgtgcacgtcaccgacgtgaccaacgccagccgtaccatgctgatggatctggagacgctggactgggacgacgagctgttgtcgttcttcgggattccgcgccagatgatgcccgagatcaaaccgtcgtcgtgcccggactgccacggtgtcacccgggaggacggaccgctcggcggtgaggtgccgatcgccggcatcctcggtgaccagcaggccgcgatggtcgggcaggtgtgcctgtcggcgggcgaggccaagaacacctacggcacaggcaatttcctgctgctcaataccggcgagaagatcgtccgctccgagaacggtctgctcaccacggtctgctaccagttcggtgacgcgaaacccgtttacgctcttgagggttcgatcgcggtgacgggttcggccgtgcagtggctgcgcgatcagctcggcatcatcagcggtgcctcgcagagcgagtcgctggcgcgtcaggtcgaggacaacggtggggtgtacttcgtgccggcgttctccgggctgttcgcaccgtactggcgctcggatgcccgcggcgccatcgtcggcctgtcccggttcaacaccaacgcccacgtcgcgcgggcgacgctggaggcgatctgctaccagagccgcgatgtcgtcgacgcgatggaggccgactccggtgtgcatctcgaggtgctcaaggtcgacggcggcatcaccgtcaacgatctgtgcatgcagatccaggccgatgtgctcggcgtcgacgtggtccggccggtggtagccgaaaccaccgctctcggtgcgggttacgcggccgggttggcggtcgggttctgggacggcgccgacgatctgcggcgcaactggcaggaggacaagcgctggacgccgcagtggagcgacgggcagcgcgccgaggggtacgccggctggcagaaggccgtacagcgcaccctggactgggtcgacgtcgagtga

SEQ ID NO: 72459 - protein, 510 aa, Mycobacterium sp. JLS
MRESALAEFVAAIDQGTTSTRCMIFDHDGAEVGRHQLEHEQILPRAGWVEHNPVEIWERTASVLMSALNRTDLSAGDLCALGITNQRETALVWNRRTGRPYYNAIVWQDTRTDRIATALDRDGRGDVIRRKAGLPPATYFSAGKVQWILDNVDGVREAAEKGDAIFGTADSWVVWNLTGGPRGGVHVTDVTNASRTMLMDLETLDWDDELLSFFGIPRQMMPEIKPSSCPDCHGVTREDGPLGGEVPIAGILGDQQAAMVGQVCLSAGEAKNTYGTGNFLLLNTGEKIVRSENGLLTTVCYQFGDAKPVYALEGSIAVTGSAVQWLRDQLGIISGASQSESLARQVEDNGGVYFVPAFSGLFAPYWRSDARGAIVGLSRFNTNAHVARATLEAICYQSRDVVDAMEADSGVHLEVLKVDGGITVNDLCMQIQADVLGVDVVRPVVAETTALGAGYAAGLAVGFWDGADDLRRNWQEDKRWTPQWSDGQRAEGYAGWQKAVQRTLDWVDVE

SEQ ID NO: 72460 - DNA, 1560 bp, Medicago truncatula
  CDS (1)..(1560)
atgtctaaagaagatgttttcattggtgcaattgaccaaggaacaagcagtagcaggttcataatatatgataaatcagctcaaccaattggatctcatcaggttgaattcactcagttctatccacaagcaggatgggtggagcataatccaatggagatattggagagcgtgaaggtttgtattactaaggcagtggataaggcaacagctaacgggttcaacgtggacaaaggattgaaggctattggtctcaccaatcaaagagagaccactcttgtttggagcaaatccaccggcgctcctcttcacaatgcgcttgtttggatggatgttcgtactacctctgtttgcaggagactggaaaaagagttatctggtggtagaacacactttgtagagagctgtggtttgcctattagcacatatttcagtgctatgaaacttctgtggttgatggaaaatgtggatgctgtcaaggaagctattaagaaaaaagatgcattgtttggaacaatagacacttggttgatttggaacttaaccggtggagtgaaaggaggattgcacgtcactgatgcttcaaatgcatcccgaacaatgttgatgaacctaaaaaccctcaactgggatgaatctaccttgaaagcacttcaaatcccagctgaaattttgcctaaaattatcagtaattcagaaattataggcaatgtttcttctggatggccagttgctggtatccctatcgctggatgtttaggtgatcaacatgcagcaatgcttggacaagcgtgccgtaaaggggaggctaaaagtacttatggtactggtgctttcattctattgaataccggtgaaggagtagttaaatcaaaccatggtcttctgtcaactatagcttataagcttggtccgaatgctccaaccaattatgcactcgaaggttctgttgctattgctggagctgcggtgcagtggcttagagatggtcttggtctcattacaactgctaaagatatagaggctctggcattagaggtagaatccaatggtggtgtttactttgttcctgccttcaatggattgtttgctccgtggtggcgtgatgatgctcgtggggtttgtatcggaataacaaggtatactagcaaggctcacattgctagagccgtgcttgagagcatatgttttcaagtaaaagatgttattgattcaatgcacaaagattctggagcagatcaatccaagaaagatgagtttttgcttagggttgatggtggtgcaactgttaacaacctgttaatgcagactcaggcggatttgttggcaacttcagtaattagaccagctgacattgaaacaacagcacttggagcagcctatgcagctggattagctgttgggatttggaaagaagatttcgttttcgattcgaaggacttgctgaagaatgctagtgttttccgtcctctaatggttgaagaaattaggaaaaagaaagtagattcttggggcaaagctgttagtagatcttttgacttagcagatctttctctttga

SEQ ID NO: 72461 - protein, 519 aa, Medicago truncatula
MSKEDVFIGAIDQGTSSSRFIIYDKSAQPIGSHQVEFTQFYPQAGWVEHNPMEILESVKVCITKAVDKATANGFNVDKGLKAIGLTNQRETTLVWSKSTGAPLHNALVWMDVRTTSVCRRLEKELSGGRTHFVESCGLPISTYFSAMKLLWLMENVDAVKEAIKKKDALFGTIDTWLIWNLTGGVKGGLHVTDASNASRTMLMNLKTLNWDESTLKALQIPAEILPKIISNSEIIGNVSSGWPVAGIPIAGCLGDQHAAMLGQACRKGEAKSTYGTGAFILLNTGEGVVKSNHGLLSTIAYKLGPNAPTNYALEGSVAIAGAAVQWLRDGLGLITTAKDIEALALEVESNGGVYFVPAFNGLFAPWWRDDARGVCIGITRYTSKAHIARAVLESICFQVKDVIDSMHKDSGADQSKKDEFLLRVDGGATVNNLLMQTQADLLATSVIRPADIETTALGAAYAAGLAVGIWKEDFVFDSKDLLKNASVFRPLMVEEIRKKKVDSWGKAVSRSFDLADLSL

SEQ ID NO: 72462 - DNA, 1560 bp, Medicago truncatula
  CDS (1)..(1560)
atgtctaaagaagatgttttcattggtgcaattgaccaaggaacaagcagtagcaggttcataatatatgataaatcagctcaaccaattggatctcatcaggttgaattcactcagttctatccacaagcaggatgggtggagcataatccaatggagatattggagagcgtgaaggtttgtattactaaggcagtggataaggcaacagctaacgggttcaacgtggacaaaggattgaaggctattggtctcaccaatcaaagagagaccactcttgtttggagcaaatccaccggcgctcctcttcacaatgcgcttgtttggatggatgttcgtactacctctgtttgcaggagactggaaaaagagttatctggtggtagaacacactttgtagagagctgtggtttgcctattagcacatatttcagtgctatgaaacttctgtggttgatggaaaatgtggatgctgtcaaggaagctattaagaaaaaagatgcattgtttggaacaatagacacttggttgatttggaacttaaccggtggagtgaaaggaggattgcacgtcactgatgcttcaaatgcatcccgaacaatgttgatgaacctaaaaaccctcaactgggatgaatctaccttgaaagcacttcaaatcccagctgaaattttgcctaaaattatcagtaattcagaaattataggcaatgtttcttctggatggccagttgctggtatccctatcgctggatgtttaggtgatcaacatgcagcaatgcttggacaagcgtgccgtaaaggggaggctaaaagtacttatggtactggtgctttcattctattgaataccggtgaaggagtagttaaatcaaaccatggtcttctgtcaactatagcttataagcttggtccgaatgctccaaccaattatgcactcgaaggttctgttgctattgctggagctgcggtgcagtggcttagagatggtcttggtctcattacaactgctaaagatatagaggctctggcattagaggtagaatccaatggtggtgtttactttgttcctgccttcaatggattgtttgctccgtggtggcgtgatgatgctcgtggggtttgtatcggaataacaaggtatactagcaaggctcacattgctagagccgtgcttgagagcatatgttttcaagtaaaagatgttattgattcaatgcacaaagattctggagcagatcaatccaagaaagatgagtttttgcttagggttgatggtggtgcaactgtaacaaacctgttaatgcagactcaggcggatttgttggcaacttcagtaattagaccagctgacattgaaacaacagcacttggagcagcctatgcagctggattagctgttgggatttggaaagaagatttcgttttcgattcgaaggacttgctgaagaatgctagtgttttccgtcctctaatggttgaagaaattaggaaaaagaaagtagattcttggggcaaagctgttagtagatcttttgacttagcagatctttctctttga

SEQ ID NO: 72463 - protein, 519 aa, Medicago truncatula
MSKEDVFIGAIDQGTSSSRFIIYDKSAQPIGSHQVEFTQFYPQAGWVEHNPMEILESVKVCITKAVDKATANGFNVDKGLKAIGLTNQRETTLVWSKSTGAPLHNALVWMDVRTTSVCRRLEKELSGGRTHFVESCGLPISTYFSAMKLLWLMENVDAVKEAIKKKDALFGTIDTWLIWNLTGGVKGGLHVTDASNASRTMLMNLKTLNWDESTLKALQIPAEILPKIISNSEIIGNVSSGWPVAGIPIAGCLGDQHAAMLGQACRKGEAKSTYGTGAFILLNTGEGVVKSNHGLLSTIAYKLGPNAPTNYALEGSVAIAGAAVQWLRDGLGLITTAKDIEALALEVESNGGVYFVPAFNGLFAPWWRDDARGVCIGITRYTSKAHIARAVLESICFQVKDVIDSMHKDSGADQSKKDEFLLRVDGGATVTNLLMQTQADLLATSVIRPADIETTALGAAYAAGLAVGIWKEDFVFDSKDLLKNASVFRPLMVEEIRKKKVDSWGKAVSRSFDLADLSL

SEQ ID NO: 72464 - DNA, 1590 bp, Oryza sativa
  CDS (1)..(1590)
atggcggaggaggtgtatgtcgcgtcgatcgaccagggcacgacgagcacgcggttcatcgtctacgaccgccacgccaagcccgtcgcgtcgcatcagctcgagttcaagcagcactacccggaggctggatgggttgagcatgatcctatggagattatggagagtgtgaagatatgcatggcgaaggcacttgacaaagctgcagctgatggtcataatatggatgttggactgaaggccattggtattacaaatcagagggaaaccactgttatgtggagcaaatccacaggccttcctctatacaatgccattgtatggatggatgctcgcacaagccccatttgcaggagattggaaagtgatctttctggtggtagaacccactttgtcaagacatgtggattgccaatcagtacctatttcagtgctttgaaggtgttatggttgatcgaaaatgtggatgccgtcaagaatgcagtccgagctggtgatgccttatttggcacaattgacacctggttaatctggaacctcacaggaggcattggcgggacagatcgtgatggaaataaagtatttgggcaccatgtcacagactgctccaatgcatctcgcacaatgcttatgaacctgaaggcacttgactgggacaaaccaacacttgagacgttaggaattcctgctgagatattgcccaaaattatcagtaactcggagagaattggtgtggttgccaatgggtttcccttggcgggcgtccctattgctgggtgcctaggagaccagcatgctgcaatgcttgggcagctgtgccagaaaggtgaagccaaaagcacctatggaactggtgccttcattcttctcaacacaggggaggagcctacccaatcctcccatggtcttcttagcacgattgcttataagcttggcccaagcgcacccactaattatgctctagaaggctccatcgcaattgctggtgccgcagttcagtggttgagagacagccttggaatcattagcacagcagctgatattgaaaagttggctgatactgtgcaggattcaggtggaatatactttgttccagcattcaatgggttgtttgcaccatggtggagggatgatgcaagaggcatatgtataggaatcacacggttcactaacaaggggcacattgctcgagcagtgctcgagagtatgtgctttcaggtgaatgatgtcctcagctccatgcacaaggatgctggggaggcaggagaagtgaagagtgcagaaggggagttcctgctgcgcgttgatggtggtgctactgtcaacaatcttctcatgcagatccaggctgatttattgggtagccctgttgtcagacctgctgacatcgagacaactgcccttggagctgcgtatgcagctggattagctgttggagtctggtcgaaggaacaaattttcgctggtttgcacaaggagaacaccacagtcttccgcccgaaattggatgaggcccacaggaggaagagagcagactcctggtacaaggccgtttcaagatcatttgatttggctgacctttctctttag

SEQ ID NO: 72465 - protein, 529 aa, Oryza sativa
MAEEVYVASIDQGTTSTRFIVYDRHAKPVASHQLEFKQHYPEAGWVEHDPMEIMESVKICMAKALDKAAADGHNMDVGLKAIGITNQRETTVMWSKSTGLPLYNAIVWMDARTSPICRRLESDLSGGRTHFVKTCGLPISTYFSALKVLWLIENVDAVKNAVRAGDALFGTIDTWLIWNLTGGIGGTDRDGNKVFGHHVTDCSNASRTMLMNLKALDWDKPTLETLGIPAEILPKIISNSERIGVVANGFPLAGVPIAGCLGDQHAAMLGQLCQKGEAKSTYGTGAFILLNTGEEPTQSSHGLLSTIAYKLGPSAPTNYALEGSIAIAGAAVQWLRDSLGIISTAADIEKLADTVQDSGGIYFVPAFNGLFAPWWRDDARGICIGITRFTNKGHIARAVLESMCFQVNDVLSSMHKDAGEAGEVKSAEGEFLLRVDGGATVNNLLMQIQADLLGSPVVRPADIETTALGAAYAAGLAVGVWSKEQIFAGLHKENTTVFRPKLDEAHRRKRADSWYKAVSRSFDLADLSL

SEQ ID NO: 72466 - DNA, 1698 bp, Aspergillus oryzae
  CDS (1)..(1698)
atgaggaacccttttgatatgtccgacctcgactctcttgtcgatgagcaagaggagcagccgtatattgacattcacgcctaccaaacacatgacggcaatcgctctctcctgcagccgaatgaaaaccgtcatggcgacagcttgaaggatcggtttattggtgccattgacactggcaccacgagctcccgctttatcatctttgactgtactggtgtccccgtcgccaagtaccaaatggaattccgtcagatccacgagcattcaggatggcacgaacaagacccgttcgacttggtggattcggtttacacatgtatcgaggaggcgatgaagtctttcatggctcttggccactcaccgtcagagatcgaagccatcggggtcaccagtcagcgagagacaacgcttgtttgggattgggagactggcgagccgttgcataacgctatcgcgtggcccgacaccaggaccaagggtctagttcgggagctgaaggcccaacccggagcggatgagttgaagaacatctgcgggtttcccctctcgacttacccctcctccgtcaccttagtatggatgcttcggaatctaccggaagtcaagaaggcatatgatgaaggaaggctcgctttcggcactgttgacacgtggctcatgtataacctgaatggtggtcctgagggaaacgtcttggtgactgatgtgacgaacgcatcaagaacgatgttcatgaacctgaaaacgcttgattatgacgataatttgttagagttcttcggcattgacaggaagaagatcagacttcctaaaattctcccatcatccgacccggacggatatggatgggtcagagggggaccgcttgatggtgttccgatcaccagctgccttggcgatcagtctgcggcgttagtcggtcattgtgccttcacacctggaacagcgaagaacacatatggcacaggatgcttccttctttacaacgttggcgaggagcccgtaatttccaagcatggcttgctcagcacagttggattccagctgggtaagcatcggaaagccgtttacgcgcttgaaggtagtgtggctgttgccggaagtggtgtttccttcctgatgaacaacatgggtttcttccgtgattcgcggaaagtaagtgaagtggcagcaacggttccagacagcggaggctgtgtgtttgtcaccgcgttcagtggtctgtttgcaccttattggattgatgatgctaagggaactatattcggaataactcagcacacgcagcgtggacacattgctcgtgccaccatggaagctgcctgcttccaaactaaggcaatcctcgatgccatggagatggatagcggacacgcattgtcggaactcgccgtcgatggtggtatgagtaattccgatatttgcatgcagacccaggcagatattatccagatccctgttgaacggccagcgatgcacgagactaccgctctaggtgctgcaatcgcggcggcattcgccattgatatctggaaggactttagcgagctcaagaacatgaaccgcgccaatcgcacaacattccaaccccatatctccgccgcgcagagctctaagttgtataagcgatggagcaaggcagtcgagatgtctcgaggctggacagatcccgctgaagaggcagaggaggaatga

SEQ ID NO: 72467 - protein, 565 aa, Aspergillus oryzae
MRNPFDMSDLDSLVDEQEEQPYIDIHAYQTHDGNRSLLQPNENRHGDSLKDRFIGAIDTGTTSSRFIIFDCTGVPVAKYQMEFRQIHEHSGWHEQDPFDLVDSVYTCIEEAMKSFMALGHSPSEIEAIGVTSQRETTLVWDWETGEPLHNAIAWPDTRTKGLVRELKAQPGADELKNICGFPLSTYPSSVTLVWMLRNLPEVKKAYDEGRLAFGTVDTWLMYNLNGGPEGNVLVTDVTNASRTMFMNLKTLDYDDNLLEFFGIDRKKIRLPKILPSSDPDGYGWVRGGPLDGVPITSCLGDQSAALVGHCAFTPGTAKNTYGTGCFLLYNVGEEPVISKHGLLSTVGFQLGKHRKAVYALEGSVAVAGSGVSFLMNNMGFFRDSRKVSEVAATVPDSGGCVFVTAFSGLFAPYWIDDAKGTIFGITQHTQRGHIARATMEAACFQTKAILDAMEMDSGHALSELAVDGGMSNSDICMQTQADIIQIPVERPAMHETTALGAAIAAAFAIDIWKDFSELKNMNRANRTTFQPHISAAQSSKLYKRWSKAVEMSRGWTDPAEEAEEE

SEQ ID NO: 72468 - DNA, 1542 bp, Aspergillus oryzae
  CDS (1)..(1542)
atgcagccatcagagatcttcgtgggttcgattgaccagggtacgaccagtaccaggtttctgatcttcaatcgcgaaggggaaccggtggcctcgcatcaagtcgaattcccacagatctatccaaaatcagggtggcatgagcataacccacttgaccttgtgtcttccgttgaaacatgcgttgaacaagcagttaaacagtttgaatccactggatattctcgcaatgatatcaaagctgttgggattaccaaccagagagaaactaccgtcgtttgggattatgaaactggcgagccattgtgcaatgccatcgtatggacggacactcgatcacaagcgattgtcaaagacttgaaggagaaaccaggggcttcacgattacagcaaatctgtggcctcccattgtcaacctattcatcctcgtctaagctgctatggatgctcacgaacgtccccagggtcaaggatgcttatgagcgaggtacactagcttttggtacagtcgacacatggctcgtgtatcgtttgaacggtggccaccaagcaaatgtgtttgtttcggaccctaccaatgcgtcacggactatgttcatgaacctagaaactctagagtacgacaactcgctcttggacttctttgatattcgaggaagagttcatctaccaaagattgttccatcctccgataccaaagcctatggagctatctcagatggaatcctcgctggcgtccctatcatgggttgtcttggcgatcaatcctcggcacttgtaggtcaaaaagggttctcaccaggaatggcaaagaacacatacggcacagggtgtttcctcctttacaatgttggcgaaaagcctgttatttccaaacacggattattggccacagtagcctatcattttgatggaaaaccagtgtacgctctggagggaagcatcgctgttggtggctcgggagtcaagttcctgcagaacaatctcgagttcttcaaggaatccaaagaagttaacgatttggccctcacggtggaggataacggaggatgcgtttttgttactgcgttcagtggtctctttgcaccttattggattgacgacgccaaaggaaccatcttcggaattacacagtacacgaaaaaaggccacatcgccagggccacacttgaagcgacctgcttccaaacgaaggcaattttggacgcgatggaaaaagacagcggccacgcgctgtctgagctggcagttgacggaggaatgagtaactctgatcttgcaatgcagacccaagcagacctgatctccattccggtctatcgccctaagatgcgagagacgaccgcgttaggtgccgccattgctgccggtctggcggttgggctttggcgaaattttgccgaactgcgcgatatcaaccgtgctggtggtgcggtctttgaacctaggattagccgtcagcaaagtgccgagtcatttgctctctgggaaaaggcagtcgaatcagatgtctcgagcgagaccacagctctccatccgtga

SEQ ID NO: 72469 - protein, 513 aa, Aspergillus oryzae
MQPSEIFVGSIDQGTTSTRFLIFNREGEPVASHQVEFPQIYPKSGWHEHNPLDLVSSVETCVEQAVKQFESTGYSRNDIKAVGITNQRETTVVWDYETGEPLCNAIVWTDTRSQAIVKDLKEKPGASRLQQICGLPLSTYSSSSKLLWMLTNVPRVKDAYERGTLAFGTVDTWLVYRLNGGHQANVFVSDPTNASRTMFMNLETLEYDNSLLDFFDIRGRVHLPKIVPSSDTKAYGAISDGILAGVPIMGCLGDQSSALVGQKGFSPGMAKNTYGTGCFLLYNVGEKPVISKHGLLATVAYHFDGKPVYALEGSIAVGGSGVKFLQNNLEFFKESKEVNDLALTVEDNGGCVFVTAFSGLFAPYWIDDAKGTIFGITQYTKKGHIARATLEATCFQTKAILDAMEKDSGHALSELAVDGGMSNSDLAMQTQADLISIPVYRPKMRETTALGAAIAAGLAVGLWRNFAELRDINRAGGAVFEPRISRQQSAESFALWEKAVESDVSSETTALHP

SEQ ID NO: 72470 - DNA, 1713 bp, Aspergillus niger
  CDS (1)..(1713)
atgaggaaccctttcgatatggccgacctggactccgccgtcgaacaggaagaacctcagcctttcatgaacattcacgcctaccagtcgcatgatggcaatcgctccctcttacaacccaacgaaaaccgccacagtatgaaggatcgctttatcggtgccattgacactggtaccaccagctcccgtttcatcatcttcgactgcactggtgttcctgtggccaagtaccagatggaattccgccaaatccacgagaaatcaggatggcacgaacaagaccccttcgaacttgtcgattccgtatacacctgcattgaagaggctatgaagaccttcctcgcactcggccactcccgggacgatatcgaggctattggtattaccagtcaacgtgagacaaccgtgtgctgggattgggagactggcgagcctctacaccacgcaatcgcgtggccagataccagaaccactgggctggttcgagaactcaagacaaaggagggtgcggatgagctgtcaaacatttgcggccttcccctatcgacctacccttcctctgtcaccctcatgtggatgctccgcaacctccccgaggttaagagggcatatgatgagggccgccttgcttttggtaccatcgacacctggctgatatataacctgaacggtggcccggagggcggccggctggtgactgacgtcaccaacgcctcacgaaccatgttcatgaacctcgaaacgcttgattacgatgataagttgttgaaattcttcgaaattgatcggaacaagattagactgcccaagattctcccttcgtctgacccggagggctacggatgggttagagacggcccgcttgagggcattcctatcacaagctgtctcggagatcagtctgcagccttggtcggtcactgtgccttcacgcctggatctgcgaagaacacctatggcacgggctgtttccttctctacaacgttggtgagaagccagttatctccaagcatggcttgcttggcaccgtgggcttccagctgggcaagcaccgcaagccagtgtatgccttggagggcagtgtcgctgttgctggaagtggtatctctttcctgatgaacaacatgggtttcttccgtgattcccgcaaagtcagtgaggtcgctgcgaccgtccccgacagtggcggctgtgtcttcgtgacggccttcagtggtctgttcgcaccctactggattgatgatgccaagggaaccatctttggtatcacccagcacacccagcgtggacacattgcacgagccaccatggaagcggcctgcttccagaccaaggccatcttggatgccatggagatggacagtggtcacaaattgtcggaattggccgtcgatggcggtatgagcaattccgatatttgcatgcagactcaagccgatatcattcagattcccgttgaacgcccggccatgcacgagacgacggcgctgggagccgcgatcgcagctggctttgcagtcaacatctggaaggatttcagcgagctcaaggacatgaaccgggccaaccgcactaccttccttccccatgcctctccagtgcagagcaagaagatgtaccgtcaatggagcaaggccgtcgagatgtcgcgtggctggctcgacacgaacgagtcggaagaagaagaagaagaaggacagaacggtgcatag

SEQ ID NO: 72471 - protein, 570 aa, Aspergillus niger
MRNPFDMADLDSAVEQEEPQPFMNIHAYQSHDGNRSLLQPNENRHSMKDRFIGAIDTGTTSSRFIIFDCTGVPVAKYQMEFRQIHEKSGWHEQDPFELVDSVYTCIEEAMKTFLALGHSRDDIEAIGITSQRETTVCWDWETGEPLHHAIAWPDTRTTGLVRELKTKEGADELSNICGLPLSTYPSSVTLMWMLRNLPEVKRAYDEGRLAFGTIDTWLIYNLNGGPEGGRLVTDVTNASRTMFMNLETLDYDDKLLKFFEIDRNKIRLPKILPSSDPEGYGWVRDGPLEGIPITSCLGDQSAALVGHCAFTPGSAKNTYGTGCFLLYNVGEKPVISKHGLLGTVGFQLGKHRKPVYALEGSVAVAGSGISFLMNNMGFFRDSRKVSEVAATVPDSGGCVFVTAFSGLFAPYWIDDAKGTIFGITQHTQRGHIARATMEAACFQTKAILDAMEMDSGHKLSELAVDGGMSNSDICMQTQADIIQIPVERPAMHETTALGAAIAAGFAVNIWKDFSELKDMNRANRTTFLPHASPVQSKKMYRQWSKAVEMSRGWLDTNESEEEEEEGQNGA

SEQ ID NO: 72472 - DNA, 1596 bp, Pandanus amaryllifolius
  CDS (1)..(1596)
atggcgggcaggaaggaggtgttcgtggcggcgatcgaccaggggacgacgagcacgcggttcatcatctacgaccaggatgcgaaggccgtcgcctcccaccaggttgagttcactcagttctaccccgaggccgggtgggtggagcacaacccgatggagatcctggagagcgtgcgggtgtgcatggccaaggcgctggacaaggccacggccgacgggtacaacgtggacggcgggctcagggccatcgggctcaccaaccagagagagaccacggtggcgtggagcaagtccacgggtcttcccctctacaacgccatcgtctggatggacgtccgcaccagctctatctgcaggagattggagaaagagttgtcagggggaagaacccactttgtagagacctgtggcctgcccatcagcacctatttcagtgccctcaagatcctgtggttgatggagaacattagtgctgtcaaagaagccattaagttgggggatgccctgttcggcaccgtcgacacttggctgatatggaacctcactgggggttgttgcggtgtggaccgggagcagaacactgtccatggacttcatatcacggactgttcaaatgcttccaggaccatgcttatgaacctgaagacacttgattgggatcaccccacattagaaaccttgggtattcccatagaaatcttgcctaagatcattagcaattcggagaccattggtgtaattgccaatgggtggcccctatctggtattcctattgccggttgccttggggatcagcatgctgcaatgctaggccagttatgcaggaagggggaagccaagagtacctatgggacgggtgccttcattcttcttaacacaggtgaggaggtcatccagtcatctcatgggctgctcagcacacttgcttacaagttaggcccgcatgcacagacaaattatgcacttgaagggtccactgctattgctggtgcagctgttcagtggctgagggatggccttggtatcatacggtctgcagctgagattgaagaattggcagagggtgtagagaacactggaggagtgtactttgtgccagcattcaatgggctgtttgcaccttggtggcgtgaggatgcacggggggtgtgtttgggtatcacgaggttcacaaacaaggggcacatcgctcgagcagtgctagagagcatgtgcttccaggtgaaagatgtgctcaactcaatgcacaaggatgttggtgatgttggggaggcgaagaacaaggaaggcgagtttttgcttcgtgttgatgggggtgccactgttaacaatcttctgatgcagattcaggctgatctgttgggtagtccagttgtgagacctgccgacattgagactacagcccttggtgcagcatatgcagctggattagctaccggagtttggactgcagaacaaatatttgcttctgggcacatagagaaggctactgtgttccgtccaaaattggatgaggagaagaggaaaaagaggactgagtcttggtgcaaggctgtgtctagaacttttgatttggcagacctatcactttga

SEQ ID NO: 72473 - protein, 531 aa, Pandanus amaryllifolius
MAGRKEVFVAAIDQGTTSTRFIIYDQDAKAVASHQVEFTQFYPEAGWVEHNPMEILESVRVCMAKALDKATADGYNVDGGLRAIGLTNQRETTVAWSKSTGLPLYNAIVWMDVRTSSICRRLEKELSGGRTHFVETCGLPISTYFSALKILWLMENISAVKEAIKLGDALFGTVDTWLIWNLTGGCCGVDREQNTVHGLHITDCSNASRTMLMNLKTLDWDHPTLETLGIPIEILPKIISNSETIGVIANGWPLSGIPIAGCLGDQHAAMLGQLCRKGEAKSTYGTGAFILLNTGEEVIQSSHGLLSTLAYKLGPHAQTNYALEGSTAIAGAAVQWLRDGLGIIRSAAEIEELAEGVENTGGVYFVPAFNGLFAPWWREDARGVCLGITRFTNKGHIARAVLESMCFQVKDVLNSMHKDVGDVGEAKNKEGEFLLRVDGGATVNNLLMQIQADLLGSPVVRPADIETTALGAAYAAGLATGVWTAEQIFASGHIEKATVFRPKLDEEKRKKRTESWCKAVSRTFDLADLSL

SEQ ID NO: 72474 - DNA, 1560 bp, Glycine max
  CDS (1)..(1560)
atggcaaatgaagatgtgtttgttggcgcgatcgaccaaggaacgagcagcagcaggttcataatatacgacgcgaagactggagtagtaggatgccaccacgtggagttcacccagttctacccgcaagccgggtgggtggagcatgaccccatggagatcttggagagtgtgaaggtgtgcgtggccaaggccgtcgataaggccaccgctgatggcttcaacgtcgataaaggcttgaaggccattggtctcaccaatcagagagagaccactctcctctggagcaaatccaccggcctccctcttcacaacgccattgtttggatggatgctcgcacttcttccatttgcaggagattggaaaaggagttatctggcggtagaaaccattttgtggagagttgtggcttgcctattagcacatacttcagtgctttgaagctgctgtggttgatggaaaatgtagatgccgtaaaggaggccataaagaaaaaggatgcgctgtttggaactattgacacttggttgatatggaatctaactggtggggtgaatgggggattgcatgttaccgatgtttcaaatgcatctcgtacaatgctcatgaatctaaaaacccttgactgggatgcatctaccttaaaaacccttaatattcctgctgaaattttgcctaatattgttagtaatgccgaaattataggagaggttgggtctggatggccaattgctggtgtccctattgctggatgtttaggggatcaacatgctgcaatgttaggacaatcatgccgtaaaggggaggctaagagcacttatggcacaggtgctttcatactactaaatactggtgaagggataattcaatcgaagcacggtcttttatccactatagctttcaagcttggcccaaaagctccaaccaattatgcattggaaggatcagttgctattgctggagctgcagtgcagtggcttagagacggtcttggcatcatttctagtgctgcagagatagaggagatggcattacaggttgaatccactggtggggtttactttgttcctgcttttaatggattgtttgccccatggtggcgtgaggatgctcgcggggtttgtattggaataacaaggtttacaagcaagggtcacattgcccgagctgtgcttgagagcatgtgtttccaagtgaaagatgtcttggattcaatgcataaagattcaggagaaagtgaatcccaaaaaacagagtttttgcttagagtggatggtggggcaactgtaaacaacctgctgatgcagattcaggcagatttggtgggatgtccagtaattagacctgctgacatagagacaacagcacttggagcagcctatgctgccggattagctactgggatttggaaagaagattttattttcaatactgaggagaagttgaagaatgctagagttttccgtcctgtaatgactgaggaagtaaggaaaaagaaagttgactcttggtgcaaagctgttagtaaaactttcgacttagctgatcttgctatttaa

SEQ ID NO: 72475 - protein, 519 aa, Glycine max
MANEDVFVGAIDQGTSSSRFIIYDAKTGVVGCHHVEFTQFYPQAGWVEHDPMEILESVKVCVAKAVDKATADGFNVDKGLKAIGLTNQRETTLLWSKSTGLPLHNAIVWMDARTSSICRRLEKELSGGRNHFVESCGLPISTYFSALKLLWLMENVDAVKEAIKKKDALFGTIDTWLIWNLTGGVNGGLHVTDVSNASRTMLMNLKTLDWDASTLKTLNIPAEILPNIVSNAEIIGEVGSGWPIAGVPIAGCLGDQHAAMLGQSCRKGEAKSTYGTGAFILLNTGEGIIQSKHGLLSTIAFKLGPKAPTNYALEGSVAIAGAAVQWLRDGLGIISSAAEIEEMALQVESTGGVYFVPAFNGLFAPWWREDARGVCIGITRFTSKGHIARAVLESMCFQVKDVLDSMHKDSGESESQKTEFLLRVDGGATVNNLLMQIQADLVGCPVIRPADIETTALGAAYAAGLATGIWKEDFIFNTEEKLKNARVFRPVMTEEVRKKKVDSWCKAVSKTFDLADLAI

SEQ ID NO: 72476 - DNA, 1893 bp, Pichia farinosa
  CDS (1)..(1893)
atggtacgtcgtcaaagtaacgcccctacgcatccattaattgcatccattgatattggaaccacttcggcgagaaccatcttgtttgatgaacatggaaccgaaattgccaagaatcagatcgagtattctaccacggcctcggaggcgccggctgattccaaaaataaggaacaatttagaagaaggtcttccttgatgaggcataatgagcccattttcagtgctgagggtattgccatttcgattactgacgatgttatgatcgaaaacaacgctgccagcgttggtccaactttgcgttatcctaagccaggttgggttgagtgtatgcctgtgcacatattggcaaacgcggtccagtgtttagctgcatccttgataaccttgcgtaagatcaaccagaatcccgctctcaagatcaagtacaaggtgaaagcaataggtattgctaacatgagagagaccacgatcgtatggtctcgtaaaacaggaaagccattgagcaatggtatcacctggactgatacgagaactgcagaaatcgtgcagcacttagaacgtatgacagatgacgagaaaaaggctgaattgaaccagaaaaccggtttacctctttcaacctacttttcagctgccaagttacgttggttattagataatgatgatacaattagagaagagtatgagaaaggcgaaggcaatttaatgtttggaactgttgacacttggttaatctacaacatgacgaaagaaaaatcttttgtttcggatgtcacaaacgcctcaagaacatatttcatggacttggaaacgaaggattacgacgatgagttattagagttctgggacatcgatcctactaggatctgtttgccaaagattgtgtcaagttctgaattttatggttcgtttgctactcctaacttatctaacttaggattccataataagattcacaccctgggcttaagaaatcttgaagactcttactgtaccccaatttgtggttgccttggtgatcagtctgcttccttagttggccagttagcgttccgtccaggttctgccaaatgtacatatggtaccggttgtttcttgttgtataacacaggtattcgaaaattgatttcgcaacatggtgccttaagtacaatcggatactggttcccaactttatccgaagacgacgggaagccacgttacgcattggaaggttcaattgcagtcgctggttcgattattcagtggcttagagacaacttgaagcttatagagcaatcgaaagatgtaggtccattggcttccctggttcatgactccggtggtgttgtatttattcctgcattctctggtctttatgctccctactggaacagcggtgcaagaggtactatctttggtatgactcagtacacctcagctagtcatatagccagagcagcccttgaaggtgtatgtttccaagttagatctattcttaaagctatggctgacgacgctggtactagcgcggactttttggaagaagccttaaatactcagaatgagtctactcctttggccacattggcagtagatggtggtatgtccaaggcagatgaagtcttgcaaattcaagctgatattttgggaccctgtgtaactgttaagagggctcagatatctgaatgtacagcattaggtgctgcaattgctgcaggattatctttcaaagacgaaaatgaaagagtgtggaaagattttaatgatgtgtttgaaaaaattgatgctgcaaacggaaacaactccttcaaagccaagttaccagacgcagagagaagaagaaattggagaagatgggaacgtgccattgacagggctaaagattggttggatcagaacaatgactaa

SEQ ID NO: 72477 - protein, 630 aa, Pichia farinosa
MVRRQSNAPTHPLIASIDIGTTSARTILFDEHGTEIAKNQIEYSTTASEAPADSKNKEQFRRRSSLMRHNEPIFSAEGIAISITDDVMIENNAASVGPTLRYPKPGWVECMPVHILANAVQCLAASLITLRKINQNPALKIKYKVKAIGIANMRETTIVWSRKTGKPLSNGITWTDTRTAEIVQHLERMTDDEKKAELNQKTGLPLSTYFSAAKLRWLLDNDDTIREEYEKGEGNLMFGTVDTWLIYNMTKEKSFVSDVTNASRTYFMDLETKDYDDELLEFWDIDPTRICLPKIVSSSEFYGSFATPNLSNLGFHNKIHTLGLRNLEDSYCTPICGCLGDQSASLVGQLAFRPGSAKCTYGTGCFLLYNTGIRKLISQHGALSTIGYWFPTLSEDDGKPRYALEGSIAVAGSIIQWLRDNLKLIEQSKDVGPLASLVHDSGGVVFIPAFSGLYAPYWNSGARGTIFGMTQYTSASHIARAALEGVCFQVRSILKAMADDAGTSADFLEEALNTQNESTPLATLAVDGGMSKADEVLQIQADILGPCVTVKRAQISECTALGAAIAAGLSFKDENERVWKDFNDVFEKIDAANGNNSFKAKLPDAERRRNWRRWERAIDRAKDWLDQNND

SEQ ID NO: 72478 - DNA, 1539 bp, Streptomyces avermitilis
  CDS (1)..(1539): transl_table=11
gtgaccgacgcacacaccgccggccccttcatcgccgcgatcgaccagggcaccacgtccagccgttgcatcgtcttcgaccgggacggccgtatcgtctccgtcgaccagaaggagcacgagcagatcttcccgaagccgggctgggtcgagcacaacgccgccgagatctggaccaacgtccaggaggtcgtcgccggagccgtcgagaaggccggcatcacccgcgacgacatcaaggccatcggcatcaccaaccagcgcgagaccacgctgctctgggacaagaacaccggtgagcccgtccacaacgccctcgtctggcaggacacccgcaccgacgcgctctgcaaggaactcggccgcaacgtcggccaggaccgcttccgccgcgagaccggcctgccgctcgcgtcgtacttcgccggcccgaaggcccgctggctgctggacaacgtcgagggcctgcgcgagcgcgccgaagccggcgacatcctcttcggcaccatggacacctgggtcatctggaacctgacgggtggtgtcaacggcggcaagcacgtcaccgacgtcaccaacgcctcccgcaccatgctgatgaacctgcacaccatgcagtgggacgacaagatcgccgagtccatcggtgtcccgctggcgatgctgcccgagatccgctcctccgccgaggtgtacggcgagatcaccggcggcaagctcggcgacctgctcggcggcatccccgtcgcctccgcgctcggcgaccagcaggcggccctgttcggccagacctgtttctccgagggcgaggccaagtccacgtacggcaccggcacgttcatgctgatgaacaccggtgacaagatcatcaactcgtacagcgggctgctgaccaccgtgggctaccagatcggcgaccagaagccggtctacgccctcgagggttccatcgccgtcaccggttcgctcgtgcagtggatgcgcgaccagatgggcctgatcaagtccgccgccgagatcgagacgctcgcgtcgtcggtcgaggacaacggcggcgcctacttcgtgccggccttctccggtctgttcgccccgtactggcgctccgacgcccgcggtgtgatcgccggtctcacccggtacgtcaccaaggcgcacatcgcgcgcgccgtcctggaggccacggcctggcagacccgcgagatcaccgacgccatgacgaaggactccggcgtcgagctcgcggccctcaaggtcgacggcggcatgacctccaacaacctgctgatgcagacgctctcggacttcctggacgcgccggtggtgcgtccgatggtcgccgagaccacctgcctcggcgccgcctacgccgccggtctcgccgtcggcttctggaccaacaccgaggacctgcgggccaactggcgcagggccgcggagtggaccccgaacatggccgcggagacccgcgaccgtgagtacaagagctggctcaaggccgtcgagcggaccatgggctggatcgaggacgaggagtaa

SEQ ID NO: 72479 - protein, 512 aa, Streptomyces avermitilis
MTDAHTAGPFIAAIDQGTTSSRCIVFDRDGRIVSVDQKEHEQIFPKPGWVEHNAAEIWTNVQEVVAGAVEKAGITRDDIKAIGITNQRETTLLWDKNTGEPVHNALVWQDTRTDALCKELGRNVGQDRFRRETGLPLASYFAGPKARWLLDNVEGLRERAEAGDILFGTMDTWVIWNLTGGVNGGKHVTDVTNASRTMLMNLHTMQWDDKIAESIGVPLAMLPEIRSSAEVYGEITGGKLGDLLGGIPVASALGDQQAALFGQTCFSEGEAKSTYGTGTFMLMNTGDKIINSYSGLLTTVGYQIGDQKPVYALEGSIAVTGSLVQWMRDQMGLIKSAAEIETLASSVEDNGGAYFVPAFSGLFAPYWRSDARGVIAGLTRYVTKAHIARAVLEATAWQTREITDAMTKDSGVELAALKVDGGMTSNNLLMQTLSDFLDAPVVRPMVAETTCLGAAYAAGLAVGFWTNTEDLRANWRRAAEWTPNMAAETRDREYKSWLKAVERTMGWIEDEE

SEQ ID NO: 72480 - DNA, 1521 bp, Leifsonia xyli subsp
  CDS (1)..(1521): transl_table=11
atggctgaatacatcgtcgctatcgaccaaggcacaacaagcacccgggcgatcatcttcgacaagtccgggtcgatcgtctcgaccgggcaattggagcacgagcagatcttcccgaagccgggctgggtcgagcacaaccccgtcgagatctggaacaacacccgcgaggtcatcgggcaggcgctctcgaaggccgatctgacccgccacgacatcgcggcggtgggcatcaccaaccagcgcgagaccgcggtggtgtgggacaagaacaccggggagccggtctacaacgcgatcgtctggcaggacacccgaacgcagccgatcgtggaccggctcgccgcggagggcggcgtcgagcgcttcaagccgatcgtgggcctcccgctcgcgacctatttctcgggaaccaagatcgtgtggatactcgagaacgtcgagggagtccgcgagcgcgccgaacgcggcgatctgctgttcggcaccaccgaaagctgggtcctctggaacctcaccggtggcaccgacggcggtgtgcatgccaccgatgtgaccaacgcctcccgcaccctgttcatggacctggagacgctgagctggcgggacgacatcctcgacgtgttcggggtgcccaagtcgatgctcccggagatcaagagctcttccgaggtctacggcgcggtcgagtcgtcgagcttgctccgcgaggtgcccgtggcgggcatcctgggcgaccagcaggccgctacgttcggccaggcggcgttcgatccgggtgagtccaagaacacctacggcaccggcaacttcctcatcttcaacacaggggaagagatcgtccactccaagaacggcctcctcaccacgctcggctacaagctgggcgacggcaaaccgcactacgccctggagggctcgatcgctgtcaccggttcgctggtgcagtggctgcgcgacaacctcggcgtcatctcgagcgctcccgagatcgaggagctggcccaaacggtcgaggacaacggcggcgcttacttcgtgccggcgttgtccgggctgttcgcaccgtactggcgcgcggacgcacgcggtgcgctcgtgggtctgacccgctatgtgaacaagggccacatcgcccgcgccgccctggaagcgaccgcgtttcagacccgtgaggtgctggacgcggtgaacgcggactcgggcgtcgacctcacggagctgaaggtggacggcggcatgatcgccaacaacaccctgatgcagttccaggccgacatcctgggcgttcccgtcgtccgtccggtcgtcgccgagaccaccgctctcggcgccgcctacgccgccggcctcgctaccggcttctgggagaacctggacgatctgcgcaagaactggaaggaggaccgccgctgggagcccaagatggatgccgccgagcgcgaccgccagctccgcctctggaagaaggccgtgacgaagaccttcgactgggtggacgacgacgtgcgcaacggctga

SEQ ID NO: 72481 - protein, 506 aa, Leifsonia xyli subsp
MAEYIVAIDQGTTSTRAIIFDKSGSIVSTGQLEHEQIFPKPGWVEHNPVEIWNNTREVIGQALSKADLTRHDIAAVGITNQRETAVVWDKNTGEPVYNAIVWQDTRTQPIVDRLAAEGGVERFKPIVGLPLATYFSGTKIVWILENVEGVRERAERGDLLFGTTESWVLWNLTGGTDGGVHATDVTNASRTLFMDLETLSWRDDILDVFGVPKSMLPEIKSSSEVYGAVESSSLLREVPVAGILGDQQAATFGQAAFDPGESKNTYGTGNFLIFNTGEEIVHSKNGLLTTLGYKLGDGKPHYALEGSIAVTGSLVQWLRDNLGVISSAPEIEELAQTVEDNGGAYFVPALSGLFAPYWRADARGALVGLTRYVNKGHIARAALEATAFQTREVLDAVNADSGVDLTELKVDGGMIANNTLMQFQADILGVPVVRPVVAETTALGAAYAAGLATGFWENLDDLRKNWKEDRRWEPKMDAAERDRQLRLWKKAVTKTFDWVDDDVRNG

SEQ ID NO: 72482 - DNA, 1527 bp, Mycobacterium leprae
  CDS (1)..(1527): transl_table=11
ttggccgagttcgctgaattcatagccgccatcgaccagggcaccaccagcacccgctgcgtgattttcgatcataatggtgctgaggtggcccgccaccagcttgagcacgagcaaatcttgccccgctccggctgggtcgaacataatcccgttgagatttgggaacgcaccgcgtcagtgctgatgtcggtgctgaacgccactaatttgtcagctaaagatattgcagcgcttggaattactaaccaacgtgagactaccctggtgtggaatcggaacaccggaaggccgtattgcaatgcgatcgtttggcaagacacccgcactgaccgtatcgcggtcgcgcttgaccgagatggccgcggagaggtgatccgccgcaaagccgggttgccgccggcgacctatttttccggcgggaaattgcaatggatcttagagaacgtcgacggggtaggcgccgctgctgaaaacggtgaagcactcttcggcacccccgatacctggttattgtggaatctgaccggtggtccgcggggtggcgtacacgtcaccgatgtgaccaacgctagccggaccatgctgatggacttagagaagctggattgggacgacgagctgttgtcgtttttttccatccctcgggcgatgttgccggcgatcgcgtcgtcttcaccgctgcagccctacggtgtcactttagcggacggacccgtcggtggtgaagtgccgatcacaggagtcttgggcgatcagcatgcggcgatggttggtcaggtgtgtctagacgcgggggaagcgaaaaacacttacggcaccggcaattttttgctgcttaacaccggtgaggctatcgtgagatccggtaacggcctgttgaccaccgtttgctatcagttcggggatgccaaacccgtctacgcgcttgaaggttcgatcgcggtgactggctcagcggtgcagtggttacgtgatcagttgggcatcatcagcggcgctgctcaaagcgaatcgctggcccgtcaggtcgttgacaatggcggggtgtacttcgtaccggcattttccgggttgttttccccgtattggcggtccgatgcacgaggcgcaattgtggggctatcacggttcaacaccaacgcgcatctggcccgcgcgacgttggaagctatctgttatcagagtcgggacgtggtggacgcgatggcagcagattctggtgtgcgccttgatgtcttgaaggtcgatggtggtatcaccagtaatgacttgtgcatgcagattcaggccgacgtgctgggcgtggacgtggtacgctcggtagttgctgagactactgcgctgggctctgcctatgcggcgggtctagcggtcgggttttgggctggtccgtcagatctacgggccaattggcaagaggataagcgttggacgccgacgtggggcgaggaccagcgtgccgcggcgtatgcgggttggcgtaaagccgtgcagcggacgttggattgggtcgatgtgtcctga

SEQ ID NO: 72483 - protein, 508 aa, Mycobacterium leprae
MAEFAEFIAAIDQGTTSTRCVIFDHNGAEVARHQLEHEQILPRSGWVEHNPVEIWERTASVLMSVLNATNLSAKDIAALGITNQRETTLVWNRNTGRPYCNAIVWQDTRTDRIAVALDRDGRGEVIRRKAGLPPATYFSGGKLQWILENVDGVGAAAENGEALFGTPDTWLLWNLTGGPRGGVHVTDVTNASRTMLMDLEKLDWDDELLSFFSIPRAMLPAIASSSPLQPYGVTLADGPVGGEVPITGVLGDQHAAMVGQVCLDAGEAKNTYGTGNFLLLNTGEAIVRSGNGLLTTVCYQFGDAKPVYALEGSIAVTGSAVQWLRDQLGIISGAAQSESLARQVVDNGGVYFVPAFSGLFSPYWRSDARGAIVGLSRFNTNAHLARATLEAICYQSRDVVDAMAADSGVRLDVLKVDGGITSNDLCMQIQADVLGVDVVRSVVAETTALGSAYAAGLAVGFWAGPSDLRANWQEDKRWTPTWGEDQRAAAYAGWRKAVQRTLDWVDVS

SEQ ID NO: 72484 - DNA, 1554 bp, Mycobacterium tuberculosis
  CDS (1)..(1554): transl_table=11
gtgtccgacgccatcctaggagagcaattggccgagtcctcggatttcatagccgccatcgaccagggcaccaccagcacccgctgcatgatcttcgatcaccacggtgccgaggtggcccgccaccagctcgagcacgagcagatcctgccccgggccggctgggtggagcacaacccggtcgagatctgggagcgcaccgcgtcggtgttgatctcggtgctcaacgccaccaacctatcgccgaaagatattgccgcgttggggattaccaaccaacgtgagacgacgctggtatggaatcggcacaccggacggccctactacaacgcgattgtatggcaggatacccgcaccgaccgcatcgcgtcggcgctggatcgagacggtcgtggaaacctgatccgccgcaaggcgggcctgccgccggcaacttatttctctggcggcaagctgcagtggatcctggaaaatgtcgatggagtccgcgcggccgccgagaacggcgacgcattgttcggcacaccggacacctgggtgttgtggaatctgaccggcgggccgcgggggggtgtgcatgtcaccgatgtaaccaacgccagccggaccatgttgatggatctagagacgctggactgggacgacgagctgttgtcgttgttttcgatacctcgggccatgctgcccgagatcgcatcgtcggcgccgtcggagccttacggtgtcacgctggcgaccgggcctgtcggcggtgaggtgccgatcaccggagttctcggtgatcagcatgcggccatggtcggtcaagtctgtctggccccaggggaggcgaaaaacacctatgggaccggcaattttctgctgctgaacaccggtgaaacgatcgtgcgatcgaataacggcctgctaaccacggtgtgctaccaattcgggaacgctaaacccgtgtacgcgcttgaaggttcgatcgcggtgaccggctcggcggtgcagtggctacgcgatcagctgggcatcatcagcggcgccgcacagagtgaggcgctggcccgccaggtccccgacaacggcggcatgtatttcgtgccggcgttttccgggctgttcgcgccatactggcggtccgatgcgcgcggcgcgatcgtcgggttgtcgcggttcaacaccaacgcgcacctggcgcgcgcaacgctggaggcgatctgctaccagagccgcgatgtggtggacgccatggaagcagactccggtgttcgcctgcaggtgttgaaggtggatggcgggatcaccggcaacgacctgtgtatgcagatccaggccgacgtgttgggtgtggatgtggtgcggccggtggtcgccgagaccaccgcactaggtgtggcctacgcggcgggcttggcggtcgggttctgggcggctccgtccgatctgcgggccaactggcgagaggacaagcggtggacaccgacgtgggacgacgacgagcgtgccgcgggttatgccggctggcgcaaggcggtgcagcggaccctggattgggttgacgtgtcctag

SEQ ID NO: 72485 - protein, 517 aa, Mycobacterium tuberculosis
MSDAILGEQLAESSDFIAAIDQGTTSTRCMIFDHHGAEVARHQLEHEQILPRAGWVEHNPVEIWERTASVLISVLNATNLSPKDIAALGITNQRETTLVWNRHTGRPYYNAIVWQDTRTDRIASALDRDGRGNLIRRKAGLPPATYFSGGKLQWILENVDGVRAAAENGDALFGTPDTWVLWNLTGGPRGGVHVTDVTNASRTMLMDLETLDWDDELLSLFSIPRAMLPEIASSAPSEPYGVTLATGPVGGEVPITGVLGDQHAAMVGQVCLAPGEAKNTYGTGNFLLLNTGETIVRSNNGLLTTVCYQFGNAKPVYALEGSIAVTGSAVQWLRDQLGIISGAAQSEALARQVPDNGGMYFVPAFSGLFAPYWRSDARGAIVGLSRFNTNAHLARATLEAICYQSRDVVDAMEADSGVRLQVLKVDGGITGNDLCMQIQADVLGVDVVRPVVAETTALGVAYAAGLAVGFWAAPSDLRANWREDKRWTPTWDDDERAAGYAGWRKAVQRTLDWVDVS

SEQ ID NO: 72486 - DNA, 1488 bp, Thermus brockianus
  CDS (1)..(1488): transl_table=11
atgaaataccttttagccctagaccaaggcaccacgtccagctgggccattctcttcaccctggagggggaggtggtggccgtggcgcagcgggcctttgcccagcactaccccgagccaggcttggtggagcacgatccttgggagatctgggagagccagctttgggcggccaaggaggccctgcgccgggcgggggtggggccggaggcggtgctggccctgggcatcgccaaccagcgggagaccaccctggtgtgggagagggatacggggcggcccctccaccccgccatcgtctggcaggaccgcaggaccgcttccctttgcgaggccctgcgggagcgggggttggaggggcttttccgggcgcgcacggggctcctgctggacccctacttctccgccaccaagctcctttggcttttggagcgcgtgcctgggctaagggagcgtgcggagaggggagaggtgtgcttcggcaccgtggacacctggctcctttggaacctcacggggggcagggtccacgccaccgaccccaccaacgccagccgcaccctcctcttccacctggaaaccctgacctgggacgaggaactcctccgcgtgctaggtatcccgaaggccctcctccccgaggtgcggccctcggacggggactttggcgagaccctgcccgggcttttgggggcccctattcccatccgaggggtcctgggggaccagcaggcggcccttctggggcaggcggccttgggggcgggggaggggaagtgcacctacggcacgggggcgttcctcctcctaaacacgggggagcggcccgtctgggcggaggggggcctcctcaccaccttggcctggcacctggagggcaaggcggcctacgccctggagggaagcgtcttcgtggcgggggcggcggtggggtggcttagggaggtgggcctccttggggaaagccacgaggtggagagcctagcccggcaggtggaggatgcgggcggggtctacttcgtccccgccttcacggggcttggggccccccactgggacccctacgcccggggggccatcctggggcttacccgggggacaacccgggcccacctggcccgggcggccctggagggggtggccttctccgtgggggaggtggcctgggccatggcgggggcggcggggctagggctcaaggccctgaaggcggacgggggcatggcgcagaacgaccttttcctggagatccaggcggaccttctgggggtgccggtgctgaggccaagggtcacggagaccaccgccctgggggcggcgtgggcgcgcgggatcggggcgggggcgctttccctgggggaccttcccgccctttggcgggaagaggcccggttcctgccccggatgccggaggcgaggcgggaggccctttaccggggctggcgtcgggcggtggaacgggccaagggctgggtccaggaggggtag

SEQ ID NO: 72487 - protein, 495 aa, Thermus brockianus
MKYLLALDQGTTSSWAILFTLEGEVVAVAQRAFAQHYPEPGLVEHDPWEIWESQLWAAKEALRRAGVGPEAVLALGIANQRETTLVWERDTGRPLHPAIVWQDRRTASLCEALRERGLEGLFRARTGLLLDPYFSATKLLWLLERVPGLRERAERGEVCFGTVDTWLLWNLTGGRVHATDPTNASRTLLFHLETLTWDEELLRVLGIPKALLPEVRPSDGDFGETLPGLLGAPIPIRGVLGDQQAALLGQAALGAGEGKCTYGTGAFLLLNTGERPVWAEGGLLTTLAWHLEGKAAYALEGSVFVAGAAVGWLREVGLLGESHEVESLARQVEDAGGVYFVPAFTGLGAPHWDPYARGAILGLTRGTTRAHLARAALEGVAFSVGEVAWAMAGAAGLGLKALKADGGMAQNDLFLEIQADLLGVPVLRPRVTETTALGAAWARGIGAGALSLGDLPALWREEARFLPRMPEARREALYRGWRRAVERAKGWVQEG

SEQ ID NO: 72488 - DNA, 24 bp, Artificial sequence
  primer
atgtttccctctctcttccgactt

SEQ ID NO: 72489 - DNA, 26 bp, Artificial sequence
  primer
ttattggaagttttctagaacctgtt

SEQ ID NO: 72490 - protein, 657 aa, Artificial sequence
  consensus sequence
  Variant (3)..(3): Xaa in position 3 is any amino acid
  Variant (8)..(8): Xaa in position 8 is any amino acid
  Variant (10)..(23): Xaa in position 10 to 23 is any amino acid
  Variant (25)..(25): Xaa in position 25 is any amino acid
  Variant (27)..(31): Xaa in position 27 to 31 is any amino acid
  Variant (32)..(96): Xaa in position 32 to 96 is any or no amino acid
  Variant (98)..(99): Xaa in position 98 to 99 is any amino acid
  Variant (104)..(105): Xaa in position 104 to 105 is any amino acid
  Variant (107)..(132): Xaa in position 107 to 132 is any amino acid
  Variant (133)..(142): Xaa in position 133 to 142 is any or no amino acid
  Variant (144)..(144): Xaa in position 144 is any amino acid
  Variant (146)..(146): Xaa in position 146 is any amino acid
  Variant (154)..(155): Xaa in position 154 to 155 is any amino acid
  Variant (157)..(159): Xaa in position 157 to 159 is any amino acid
  Variant (162)..(162): Xaa in position 162 is any amino acid
  Variant (164)..(167): Xaa in position 164 to 167 is any amino acid
  Variant (168)..(168): Xaa in position 168 is any or no amino acid
  Variant (172)..(172): Xaa in position 172 is any amino acid
  Variant (174)..(174): Xaa in position 174 is any amino acid
  Variant (177)..(182): Xaa in position 177 to 182 is any amino acid
  Variant (184)..(196): Xaa in position 184 to 196 is any amino acid
  Variant (197)..(199): Xaa in position 197 to 199 is any or no amino acid
  Variant (203)..(204): Xaa in position 203 to 204 is any amino acid
  Variant (205)..(205): Xaa in position 205 is any or no amino acid
  Variant (210)..(211): Xaa in position 210 to 211 is any amino acid
  Variant (213)..(214): Xaa in position 213 to 214 is any amino acid
  Variant (216)..(218): Xaa in position 216 to 218 is any amino acid
  Variant (220)..(229): Xaa in position 220 to 229 is any amino acid
  Variant (231)..(233): Xaa in position 231 to 233 is any amino acid
  Variant (234)..(235): Xaa in position 234 to 235 is any or no amino acid
  Variant (239)..(239): Xaa in position 239 is any amino acid
  Variant (241)..(241): Xaa in position 241 is any amino acid
  Variant (244)..(246): Xaa in position 244 to 246 is any amino acid
  Variant (250)..(251): Xaa in position 250 to 251 is any amino acid
  Variant (252)..(265): Xaa in position 252 to 265 is any or no amino acid
  Variant (267)..(267): Xaa in position 267 is any amino acid
  Variant (269)..(270): Xaa in position 269 to 270 is any amino acid
  Variant (276)..(277): Xaa in position 276 to 277 is any amino acid
  Variant (279)..(279): Xaa in position 279 is any amino acid
  Variant (281)..(281): Xaa in position 281 is any amino acid
  Variant (284)..(285): Xaa in position 284 to 285 is any amino acid
  Variant (287)..(289): Xaa in position 287 to 289 is any amino acid
  Variant (291)..(294): Xaa in position 291 to 294 is any amino acid
  Variant (296)..(299): Xaa in position 296 to 299 is any amino acid
  Variant (300)..(301): Xaa in position 300 to 301 is any or no amino acid
  Variant (304)..(304): Xaa in position 304 is any amino acid
  Variant (306)..(307): Xaa in position 306 to 307 is any amino acid
  Variant (309)..(312): Xaa in position 309 to 312 is any amino acid
  Variant (313)..(314): Xaa in position 313 to 314 is any or no amino acid
  Variant (316)..(324): Xaa in position 316 to 324 is any amino acid
  Variant (325)..(345): Xaa in position 325 to 345 is any or no amino acid
  Variant (348)..(348): Xaa in position 348 is any amino acid
  Variant (350)..(350): Xaa in position 350 is any amino acid
  Variant (355)..(355): Xaa in position 355 is any amino acid
  Variant (358)..(359): Xaa in position 358 to 359 is any amino acid
  Variant (362)..(365): Xaa in position 362 to 365 is any amino acid
  Variant (366)..(366): Xaa in position 366 is any or no amino acid
  Variant (368)..(368): Xaa in position 368 is any amino acid
  Variant (371)..(371): Xaa in position 371 is any amino acid
  Variant (377)..(377): Xaa in position 377 is any amino acid
  Variant (379)..(379): Xaa in position 379 is any amino acid
  Variant (381)..(381): Xaa in position 381 is any amino acid
  Variant (383)..(383): Xaa in position 383 is any amino acid
  Variant (385)..(389): Xaa in position 385 to 389 is any amino acid
  Variant (391)..(392): Xaa in position 391 to 392 is any amino acid
  Variant (394)..(394): Xaa in position 394 is any amino acid
  Variant (396)..(396): Xaa in position 396 is any amino acid
  Variant (398)..(407): Xaa in position 398 to 407 is any amino acid
  Variant (408)..(419): Xaa in position 408 to 419 is any or no amino acid
  Variant (426)..(426): Xaa in position 426 is any amino acid
  Variant (428)..(429): Xaa in position 428 to 429 is any amino acid
  Variant (431)..(434): Xaa in position 431 to 434 is any amino acid
  Variant (439)..(450): Xaa in position 439 to 450 is any amino acid
  Variant (451)..(451): Xaa in position 451 is any or no amino acid
  Variant (454)..(455): Xaa in position 454 to 455 is any amino acid
  Variant (457)..(459): Xaa in position 457 to 459 is any amino acid
  Variant (462)..(463): Xaa in position 462 to 463 is any amino acid
  Variant (466)..(466): Xaa in position 466 is any amino acid
  Variant (469)..(469): Xaa in position 469 is any amino acid
  Variant (472)..(472): Xaa in position 472 is any amino acid
  Variant (475)..(475): Xaa in position 475 is any amino acid
  Variant (477)..(479): Xaa in position 477 to 479 is any amino acid
  Variant (483)..(485): Xaa in position 483 to 485 is any amino acid
  Variant (487)..(494): Xaa in position 487 to 494 is any amino acid
  Variant (496)..(496): Xaa in position 496 is any amino acid
  Variant (500)..(500): Xaa in position 500 is any amino acid
  Variant (503)..(506): Xaa in position 503 to 506 is any amino acid
  Variant (508)..(514): Xaa in position 508 to 514 is any amino acid
  Variant (516)..(517): Xaa in position 516 to 517 is any amino acid
  Variant (519)..(519): Xaa in position 519 is any amino acid
  Variant (521)..(525): Xaa in position 521 to 525 is any amino acid
  Variant (526)..(546): Xaa in position 526 to 546 is any or no amino acid
  Variant (548)..(548): Xaa in position 548 is any amino acid
  Variant (553)..(559): Xaa in position 553 to 559 is any amino acid
  Variant (562)..(562): Xaa in position 562 is any amino acid
  Variant (566)..(570): Xaa in position 566 to 570 is any amino acid
  Variant (571)..(572): Xaa in position 571 to 572 is any or no amino acid
  Variant (574)..(574): Xaa in position 574 is any amino acid
  Variant (576)..(579): Xaa in position 576 to 579 is any amino acid
  Variant (581)..(581): Xaa in position 581 is any amino acid
  Variant (588)..(588): Xaa in position 588 is any amino acid
  Variant (592)..(592): Xaa in position 592 is any amino acid
  Variant (594)..(596): Xaa in position 594 to 596 is any amino acid
  Variant (597)..(602): Xaa in position 597 to 602 is any or no amino acid
  Variant (604)..(633): Xaa in position 604 to 633 is any amino acid
  Variant (634)..(652): Xaa in position 634 to 652 is any or no amino acid
  Variant (654)..(655): Xaa in position 654 to 655 is any amino acid
IDXGTTSXRXXXXXXXXXXXXXXQXEXXXXXXXXXXXXXXXXXXXXXXXXXXXXXXXXXXXXXXXXXXXXXXXXXXXXXXXXXXXXXXXXXXXXXXPXXGWVEXXPXXXXXXXXXXXXXXXXXXXXXXXXXXXXXXXXXXXXAXGXTNQRETTXXWXXXTGXPXXXXXIVWXDXRTXXXXXXLXXXXXXXXXXXXXXXXGLPXXXTYFSXXKXXWXXXNXXXXXXXXXXGXXXXXFGTXDXWLXXXLTGXXXXXXXXXXXXXXXXVXDXXNASRTXXMXLXTLXXDXXXLXXXXIXXXXXXLPXIXXSXXXXXXGXXXXXXXXXXXXXXXXXXXXXXXXXXXXXXPIXGXLGDQXAAXXGQXXXXXGXAKXTYGTGXFXLXNXGXXXXXSXXGXLXTXXXXXXXXXXXXXXXXXXXXXXYALEGSXAXXGXXXXWLRDXXXXXXXXXXXXXLAXXVXXXGGXXFVXAFXGLXAPXWXXXARGXXXGXXXXXXXXHXARAXLEXXXXQXXXXXXXMXXDXGXXXXXXXXXXXXXXXXXXXXXXXXXXLXVDGGXXXXXXXMQXQADXXXXXXXVXRXXXXEXTALGAAXAAGXAXXXXXXXXXWXXXXXXXXXXXXXXXXXXXXXXXXXXXXXXXXXXXXXXXXXXXXXXXXXWXXAV

SEQ ID NO: 72491 - protein, 58 aa, Artificial sequence
  protein pattern
  Variant (3)..(4): Xaa in position 3 to 4 is any amino acid
  Variant (5)..(5): Xaa in position 5 is Phe, Ile or Leu
  Variant (7)..(7): Xaa in position 7 is Pro or Thr
  Variant (10)..(10): Xaa in position 10 is Ala, Asn, Ser or Thr
  Variant (13)..(13): Xaa in position 13 is any amino acid
  Variant (16)..(16): Xaa in position 16 is His, Trp or Tyr
  Variant (18)..(19): Xaa in position 18 to 19 is any or no amino acid
  Variant (21)..(22): Xaa in position 21 to 22 is any or no amino acid
  Variant (24)..(24): Xaa in position 24 is Lys or Arg
  Variant (25)..(25): Xaa in position 25 is Ala or Gly
  Variant (26)..(28): Xaa in position 26 to 28 is any amino acid
  Variant (30)..(30): Xaa in position 30 is Ile, Leu or Met
  Variant (31)..(31): Xaa in position 31 is Ser or Thr
  Variant (32)..(32): Xaa in position 32 is Gln, Arg or Ser
  Variant (33)..(33): Xaa in position 33 is any amino acid
  Variant (34)..(34): Xaa in position 34 is Asn, Thr or Val
  Variant (35)..(37): Xaa in position 35 to 37 is any amino acid
  Variant (39)..(39): Xaa in position 39 is Ile, Leu or Val
  Variant (40)..(40): Xaa in position 40 is Ala or Val
  Variant (43)..(43): Xaa in position 43 is Ala, Thr or Val
  Variant (44)..(44): Xaa in position 44 is Ile, Leu, Met or Val
  Variant (46)..(46): Xaa in position 46 is Ala, Gly or Ser
  Variant (47)..(47): Xaa in position 47 is any amino acid
  Variant (48)..(48): Xaa in position 48 is Ala or Cys
  Variant (49)..(49): Xaa in position 49 is Phe, Trp or Tyr
  Variant (50)..(50): Xaa in position 50 is Gln or Ser
  Variant (51)..(51): Xaa in position 51 is Ala, Ser, Thr or Val
  Variant (52)..(52): Xaa in position 52 is any amino acid
  Variant (53)..(53): Xaa in position 53 is Ala, Asp or Glu
  Variant (54)..(54): Xaa in position 54 is Ile, Leu or Val
  Variant (55)..(56): Xaa in position 55 to 56 is any amino acid
  Variant (57)..(57): Xaa in position 57 is Ala or Ser
GGXXXVXAFXGLXAPXWXXDXXAXXXXXGXXXXXXXXHXXRAXXEXXXXXXXXXXXXM

SEQ ID NO: 72492 - protein, 34 aa, Artificial sequence
  protein pattern
  Variant (2)..(2): Xaa in position 2 is any amino acid
  Variant (5)..(5): Xaa in position 5 is Cys, Asn or Ser
  Variant (11)..(11): Xaa in position 11 is Ala, Cys or Asn
  Variant (13)..(13): Xaa in position 13 is any or no amino acid
  Variant (16)..(16): Xaa in position 16 is any or no amino acid
  Variant (18)..(18): Xaa in position 18 is Ala, Thr or Val
  Variant (20)..(24): Xaa in position 20 to 24 is any amino acid
  Variant (26)..(27): Xaa in position 26 to 27 is any amino acid
  Variant (29)..(29): Xaa in position 29 is any amino acid
  Variant (30)..(30): Xaa in position 30 is Leu or Val
  Variant (31)..(31): Xaa in position 31 is Ala, Gly, Ser or Thr
  Variant (33)..(33): Xaa in position 33 is Phe, Ile, Leu or Val
  Variant (34)..(34): Xaa in position 34 is Ala, Cys, Gly or Ser
GXAKXTYGTGXFXLLXNXGXXXXXSXXGXXXTXX

SEQ ID NO: 72493 - protein, 40 aa, Artificial sequence
  protein pattern
  Variant (3)..(6): Xaa in position 3 to 6 is any amino acid
  Variant (8)..(8): Xaa in position 8 is Ala, Ser or Thr
  Variant (10)..(10): Xaa in position 10 is any amino acid
  Variant (11)..(11): Xaa in position 11 is Ile, Leu or Met
  Variant (12)..(12): Xaa in position 12 is Phe, Ile, Leu or Val
  Variant (13)..(13): Xaa in position 13 is Phe or Tyr
  Variant (14)..(14): Xaa in position 14 is Asp, Asn or Ser
  Variant (15)..(16): Xaa in position 15 to 16 is any amino acid
  Variant (17)..(17): Xaa in position 17 is Ala, Gly or Thr
  Variant (18)..(19): Xaa in position 18 to 19 is any amino acid
  Variant (20)..(20): Xaa in position 20 is Ile or Val
  Variant (21)..(21): Xaa in position 21 is Ala, Glu, Gly or Ser
  Variant (22)..(25): Xaa in position 22 to 25 is any amino acid
  Variant (27)..(27): Xaa in position 27 is Phe, His or Tyr
  Variant (28)..(28): Xaa in position 28 is any amino acid
  Variant (29)..(29): Xaa in position 29 is Asn, Gln or Thr
  Variant (30)..(39): Xaa in position 30 to 39 is any amino acid
  Variant (40)..(40): Xaa in position 40 is Asp, Gly, Asn or Pro
IDXXXXSXRXXXXXXXXXXXXXXXXEXXXXXXXXXXXXXX

SEQ ID NO: 72494 - protein, 23 aa, Artificial sequence
  protein pattern
  Variant (2)..(3): Xaa in position 2 to 3 is any amino acid
  Variant (9)..(9): Xaa in position 9 is any amino acid
  Variant (10)..(10): Xaa in position 10 is Phe or Leu
  Variant (12)..(12): Xaa in position 12 is Asp or Asn
  Variant (14)..(17): Xaa in position 14 to 17 is any amino acid
  Variant (18)..(18): Xaa in position 18 is Trp or Tyr
  Variant (20)..(22): Xaa in position 20 to 22 is any amino acid
  Variant (23)..(23): Xaa in position 23 is Ala, Leu or Val
DXXNASRTXXMXLXXXXXDXXXX

SEQ ID NO: 72495 - protein, 19 aa, Artificial sequence
  protein pattern
  Variant (2)..(2): Xaa in position 2 is Ile, Leu or Val
  Variant (3)..(3): Xaa in position 3 is Ala or Thr
  Variant (4)..(4): Xaa in position 4 is Asp, Asn or Ser
  Variant (5)..(5): Xaa in position 5 is any amino acid
  Variant (10)..(10): Xaa in position 10 is Ile, Leu or Val
  Variant (11)..(11): Xaa in position 11 is any amino acid
  Variant (13)..(13): Xaa in position 13 is Asp, Glu, Asn or Ser
  Variant (14)..(15): Xaa in position 14 to 15 is any amino acid
  Variant (18)..(18): Xaa in position 18 is any amino acid
GXXXXRETTXXWXXXTGXP

SEQ ID NO: 72496 - protein, 19 aa, Artificial sequence
  protein pattern
  Variant (2)..(2): Xaa in position 2 is Ile, Leu or Val
  Variant (3)..(3): Xaa in position 3 is any amino acid
  Variant (4)..(4): Xaa in position 4 is Gly or Ser
  Variant (5)..(5): Xaa in position 5 is any amino acid
  Variant (6)..(6): Xaa in position 6 is Ala or Leu
  Variant (10)..(10): Xaa in position 10 is any amino acid
  Variant (11)..(11): Xaa in position 11 is any or no amino acid
  Variant (13)..(14): Xaa in position 13 to 14 is any amino acid
  Variant (15)..(15): Xaa in position 15 is any or no amino acid
  Variant (17)..(18): Xaa in position 17 to 18 is any amino acid
  Variant (19)..(19): Xaa in position 19 is Ala, Cys or Gly
PXXXXXGDQXXAXXXGXXX

SEQ ID NO: 72497 - protein, 19 aa, Artificial sequence
  protein pattern
  Variant (2)..(5): Xaa in position 2 to 5 is any amino acid
  Variant (6)..(6): Xaa in position 6 is any or no amino acid
  Variant (9)..(9): Xaa in position 9 is Ala or Ser
  Variant (10)..(10): Xaa in position 10 is Ala, Cys or Gly
  Variant (11)..(11): Xaa in position 11 is any amino acid
  Variant (13)..(13): Xaa in position 13 is Ala, Ile, Leu or Val
  Variant (14)..(14): Xaa in position 14 is any amino acid
  Variant (16)..(16): Xaa in position 16 is any or no amino acid
  Variant (18)..(18): Xaa in position 18 is any amino acid
  Variant (19)..(19): Xaa in position 19 is Asp, Glu or Asn
LXXXXXYFXXXKXXWXLXX

SEQ ID NO: 72498 - protein, 18 aa, Artificial sequence
  protein pattern
  Variant (5)..(5): Xaa in position 5 is any amino acid
  Variant (6)..(6): Xaa in position 6 is Cys, Ser, Thr or Val
  Variant (7)..(7): Xaa in position 7 is any amino acid
  Variant (8)..(8): Xaa in position 8 is Ala, Asn, Ser or Thr
  Variant (9)..(9): Xaa in position 9 is Asp, Gly, Asn or Gln
  Variant (10)..(11): Xaa in position 10 to 11 is any amino acid
  Variant (12)..(12): Xaa in position 12 is Leu or Met
  Variant (14)..(14): Xaa in position 14 is any amino acid
  Variant (16)..(16): Xaa in position 16 is Ala or Ser
  Variant (18)..(18): Xaa in position 18 is Ile, Leu or Val
VDGGXXXXXXXXQXQXDX

SEQ ID NO: 72499 - protein, 22 aa, Artificial sequence
  protein pattern
  Variant (2)..(2): Xaa in position 2 is any amino acid
  Variant (3)..(3): Xaa in position 3 is Lys or Arg
  Variant (4)..(4): Xaa in position 4 is Ala, Pro or Ser
  Variant (5)..(7): Xaa in position 5 to 7 is any amino acid
  Variant (9)..(9): Xaa in position 9 is any or no amino acid
  Variant (11)..(11): Xaa in position 11 is any or no amino acid
  Variant (16)..(16): Xaa in position 16 is Ala or Gly
  Variant (17)..(17): Xaa in position 17 is any amino acid
  Variant (18)..(18): Xaa in position 18 is Ala or Leu
  Variant (20)..(20): Xaa in position 20 is Ala, Cys, Gly or Asn
  Variant (21)..(21): Xaa in position 21 is Phe, Leu or Met
  Variant (22)..(22): Xaa in position 22 is Ala or Ser
VXXXXXXEXTXALGAXXXAXXX

SEQ ID NO: 72500 - DNA, 1542 bp, Saccharomyces cerevisiae
  CDS (1)..(1542)
atgactgctggttctgccccccctgttgattacacttccttaaagaagaacttccaaccgtttctctccagaagagtagaaaatagatctctgaaaagcttttgggatgcttctgatatctcagatgacgtcattgagctagctggtggaatgccaaacgagagattttttcctatcgaatctatggatttgaaaatatcaaaagttccttttaatgataacccaaaatggcataattcgtttaccacggcgcatttggacttgggatcccccagtgagctacccattgcacgttctttccaatatgcagaaaccaagggtttaccccctctcttacattttgttaaagattttgtgtccagaattaatcgcccagccttttccgatgagacggagtctaactgggatgtcatcctttctggcgggtccaacgattcaatgtttaaggtttttgaaacaatttgcgacgaatcgaccactgtgatgattgaagagtttactttcaccccggctatgtccaatgtggaggctacaggagcaaaagtcatccccatcaagatgaacctgaccttcgacagagagtcccagggtattgatgtcgaatatctaacgcagttgctcgataattggtcaactggaccatacaaagacttaaacaagccaagggtcctatataccattgcaacgggccaaaatcctaccgggatgtctgtcccccagtggaaaagagagaaaatttaccagttggcccaaagacacgatttcctcattgttgaagatgatccctacggttatctgtactttccttcctataatccgcaagagccattagaaaacccttaccattctagcgacctgactactgaacggtatttgaatgattttttaatgaaatcattcttgactttggatacagatgcccgtgtcatccgtttggagactttttctaaaatttttgctcctggattaaggttatccttcatcgttgctaataaattccttttgcaaaaaatcttggatttggccgacattactacaagggcccccagtggtacctcacaagctattgtttattctacaataaaggcaatggctgagtccaacttatcgtcctctctttctatgaaagaagcaatgtttgagggttggataagatggataatgcagattgcttctaaatacaatcataggaaaaatcttactttgaaagccttatacgaaacagaatcttaccaagctggtcagtttaccgttatggaaccctccgcgggtatgttcatcattattaaaatcaattgggggaatttcgatagacctgacgatttgccgcaacagatggatattttagataagttcttgctgaagaatggtgttaaagtagtgcttggttataaaatggctgtttgcccaaattattcaaagcagaattcagattttctaagactcaccatcgcctatgcaagggatgatgatcagttgattgaagcttccaaaagaatcggtagtggcataaaagaattttttgacaactataaaagttga

SEQ ID NO: 72501 - protein, 513 aa, Saccharomyces cerevisiae
MTAGSAPPVDYTSLKKNFQPFLSRRVENRSLKSFWDASDISDDVIELAGGMPNERFFPIESMDLKISKVPFNDNPKWHNSFTTAHLDLGSPSELPIARSFQYAETKGLPPLLHFVKDFVSRINRPAFSDETESNWDVILSGGSNDSMFKVFETICDESTTVMIEEFTFTPAMSNVEATGAKVIPIKMNLTFDRESQGIDVEYLTQLLDNWSTGPYKDLNKPRVLYTIATGQNPTGMSVPQWKREKIYQLAQRHDFLIVEDDPYGYLYFPSYNPQEPLENPYHSSDLTTERYLNDFLMKSFLTLDTDARVIRLETFSKIFAPGLRLSFIVANKFLLQKILDLADITTRAPSGTSQAIVYSTIKAMAESNLSSSLSMKEAMFEGWIRWIMQIASKYNHRKNLTLKALYETESYQAGQFTVMEPSAGMFIIIKINWGNFDRPDDLPQQMDILDKFLLKNGVKVVLGYKMAVCPNYSKQNSDFLRLTIAYARDDDQLIEASKRIGSGIKEFFDNYKS

SEQ ID NO: 72502 - DNA, 1203 bp, Sulfolobus tokodaii str. 7
  CDS (1)..(1203): transl_table=11
atgttcgaaagatttctttcaaaagacgtatcaaatttaaggtcgtcagaaattagagatttattaaaactgactgaaggaaaaaaagttattagtttagctggcggtttaccagatcctactacttttcccgttgaagagattagaaaaataactgacgatgtactcagagaaaaatctgatagagccctacaatattcaacaacgtctgggataactgagttcaaaaaagagcttgttaacctatcaagatacagaggaataagcggtataaatgaaaataatacattcgtaactgtaggaagccaagaagccttatttatgatatttaatctcctagtagatccaggagatactgtaatcgtggaaatgcccacatatcttgctgcacttaatattcttagagcaagaaaacccaatttcattggcgtccatcttacacaaaatggtccagaccttgatgaattagagagaaaagtaaaagagagcataagtaatggcaaaaaaccgaagctaatgtatgttatacctacagctcaaaaccctggaggaacaacaatgagtttagatgataggaaaagacttcttgaaatagctcaaaaatacgactttttacttatagaagatgatgcttatggctttttagtttttgacggagaagcaccaccaccacttataagtttagataaagaaggaagagtaatatatacatctacattcagtaaaattttagctccaggtttaagattaggatgggttatagcacaagaagagtttattagagaaatggagttatacaagcagaatatagatttgcatactcctacacttactcaaatgatagcaatggaggcaataaagagaggagttatacaaaatcagttaccattgattagaagagtatatagagaaaaaagagatgtaatgctagcagcaatagagaaatacttcccgaaagaagctacgtggagcagaccagttggaggaatgtttgtttttgcctggttaccagaaaaaatagatacagtaaagatgttagaggaaagcatgagaagaggagtagcctatgttcctggatctagtttctaccatgattattctgggagaaatactatgagattaaacttcagctatcctactaagcaagaactagaagaaggtattaaaatcctaggaaatactatattagattttcttaaataa

SEQ ID NO: 72503 - protein, 400 aa, Sulfolobus tokodaii str. 7
MFERFLSKDVSNLRSSEIRDLLKLTEGKKVISLAGGLPDPTTFPVEEIRKITDDVLREKSDRALQYSTTSGITEFKKELVNLSRYRGISGINENNTFVTVGSQEALFMIFNLLVDPGDTVIVEMPTYLAALNILRARKPNFIGVHLTQNGPDLDELERKVKESISNGKKPKLMYVIPTAQNPGGTTMSLDDRKRLLEIAQKYDFLLIEDDAYGFLVFDGEAPPPLISLDKEGRVIYTSTFSKILAPGLRLGWVIAQEEFIREMELYKQNIDLHTPTLTQMIAMEAIKRGVIQNQLPLIRRVYREKRDVMLAAIEKYFPKEATWSRPVGGMFVFAWLPEKIDTVKMLEESMRRGVAYVPGSSFYHDYSGRNTMRLNFSYPTKQELEEGIKILGNTILDFLK

SEQ ID NO: 72504 - DNA, 1413 bp, Schizosaccharomyces pombe 972h-
  CDS (1)..(1413)
atggataatttaaaaaaaaaatatcaacatcatttatccctagaaagcgcatcccgtgagtatggtccgtttcagatgttaggtcgtattcaaagtgactcggatatcaaaatgctttcctttgctggtggagaacccaatcccagtaaattcccgattcataaactttcggtctccttcccagaagtaaattcttgggaaaaagacacgaacaaggacgcaactgtgtcttatgaattaagtaataatgcaaatgagggttctctggatttactgggagctttacagtacggccagtgccaaggaattccagaattggtcaagtttataaaagatcacgttggacaaatccacatgccacaatataaggactgggatataaaaataacaaatggaaatacgatcggccttgagtattgcttgcgattgctcgtcaaccgtggtgattgtattctcatagaaaaatatacataccctgccgcaattaccgcaatgcgtccccttggtgtgaaatttattcccattgacatggatgaaaacggcatgctaccagaaagttttgagaaagttatggaaacatgggattcatcgttaggagcaaggccccatgttttgtatactataccgactgggcaaaacccaactggatccacgttaactttggaaagaagaaagaagtttctaaccttggcaaaaaaatacgatattatcattgtcgaagatgaaccatactattttttgcaaatggaaaaatatgatgcaaattggaaacctgacaagcaagctttcaatatttcgtcattcaaaaaaaagctaattccctctttactccatctagataccgacggtagggttttgcgagttgattccttttccaaattgattgtaccgggattacgtttgggatggataactggaaattctctattcatcgatcgcataacccgttacgcagaagtttgtactgagagcccatccggcgtctctcaagtggttctctatgctatattaaatcgttggggacaaaatggttttttggagtggctacaagatttgcaaaactcatatactatgcgtcgaaatgctcttcttttggcagctgacaaacatcttccaaaatctgtttgtaaatatcattctcctaaagctggattgtttctatgggttgaacttgacaaaaaccgtcttatttgctcaaatatggacaagtccatttcggaaattgagatggaaatttttgtagaacttgttaacaatggggtaaagcctgtttgtggacagctatttatgggagaaccaaattcggcggacaaaattttttttcgatttgcttattcccttgctgacctaagcacttttgaagctggtttagagcggtttactagtactatacaaaaatattttcaattgtga

SEQ ID NO: 72505 - protein, 470 aa, Schizosaccharomyces pombe 972h-
MDNLKKKYQHHLSLESASREYGPFQMLGRIQSDSDIKMLSFAGGEPNPSKFPIHKLSVSFPEVNSWEKDTNKDATVSYELSNNANEGSLDLLGALQYGQCQGIPELVKFIKDHVGQIHMPQYKDWDIKITNGNTIGLEYCLRLLVNRGDCILIEKYTYPAAITAMRPLGVKFIPIDMDENGMLPESFEKVMETWDSSLGARPHVLYTIPTGQNPTGSTLTLERRKKFLTLAKKYDIIIVEDEPYYFLQMEKYDANWKPDKQAFNISSFKKKLIPSLLHLDTDGRVLRVDSFSKLIVPGLRLGWITGNSLFIDRITRYAEVCTESPSGVSQVVLYAILNRWGQNGFLEWLQDLQNSYTMRRNALLLAADKHLPKSVCKYHSPKAGLFLWVELDKNRLICSNMDKSISEIEMEIFVELVNNGVKPVCGQLFMGEPNSADKIFFRFAYSLADLSTFEAGLERFTSTIQKYFQL

SEQ ID NO: 72506 - DNA, 1425 bp, Schizosaccharomyces pombe 972h-
  CDS (1)..(1425)
atggctgctcaacctaaagacctttcacaccacttgtctgtggaaagtgcaagtcgtaaacaatctccacttaaagctgtcgctctttccaaaagcagccgcaatattaaaatcatttctttggctggcggtttgcctaaccctgaatactttcccattcgtgagatggatgcggagattcctgctataaactcttggaagaaggattcttcaaacagtggaaagctcgataccgtttctgttcctatgagctctagtgattctgatgtccttcctcttagtgtcgctttgcagtacggccagggttctggtgctgctttactttcccaatttttaaaggaacacactcgcatcattcataatcctccttatgaaggttggaacatcattatgactaccggtaatacttcatgcctagacatcgctcttcgtatgttgaccaatcgaggcgattccattttggtagagaaatactccttcccttccgcattacaaagcatgcgtcctcttggtttaagctgcattcctattgatatggaccagtttggttttttaccagagtctatggatgatattttgactaattgggatgctacttcctacggttctcctaaaccccacgtactttacactattcctactggtcaaaatcccactggtagtactctttctgtggagaggagaaagcaaatttacactctggcacaaaagcatgatattattatcctagaggatgaaccttactattacttacaaatggacgcttatgaaggaaaaccagaagctgctgataaagcttttaccaacgagcaatttgtaaaagaacttattccttcattcttaagtatggatgtcgacggtcgtgtcatccgtatggattctctgtcaaaggttgtagcccctggttctcgtgtaggttggttcactgctcaaccgttgttcattgaacgtggtttgcgtgctgctgaaactgcaactcaaagtgcttctggtatttcccaaggcatcctgtatgccatgttcaagcattggggtcaagacggatacctagagtggttgaagcatattcggtattcttatacgcttcgccgtaattatcttctttatgccatggacacatacttaccaaaatcggtctgctcttatatccctcctgtcgctggtatgtttatttggttcgaagttgacaaatcgcgctacatccatgccgataaaaatgaatctattcccgaaatcgaatctaaaatccatgctgaagctgttgaagaaggcgttaaccttgcttgcggtaactggttcgttgttgaccctagagtcaacgataagattttcttccgtgtgacatttgctcacgctgaattagaagaatttaatgttgccattgaacgttttgcgggcgttttgaagaataatttcaaatgctga

SEQ ID NO: 72507 - protein, 474 aa, Schizosaccharomyces pombe 972h-
MAAQPKDLSHHLSVESASRKQSPLKAVALSKSSRNIKIISLAGGLPNPEYFPIREMDAEIPAINSWKKDSSNSGKLDTVSVPMSSSDSDVLPLSVALQYGQGSGAALLSQFLKEHTRIIHNPPYEGWNIIMTTGNTSCLDIALRMLTNRGDSILVEKYSFPSALQSMRPLGLSCIPIDMDQFGFLPESMDDILTNWDATSYGSPKPHVLYTIPTGQNPTGSTLSVERRKQIYTLAQKHDIIILEDEPYYYLQMDAYEGKPEAADKAFTNEQFVKELIPSFLSMDVDGRVIRMDSLSKVVAPGSRVGWFTAQPLFIERGLRAAETATQSASGISQGILYAMFKHWGQDGYLEWLKHIRYSYTLRRNYLLYAMDTYLPKSVCSYIPPVAGMFIWFEVDKSRYIHADKNESIPEIESKIHAEAVEEGVNLACGNWFVVDPRVNDKIFFRVTFAHAELEEFNVAIERFAGVLKNNFKC

SEQ ID NO: 72508 - DNA, 1446 bp, Schizosaccharomyces pombe 972h-
  CDS (1)..(1446)
atgatccggaatagtgaggattttagccatcatttgtcgagagaaagcaaggctcgtgagaaaggcccttttcaaatgttaggaagaattaaaagtagtacagggattgacgctatatctttttcctcaggtttacctcatcctaacaagtttgctatccgtgagctttctatcaagtttcctcaacttggttgctttaaggaggaaaatgggacatacgccaaagaggttaatgtaacatttaacataaaagctgatccttctgagggtcttttaaatttctctcagtccttgcagtatggccaatgccaaggaatttctgaattggtgggatttataaaggaacacattcggcggattcatgctccccgatacgaaaactgggatattaagatgagtaatggtaatacaagtggtttggaatattgtttacgactgctagtcaattatggggatcatgtcttgacagaaaagtacacttatcctgctgccatcaccgcaatgcgagccctaggtgttcaatttgtatctgttgatatggattcggaaggtatgcttcctgaaagtcttgaagaaattatgagagactgggatatatctctgggacctagacctcatgtcttgtacacagttcctactggtcaaaatcctactggttctactttgtcattaagtcggcgcaaaaagcttttagcattagcaaggaaatacgatatcatcatcgttgaagatgagccatactattttctacaaatggaagattataacggaagtttaaaccctgcacagcaaaaatgtgatgggtcaacgtttttaaagagtttggtcccttcattgctaagtttagacacagaaggtcgagttttgcgacttgattcgttctctaaactgattgctccaggaacccgccttggctatattactggaaattcaatgtttattgatcatattacacggattgcagaagtatgcacggaaagcccgtctggtatttgccaatctgtattgtatgcaatgctgcataattggggtcaagagggcttttgtgcatggttacaggagctgcaatattcttatactgttcgtcgaaacgcattccttaatgtagcaaacaagtatctaccaaattctgtttgtatttatcacgtaccaagagctggattattcttgtgggttgagttaaacttaaatcattaccgcttttcggatacgaaaaagtcagtttcccaaattgaaatggaaatattcctagcgcttgtagaaaaaggtgtaaaaactgtttgtggtcagttttttatggcaaatccagaacgtagtactaagatctttttccgtttcgcatattcaattgctgactttgaggactttgaggagggaattaagcgatttacatcagtcataaatgagcattttaatgtcgaaagcagagtacgaatctgcccttga

SEQ ID NO: 72509 - protein, 481 aa, Schizosaccharomyces pombe 972h-
MIRNSEDFSHHLSRESKAREKGPFQMLGRIKSSTGIDAISFSSGLPHPNKFAIRELSIKFPQLGCFKEENGTYAKEVNVTFNIKADPSEGLLNFSQSLQYGQCQGISELVGFIKEHIRRIHAPRYENWDIKMSNGNTSGLEYCLRLLVNYGDHVLTEKYTYPAAITAMRALGVQFVSVDMDSEGMLPESLEEIMRDWDISLGPRPHVLYTVPTGQNPTGSTLSLSRRKKLLALARKYDIIIVEDEPYYFLQMEDYNGSLNPAQQKCDGSTFLKSLVPSLLSLDTEGRVLRLDSFSKLIAPGTRLGYITGNSMFIDHITRIAEVCTESPSGICQSVLYAMLHNWGQEGFCAWLQELQYSYTVRRNAFLNVANKYLPNSVCIYHVPRAGLFLWVELNLNHYRFSDTKKSVSQIEMEIFLALVEKGVKTVCGQFFMANPERSTKIFFRFAYSIADFEDFEEGIKRFTSVINEHFNVESRVRICP

SEQ ID NO: 72510 - DNA, 1494 bp, Eremothecium gossypii
  CDS (1)..(1494)
atgacagtgacactaccaccggcgcaagacttctcgtacaagttcagcgaagagacgaaggcgcgcataccctcgcccctcaagacttgtcttcgctactacaatgatcccgacatcatatttcttggcggcgggctgccccgcagcgagctgttcccctgggacagcgtcagcgcgagctgcgcggcgccgccgttcaaaacgggaacggcgggcggcatgcagctgcacgtggccaaaagtggacagagcgccaacgcggtcgtcagcggcgcgcgcgacgtgccgctcgagcgggcgctgcagtacgggttctcgcaggggcagccggagttgatggacttcgtgcgggagcacacgcggcgcttgcatcgcatgcagtacgcggactgggacgtgctggcgacggtcggcaacacgtcggcatgggaatcgacgctgcgggtgttctgtaaccgcggagacacgatcctggcggaggagtacacgttttcgtcgtcgctggtggcggcggaggcacagggcgtgcgcgcgtacccagtgccgctggacgagaacgggatggtgccagagcggctgggcgagctactggataactgggagcggtggcacgacggcgtgccacggcccaagctgctgtacacggtgccgacggggcagaaccccacgggcacgtgcctgtcgaacgatcggcgccaggcggtataccgcctggcgcagcagcacgacctgctgatcgtggaggacgagccgtattacttcctgcaactggacccctatgaggcggacgcgggacggcgggcgccgcgcgtgtttgcgagccacgaggagtttgtgggctcgctggtgcggtcgtttctgtcgctggacaccgacgggcgcgtgttgcgtctggactcgttctccaaggtgctggcgccgggcacgcgcctgggatggattgcgggcgccaagcagctgctgcaggcgtacctggcattgctggagttgactgtgcaggcgccgtccggtttcacgtcgtcgcttatcgcggggacgctgacgcggtggggacaggagcactacatcgactggctgatcgagctgcggcgcgagtacacgcacctgcgagacgttgtgatggacgcgctgcaccgctacattccggcgaagccgtgggtgcgcgtcaacccgacggaggcgggcatgttcttcactgtacacttgaacgcggccgcgcacccacgttttgtgtcggagtacgagtcgcagcctgagcgggtagagtgggcactctacgagaagatgatcgcccacggtgtactggcggttccgggcatgtggttccggactggcggtaaggatccctcccgctcgcgccaggctggtgacacaaacaacatattcttccgcggcaccttcgccgcagtggaggaggataagctcgtagttgggatccagcggcttggtagcatgctggccgaggagttcggctgttctggttttgcgcgctga

SEQ ID NO: 72511 - protein, 497 aa, Eremothecium gossypii
MTVTLPPAQDFSYKFSEETKARIPSPLKTCLRYYNDPDIIFLGGGLPRSELFPWDSVSASCAAPPFKTGTAGGMQLHVAKSGQSANAVVSGARDVPLERALQYGFSQGQPELMDFVREHTRRLHRMQYADWDVLATVGNTSAWESTLRVFCNRGDTILAEEYTFSSSLVAAEAQGVRAYPVPLDENGMVPERLGELLDNWERWHDGVPRPKLLYTVPTGQNPTGTCLSNDRRQAVYRLAQQHDLLIVEDEPYYFLQLDPYEADAGRRAPRVFASHEEFVGSLVRSFLSLDTDGRVLRLDSFSKVLAPGTRLGWIAGAKQLLQAYLALLELTVQAPSGFTSSLIAGTLTRWGQEHYIDWLIELRREYTHLRDVVMDALHRYIPAKPWVRVNPTEAGMFFTVHLNAAAHPRFVSEYESQPERVEWALYEKMIAHGVLAVPGMWFRTGGKDPSRSRQAGDTNNIFFRGTFAAVEEDKLVVGIQRLGSMLAEEFGCSGFAR

SEQ ID NO: 72512 - DNA, 1539 bp, Eremothecium gossypii
  CDS (1)..(1539)
atgacacaggaggatcagcagaataaagccaaggacctcaggcacctcctcagtcgagaggcgcttcggcggcggccgtcgccaatcaaaacgacgatggcgtactttggggaggcgggaatggtgtttttaggagcgggaatgccgcccgcagagctctttcctatcagcgcagtcagcgtggaggtgcctgtgccaggagaggacggacagacattagtgggacgcattccgaagggagcgggggagcgggagtttgcccgggacgtgccgttatcgcgggcattgcagtacggcaactcgcgggggcagagcgagctcgtggaattcttgcgacagcacacggagaagttccacaagctccgttacgcggactgggacgtgctcgtgacggcggggtccacgcaggcgtgggacgcgactatgcgcttgttctgcaacgagggcgactcggtggtcatggaggcgttcacatactcgtcgtcggtggaggcagcggaggcgcaggggctctactgtgtagggatggaggtggacagcgaaggcattgttccagagcggctcgcggagctcttggcggagtgggacacacagcacgcgggccacgcgcggccgcgcgtgctctatacgatccccacggggcagaacccgatgggcagcacgctcgtggacgcgcggaaggcgcagatctaccgccttgcgcagcaatacgacatgttgattgttgaggacgacccgtactactttttgcaaatggatgcctacgacgccgcaggcccgcgcggcatagaggcctacgagggcgcgcgtgcggcgttgcgcgcagaccacgcgcgtttcgcctcgagcctctcccgctccttccttgactgggacaccgacgggcgcgttgtgcgcttggagtccacttccaaggtctttgctccgggctgtcgcactggctggatcgtcggtgcccgcgcattgctcgaccagtactggtatctccaggaggtgtccgtgcagtccacctgcggctttgcacaagccattctcagcggtatgttgaaccgctggggccaggaccgctacaccaactggctcatcgatctccggctcgagtacacggcccgccgtgaccactgcctagactgttgtcataagtaccttccagattttgtgcacgtcgagccgccacaggcgggcatgttcttcatgcttgtcctagatgccgcgcttcaccctggatttgcctctgacttctcgtcctcgcctcagcgtctcgagactcatctctacgacaccttcatcaagaacggagtgcttttggcctgtggctcctggtttgctgtcaaccgcagcccctccaagggcacgtctatttacttccgtggcacatacgctgcagtcgatcccgcctccatggaggcgggcatcaagtgtattgcccagacactactcaaggagtttggacactgtgccacctcttgttcgtattatacgtacgagcagcgcattcctgcacgcatttctagctacgtatctaacggtcttgactag

SEQ ID NO: 72513 - protein, 512 aa, Eremothecium gossypii
MTQEDQQNKAKDLRHLLSREALRRRPSPIKTTMAYFGEAGMVFLGAGMPPAELFPISAVSVEVPVPGEDGQTLVGRIPKGAGEREFARDVPLSRALQYGNSRGQSELVEFLRQHTEKFHKLRYADWDVLVTAGSTQAWDATMRLFCNEGDSVVMEAFTYSSSVEAAEAQGLYCVGMEVDSEGIVPERLAELLAEWDTQHAGHARPRVLYTIPTGQNPMGSTLVDARKAQIYRLAQQYDMLIVEDDPYYFLQMDAYDAAGPRGIEAYEGARAALRADHARFASSLSRSFLDWDTDGRVVRLESTSKVFAPGCRTGWIVGARALLDQYWYLQEVSVQSTCGFAQAILSGMLNRWGQDRYTNWLIDLRLEYTARRDHCLDCCHKYLPDFVHVEPPQAGMFFMLVLDAALHPGFASDFSSSPQRLETHLYDTFIKNGVLLACGSWFAVNRSPSKGTSIYFRGTYAAVDPASMEAGIKCIAQTLLKEFGHCATSCSYYTYEQRIPARISSYVSNGLD

SEQ ID NO: 72514 - DNA, 1680 bp, Gibberella zeae PH-1
  CDS (1)..(1680)
atgctttcagctgtaagaacagccaggcttagatcattgatcaaacacagccgtacgattcatagcagttcgaaacatctgtcaagcactgaagctgccccggctgctcgtccagcacactatgacacctcccagaagctttcagctatcgatgcggtaaaagagagacgactcaaggccggaaagctggtcgctggagttgctgccgcttctgatagtgatatgttcaaaggcccgacgacagggctgcccaagtctaagcgatgggataaccatctcagtcatgagagcaaagtaagagagccatgtacacttaaacaagcagctcgccatatgaagaagcccggtctcatctccctagggggcggcttaccatccagcgaagtcttccccttcgccgagctcggcttcaaggtcccagtggctcccaaattctcagagaaggacacggaagaatcaggccaaaccgtcacaattggaaaatacgacgttagagaccgtgggggtacttatgatttgtccatcgcctgcaactacggacaagctacagggtcccctcagatgatgagatacctgacggagcacactgagattgtgtacaaacccccttatgcagactggaaagtttgtcaaactattggaagtaccggagcactagaagaggcactacggatgttctgtgataaggaccgtggtgattctgtactcaccgaagactttagcttctcaaccgccttggaaaccgttggacctcttggcatcaaggcctttggtgtttccattgacgagcagggcctgattccagaggctatggatgagcttctgtcgaactgggatgctaaagagcgaggctcccgaaaacctcatctgctatacaccgtcccctcaggccagaaccccacaggtgcaacgcaagggaccgaaagacgcaaggcgatttacgccgtggcacagaagcacgatatatacatcatcgaagacgagccgtattacttcctccagatgcaaccctacacaggccgcaaccaacccgatgttccgccaccaaagacggtagatgaatttgtctcatcactcattccttcgcttctgagcatagatgttgatggtcgagttatgcgcatggactcgttctcaaaagtgcttgtcccaggatctcgtctaggatggatcactgcatcggagcagatcgtagagagatacattcgacacgctgaagttgcgagtcaaggcccaagtggcttctcacaggtcattctgtataagttgctcgacgagacgtggggacatgagggatacttgagatggttgatgaacttgcggctggagtataccaagaagcgagatgctctcctggccgcatgcgaagatcatctaccaagtgatctcgccagctggacgcctcccgtagctggcatgtttatgtggatcaatattgattatacaaagcatcccgacgcaggaaagcgaagtatcgtcgatatagaagaggaaatcttcaacttatgcattgagaatggcgtgctaatcgctagaggctcgtggttcttgactgaaaaggacaaggcaccaccaggactgttctttagggcgacgtacgcatctgctacacctgagaatatgaacaaggctattgagaggtttggaaaagctgttagggatagctttggacgaaagtaa

SEQ ID NO: 72515 - protein, 559 aa, Gibberella zeae PH-1
MLSAVRTARLRSLIKHSRTIHSSSKHLSSTEAAPAARPAHYDTSQKLSAIDAVKERRLKAGKLVAGVAAASDSDMFKGPTTGLPKSKRWDNHLSHESKVREPCTLKQAARHMKKPGLISLGGGLPSSEVFPFAELGFKVPVAPKFSEKDTEESGQTVTIGKYDVRDRGGTYDLSIACNYGQATGSPQMMRYLTEHTEIVYKPPYADWKVCQTIGSTGALEEALRMFCDKDRGDSVLTEDFSFSTALETVGPLGIKAFGVSIDEQGLIPEAMDELLSNWDAKERGSRKPHLLYTVPSGQNPTGATQGTERRKAIYAVAQKHDIYIIEDEPYYFLQMQPYTGRNQPDVPPPKTVDEFVSSLIPSLLSIDVDGRVMRMDSFSKVLVPGSRLGWITASEQIVERYIRHAEVASQGPSGFSQVILYKLLDETWGHEGYLRWLMNLRLEYTKKRDALLAACEDHLPSDLASWTPPVAGMFMWINIDYTKHPDAGKRSIVDIEEEIFNLCIENGVLIARGSWFLTEKDKAPPGLFFRATYASATPENMNKAIERFGKAVRDSFGRK

SEQ ID NO: 72516 - DNA, 1515 bp, Candida glabrata CBS 138
  CDS (1)..(1515)
atgactctgccagaatctaaagatttcacttacttcttctctgaagaaaccaaggctcgtaagccttctccattaaagacatgcattcaatacttttctgatcctaacatgatctttcttggtggtggtcttccaatgagtgcttacttcccttgggataacttggctgctgatacaccattgccacctttcaccaatggtatcggtgcaactataaccggctctcaagaagacacctcaaagttttcagtcaagaaggaatctaaagtccatgaaggtgacattcctctggctcgttccttgcaatatggtaagagtatgggtcaaccagaattgactgatttcttgaaggagcacactaagatgattcacgatatgaaatacagcgactgggatgttgttgctactacaggtaacaccaacgcttgggaatccaccttaagagtcttctgtaacagaggcgatgttattcttgctgaagctcactcattctcttcttctttagcttctgcagaagcccagggtatcattactttcccagttcctatcgatgctcacggtattattccagaaaagctagaagcattgctggacaactggaccgagggtgctccaaagccaaagctattgtataccattccaacgggccaaaacccaacagggtcttctttgaatgccgaaagaaagaaggagatttacagaattgctcaaaagcatgacttcttgattatagaggacgaaccatactacttcttgcaagttggtgaatatatcagtgacctaagtaagagagctgaagttgcccaaaagaacgcaaacatttcacatgaagatttcctaaagtcactagctcttactttcttgtctgttgataccgatggtagagtcatcagaatggactctttctccaaggttttagctccaggtactagattgggttggattactggttcatctaaactactccaagcatacttaagtctacatgaaatgactattcaatctccatccggtttctctcaatctcttgtgagtggtactttgaaccgttggggccaaaagggttacattgactggttgatcggtctacgtcatgaatacactgccaagcgtgaccattgtattgactccttgtataaattcattccaaaggataacaacaaagaaggtaaaccaatttttactatcaacccaccaattgctggtatgttctttactgttgacatggacgctagcgcccatcctgaatttgctaccacttacgaatcagatccaaccaaggttgaagaagcattatatcaaaaggttatcaagtctggtgtcctagtcgttccaggtatatggttcaaggccgatggtgaaactacaccagctcaaccagcttcatcaaaggaaaaccctaacccaaaccaaattttcttcagaggtacttacgctgctgttgaaccttctaagctggacgaaggtttgaagagattaggccaatgtctacgtgaagaatttcaattggcataa

SEQ ID NO: 72517 - protein, 504 aa, Candida glabrata CBS 138
MTLPESKDFTYFFSEETKARKPSPLKTCIQYFSDPNMIFLGGGLPMSAYFPWDNLAADTPLPPFTNGIGATITGSQEDTSKFSVKKESKVHEGDIPLARSLQYGKSMGQPELTDFLKEHTKMIHDMKYSDWDVVATTGNTNAWESTLRVFCNRGDVILAEAHSFSSSLASAEAQGIITFPVPIDAHGIIPEKLEALLDNWTEGAPKPKLLYTIPTGQNPTGSSLNAERKKEIYRIAQKHDFLIIEDEPYYFLQVGEYISDLSKRAEVAQKNANISHEDFLKSLALTFLSVDTDGRVIRMDSFSKVLAPGTRLGWITGSSKLLQAYLSLHEMTIQSPSGFSQSLVSGTLNRWGQKGYIDWLIGLRHEYTAKRDHCIDSLYKFIPKDNNKEGKPIFTINPPIAGMFFTVDMDASAHPEFATTYESDPTKVEEALYQKVIKSGVLVVPGIWFKADGETTPAQPASSKENPNPNQIFFRGTYAAVEPSKLDEGLKRLGQCLREEFQLA

SEQ ID NO: 72518 - DNA, 1614 bp, Candida glabrata CBS 138
  CDS (1)..(1614)
atggcttcatgcatagcctgcgatgacacatatatagttttcatatacattttcttacatagcagctttgtaccaattaggatactacaagcgatgacgacgatgattgatttagaggaaaagtttggacagtttttgtcctggaggatgcagaacaggaagttggtggctttctgggatgatgaagtgttgggtgacgatgtcattgagttgaccgccggtatgcccaacgagcagtttttccccatcaaggccatggacatgaccattgtcaacaagccatttgagtcagccgatgacacctctaagcacctgcactgtaagatgtccacttacgagcccaagagtttgcccatcgctagaagtttccagtacaacgaggtgccaggtttgccccagatcagaaactttgccaagtacttggtcaacaagatcaacaagccagcttactctgctgatcagtgggatgtgctgttgtcctcgggctcgtgtgactccatgttcaagttctttgagtgtttctgtgatgagaaatccacagtgcttatggaagagttcacattcacaccggtgatctctcacgtcaaggccactggtgctgaatgtatcccattgaagatgaacttgaccaaggatccaagcactcaaggtatcgatgtcgactacctgactcaattgctagacaactggtcctcaggcccttacaaacacttgaacaagccaagaattctttacaccatatgcactgggcaaaacccaactggtgtcaccatcccaatggagaaccgtaggaagatttacgagttggctcataagcataacttcttgatcttggaggatgacccatacggatatttgtcatttccatcttataaaccggaggacccattgaagaacgattatctagaagacggcttcacagtggaaaagtacactaacgaattcctagtggactcgttcttgaccatcgatacggacgctcgtgttattcgtatggagaccttctcaaaagtatttgcacctggcctaagactggggttcatcgtggctaacaagtatatcatcagcaacttgcttgaatacgccgagatcaccactagggcaccaagtggtgtctctcaggccgtgctgtacaacactttggagaccatggcgctataccaagatggcgatgacaaggaagacccagagaaaaagcaagaggcgctgttccaaggttggatgcattggatcatgaaggtggctgctgagtacacccacagaagaaacataacattgaaggcactatatgagaccgatgcctacaagaacggcctgttcacagtgatcgagccatctgctggtatgtttgtcggagtcaagatcaaatgggacaaagcgcccggtgagatcggtaacatccccgagcaaatgaagaaactcgacagattccttgtgcaaaatggtatcaagacagtgctgggatacagaatgggtgtgtcttccgagttgtcccacgacaactccgacttcttaagagtcacaattgcttacgccaaggatgaccagcagctagtagaggcctctcatagaatcggctccggtatcgagcaattcttcaaagagctaaaataa

SEQ ID NO: 72519 - protein, 537 aa, Candida glabrata CBS 138
MASCIACDDTYIVFIYIFLHSSFVPIRILQAMTTMIDLEEKFGQFLSWRMQNRKLVAFWDDEVLGDDVIELTAGMPNEQFFPIKAMDMTIVNKPFESADDTSKHLHCKMSTYEPKSLPIARSFQYNEVPGLPQIRNFAKYLVNKINKPAYSADQWDVLLSSGSCDSMFKFFECFCDEKSTVLMEEFTFTPVISHVKATGAECIPLKMNLTKDPSTQGIDVDYLTQLLDNWSSGPYKHLNKPRILYTICTGQNPTGVTIPMENRRKIYELAHKHNFLILEDDPYGYLSFPSYKPEDPLKNDYLEDGFTVEKYTNEFLVDSFLTIDTDARVIRMETFSKVFAPGLRLGFIVANKYIISNLLEYAEITTRAPSGVSQAVLYNTLETMALYQDGDDKEDPEKKQEALFQGWMHWIMKVAAEYTHRRNITLKALYETDAYKNGLFTVIEPSAGMFVGVKIKWDKAPGEIGNIPEQMKKLDRFLVQNGIKTVLGYRMGVSSELSHDNSDFLRVTIAYAKDDQQLVEASHRIGSGIEQFFKELK

SEQ ID NO: 72520 - DNA, 1593 bp, Kluyveromyces lactis NRRL Y-1140
  CDS (1)..(1593)
atgacggtaaccattgatgataagacgttagaagagcattattcgaagttcttgaatcgtcacgttgacagaagagttattctgcaattctgggatgattatttgcccaaggatgtgaaaccgcatccaaacccatatgttttggcagctggtatgccaaacgagggtttgttccctgtggaatctgtgcatgtcaatgtggttgaacgtccgttccagcatttggagtacccattcaaaagtgaaaagatccatgtcggtgctgctggtgaaatcggtgtcaatgaagctgaatacgtgaaatctagggtcgatgatggtagtatggttgatatttggaggtacgatccatctcatggtgataacattccaattgcccaggcactacaatattctgacacgaaagggttcccgcaattgattgatttctcaaagaagttggttagttacttaaacaagccagcttacgacaattgggatgttatgttagcaaatggatcttctgattctttatctaaagttttcaccactttaacagatgaagacgttaccgtgttaatggaagaatttactttcactccgactatctccaacgtcactgcaaatggtgggattccgattccattgaaagttgatatcacggatgatgcttctcagcagggtattaacgtcgagtatatggaccaattgcttgagaattggtcaacaggtgaatattctcacttatctaagcctagactgttatacacaatcgtcacagggcaaaatccaaccggtatgacacaatgcaaagagaagagacagaaaatatacgatctatgcgaaaaacatgacattataattgtggaagatgatccgtatggttacctaaagtttttaccctttgacaagtctgatccattaaagaatcaatataacgatggcactatcactttcgataaatattgtaaagaaatattagccccctcatatttgaccatagacacatcagggagagtcattagattagaaactttctccaaagtcttcgcccctgggatgcgtctttccttcattgtcgccaataaatttatcctagacaagttattgaaatatgcagacatttctgttagatcgccatgtggtcttgcccaagctatgaccattaatataatagacaaatgggcagaaaatttcaatggagacaaggtcagagcttggctatcatgggtcatgaaagttgctggtgagtatacacatagaagaaatgtgcttttccaagcattggaagctacaccagcttataaagaagaattatttgaattgattgaaccctctgccggtatgttcattagtatcaagatcaattttgataagttcggagaaatctcggataaattaaaggccatgaatttcttaaactacaagttgttggaagaaggttgcattgtaatcttgggttacagaatggcagttgacaagaaattttcatatgacaggtccaactttttaagaattacatttgctatggctccagatgaagagcatttacaaacagctgctgaaaggctaggtaaaggtgttgagagattcttcaaagagtatcacaactga

SEQ ID NO: 72521 - protein, 530 aa, Kluyveromyces lactis NRRL Y-1140
MTVTIDDKTLEEHYSKFLNRHVDRRVILQFWDDYLPKDVKPHPNPYVLAAGMPNEGLFPVESVHVNVVERPFQHLEYPFKSEKIHVGAAGEIGVNEAEYVKSRVDDGSMVDIWRYDPSHGDNIPIAQALQYSDTKGFPQLIDFSKKLVSYLNKPAYDNWDVMLANGSSDSLSKVFTTLTDEDVTVLMEEFTFTPTISNVTANGGIPIPLKVDITDDASQQGINVEYMDQLLENWSTGEYSHLSKPRLLYTIVTGQNPTGMTQCKEKRQKIYDLCEKHDIIIVEDDPYGYLKFLPFDKSDPLKNQYNDGTITFDKYCKEILAPSYLTIDTSGRVIRLETFSKVFAPGMRLSFIVANKFILDKLLKYADISVRSPCGLAQAMTINIIDKWAENFNGDKVRAWLSWVMKVAGEYTHRRNVLFQALEATPAYKEELFELIEPSAGMFISIKINFDKFGEISDKLKAMNFLNYKLLEEGCIVILGYRMAVDKKFSYDRSNFLRITFAMAPDEEHLQTAAERLGKGVERFFKEYHN

SEQ ID NO: 72522 - DNA, 1476 bp, Debaryomyces hansenii CBS767
  CDS (1)..(1476)
atgtctaaaccagaagctaaggatttgagccacttgttgagtgaagaagctaagtcgagaaaaaactctccattgaaggctgctttcaagtattacaaacaaccaggaatgacgttcttgggcggtggattaccattatcagattgttttccgttcaataaagtgacagcggacattccatcggtaccattttcagaaggtatttcggctccgctctctgatgaaaataaaactgtcgtagaggtatacaaaagagccgaaatgaacaagacagaagacaagcagatcgagcttgccagatcattgcaatatggacacactgaaggtcaagccgagattattgatttcttgaaggagcacacggaaaagattcacaatgttccatataaggattgggatcttattgcatctgttggtaacacgcaatcgtgggatgcaaccttgagatcgtttgtcaccagaggtgattctatcttggttgaagaatattcgttcagttcggcattggaaactgcccacgcacaaggcgttaataccattccagttccaatggacgccaagggaattcttccggaagcattggaaaagcagttagaccaatgggttggaccaaagccaaagttgttatataccatttgtactggtcaaaacccaaccgggtcttgtctctcggctgaaagaagaagggccatctacaaattggcatgcaagcacgatttcatcattattgaggacgagccttattacttcttgcaaatggaagattataccacggacgaaaagtcaagagctagcaacaaggtcgacagccacgacgaattcgtcaaggctttagttccatcctacatctccatggatgtcgaaggaagagttatcagattagactcattctctaaggttttggcacctggtttgagattcggttggattgtcggacaagccaaattactcgagagatatgtcagaatccatgaagtttctatccagtgtccatctggttttactcaatccatctgtaattccttgttgcaaaaatggggtcaaaagggttacttagattggttaatgggcttacgtgccgactacacccacaagagagatgtcgctattgatgcagttaacaagtacttccctaaggaagttgtatcatttatcccaccagtggccggtatgtttttcacaactaccatcgacgcttccaagcaccctaaattcaagtccgagtttaacgaggacccactccaggttgaaaatgccgtctacgagcaagctttgaaacaaggttgtttgatgatcccaggttcttggttcaaggccgacggtaaatcaaatcctccacaacctgaattaccagaaaaccctgctagcaaaaacaccttcttctttagaggtacatatgctgccgttccattagatcaattagtcataggattagaaaaattcggtaaagcaattaaggttgaatacggtctttaa

SEQ ID NO: 72523 - protein, 491 aa, Debaryomyces hansenii CBS767
MSKPEAKDLSHLLSEEAKSRKNSPLKAAFKYYKQPGMTFLGGGLPLSDCFPFNKVTADIPSVPFSEGISAPLSDENKTVVEVYKRAEMNKTEDKQIELARSLQYGHTEGQAEIIDFLKEHTEKIHNVPYKDWDLIASVGNTQSWDATLRSFVTRGDSILVEEYSFSSALETAHAQGVNTIPVPMDAKGILPEALEKQLDQWVGPKPKLLYTICTGQNPTGSCLSAERRRAIYKLACKHDFIIIEDEPYYFLQMEDYTTDEKSRASNKVDSHDEFVKALVPSYISMDVEGRVIRLDSFSKVLAPGLRFGWIVGQAKLLERYVRIHEVSIQCPSGFTQSICNSLLQKWGQKGYLDWLMGLRADYTHKRDVAIDAVNKYFPKEVVSFIPPVAGMFFTTTIDASKHPKFKSEFNEDPLQVENAVYEQALKQGCLMIPGSWFKADGKSNPPQPELPENPASKNTFFFRGTYAAVPLDQLVIGLEKFGKAIKVEYGL

SEQ ID NO: 72524 - DNA, 1599 bp, Yarrowia lipolytica CLIB122
  CDS (1)..(1599)
atgtccttccacgacaagttcatttctgaccgttcaaaggcccggtctcattcccatttcacgctcaaccagacggccaagacaaccaaaccccattccaacccgattttcatctctggaggtcttcccaaccccattgggttccccattgacgagatcaccgtcaatctgaccaccagtcccaatccccgacctcgatttgtgcctgctgcgactctgttttccaagccaggactggtcgagttccccgacatcaccgagaatagcacccggttgagccagaacctcaagatcctcaagtttgccgagtcgctggaaactgcgacaaacggcaatggcggccagctgactctcgagcgatctctccagtacggcgaacaagatggtcacccgcagctcaagaaatttgtgacggccctcaccaagcgcctccatccccccaagctggacgagaaggactggaacgtgatcatcaccaatggcggtggagacggtattcacaaggccgtggacctgctcattaaccctggagaccatgtccttgttgaggagtactgcttctctccctcctttgacaacattaaatctgtcggaggtattcttgttcccatcaagctagattatgacgagggactcgacgtgactggtctcaaacggatccttgaaaactgggatgaggccaagcagggacccaaaccccgagttctgtatagtgttccttctggccagaatccctacggagtctcccagtctctggagagacgtaaagcaatctatgctgttctgaaagaacatgggatcgtcatcatcgaagatgatccctacggagccctggcctacgagtcctacaacaagaaattcaccaacggcaactcctccaagtctctgaacactccggagaaggctcatgacgagtctgtcgactctgaggcacgtgaatccgacatctccaaggctgatatcgaccattacacctccttgatcgctccctcttacctcaccattgatgatgtaggactggttgttcgaattgacactttctccaaggtattttctccgggacttcgacttgggtggattgtcagtcacgtcaacttcattgagaagctatctctatacacttctctttcaacccgggccgcttccggcgtttctcagctgctgatcaacaacattgctcactcttggggtcttgagggctggttgcgttggtgtcttctgttgcgaaaccagtatctggagcgacgaaaccaccttctagcccagctggacaagctcgaccagtccaagatcacctacatcacgcctgtctgtggtatgtttgtgtctgcgcttgttcattttgataagattgcgtcttcgtcgtttaatggcgtcactcttccctaccagtcgcgactggtggagcttggaatcgaggaaggagttctgattgtttctggatccaatatggctgcttccgaagagctgcgtcaaacggccaagttcattcgactcacttttgcctatgaggatcccgatctgctcgacgaggctatcaagcgattgggtaaggcggtggaccggctttttgaggagggtgagattaagcagaagtag

SEQ ID NO: 72525 - protein, 532 aa, Yarrowia lipolytica CLIB122
MSFHDKFISDRSKARSHSHFTLNQTAKTTKPHSNPIFISGGLPNPIGFPIDEITVNLTTSPNPRPRFVPAATLFSKPGLVEFPDITENSTRLSQNLKILKFAESLETATNGNGGQLTLERSLQYGEQDGHPQLKKFVTALTKRLHPPKLDEKDWNVIITNGGGDGIHKAVDLLINPGDHVLVEEYCFSPSFDNIKSVGGILVPIKLDYDEGLDVTGLKRILENWDEAKQGPKPRVLYSVPSGQNPYGVSQSLERRKAIYAVLKEHGIVIIEDDPYGALAYESYNKKFTNGNSSKSLNTPEKAHDESVDSEARESDISKADIDHYTSLIAPSYLTIDDVGLVVRIDTFSKVFSPGLRLGWIVSHVNFIEKLSLYTSLSTRAASGVSQLLINNIAHSWGLEGWLRWCLLLRNQYLERRNHLLAQLDKLDQSKITYITPVCGMFVSALVHFDKIASSSFNGVTLPYQSRLVELGIEEGVLIVSGSNMAASEELRQTAKFIRLTFAYEDPDLLDEAIKRLGKAVDRLFEEGEIKQK

SEQ ID NO: 72526 - DNA, 1566 bp, Aspergillus nidulans FGSC A4
  CDS (1)..(1566)
atgagccgtttacatattcatgacatcgaatctttacgcgccagctccgcacccctaccgctgacggttgcgcccgccacttcctccgagcatttcaagtccattcacactcgccaaagacctgtcgcctgtcgattggaccatcacttcagcgccgagagcagggacttcaatggtgccgatttcaagaaaggtgcgagccccatcggaccacggaagatcattcctcttggtactggacgaccaacagccgactattatccgtgggaatcatttacattccacggtgtctcgcctgcttccctggcgagtagcacagctaacgactctggccattcggtttacacagtcacaaagcgagatgccacgtacaatctctcgctaggaatgaattacggtcatgcggcaggttcgccgcatctcctgcgattcatcacggaacacattgagctggtccataatccgccatatcaagactggcgtacttttctgtcttgcggcgcgacagtggcgcttgaagttgccctgcggatattctgcaatcggggtgattggattttgacagaacaatacacctactctggaacactcgagactgcaaccctgacctgtgcacgagtgtatggagttgaaatggatgcggatggtcttcggtccgatgtcctagaaagaaccctcgcctcttgggacacatctaagggcaggaaaccaagagtattatataccatacctacaggccaaaatcccacaggatacagccagtctctggagagacgtgcagccatctacgcgatcgcggtcaagcatgacctgatcataatcgaagatgacccttattacttcctccgtctgggtccctacaacgaagcaagtacagacgccgaagaacccacaaagatatctcctgatgcattctatagcactggagacccatcctacctctctctggatacatctggccgcgtcgtgcgcctggattcgacgtctaagattctcgccccagggctgcgcgcgggctgggtgactgcatcatcgcaaatcatcgacaagtttctcgcctaccaggaagttagtaccatagcagtgagtggctcgtcacaactaatgctatggagcctccttgatcaggggtggggccacaccggcttctcgtcctggttgctgcatctctcaggggagtaccgacagcgtcgtaatatccttttacgcgcatgccaacagcaccttccaagagatatagcagagtgggtgccgccgcggtacggcatgtttctttggattaaagtgaactggagacgacaccctgtaataggcaaattcgaaacaaaggcgacgccagaggaggtggattcccgccttcaagggctggaggcccagattgtttctgatgcgcttagtcgaggcgttttgatcaccaagggctcacttttttcttggaataagagacccaacggcgagctgcacttccggatgacctttgcggcggccgagaaggcagatttggaagagggcgtgaggcttctcggggagactctgagaggtgtatttcagacatgcttagattag

SEQ ID NO: 72527 - protein, 521 aa, Aspergillus nidulans FGSC A4
MSRLHIHDIESLRASSAPLPLTVAPATSSEHFKSIHTRQRPVACRLDHHFSAESRDFNGADFKKGASPIGPRKIIPLGTGRPTADYYPWESFTFHGVSPASLASSTANDSGHSVYTVTKRDATYNLSLGMNYGHAAGSPHLLRFITEHIELVHNPPYQDWRTFLSCGATVALEVALRIFCNRGDWILTEQYTYSGTLETATLTCARVYGVEMDADGLRSDVLERTLASWDTSKGRKPRVLYTIPTGQNPTGYSQSLERRAAIYAIAVKHDLIIIEDDPYYFLRLGPYNEASTDAEEPTKISPDAFYSTGDPSYLSLDTSGRVVRLDSTSKILAPGLRAGWVTASSQIIDKFLAYQEVSTIAVSGSSQLMLWSLLDQGWGHTGFSSWLLHLSGEYRQRRNILLRACQQHLPRDIAEWVPPRYGMFLWIKVNWRRHPVIGKFETKATPEEVDSRLQGLEAQIVSDALSRGVLITKGSLFSWNKRPNGELHFRMTFAAAEKADLEEGVRLLGETLRGVFQTCLD

SEQ ID NO: 72528 - DNA, 1590 bp, Aspergillus nidulans FGSC A4
  CDS (1)..(1590)
atgtctccgccggcagctttggacatggataccaacggcattggcgctcctaagccgttgactgtcgatggaattgctgctgtgagggcgaagagcgccccaatgcctgctggggttgctcctgctaccagtagtgatatgttcaagagtccggcctgttacaccaaaccaaaggcgaagagatgggacaatttcttcactcttgaagctaagtcacgaaagacctcgacattaaaaggagcggcgaagtttttgaaaaacccaggccttatttccttgggtggcgggctgccctccccagaatacttcccgttcgaagaactctctttcaaagtgcctaccccgcctggcttttcccccgaagcaacgcgacagtccggcactactttggtcgccggaaaacatgatattcgtgagggcaagagcctgtacgatcttgaggtttctctgaactacgggcaatcgactggatcccctcagctgctccgatttgtgacggaacataccgagctcattcataaccccccatactctgactggcaatgcgctttgactgccggaagtacctatgcctgggatacagctctccggttgttctgtgaaaggggtgattaccttctgatggaagagtatactttctctagcgcccaagaaaccgcccttccccagggagtcaacgttgcccccgttaagatggacgaacaaggacttctgcctggagacctggatgatgtcctgagcaactgggatgagaaagtccgcggtgctcggaagcctttcgttctctataccatcccgaccggccagaaccccacaggcgctacgcaatccgcagaacggcgaaaggagatctacaaagtcgctcagaagcacaacatttatatcattgaggacgagccgtactacttcttgcaaatgcagccgtacacaggagccgatagtgcgccagtgccgcctcctgcgaaccacgaagaatttgtcaagtcccttattccttcatatctgagcattgatgtcgatggccgtgttcttcgtgttgagtcattctccaaagtcctggcccctggctcgcgtaccggctgggtcgtcggctctgagcaggtcattgaacgctttcttcgaaacaccgaagtttccgcccagcatccgagcggtatctcccagctgatgctcttcaagctgttggatgagcactggggacaccttgggtacttcgattggcttatcaacctgcgcatgcaatacaccaaccgcagaaatattatggttcaagcatgcgagaagcatcttcctcaggagattgctagctggatcgcccctgcagcgggcatgttccactggattcaagtggactggaagaagcaccctgaactcacatctggtaagactcgcgactccatcgaagaggctcttttccatgccgctatcaacaacggcgtccttgtgtcgcgtggaagctggttcaaggccgctggagcaagcgaagacaagcttttcttccgtgctacattcgcggctgccagtgaggagaatatcacagaggcgatcaggagatttggtgatgcgctccgggttgagttcaagctatag

SEQ ID NO: 72529 - protein, 529 aa, Aspergillus nidulans FGSC A4
MSPPAALDMDTNGIGAPKPLTVDGIAAVRAKSAPMPAGVAPATSSDMFKSPACYTKPKAKRWDNFFTLEAKSRKTSTLKGAAKFLKNPGLISLGGGLPSPEYFPFEELSFKVPTPPGFSPEATRQSGTTLVAGKHDIREGKSLYDLEVSLNYGQSTGSPQLLRFVTEHTELIHNPPYSDWQCALTAGSTYAWDTALRLFCERGDYLLMEEYTFSSAQETALPQGVNVAPVKMDEQGLLPGDLDDVLSNWDEKVRGARKPFVLYTIPTGQNPTGATQSAERRKEIYKVAQKHNIYIIEDEPYYFLQMQPYTGADSAPVPPPANHEEFVKSLIPSYLSIDVDGRVLRVESFSKVLAPGSRTGWVVGSEQVIERFLRNTEVSAQHPSGISQLMLFKLLDEHWGHLGYFDWLINLRMQYTNRRNIMVQACEKHLPQEIASWIAPAAGMFHWIQVDWKKHPELTSGKTRDSIEEALFHAAINNGVLVSRGSWFKAAGASEDKLFFRATFAAASEENITEAIRRFGDALRVEFKL

SEQ ID NO: 72530 - DNA, 1773 bp, Aspergillus nidulans FGSC A4
  CDS (1)..(1773)
atggcttccttgtcgccccctttagatttgtcgcatcactttagcctcacaacgaagcggcgtgctccgagcgccgtcaaagacttctataagtattttatgattccgggcattgccaatttggccggtggactgccaaatgcttcttattttccgtacgacacactcgaagcctctgccgcacatccccagcgattcccgacaataccgggcggaaagaaggccaagggaccccagacaagcgagcgtatcgtcgtacctaaagaatctcggagtgcgacatcaaagaagattgatatcacaacagccttgcaatatggcaccagcgagggtctccctcctctggcgacttttgtcaatcagttcgttcgcgagcatcttcacccgaacattccctacgctggcggtcctggcaccctcttgaccacgggcgcaaccgacggcttctccaaggctattgaagctttcacggaaacgtggaatcccgaccgtgacgggatacacttgcgccagggcattctctgcgaggaattcgtgtatatgaatgctattcagaccgtcaagccaagagggttgaacatcgtcccggtggctattgatgacgagggtatgctgccatacggcccgggcggattggccgaggttttgggaaactggaaccatcgcaaaggctgtcgtccacatctgatgtataccataaccatcggccagaacccaactggtggcacattgtctgtcgaacgtcgcaagcagatctacgctatttgccaaaagtacgatgtgatcattgtcgaggacgacccatactggaacctgcagtacccgtcagcccaggaactccaagcacgacatcggaactcgtcagtaaacccagctttgtcggagcgcaattacaacgctggaagaaagtcatctgggtacaagtttcttgattcccttgtgccgtcgtatctctccatcgacatggacggccgggttgtccgcctggacacgttttcgaagacaattgctccgggttgccgtctcggctggattacagcacaaccagctttcattgagaggctggcgcgaatcgcagaatcgtcaacccaagcaccatcaggcttcgtccaagctatggttgccgaactgatcctgggccagcaggtggatgatggatctgctgattccgcgaaaagcaaggacaccgaaagggcctggaagatggatggctgggtacgctggcttgaaggtctacgagcaggttacgaacaacgcatgcagcagatgtgcagtggcctggaggagggtaaatatatcgcactccacactaggtcggatgagttctccttgagcgggaatgaagaagactcatgggaggtcttggaaaaagtacaaatgtacgacttcgcatggcccactggcggcatgttcgtctgggttaaagtaaactatgagagtcaccccttacgtcagatatatggacctgagaggctctccaaagcgctatgggtgcatttcacccaaaaaccacagctctgcctccttggtccaggcaccatattctcgccgacggacgaggtacaagctcgtggtcatcaatacttccggctgtgcttcgctgcaatgccggcagatgatgttgtccccatcactcaacgagtggtcgatggtttcagatcgttttggcagagaaagaacttagacggacttgaaggtgatgacggcattgcacaaacgatggagcagctgcagatggaaccatctgctaattttctgggaatgggctgttga

SEQ ID NO: 72531 - protein, 590 aa, Aspergillus nidulans FGSC A4
MASLSPPLDLSHHFSLTTKRRAPSAVKDFYKYFMIPGIANLAGGLPNASYFPYDTLEASAAHPQRFPTIPGGKKAKGPQTSERIVVPKESRSATSKKIDITTALQYGTSEGLPPLATFVNQFVREHLHPNIPYAGGPGTLLTTGATDGFSKAIEAFTETWNPDRDGIHLRQGILCEEFVYMNAIQTVKPRGLNIVPVAIDDEGMLPYGPGGLAEVLGNWNHRKGCRPHLMYTITIGQNPTGGTLSVERRKQIYAICQKYDVIIVEDDPYWNLQYPSAQELQARHRNSSVNPALSERNYNAGRKSSGYKFLDSLVPSYLSIDMDGRVVRLDTFSKTIAPGCRLGWITAQPAFIERLARIAESSTQAPSGFVQAMVAELILGQQVDDGSADSAKSKDTERAWKMDGWVRWLEGLRAGYEQRMQQMCSGLEEGKYIALHTRSDEFSLSGNEEDSWEVLEKVQMYDFAWPTGGMFVWVKVNYESHPLRQIYGPERLSKALWVHFTQKPQLCLLGPGTIFSPTDEVQARGHQYFRLCFAAMPADDVVPITQRVVDGFRSFWQRKNLDGLEGDDGIAQTMEQLQMEPSANFLGMGC

SEQ ID NO: 72532 - DNA, 1572 bp, Candida albicans SC5314
  CDS (1)..(1572): transl_table=12
atgtctgatcctactcatttaatttctaagcgagctgctggaagaacttcggtacattttacaaatgctccatctgataagcctccggcaaatttcaagcctcatgaaaaaccgttggcattgtcttatggtatgccgaatcacgggtttttcccaattgattccatagatgtcaatttagttgattacccattccaaaaaattaccacaccttctactacttcgtctactgcagaagaagaacctccttcttcttctttgaatggttccgagaacggtcatcaaaccaaaactccgccttccagtatacacacaccacagtcaactgttcatatcagcagacatactactgatccaaaattaattgatttggctagaggattacaatatgctgctgttgaaggtcatgcaccattattacaatttgcaagagatttcatcattcgtacacataaaccaaattatgacgattggaatgttttcattactactggtgccagtgatggattaaataaagctgctgatgtatttttagatgatggtgatgttatcttagttgaggaatttacatttagtccatttttaagatttctggataatgctggtgctaaagctgttccagtgaaaatcaattttgataatgattctgatggaattgatttgactcaatttgttgatttattggagaattgggagaaacattatccaaacttacctaaaccaaaggcattatatactattgccacaggacaaaatccaactggatttactcaatctttagaatttagaaagaaaatttatgatttggctgtcaaatatgattttgccattattgaagatgatccttatggttatttgacattaccaaaatatgaaaaacctaatataggtggtagtggtagtggcaataatgaattgaaaaacgatcttgaaattgacgattatttgaaaaatcatttgactccatcttaccttgaattggacactactggtagagttcttagagttgagaccttttccaaattatttgctccaggtttgagattaggatttattgttggtcataaagaagtcattgacgcagttaagaattatagtgacgttgttaatcgaggtgctctgggtttaacacaaactattgttaataatgttattcaagaaaactttaaaggtgttgatggatggctagaatggattttaaaaatgagattgaattattcttacagaaaagatttgttattatattcaatttttgaatcacaagcttataaaaaaggttatgttgatgttattgaccctaaagctggtatgtttgttacttttaaaattaatttgccaaaagatgttgatgttttacaaaaaatgaaattattattatggaaattgatttcttatggaattttggttgttccaggatataatatgacggttgatttagagtttagtaaagatagaagcaatttctttagattatgttatgctcttgctaataatgatgaagaaattcttgaaagtggtaaaagattgactgatgcagtttatgaattctttagtaatgggttagagttttaa

SEQ ID NO: 72533 - protein, 523 aa, Candida albicans SC5314
MSDPTHLISKRAAGRTSVHFTNAPSDKPPANFKPHEKPLALSYGMPNHGFFPIDSIDVNLVDYPFQKITTPSTTSSTAEEEPPSSSLNGSENGHQTKTPPSSIHTPQSTVHISRHTTDPKLIDLARGLQYAAVEGHAPLLQFARDFIIRTHKPNYDDWNVFITTGASDGLNKAADVFLDDGDVILVEEFTFSPFLRFSDNAGAKAVPVKINFDNDSDGIDLTQFVDLLENWEKHYPNLPKPKALYTIATGQNPTGFTQSLEFRKKIYDLAVKYDFAIIEDDPYGYLTLPKYEKPNIGGSGSGNNELKNDLEIDDYLKNHLTPSYLELDTTGRVLRVETFSKLFAPGLRLGFIVGHKEVIDAVKNYSDVVNRGASGLTQTIVNNVIQENFKGVDGWLEWILKMRLNYSYRKDLLLYSIFESQAYKKGYVDVIDPKAGMFVTFKINLPKDVDVLQKMKLLLWKLISYGILVVPGYNMTVDLEFSKDRSNFFRLCYALANNDEEILESGKRLTDAVYEFFSNGLEF

SEQ ID NO: 72534 - DNA, 1572 bp, Candida albicans SC5314
  CDS (1)..(1572): transl_table=12
atgtctgatcctactcatttaatttctaagcgagctgctggaagaacttcggtgcattttacaaatgctccatctgataagcctccggcaaatttcaagcctcatgaaaaaccgttggcattgtcttatggtatgccgaatcacgggtttttcccaattgattccatagatgtcaatctagttgattacccatttcaaaaaattaccacaccttctactacttcgtctactgcagaagaagaacctccttcttcttctttgaatggttccgagaacggtcatcaaaccaaaactccgccttccagtatacacacaccacagtcaactgttcatatcagcagacatactactgatccaaaattaattgatttggctagaggattacaatatgctgctgttgaaggtcatgcaccattattacaatttgcaagagatttcatcattcgtacacataaaccaaattatgacgattggaatgttttcattactactggtgccagtgatggattaaataaagctgctgatgtatttttagatgatggtgatgttatcttagttgaggaatttacatttagtccatttttaagatttctggataatgctggtgctaaggctgttccagtgaaaatcaattttgataatgattccgatggaattgatttgactcaatttgttgatttattggagaattgggagaaacattatccaaacttacctaaaccaaaggcattatatactattgccacaggacaaaatccaactggatttactcaatctttagaatttagaaagaaaatttatgatttggctgtcaaatatgattttgccattattgaagatgatccttatggttatttgacattaccaaaatatgaaaaacctaatataggtggtagtggtagtggcaataatgaattgaaaaacgatcttgaaattgatgattatttgaagaatcatttgactccatcttaccttgaattggacactactggtagagttcttagagttgagaccttttccaaattatttgctccaggtttgagattaggatttattgttggtcataaaaaagtcattgacgcagttaagaattatagtgacgttgttaatcgaggtgctctgggtttaacacaaactattgttaataatgttattcaagaaaactttaaaggtgttgatggatggctagaatggattttaaaaatgagattgaattattcttatagaaaagatttattattatattcaatttttgaatcacaagcttataaaaaaggttatgttgatgttattgaccctaaagctggtatgtttgttacttttaaaattaatttgccaaaagatgttgatgttttacaaaaaatgaaattattattatggaaattgatttcttatggaattttggttgttccaggatataatatgacggttgatttagagtttagtaaagatagaagcaatttctttagattatgttatgctcttgctaataatgatgaagaaattcttgaaagtggtaaaagattgactgatgcagtttatgaattctttagtaatgggttagagttttaa

SEQ ID NO: 72535 - protein, 523 aa, Candida albicans SC5314
MSDPTHLISKRAAGRTSVHFTNAPSDKPPANFKPHEKPLALSYGMPNHGFFPIDSIDVNLVDYPFQKITTPSTTSSTAEEEPPSSSLNGSENGHQTKTPPSSIHTPQSTVHISRHTTDPKLIDLARGLQYAAVEGHAPLLQFARDFIIRTHKPNYDDWNVFITTGASDGLNKAADVFLDDGDVILVEEFTFSPFLRFSDNAGAKAVPVKINFDNDSDGIDLTQFVDLLENWEKHYPNLPKPKALYTIATGQNPTGFTQSLEFRKKIYDLAVKYDFAIIEDDPYGYLTLPKYEKPNIGGSGSGNNELKNDLEIDDYLKNHLTPSYLELDTTGRVLRVETFSKLFAPGLRLGFIVGHKKVIDAVKNYSDVVNRGASGLTQTIVNNVIQENFKGVDGWLEWILKMRLNYSYRKDLLLYSIFESQAYKKGYVDVIDPKAGMFVTFKINLPKDVDVLQKMKLLLWKLISYGILVVPGYNMTVDLEFSKDRSNFFRLCYALANNDEEILESGKRLTDAVYEFFSNGLEF

SEQ ID NO: 72536 - DNA, 1755 bp, Aspergillus oryzae
  CDS (1)..(1755)
atggcgcctcctcttgacttatcccatcattatgcatccaccaccaaacgacgtcagggaagcggcatcaaagacctatataagtacttcttcatcccaggcattgcgaacctggctggtggcttaccaaacccctcatacttcccatacgataccctcgaggctaccgtcgcgacaccccagcgtttccaaccttccaacaatggcacaaccaagaagtctggagatgacgctaagtcatccatgcggttgatcgttcctaaggagagtcacgcgaccgatgtacagaatagaatcgatatcgccacagccctgcagtatgtcacagctgatggcctcccccctatggcctcatttgttcgccaattcgcccgtcaccatcttcatcccaacgttccatatgccggaggtcccgaaaccatcctcaccactggagcgaccgatggcttctcaaaatcaatcgaagtattcacgaatgtctggaacccagacagagactggaccagtcagcgcgagggcattctttgtgaggaatttgtatatatgaatgctgttacaaccgtcaagccaagaggcctcaacgtcgtgccggtcgccatcgatgtacagggaatgttggcacgcggtaaaggagggttggccgatgttcttgaaaactgggacttccgaaaaggacgtcgtccgcatttaatgtacaccatcacgattggccagaaccccacgggcggtaccctatccgtcgagcgtagaaaagaaatctacgcactctgtcatcgatacgatatcatcataatcgaggacgatccttactggaacttgcaatacccatcggcggccgcgttagaagcccagcatcggggcacgcccatggatacagcttcagtaaagcgcaattacaatgcgcatggaaagtcctccgggtatgaattcctggactcgttggttccatcgtatttgtccttggacacggatggacgcgttgtgcgtctcgacactttctccaagaccattgcccctggttgtcgcttgggctggataactgcacaaccggccgtgattgagaggttgactcgggtcaccgaaaccgcaacgcaggcaccttcgggctttgttcaagccctggtagccaaactgattctgggtcaacagacagatcacaagtctaccaattcgaacaagagcgatcgtagctggcaaatggatggctgggtccgttggctggagggtttgcgcggtggatatgaacgacgcatgcaagacatgtgcagcactctagaggagggtagatttattatcgcctcggaagccggcctcgagtccagcgaggaaagctgggaagtcgtagataaagtacagatgtatgactttgcttggcccaccggcggtatgttcgtctggattaagctccgtctcgacacccatcccttgcatggaagatacgacccagccaggctttccaaggcattatgggtacatttgatgcagaaaccccacctctgtctcctaggtcccggagacttgtttgctccctcgcaggagaccttgaatcgttcttggcagtattaccgactttgctttgccgctatgcctgaagctgatgtgaaggatatcacggtgagattggtggatgggttccgggcgttctggaagaagaccgacttagatggtctcgagggagacggtgcagatatttcgcaggtggttcagagtatgggcatggagcgcgtaggaaatttcttgggaagtggatgttag

SEQ ID NO: 72537 - protein, 584 aa, Aspergillus oryzae
MAPPLDLSHHYASTTKRRQGSGIKDLYKYFFIPGIANLAGGLPNPSYFPYDTLEATVATPQRFQPSNNGTTKKSGDDAKSSMRLIVPKESHATDVQNRIDIATALQYVTADGLPPMASFVRQFARHHLHPNVPYAGGPETILTTGATDGFSKSIEVFTNVWNPDRDWTSQREGILCEEFVYMNAVTTVKPRGLNVVPVAIDVQGMLARGKGGLADVLENWDFRKGRRPHLMYTITIGQNPTGGTLSVERRKEIYALCHRYDIIIIEDDPYWNLQYPSAAALEAQHRGTPMDTASVKRNYNAHGKSSGYEFLDSLVPSYLSLDTDGRVVRLDTFSKTIAPGCRLGWITAQPAVIERLTRVTETATQAPSGFVQALVAKLILGQQTDHKSTNSNKSDRSWQMDGWVRWLEGLRGGYERRMQDMCSTLEEGRFIIASEAGLESSEESWEVVDKVQMYDFAWPTGGMFVWIKLRLDTHPLHGRYDPARLSKALWVHLMQKPHLCLLGPGDLFAPSQETLNRSWQYYRLCFAAMPEADVKDITVRLVDGFRAFWKKTDLDGLEGDGADISQVVQSMGMERVGNFLGSGC

SEQ ID NO: 72538 - DNA, 1587 bp, Aspergillus oryzae
  CDS (1)..(1587)
atgagccccccggccgctttggataatgcgaatggctctcccgcggcccctctgaccgtggagggtattcctgccctgagggccaacagcgccccaattcccaagggtgttgcacctgcgacgagtagtgatatgttcaaaagcccggcatgttatacgaagcccaaagctaaacgctgggatcacattctctccaccgaagctaaatctcggaaggtatccacattgaagggtgccgcgaaatacttgaagaacccaggcctcatatctctgggtggtggactgccctctcctgaatactttcctttcgaggagcttgatatcaaggtccccactccaccaggatttacgcccgaagctactcgcgagtctggaaccgttgtacacgccggcaagagtgatattcgggaaggaaagagtctatatgatcttgaggttgctcttaattacggtcaagccacgggtgctccccaactgctgagatacgtcacagagcacacagagctcatccacaaccccccatactcggactggcaatgttgtctgaactgtggtagcaccttcggatgggatgtggcactcagactcttttgcgaacggggcgattatatcatgatggaagaatataccttctctagcgcacaggaaacggccctcccccagggcttgaaggtggcacctgttaagatggacgaagagggccttttgcccgagtcccttgacgaggtcctgagtaactgggatgaaagcgctcggggtgctcgcaagcccttcgttctctacactatccctacaggacagaaccctacgggcgctacccaacaggcggagagacgcaaggcagtctacaaggttgcccagaagcacgacgtttatattgtggaggacgaaccctattacttcttgcagatgcagccatacgctggagctgatggcgagcccgttccaccgcccgccaaccacgaagaatttatcaagtctcttatcccttcctacctgagccttgacactgatggtcgtgtgcttcggctggaatctttctctaaggttcttgctcctggctcccgggttggctgggctgtcggatccgagcaaatcatcgaacgcttcaccagaacctgcgagactagttctcagaacccaagcggcatctcgcagcttgtgctttataagctcttggaggagcaatggggccacgctggatacctagactggctgatcaaccttcgtatgtcttacacggcgcgcagagactccatgatgcatgcgtgtgagaagtatctcccccgagaacttgcccattggaacccccctgcagcagggatgtttcattggatcgaaatcgactggcggaagcacccgagactttcgtctggcaagacacgcgaagaaatcgaggaggaagttttccaggccgcagttaacaacggcgtgctgatctctcgtggcagctggttcaaggctcaaggcgcgagcgaggagaagttgttcttccgtgctacatttgctgccgctagctccgatgctattgctgaagcaatttcccgtttcggtacaactctgagacaagagtttggtctgaactga

SEQ ID NO: 72539 - protein, 528 aa, Aspergillus oryzae
MSPPAALDNANGSPAAPLTVEGIPALRANSAPIPKGVAPATSSDMFKSPACYTKPKAKRWDHILSTEAKSRKVSTLKGAAKYLKNPGLISLGGGLPSPEYFPFEELDIKVPTPPGFTPEATRESGTVVHAGKSDIREGKSLYDLEVALNYGQATGAPQLLRYVTEHTELIHNPPYSDWQCCLNCGSTFGWDVALRLFCERGDYIMMEEYTFSSAQETALPQGLKVAPVKMDEEGLLPESLDEVLSNWDESARGARKPFVLYTIPTGQNPTGATQQAERRKAVYKVAQKHDVYIVEDEPYYFLQMQPYAGADGEPVPPPANHEEFIKSLIPSYLSLDTDGRVLRLESFSKVLAPGSRVGWAVGSEQIIERFTRTCETSSQNPSGISQLVLYKLLEEQWGHAGYLDWLINLRMSYTARRDSMMHACEKYLPRELAHWNPPAAGMFHWIEIDWRKHPRLSSGKTREEIEEEVFQAAVNNGVLISRGSWFKAQGASEEKLFFRATFAAASSDAIAEAISRFGTTLRQEFGLN

SEQ ID NO: 72540 - DNA, 1503 bp, Saccharomyces cerevisiae
  CDS (1)..(1503)
atgactttacctgaatcaaaagacttttcttacttgttttcggatgaaaccaatgctcgtaaaccatccccattgaaaacctgcatccatcttttccaagatcctaacattatctttttgggtggtggcctgccattaaaagattatttcccatgggataatctatctgtagattcacccaagcctccttttccccagggtattggagctccaattgacgagcagaattgcataaaatacaccgtcaacaaagattacgctgataaaagtgccaatccttccaacgatattcctttgtcaagagctttgcaatacgggttcagtgctggtcaacctgaactattaaacttcattagagatcataccaagattatccacgatttgaagtataaggactgggacgttttagccactgcaggtaacacaaatgcctgggaatctactttaagagtcttttgtaaccgaggtgatgtcatcttagttgaggcacattctttttcctcttcattggcttctgcagaggctcaaggtgtcattaccttccccgtgccaattgacgctgatggtatcattcctgaaaaattagctaaagtcatggaaaactggacacctggtgctcctaaaccaaagttgttatacactattccaacgggccaaaatccaactggtacttccattgcagaccatagaaaggaggcaatttacaagatcgctcaaaagtacgacttcctaattgtggaagatgaaccttattatttcttacaaatgaatccctacatcaaagacttgaaggaaagagagaaggcacaaagttctccaaagcaggaccatgacgaatttttgaagtccttggcaaacactttcctttccttggatacagaaggccgtgttattagaatggattccttttcaaaagttttggccccagggacaagattgggttggattactggttcatccaaaatcttgaagccttacttgagtttgcatgaaatgacgattcaagccccagcaggttttacacaagttttggtcaacgctacgctatccaggtggggtcaaaagggttacttggactggttgcttggcctgcgtcatgaatacactttgaaacgtgactgtgccatcgatgccctttacaagtatctaccacaatctgatgctttcgtgatcaatcctccaattgcaggtatgtttttcaccgtgaacattgacgcatctgtccaccctgagtttaaaacaaaatacaactcagacccttaccagctagaacagagtctttaccacaaagtggttgaacgtggtgttttagtggttcccggttcttggttcaagagtgagggtgagacggaacctcctcaacccgctgaatctaaagaagtcagtaatccaaacataattttcttcagaggtacctatgcagctgtctctcctgagaaactgactgaaggtctgaagagattaggtgatactttatacgaagaatttggtatttccaaatag

SEQ ID NO: 72541 - protein, 500 aa, Saccharomyces cerevisiae
MTLPESKDFSYLFSDETNARKPSPLKTCIHLFQDPNIIFLGGGLPLKDYFPWDNLSVDSPKPPFPQGIGAPIDEQNCIKYTVNKDYADKSANPSNDIPLSRALQYGFSAGQPELLNFIRDHTKIIHDLKYKDWDVLATAGNTNAWESTLRVFCNRGDVILVEAHSFSSSLASAEAQGVITFPVPIDADGIIPEKLAKVMENWTPGAPKPKLLYTIPTGQNPTGTSIADHRKEAIYKIAQKYDFLIVEDEPYYFLQMNPYIKDLKEREKAQSSPKQDHDEFLKSLANTFLSLDTEGRVIRMDSFSKVLAPGTRLGWITGSSKILKPYLSLHEMTIQAPAGFTQVLVNATLSRWGQKGYLDWLLGLRHEYTLKRDCAIDALYKYLPQSDAFVINPPIAGMFFTVNIDASVHPEFKTKYNSDPYQLEQSLYHKVVERGVLVVPGSWFKSEGETEPPQPAESKEVSNPNIIFFRGTYAAVSPEKLTEGLKRLGDTLYEEFGISK

SEQ ID NO: 72542 - DNA, 21 bp, Artificial sequence
  primer
atgactgctggttctgccccc

SEQ ID NO: 72543 - DNA, 28 bp, Artificial sequence
  primer
tcaacttttatagttgtcaaaaaattct

SEQ ID NO: 72544 - protein, 610 aa, Artificial sequence
  consensus sequence
  Variant (2)..(6): Xaa in position 2 to 6 is any amino acid
  Variant (8)..(24): Xaa in position 8 to 24 is any amino acid
  Variant (25)..(32): Xaa in position 25 to 32 is any or no amino acid
  Variant (34)..(35): Xaa in position 34 to 35 is any amino acid
  Variant (37)..(37): Xaa in position 37 is any amino acid
  Variant (39)..(42): Xaa in position 39 to 42 is any amino acid
  Variant (45)..(63): Xaa in position 45 to 63 is any amino acid
  Variant (64)..(119): Xaa in position 64 to 119 is any or no amino acid
  Variant (123)..(126): Xaa in position 123 to 126 is any amino acid
  Variant (128)..(133): Xaa in position 128 to 133 is any amino acid
  Variant (135)..(149): Xaa in position 135 to 149 is any amino acid
  Variant (150)..(154): Xaa in position 150 to 154 is any or no amino acid
  Variant (156)..(161): Xaa in position 156 to 161 is any amino acid
  Variant (163)..(181): Xaa in position 163 to 181 is any amino acid
  Variant (182)..(191): Xaa in position 182 to 191 is any or no amino acid
  Variant (193)..(193): Xaa in position 193 is any amino acid
  Variant (195)..(208): Xaa in position 195 to 208 is any amino acid
  Variant (210)..(230): Xaa in position 210 to 230 is any amino acid
  Variant (231)..(236): Xaa in position 231 to 236 is any or no amino acid
  Variant (238)..(239): Xaa in position 238 to 239 is any amino acid
  Variant (241)..(244): Xaa in position 241 to 244 is any amino acid
  Variant (245)..(250): Xaa in position 245 to 250 is any or no amino acid
  Variant (252)..(253): Xaa in position 252 to 253 is any amino acid
  Variant (258)..(258): Xaa in position 258 is any amino acid
  Variant (266)..(272): Xaa in position 266 to 272 is any amino acid
  Variant (274)..(276): Xaa in position 274 to 276 is any amino acid
  Variant (278)..(279): Xaa in position 278 to 279 is any amino acid
  Variant (281)..(283): Xaa in position 281 to 283 is any amino acid
  Variant (285)..(286): Xaa in position 285 to 286 is any amino acid
  Variant (288)..(288): Xaa in position 288 is any amino acid
  Variant (291)..(291): Xaa in position 291 is any amino acid
  Variant (294)..(295): Xaa in position 294 to 295 is any amino acid
  Variant (297)..(300): Xaa in position 297 to 300 is any amino acid
  Variant (302)..(305): Xaa in position 302 to 305 is any amino acid
  Variant (306)..(345): Xaa in position 306 to 345 is any or no amino acid
  Variant (347)..(348): Xaa in position 347 to 348 is any amino acid
  Variant (350)..(350): Xaa in position 350 is any amino acid
  Variant (352)..(353): Xaa in position 352 to 353 is any amino acid
  Variant (355)..(356): Xaa in position 355 to 356 is any amino acid
  Variant (360)..(360): Xaa in position 360 is any amino acid
  Variant (362)..(364): Xaa in position 362 to 364 is any amino acid
  Variant (368)..(369): Xaa in position 368 to 369 is any amino acid
  Variant (373)..(373): Xaa in position 373 is any amino acid
  Variant (375)..(375): Xaa in position 375 is any amino acid
  Variant (377)..(399): Xaa in position 377 to 399 is any amino acid
  Variant (402)..(403): Xaa in position 402 to 403 is any amino acid
  Variant (405)..(418): Xaa in position 405 to 418 is any amino acid
  Variant (419)..(440): Xaa in position 419 to 440 is any or no amino acid
  Variant (442)..(448): Xaa in position 442 to 448 is any amino acid
  Variant (450)..(472): Xaa in position 450 to 472 is any amino acid
  Variant (473)..(498): Xaa in position 473 to 498 is any or no amino acid
  Variant (500)..(501): Xaa in position 500 to 501 is any amino acid
  Variant (505)..(525): Xaa in position 505 to 525 is any amino acid
  Variant (526)..(547): Xaa in position 526 to 547 is any or no amino acid
  Variant (549)..(553): Xaa in position 549 to 553 is any amino acid
  Variant (555)..(567): Xaa in position 555 to 567 is any amino acid
  Variant (568)..(582): Xaa in position 568 to 582 is any or no amino acid
  Variant (584)..(586): Xaa in position 584 to 586 is any amino acid
  Variant (588)..(599): Xaa in position 588 to 599 is any amino acid
  Variant (600)..(600): Xaa in position 600 is any or no amino acid
  Variant (602)..(609): Xaa in position 602 to 609 is any amino acid
SXXXXXRXXXXXXXXXXXXXXXXXXXXXXXXXLXXGXPXXXXFPXXXXXXXXXXXXXXXXXXXXXXXXXXXXXXXXXXXXXXXXXXXXXXXXXXXXXXXXXXXXXXXXXXXXXXXXXXXLQYXXXXGXXXXXXFXXXXXXXXXXXXXXXXXXXXWXXXXXXGXXXXXXXXXXXXXXXXXXXXXXXXXXXXXLXEXXXXXXXXXXXXXXGXXXXXXXXXXXXXXXXXXXXXXXXXXXLXXWXXXXXXXXXXPXXLYTIXTGQNPTGXXXXXXXRXXXYXXAXXXDXXIXEDXPYXXLXXXXYXXXXXXXXXXXXXXXXXXXXXXXXXXXXXXXXXXXXXXXXXXXXLXXSXLXXDXXGRVXRXXXFSKXXAPGXRXGXXXXXXXXXXXXXXXXXXXXXXXSGXXQXXXXXXXXXXXXXXXXXXXXXXXXXXXXXXXXXXXXWXXXXXXXYXXXXXXXXXXXXXXXXXXXXXXXXXXXXXXXXXXXXXXXXXXXXXXXXXPXXGMFXXXXXXXXXXXXXXXXXXXXXXXXXXXXXXXXXXXXXXXXXXXGXXXXXGXXXXXXXXXXXXXXXXXXXXXXXXXXXXRXXXAXXXXXXXXXXXXXRXXXXXXXXF

SEQ ID NO: 72545 - protein, 29 aa, Artificial sequence
  protein pattern
  Variant (2)..(2): Xaa in position 2 is any amino acid
  Variant (3)..(3): Xaa in position 3 is Ile or Leu
  Variant (4)..(5): Xaa in position 4 to 5 is any amino acid
  Variant (7)..(7): Xaa in position 7 is any amino acid
  Variant (8)..(8): Xaa in position 8 is Asp, Glu, Ser or Thr
  Variant (9)..(9): Xaa in position 9 is Ala or Gly
  Variant (12)..(12): Xaa in position 12 is Ile, Leu, Met or Val
  Variant (14)..(14): Xaa in position 14 is Leu, Met or Val
  Variant (15)..(15): Xaa in position 15 is Asp or Glu
  Variant (16)..(16): Xaa in position 16 is Ser or Thr
  Variant (17)..(17): Xaa in position 17 is any amino acid
  Variant (20)..(20): Xaa in position 20 is any amino acid
  Variant (21)..(21): Xaa in position 21 is Phe, Ile, Leu or Val
  Variant (22)..(22): Xaa in position 22 is Ala or Val
  Variant (25)..(25): Xaa in position 25 is any amino acid
  Variant (27)..(27): Xaa in position 27 is any amino acid
  Variant (28)..(28): Xaa in position 28 is Gly or Ser
  Variant (29)..(29): Xaa in position 29 is Phe, Trp or Tyr
SXXXXDXXXRVXRXXXXSKXXXPGXRXXX

SEQ ID NO: 72546 - protein, 19 aa, Artificial sequence
  protein pattern
  Variant (2)..(2): Xaa in position 2 is any amino acid
  Variant (3)..(4): Xaa in position 3 to 4 is any or no amino acid
  Variant (6)..(6): Xaa in position 6 is any or no amino acid
  Variant (9)..(9): Xaa in position 9 is Ile or Val
  Variant (10)..(10): Xaa in position 10 is Ala, Cys, Pro or Thr
  Variant (11)..(11): Xaa in position 11 is any amino acid
  Variant (18)..(18): Xaa in position 18 is any amino acid
  Variant (19)..(19): Xaa in position 19 is Cys, Ser or Thr
PXXXLXYTXXXGQNPTGXX

SEQ ID NO: 72547 - protein, 22 aa, Artificial sequence
  protein pattern
  Variant (2)..(2): Xaa in position 2 is any amino acid
  Variant (3)..(3): Xaa in position 3 is Ile, Leu or Val
  Variant (4)..(4): Xaa in position 4 is Ala or Cys
  Variant (5)..(6): Xaa in position 5 to 6 is any amino acid
  Variant (7)..(7): Xaa in position 7 is His or Tyr
  Variant (8)..(8): Xaa in position 8 is Asp or Asn
  Variant (9)..(9): Xaa in position 9 is Phe, Ile, Leu, Met or Val
  Variant (10)..(10): Xaa in position 10 is any amino acid
  Variant (12)..(12): Xaa in position 12 is Ile, Leu or Val
  Variant (15)..(15): Xaa in position 15 is Asp or Glu
  Variant (18)..(21): Xaa in position 18 to 21 is any or no amino acid
YXXXXXXXXXIXEDXPYXXXXY

SEQ ID NO: 72548 - protein, 16 aa, Artificial sequence
  protein pattern
  Variant (2)..(2): Xaa in position 2 is Ala, Gly, Ser or Thr
  Variant (3)..(3): Xaa in position 3 is any amino acid
  Variant (5)..(5): Xaa in position 5 is Leu or Met
  Variant (7)..(10): Xaa in position 7 to 10 is any amino acid
  Variant (13)..(15): Xaa in position 13 to 15 is any amino acid
  Variant (16)..(16): Xaa in position 16 is Ile, Leu, Met or Val
LXXGXPXXXXFPXXXX

SEQ ID NO: 72549 - DNA, 1893 bp, Saccharomyces cerevisiae
  CDS (1)..(1893)
atgcttaaatcattaaaatccagaagactaatcttaaaacgattagtaacactgctgctctctttattcttttcttatctcattttctctgccagtcggaatgttacatcatccaataaattaaacaaccatgcaagcgagaggacagctgttgaatcatctgcattcaattggattgaaaaacgacaacaccaagtgagatccgaaaacttaatgaacagattatctgcctactttttgccctttttgagtagaagttctcacaaagaacgtgtattgttgaggcaattaggaaataatgaaatagcgaagagtgacaagtgccgttacatttttgaagtactatacaagattgatcccgactgggacaatgcgcaaactgcaaaattttataatgttgatggtgtagataacacgttggcctcattgttaggggaaagattaagatcttatgattattgctttttatctggtcaattagatcctactgcaatatttgcaaattcaaccgtaaatcctcatgatttgcaaaacagaatgtttccatttctgaagaaaattaacgaggaatccaaaactgtaatgtggcctattatcacagacatgacaactggagaggcagttccggcacccgaggttgatatggaatcatcaaactttaatggtaacttttggtccaactggaataggttgagcaaaggaagaggttttgttttaactattgctgaaaaggatgttcctttatttttgaaacagttgaaagtgatggaattttcaaaaaacgaattaccattccaaatagtatccacgggaaatgaactatcagcagagtctattgctaaaatttctgagaccgctaaagaaacggaacaaagggtctacttagtagactgctcgacagtgcttgacactaattttgctaatacatacatttctttttttcagaataaatgggtcgccactttgttcaacacatttgaagaatacattttgttggatgcagacgtagtaccgtttgtagggtctgattactttttcgactctccttcttacagggagagcgggatacttttgttcaaggatagggttatggaaaacgagcaaactttccaatactgcatcgaaatgttaaatgaagtggaaccctctgcacaagaacgcagatttattggaagtaggttagtttttgattcgtcattaccgttttcttccgaaacctcagaagaagcatctgtgtattacaattttttcaaaaaattacgactccatcatgttgatagtggtttggttgtagtcaataaacttgagaaattaaatggattgttgatgtcttttatgttaaatttggatggaaaattgcagaggtgtgtgtatggtgacaaggaaatattctggttggggcaattatatgctggccaggattattctatcaatcccgttgatggcagtattattggacctgttaatgaagagcctgaaaatgatgacggacataaaagcgggatgtactacatttgttctacgcagattgcacacagtgactccaaaaatcgattactatgggtaaacggtggactgaagacttgtaaaatttcgaacagtgctgaagatgactttggaagagagccagagtattttaagagtagatatggggacatttcaaaattaaaaaggatatatgatgcttcgttgaacgtagagggactaatcgttcctgacgtttctgttcatccatggatgcaaatcaaggaatgttctaattatatgtattgtgcatatgctacgggtgacggacacacaaactctgaacttgacgaaggtcgtctaatcacgtttactgaaaaggaattacgatatatcaatgatatttctcgaacctggaatgctaattga

SEQ ID NO: 72550 - protein, 630 aa, Saccharomyces cerevisiae
MLKSLKSRRLILKRLVTLLLSLFFSYLIFSASRNVTSSNKLNNHASERTAVESSAFNWIEKRQHQVRSENLMNRLSAYFLPFLSRSSHKERVLLRQLGNNEIAKSDKCRYIFEVLYKIDPDWDNAQTAKFYNVDGVDNTLASLLGERLRSYDYCFLSGQLDPTAIFANSTVNPHDLQNRMFPFLKKINEESKTVMWPIITDMTTGEAVPAPEVDMESSNFNGNFWSNWNRLSKGRGFVLTIAEKDVPLFLKQLKVMEFSKNELPFQIVSTGNELSAESIAKISETAKETEQRVYLVDCSTVLDTNFANTYISFFQNKWVATLFNTFEEYILLDADVVPFVGSDYFFDSPSYRESGILLFKDRVMENEQTFQYCIEMLNEVEPSAQERRFIGSRLVFDSSLPFSSETSEEASVYYNFFKKLRLHHVDSGLVVVNKLEKLNGLLMSFMLNLDGKLQRCVYGDKEIFWLGQLYAGQDYSINPVDGSIIGPVNEEPENDDGHKSGMYYICSTQIAHSDSKNRLLWVNGGLKTCKISNSAEDDFGREPEYFKSRYGDISKLKRIYDASLNVEGLIVPDVSVHPWMQIKECSNYMYCAYATGDGHTNSELDEGRLITFTEKELRYINDISRTWNAN

SEQ ID NO: 72551 - DNA, 1947 bp, Eremothecium gossypii
  CDS (1)..(1947)
atggtacaatcgccgtcgatagctatattggttgcctggggtctccagtgcaaaggcctcccggacgccattttacggacagtcattgcactccttttagcaactgataggtcagggatggttagctatggtctaatgggtaacttttcgaagaaaatggtgcacagaggtatgggccgttggagatttcgaggccaccgatggtcgttacggtatattcgaatatgtgttcgaacagttatggttttcagcatgctggccctggtccttcaatatagcggcaagatactggtggcctcaatcttgcacaatagcgttcgtcccagcagcaaaacaccgctccatacagtacatgctgttgaacaactccagttcgggagatggccgctggaaaagaagtgccagtggtactttgcgaaagaaaagagacaacaatggctgaacgaaattatcgaaaggtcgcgtggtcgcatgaaggatgcctcggtgacagctgccatgctggaacgactacgagtgttcgacacttgtttcatgcaaggagatataggtcttcgtgaggtttttggtgaggacataaacttgtactctctccatcatgaactatttccgtttttaaagaaagtacgcgattggagcgaactgctcccccaggtattggatctcaatgatgggtcacgttatttattggggaacaagctacccgagcaagcatttaaggtggataacgacttaccattttgggagaatttgcggagatcttcgagtgggcgagggatagtagcgaccgtggcagacattcatcttgatcaattgaagcgcctgctccatgtccttgatgaactggggaataaattgcctatagagttggtgtacaagggtaacgacttctctcgattgcctatcaaaagactgaaaaggtacgttcggcagcacacaaaacagcgagttcggctggtggactgttcgcgtgtactacgcagtacacatatacctaagataaagaggttcatgaataagtggttagccactatattcaattcatttgaggaaataatactactagacgtggatgttgtgccactggttccaatcgatagctacttcaaacttcccggctacactaaaacgggcgctctgttcttcaaggatagaacgcttccggagtaccttcctgtttcatgcacaaaagcgatactactcttgccaccatcgtcggaggagaacaaactttggggacattctatgagatatcgaacaccaatgacaaaagctggcgcactagaccggaccaattccgccgaaacagaggttatgtacaactatttcatcgaacgatatcgtcatcaggtagaaactggtctggtggtgctgaatagaaagcaacggctcttttctctggttacttcgttcatgattcatttaaacttacgattcagcgagtgtttccacggtgacaaggaagtattttggctgggacagctgcttacaggaaatgagtactcaattcacccaatgcctgcagctataatcggtgagcttcagcagggtgaacgaaaactggctgcgacggaatatcgtatttgcagcacgcagattgctcatccagatactgatggaactgtattatggattaatggcggcatgtggaactgtaaagataataaagctgcagaagaagacttttccgattacaaccgctacttcacaaggaaatttggctcccagcaaaaactagccgattggtataaacagacacttaaagttactggtgtttttagcccagaactaaagaattcaaaatggatacctgcaaaggaatgcaaacaatccgcattttgctcctctgtctttgtacatgatgacgaggagcttcaatctctgaaggatgctgatatctcggtatgcaatcatctagcgtcagtttggggctcgttgcctgaataa

SEQ ID NO: 72552 - protein, 648 aa, Eremothecium gossypii
MVQSPSIAILVAWGLQCKGLPDAILRTVIALLLATDRSGMVSYGLMGNFSKKMVHRGMGRWRFRGHRWSLRYIRICVRTVMVFSMLALVLQYSGKILVASILHNSVRPSSKTPLHTVHAVEQLQFGRWPLEKKCQWYFAKEKRQQWLNEIIERSRGRMKDASVTAAMLERLRVFDTCFMQGDIGLREVFGEDINLYSLHHELFPFLKKVRDWSELLPQVLDLNDGSRYLLGNKLPEQAFKVDNDLPFWENLRRSSSGRGIVATVADIHLDQLKRLLHVLDELGNKLPIELVYKGNDFSRLPIKRLKRYVRQHTKQRVRLVDCSRVLRSTHIPKIKRFMNKWLATIFNSFEEIILLDVDVVPLVPIDSYFKLPGYTKTGALFFKDRTLPEYLPVSCTKAILLLPPSSEENKLWGHSMRYRTPMTKAGALDRTNSAETEVMYNYFIERYRHQVETGLVVLNRKQRLFSLVTSFMIHLNLRFSECFHGDKEVFWLGQLLTGNEYSIHPMPAAIIGELQQGERKLAATEYRICSTQIAHPDTDGTVLWINGGMWNCKDNKAAEEDFSDYNRYFTRKFGSQQKLADWYKQTLKVTGVFSPELKNSKWIPAKECKQSAFCSSVFVHDDEELQSLKDADISVCNHLASVWGSLPE

SEQ ID NO: 72553 - DNA, 1926 bp, Eremothecium gossypii
  CDS (1)..(1926)
atgtgcaagtggtgcgggcgctggatcgtcctcgcatgggagcatcagatgtcatatcggcgaagcctttccatatggcggctacgaacgatacgagttccgctcctgcttgcgctgttggggtctgtgagcgtgctgctattgctgtcgctgacgccacacatgtggcctggatggccatctccggcagcacgggaggtcccggcttcaccagagtcacaggccccggcttcaccagagttacaggccccggcttcaacacagccacagtccccagcagggtctaagacgctactgcaagacttactgctagatagcaaaaaaccggagggggcctctacgccacagatgcagtgcaagcgctactttgagggcacatatctccgggagccttcctgggcaaatacgtgttgcgcatggcagacgactttcttacggctacgcaatacacagcgaggctgttggagcggtgtgtgcatatttgctgattgtttcggggttcaatatttccggatctcagatcagctatcaaacaagatagacatgcacgacttccatcagcggatgttccctttcttggcgaagaagagagaatggagggatatgtggcctgtcatcacggatatcaacaccgggatgacttttgagggcggggctgtgtgggaagggcgccaatcagagattgacgatggtgcatctttttggaaaaactggcgctctttttcgcacggtaagggaatcacgatgtcggtaggggacggccacttggaaatgttactgcgcatgctcaccgtgctggattatttgggtaatgagctcccaattgagatagtagagaaaggcggtgagctttcacagcagtttagggataagctgacggaattcgtccgtaacaagtccaagcagaaagtgcgaattatatcatgcgccaggacattggacgagacgcatgcaagactaatttttggctttagctgcaaatgggtagcgttaatgtttaacacttttgaggaggcgatctttttggatgttgatgctgtgccgtatattctaccagagcagtttttcgatatggagggatataaatcgacaggtattatgctcttcagggaccgtttgatagaccagcatgtgtcaaaagaatgtccagacgctgtgcgacaaatgattcccacacaagaggagaccagcatctggaatcacaaagctaagttcagcggcccagccgccaacaaggaagcatatgacaataccaaagacgagggggcagccgcggtttacgatcggttctttagggatcattattaccatgtcgtcgagagcggcgtcgtggtgtttaacaaaaagaacaaacttcagtcaattgttaactcttttatgctaaacctgaatttctattacgtcggctgcttctacggagataaggagctgatgtgggtgggccagctcctctccgcagaggattattatattcatccagcacctcccgccatattaggcagtgccgaggagtttgagcgcgagggaaatactgtaagttatcgggtttgcggagcgcagattggccacatggaactggatggctcattgctatggactaatggtggtctgaggacatgcaaatttacggacactgctgagcaggatttcagtaaatcgccggaatatttcaacccaaagtacagtagcccccagcaattacaggagcactatagcaaacctttggaaatccagcttatttttattcccgagctcacatattccgtttgggagaaatccgtcgagtgccaaggatatacatggtgctcaactgtcactctgaacccagagaatccctcggagttcaagtccatagtaatgaagggcgacacgcggctggaacattacaacaacatatcacaaaggtggaatagcgcgtcattttga

SEQ ID NO: 72554 - protein, 641 aa, Eremothecium gossypii
MCKWCGRWIVLAWEHQMSYRRSLSIWRLRTIRVPLLLALLGSVSVLLLLSLTPHMWPGWPSPAAREVPASPESQAPASPELQAPASTQPQSPAGSKTLLQDLLLDSKKPEGASTPQMQCKRYFEGTYLREPSWANTCCAWQTTFLRLRNTQRGCWSGVCIFADCFGVQYFRISDQLSNKIDMHDFHQRMFPFLAKKREWRDMWPVITDINTGMTFEGGAVWEGRQSEIDDGASFWKNWRSFSHGKGITMSVGDGHLEMLLRMLTVLDYLGNELPIEIVEKGGELSQQFRDKLTEFVRNKSKQKVRIISCARTLDETHARLIFGFSCKWVALMFNTFEEAIFLDVDAVPYILPEQFFDMEGYKSTGIMLFRDRLIDQHVSKECPDAVRQMIPTQEETSIWNHKAKFSGPAANKEAYDNTKDEGAAAVYDRFFRDHYYHVVESGVVVFNKKNKLQSIVNSFMLNLNFYYVGCFYGDKELMWVGQLLSAEDYYIHPAPPAILGSAEEFEREGNTVSYRVCGAQIGHMELDGSLLWTNGGLRTCKFTDTAEQDFSKSPEYFNPKYSSPQQLQEHYSKPLEIQLIFIPELTYSVWEKSVECQGYTWCSTVTLNPENPSEFKSIVMKGDTRLEHYNNISQRWNSASF

SEQ ID NO: 72555 - DNA, 1938 bp, Eremothecium gossypii
  CDS (1)..(1938)
atggcattttttagaggaagattacggcctattctcgggctcattacccttgcaatagtagttagtacctgtttccttggactctcgctgttaacagaagagtttaaccaggggattgtttcatctatacatcagtggtcgccaccatcctggttagttaaaccgtcgaatggagccaagtcagtgaatgaggctaagccacagagtgaggacaagccatcgagtgaaagcaagccacagagtgaggacaactcatcgagtgaggacaagccggatgatgcaaaaagttctctgctggacctgttgacacaagaagggcctgatgtggtcgccttatgggatttacaagagcgttgcaagcgatactttgaattgacctaccgaaaagagcccgcttggtctaatcaagttcctttcttatcaagggatatcatatcagatgcctcgtattccgccaagttaatggaaagatggagaatatttgcggattgttttattgagggaaatgagcctttatcgactactctcgatggtagagttgacatatttgacttccagcaacgtatgtacccctttttgactaaagttcggcgttgggaagaaatttggcctatgataacagatctcaatacaggagaacagtatcagcctggtcatttgaaagatggacagagattaactattgacgataatttatcgttctggaaaaactggcaattattctcgaaaggtagaggtataacaattacggcaggtgctgaacatgtcgaaatgcttcctcggcttctaaatgttcttgatcacatcggtaatactctgccaatagaactgataaatgcggcagacctacctccaacgaccattgataaaattgctaaatatgttcagatgaaatctaaccaaactgtacgcctggtcgattgtggcaaaactttggaacacagctatcgctcattgattactggtttccgtcataaatggctagcctatatctttaacacttttgaggaggcggtattcatagacctcgacgctgtgccatttgtcgatcttgaaaagttatttgaagtcgaaggctacaagtccgaaggcatattaatgtttagggaccgctcctatgatggtgagaaaccagatgattgtccaaaagctatgcgtataatgatgccatcgccaaaagagcatactatgtggcagcatggatcaaattatgataagcaggtagctgaagatgaactgactaagaaaccaagagatgctggagcagcaacattttatatcaagtatatggaaggtaagtcgttccatatggcagaaagtgggcttatagttatgcacaagaacaagaagttaccatctcttctcatttcactgatgttgcatatgaccttcgaaacgcatttgtgttcacatggggacaaagagtacctctggcttggacaattagtatcgggagaaaactattacgtggatccccgtccgccggctataataggcgtaccgcagctagttagtaatcatggtcaggtagatgagtataagatatgctccgcgcaaatagcccacatggacgatgatgggtctatattatgggttaatggtggattaaaaaattgtaaatttgatgctgtggaaagggactttgaagattacacggaatacttctctaaaaaatacatcaataaagaaaatcttcagaagttttatgatcttgaggtggatatgcagatggcattcattcctgactttgttgatagcgattgggtcaaagcaccagaatgtagagcctttacatggtgctcaaccattaaagcagattcaatggaaggtgctgaataccaatcatatattataaagaaaggcgaccctcgattgcgtgaatataacaaaatagccgaaatctggagcaaagcgccatatctgagcagtatagcataa

SEQ ID NO: 72556 - protein, 645 aa, Eremothecium gossypii
MAFFRGRLRPILGLITLAIVVSTCFLGLSLLTEEFNQGIVSSIHQWSPPSWLVKPSNGAKSVNEAKPQSEDKPSSESKPQSEDNSSSEDKPDDAKSSLLDLLTQEGPDVVALWDLQERCKRYFELTYRKEPAWSNQVPFLSRDIISDASYSAKLMERWRIFADCFIEGNEPLSTTLDGRVDIFDFQQRMYPFLTKVRRWEEIWPMITDLNTGEQYQPGHLKDGQRLTIDDNLSFWKNWQLFSKGRGITITAGAEHVEMLPRLLNVLDHIGNTLPIELINAADLPPTTIDKIAKYVQMKSNQTVRLVDCGKTLEHSYRSLITGFRHKWLAYIFNTFEEAVFIDLDAVPFVDLEKLFEVEGYKSEGILMFRDRSYDGEKPDDCPKAMRIMMPSPKEHTMWQHGSNYDKQVAEDELTKKPRDAGAATFYIKYMEGKSFHMAESGLIVMHKNKKLPSLLISLMLHMTFETHLCSHGDKEYLWLGQLVSGENYYVDPRPPAIIGVPQLVSNHGQVDEYKICSAQIAHMDDDGSILWVNGGLKNCKFDAVERDFEDYTEYFSKKYINKENLQKFYDLEVDMQMAFIPDFVDSDWVKAPECRAFTWCSTIKADSMEGAEYQSYIIKKGDPRLREYNKIAEIWSKAPYLSSIA

SEQ ID NO: 72557 - DNA, 1884 bp, Candida glabrata CBS 138
  CDS (1)..(1884)
atgttatccaaactatcaatgatacagggcaggttacctgttagtcggagaccaatagttttagttttgacacttcttggagctatatttctgttgacacagtttaacaaggatgatgaaatagtcttacagccagaacaattgggccttggcaaatataaaggagcgaggaaggctttaccaaactcagtgtataagaagactgctactatattaaagaggaatagaggaaatgatcagaatacgaaatctcagtatgaaatagattgggaagaaggaagaatttcacgagttgagatgtgcaggaccatgattcatgaaatctataatattggcataaataataagccccatgtgctgtcctcacccatgaagaattttgctagtgtagcggccatggcagaatccataagactgtacaatttttgttttattgatggaaatatcaatagttttgaactttatggtcaagaaaacaatgcaggtgctactgttctattgaatgacttctttccttttttgaaggcgcatacggatggtgagcatatgtggccagaagttacacatttgaataaggataaaataatactgccaaactttgatctggaagcagtagatacttttaacgcaaatttttggattaactggaagaagcatgcacgaggaagaggtatagttgttacattcaaggaggaggaagcaaatatgatgatgaaattaattgctgtgttaggccatctaaaaaatagattacctattcagatcgtgattcaaggtaataaatttggtagcagaacaattgagatgttgaaggaaaaggcgattgaaaagaaacagcagatatacattgtagatgccacaaagctgctgatggagaaatatgcagaagttcatatacagggctataccaacaaatggattgcttctatatttaatacttttgaagagttcattcttctggatgttgacactgtaccgttcataaatcccaagaagttttttgaaaagaaaggatacaggacaacaggattttatatgtatcaggatagaaacttggtgaatgagaaacttggcagaaagtgtgtcgacataatatctggggcacaactttctggatatgaggctcgtgtcctgaacacaggctttttgtacagcccttattttgcaagggaggatgattacaccactgcttctgctcgcgcgtattacaaactgttcaataactggacattacaccaagctgaaagtgttctagtggtgataaacaagaagcagaagctaggtgggttgttgatgtcatttatgttaaacacgcagatagctctgaagcaatgctttttgggtgacaaggaattcttctggataggtcagttgatgaacaacagtccttactatatagatgaaagaccggctactatcgtcggacctttgtcctcacctactgatgagcaaagcaattactacaagatttgctccgcacaactgggccatcttggggaagacggtaaactcgattgggttaacggaggcatgcaggtctgcaagttcaaaaacgcagctatgaaggactttaccgacgaccccgagtttttcaaatctagacataaggacgcggcggttcttcagaatttttacgactcgactgtgacgctcgacggttacatgacagcggatccgccaagttgccaatggatgaacatcagggagtgccagaagtacatgtactgcattatctgcgacaagaagcccagcctggggacagccgcgcccggagacatgaccccctcagtgcagtttactgataagtaccacgcgcaagttaacgacatcgcccgcatatggtccgaagagtccacaagcgacacaaacgctttcggtgtctag

SEQ ID NO: 72558 - protein, 627 aa, Candida glabrata CBS 138
MLSKLSMIQGRLPVSRRPIVLVLTLLGAIFLLTQFNKDDEIVLQPEQLGLGKYKGARKALPNSVYKKTATILKRNRGNDQNTKSQYEIDWEEGRISRVEMCRTMIHEIYNIGINNKPHVLSSPMKNFASVAAMAESIRLYNFCFIDGNINSFELYGQENNAGATVLLNDFFPFLKAHTDGEHMWPEVTHLNKDKIILPNFDLEAVDTFNANFWINWKKHARGRGIVVTFKEEEANMMMKLIAVLGHLKNRLPIQIVIQGNKFGSRTIEMLKEKAIEKKQQIYIVDATKLLMEKYAEVHIQGYTNKWIASIFNTFEEFILLDVDTVPFINPKKFFEKKGYRTTGFYMYQDRNLVNEKLGRKCVDIISGAQLSGYEARVLNTGFLYSPYFAREDDYTTASARAYYKLFNNWTLHQAESVLVVINKKQKLGGLLMSFMLNTQIALKQCFLGDKEFFWIGQLMNNSPYYIDERPATIVGPLSSPTDEQSNYYKICSAQLGHLGEDGKLDWVNGGMQVCKFKNAAMKDFTDDPEFFKSRHKDAAVLQNFYDSTVTLDGYMTADPPSCQWMNIRECQKYMYCIICDKKPSLGTAAPGDMTPSVQFTDKYHAQVNDIARIWSEESTSDTNAFGV

SEQ ID NO: 72559 - DNA, 1887 bp, Candida glabrata CBS 138
  CDS (1)..(1887)
atgtcgctactagcacggtacttgcttcaaaggcgagtgaaacgatatagtgttctatttgtgctatttgtgggtctgtttatattcattgccagacatcttacaaatgaagaagaatccgacaatggtatatacaaagatgataaattcccatacgaagatggattattgcactctagtagcaattcagcgtacacattcataacagatgcaatgaacaaattaactaaaaagaagaaaaatagctttttatcacccaaaggtctgtcctatttcaaagatgatgagagaatattaaagaattggaatactagctctagagtggacaaatgcaaatggctcataagaggtatctatgccgatccaaattggaataacagggacattttgataggttcagatgagacaaatgataaaaataaattccatttatcttccgaacgtattcgaattcataactactgcttcatgaaggaacgtattgacccggtgcaaatgttcaatgaattgaacatatcatcaactgatgcatatgatttccaaggtagaatgtttatgtttttaagaaatgtgacctctactgatgaagcatatatctatcccataattaaaaatgtgcgtaatggccaagtgaccactaaaccacatactaagttgtcaccaatgcaatacaattcaaatttcatggcttactggaaacaggaatcaaaaggaagaggcatagcattaacagcggcccctaaagatgtaaagctcttaaggtcactatttaaggtattcgagaagttaggaaatacttatccaatacaaatagttcagaaaggaggagagatgtcaccgacaatggaaagcctgatcaaagattacgcgattgaaactaatcaaaatgtgtttattgtagatttgtctccagttcttgaccctgattttgctactgatcacataaggaaattccaaaacaaatggtttgcttctatattcaatactttcgaagaggtaatgttgattgacgcagacgtggtaatatatacggagccagagagcttcttcaaccttgacgggtacaaaaatacaggattattactttggagagatagggagattgtagatgctaagacacatgaaaggtgcactgatatggcaccatactttgagccggcgctggaggagcataggttactaggaactgtacaaaaataccggctcactggtccctctttagagacacatgatgaacctgaagcggagacactattcgattttttccatagacgcatcgtgactattatcgatagtggtgttgtcatatacaataagaagcaaaaattacatggtttgattttagcagagtattttcataatagtaagcaatttgccggttgtgtgtatggtgataaagaatattttgagtttggtgctttagtcgctggggaggattatcatgtagaggcagaaaaggctgttgccattggagcagttggatatcaccctccaagagagaaatattacgtatgttcgggtcaaatgggtcatgttgacagaaataacaatttgttgtggtctaatggtgggctaaagaactgtaaatccgattgtgctgaagcagatttcgagaaaatgcctaagtatttcaaagctaaatatgggacactaaaggctgttaaagagtactataacggtttgatggacattcaggggtttgtgttaccagatgtacagaagcagaaatgggtacagtaccctgattgtcagcaattcttgtattgcgcatttattactgatccacctgaacctgacaataagggaaaattagttaggttcagtgatgaagaaaagatgagatacaatgagattggtaaagcctggtattccggagcaaatgattaa

SEQ ID NO: 72560 - protein, 628 aa, Candida glabrata CBS 138
MSLLARYLLQRRVKRYSVLFVLFVGLFIFIARHLTNEEESDNGIYKDDKFPYEDGLLHSSSNSAYTFITDAMNKLTKKKKNSFLSPKGLSYFKDDERILKNWNTSSRVDKCKWLIRGIYADPNWNNRDILIGSDETNDKNKFHLSSERIRIHNYCFMKERIDPVQMFNELNISSTDAYDFQGRMFMFLRNVTSTDEAYIYPIIKNVRNGQVTTKPHTKLSPMQYNSNFMAYWKQESKGRGIALTAAPKDVKLLRSLFKVFEKLGNTYPIQIVQKGGEMSPTMESLIKDYAIETNQNVFIVDLSPVLDPDFATDHIRKFQNKWFASIFNTFEEVMLIDADVVIYTEPESFFNLDGYKNTGLLLWRDREIVDAKTHERCTDMAPYFEPALEEHRLLGTVQKYRLTGPSLETHDEPEAETLFDFFHRRIVTIIDSGVVIYNKKQKLHGLILAEYFHNSKQFAGCVYGDKEYFEFGALVAGEDYHVEAEKAVAIGAVGYHPPREKYYVCSGQMGHVDRNNNLLWSNGGLKNCKSDCAEADFEKMPKYFKAKYGTLKAVKEYYNGLMDIQGFVLPDVQKQKWVQYPDCQQFLYCAFITDPPEPDNKGKLVRFSDEEKMRYNEIGKAWYSGAND

SEQ ID NO: 72561 - DNA, 1914 bp, Candida glabrata CBS 138
  CDS (1)..(1914)
atgccgttaaaacttcggtttatatcgatgatattgcaactgagaaggctcgttggtgcaaaagtgaatacacgacatagactatatctaattccgctggtagcagttttgttattttttgttaactggcctcgttctaccacgccccctgtggtctctatatatgaaggcgagtatccatttaatgaggatttgctacattcaagtgctgagtcagcctttacagttatttcagataaaatcaataaccttaaagatgagtacgcaaacagatcgctaaaacaaaagttattttcattctttgataaagatgagaagattcttaagaattgggaaagtagttctttgaatgataaatgcagatggttagtcagaggtatatactccagctcagcatggaataattttgatataacaaaaaattataaatttgaaactgcctatgaaaaatttcaagcagttactgagcgtgtaagaatctacaattactgtttcatgaatggcaatatcgaccccgttgaggtatttgatgagttgaacataccgtttgcagacccatatgacttccaaagtcggatgttcatgttcttgaagaaggtgaataggaatgacaaagcgtacatgtacccactaatcaagaatgtgcgtaatggagatattatagcgaagccacggactaagatgagtgctaaggagtacaatgctaatttcatggggcactggaaagctgaggcccgcgggcgaggtattacgttgacagtagcacctgatgatataaagctattgcggtcattatttaaagttttggagaagttagggaatgaatatcctgtggaggttgtccataaaggtggtgagatgacacccaagatggaagatctgatcagacaatatgctgaggagacaaaccaggaagtatatgtcatcaacctctcaccaatacttgatccagattttgctagtcagaatatcaagtcattcaaaaataaatggtttgcagctatgttcaatacctttgaagaagctattttgctagacgtagatgttgttctttacgcatctccagagtatttcttcgaactggatggttataaaaaaacaggactcatgctatggaaggatagagaatatactgaggttgaaactagtgatcgctgcgcttcaatggctccatattttgaaccttcagaagaagaacatgaattgttgggtacaatacaaaagtatagactaactggacctgatttagaaacacataatgaatccgaagccactacacttaatgacttttttaacaataaattagccactataattgatagcggagttgtccttattaataagaaacaaaaattaaatgctctcttacttgctgcatattatcatatgagcaaatactttggaggctgcacatacggtgacaaagaattatttgaaattgcagcattggctgctggcgaagattattatgttgatccaaacaaagcaggagcaatagggccaattggataccatccaccaagagagaaatattatgtttgttccgcccaaatgggacatccggatgaaaacaacaacttactttggtctaatggtgggctaaagaattgtaagttagatagtgcagaagccgacttcaaaaaattaccaaaatattttaaggccaaatacggcagtctggatactgtcaaactatattacaaaggtcggtcagaaattcagggctttattgttcctgatatcgttaaacaaaagtggatacaatacccagactgtcaacattacttatattgtgcatttattacagatccaccagaggatgataatactggaaaacttgtaagatttagtgaggaggagatggagaagtataacgagataggaagagcttggtatgcgggtactatatattag

SEQ ID NO: 72562 - protein, 637 aa, Candida glabrata CBS 138
MPLKLRFISMILQLRRLVGAKVNTRHRLYLIPLVAVLLFFVNWPRSTTPPVVSIYEGEYPFNEDLLHSSAESAFTVISDKINNLKDEYANRSLKQKLFSFFDKDEKILKNWESSSLNDKCRWLVRGIYSSSAWNNFDITKNYKFETAYEKFQAVTERVRIYNYCFMNGNIDPVEVFDELNIPFADPYDFQSRMFMFLKKVNRNDKAYMYPLIKNVRNGDIIAKPRTKMSAKEYNANFMGHWKAEARGRGITLTVAPDDIKLLRSLFKVLEKLGNEYPVEVVHKGGEMTPKMEDLIRQYAEETNQEVYVINLSPILDPDFASQNIKSFKNKWFAAMFNTFEEAILLDVDVVLYASPEYFFELDGYKKTGLMLWKDREYTEVETSDRCASMAPYFEPSEEEHELLGTIQKYRLTGPDLETHNESEATTLNDFFNNKLATIIDSGVVLINKKQKLNALLLAAYYHMSKYFGGCTYGDKELFEIAALAAGEDYYVDPNKAGAIGPIGYHPPREKYYVCSAQMGHPDENNNLLWSNGGLKNCKLDSAEADFKKLPKYFKAKYGSLDTVKLYYKGRSEIQGFIVPDIVKQKWIQYPDCQHYLYCAFITDPPEDDNTGKLVRFSEEEMEKYNEIGRAWYAGTIY

SEQ ID NO: 72563 - DNA, 1872 bp, Candida glabrata CBS 138
  CDS (1)..(1872)
atgcatttattccatctacaaaacaataagcgactacgttatagcattattttcctagccttcacatctttattactgttactttatagatcaaattcgatagagccgttaccaaagtcaatatatgtcgatgatcaatacccatatgctgaaggtttattacggtcgggtcataattcagcatttacattaatatctaatgagatgaacaagaatcaatcaagggataaacaatctctatcggatgggcttacccgtttcttcgatcgggattccaaagttcttaaaaattgggacaatagttcgagaaaagacaaatgcaagtggcttataagaggcatttatacggactccaattggactaacatagatattttggaatggacaaatgacgcaactgataagaacaaattccaagtatgctctgaacgtgtaagaatctacaattactgtttcatgaatggcaatatcgaccccgttgaggtatttgatgagttgaacataccgtttgcagacccatatgacttccaaagtcggatgttcatgttcttgaagaaggtgaataggaatgacaaagcgtacatgtacccactaatcaagaatgtgcgtaatggagatattatagcgaagccacggactaagatgagtgctaaggagtacaatgctaatttcatggggcactggaaagctgaggcccgcgggcgaggtattacgttgacagtagcacctgatgatataaagctattgcggtcattatttaaagttttggagaagttagggaatgaatatcctgtggaggttgtccataaaggtggtgagatgacacccaagatggaagatctgatcagacaatatgctgaggagacaaaccaggaagtatatgtcatcaacctctcaccaatacttgatccggactttgcagaagagaatatcaaaagatttagtaacaagtggctggcagccatgtttaatacttttgaagaagtaatgcttctagatgctgatgtagttctatacaaccatcccgatcatttttttgagctgaaaggctatcaagatacaggacttatgctatggaaagatagggaaatcactgacactgatgtttatgataaatgcactgcaatggcgcctttttttgagccatcattagaagagcataaactattaggaactacccaaaaatacagattaacgggtccttcactggaagcacataatgaatcagaagcgaccacattgatagattactttcgcaaaaaacgtcttaacgttattgatagtggtgttgttatcttcaacaaaaagcaaaagcttcatgctttagtgctctcgaattattatcatatcaatcgaaaatttttaggatgtgtccacggtgataaggagttttttgaatttggtgtattggctgcaggtgaagattaccacattgccccacagagggcagccgcccttggtccaattggttttcatcctggccggcaaaaatattacgtgtgttccactcaaatggggcatccagatgaaaataataacattttgtggtccaatggggggctaaagaattgtaagctagataaagcagaagctgattttaaaaggcacccagaatatttcaaggccaaatacggaaatgtagctactgcgaaagtatattatacttaccgagttgagattcaaggctttattatccccgatgtaaaaaaacaggaatggtttcaatatcccgattgcgcgcactattggtattgcgccttcttagaggatacaccagattcactctcgacaggcaagctagtaaaattcactgaaaaagagatagagaggtataatgacatcggcaaagcttggtatcatggtactaagtaa

SEQ ID NO: 72564 - protein, 623 aa, Candida glabrata CBS 138
MHLFHLQNNKRLRYSIIFLAFTSLLLLLYRSNSIEPLPKSIYVDDQYPYAEGLLRSGHNSAFTLISNEMNKNQSRDKQSLSDGLTRFFDRDSKVLKNWDNSSRKDKCKWLIRGIYTDSNWTNIDILEWTNDATDKNKFQVCSERVRIYNYCFMNGNIDPVEVFDELNIPFADPYDFQSRMFMFLKKVNRNDKAYMYPLIKNVRNGDIIAKPRTKMSAKEYNANFMGHWKAEARGRGITLTVAPDDIKLLRSLFKVLEKLGNEYPVEVVHKGGEMTPKMEDLIRQYAEETNQEVYVINLSPILDPDFAEENIKRFSNKWLAAMFNTFEEVMLLDADVVLYNHPDHFFELKGYQDTGLMLWKDREITDTDVYDKCTAMAPFFEPSLEEHKLLGTTQKYRLTGPSLEAHNESEATTLIDYFRKKRLNVIDSGVVIFNKKQKLHALVLSNYYHINRKFLGCVHGDKEFFEFGVLAAGEDYHIAPQRAAALGPIGFHPGRQKYYVCSTQMGHPDENNNILWSNGGLKNCKLDKAEADFKRHPEYFKAKYGNVATAKVYYTYRVEIQGFIIPDVKKQEWFQYPDCAHYWYCAFLEDTPDSLSTGKLVKFTEKEIERYNDIGKAWYHGTK

SEQ ID NO: 72565 - DNA, 1890 bp, Candida glabrata CBS 138
  CDS (1)..(1890)
atgtcgctactagcacggtacttgcttcaaaggcgagtaaaacgatatagtattctatttgtgctatttttgggtttgtttatgttcattgccaggcacacacaaagaagaaatgacacaagcatatctgtttttgcagaagaaaagtttccctataatgaagggcttttacattctgaaggcaattcagcttatacatttatgagccaaaagctccaaagagttagtgaaaactgggataaagatccgatctacaaaagaatattttcaagcgttgattatgattataaaattttaatgcactggaatacaagctcaagacaagataagtgtaagtggctaattagttcactatattcagatcccaactgggacaatcgtgatatattcgaatactcaaaaaatgggcaatataacaatacgtttaaagtagcagctgagaatttaagaatatataattattgttttctaaatggaaacattaatcctttacagttttttgatgacttgagtataccattcacagatgcctacgatttccaaaaaaggatggtaatatttttaaggaagacttcttctgatgatgaggcatatttatatccattgatcaaaaacgtccgtaatggtgaaataattgccaaaccgccaacaaaactatctccaagagagtacaattcaaacttcatgggccattggaagcgagaatcaaagggaaagggtatcacactaaccatagcacccggtgatattaaacttctgcgatctttatttaaagttctccaaaggcaagggaatgaatatcctgtgcaaataattcaaaaggggggtgaaatgacacctaaaatggaatcgcttataaaaaaatacgcgttagaaacagagcaagatgtatatataattgacctagctccaatcctagatcccgcttttgctatccagagaattacaaaatttcaaaataaatggtttgcatctatgtttaatacttttgaagaagctttactactagatgccgatgttgttctttacactgaaccggaacacttttttaaaatgaaaggctatcaagatacagggctcttgttatggagagatagagagttgactgcactagagacaccagatagatgtgcagcgctagctccccatttagaaccctctgtagaggaatatagcttgctaggcactagacagaaatatagactaacagaatcatccttaaagattcacaatgaaccagaagcaagaacgctttatgaatatttccataaaaagattgtaacgatcattgatagtggcgttgtagtgtataacaaaaggcaaaagctacatgctctcatgactgccgaatacttccatatcagtcgtaagtttgcaggctgtgtctacggtgacaaggaatattttgaatttggtgcttttgctgcaggagaagattaccacatagaaaaagataaggcttctgcgattggatcaatagaatatcattccgctaaagataagtattacatatgttccgcacagatgggacatgctgatgaaaataataatttgttgtggtcaaatggaggattaatgaactgtaaagcaaattctgcagctgatgattttaatgaaaatccgaagtacttcaaagctaagtatggagatgttaagacactcgaagcccattatagcaagccaatagatattcaaggttttattataccagatataagcaagcataattggattcaatatccagagtgtaaacgctatgtttattgtgctttcgttgccgatcctccagtagatagcaataccggaaagcttgtcagattcagcagaaagaacaggcaaatatataaggatattgccagtgtgtggtttgaaggcacttcatattcataa

SEQ ID NO: 72566 - protein, 629 aa, Candida glabrata CBS 138
MSLLARYLLQRRVKRYSILFVLFLGLFMFIARHTQRRNDTSISVFAEEKFPYNEGLLHSEGNSAYTFMSQKLQRVSENWDKDPIYKRIFSSVDYDYKILMHWNTSSRQDKCKWLISSLYSDPNWDNRDIFEYSKNGQYNNTFKVAAENLRIYNYCFLNGNINPLQFFDDLSIPFTDAYDFQKRMVIFLRKTSSDDEAYLYPLIKNVRNGEIIAKPPTKLSPREYNSNFMGHWKRESKGKGITLTIAPGDIKLLRSLFKVLQRQGNEYPVQIIQKGGEMTPKMESLIKKYALETEQDVYIIDLAPILDPAFAIQRITKFQNKWFASMFNTFEEALLLDADVVLYTEPEHFFKMKGYQDTGLLLWRDRELTALETPDRCAALAPHLEPSVEEYSLLGTRQKYRLTESSLKIHNEPEARTLYEYFHKKIVTIIDSGVVVYNKRQKLHALMTAEYFHISRKFAGCVYGDKEYFEFGAFAAGEDYHIEKDKASAIGSIEYHSAKDKYYICSAQMGHADENNNLLWSNGGLMNCKANSAADDFNENPKYFKAKYGDVKTLEAHYSKPIDIQGFIIPDISKHNWIQYPECKRYVYCAFVADPPVDSNTGKLVRFSRKNRQIYKDIASVWFEGTSYS

SEQ ID NO: 72567 - DNA, 1899 bp, Candida glabrata CBS 138
  CDS (1)..(1899)
atgcaacctattatgaagtttaggttgagaagacagtcaagaaaatacgtcctgattttcttggctgcttgtactcttattttcatattgtatcccacaaagcagacatttcaagaacaacattctacttctgattccaggaaaaaaagcacttcaagtgattatagcttgaagttgaagcaagttttcgataaatcaccatttagtgatctttcgaagagaattgagatagcagaagaagaagctaactcgttctcattactgaagctaatacctttcttgggaaacggtaaggatgctagggaaagaaaagtgcttgcacactgggcgcaagctaataggaaagaccaatgccctcaattaatcaagggtctttacgcaacgcctgattggtcgaacaatgaaattgtggccgcgcacaagaaagttagggttgatgaaattaatatgcaagtttcagttgagagaattagaatctacaattactgtttcctagagggtggtcttgacgtaaccgaagtcttaaaggatgctggactatcttcatatgatgcttttgacttccaaagtaggatgttcatcttcttaaagcaagtaacaaaaactgacgccaaatatttgtatccaataatacagaatttgaacacagaagaaataatcagtgaaccaactacaactaagtcaccacaagatttcaatgcaaactttatggctaattggaggcaattagctaatggtaaaggtatagcgatcactgtcaaccctgatgatgtggagtttatgattcgtctatttagagtgttaaaagaacttggaaacacataccctattcaagtcatacaaaaggggggagagctgacttcaccactaattgagcaaattaagaaaactgctattgaaacaaaccaagcagtgtctattgttgatttgagtcctatacttgatgagaagtttgcaagggaacaaattacatcattccacaataaattttttgctgcaatgtttaatacttttgaagaagtcctgttgctcgatgctgacgtagtaccttatgtgtctttggatgaatttttcaatctcaagggatataaggatacagggctccaattctggagagatagaaatagaggttctgatacacataagttctgctcaaatttaggtgtttatcttgaaccatctttggaagagcataatttattaggcactgagttgaaattcagaatcaatagtctggccaagaagaaggtgagatcatcagaagaaagagctttccatcgttttttcaatgaactgaaggttcacaacatcgatagtggtataatagtgttgaacaagaaacagaagttgcacagcctaattatgggtgagattttctatactaacggtagatttggtagatgcgcttacggagataaggagatgtttatgatgggagcatttgctactggcgcagattttataattgatccacgtgatgccggtattattggaccaataggatataatatagatcaaagagtgaactttatttgttcagcccaaatgggtcacttggatgaaaataacagggtactatggtctaatggtggtttaagattctgcaaattccctgattttgctaaaaaggactacactccaaaaaaccaagactacttcattcaaaaataccaatcatatgataatatggctagaatatacaagactaaagtggagataacaggatttattatacctgaagtcgagaaaaatgaatggatgcaaatacctgattgtcaatcatacatgtactgcggtcttgctaagaaagttgacactaaagctctgatcttaaagtttgaaggtgaggaaaaggagaggttgaacagaatatcagatgtatggaacaatccaatctag

SEQ ID NO: 72568 - protein, 632 aa, Candida glabrata CBS 138
MQPIMKFRLRRQSRKYVLIFLAACTLIFILYPTKQTFQEQHSTSDSRKKSTSSDYSLKLKQVFDKSPFSDLSKRIEIAEEEANSFSLLKLIPFLGNGKDARERKVLAHWAQANRKDQCPQLIKGLYATPDWSNNEIVAAHKKVRVDEINMQVSVERIRIYNYCFLEGGLDVTEVLKDAGLSSYDAFDFQSRMFIFLKQVTKTDAKYLYPIIQNLNTEEIISEPTTTKSPQDFNANFMANWRQLANGKGIAITVNPDDVEFMIRLFRVLKELGNTYPIQVIQKGGELTSPLIEQIKKTAIETNQAVSIVDLSPILDEKFAREQITSFHNKFFAAMFNTFEEVLLLDADVVPYVSLDEFFNLKGYKDTGLQFWRDRNRGSDTHKFCSNLGVYLEPSLEEHNLLGTELKFRINSLAKKKVRSSEERAFHRFFNELKVHNIDSGIIVLNKKQKLHSLIMGEIFYTNGRFGRCAYGDKEMFMMGAFATGADFIIDPRDAGIIGPIGYNIDQRVNFICSAQMGHLDENNRVLWSNGGLRFCKFPDFAKKDYTPKNQDYFIQKYQSYDNMARIYKTKVEITGFIIPEVEKNEWMQIPDCQSYMYCGLAKKVDTKALILKFEGEEKERLNRISDVWNNPI

SEQ ID NO: 72569 - DNA, 1911 bp, Candida glabrata CBS 138
  CDS (1)..(1911)
atggaaaagctgtatatgaagaagagcctgcttgtgtacaggactaagaaggtcttgaggcaacattgcgtgactatttctctttgcgtttcgttgctgttcattatatttactgtttttggtggttcttctgtcgatgatagacaaggatacgacttgctgaacttgagtctggagcaagggtccacatttgcttctaaatactcagtcttcaaatatgtctcttccaggatatatgaaaatgagaagaagccaggcagattgatgttcttgaagaaactattcccattcggtaacaatgggagagatttacatgagcgttccgtgctctccaactgggataaagctagtaaggctgaccaatgtgcgttgcttctacaagggttttatttggatcccaagtgggacaacgctgacattttgactgagagagaagaaaaagaagattacagaaatatgcaattggccattgaacgtatgagaacatacaagtactgcttcatggacgaagatattgacatcttggatactttcaaggcggcagggttctcccccaatgaagcatatgtcttccaaaaaaaactgtttatgtttttgaagcagactgacgggagtaccacagaatacttgtatccaagaattgaaaacttacgtacaggtgttattacagaagaaccaaccactgatttatctgtaagtgagtataatgcaaagttcattcctacttggaggaatatggcaaagggtaaaggtatcgcggtatcagtttccccaaaggaaattagaatgttacattctttatttgctgtgttgaatcaacaaggtaacaaactacctattcagattattgataagggcgaaacattaactttggcagacaaagaactgataaagtcttacgcagtaaaaactaaccaggatgtttcagttgttgatctcagccctataattgatgctgaatatgcagatgaaaatattataggaatgcataataaatggtttgctgcaatgtttaatacctttgaagaagttctattgctagatgtagatgtaataccatttgttggaacagaaaagttttttcaacttgaaccttacacttcaagacatatcttgttctggaggaacagagatatcaagaaaaagaatccaaaatactgtcctgaagcagctattttcttggaaccaactactgaagagcaccaggtgttgaaaactgatctacatcacaaactatttacaaaacaagtgagaaaccctgccacttctgaagacaaagctctttccgagttctgctttcaaaggaagtcaaatcatgttgatcctggcttaattgtgttcaataagaagctcagattccagacatttgctatcacagagttattgcaccaacacgatacatttagggcatgcgtcggtaccggtgctgatgcgctcatattaggtgcttttgctgctggcgaaacatttagactagacccaagagacgctggtatcgttggttctataagttactcggaagcagacaagatgaactttgtctgtggtactcaaatcgcacacaatgatgacaaggacaatttgctatggatatctggtggaggcaggacgtgcaaaaacccagatctgctggtggaagattttgcagctgatgaagagtattacgaggtgcgttatggtaactacggtaatgctgaaactatttacaaatccaagatacggatcgatggctacttagcaccgaaggtcagccagaaggaatgggtcgtcatcccggactgtggcaacactatgagatgtgcctttgtggattccaacgtcaaggactttagtggtagatccattaagtataacgacgagaccaaatcgagagtcaccaatctaatagatatttggtacaatgccgagtaa

SEQ ID NO: 72570 - protein, 636 aa, Candida glabrata CBS 138
MEKLYMKKSLLVYRTKKVLRQHCVTISLCVSLLFIIFTVFGGSSVDDRQGYDLLNLSLEQGSTFASKYSVFKYVSSRIYENEKKPGRLMFLKKLFPFGNNGRDLHERSVLSNWDKASKADQCALLLQGFYLDPKWDNADILTEREEKEDYRNMQLAIERMRTYKYCFMDEDIDILDTFKAAGFSPNEAYVFQKKLFMFLKQTDGSTTEYLYPRIENLRTGVITEEPTTDLSVSEYNAKFIPTWRNMAKGKGIAVSVSPKEIRMLHSLFAVLNQQGNKLPIQIIDKGETLTLADKELIKSYAVKTNQDVSVVDLSPIIDAEYADENIIGMHNKWFAAMFNTFEEVLLLDVDVIPFVGTEKFFQLEPYTSRHILFWRNRDIKKKNPKYCPEAAIFLEPTTEEHQVLKTDLHHKLFTKQVRNPATSEDKALSEFCFQRKSNHVDPGLIVFNKKLRFQTFAITELLHQHDTFRACVGTGADALILGAFAAGETFRLDPRDAGIVGSISYSEADKMNFVCGTQIAHNDDKDNLLWISGGGRTCKNPDLLVEDFAADEEYYEVRYGNYGNAETIYKSKIRIDGYLAPKVSQKEWVVIPDCGNTMRCAFVDSNVKDFSGRSIKYNDETKSRVTNLIDIWYNAE

SEQ ID NO: 72571 - DNA, 1863 bp, Candida glabrata CBS 138
  CDS (1)..(1863)
atgaatcgcaggactaagagtctgctgagaaggtacattttagcgattatagtgatcttgtcactgacgtttgtcttctacagcaatactctcacaactgttgtaagtactgtgaatgtggccgatacccaagattacacttccggattgaagcacgcttctccagtttcgcctttcagctatgtgaacaactatcttctgaactcagagaagacccgttctagcaccgtgaagaaactgctgccatttctgaataagccaaaggatggtcttgtcgattggaacagcagttccaagtatcaaaagtgtctactgttggtgaagagcatgtataaggcacaccctcattggagtaaccgtgatatcatgactgcatatgataacgaaagtgtagaagatctgaatctacaactagcgggagaaaggataaaaatctacaagcagtgcttcctggataacgacattgaacctatagaatttttcaaaagactgagtatacctgacgttgacgcatatgattttcaaaagaggatgttctatttcttcagagatatcactgctagcaacaccgactacttccacccagccataaagaacgtgaaaagtggtgaggttgtctccaaacctaagaccaagctaacacctcaagaatataacgcaaacatcattgggaattggcgtaagctatcccgcgggaaaggtatcgttttaactgtaagccaatcggatgtccctcttttacgtcaacagttcagagtttggaaggaactcggtaacaaattgcctattcaggttgtgcacaaaggtacagaaattaatgccgagttggagcaaaagatcaaagaatatgctatagagatggagcaagatgtttatgtggttgatttgagcccagttatcgatccagattttgctgaaaactctatccagaactttcataacaagtggtacgctgccatcttcaatactttcgaagaattaattctgatagatgccgatgctatcccatacgtgcctgctgaagatttcctgaaatcaaagtcatacaaaaagacgggtttgagattatggagagacagggatattacacatgaacgtacgttacacttctgtgtagagatggcaccatactttgaaccaactcttgaagaacacaatctcataggcacaaccttgagctacagactaacagattcggggctcaaggatgctaaggattctgaagggagagccctgtatgagtttttccagaagatgtatctgcaccatgttgacagtggtctggtggttattgacaagaaagacaagatacacagtttaatcatgtccgagatcttgcatagtcataccaggttcggaagatgcacttacggtgataaagagcttttcatgcttggtgcatatatggttggcgagagttacacgttagaagctcagagtgcagcgattataggtaccgttggctacgagaaggagttctctaggcattacatatgcgcaacacaaatgggacacagtgacgaagacaatagacttctgtggtctaatggtggtctaagaacttgtaaatttgactgtgcagaggaagattttaataaggatgaagaatactacaaaaaaagatatcagaacgtagacaatctaaaggccgtctactcttctaggttaaacatagatggtttcattattcctgatacaacagtaaacaagtggctacaactaagtgaatgtaggcagtatatgtattgcgcccacgttgacgataatagagagaaagataaggggactcttgtcagattgaccgacgaggaaaagcaaaaagtgaacagaatctctgaattttggaactcagcaaaaatttga

SEQ ID NO: 72572 - protein, 620 aa, Candida glabrata CBS 138
MNRRTKSLLRRYILAIIVILSLTFVFYSNTLTTVVSTVNVADTQDYTSGLKHASPVSPFSYVNNYLLNSEKTRSSTVKKLLPFLNKPKDGLVDWNSSSKYQKCLLLVKSMYKAHPHWSNRDIMTAYDNESVEDLNLQLAGERIKIYKQCFLDNDIEPIEFFKRLSIPDVDAYDFQKRMFYFFRDITASNTDYFHPAIKNVKSGEVVSKPKTKLTPQEYNANIIGNWRKLSRGKGIVLTVSQSDVPLLRQQFRVWKELGNKLPIQVVHKGTEINAELEQKIKEYAIEMEQDVYVVDLSPVIDPDFAENSIQNFHNKWYAAIFNTFEELILIDADAIPYVPAEDFLKSKSYKKTGLRLWRDRDITHERTLHFCVEMAPYFEPTLEEHNLIGTTLSYRLTDSGLKDAKDSEGRALYEFFQKMYLHHVDSGLVVIDKKDKIHSLIMSEILHSHTRFGRCTYGDKELFMLGAYMVGESYTLEAQSAAIIGTVGYEKEFSRHYICATQMGHSDEDNRLLWSNGGLRTCKFDCAEEDFNKDEEYYKKRYQNVDNLKAVYSSRLNIDGFIIPDTTVNKWLQLSECRQYMYCAHVDDNREKDKGTLVRLTDEEKQKVNRISEFWNSAKI

SEQ ID NO: 72573 - DNA, 1983 bp, Candida glabrata CBS 138
  CDS (1)..(1983)
atgtccattgaggggcttcgatacattttttatggttgtaaggatgttttagggaataggcattctttcaacagacgtgcctcttttctattgtcatttttcatctcactatgtcttctaatttggtataaccaacatgaagatacagcaaagttgtcttctataaaatataggtatactgagtatgaaagtcaattgaaactaggaagttcgagtcagttatttggcaggattacttcaaaggcatataaaatggagcaggaaaataaccgccagcaacaatggaaaaacttgctattctggaaacctttaacggtagaacaactagaatacaatacattgccgtattggaatgctgcttctgatttagatagatgtagtcttttagtgaaagctctgtatgacggcgatccaaaatggaacaatagtgaaatattagtctggaataaagacatggctatgaaaaaatacagtttgttgcacccggttgaaagaattcgaatgtataaccattgctttttagataaaggggttgacgtgatacaggtttttaaaaagcttggactagatgaacataatgctactgagtttaaccataggatgtttccaatgtttcaatttgtgaatgtcacttcagatcaatacttgtatccaaaacttaccgatttgagaacgggtaaagttataacgaaacctaagacaaaacaaagagctctagaatataatctcaattttctgaggaattggagaaatgaagcaaagggcaaaggattagttattactatagagtcaaacaatctccatatattgaggaaattgtttaaatttctaaaagaaaatggaaatactcttcctattcaactagtatttaaaaggaatgtgactctagcaaggttcaaggatgcaatcatttcatatgcggaggaatctgatcaacacgtaacaataattgagatagaagcactcattgacgatagtttcaataagggaacatttgttggttatgacgataagtttctagcatcaatatttaatacatttgaagatgtggtaatgatggatatcgaggtcataccttatgtaaatccagaagagttattggagaatgaagagtataaaaattccggtttatatatgtggcgagacaagtatctgggggctttgctgcatgcgtatatatgtacggatgttatgaaatcactagagccatccatggatgaatataaaacaattggttccaaatttcctcttagaatgaatgacccacgcctcacagatacatcagatcccatgggtgctatacttcatgggtattataacctatatttaatgcatcaagttgatgggggtgttatattgttgaacaagaagcaaaagttaggtggactaatcatgggtatggttatgaacatgcacagggactatgctcactgttcaaccggtacaaaagaagcgttctggtttggtccatacgttgctggaatggaatttgcagtaggcactatcgacgcaggtataataggaccaattagacgctcaactatagaagatagacttggtgttcccgaaatatgttccaaccaagtaatacatgttgatcatgaagataaactgctttggggtaaaggaactttctatgaatgtgagtcggataagttacaagaaatagatattgaaagcgaagttggtataagaaaaagatcgctaccaagcacagatgtaaatgttgtgagaagagatgaacaacagtttgccagcaaggagcccaaacgcgggtttttagccatcacaggttttataattccatctagagtagtcaagaaatggaagtacagaattgggagctcagtagagtattactgtacatttgttgacaggataggtgacgccgacagtaagctggtacggtttgacaagaagactaagagatttgtcaaccatctagcccagatatggagggaaacaaaaatatctgtaggttag

SEQ ID NO: 72574 - protein, 660 aa, Candida glabrata CBS 138
MSIEGLRYIFYGCKDVLGNRHSFNRRASFLLSFFISLCLLIWYNQHEDTAKLSSIKYRYTEYESQLKLGSSSQLFGRITSKAYKMEQENNRQQQWKNLLFWKPLTVEQLEYNTLPYWNAASDLDRCSLLVKALYDGDPKWNNSEILVWNKDMAMKKYSLLHPVERIRMYNHCFLDKGVDVIQVFKKLGLDEHNATEFNHRMFPMFQFVNVTSDQYLYPKLTDLRTGKVITKPKTKQRALEYNLNFLRNWRNEAKGKGLVITIESNNLHILRKLFKFLKENGNTLPIQLVFKRNVTLARFKDAIISYAEESDQHVTIIEIEALIDDSFNKGTFVGYDDKFLASIFNTFEDVVMMDIEVIPYVNPEELLENEEYKNSGLYMWRDKYLGALLHAYICTDVMKSLEPSMDEYKTIGSKFPLRMNDPRLTDTSDPMGAILHGYYNLYLMHQVDGGVILLNKKQKLGGLIMGMVMNMHRDYAHCSTGTKEAFWFGPYVAGMEFAVGTIDAGIIGPIRRSTIEDRLGVPEICSNQVIHVDHEDKLLWGKGTFYECESDKLQEIDIESEVGIRKRSLPSTDVNVVRRDEQQFASKEPKRGFLAITGFIIPSRVVKKWKYRIGSSVEYYCTFVDRIGDADSKLVRFDKKTKRFVNHLAQIWRETKISVG

SEQ ID NO: 72575 - DNA, 1929 bp, Candida glabrata CBS 138
  CDS (1)..(1929)
atgaagcccatgaattacagggccaggaaacagtttggtaggcgggccgtactcactgttgtggttatttttgtgcttttatatctgagctcttcatcatcctctcctaaggcaggcaaccatgtatctgacaaggatgcagttgatgacccattcaggatgcattatgaatttggtctgtatcctgcaagcacattttctccattcagctatataaatacaaggataatgaagctgaaagaagagaaggatgaccccaagaaggccggtaagaagacccgcactgaatcagaggaggacaaaatattattgaactggaacaagggctccaggtttgatcaatgccgactattggtgaaaggtttctatacagatgagaagtggaacaatatgaatctggtctacgcttggtctagtaaggactatatggagaagacagcacagtttgcaggcgagtgtatgagaatatacaactattgcttctttgaaggtgatgttaatcctcgggaactattcaaaaagcttgatctacaagcaactgatgcttatgacttccagaaaaggatgttcttctttttgaaaaacgtaacacaagaggatagcgactacttgtacccaactataaaaaatgtccgcactggcgaagttgtcagtaaaccaaagaccaaacaaagtccacaagagtttaactcgaacttctttgctaactggagaaaaattgcatctggcagaggaattgtactatctgcaaaacctgatgatattgatatgctgcggcaacaattaagcgtctggaaagaactaggaaacaaatatccaatccaggtggttcataaaggtggagaattaaccagggataatgaaatatcattgaagcagtttgcagaggagacagaccaaaatatatatattgtggatgcgggtcctgtccttgataaaaattttgcggatgagcatataaccaagttccacaataagtgggtaggtgtactattcaatacttttgaggaatatattatggtagatgctgatactgtaccttttatctcagctgaagacttcttcgaatctgagaacttcaagaaatcaggaatgagaatgtggagagacagaacgcttaccaacagacatatccgtgaacattgcccagatcttgccttgaaacttgagccatccttggaggaacatagaatcttaggaactacactaagatttaagttattagatccagacttaaagcaagaaaagacatctgaagagagagctttcaaccaaatgagaactaacttggcacttcaccatgtggatagtggattagtagtcataaacaagaaagagaaactgcatagcttattgctatcagaattctttcaaaaccacgccctattcagaagatgcagttacggtgacaaagagttgttttggtatgctgccttctctgcaaatacagattatgttatagagcccgaagatgctgcaactatcggtaagttagaatattccgaaaaggatagaagatacagcatttgtgccatccaaatggcccatacagattcgaatgatcaactactttggactaatactggcttaagaaactgtaaaatacctgaagtagctaagaaggacttcgatgagaatccaaagatgatgaccgagaaatatggaagtcttgaagtaatgaagatatcatatcacgcacctttgcaaatagatggttatttgattcctgatccagaagaacatgaatggcaacaaacacatgtttgtgctgactacacatactgcggttttgtcgatgaactgaatataggctacagcaaggctaaagtacatgagttttcggatgaggagaagaagagattgaataaaatatccaaaatatggaacaatgctgatgtcaacaaagagagaaatagaattggtgtatag

SEQ ID NO: 72576 - protein, 642 aa, Candida glabrata CBS 138
MKPMNYRARKQFGRRAVLTVVVIFVLLYLSSSSSSPKAGNHVSDKDAVDDPFRMHYEFGLYPASTFSPFSYINTRIMKLKEEKDDPKKAGKKTRTESEEDKILLNWNKGSRFDQCRLLVKGFYTDEKWNNMNLVYAWSSKDYMEKTAQFAGECMRIYNYCFFEGDVNPRELFKKLDLQATDAYDFQKRMFFFLKNVTQEDSDYLYPTIKNVRTGEVVSKPKTKQSPQEFNSNFFANWRKIASGRGIVLSAKPDDIDMLRQQLSVWKELGNKYPIQVVHKGGELTRDNEISLKQFAEETDQNIYIVDAGPVLDKNFADEHITKFHNKWVGVLFNTFEEYIMVDADTVPFISAEDFFESENFKKSGMRMWRDRTLTNRHIREHCPDLALKLEPSLEEHRILGTTLRFKLLDPDLKQEKTSEERAFNQMRTNLALHHVDSGLVVINKKEKLHSLLLSEFFQNHALFRRCSYGDKELFWYAAFSANTDYVIEPEDAATIGKLEYSEKDRRYSICAIQMAHTDSNDQLLWTNTGLRNCKIPEVAKKDFDENPKMMTEKYGSLEVMKISYHAPLQIDGYLIPDPEEHEWQQTHVCADYTYCGFVDELNIGYSKAKVHEFSDEEKKRLNKISKIWNNADVNKERNRIGV

SEQ ID NO: 72577 - DNA, 1878 bp, Candida glabrata CBS 138
  CDS (1)..(1878)
atgaagacactactcagggcgaggaaccctggtttcaagcgttgctcgcttttagcagtcattgcgatatgctttctgttcatcttcatgcgtgcagattccgcttctcaaaggcggtcgacgagatatgaagaagatctattgttctcgtcgggaaactctacatatgcttattttcagcgcaaagtcaaggaattgcatgacaataaaccattcttctccttggagaacatgctaccctcatggatgctgtcaactcacactgctagagagaaaagagtccttttaaactgggataagagttccggctttgaccaatgtgctatgctaattaaaggcctttacaacgaccctaattgggataatatggccatcactatagatcatgataacgctacaatcaacgatgaggtgttccagatgtctgctgaacgtgtaaggctgtacaaccactgcttcttgcagaatagttatgatataaatgaaatgtttgagaagtatcgcatgtattacacttcacctcatgattaccaaaggagaatgtttccatttttgagaaaagtaacagccatggacggttactatatatatcctaccataacaaacctacgtacaggagaagtacagactggtcctatagcagatatgagctaccaggaattcaactctaattttatcgctcactggaagaatgaagcgaaaggcagaggcatcgtggtcactgctagtgttaatgattgcagattcttgcgttctcagttttttgtatggaaagagctaggtaacacatatccaattcaagtggtcactaagggtaaagaaatgccaccagaactgatagctaaaatcaaagaatatgcaactgaggcagaccaagaggtttacatagtagacttgcaaaatgtgttagatccaaattatgctgaaaaatatatcgaaaatttccataacaaatggtacgcagcaatgtttaatacctttgaagaagcaatccttgtcgacgctgatgttgtgtcttatgttcacccagatgagtattttgaatcggctgatttcaagaaaacaggtcttaaactatggagagacagagatatcccagatatccacgtgcatatatactgcctaaacatggcaccatatttcttaccatctaaagaagaacatagaactctcggtactactctaaagtatagacttgaggaggaatcattaaaggatgcaggcacatctgaagctgacggcttacataaattctttttcgagaagtcaggctctattgttgatagtggtcttgttgtattcaacaagaagaagaaattacattccctaattatttcagagttttttcataccgatgccaagttcaaaccatgcacatatggtgataaggaaattttcatgcttggagcttacagtgctggtgtagactattcattggaccctgaggctgctgtgatcataggcccaatcagagagtcaacaaataagaagtttaactccatttgctcagctcaaatgggccataccaatggccgtggcaaactgctgtggtccaatggtgggttacaagtgtgtaagaacccaaactttgccaaggatgactttgagaaagatgttaaattcatgagtaataattatggtacacttgaagacacagagaagtactacaagtctaacctatctattgatgggttcatatcgcccaatgtaccaaacctcaaattccaacagcaacctgcctgtcaccactatatgtactgcgtacatatgcctgtcgatggcgaagatatgggagagttggttcgtttcgatcaagaacagagagaaagagttaacaaaatttcgaacgtatggaactctgtcaagatcaatctataa

SEQ ID NO: 72578 - protein, 625 aa, Candida glabrata CBS 138
MKTLLRARNPGFKRCSLLAVIAICFLFIFMRADSASQRRSTRYEEDLLFSSGNSTYAYFQRKVKELHDNKPFFSLENMLPSWMLSTHTAREKRVLLNWDKSSGFDQCAMLIKGLYNDPNWDNMAITIDHDNATINDEVFQMSAERVRLYNHCFLQNSYDINEMFEKYRMYYTSPHDYQRRMFPFLRKVTAMDGYYIYPTITNLRTGEVQTGPIADMSYQEFNSNFIAHWKNEAKGRGIVVTASVNDCRFLRSQFFVWKELGNTYPIQVVTKGKEMPPELIAKIKEYATEADQEVYIVDLQNVLDPNYAEKYIENFHNKWYAAMFNTFEEAILVDADVVSYVHPDEYFESADFKKTGLKLWRDRDIPDIHVHIYCLNMAPYFLPSKEEHRTLGTTLKYRLEEESLKDAGTSEADGLHKFFFEKSGSIVDSGLVVFNKKKKLHSLIISEFFHTDAKFKPCTYGDKEIFMLGAYSAGVDYSLDPEAAVIIGPIRESTNKKFNSICSAQMGHTNGRGKLLWSNGGLQVCKNPNFAKDDFEKDVKFMSNNYGTLEDTEKYYKSNLSIDGFISPNVPNLKFQQQPACHHYMYCVHMPVDGEDMGELVRFDQEQRERVNKISNVWNSVKINL

SEQ ID NO: 72579 - DNA, 1992 bp, Kluyveromyces lactis NRRL Y-1140
  CDS (1)..(1992)
atgtcagttaacaagccaaataatctaaaatatgtaatgaataaacaaagtaaatcaaattgtccgatgaggctgagactctatctgcactcaaaacaagaaagaaatccgagagactatgcttgtggccctgaagcgatgaaatttcgttggagaaggatatttagcatcaaggtgcttgggattgtaactacgttgctgtttatatcttttctattaccaagcggagcagtaccaaattcaactgttccacattttgaaggtaaaagagcactaatttactctccattttatagactcgcaagctcgcttaacctcggaaaatggctttcgttggctctacatgctactaataagtatcataagattggtttggactggccaacgctacccctagagcagaaatgccgtttttatttcgaatcaacattggaaataaacccaacatggaataatgatcatattaaagacttccataacgacaataatttggatgaccccttggcagagcttatgttagaacggataaggatgtatgattcttgtttcatcagtggaggtttatccacatccaaggtgttcaagagatcagtcgtgaagccaaacgatcttgaatcgagattattccctttcctctcaaagaagacaccattcagacatttgtggcctaaaatgatacatgtcaatccttggacgttgattccttcttttagtaacccattgttagaaggtaaagacacctggaaaatggatgataattattcattcttctataattggaataattttgcagaggggaagggaattgtactgacattggggctgaggcacggtgaccagttcaagaagttacttctcactttggagaatttaaataatacacttccaatacaagttattcacaacggatctgagcttactgaagccttcatttacgacattcattcattcttaaacgcaaaaaaattatcacagcaggtttattttgtcaatattgaaccgttaatcgatgcttcattcgttggtcaatacgtccattatttcataaataaatggatggcattattgttcaataccttttctgaatgtattctactggatgcggactctgtgtcatttgccagtcttgaatcctattttgatttcaaaggttatcaggacactggcatgctgttattcagagacagaaatattataggcgagaaaacttttatttattgtacagatacattaaagaagcttttcccgtctgtagaagaaacccatttcatgagccatagatctactttccccctcgaacttgtggagaatgataatatcaatatcgatactctatctatggaagagcagatatactataagttcttccataacttacaactacatcacatagatagtggattagttgtagttgatcgagttaaaaaattatctagtctactcatctcaactatgatgaatatcgatggtaagcttcaaagatgcgtttacggcgataaagaaatattttggcttggccaattgctcgccggagagaaatattctatatacccaactgaaggttccatcatgggtaccgttaaaaacaagcctgatgatacttttgaaatatgtggcacccaaatggctcacgtcagcacagaaggtactttactatggtccaacggtgggttgaagaagtgtaaggtacaagactgtgccgtggctgatttcgaccacgaccctgactatttccaagagaaatacggcaaccctgttgccttacagcaaatgtatgattcttcattatctatcagtggttatatcacgccgaatgttgggcaatatccctgggaaaaaatcaaggagtgtcatcagtacacttattgtgccacagcaaaagaaaacgtaggaaccatagtcaaattcgataccgatactatttcacgtttacaatctgtttcggatatctggaattcaaacgtcaaacttgatgataacatggaaatatag

SEQ ID NO: 72580 - protein, 663 aa, Kluyveromyces lactis NRRL Y-1140
MSVNKPNNLKYVMNKQSKSNCPMRLRLYLHSKQERNPRDYACGPEAMKFRWRRIFSIKVLGIVTTLLFISFLLPSGAVPNSTVPHFEGKRALIYSPFYRLASSLNLGKWLSLALHATNKYHKIGLDWPTLPLEQKCRFYFESTLEINPTWNNDHIKDFHNDNNLDDPLAELMLERIRMYDSCFISGGLSTSKVFKRSVVKPNDLESRLFPFLSKKTPFRHLWPKMIHVNPWTLIPSFSNPLLEGKDTWKMDDNYSFFYNWNNFAEGKGIVLTLGLRHGDQFKKLLLTLENLNNTLPIQVIHNGSELTEAFIYDIHSFLNAKKLSQQVYFVNIEPLIDASFVGQYVHYFINKWMALLFNTFSECILLDADSVSFASLESYFDFKGYQDTGMLLFRDRNIIGEKTFIYCTDTLKKLFPSVEETHFMSHRSTFPLELVENDNINIDTLSMEEQIYYKFFHNLQLHHIDSGLVVVDRVKKLSSLLISTMMNIDGKLQRCVYGDKEIFWLGQLLAGEKYSIYPTEGSIMGTVKNKPDDTFEICGTQMAHVSTEGTLLWSNGGLKKCKVQDCAVADFDHDPDYFQEKYGNPVALQQMYDSSLSISGYITPNVGQYPWEKIKECHQYTYCATAKENVGTIVKFDTDTISRLQSVSDIWNSNVKLDDNMEI

SEQ ID NO: 72581 - DNA, 2241 bp, Kluyveromyces lactis NRRL Y-1140
  CDS (1)..(2241)
atgatggttgtaaggcgttttttatcagcttcgcgatataatatgccatcttttaggtccaggcccgttctcttagctatctttggtgtctgtgctaccgtgatatggtacctattctttttccagtctaatctgaagatggcagatttgaaaaaggtagcaacttcaaggtatctttcacaagaaccgtcgttatcagaacttatgtcaaatgtgaagatcaagcctattgaagaaaccccggtttcgccattggagttgattccagatatcgaaatatcgactagaaagaaatacgatgcgtcgtgggatctgttgttccgtggtagaaaatataaatcgttcaacgattatgatcttcatacgaaatgtgagttttatttccagaatttatacaatttgaacgaggattggaccaataatattcggacgttcactttcgatattaacgatgtagacacgtctacgaaaattgacgctcttaaagattccgatggggttcaattggtggacgagaaggctatacgtttatacaagagaacgcataacgttgccttggctacggaaaggttacgtctttatgataaatgttttgtcaatagtccaggttcaaacccattgaaaatggatcaccttttcagatcgaacaagaagagtaagactacggctttggatgacgaagtcactgggaaccgtgatacttttaccaagacgaagaaaacttcgttcttaagcgatatggacacgagtagtttccagaagtacgatcaatgggatttcgaacatagaatgttccccatgatcccatatttcgaggaacacaatttcaccaacgtgatgcctattttcaccggctcaaacggtggggaacctttacctcaagggaaattcccggtattagatccaaaatccggtgaattgttacgtgtagagactttcagatatgataaatcgaaatcgctttggaagaactggaatgatatgtcctctgcttctggtaaacgtggtattatcttggctgctggcgacggccaagtggaccaatgcatccgtcttattgctacgttgagagctcaaggaaacgctctacctattcaaattatccacaacaaccaattgaatgagaaatctgtgaaactgttatcggaggccgctaaatctaccgaattctcatccggtagagctcaatctctttggttagtgaatgtgggccccacgttggaatcttcaatgaagagcaattttgggagatttaagaataagtggttgtcagttattttcaacacttttgaagaatttatattcatagatacagatgccatctcctacattaatatggctgattatttcaacttcaaggagtacaaatctactggaacactcttctttaaggataggtctttggcaattggaactgaacagaaatgtggtcctttgttcgaaactcttgaaccaagaattcttgaaatgtactatttcaatactttacctatgatcaatggtgattacgtggaacagcaatgtatgggcatgctcaccccagaggaaaaagtttacaaacgtttctttgaagttggtcatcaacacaacttggaaagtggattattggccatcaacaaaaacgaacacatcatgggattggttactgcaacagtcttaaatatcgcaccaaaggtcggaggttgcggttggggtgacaaagagtttttctggcttggtttgttggttgctggccaacgctactcgatctatgatatagatgcaagtgcaattggtgttcctcaacagaagcaatctatcgctaacggagacgaatttgatgaatataggatttgttctttacaagtggcacatacttcatacgacggacatttactatggataaatggtggctctcagtactgtaagaaaccagagacttttgaaggtgattggaccaacattaaggagcttcgtgaatcgtattctgatgataaagaaaaggctctgaaggcttatagtgatacagttaaggtggaagcagcaatcgtgccagattccagaagtaatggttggggtagagacgatcaaagatgtaaaggctacttctggtgcggcaaatttacttcaaagctgaaaccgtatacttataacacggtggtaactaaaggtgatttgatccgtttcggagacgaggaaatcgaaagtatctccaagattaataagatctggaatgatgctattattccagacggagcttaa

SEQ ID NO: 72582 - protein, 746 aa, Kluyveromyces lactis NRRL Y-1140
MMVVRRFLSASRYNMPSFRSRPVLLAIFGVCATVIWYLFFFQSNLKMADLKKVATSRYLSQEPSLSELMSNVKIKPIEETPVSPLELIPDIEISTRKKYDASWDLLFRGRKYKSFNDYDLHTKCEFYFQNLYNLNEDWTNNIRTFTFDINDVDTSTKIDALKDSDGVQLVDEKAIRLYKRTHNVALATERLRLYDKCFVNSPGSNPLKMDHLFRSNKKSKTTALDDEVTGNRDTFTKTKKTSFLSDMDTSSFQKYDQWDFEHRMFPMIPYFEEHNFTNVMPIFTGSNGGEPLPQGKFPVLDPKSGELLRVETFRYDKSKSLWKNWNDMSSASGKRGIILAAGDGQVDQCIRLIATLRAQGNALPIQIIHNNQLNEKSVKLLSEAAKSTEFSSGRAQSLWLVNVGPTLESSMKSNFGRFKNKWLSVIFNTFEEFIFIDTDAISYINMADYFNFKEYKSTGTLFFKDRSLAIGTEQKCGPLFETLEPRILEMYYFNTLPMINGDYVEQQCMGMLTPEEKVYKRFFEVGHQHNLESGLLAINKNEHIMGLVTATVLNIAPKVGGCGWGDKEFFWLGLLVAGQRYSIYDIDASAIGVPQQKQSIANGDEFDEYRICSLQVAHTSYDGHLLWINGGSQYCKKPETFEGDWTNIKELRESYSDDKEKALKAYSDTVKVEAAIVPDSRSNGWGRDDQRCKGYFWCGKFTSKLKPYTYNTVVTKGDLIRFGDEEIESISKINKIWNDAIIPDGA

SEQ ID NO: 72583 - DNA, 2289 bp, Saccharomyces cerevisiae
  CDS (1)..(2289)
atgttggcactccggagatttatattaaaccaaaggtctttgagatcgtgtaccataccgattctagtcggagccttgatcattattctcgtgctattccaactagttacccaccgaaatgatgcgcttatacgatcaagcaatgtaaacagtacaaacaagaaaacattgaaagatgcagatcctaaggttcttattgaagccttcggctctcctgaggtcgacccagtggatacaattccagtatcgccactagaattagttccattttatgaccagtctatagatactaaaaggagttctagttggctaatcaataagaagggctattataagcatttcaacgaattaagcttaactgatagatgtaaattttatttccggacactgtatacgctagacgatgaatggactaatagtgtgaagaaactggagtacagcataaatgataatgaaggagttgacgaaggtaaagatgcgaatggaaatccaatggatgagaaatccgagagattgtatcgccggaaatatgatatgttccaggcatttgagagaataagagcctatgatagatgttttatgcaggccaatccagttaatattcaagaaatttttccgaaaagtgataagatgtcgaaagagagggttcaatcaaaattaatcaaaaccttaaatgctactttccctaattatgatccagacaattttaagaaatacgatcaattcgaattcgagcacaaaatgtttccgtttataaataactttaccacagagacttttcatgagatggttccaaaaatcacatcaccttttggaaaagtattagagcaaggcttcttacccaagttcgatcataaaactggtaaagtgcaggagtatttcaaatatgaatacgatccatcaaaaaccttctgggccaattggagggatatgagcgccaaagtagccggtcgtggtattgtattgagtttaggttccaaccaatttccattagctgtcaaatttattgcttctttgagatttgaagggaatactttaccgatccaagtggtctatagaggcgatgagctgtcgcaagaactagtggacaaacttatatatgctgctagaagtcctgatttcaaaccagtagaaaataattacgataattctaccaatgttccacaagaaatttggttcctagatgtttctaataccatccaccctaagtggcgaggtgacttcggtagttataaaagtaaatggctagtggttctactcaatcttttgcaagaatttgtctttttagatattgatgctattagttatgaaaaaattgataactacttcaagaccactgaataccagaagacaggaactgtattttacagggaaagggcgctaagagaaaacgtgaatgaaagatgtattgctagatatgaaactctattgcctagaaaccttgaatctaaaaatttccaaaactcacttcttatcgatcctgatcatgctctcaacgaatgtgacaatactttaactacagaagagtacatattcaaagctttttttcatcatagaaggcagcaccagttagaagctggtttatttgctgtcgacaaatcaaaacacacgatccccctagtgcttgctgctatgattcatttggccaaaaatacagcccactgcacacatggtgataaagagaatttctggttagggttcttggccgcaggtcacacttatgcactgcagggagtgtattccggagctattggtgattatgtaaagaaaaccgacttgaacggaaagaggcaagaagctgcagtcgaaatatgttccgggcaaatagcacatatgtctactgataagaaaactttactttgggttaacggtggaggtaccttttgtaaacacgataatgctgctaaagatgattggaaaaaagatggcgactttaagaaattcaaagatcaattcaagacttttgaagaaatggaaaaatattattacataactccaatcagcagcaaatatgtcatcttacctgatccaaaatctgatgattggcatagggcctctgcaggtgcttgtggtggttatatatggtgtgccacacataaaaccctcctaaagccatatagttataaccacagaaccactcacggcgaattaataactctagatgaggagcagcgcctacatattgatgctgtcaacactgtttggtcacatgctaataaagataacaccagatcattcactgaagaagagatcaaggaattagaaaattctagacacgaacaaagctag

SEQ ID NO: 72584 - protein, 762 aa, Saccharomyces cerevisiae
MLALRRFILNQRSLRSCTIPILVGALIIILVLFQLVTHRNDALIRSSNVNSTNKKTLKDADPKVLIEAFGSPEVDPVDTIPVSPLELVPFYDQSIDTKRSSSWLINKKGYYKHFNELSLTDRCKFYFRTLYTLDDEWTNSVKKLEYSINDNEGVDEGKDANGNPMDEKSERLYRRKYDMFQAFERIRAYDRCFMQANPVNIQEIFPKSDKMSKERVQSKLIKTLNATFPNYDPDNFKKYDQFEFEHKMFPFINNFTTETFHEMVPKITSPFGKVLEQGFLPKFDHKTGKVQEYFKYEYDPSKTFWANWRDMSAKVAGRGIVLSLGSNQFPLAVKFIASLRFEGNTLPIQVVYRGDELSQELVDKLIYAARSPDFKPVENNYDNSTNVPQEIWFLDVSNTIHPKWRGDFGSYKSKWLVVLLNLLQEFVFLDIDAISYEKIDNYFKTTEYQKTGTVFYRERALRENVNERCIARYETLLPRNLESKNFQNSLLIDPDHALNECDNTLTTEEYIFKAFFHHRRQHQLEAGLFAVDKSKHTIPLVLAAMIHLAKNTAHCTHGDKENFWLGFLAAGHTYALQGVYSGAIGDYVKKTDLNGKRQEAAVEICSGQIAHMSTDKKTLLWVNGGGTFCKHDNAAKDDWKKDGDFKKFKDQFKTFEEMEKYYYITPISSKYVILPDPKSDDWHRASAGACGGYIWCATHKTLLKPYSYNHRTTHGELITLDEEQRLHIDAVNTVWSHANKDNTRSFTEEEIKELENSRHEQS

SEQ ID NO: 72585 - DNA, 27 bp, Artificial sequence
  primer
atgcttaaatcattaaaatccagaaga

SEQ ID NO: 72586 - DNA, 25 bp, Artificial sequence
  primer
tcaattagcattccaggttcgagaa

SEQ ID NO: 72587 - protein, 641 aa, Artificial sequence
  consensus sequence
  Variant (2)..(8): Xaa in position 2 to 8 is any amino acid
  Variant (10)..(12): Xaa in position 10 to 12 is any amino acid
  Variant (13)..(14): Xaa in position 13 to 14 is any or no amino acid
  Variant (16)..(16): Xaa in position 16 is any amino acid
  Variant (18)..(34): Xaa in position 18 to 34 is any amino acid
  Variant (35)..(65): Xaa in position 35 to 65 is any or no amino acid
  Variant (67)..(68): Xaa in position 67 to 68 is any amino acid
  Variant (70)..(73): Xaa in position 70 to 73 is any amino acid
  Variant (76)..(99): Xaa in position 76 to 99 is any amino acid
  Variant (100)..(141): Xaa in position 100 to 141 is any or no amino acid
  Variant (143)..(143): Xaa in position 143 is any amino acid
  Variant (145)..(155): Xaa in position 145 to 155 is any amino acid
  Variant (156)..(157): Xaa in position 156 to 157 is any or no amino acid
  Variant (159)..(184): Xaa in position 159 to 184 is any amino acid
  Variant (185)..(197): Xaa in position 185 to 197 is any or no amino acid
  Variant (199)..(201): Xaa in position 199 to 201 is any amino acid
  Variant (203)..(207): Xaa in position 203 to 207 is any amino acid
  Variant (209)..(209): Xaa in position 209 is any amino acid
  Variant (210)..(212): Xaa in position 210 to 212 is any or no amino acid
  Variant (215)..(236): Xaa in position 215 to 236 is any amino acid
  Variant (239)..(240): Xaa in position 239 to 240 is any amino acid
  Variant (242)..(246): Xaa in position 242 to 246 is any amino acid
  Variant (247)..(247): Xaa in position 247 is any or no amino acid
  Variant (249)..(267): Xaa in position 249 to 267 is any amino acid
  Variant (268)..(282): Xaa in position 268 to 282 is any or no amino acid
  Variant (284)..(307): Xaa in position 284 to 307 is any amino acid
  Variant (308)..(308): Xaa in position 308 is any or no amino acid
  Variant (311)..(311): Xaa in position 311 is any amino acid
  Variant (313)..(314): Xaa in position 313 to 314 is any amino acid
  Variant (321)..(324): Xaa in position 321 to 324 is any amino acid
  Variant (326)..(326): Xaa in position 326 is any amino acid
  Variant (328)..(337): Xaa in position 328 to 337 is any amino acid
  Variant (339)..(342): Xaa in position 339 to 342 is any amino acid
  Variant (344)..(346): Xaa in position 344 to 346 is any amino acid
  Variant (348)..(352): Xaa in position 348 to 352 is any amino acid
  Variant (355)..(363): Xaa in position 355 to 363 is any amino acid
  Variant (364)..(364): Xaa in position 364 is any or no amino acid
  Variant (366)..(373): Xaa in position 366 to 373 is any amino acid
  Variant (375)..(377): Xaa in position 375 to 377 is any amino acid
  Variant (379)..(419): Xaa in position 379 to 419 is any amino acid
  Variant (420)..(424): Xaa in position 420 to 424 is any or no amino acid
  Variant (426)..(430): Xaa in position 426 to 430 is any amino acid
  Variant (432)..(437): Xaa in position 432 to 437 is any amino acid
  Variant (439)..(452): Xaa in position 439 to 452 is any amino acid
  Variant (454)..(455): Xaa in position 454 to 455 is any amino acid
  Variant (460)..(460): Xaa in position 460 is any amino acid
  Variant (462)..(463): Xaa in position 462 to 463 is any amino acid
  Variant (465)..(468): Xaa in position 465 to 468 is any amino acid
  Variant (470)..(471): Xaa in position 470 to 471 is any amino acid
  Variant (473)..(482): Xaa in position 473 to 482 is any amino acid
  Variant (484)..(495): Xaa in position 484 to 495 is any amino acid
  Variant (496)..(502): Xaa in position 496 to 502 is any or no amino acid
  Variant (504)..(505): Xaa in position 504 to 505 is any amino acid
  Variant (507)..(508): Xaa in position 507 to 508 is any amino acid
  Variant (510)..(516): Xaa in position 510 to 516 is any amino acid
  Variant (517)..(517): Xaa in position 517 is any or no amino acid
  Variant (520)..(520): Xaa in position 520 is any amino acid
  Variant (524)..(526): Xaa in position 524 to 526 is any amino acid
  Variant (529)..(534): Xaa in position 529 to 534 is any amino acid
  Variant (535)..(535): Xaa in position 535 is any or no amino acid
  Variant (537)..(557): Xaa in position 537 to 557 is any amino acid
  Variant (558)..(568): Xaa in position 558 to 568 is any or no amino acid
  Variant (570)..(580): Xaa in position 570 to 580 is any amino acid
  Variant (582)..(587): Xaa in position 582 to 587 is any amino acid
  Variant (589)..(593): Xaa in position 589 to 593 is any amino acid
  Variant (594)..(595): Xaa in position 594 to 595 is any or no amino acid
  Variant (597)..(601): Xaa in position 597 to 601 is any amino acid
  Variant (603)..(630): Xaa in position 603 to 630 is any amino acid
  Variant (631)..(640): Xaa in position 631 to 640 is any or no amino acid
CXXXXXXXYXXXXXWXNXXXXXXXXXXXXXXXXXXXXXXXXXXXXXXXXXXXXXXXXXXXXXXXXEXXRXXXXCFXXXXXXXXXXXXXXXXXXXXXXXXXXXXXXXXXXXXXXXXXXXXXXXXXXXXXXXXXXXXXXXXXXFXFXXXXXXXXXXXXXPXXXXXXXXXXXXXXXXXXXXXXXXXXXXXXXXXXXXXXXFXXXWXXXXXGXXXXGIXXXXXXXXXXXXXXXXXXXXXXGNXXPXXXXXXGXXXXXXXXXXXXXXXXXXXXXXXXXXXXXXXXXXQXXXXXXXXXXXXXXXXXXXXXXXXXKWXAXXFNTFEEXXXXDXDXXXXXXXXXXFXXXXYXXXGXXXXXDRXXXXXXXXXXCXXXXXXXXPXXXEXXXXXXXXXXXXXXXXXXXXXXXXXXXXXXXXXXXXXXXXXXXXXXGXXXXXKXXXXXXLXXXXXXXXXXXXXXCXXGDKEXFXXGXXXXGXXYXXXXXXXXXXGXXXXXXXXXXXXXXXXXXXCXXQXXHXXXXXXXXLWXNGGXXXCKXXXXXXXDXXXXXXXXXXXXXXXXXXXXXXXXXXXXXXXXYXXXXXXXXXXXPXXXXXXWXXXXXXXCXXXXXCXXXXXXXXXXXXXXXXXXXXXXXXXXXXXXXXXXXXXXW

SEQ ID NO: 72588 - protein, 44 aa, Artificial sequence
  protein pattern
  Variant (2)..(5): Xaa in position 2 to 5 is any or no amino acid
  Variant (10)..(10): Xaa in position 10 is Asp or Glu
  Variant (11)..(11): Xaa in position 11 is any amino acid
  Variant (12)..(12): Xaa in position 12 is Ile, Leu, Met or Val
  Variant (13)..(13): Xaa in position 13 is Phe, Leu or Met
  Variant (14)..(14): Xaa in position 14 is Ile, Leu, Met or Val
  Variant (16)..(16): Xaa in position 16 is any amino acid
  Variant (17)..(17): Xaa in position 17 is Asp or Glu
  Variant (18)..(18): Xaa in position 18 is Ala, Thr or Val
  Variant (19)..(19): Xaa in position 19 is Ile or Val
  Variant (20)..(20): Xaa in position 20 is any amino acid
  Variant (21)..(21): Xaa in position 21 is Phe or Tyr
  Variant (22)..(27): Xaa in position 22 to 27 is any amino acid
  Variant (28)..(28): Xaa in position 28 is Phe or Leu
  Variant (29)..(32): Xaa in position 29 to 32 is any amino acid
  Variant (33)..(33): Xaa in position 33 is Phe or Tyr
  Variant (34)..(39): Xaa in position 34 to 39 is any amino acid
  Variant (40)..(40): Xaa in position 40 is Phe, Leu or Met
  Variant (41)..(41): Xaa in position 41 is Phe, Trp or Tyr
  Variant (42)..(42): Xaa in position 42 is any amino acid
  Variant (43)..(43): Xaa in position 43 is Asp or Asn
  Variant (44)..(44): Xaa in position 44 is Lys or Arg
FXXXXNTFEXXXXXDXXXXXXXXXXXXXXXXXXXXXXXXXXXXX

SEQ ID NO: 72589 - protein, 60 aa, Artificial sequence
  protein pattern
  Variant (2)..(13): Xaa in position 2 to 13 is any amino acid
  Variant (14)..(14): Xaa in position 14 is any or no amino acid
  Variant (16)..(16): Xaa in position 16 is Ile, Leu, Met or Val
  Variant (17)..(17): Xaa in position 17 is any amino acid
  Variant (18)..(18): Xaa in position 18 is Ala, Gly or Ser
  Variant (19)..(29): Xaa in position 19 to 29 is any amino acid
  Variant (31)..(32): Xaa in position 31 to 32 is any amino acid
  Variant (34)..(34): Xaa in position 34 is Asp or Thr
  Variant (37)..(37): Xaa in position 37 is any amino acid
  Variant (38)..(38): Xaa in position 38 is Phe or Leu
  Variant (39)..(40): Xaa in position 39 to 40 is any amino acid
  Variant (41)..(41): Xaa in position 41 is Ala or Gly
  Variant (42)..(44): Xaa in position 42 to 44 is any amino acid
  Variant (45)..(45): Xaa in position 45 is Ala, Ser, Thr or Val
  Variant (46)..(46): Xaa in position 46 is Gly or Asn
  Variant (47)..(48): Xaa in position 47 to 48 is any amino acid
  Variant (49)..(49): Xaa in position 49 is Phe or Tyr
  Variant (50)..(50): Xaa in position 50 is any amino acid
  Variant (51)..(51): Xaa in position 51 is Ile, Leu or Val
  Variant (52)..(55): Xaa in position 52 to 55 is any amino acid
  Variant (56)..(56): Xaa in position 56 is Ala, Gly, Pro or Ser
  Variant (57)..(57): Xaa in position 57 is Ala, Gly, Ser or Val
  Variant (58)..(58): Xaa in position 58 is any amino acid
  Variant (59)..(59): Xaa in position 59 is Ile, Leu or Met
GXXXXXXXXXXXXXLXXXXXXXXXXXXXXCXXGXKEXXXXXXXXXXXXXXXXXXXXXXXG

SEQ ID NO: 72590 - protein, 12 aa, Artificial sequence
  protein pattern
  Variant (2)..(2): Xaa in position 2 is any or no amino acid
  Variant (4)..(4): Xaa in position 4 is any amino acid
  Variant (8)..(10): Xaa in position 8 to 10 is any amino acid
LXWXNGGXXXCK

SEQ ID NO: 72591 - DNA, 924 bp, Saccharomyces cerevisiae
  CDS (1)..(924)
atgactagtaaattaaaacgggttgctgtcgcacaattatgttcatccgctgacctgaccaaaaacttaaaagtggtaaaagaattgatatctgaagccattcaaaaaaaggcggatgtcgtttttctccctgaggcaagtgactatctttctcaaaaccctcttcattccaggtatttggcacagaaaagccccaaatttattcggcaattacagtcaagcattaccgaccttgtcagagataattcacggaatatagatgtttccattggggtacacttgccgccctcagaacaagatttacttgaaggcaatgatcgagtcagaaacgttctattatatatcgatcatgaagggaaaatattgcaagaataccaaaaactgcatttgtttgacgtagacgtgccaaatggaccgatattgaaagaatcaaaatctgtccagcctggcaaagccattcctgacattatagagtctccattgggaaaattgggcagtgccatttgttatgatattcgctttcccgaattttctttgaaattacgatcaatgggggctgaaatcttatgttttcccagtgcgttcactattaaaacaggggaagcacattgggagttactaggcagagcaagagcggttgacactcaatgctatgtgctcatgccagggcaggttggaatgcacgatctcagtgatccagagtgggagaaacaatcacatatgagcgctctcgaaaaaagctccaggagagaatcttggggacactcaatggtcattgatccttggggtaaaataatagcgcatgccgatccctctactgttggaccacaactaattctcgctgatttggatcgtgagcttttgcaagaaataaggaacaaaatgcccttatggaaccagagaagagacgatttatttcattga

SEQ ID NO: 72592 - protein, 307 aa, Saccharomyces cerevisiae
MTSKLKRVAVAQLCSSADLTKNLKVVKELISEAIQKKADVVFLPEASDYLSQNPLHSRYLAQKSPKFIRQLQSSITDLVRDNSRNIDVSIGVHLPPSEQDLLEGNDRVRNVLLYIDHEGKILQEYQKLHLFDVDVPNGPILKESKSVQPGKAIPDIIESPLGKLGSAICYDIRFPEFSLKLRSMGAEILCFPSAFTIKTGEAHWELLGRARAVDTQCYVLMPGQVGMHDLSDPEWEKQSHMSALEKSSRRESWGHSMVIDPWGKIIAHADPSTVGPQLILADLDRELLQEIRNKMPLWNQRRDDLFH

SEQ ID NO: 72593 - DNA, 1110 bp, Arabidopsis thaliana
  CDS (1)..(1110)
atgaagtcagcaatttcatcgtcactcttcttcaattcgaagaatcttttaaaccctaatcctctttctcgcttcatttctctcaaatctaacttcctccctaaattatctccgagatcgatcactagtcacaccttgaagctcccatcttcgtcaacctcagctttaagatccatttcctcttccatggcttcttctttcaaccctgaacaagctagagttccctctgctcttcctctcccagctcctccgttgaccaaattcaacatcggattgtgtcagctatctgttacatctgacaaaaagagaaacatctctcatgctaaaaaagccattgaagaagctgcttctaaaggagctaagcttgttctcttacccgaaatttggaacagtccgtattccaatgatagttttccagtttatgcggaggagattgatgcaggtggtgatgcttctccttcaacggcaatgctttctgaagtttccaaacgtctcaagattacaatcattggtggatctataccagaaagagttggagatcgtttgtataacacttgctgtgtctttggttccgatggagagctaaaagctaagcatcggaagatacatttatttgatatagacattcccgggaagattacttttatggaatccaaaactcttactgctggagagacaccaacaatcgttgacacagatgtagggcgtattggaataggcatctgttatgatatcaggttccaggagttagctatgatatatgctgcaagaggggctcatttgctgtgctacccgggagcctttaacatgacaactggaccattgcattgggaattactacaaagggccagggctacggataatcagttatatgtggcgacatgctcacctgccagagattcaggagctggctacactgcttgggggcactcaacactcgttgggccttttggagaagtactagcaacgactgagcatgaggaggccattatcatagcagagattgattactctatccttgaacaacgaaggactagccttccattgaataggcagcggcggggagatctttaccagcttgtagacgtacagcgcttagactctaaatga

SEQ ID NO: 72594 - protein, 369 aa, Arabidopsis thaliana
MKSAISSSLFFNSKNLLNPNPLSRFISLKSNFLPKLSPRSITSHTLKLPSSSTSALRSISSSMASSFNPEQARVPSALPLPAPPLTKFNIGLCQLSVTSDKKRNISHAKKAIEEAASKGAKLVLLPEIWNSPYSNDSFPVYAEEIDAGGDASPSTAMLSEVSKRLKITIIGGSIPERVGDRLYNTCCVFGSDGELKAKHRKIHLFDIDIPGKITFMESKTLTAGETPTIVDTDVGRIGIGICYDIRFQELAMIYAARGAHLLCYPGAFNMTTGPLHWELLQRARATDNQLYVATCSPARDSGAGYTAWGHSTLVGPFGEVLATTEHEEAIIIAEIDYSILEQRRTSLPLNRQRRGDLYQLVDVQRLDSK

SEQ ID NO: 72595 - DNA, 828 bp, Vibrio cholerae O1 biovar eltor str. N16961
  CDS (1)..(828): transl_table=11
atgcaacgagttggactggtgcaaatgacctcaggccctgagataagtcgtaatctgacttatctcaaacaagaggtggccaagcttgctcagcaaggagcacaatggattgtgacaccagaaaatgccctgctgttggggaatcgtgaacaataccatcaacaagccgaatcactggatcacggcccagttcagcacgccttagcgagcctcgccaaagaatatggtgtatggttattgataggcagtatgccgatccgccacgctgagggggttactaccagtagcctattgtggaatgcacaaggtgagcgagtggcggtttacgataaactgcatatgttcgatgtcgatgtcgctgatggccatcagcgttatcgcgaatcggaaacctttacgccggggcaacaggtggtcgtcacctcaacgccgtttggagcgttgggcctatcgatttgctacgatgtgcgttttccgcacttgtacgcagatttacggcgccaaggtgcacagattttgctggttcctgcggcctttactgcggtgacgggccaagcccactgggaagtcttattacgcgcccgagccattgaaacgcaatgctgggtgattgccgtgggtcaaactggacatcacccatgcggacgagagacgtggggacattccatggtgattagcccgtggggtgaagtgatcgccaatttaggcgccgaagtacaaagtaaagtggtcgagttcgatcttgcaacgctcgattctgtgagacgcgcaatgcccattacacagcacacgcgttttacccatcaattaatagagaacacacactga

SEQ ID NO: 72596 - protein, 275 aa, Vibrio cholerae O1 biovar eltor str. N16961
MQRVGLVQMTSGPEISRNLTYLKQEVAKLAQQGAQWIVTPENALLLGNREQYHQQAESLDHGPVQHALASLAKEYGVWLLIGSMPIRHAEGVTTSSLLWNAQGERVAVYDKLHMFDVDVADGHQRYRESETFTPGQQVVVTSTPFGALGLSICYDVRFPHLYADLRRQGAQILLVPAAFTAVTGQAHWEVLLRARAIETQCWVIAVGQTGHHPCGRETWGHSMVISPWGEVIANLGAEVQSKVVEFDLATLDSVRRAMPITQHTRFTHQLIENTH

SEQ ID NO: 72597 - DNA, 849 bp, Pseudomonas aeruginosa PAO1
  CDS (1)..(849): transl_table=11
atgtccattgccgtgatccagatggtcagccaggacgacgtgacggccaacctggccgccgcccgtcgcctgctggaacaggccgccgagggcggggcgcggctcgccgtgctaccggaaaacttcgccgccatgggccggcgcgacctggccgaactggggcgcgccgaggcgcgggggaacgggcctatcctgccgtggttgaattccgccgctcgcgacctcaggttgtggatagtcgccggaacgttgccgctgccgccggatgggcaacccgaggcgaaggcgaatgcctgttcgctgctgatcgacgagcacggagagcgggttgcgcgctacgacaagctgcacctgttcgatgtggatgtagccgatgcgcggggccgctatcgtgaatccgacgactatgctttcggtcagaagatcgtggtggcggatacgccggtcggccgcctcggcctgacggtctgctacgacctgcgttttccggagctctataccgccctgcgcgaggccggcgcggagctgatcacggcgccgtcggcgttcaccgcggtgaccggcgcggcgcactggcaggtactggtccgcgcccgtgccatcgagacccagtgctacctgctggcggccggacagggtggcgttcacccacggggccgggagacgttcggccattcggccatcgtcgatccctggggccgggtcctggccgagcggccgcagggcgaagcggtgctgctggcggtgcgcgacgccgcagaacaggcggatatccgccggcgcatgccggtggtggcgcacagacgatttttcccgccggccgaaccgcggccggcgcgtacggagtga

SEQ ID NO: 72598 - protein, 282 aa, Pseudomonas aeruginosa PAO1
MSIAVIQMVSQDDVTANLAAARRLLEQAAEGGARLAVLPENFAAMGRRDLAELGRAEARGNGPILPWLNSAARDLRLWIVAGTLPLPPDGQPEAKANACSLLIDEHGERVARYDKLHLFDVDVADARGRYRESDDYAFGQKIVVADTPVGRLGLTVCYDLRFPELYTALREAGAELITAPSAFTAVTGAAHWQVLVRARAIETQCYLLAAGQGGVHPRGRETFGHSAIVDPWGRVLAERPQGEAVLLAVRDAAEQADIRRRMPVVAHRRFFPPAEPRPARTE

SEQ ID NO: 72599 - DNA, 819 bp, Methanothermobacter thermautotrophicus str. Delta H
  CDS (1)..(819): transl_table=11
atgaggcttggaatatgccagatgcaggtaaccgaagataaagagaagaatgttggtactgccgttgagatgattgtggaggccgctgagagaggcgcccggctcattgtgcttcctgagatgttcacatgcccctacgatgtaaaccttttttcagagtatgcagaggatgagaatggatactccataagaaccatgaggtcaattgccagggaactggggatccacctggtcgcaggttccatccccgaggaaacacctgaaggcatctacaacacctcctttgtgatggacgatggtgggaacatcatcgggaagcatcgcaaggtccacctcttcgacatcaatgttcccggagagataagcttcagggaatcagatagcctgattgcaggcgactccgtgaccgttatagaaactccccagtgcgttatgggtgtggggatatgctatgatatgcgtttccctgaactttcaaggatgatggccctagggggtgcagaggtccttatattcccgggggcattcaatatgacaaccggaccggcccactggaggctccttgtaaggtcaagggccctggataaccagtgctactgtgttgctgcatcacctgcaaggaacccctcagcgtcctatgttgcctatggccactctatgatcgctgatccctggggctctgtcgtctgtgaggccgatgcatccccctctgtgatcacagcagatattgacctggaagccgtggagaggatccggaggaagcttcccctcctgagaaacagaaggcctgatgtgtacggctggagatctggagtatga

SEQ ID NO: 72600 - protein, 272 aa, Methanothermobacter thermautotrophicus str. Delta H
MRLGICQMQVTEDKEKNVGTAVEMIVEAAERGARLIVLPEMFTCPYDVNLFSEYAEDENGYSIRTMRSIARELGIHLVAGSIPEETPEGIYNTSFVMDDGGNIIGKHRKVHLFDINVPGEISFRESDSLIAGDSVTVIETPQCVMGVGICYDMRFPELSRMMALGGAEVLIFPGAFNMTTGPAHWRLLVRSRALDNQCYCVAASPARNPSASYVAYGHSMIADPWGSVVCEADASPSVITADIDLEAVERIRRKLPLLRNRRPDVYGWRSGV

SEQ ID NO: 72601 - DNA, 873 bp, Agrobacterium tumefaciens str. C58
  CDS (1)..(873): transl_table=11
atggaggacgtgatgagtttcaaggctgccgccatccagatgcgctccggcgtcgacccggtaaggaacgccgccgatatggaacggctggtgcgcgccgccgcggcggaaggggctgtgtatgtacagaccccggaaatgacgggcgcaatccagaaggacaggcaggcgcttcgtgcccagctgcgtgatgacgatggcgatatcatcgtagcgaccgccgcacggctggcacgcgagcttggcattcacgtccatatcggctccacggccattgcccgcccggatggcaagatcgccaatcgcggttttctcttcgcgccggatggttcgcgcatctgcagctacgacaagatccatatgttcgatgtcgatctcgataatggcgaaagctggcgtgaaagtgccgcttaccaacccggtgaagtggcacgtatcgccgaactaccgttggcaaaattcggctttgcgatttgttatgacgtccgtttccctcagcttttccgggcagaagcgctggctggtgcggaggttctgacggttccggcggccttcacacgccagacgggggaagcccactgggaaatcctgttgcgtgcccgtgctatcgaaaacggtgcttttgtaatcgccgccgcacaggccggcgttcacgaggacggtcgcgagacattcggccattccatcatcatcgacccctggggtaaggtgctggccttggcgggcggtgcgggggaagagattatctttgccgagatcgacacgtcgctggttgcggctgcgcgcggcaaaattcccaatctgcgcaatgcccgtgagttcgggctggacaccgtcattcccctgaaacctgccggaggtgaggcggcgtga

SEQ ID NO: 72602 - protein, 290 aa, Agrobacterium tumefaciens str. C58
MEDVMSFKAAAIQMRSGVDPVRNAADMERLVRAAAAEGAVYVQTPEMTGAIQKDRQALRAQLRDDDGDIIVATAARLARELGIHVHIGSTAIARPDGKIANRGFLFAPDGSRICSYDKIHMFDVDLDNGESWRESAAYQPGEVARIAELPLAKFGFAICYDVRFPQLFRAEALAGAEVLTVPAAFTRQTGEAHWEILLRARAIENGAFVIAAAQAGVHEDGRETFGHSIIIDPWGKVLALAGGAGEEIIFAEIDTSLVAAARGKIPNLRNAREFGLDTVIPLKPAGGEAA

SEQ ID NO: 72603 - DNA, 852 bp, Caulobacter crescentus CB15
  CDS (1)..(852): transl_table=11
atgagccctcctgcgccgctccgcgtcgggctgatccagacccgcacccccgccacccacgccgctgcgctgggccacgtggcgccgctggtgcgcgaggcgatcgcgggcggcgcaaaggtcgtcctgacgcccgaatgcaccaacgtcgtccagaaggaccgcagcctgctgctgccggcgctcaagaccctggacgaggacccggtggtgctgggtctgcgcgagatcgccgcgcagacggggacctggatcgccatcggctcggccctggtgcgccgcgagaccggcgacaaggccgccaaccgccaggtggtcatcgacccgaccggcgcgatcgtggccacctacgacaagctgcacatgttcgacgtggacctgcccccaagagacgggaaggccggcgagacggcgcgggagtcctcggcctatgagcccggcgatgcggccgtggtggtcgacacgccttgggccaagctgggcctgaccatctgctacgacatgcgctttcccgccctgcatcgggccctggccctggccggcgcgaccgtgctgaccgttccggccgccttcacccgccccaccggcgaggcccactgggagatcctgctgcgcgcccgcgccatcgagaccggctccttcgtgctggccgccgcccagggcggtttccacgaggacggtcgcggcacctggggccgctcgatcgtggtggggccgtggggcgagatcatcgccacgctggaccatgacgaacccggcgtgctgctggcggatctcgacctgcccgccgccgacaaggcgcgcgcggcgatcccggccctgaagaacgcccgggctttcaccggtccatga

SEQ ID NO: 72604 - protein, 283 aa, Caulobacter crescentus CB15
MSPPAPLRVGLIQTRTPATHAAALGHVAPLVREAIAGGAKVVLTPECTNVVQKDRSLLLPALKTLDEDPVVLGLREIAAQTGTWIAIGSALVRRETGDKAANRQVVIDPTGAIVATYDKLHMFDVDLPPRDGKAGETARESSAYEPGDAAVVVDTPWAKLGLTICYDMRFPALHRALALAGATVLTVPAAFTRPTGEAHWEILLRARAIETGSFVLAAAQGGFHEDGRGTWGRSIVVGPWGEIIATLDHDEPGVLLADLDLPAADKARAAIPALKNARAFTGP

SEQ ID NO: 72605 - DNA, 816 bp, Nostoc sp. PCC 7120
  CDS (1)..(816): transl_table=11
atgaagtcttatttagctgccgctattcaaatgaccagtgtgcctgatttacacaagaatttggcacaagcagaagaattaattgatctggcggtgcgtcggggtgctgagttagtgggtttgccagaaaatttttcctttatgggtgaagaacaggataaactggctcaagcagaagcgatcgctcgtgaaagtgagatttttattaaaacgatggcgcagcgctaccaagtgactcttttgggtggtagtttccccgtaccggtaagtgatacaggtagagtctataacaccaccattctcatcagtcccagtggtgaagaacttgctcgctacaataaagtacacctttttgatgtcaatgttcctgatggtaatacctaccgcgaatctagtactgttgtcgccggtcagcaattaccccccgtccatttttcggaatatctaggcaatatcggcgtttctatttgctacgatgtccgcttcccggaactctaccgccatctctcagacaagggaacagatattatttttatacctgctgctttcactgcttttacaggcaaagaccactggcaagttttactgcaagccagagctattgaaaataccgcctatgtaattgcacctgctcaaacaggtaataactacggtcgccgcctcacccacggacacgctgtggttatcgacccctggggaacgattttagctgatgccggtgacaaaccaggaattgcgatcgcggaaatcaacccttcacgcctagaacaagtccgccgccaaatgccttccttgcaacatcgtgtatttagctaa

SEQ ID NO: 72606 - protein, 271 aa, Nostoc sp. PCC 7120
MKSYLAAAIQMTSVPDLHKNLAQAEELIDLAVRRGAELVGLPENFSFMGEEQDKLAQAEAIARESEIFIKTMAQRYQVTLLGGSFPVPVSDTGRVYNTTILISPSGEELARYNKVHLFDVNVPDGNTYRESSTVVAGQQLPPVHFSEYLGNIGVSICYDVRFPELYRHLSDKGTDIIFIPAAFTAFTGKDHWQVLLQARAIENTAYVIAPAQTGNNYGRRLTHGHAVVIDPWGTILADAGDKPGIAIAEINPSRLEQVRRQMPSLQHRVFS

SEQ ID NO: 72607 - DNA, 870 bp, Ralstonia solanacearum GMI1000
  CDS (1)..(870): transl_table=11
atgagcacgaccaccctcgcccctgccgccgccgcgtccgttccggatgcgccgttcgatgcaccgttccgcgtcgccgccatccagaccgtgacgggcatcgacgtggacgccaacctggcccgcgccgacgcgctgctcgccgaagccgcggcccggggtgcgcagctggcgctgctgcccgagtatttctgcatgatgggccgcaaggacagcgacaaggtcgccatccgcgaggcggaccaggacggcccgatccaggccttcctggccgatgccgcgcgccggcaccggctgtggctggtcggcggcacgctgccgctgtggtgcgaagacgccgagcgcgtgcgcaatacgtcgctcgcattcgatccggccggccagcgcgtggcccgctacgacaagatccatctgttcaacttcgtgcgcggcgaagagcgctacgacgaagcgcgcaccatcgagccgggcgccacgccggtcgcgttcgaggcgccgtgcggccgcgtcggcatgtcggtgtgctacgacctgcgcttcccggagctgtaccgggcgctgtcggcgcagggcaatctgaacctgatcctgatgccggccgccttcacctacgtgacgggcgcggcgcactgggaaatcctgctgcgcgcccgcgccgtggagaaccagtgctacgtgctcgccgccgcgcaaggcggacgccacgaaaacggccgccgcacctggggccactccatgctggtcgacccatggggcgagatcatcgcctcggtgccggaaggcgaaggcgtggccatcggcgacatggacccggcgcgcctggcgcaggtccgccgcgacctgcccgcgctcaagcaccgcgtgatgtag

SEQ ID NO: 72608 - protein, 289 aa, Ralstonia solanacearum GMI1000
MSTTTLAPAAAASVPDAPFDAPFRVAAIQTVTGIDVDANLARADALLAEAAARGAQLALLPEYFCMMGRKDSDKVAIREADQDGPIQAFLADAARRHRLWLVGGTLPLWCEDAERVRNTSLAFDPAGQRVARYDKIHLFNFVRGEERYDEARTIEPGATPVAFEAPCGRVGMSVCYDLRFPELYRALSAQGNLNLILMPAAFTYVTGAAHWEILLRARAVENQCYVLAAAQGGRHENGRRTWGHSMLVDPWGEIIASVPEGEGVAIGDMDPARLAQVRRDLPALKHRVM

SEQ ID NO: 72609 - DNA, 861 bp, Agrobacterium tumefaciens str. C58
  CDS (1)..(861): transl_table=11
atgagtttcaaggctgccgccatccagatgcgctccggcgtcgacccggtaaggaacgccgccgatatggaacggctggtgcgcgccgccgcggcggaaggggctgtgtatgtacagaccccggaaatgacgggcgcaatccagaaggacaggcaggcgcttcgtgcccagctgcgtgatgacgatggcgatatcatcgtagcgaccgccgcacggctggcacgcgagcttggcattcacgtccatatcggctccacggccattgcccgcccggatggcaagatcgccaatcgcggttttctcttcgcgccggatggttcgcgcatctgcagctacgacaagatccatatgttcgatgtcgatctcgataatggcgaaagctggcgtgaaagtgccgcttaccaacccggtgaagtggcacgtatcgccgaactaccgttggcaaaattcggctttgcgatttgttatgacgtccgtttccctcagcttttccgggcagaagcgctggctggtgcggaggttctgacggttccggcggccttcacacgccagacgggggaagcccactgggaaatcctgttgcgtgcccgtgctatcgaaaacggtgcttttgtaatcgccgccgcacaggccggcgttcacgaggacggtcgcgagacattcggccattccatcatcatcgacccctggggtaaggtgctggccttggcgggcggtgcgggggaagagattatctttgccgagatcgacacgtcgctggttgcggctgcgcgcggcaaaattcccaatctgcgcaatgcccgtgagttcgggctggacaccgtcattcccctgaaacctgccggaggtgaggcggcgtga

SEQ ID NO: 72610 - protein, 286 aa, Agrobacterium tumefaciens str. C58
MSFKAAAIQMRSGVDPVRNAADMERLVRAAAAEGAVYVQTPEMTGAIQKDRQALRAQLRDDDGDIIVATAARLARELGIHVHIGSTAIARPDGKIANRGFLFAPDGSRICSYDKIHMFDVDLDNGESWRESAAYQPGEVARIAELPLAKFGFAICYDVRFPQLFRAEALAGAEVLTVPAAFTRQTGEAHWEILLRARAIENGAFVIAAAQAGVHEDGRETFGHSIIIDPWGKVLALAGGAGEEIIFAEIDTSLVAAARGKIPNLRNAREFGLDTVIPLKPAGGEAA

SEQ ID NO: 72611 - DNA, 924 bp, Arabidopsis thaliana
  CDS (1)..(924)
atgaacgcttactctgtttctctcgacttcactaaaccttctctattcacacgcatcactctctcttctcagattcctctaaccatggccaccactgtaaacaaaacagttcgtgtcgcagctgctcaaatgacatcggtcaatgatctaatgaccaacttcgccacttgctctcgtctcgttcaagaagcagcattggctggtgcaaagctgatttgcttccctgagaacttctcttttgtgggagataaggaaggagagagtgtgaaaattgctgaaccattagatggcccagtgatggaacggtattgctctctcgccagggattcaaatatatggttgtctcttggaggttttcaagagagatttgatgatactcatttgtgtaatacacatgttgtgatcgatgatgctggaatgatccgagacacttatcagaaaatgcatttgtttgatgttgatgttcctggtggaagctcgtacaaagaaagcagctttacagttccagggacaaagattgtttccgtagacagccctgtcgggcgcttaggccttactgtatgctacgatttgaggttccctaagatatatcagcaactgagatttgaacagaaagctcaggttttactagtaccatcagctttcaccaaggtcactggggaggcacactgggagattcttcttcgagcccgagcaattgaaactcaatgttatgtcatagctgctgctcaagcaggaaagcataatgagaaaagagaaagttatggtgacacactgatcattgatccgtggggaactgtagttggaaggttacctgatcgtgtttcgaccggcattgtcgtggcagatattgatttttcattgattgactcagtgagaacaaaaatgccaatagataagcaacgagtctcaatagatctctga

SEQ ID NO: 72612 - protein, 307 aa, Arabidopsis thaliana
MNAYSVSLDFTKPSLFTRITLSSQIPLTMATTVNKTVRVAAAQMTSVNDLMTNFATCSRLVQEAALAGAKLICFPENFSFVGDKEGESVKIAEPLDGPVMERYCSLARDSNIWLSLGGFQERFDDTHLCNTHVVIDDAGMIRDTYQKMHLFDVDVPGGSSYKESSFTVPGTKIVSVDSPVGRLGLTVCYDLRFPKIYQQLRFEQKAQVLLVPSAFTKVTGEAHWEILLRARAIETQCYVIAAAQAGKHNEKRESYGDTLIIDPWGTVVGRLPDRVSTGIVVADIDFSLIDSVRTKMPIDKQRVSIDL

SEQ ID NO: 72613 - DNA, 831 bp, Schizosaccharomyces pombe 972h-
  CDS (1)..(831)
atgacattggcagcagtagctcagcttaactcaagtggttctattctaaaaaacttagccatatgtaaagaattgataagtcaagcagccgccaaaggtgcgaaatgcatattcttccctgaggcttctgactttatagctcataatagtgatgaggctattgaacttacaaatcatcctgactgtagcaagtttattcgggacgttcgagagtcagctaccaaacattcaatcttcgtaaacatatgcgtgcacgaaccatctaaggttaaaaacaagctactaaacagtagcctgtttatcgagcctcttcatggtgaaatcattagccgttacagcaaagctcatctttttgatgttgaaattaaaaatggaccaactttaaaagagtcgaatactacacttcgtggtgaagctattctcccaccttgtaaaacccctctaggcaaagttggttctgcaatttgttttgacatccgcttcccagaacaagctataaagcttagaaacatgggtgctcacattatcacataccctagtgcttttactgaaaagaccggagctgctcattgggaagtgctgttgagagctcgcgctttggactctcagtgttatgttatagctcctgcgcaaggtggaaagcataacgagaagcgtgctagttatggtcattccatgattgttgacccttggggtactgttattgctcaatacagtgatatctcttctccgaatggcctcatttttgctgaccttgatttgaatcttgttgaccatgtacgaacttatattccactattacgtagaaacgatttatacccgaccatttag

SEQ ID NO: 72614 - protein, 276 aa, Schizosaccharomyces pombe 972h-
MTLAAVAQLNSSGSILKNLAICKELISQAAAKGAKCIFFPEASDFIAHNSDEAIELTNHPDCSKFIRDVRESATKHSIFVNICVHEPSKVKNKLLNSSLFIEPLHGEIISRYSKAHLFDVEIKNGPTLKESNTTLRGEAILPPCKTPLGKVGSAICFDIRFPEQAIKLRNMGAHIITYPSAFTEKTGAAHWEVLLRARALDSQCYVIAPAQGGKHNEKRASYGHSMIVDPWGTVIAQYSDISSPNGLIFADLDLNLVDHVRTYIPLLRRNDLYPTI

SEQ ID NO: 72615 - DNA, 870 bp, Yersinia pestis KIM
  CDS (1)..(870): transl_table=11
atgaaaaatgccaatgttgcattattgcagttgtgcagcggtgaaaatacccgtgacaatctggctcaaattgagcagcagatcaaacagttaaatgcaggtatcaaactggttatgacgcctgaaaatgcgttgttatttgctaatgctgcctcttatcgtcaccatgcggaacaccataatgacggtccattacagcaagaagtgcgtgaaatggcacggcgctacggggtttggatacaggttggctccatgcctatggtgagccgtgagtcaccggacctgatcaccagcagtagcttgttatttgatgatcaaggcgaactcaaagcccgttacgataaaattcacatgtttgatgtcgatatcaatgacatccatggccattaccgtgagtctgatacttatcagccggggcagcagttgacggtggttgataccccggttggccgcttgggcatgaccatttgctatgacttgcgtttccctggcttgtttcaggctttgcgagcgcagggggctgaaatcatttctgttccggcagcctttaccaaaatgacgggtgaggcgcattgggaaacattgctccgtgcacgggctatcgaaaaccagtgcgtgatattggctgctgcacaggtggggcgtcacggtgctacccgccggacgtggggccataccatggcagtcgatgcctggggtaaaattattgggcataacccagatgcggtggcggccctaaaagtaagaattgaaaccgcaggtttgaagacgattcgcaatcaaatgccggtcatgcagcacaatcgctttcaggcgacgctggagccgacattgaataaaccattattgaataaaccaccatctaattaa

SEQ ID NO: 72616 - protein, 289 aa, Yersinia pestis KIM
MKNANVALLQLCSGENTRDNLAQIEQQIKQLNAGIKLVMTPENALLFANAASYRHHAEHHNDGPLQQEVREMARRYGVWIQVGSMPMVSRESPDLITSSSLLFDDQGELKARYDKIHMFDVDINDIHGHYRESDTYQPGQQLTVVDTPVGRLGMTICYDLRFPGLFQALRAQGAEIISVPAAFTKMTGEAHWETLLRARAIENQCVILAAAQVGRHGATRRTWGHTMAVDAWGKIIGHNPDAVAALKVRIETAGLKTIRNQMPVMQHNRFQATLEPTLNKPLLNKPPSN

SEQ ID NO: 72617 - DNA, 813 bp, Thermosynechococcus elongatus BP-1
  CDS (1)..(813): transl_table=11
atgaaatcctatctcgctgccgcagtccaaatgacgagccaacccaatcttgaagcaaatttggctcaggcagaagaactcattgaattggcggtgagacgaggggcagaactcattgggttgccagaaaatttttcttttctcggtgacgatcgcgagaaagttgcccaggcagcaacgatcgctgagcggactgaggcctttttgaaacggatggcccagcgattccagattacgctggtggggggtggctatccggtgccggcaacggaaggcaaggtctataacacagcggtattgatcggcccgacgggggaagaattgagccgctaccaaaaggtgcatttatttgatgtcgatttgcccgatggcaatatttaccacgaatcgggcacagtgctcgccggacagcagttgccctcggtctatcccagtaaggaactcggcaatattggcttgtcggtgtgctacgatgtccgctttccagaactttaccgtgccctctcccaggcgggggcaacggtcctgtttgtgcccgctgcctttaccgccttcacgggtaaggatcactggcaggttctactgcaagctcgggccatcgaaaatacctgttatgtcattgcgccggcccagacgggggttcactatgcacggcggcaaacccacggccatgcactgattgtggatccttggggaaccatcctcgcagatgcgggcgatcgccctggcctcgcgattgcggccattgaacccagccgccttgagcaagtgcgtcaacagatgccttgcctgcaacaccgcgtctttttctga

SEQ ID NO: 72618 - protein, 270 aa, Thermosynechococcus elongatus BP-1
MKSYLAAAVQMTSQPNLEANLAQAEELIELAVRRGAELIGLPENFSFLGDDREKVAQAATIAERTEAFLKRMAQRFQITLVGGGYPVPATEGKVYNTAVLIGPTGEELSRYQKVHLFDVDLPDGNIYHESGTVLAGQQLPSVYPSKELGNIGLSVCYDVRFPELYRALSQAGATVLFVPAAFTAFTGKDHWQVLLQARAIENTCYVIAPAQTGVHYARRQTHGHALIVDPWGTILADAGDRPGLAIAAIEPSRLEQVRQQMPCLQHRVFF

SEQ ID NO: 72619 - DNA, 849 bp, Shewanella oneidensis MR-1
  CDS (1)..(849): transl_table=11
atgcgcatcagcttgttgcaatgtcagagcagtcgcgacgtcagtgcgaacctgttgtttatcgaatcgcagcttgaggaattaactcaggagcggcagcagtggggcgataattcccctcatttggtggtgttacccgaatgcagtttattgtttggtggccatgagagccagcaacttgcctatgcgggcgatagtcatcacagccagttaaaatcagcgttaagtgctttagctacgcgctatcgggtgtttatggtggcagggacgattcctgcgctagcggagggtggtcgtgtctatagccgttgttatctgtttgatgataaaggtgataccttagggcattacgataaactgcatttatttgatgttgatgttgccgatggcaccaaacaataccgcgagagcgaaaccttttgccccggcgatcatatcagtgttatcgatacaccttttggcaaaattggcctatccatctgttatgatttacgctttcctgacttatttcgggcaatgcgtctcgctggagccgagattattaccgttccttcggcctttactaaggtcaccggagaagcccactggcaagtgttattgcaggccagagccattgagactcaatgttttatcgtagccgctgcccagtggggagcccataaccaaggtagccgtgaaacttgggggcaaagcatggtgattggcccttggggcaacatcattgccgagcggaaaacaggaacgggttgggtacatgccgatatcgatttaaccgaggtgaatagcatccgcagcaaaatgcccgtaatgcaacataatcggtttaatgtaccgatgattaaacgctaa

SEQ ID NO: 72620 - protein, 282 aa, Shewanella oneidensis MR-1
MRISLLQCQSSRDVSANLLFIESQLEELTQERQQWGDNSPHLVVLPECSLLFGGHESQQLAYAGDSHHSQLKSALSALATRYRVFMVAGTIPALAEGGRVYSRCYLFDDKGDTLGHYDKLHLFDVDVADGTKQYRESETFCPGDHISVIDTPFGKIGLSICYDLRFPDLFRAMRLAGAEIITVPSAFTKVTGEAHWQVLLQARAIETQCFIVAAAQWGAHNQGSRETWGQSMVIGPWGNIIAERKTGTGWVHADIDLTEVNSIRSKMPVMQHNRFNVPMIKR

SEQ ID NO: 72621 - DNA, 852 bp, Pseudomonas putida KT2440
  CDS (1)..(852): transl_table=11
atgaaggcagcggtaatccagatggtcagccaggacgacgtgcagaccaacctgcagcgtgccggtgccctgttggagcaggccgcattgggcggcgcacggttggcggtgctgccggaaaactttgccgccatggggcgcaaggacgctgctgccatcggccgcgccgaagccttgggggaagggcccatcctgccgtggttgaaacgcaccgcccgcgacctcaagttatggattgttgccggtactttgcccttgccgccgttcggccatcccgatgccaaggcccatgcgtgctcgctgctggtcgatgaacacggcgaggtggcggcaaggtatgacaagctgcacttgtttgatgtggacgtggccgacaaccggggccgttaccgcgagtcggatgactacgcacagggtgctcaggtggtggtggctgatacgccggtcggtcggctggggctgagcgtgtgttacgacctgcgctttcccgaactgtacagcgcgctgcgcgcggccggcgcggagctgataaccgcaccggcagcttttaccgcagtgaccggcgcagcacattgggaggtgctggtgcgtgcccgggccatcgaaacccagtgttacctgctggctgcggcacagggcggtgcccaccctggcccacgggaaacccatggccatgcggcgatcgtcgacccttgggggcgcattctcgcagaacaggcgcaaggtgaagcggtactgcttgccgagcgcgacattgaagaacaagcgtccattcggacgcgcatgccggtggtatcgcaccggcgctttttttcgcagggcgcgttgcggcctgcgcatacctcggagtga

SEQ ID NO: 72622 - protein, 283 aa, Pseudomonas putida KT2440
MKAAVIQMVSQDDVQTNLQRAGALLEQAALGGARLAVLPENFAAMGRKDAAAIGRAEALGEGPILPWLKRTARDLKLWIVAGTLPLPPFGHPDAKAHACSLLVDEHGEVAARYDKLHLFDVDVADNRGRYRESDDYAQGAQVVVADTPVGRLGLSVCYDLRFPELYSALRAAGAELITAPAAFTAVTGAAHWEVLVRARAIETQCYLLAAAQGGAHPGPRETHGHAAIVDPWGRILAEQAQGEAVLLAERDIEEQASIRTRMPVVSHRRFFSQGALRPAHTSE

SEQ ID NO: 72623 - DNA, 822 bp, Pseudomonas putida KT2440
  CDS (1)..(822): transl_table=11
gtgaaagtttctcttatccaggtgaattcagtacaggacaaggcgttcaatttggccgaagctgatcgtctcgcacgagaggcaatcgatcgagacggctcacgtcttgttgtatttcctgaacactttgactgggcgggtggtacacctgaacaaaagatcgcagctggcgagccgcatagcggggggccggcttatgaaatgtgtaaaaaactggcacaggactgcaatgtctacgttcacaccggtagcttctacgaaagcacgcctgacggtagccgcgtctataacacctcggtcgtttttgatcccaaaggcaacgagctgggtcgctaccgtaaaatccacctgttcgacatcgtcactcctgacggtatgcgctatggcgaatccagtgcagtagcgccaggtacagaggtatcggtggtcgatattgaaggccttaagtatggctttgcgatctgctacgacattcgcttcccggagcttttccaaaagctggttgcgttgggtgctgatgtaattgtactgccggcggcatttacccttcaaactggtaaagatcattgggatgtactctgccgcgctcgggcaattgaaacgcagtgctatttccttgctccaggtcaaactgggccattcgaacagtccggtgagactcgctattcctacggtcactcgctggtttgtgatccatggggccacattatcgccaaggcgtcggatggtgtcggctatgtaactgccaatatcgaacccgagcgcatcgcagcagtgcgcaaacaaattccgcttgcttcgcacaaggtacttcagaaatga

SEQ ID NO: 72624 - protein, 273 aa, Pseudomonas putida KT2440
MKVSLIQVNSVQDKAFNLAEADRLAREAIDRDGSRLVVFPEHFDWAGGTPEQKIAAGEPHSGGPAYEMCKKLAQDCNVYVHTGSFYESTPDGSRVYNTSVVFDPKGNELGRYRKIHLFDIVTPDGMRYGESSAVAPGTEVSVVDIEGLKYGFAICYDIRFPELFQKLVALGADVIVLPAAFTLQTGKDHWDVLCRARAIETQCYFLAPGQTGPFEQSGETRYSYGHSLVCDPWGHIIAKASDGVGYVTANIEPERIAAVRKQIPLASHKVLQK

SEQ ID NO: 72625 - DNA, 825 bp, Vibrio vulnificus CMCP6
  CDS (1)..(825): transl_table=11
atggaaaggattgccattattcaaatgacgtcgacgtcagactgtacagacaatgtggcttatattgagcattgggcagagcaggcggcccttctaggggcaagtttggtggtgaccccagaaaacgccttgctgtttggtggcagagaggattaccaccagcatgccgaaccgcttggtaatggcccattgcaacaggccatggcgcagcttgccaaacggctggcagtgaccctggtgattggcagcatgccgattcgccaagggcatgacgttaccactaccagcttggtttttggccccaatggcgaacgtcttggtcattacagcaagctgcacatgtttgatgtggaggtcagcgatggccatgggcattaccgtgaatcagacagctttttggctggcgatcgcagcagtgtggtggccacgcccataggccgtttagggctttccatttgctacgatgttcgctttccggcgttgtaccaaacactacgtcaaaagggagccgatattttgttggtgcccgcggcgtttactgcggtgactggagaggcgcattgggaaatactcttgcgcgctcgagcgatagaaaatcagtgctgggtgattgccgcagcacaaggcggaatgcattccgccagtcgtgaaacgtggggccactctatggtcattgacccttgggggaaagtcgtcgcacaattaccgcaacaaggtgatttgctgcttgcagagatagacttagccttaagtgacacgattcgacgtaaaatgccagtggtgaaacacagccgttttactcatttactagacaataaagattga

SEQ ID NO: 72626 - protein, 274 aa, Vibrio vulnificus CMCP6
MERIAIIQMTSTSDCTDNVAYIEHWAEQAALLGASLVVTPENALLFGGREDYHQHAEPLGNGPLQQAMAQLAKRLAVTLVIGSMPIRQGHDVTTTSLVFGPNGERLGHYSKLHMFDVEVSDGHGHYRESDSFLAGDRSSVVATPIGRLGLSICYDVRFPALYQTLRQKGADILLVPAAFTAVTGEAHWEILLRARAIENQCWVIAAAQGGMHSASRETWGHSMVIDPWGKVVAQLPQQGDLLLAEIDLALSDTIRRKMPVVKHSRFTHLLDNKD

SEQ ID NO: 72627 - DNA, 879 bp, Bradyrhizobium japonicum USDA 110
  CDS (1)..(879): transl_table=11
atgagcgacaacaggaccttcaccgccgcgatggtgcagatgcgcaccggcctgatgcccgagcccagcctcgcgcaggccaccaggctgatccggcaggccgcggccaacggcgccgactacgtgcagacgcccgaagtcagcaacatgatgcagctgaaccgcaaggcgctgttcgagcacctccagagcgaagagaacgacgcctcgctcaaggcttaccgcgcgctcgcggcggagctgaagatccacatccatgtcggctcgctggcattgcgtttctcggacgaaaaagcggtcaaccgctcgttcctgatcgggcccgagggcaatgtgctcgcgagctacgacaagatccacatgttcgacatcgagctgccggacggcgagagctatcgcgaatccgccaattaccagccgggcgagaccgccgtgatctccgacctgccctggggccgggtcgggctgacgatctgctacgacgtgcgcttccccgcgctctaccgcgcgctggccgagagcggcgcctatttcatcacggtgccgtccgccttcacgcgcaagaccggtgaagcgcactggcacgtgctgctgcgcgcacgcgcgatcgagaccggttgtttcgtgttcgccgcggcgcaggccggcctgcacgagaacaagcgcgagacctatggccactcgttgatcatcgatccctggggcgagatcctcgcggaaggtgacgtcgagcccggcattatcatggccacgatcgatcccgccaaggtcgagaccgcgcgccgggcgatcccttcgctccagcacggccgccgcttcggcgtcgccgaccccaaggccgggccggatcatctgcatctggtgcggggatcggcatga

SEQ ID NO: 72628 - protein, 292 aa, Bradyrhizobium japonicum USDA 110
MSDNRTFTAAMVQMRTGLMPEPSLAQATRLIRQAAANGADYVQTPEVSNMMQLNRKALFEHLQSEENDASLKAYRALAAELKIHIHVGSLALRFSDEKAVNRSFLIGPEGNVLASYDKIHMFDIELPDGESYRESANYQPGETAVISDLPWGRVGLTICYDVRFPALYRALAESGAYFITVPSAFTRKTGEAHWHVLLRARAIETGCFVFAAAQAGLHENKRETYGHSLIIDPWGEILAEGDVEPGIIMATIDPAKVETARRAIPSLQHGRRFGVADPKAGPDHLHLVRGSA

SEQ ID NO: 72629 - DNA, 846 bp, Pseudomonas syringae pv. tomato str. DC3000
  CDS (1)..(846): transl_table=11
atgaccttcgctgtgattcagatggtcagccagagcgatgtccaggctaatctggccagcgcccgccgattgctcgaacaggcggcagaaggcggtgccaggctcgccgtgctgccggaaaacttcgtcgcaatggggcgccgtgatgtcgctgatatcggtcgtgccgaggctgatgggcacggccccatcctgccatggttgaaactggccgctcgcgacctcaagttatggattgttgccggaacattgccactgccgccgaccgcgcagccagcgggcaaggtcaccgcctgttcgctgctggttgacgagcatggcgagcagatagcgcgctatgacaagctgcatttgtttgacgtggatgttgccgacagccgaggccgctaccgtgaatcggatgactatgctcatggcagcaaggttgtggtggtcgatacgccggtcggtcgtctggggttgagcgtgtgttatgacctgcgcttcccggagctttacaccgcgctgcgtgaagccggcgctgaactgatcacggccccgtcggcattcacagcggtcaccggcgctgcgcactgggacattctgatcagggcgcgcgccgtcgaaacccagtgctacgtgctggcggcggcacaaggcggggtccatccggggcctcgcgagacttacggacacgcggccatcgttgatccatggggccgcgtactggatcagcaagcgcagggtgaagccgtgctgctggccacacgcgacagtgaagaacaagcgtccatacgggcgcggatgccggtgtccagtcaccggcgctttttttcgcaggacgccatgcggcctgcttcggagtga

SEQ ID NO: 72630 - protein, 281 aa, Pseudomonas syringae pv. tomato str. DC3000
MTFAVIQMVSQSDVQANLASARRLLEQAAEGGARLAVLPENFVAMGRRDVADIGRAEADGHGPILPWLKLAARDLKLWIVAGTLPLPPTAQPAGKVTACSLLVDEHGEQIARYDKLHLFDVDVADSRGRYRESDDYAHGSKVVVVDTPVGRLGLSVCYDLRFPELYTALREAGAELITAPSAFTAVTGAAHWDILIRARAVETQCYVLAAAQGGVHPGPRETYGHAAIVDPWGRVLDQQAQGEAVLLATRDSEEQASIRARMPVSSHRRFFSQDAMRPASE

SEQ ID NO: 72631 - DNA, 822 bp, Vibrio parahaemolyticus RIMD 2210633
  CDS (1)..(822): transl_table=11
atggaacgtgttggcatcattcaaatgacttcggggcctgatattcaggcgaatttggactttattgaccagcaatgtactttggcggccaatcaaggagtaaagctggtgctcacgccggaaaatgcggtgttgtttgccagtcgagaagagtaccatcaacatgcagagccgttaggtagcggtgctattcaagagcgtttagccaatatcgcgaagagtcatcaactgacgcttgtcgttggtagcatgccgattcaaaccgcgcgtggtgtgacaacgacgacgctcgttttacctcctcacggaaaatgcattgcccattatgacaagctgcatatgtttgatgtcgatgtagaagatggccatggcagctaccgagagtcagatactttcaccgcgggcaaccaaattgtggtggcagaaacggatatcggcagcgtcggcttgagcatttgttacgacgttcgtttccccgaattgtacaaagcactgcgtttagcgggggcggataccattgttgttcccgccgcgtttactgcggttactgggcaagctcactgggaagtgttgctgcgagctcgagcaattgaaacgcaatgttggattttagccagtggacaagcgggaacacactcttgcggccgtaaaacgtgggggcattcaatggtgattgacccctggggacgcattcacaaacaacttcaagaccaagtgggtttgctggtggcagagatagatttgtcacaaacccagcaagtaaggcagaatatgccgctgactcaacacagtcgctttcaaaatgaattgagacggaaataa

SEQ ID NO: 72632 - protein, 273 aa, Vibrio parahaemolyticus RIMD 2210633
MERVGIIQMTSGPDIQANLDFIDQQCTLAANQGVKLVLTPENAVLFASREEYHQHAEPLGSGAIQERLANIAKSHQLTLVVGSMPIQTARGVTTTTLVLPPHGKCIAHYDKLHMFDVDVEDGHGSYRESDTFTAGNQIVVAETDIGSVGLSICYDVRFPELYKALRLAGADTIVVPAAFTAVTGQAHWEVLLRARAIETQCWILASGQAGTHSCGRKTWGHSMVIDPWGRIHKQLQDQVGLLVAEIDLSQTQQVRQNMPLTQHSRFQNELRRK

SEQ ID NO: 72633 - DNA, 864 bp, Nitrosomonas europaea ATCC 19718
  CDS (1)..(864): transl_table=11
atgtctactgacgttggtatcgatcaggccgcccgctctaaagcgggtgataataccagagtaagggtggcagccgttcagatggcttccggtcccagtgtagctgctaatcttgaagaggctttccgcctgattgaagaggccgccgcaaaacaggccaagctggtagtgttgccggaatatttctgtatcatgggaatgaaggatacggataagctggcagtgcgtgaaaatcctggtgaaggggaaattcagaattttctgagcgaaaccgcaaagcggtttggcatctggctggcgggagggtcggtaccactgatttcaccggtatcggacaaggtatacaacagttgcctggtatacgatgaacatggccagcaggtggcgcgttacgataagattcacctgttcgggttgtcgctgggtaacgagaatttcgctgaagagagaacgatcgacgcgggtaatcgggtggttgcgctcgattccccgtttgggcggatggggttgtccatctgctatgatctgcgtttccccgaactttaccgtatgatgggcaaggtggatgtcattctggcaccggcggcgttcactgccattaccggcaaggcccactgggagacgctgattcgtgcgcgtgcgatcgagaatcaggcttatctgatcgctccggcgcaagggggattccatgtgaacgggcgtgaaaccaatggtgacagcatgatcgtcgatccatggggtgtgattatcgaccgtcttccgcgtggaccgggggtagtggtggcggaaatcgaccgagcatatcagtcaagtgtgcgggcgagtctgcctgcgctggagcaccgctgcctgcttgcctgttga

SEQ ID NO: 72634 - protein, 287 aa, Nitrosomonas europaea ATCC 19718
MSTDVGIDQAARSKAGDNTRVRVAAVQMASGPSVAANLEEAFRLIEEAAAKQAKLVVLPEYFCIMGMKDTDKLAVRENPGEGEIQNFLSETAKRFGIWLAGGSVPLISPVSDKVYNSCLVYDEHGQQVARYDKIHLFGLSLGNENFAEERTIDAGNRVVALDSPFGRMGLSICYDLRFPELYRMMGKVDVILAPAAFTAITGKAHWETLIRARAIENQAYLIAPAQGGFHVNGRETNGDSMIVDPWGVIIDRLPRGPGVVVAEIDRAYQSSVRASLPALEHRCLLAC

SEQ ID NO: 72635 - DNA, 822 bp, Prochlorococcus marinus subsp. marinus str. CCMP1375
  CDS (1)..(822): transl_table=11
ttggcggattttctagcagcggcagttcaaataacaagtacctctgacattgaggcaaatttctctttggctgaagagcaaatagaacttgcttctcggcgaggagcagagttagttggcttgccagagaattttgcttttttgggaaatgatcaacaacgattagatatttctgcatctctagctgagcagtgcagtcaatttttggtgacgatggctaggagatatcaaatatttcttttaggtggtggattcccagttcctgcaggagatggccagcggacccttaacagagctgaattagtaggtagagatggtcagcttttaggtagatatgacaagattcatttgtttgatgtggatttgccagatgggaacaaatatagagaatccgaaactattatttccgggaagaagttgccttcggttattaatcttcctggtttatgtaaggtcggaatatcgatttgttacgacgttcgtttccctgaactttataggcatcttgtaaatgaaggtgcagagttgttaatgattcctgcgacctttacagcttttacaggtaaagatcactggcaagttttgcttcagtctagagctatcgaaaacacagcttatgtcgttgctccagctcaaactggtttacattatggtcggcgtcaaagtcatggtcacgcaatgattattgatccttggggaactgtgcttgctgatgcaggagttcaacaaggttcagctatagcaccagtagatacttctagagttcaaagtataaggaatcaaatgccttgtctaaaacataggaaaccagaacttttttaa

SEQ ID NO: 72636 - protein, 273 aa, Prochlorococcus marinus subsp. marinus str. CCMP1375
MADFLAAAVQITSTSDIEANFSLAEEQIELASRRGAELVGLPENFAFLGNDQQRLDISASLAEQCSQFLVTMARRYQIFLLGGGFPVPAGDGQRTLNRAELVGRDGQLLGRYDKIHLFDVDLPDGNKYRESETIISGKKLPSVINLPGLCKVGISICYDVRFPELYRHLVNEGAELLMIPATFTAFTGKDHWQVLLQSRAIENTAYVVAPAQTGLHYGRRQSHGHAMIIDPWGTVLADAGVQQGSAIAPVDTSRVQSIRNQMPCLKHRKPELF

SEQ ID NO: 72637 - DNA, 831 bp, Bordetella pertussis Tohama I
  CDS (1)..(831): transl_table=11
atgacaggcgaccctcgaaccgacacaaccccgtcctgccgcgtggcggccatacagatggtctccggccctgacgttgatgaaaacctggcgcaagctgctgaattgattgggaaagctgcgcaggacggcgcgcggctggttgcgttgcccgaatatttctgttttatggggcataccgataccgacaaacttgccatcaaggaagagagtggttatggcaaaattcagagctttctttcaaatatttcatcccaatatggaatatgggtggtgggcggcaccttgccattaaccagcccggacccgcagcgcgtattcaatacaacttttgtatacggacccggcggccagccggcggcgcgctacgacaaaatccatttattcaatttccagcgcggcgccgaatcgtacgacgaggcaattgccatccggcccggcaaagcggtgcaggtattcgatggcccgtgcgggcgggtcggactgtcggtgtgctacgacctgcgctttcccgagctgtaccgtgccatgggtacggtcgacctgatcctggtgccggccgccttcacctacaccacgggccaggctcactgggagctcctgctgcgtgcccgcgccatcgaaaaccagtgttatgtgctggcgccggcgcaaggcgggcggcattcgaccggacggcgcacctggggccattccatgctggtcgacccctgggggcaggtgctggacgttttacccgaggggccgggcgtcatcggcggtaccatagaggctgcgcgcctggctgaggtacgcgccagcctgcctgccctgcgtcatcgcgttctatag

SEQ ID NO: 72638 - protein, 276 aa, Bordetella pertussis Tohama I
MTGDPRTDTTPSCRVAAIQMVSGPDVDENLAQAAELIGKAAQDGARLVALPEYFCFMGHTDTDKLAIKEESGYGKIQSFLSNISSQYGIWVVGGTLPLTSPDPQRVFNTTFVYGPGGQPAARYDKIHLFNFQRGAESYDEAIAIRPGKAVQVFDGPCGRVGLSVCYDLRFPELYRAMGTVDLILVPAAFTYTTGQAHWELLLRARAIENQCYVLAPAQGGRHSTGRRTWGHSMLVDPWGQVLDVLPEGPGVIGGTIEAARLAEVRASLPALRHRVL

SEQ ID NO: 72639 - DNA, 831 bp, Bordetella parapertussis 12822
  CDS (1)..(831): transl_table=11
atgacaggcgaccctcgaaccgacacaaccccgtcctgccgcgtggcggccatacagatggtctccggccctgacgttgatgaaaacctggcgcaagctgctgaattgattgggaaagccgcgcaagacggtgcgcggctggttgcgttgcccgaatatttctgttttatggggcataccgataccgacaaacttgccatcaaggaagagagtggttatggcaaaattcagagctttctttcaaatatttcatcccaatatggaatatgggtggcgggcggtaccttgccattaaccagcccggacccgcagcgcgtattcaatacaacttttgtatacggacccggcggccagccggcggcgcgctacgacaaaatccatttattcaatttccagcgcggcgccgaatcgtatgacgaggcaattgccatccggcccggcaaagaggtgcaggtattcgatggcccgtgcgggcgggtcggattgtcggtgtgctacgacctgcgctttcccgagctgtaccgtgccatgggtacggtcgacctgatcctggtgccggccgccttcacctacaccacgggccaggctcactgggagctcctgctgcgtgcccgcgccatcgaaaaccagtgttatgtgctggcgccggcgcaaggcgggcggcatccgaccggacggcgcacctggggccattccatgctggtcgacccctgggggcaggtgctggacgttttacccgaggggccgggcgtcatcggcggtaccatagaggctgcgcgcctggctgaggtacgcgccagcctgcctgccctgcgtcatcgcgttctatag

SEQ ID NO: 72640 - protein, 276 aa, Bordetella parapertussis 12822
MTGDPRTDTTPSCRVAAIQMVSGPDVDENLAQAAELIGKAAQDGARLVALPEYFCFMGHTDTDKLAIKEESGYGKIQSFLSNISSQYGIWVAGGTLPLTSPDPQRVFNTTFVYGPGGQPAARYDKIHLFNFQRGAESYDEAIAIRPGKEVQVFDGPCGRVGLSVCYDLRFPELYRAMGTVDLILVPAAFTYTTGQAHWELLLRARAIENQCYVLAPAQGGRHPTGRRTWGHSMLVDPWGQVLDVLPEGPGVIGGTIEAARLAEVRASLPALRHRVL

SEQ ID NO: 72641 - DNA, 831 bp, Bordetella bronchiseptica RB50
  CDS (1)..(831): transl_table=11
atgacaggcgaccctcgaaccgacacaaccccgtcctgccgcgtggcggccatacagatggtctccggccctgacgttgatgaaaacctggcgcaagctgctgaattgattgggaaagccgcgcaggacggcgcgcggctggttgcgttgcccgaatatttctgttttatggggcataccgataccgacaaacttgccatcaaggaagagagtggttatggcaaaattcagagctttctttcaaatatttcatcccaatatggaatatgggtggcgggcggtaccttgccattaaccagcccggacccgcagcgcgtattcaatacaacttttgtatacggacccggcggccagcaggcggcgcgctacgacaaaatccatttattcaatttccagcgcggcgccgaatcgtatgacgaggcaattgccatccggcccggcaaagaggtgcaggtattcgatggcccgtgcgggcgggtcggattgtcggtgtgctacgacctgcgctttcccgagctgtaccgtgccatgggtacggtcgacctgatcctggtgccggccgccttcacctacaccacgggccaggctcactgggagctcctgctgcgtgcccgcgccatcgaaaaccagtgttatgtgctggcgccggcgcaaggcgggcggcatccgaccggacggcgcacctggggccattccatgctggtcgacccctgggggcaggtgctggacgttttacccgaggggccgggcgtcatcggcggtaccatagaggctgcgcgcctggctgaggtacgcgccagcctgcctgccctgcgtcatcgcgttctatag

SEQ ID NO: 72642 - protein, 276 aa, Bordetella bronchiseptica RB50
MTGDPRTDTTPSCRVAAIQMVSGPDVDENLAQAAELIGKAAQDGARLVALPEYFCFMGHTDTDKLAIKEESGYGKIQSFLSNISSQYGIWVAGGTLPLTSPDPQRVFNTTFVYGPGGQQAARYDKIHLFNFQRGAESYDEAIAIRPGKEVQVFDGPCGRVGLSVCYDLRFPELYRAMGTVDLILVPAAFTYTTGQAHWELLLRARAIENQCYVLAPAQGGRHPTGRRTWGHSMLVDPWGQVLDVLPEGPGVIGGTIEAARLAEVRASLPALRHRVL

SEQ ID NO: 72643 - DNA, 828 bp, Prochlorococcus marinus subsp. pastoris str. CCMP1986
  CDS (1)..(828): transl_table=11
ttgactgattttttagtggccgctttacaaattacaagtacttctaatgttgaagcgaattttgctgaggctgaggaacagattgaattagcctctaggaggggttcagaactgataggtttgccagagaattttgcattcttgggtgaagataatgaaaaacttagaatggcttctgaattatcaataaagtgtaccaacttcctaaaaacgatgtctcagagatatcaagtttttctcttaggaggaggttatcccgtccccgctggagataatcgtcatactttcaatagatcagctctttttggcaaagatggacaggttttagcaaaatatgacaaaatccatctttttgatgttgatttacctgatggtaatttatacaaagaatcatcaactattttgtctggggaggaacatcctccagttattgatgttccaggcctttgtaaaataggattatctatttgttacgatgttagattccctgaactttatagacacctttcctcgaaaggtgctgaacttataatgattcctgcagcatttacagcttttactggaaaagaccattggcaaattttacttcaagcaagagcgattgaaaatacagcttatgtagtagcccctgctcaaacaggtattcactatgggagaagacaaagtcatggacatgcaatggttatagacccttggggaactgttttgtctgatgcaggaaaaacacaaggagcagcaatagcccctgcagataaagagagggtccaaaagataagagagcagatgccaagtttaaaacatagaaaaactaagatgtttgcaaaataa

SEQ ID NO: 72644 - protein, 275 aa, Prochlorococcus marinus subsp. pastoris str. CCMP1986
MTDFLVAALQITSTSNVEANFAEAEEQIELASRRGSELIGLPENFAFLGEDNEKLRMASELSIKCTNFLKTMSQRYQVFLLGGGYPVPAGDNRHTFNRSALFGKDGQVLAKYDKIHLFDVDLPDGNLYKESSTILSGEEHPPVIDVPGLCKIGLSICYDVRFPELYRHLSSKGAELIMIPAAFTAFTGKDHWQILLQARAIENTAYVVAPAQTGIHYGRRQSHGHAMVIDPWGTVLSDAGKTQGAAIAPADKERVQKIREQMPSLKHRKTKMFAK

SEQ ID NO: 72645 - DNA, 822 bp, Prochlorococcus marinus str. MIT 9313
  CDS (1)..(822): transl_table=11
gtgaccgactttctggcagccgctttgcagctgacgagcacctcggatccagagctcaattttgctgctgccgaggagcagatcgaactggctgcccgccgtggggcggaattggtgggattacctgaaaattttgcctttatgggtgatgacgagcgacgtctggagctggcacaagacttagctgagcaatgcagccgctttctggtcaccatggcaaggcgctaccaggtggtgcttctgggcgggggcttccctgtaccttcaggagatagcaatcacacggtcaacagagccgaattggtcggtcgtgatggtcagctgctagcgagatacgacaagattcatctcttcgatgtggatctacctgaaggcaacacctatcaggagtcggccacgactacgtctggtcgtgaactacccccggtcgtggatgtgccaggactatgtcgagtgggactatccatctgctacgacgtgcgcttccctgagctctatcgccatctcgtcagtgctggtgccgagttattgatgattccagcagcattcacggctttcaccggaaaagatcactggcaggtcttacttcaagccagggccatcgaaaacacctcctatgtgcttgcacctgcccagacaggtcgtcattacagccgtcgacagagccatggacatgccatggtgattgatccctggggaaccgtcttggctgatgcaggagtgagtcagggtgcagccattgctcctgtggataactcgcacattggtcgcattcgcgcgcaaatgccaagcctccaacaccggcagtcagcactgttctga

SEQ ID NO: 72646 - protein, 273 aa, Prochlorococcus marinus str. MIT 9313
MTDFLAAALQLTSTSDPELNFAAAEEQIELAARRGAELVGLPENFAFMGDDERRLELAQDLAEQCSRFLVTMARRYQVVLLGGGFPVPSGDSNHTVNRAELVGRDGQLLARYDKIHLFDVDLPEGNTYQESATTTSGRELPPVVDVPGLCRVGLSICYDVRFPELYRHLVSAGAELLMIPAAFTAFTGKDHWQVLLQARAIENTSYVLAPAQTGRHYSRRQSHGHAMVIDPWGTVLADAGVSQGAAIAPVDNSHIGRIRAQMPSLQHRQSALF

SEQ ID NO: 72647 - DNA, 822 bp, Synechococcus sp. WH 8102
  CDS (1)..(822): transl_table=11
gtgaacgacttcctggcggctgccgtgcaactcacgagcagccaggacccggaaatcaatttcaatgccgccgaggagcagatcgatctggcggcacgacgtggtgcggatctggtgggtttgcctgagaacttcgccttcatgggcgaggacagtcgccgcctcgagctggcgtctgacctggccgaacgctgcagccgctttctggtgacgatggcgcggcgttaccaggtggtgctgctgggcggaggattccctgcgccggtgggtgatggctcaaggacgttgaaccgggcagaactggtggaccgggatggccagctgttggcccgttacgacaagatccacctcttcgacgttgaccttcccgacggcaacacctaccgcgagtcggcaaccgtgaatgccggccaggagttgccgcctgtggtggatgtgccgggtctgtgcaaggtgggtctgtccatctgttacgacgttcgctttcctgagctgtatcgacacctcgtgggtgctggagccgatctgctgatgattccagccgctttcaccgccttcaccggcaaggaccactggcaagtgctgcttcaggcccgagccattgaaaacaccgcctacgtgctggctccggcgcagaccggccagcactacgggcgtcgccacagccatggtcacgccttagtgattgatccctggggcacggttttggccgatgcaggtgtgttgcctggggctgccattgcacccgtcaacacagcccatcagggacatgttcgggatcagatgccgagtctgcgccaccgccggccggcattgttctga

SEQ ID NO: 72648 - protein, 273 aa, Synechococcus sp. WH 8102
MNDFLAAAVQLTSSQDPEINFNAAEEQIDLAARRGADLVGLPENFAFMGEDSRRLELASDLAERCSRFLVTMARRYQVVLLGGGFPAPVGDGSRTLNRAELVDRDGQLLARYDKIHLFDVDLPDGNTYRESATVNAGQELPPVVDVPGLCKVGLSICYDVRFPELYRHLVGAGADLLMIPAAFTAFTGKDHWQVLLQARAIENTAYVLAPAQTGQHYGRRHSHGHALVIDPWGTVLADAGVLPGAAIAPVNTAHQGHVRDQMPSLRHRRPALF

SEQ ID NO: 72649 - DNA, 810 bp, Chromobacterium violaceum ATCC 12472
  CDS (1)..(810): transl_table=11
atgaagcagaagtttgtcgccgcagccgtgcagatggtttccggttgcggcctggaggccaacctggcccgcgccgaccagctgctgggagaggccgccgcgcgcggcgccggcctggcggtgttgccggagtatttttgcctgatgggcgcgaaggaaaccgacaaggtagccatccgcgaaccgttcggcggcggccccatccagcaggcgctgtcggagatggcgcgccgccatggcctgtggctgctgggcggcaccgtgccgcttgtctgcgaggaagagggcaaggtgttcaacagcagcctgctctacaatccgcagggagaggtggcggcccgctacgacaagatccacctgttcggtttcaccggccagggagaaagttattgcgagtccaacaccatacgcccgggcgtgacgccgaccaaggcggaaacgccgctgggcgacatcgctttcggcatctgctacgacctgcgcttcccggagctgttccgcatgctggcgccggtcgacctgctgatcttgccggcggccttcaccgccaccaccggcgaagcgcactgggagccgctgctgcgggcccgggcaatagaaaaccagtgttacctgattgcctccgcgcagggcggaaggcatgaaaacggccggcagacgcacggccactcgatgatcatcgacccgtgggggcgcattctcgccgaactgccgagcggcgagggcgtcatcaccgccgagatcgatcccgaatggacggattcggtgcggagccgcctgccggctctggcgcaccgggtcatacgctga

SEQ ID NO: 72650 - protein, 269 aa, Chromobacterium violaceum ATCC 12472
MKQKFVAAAVQMVSGCGLEANLARADQLLGEAAARGAGLAVLPEYFCLMGAKETDKVAIREPFGGGPIQQALSEMARRHGLWLLGGTVPLVCEEEGKVFNSSLLYNPQGEVAARYDKIHLFGFTGQGESYCESNTIRPGVTPTKAETPLGDIAFGICYDLRFPELFRMLAPVDLLILPAAFTATTGEAHWEPLLRARAIENQCYLIASAQGGRHENGRQTHGHSMIIDPWGRILAELPSGEGVITAEIDPEWTDSVRSRLPALAHRVIR

SEQ ID NO: 72651 - DNA, 813 bp, Gloeobacter violaceus PCC 7421
  CDS (1)..(813): transl_table=11
gtgatagaaagctacctggccgccgctatccagatgaccagcaccgccgacatcgaggccaacctcgaccaggcctatgcgctgattggcatcgcggtgcgccgcggcgcccgcctggtcagcctgcccgagaactttgcctttctgggactggaggctgagaaactcgccctcgccccgcgcatcgccgagatgagcgaaaaatttcttgtctccgccgcgcgcgactgggcggtgacgctgctgggcggcggctacccggtgctcgccgagcagacggccaagtgctacaacacagccctgctcgtgggtcccgagggtcaggagttgggccgctaccgcaaattgcacctgttcgacgtcaacctgcccgacggcaacacttaccacgagtccgactcgatcgtgcccggcaaagacctggtggtggtgcgcagcgacaccctcggcaatctgggtctatcggtctgctacgacctgcgctttccggaactctaccgggccctctcggcggcgggggcggaagtcctgctggtgccctcggcctttaccgccttcaccggcaaggaccactggcgggtgctcctgcaggcgcgggcgatcgaaaatacctgctacgtgatcgccgccgcccagaccggcgagcactatccgcgtcggcaaacctacggccacgcgatgatcgtcgatccgtggggcaacgtgctctccgacgccggggacaccaccggcatcgccatcggcgaaatcaaccccatgcgtctggaggcggtgcgccgccaattgcccgtgctgcaacaccggcaactttga

SEQ ID NO: 72652 - protein, 270 aa, Gloeobacter violaceus PCC 7421
MIESYLAAAIQMTSTADIEANLDQAYALIGIAVRRGARLVSLPENFAFLGLEAEKLALAPRIAEMSEKFLVSAARDWAVTLLGGGYPVLAEQTAKCYNTALLVGPEGQELGRYRKLHLFDVNLPDGNTYHESDSIVPGKDLVVVRSDTLGNLGLSVCYDLRFPELYRALSAAGAEVLLVPSAFTAFTGKDHWRVLLQARAIENTCYVIAAAQTGEHYPRRQTYGHAMIVDPWGNVLSDAGDTTGIAIGEINPMRLEAVRRQLPVLQHRQL

SEQ ID NO: 72653 - DNA, 903 bp, Vibrio vulnificus YJ016
  CDS (1)..(903): transl_table=11
gtgaaatttcgcgtagccgtggtgagtttgaactcccagaaaaactgcgcaaagaagcgcaagaataaggagcgaatgatggaaaggattgccattattcaaatgacgtcaacgtcagactgtacagacaatgtggcttatattgagcattgggcagagcaggcggcccttcaaggggcaagtttggtggtgaccccagaaaacgctttgctgtttggaggtcgagaggattaccaccagcatgccgaaccgcttggtaacggcccattacaacaggccatggcgcagcttgccaaacggctggcagtgaccttagtgattggcagcatgccgattcgccaagggcatgacgttaccaccaccagcttggtttttggccccaatggcgaacgtcttggtcattacagcaagctgcacatgtttgatgttgaggtcagcgatggccatgggcattaccgtgaatcagacagctttttggctggcgatcgcagcagtgtggtggccacgcccataggccgtttagggctttccatttgctacgatgttcgctttccggcgttgtaccaaacactacgccaaaagggagccgatattttgttggtgcccgcggcgtttactgcggtgactggagaggcgcattgggaagtactcttgcgcgctcgagcgatagaaaatcagtgctgggtgattgccgcagcacaaggcggaatgcattccgccagtcgtgaaacgtggggccactctatggtcattgacccttgggggaaagtcgtcgcacaattaccgcaacaaggtgatttgctgcttgcagagatagacttagccttaagtgacacgattcgacgtaaaatgccagtggtgaaacacagccgttttactcatttactagacaataaagattga

SEQ ID NO: 72654 - protein, 300 aa, Vibrio vulnificus YJ016
MKFRVAVVSLNSQKNCAKKRKNKERMMERIAIIQMTSTSDCTDNVAYIEHWAEQAALQGASLVVTPENALLFGGREDYHQHAEPLGNGPLQQAMAQLAKRLAVTLVIGSMPIRQGHDVTTTSLVFGPNGERLGHYSKLHMFDVEVSDGHGHYRESDSFLAGDRSSVVATPIGRLGLSICYDVRFPALYQTLRQKGADILLVPAAFTAVTGEAHWEVLLRARAIENQCWVIAAAQGGMHSASRETWGHSMVIDPWGKVVAQLPQQGDLLLAEIDLALSDTIRRKMPVVKHSRFTHLLDNKD

SEQ ID NO: 72655 - DNA, 876 bp, Rhodopseudomonas palustris CGA009
  CDS (1)..(876): transl_table=11
atgaccgaagcggtgccgttcaatgccgcccttgtgcagatgcgcagcggcctcactcccgagcccaatctcgagcagggcaccaggctgatccgcgaggcggtgaaggccggcgccgactacgtgctcacccctgaggtgagcaacatgatgcagctcaaccgcgaagcgctgttcgcgcaactcgccgagcaggacgacgatctgtcgctgaaggcgtatcgcgagttggcacgcgaactgaacatccatctgcacatcggctcgctggcgctgcgcgcctcgccggatcgtgcagtcaaccgctcgttcctgatcggcccggacggtgcgatcctggcgagctacgacaagatccatatgttcgacatcgatctcggcaatggcgaaagctaccgggagtcggcgaactaccagccgggcgagaccgcggtgatctccgatctgccgtggggccggatcggcctgaccatctgttatgacgtgcgtttcccggcgctgtaccgcgcgctggccgaatccggcgcgtcgttcctggcggtgccggcggcgttcaccaagccgaccggcgaggcgcactggcacgtgctgctgcgcgcccgcgccatcgagaacggctgcttcgtcttcgccgcggcgcaaggcggtttgcatgagaacaagcgcgagactttcggccattcgctgatcatcgatccgtggggcaaggtcctggccgaaggcggcatcgagcccggcttcgtcatggcgcggatcgatccggccgaagtgacgaaggcgcgcggcaagattccgtcgctgcagcacggccggcgcttcactgtcgccgacgcgaacgccggccccggccatctgcatctggtccggcaatcatga

SEQ ID NO: 72656 - protein, 291 aa, Rhodopseudomonas palustris CGA009
MTEAVPFNAALVQMRSGLTPEPNLEQGTRLIREAVKAGADYVLTPEVSNMMQLNREALFAQLAEQDDDLSLKAYRELARELNIHLHIGSLALRASPDRAVNRSFLIGPDGAILASYDKIHMFDIDLGNGESYRESANYQPGETAVISDLPWGRIGLTICYDVRFPALYRALAESGASFLAVPAAFTKPTGEAHWHVLLRARAIENGCFVFAAAQGGLHENKRETFGHSLIIDPWGKVLAEGGIEPGFVMARIDPAEVTKARGKIPSLQHGRRFTVADANAGPGHLHLVRQS

SEQ ID NO: 72657 - DNA, 831 bp, Bdellovibrio bacteriovorus HD100
  CDS (1)..(831): transl_table=11
atgagttcagagttggttgtcgcagcagtgcaaatgacttcggtcgatgatgtaactaccaacttggctcagatggaggaactcttaaaagaggccttcaacggcgcgcaaccgcgctttgtttccttccctgaaaactgtctgtatttgcgcttgaaagagggcgaaaagatcgaggggcttactctcagtcacccggcctttgcgcgtctttccgagctggccaaacactacaatacttatctgcatctgggttcgatccctctttatctggaggggcatctttacaattcctcggcgctgatcactccggaaggggaggtacagcccacgtatcagaaaatgcatctgttcgacattcagctggatggtcaggcccctttgcgtgaatccgatgtgtttcgccacgggcaaaccccgaatgtgatcgatatcgacggctggaaggtgggcgaggcgatctgctatgatgtgcgttttgccgaactgttttcgcagtacgcccgtcgtgaagtggatgtgattttacttccggcggcgttcctggtgaagaccggcgaggcgcactgggaaattctgctgcgggcccgtgcgattgagaatcagtcttatgtgattgccgccgctcaagggggcacccacacgggtcttcgtggtggcacccgggaaacctatggccacagcctgatcatagacccttggggggccgttgtaggccaagttgaaaagcgccagcctggggttacgatctctaaattcacacgcgaacggatcgattctgttcgacgccaaataccgatgaagttccaccgccgccttcccgtaggttag

SEQ ID NO: 72658 - protein, 276 aa, Bdellovibrio bacteriovorus HD100
MSSELVVAAVQMTSVDDVTTNLAQMEELLKEAFNGAQPRFVSFPENCLYLRLKEGEKIEGLTLSHPAFARLSELAKHYNTYLHLGSIPLYLEGHLYNSSALITPEGEVQPTYQKMHLFDIQLDGQAPLRESDVFRHGQTPNVIDIDGWKVGEAICYDVRFAELFSQYARREVDVILLPAAFLVKTGEAHWEILLRARAIENQSYVIAAAQGGTHTGLRGGTRETYGHSLIIDPWGAVVGQVEKRQPGVTISKFTRERIDSVRRQIPMKFHRRLPVG

SEQ ID NO: 72659 - DNA, 876 bp, Eremothecium gossypii
  CDS (1)..(876)
atgtctgagattctgcgtgcaaaggtcaaagtggcactcgtgcagctggccgggtcatccgccagcaaggcggcgaacctggcgcgcgccgggcagttcatagagcgcgcgatgacggagcagccagacacggggctggtggtgctgccggagtgcttcaacgcgccgtacgagattggcaagttccgcgagttcgcggaggtggcggcagagggcccggagtcgccgtcggtgggcttcctggcggggcaggcgcggcggtggggcgtgacgctggtgggcgggacgatccccgagctggagccggacacgcagcgggtctacaacacgtgcctggtgttcgacggcaagggcgctctagtcggcaagcaccgcaaggtgcacctgttcgacgtggacatccccggcaagatcacgttcacagaaagccggacgctggccgcggggcggcacgtgacccaggtggacacgccggctggcgcgctcggcgtcggcgtgtgctacgacctgcgcttcccggaactggccatggtgtgcgcgcggcgcggcgcgtacgcaatggtgtaccccagcgcgttcaacacgacgaccgggccgctgcattggcacctgctcgcccgcgcgcgcagcgtcgacaaccagatctacacgctgctgtgctcgcccgcgcgcgtcgccggcgcgtcgtaccaggcgtacggccactcgctcgtcgtcgaccccaccggccgcgtcgtcgcagaggccggcgagggtgaggagatcctgtacgcgacgctcgaccccgcggagctcgactgggtgcgccgcgccatccccgtcacgcgccagcggcgcttcgacgtctacgcggacgtcgcggcctcctccccttag

SEQ ID NO: 72660 - protein, 291 aa, Eremothecium gossypii
MSEILRAKVKVALVQLAGSSASKAANLARAGQFIERAMTEQPDTGLVVLPECFNAPYEIGKFREFAEVAAEGPESPSVGFLAGQARRWGVTLVGGTIPELEPDTQRVYNTCLVFDGKGALVGKHRKVHLFDVDIPGKITFTESRTLAAGRHVTQVDTPAGALGVGVCYDLRFPELAMVCARRGAYAMVYPSAFNTTTGPLHWHLLARARSVDNQIYTLLCSPARVAGASYQAYGHSLVVDPTGRVVAEAGEGEEILYATLDPAELDWVRRAIPVTRQRRFDVYADVAASSP

SEQ ID NO: 72661 - DNA, 924 bp, Magnaporthe grisea 70-15
  CDS (1)..(924)
atggcaagcagcgcggagaagacgcacgaaccggtgctcaagcagcctgtcaagctcgcctgcatccaactggccagcggcgccgataaggcggcgaacctgtcccacgcccgcgacaaggtgatcgaggcctcgcgcgcaggagcaaagatcatcctgctgcccgagtgcttcaactccccctacggctgcgactatttcccctcgtacgctgaggccctgctgccctccccgccgacccgggggcagagcccgagctaccacgccctgtccgccatggccaaggagacgggcgcctacctcatcgctggctccatcccggagctggtcgacggtgccagcggggacgacaaggacaagaagtactacaacacggcgctcgtcttctccccgtcgggcgacctgctggccacccaccgtaaggtccacctcttcgacatcgacataccgggcaagattaccttccgtgagtcggacgtgctgtcccccggcaatgaggtgaccatcgtggaccttcccccgtacggcaaggtcggcgtggccatctgctacgacatacggttcccagagctggccacaatcgcggcgcgcaagggcgcctttgcgctgctctacccgggcgctttcaacatgacgacgggcccgctgcactgggagctgctggcgcgtgccagggccgtcgacaaccaactctacgtcgccctctgcagtccggccagggacctgaaggcctcctatcacgcctggggccacagccttgtcgccgaccccatggccgaggtcctgagccaggccgacgacgtcgagacaattgtctacgccgacctggaccccgaggctatagaagggccccggactaggatccctctcagggatcaaaggaggttcgatgtctacccggacatcagccagccgggcgcctga

SEQ ID NO: 72662 - protein, 307 aa, Magnaporthe grisea 70-15
MASSAEKTHEPVLKQPVKLACIQLASGADKAANLSHARDKVIEASRAGAKIILLPECFNSPYGCDYFPSYAEALLPSPPTRGQSPSYHALSAMAKETGAYLIAGSIPELVDGASGDDKDKKYYNTALVFSPSGDLLATHRKVHLFDIDIPGKITFRESDVLSPGNEVTIVDLPPYGKVGVAICYDIRFPELATIAARKGAFALLYPGAFNMTTGPLHWELLARARAVDNQLYVALCSPARDLKASYHAWGHSLVADPMAEVLSQADDVETIVYADLDPEAIEGPRTRIPLRDQRRFDVYPDISQPGA

SEQ ID NO: 72663 - DNA, 918 bp, Gibberella zeae PH-1
  CDS (1)..(918)
atggcaattgcggcaatcggtcagatctgctcaacgaagtcgatcaagggtaatctggaacaatgtgtcaaactggtggcgagtgcagcccggggacaagcaaaggtcttgtttctcccagaggcggctgactacatcgcctcgaacggtaaagagtcattggagcttgcagagcctcaatcgacgtcgtcttttgtgagcggtcttcgggaggcagctcgagagcatcgcgttgctgtccatgtaggtatccaccaccgtgatgagacagatattggacaggagcagtcaaagaggattctgaaccgaacgatctatatcaacgcagatggccaaatcgacgatacggcaacttacgacaagcttcatgcattcgactttggcaagatgaaggagagtgacacggtccagcctggtaaaactctcacagcacctttcgacactcccataggccgcatcggaagcctcatctgcttcgacctgcggttcccagaggcacctctggcacttgcccaacccggtcctcacagcgcgtggaagaaccgcccagcgcaggtactgacatacccgagtgccttcacctgccagacaggaccggtgcactgggagactcttctcaaggccagagccatcgagacacagagctacgtcattgcgtcgggtcaggttggaaaacacaacgagaagagatcgagttggggacagagcataatcattgatccttggggaaaggttgtcttaaagctcaaaggcgtgaaagaggagggtggaaaatatgagggcacgccggaggagggtgctgttggggatattgggtttgtggacattgatcttgagtatttggagaagattcgaaatgacagccctcttcagaggagaacggatgtttatcctgagttagtttgcagcaaggcatag

SEQ ID NO: 72664 - protein, 305 aa, Gibberella zeae PH-1
MAIAAIGQICSTKSIKGNLEQCVKLVASAARGQAKVLFLPEAADYIASNGKESLELAEPQSTSSFVSGLREAAREHRVAVHVGIHHRDETDIGQEQSKRILNRTIYINADGQIDDTATYDKLHAFDFGKMKESDTVQPGKTLTAPFDTPIGRIGSLICFDLRFPEAPLALAQPGPHSAWKNRPAQVLTYPSAFTCQTGPVHWETLLKARAIETQSYVIASGQVGKHNEKRSSWGQSIIIDPWGKVVLKLKGVKEEGGKYEGTPEEGAVGDIGFVDIDLEYLEKIRNDSPLQRRTDVYPELVCSKA

SEQ ID NO: 72665 - DNA, 867 bp, Candida glabrata CBS 138
  CDS (1)..(867)
atgtcctatatattgaaatcaaaagttaaagttgcattgatccagctggtgggatcaactccagataaacttgcgaatttgaaacatgccaaggcattgattgataatgctatgcaaagagagccagaaactaaaatagttgttctacctgaatgtttcaattctccttatgatgttactcagtttgctaaatactctgaggtaattgaggatccagaagcaccttcagttaatattttgaaagaaattgccaagacccatgccatcacattgattggtggctccatcccagaaagagatccagcaaatgacaatatatacaacacatgtttaattataaatgaagaggggtctattattgctaagcacaggaagctgcatttatttgacattgatattcctaacaagattacctttaaggaaagtatcacattaacaggaggtgataaggttactatggtcgatacaaagtatggtaaaattggtgttggtatctgttatgatttgagattcccagaaatggccatgattgctgctagaaagggggcatttgctatgatttatccgggtgccttcaacactgtgactggtcccctacattggcaattattagcaagagccaggtcagtggataaccagatttatacattactatgttcaccagctagagttccaggaagtccatatcaggcttggggtcactctctctgctctgatccatctggtaaaattctttgtgaagctgatatcaatgaggaaacattattcatcgatttggacccggaagttatagaaaccactagaggtggtattccaattacgactcaaagaaggtttgatgtttatccagatgtttcaagtaaatga

SEQ ID NO: 72666 - protein, 288 aa, Candida glabrata CBS 138
MSYILKSKVKVALIQLVGSTPDKLANLKHAKALIDNAMQREPETKIVVLPECFNSPYDVTQFAKYSEVIEDPEAPSVNILKEIAKTHAITLIGGSIPERDPANDNIYNTCLIINEEGSIIAKHRKLHLFDIDIPNKITFKESITLTGGDKVTMVDTKYGKIGVGICYDLRFPEMAMIAARKGAFAMIYPGAFNTVTGPLHWQLLARARSVDNQIYTLLCSPARVPGSPYQAWGHSLCSDPSGKILCEADINEETLFIDLDPEVIETTRGGIPITTQRRFDVYPDVSSK

SEQ ID NO: 72667 - DNA, 942 bp, Candida glabrata CBS 138
  CDS (1)..(942)
atgtcagtcaagattgctataggacaactgtgctcctcttctcagcatgcgcagaatttgtctatagtagcgtccttaatagaacgagccatcaaactggatgctagagtaatattcttccctgaagccactgattacctatctcaaaacgccacgcactcaagagttctggctaaatcaagtcctacatttgtagatgatctacagctaaagatcaaggacattaatgagagatataaatcggagaagagggctatagatgtttccataggggtacatcttccaccttccgagcaggatatattgaaaggtgacgacagagttaagaatgttctactctatatagacagctctggggttatcagatctagctacacaaagctacacttatttgatgttgatgtgccaaacggcccaatcttaaaagaatcacaatctgttcaaccaggagaccaaattccttcaataatagatacccctgcagggaaattagggtgctccatttgctatgacattagatttcccgaacttgctctaagattgaggagtatgggggcccaaatattatgttatcctagtgcctttacaatgaaaactggtcaggcccactgggaactgttgggtagggctcgagctatagatacacagtgctatgtagtaatgccagggcaatctggtacccataatgtaactgaagatacctggagtaaaactgctgattccaaaacaaaccccaatagtgtaactagaatgtcctggggccactcaatgatcatcaatccatggggtgacgtgattgcaagaagcgatgaaacaaacaatgaacctcagctagtcgtgtccgatattgatctaaaatcaatggagagagtaagggtaaatatgccgctctggcaacagagaaggttggatttattcgacaataattactcaatcacataa

SEQ ID NO: 72668 - protein, 313 aa, Candida glabrata CBS 138
MSVKIAIGQLCSSSQHAQNLSIVASLIERAIKLDARVIFFPEATDYLSQNATHSRVLAKSSPTFVDDLQLKIKDINERYKSEKRAIDVSIGVHLPPSEQDILKGDDRVKNVLLYIDSSGVIRSSYTKLHLFDVDVPNGPILKESQSVQPGDQIPSIIDTPAGKLGCSICYDIRFPELALRLRSMGAQILCYPSAFTMKTGQAHWELLGRARAIDTQCYVVMPGQSGTHNVTEDTWSKTADSKTNPNSVTRMSWGHSMIINPWGDVIARSDETNNEPQLVVSDIDLKSMERVRVNMPLWQQRRLDLFDNNYSIT

SEQ ID NO: 72669 - DNA, 873 bp, Kluyveromyces lactis NRRL Y-1140
  CDS (1)..(873)
atgtccgcagttttgaaatctaagttgaaggtagctttagttcagttagcaggatcttcgcctgacaagagtgcgaatttgagcagagccgctcaattcgttgctaaagccatggatgcacaaccggatacgaaactggttgtgttaccagaatttttcaacgctccatatgcagttgataagttcagagaatatgccgaagtaatcacacctgacgcgacatcggtgaaagcgttatctgagattgctcgcaaatggaaagtcacactagttggtggttccatcccagagctagaaccttctacagacaaaatatataacacgtctcttatctttaatgaagatggtgagatcattggcacacatcgtaaagcacatcttttcgatattgatattccaaatggtatcactttcaaggaatccgttactctatctggtgggaacaaaaatacgttgattgatgatccaaagatcggtaaatttggtgtcggtatctgttacgatatgagatttccggaacttgctatggttagtgccagaaaaggtgcatttgctatgatttatccaagtgctttcaacactaccaccggtccaatgcactggcaccttttggccagatctcgtagtatcgacaacgagatttataccatcttgtgctcaccagctagaagtgggggctctggttatcaggcttatggtcatagtttggtggttaatccaagaggtgaaatcattgcagaagctggtgaaggtgaagagatcgtatacgccgaattggatcctcaacttatcaaggaagtaagacaagctatacctgttactttccaaagaagatttgacatctatcctgacgttagtaagaccgataaataa

SEQ ID NO: 72670 - protein, 290 aa, Kluyveromyces lactis NRRL Y-1140
MSAVLKSKLKVALVQLAGSSPDKSANLSRAAQFVAKAMDAQPDTKLVVLPEFFNAPYAVDKFREYAEVITPDATSVKALSEIARKWKVTLVGGSIPELEPSTDKIYNTSLIFNEDGEIIGTHRKAHLFDIDIPNGITFKESVTLSGGNKNTLIDDPKIGKFGVGICYDMRFPELAMVSARKGAFAMIYPSAFNTTTGPMHWHLLARSRSIDNEIYTILCSPARSGGSGYQAYGHSLVVNPRGEIIAEAGEGEEIVYAELDPQLIKEVRQAIPVTFQRRFDIYPDVSKTDK

SEQ ID NO: 72671 - DNA, 909 bp, Kluyveromyces lactis NRRL Y-1140
  CDS (1)..(909)
atgaacgtagcaagaattggtattggtcagctgtgctcctcctcaaatttgaagcagaatctagaagttgtgaaatcattgattaaaaaagctttggatcaagacgttaaagtcctattctttccagaagcaactgactacttaagcagaaacgcagaacattctaaaaaattggcttcacaaacgccagaatttatttctgaactacaaagtgcaatatgtcaattgacgaaggcagcaggaaagccaattgatatttccattggtattcatatgcctccttctgaagtaaataccaaaaatggggattccagagttaagaatgttcttctatacatcaattcaaacggtgaaattctacagaagtatcaaaaattgcatctcttcgatgttgatgtccctaatggtccgattttgaaggaatctaacagcgttcagcctggttccgaaattccaagcataattaatactccagtaggaaaattaggaagttgtatctgttacgatataaggttccctgaactttctttgaaattacgctctaaaggggcgcaaattctatgcttccccagtgctttcactatgaagacaggcgaagcccattgggagctgttgggtagagcaagagcgattgatactcaaagttttgtggttatgccagctcaacaaggtgaacatgatgtctatgctgatgagaaaccatctgatgaatcagcagtaaaaagaatctcttggggtcattctatgattattgatccgtggggtaggattttgtctgctgcagatctaaccacgcatgatccccagctcataatcgctgatctcgatattgaagcacaagataagattagaagagatatgccgttgtgggcccagcgtaggagagatatctttggagactttgtctga

SEQ ID NO: 72672 - protein, 302 aa, Kluyveromyces lactis NRRL Y-1140
MNVARIGIGQLCSSSNLKQNLEVVKSLIKKALDQDVKVLFFPEATDYLSRNAEHSKKLASQTPEFISELQSAICQLTKAAGKPIDISIGIHMPPSEVNTKNGDSRVKNVLLYINSNGEILQKYQKLHLFDVDVPNGPILKESNSVQPGSEIPSIINTPVGKLGSCICYDIRFPELSLKLRSKGAQILCFPSAFTMKTGEAHWELLGRARAIDTQSFVVMPAQQGEHDVYADEKPSDESAVKRISWGHSMIIDPWGRILSAADLTTHDPQLIIADLDIEAQDKIRRDMPLWAQRRRDIFGDFV

SEQ ID NO: 72673 - DNA, 939 bp, Debaryomyces hansenii CBS767
  CDS (1)..(939)
atgtcaaatacggttagagttgcatgtgggcagttatgctcgtcatccaatttgctgtcgaatgcaaatatcgttaaaaagttaatccgcaaggcagtgacagccaaggcaaaggtattgttcttaccagaagccaccgattacatagccaaagatgctattcagtcgatgcaactagcacagtcgagccacgagaagtttatctctgatatacaaagggaattgaaggaggtgtatgcggataatggtgacggactctttgttgcggtaggagtccatgaaccgtcgagcagtacaggagtaaatgctaaggaaattttgaacaaggtgctgaataatcaactttggattggtaacagaggtgaaatattacacagataccaaaaattgcatcttttcgacatcaatattgaaaatgggcccatcttgaaagagtcgaactcggtggaaccgggaagtagtgttttgaagccatttccaatcaacacgtcaagtttatcggagttcctaatagggtttgccacatgttacgatattaggttccctgaattgggcttgcgcttgagaagtttaggggctaacattattacgtatccgtctgcgttcaccaccaaaacgggccaggcccattgggagctattggccagggcgagagctgtagacacacaatgctacgtggtaatggcagcgcaatgtggtgaacacgacacggggggcgacaaaaaaaggatcagctacggtaactcgattatcattgatccttggggcaataagataagtgagtgtcacaaatataacgaagatttggtagtggattccgagggcgattactacgaaatgtgtgtggctgatctcgacttggatatggtcgagaagactagaagagatatgccgttgatgacccatagaagacccgatgtatttggaaacgaagtatag

SEQ ID NO: 72674 - protein, 312 aa, Debaryomyces hansenii CBS767
MSNTVRVACGQLCSSSNLLSNANIVKKLIRKAVTAKAKVLFLPEATDYIAKDAIQSMQLAQSSHEKFISDIQRELKEVYADNGDGLFVAVGVHEPSSSTGVNAKEILNKVLNNQLWIGNRGEILHRYQKLHLFDINIENGPILKESNSVEPGSSVLKPFPINTSSLSEFLIGFATCYDIRFPELGLRLRSLGANIITYPSAFTTKTGQAHWELLARARAVDTQCYVVMAAQCGEHDTGGDKKRISYGNSIIIDPWGNKISECHKYNEDLVVDSEGDYYEMCVADLDLDMVEKTRRDMPLMTHRRPDVFGNEV

SEQ ID NO: 72675 - DNA, 861 bp, Yarrowia lipolytica CLIB122
  CDS (1)..(861)
atgtctctcaagcagtctctgaaagtcgcactgatccagtttgccgccggagccgacaaggcggctaacattgccaaggtgaccaccaaggtggcggaggcggcgaaaaacggagccaagctggtggtcctccccgaatgcttcaactcgccctacgccgtgtcggccttccccaaatacgccgagaagatcccggatggcgaaaccacctcggctctgtcggatctggccaagaaacacaacctattcctggtaggaggctcatacccggagtccgacgctggcaaggtctacaacacgtcggtggccttctctccctccggcgacattatcagcaagcaccgaaaactgcacctgttcgacattgacgtgcccggaaaaatcaccttcaaggaaagcgagaccctgaccggtggcgacaaaatcaccctgttcgatatggagggctacggcaagatcggcctgggcatctgctacgatatccggttccccgaggtggcggccaccgccgctcgaaagggcgcctttgccatgatctaccccggcgctttcaataccaccaccggcccgctgcactggcatctgcttgcccgagcccgagccgtcgacaaccagctgtacgtcattgcgtgctcccccgcccaggacctcaactcgggctaccacgcctttggccactcgcttgtgtccgatcctctgggcaagattattgccgaggccgacgtcgacgagaccgtggtttacgctgagcttgagcctgaagagttggcggcagctcgacagaacatccctgttggtactcagcgacggttcgatgcctacgatgatgtgagcaagaccgccaaggtgagtgctgtttaa

SEQ ID NO: 72676 - protein, 286 aa, Yarrowia lipolytica CLIB122
MSLKQSLKVALIQFAAGADKAANIAKVTTKVAEAAKNGAKLVVLPECFNSPYAVSAFPKYAEKIPDGETTSALSDLAKKHNLFLVGGSYPESDAGKVYNTSVAFSPSGDIISKHRKLHLFDIDVPGKITFKESETLTGGDKITLFDMEGYGKIGLGICYDIRFPEVAATAARKGAFAMIYPGAFNTTTGPLHWHLLARARAVDNQLYVIACSPAQDLNSGYHAFGHSLVSDPLGKIIAEADVDETVVYAELEPEELAAARQNIPVGTQRRFDAYDDVSKTAKVSAV

SEQ ID NO: 72677 - DNA, 870 bp, Yarrowia lipolytica CLIB122
  CDS (1)..(870)
atgactctcgcagcagtcggccaattttgtgcaaccaattcacttactcacaatgcctctattgttgcaggactagtccatagagcagcagccctgggcgcccaggctctgttcctccctgaagcctccgactacatttctggctcgcctaaggaagggttgagtcttgcacgaaatgctgaaaattcgcccatgatcgcagcaatcagggaggctcaaaaggaaatcaaacagagcggaatgtctggaattgaggtctcagtaggagttcatgagctgtcctcttcttctgaccgggtcagaaacaccctattgtggcttgattccaacggagacattgtcaacagataccaaaaagtgcatctcttcgacgtggaggtgcccaacggtcctattctgcaggaatcaaagtcagtagagcccgggtctgaacttcccaagccgttcgagaccccagtgggaacagttggacctgctatttgttatgatatccggtttcctgagctggcattgttgttgagaaagcaaggcgcccagattctgcaatttccctcggcgtttacagtcagaactggcgccgcccactggcacgttcttgcccgagctcgtgctatcgatacccaatgctatgtcatgatgccagcgctggttggaaaacacacagaggacggcaagcgagaaagctacggacacgccatgataattgacccctggggaactgttcttgccgaggccagcgacatagactcttcggctgcagttattgttgccgatatcaacctagagcagctgaagaaggtcaggaccaatatgcctctgtgggaccagagacgaaatgatgtgtatagcttgcttgaggtgaagaaatag

SEQ ID NO: 72678 - protein, 289 aa, Yarrowia lipolytica CLIB122
MTLAAVGQFCATNSLTHNASIVAGLVHRAAALGAQALFLPEASDYISGSPKEGLSLARNAENSPMIAAIREAQKEIKQSGMSGIEVSVGVHELSSSSDRVRNTLLWLDSNGDIVNRYQKVHLFDVEVPNGPILQESKSVEPGSELPKPFETPVGTVGPAICYDIRFPELALLLRKQGAQILQFPSAFTVRTGAAHWHVLARARAIDTQCYVMMPALVGKHTEDGKRESYGHAMIIDPWGTVLAEASDIDSSAAVIVADINLEQLKKVRTNMPLWDQRRNDVYSLLEVKK

SEQ ID NO: 72679 - DNA, 600 bp, Aspergillus nidulans FGSC A4
  CDS (1)..(600)
atggctatcgcagctctattcctacccgaggcagcggactacatagggtcgtccccagcagagacgatatcgcttgctcgtcccgtacaagaaagtgaatttgttcttggtctccaaagtgaggctcgagataacaatctgcatataaacgtcggaattcatgagcctgcagcaaacggaagggtgaagaatacgctcatctggattgacgacaagggctatatcacgcagcggtatcagaagctacgcttccctgagatcagcttagcattaagacgccagaatgctcagatcattacctatccatcagcatttacggtccccacaggcagagcacattgggaaacgcttctccgggccagggctatcgaaacacagtcctatgtaatagccgctgcgcaagcaggtcctcataatgagaaaagacagagctatggccactcgatgattgtgaacccctggggagagatcatggctaagcttggcgacgagtatgaagagccacagatcgtcgttgcgaatattgatctggagcttctgggaaaggtcagaacagagatgccgctgcttagaaggacagatatataccctgagatatag

SEQ ID NO: 72680 - protein, 199 aa, Aspergillus nidulans FGSC A4
MAIAALFLPEAADYIGSSPAETISLARPVQESEFVLGLQSEARDNNLHINVGIHEPAANGRVKNTLIWIDDKGYITQRYQKLRFPEISLALRRQNAQIITYPSAFTVPTGRAHWETLLRARAIETQSYVIAAAQAGPHNEKRQSYGHSMIVNPWGEIMAKLGDEYEEPQIVVANIDLELLGKVRTEMPLLRRTDIYPEI

SEQ ID NO: 72681 - DNA, 1269 bp, Aspergillus nidulans FGSC A4
  CDS (1)..(1269)
atgaccgccttactgaagaagcccctcaaacttgccttggtgcagcttgcatcaggcgcagacaaagccgctaatcttgcccacgcccgtacgaaggtcctcgaggctgcaaaggccggtgcctccttgattgtccttcccgagtgctttaactccccatacggcactcaatattttccaaaatatgccgaaactcttcttccgtctcctccaacaaaggaacagtctccgtcctatcacgccttatcagctctcgccgctgaggccaaggcgtacctcgtaggaggcagcatcccggagcttgaaaccacatccaagaaatattacaatacgtcgctggtattctcaccgtccggcgcgctcattggaacccaccgcaagacccacctgtttgacatcgatattcccgggaagattacattcaaggagagcgaagttctgtcgcctggaaatcaactgactattgtggacctacctgactacggcaaaatcggtctcgccatctgctatgacatccgtttcccagagcccggcatgactgctgctcgcaagggtgcattcgcactgatctatcctggtgctttcaacacgactactggtcctttgcactggcagttactcgctcgcgcccgcgcagttgacaaccaggtgtatgtggcattgtgcagccccgcacgggacacaactgccacctaccatgcctacggccatagtctggtggcagatcccagtgcgaagattctgtcagaggcagaagagtcggagactatcgtctacgccgatctcgaccccgagacgattgaaagtacgcgaaagggtatccccatctacacccaacggcggttcgacttgtacccggactcgacaacttcagccaaccacagccgaacacccttcaatatgtccaacgttcagaccggcaagaagcagcgttcggctatcgccgacgtggtgacccgcgagtacaccattaacctgcacaagaggacgcacggtgtttccttcaagaagcgtgctcctcgcgctatcaaggagatccgcgctttcgctactcgcgccatgggcaccaccgacgtccgcctcgacccccagctcaacaagaaggtctgggaagccggtatcaagggcgttcctttccgcctccgtgtccgcatctctcgcaagcgtaacgacgaggagggtgctaaggagaagctctactcctacgtccaggccgtcaacgttaaggagcccaagggtctccagaccaccgttgtcgatgaggagtaa

SEQ ID NO: 72682 - protein, 422 aa, Aspergillus nidulans FGSC A4
MTALLKKPLKLALVQLASGADKAANLAHARTKVLEAAKAGASLIVLPECFNSPYGTQYFPKYAETLLPSPPTKEQSPSYHALSALAAEAKAYLVGGSIPELETTSKKYYNTSLVFSPSGALIGTHRKTHLFDIDIPGKITFKESEVLSPGNQLTIVDLPDYGKIGLAICYDIRFPEPGMTAARKGAFALIYPGAFNTTTGPLHWQLLARARAVDNQVYVALCSPARDTTATYHAYGHSLVADPSAKILSEAEESETIVYADLDPETIESTRKGIPIYTQRRFDLYPDSTTSANHSRTPFNMSNVQTGKKQRSAIADVVTREYTINLHKRTHGVSFKKRAPRAIKEIRAFATRAMGTTDVRLDPQLNKKVWEAGIKGVPFRLRVRISRKRNDEEGAKEKLYSYVQAVNVKEPKGLQTTVVDEE

SEQ ID NO: 72683 - DNA, 906 bp, Candida albicans SC5314
  CDS (1)..(906): transl_table=12
atgtcgaaccaagtattaaaatctccattatccaaatcaattaaaattgcactcattcaattaaaagcaggtgcagataaagcagcaaatttgaccaaagtaaccaaatttattgatgatgcagttaccaaatccacaggagtaaatttggtcatgttaccagaatgttttaattcaccttatgctgtagaccaatttagaaattatgctgaagacatcccccagggagaaactactcaattgttgtcaagtttggcacaaaaatataaaatatacattatagggggctcgattccagagaaaggcgagaatgataaaatttacaatacatcgttgactttcaatcctcaaggtgaaatcattgcaaaacaccgcaaagctcatttgtttgatatagatatacctaatggtattactttccaagaatcattaactttatccggcggggacaaagctacggttttcaaattgggagaatatggtaatgtaggtttagggatttgctatgatatcagatttccagaattagcttcgatagcatcgcgttacccatacaactcgtttgctatgttttaccctggtgcatttaacacaaccaccggtccattgcattggcatctattagctcgtgctcgtgccgttgataatgaaacttttgtagttttatgttcacctgctagagacgttgaaggaggtggctaccaagcttacggacactcattagttgctgatccatttggtaatatcattgccgaagctggagaaggagaagaaatattgtatgccgaattggacccggctttgttgcccaaagccagagatgggattccagtacactatcaaagaagatttgacatctatggtgattttgttggtgagggaaaggcaaaagtaagtgacaagtag

SEQ ID NO: 72684 - protein, 301 aa, Candida albicans SC5314
MSNQVLKSPLSKSIKIALIQLKAGADKAANLTKVTKFIDDAVTKSTGVNLVMLPECFNSPYAVDQFRNYAEDIPQGETTQLLSSLAQKYKIYIIGGSIPEKGENDKIYNTSLTFNPQGEIIAKHRKAHLFDIDIPNGITFQESLTLSGGDKATVFKLGEYGNVGLGICYDIRFPELASIASRYPYNSFAMFYPGAFNTTTGPLHWHLLARARAVDNETFVVLCSPARDVEGGGYQAYGHSLVADPFGNIIAEAGEGEEILYAELDPALLPKARDGIPVHYQRRFDIYGDFVGEGKAKVSDK

SEQ ID NO: 72685 - DNA, 900 bp, Candida albicans SC5314
  CDS (1)..(900): transl_table=12
atgctgtctttgaaaattgcagtgggtcagctttgctcatcatccaatctttcccagaatcttcgtgttgtgaagaaattgttacaaaaagctcaattagaaaaagctcgtctactttttctaccagaagcaaccgactatatttctagaaatgccaaccattcaattgagttatcccaagaggttcaaagcaatttcttatctccattgttggattatgtcaagtctttaaatgggtcgacctacttatcaattggaatacatttgccagggaaaaagagagttcgaaatgtacatgttttgattgaccccaaaggtgccatagtttccgaataccaaaaagtgcatctatttgacgttgacgtgccaaatggaccaatattgaaagagctgaattctgttgagccaggaaacaagattgaggatcccatccccatcgatgattttaaactagggttgggtatttgctacgacattagattccctgaattggctttgaggctcaggagattggggagtgatatcattacatttcctagtgcatttacaactcgtacaggggaagcccattgggagttgttatccaaagctagagccatcgactctcaatgctttgtcattaatgcagctcaatgtggacaacaccaggttggaacagaccctaatgatttatcaaaagtaataaaaagaataagttatggtgattccataatcgtcgacccatggggtgaagttttagcacgaggggaaaagtacactgacgagttgaaacatgacgacgatggtgactattatgaattgatccaagcagaattgaaactagatgattcagaatcaatcagaaaaaacatgccattattagatcatcgaaggccagacgtttttgggtacgagatatag

SEQ ID NO: 72686 - protein, 299 aa, Candida albicans SC5314
MSSLKIAVGQLCSSSNLSQNLRVVKKLLQKAQLEKARLLFLPEATDYISRNANHSIELSQEVQSNFLSPLLDYVKSLNGSTYLSIGIHLPGKKRVRNVHVLIDPKGAIVSEYQKVHLFDVDVPNGPILKESNSVEPGNKIEDPIPIDDFKLGLGICYDIRFPELALRLRRLGSDIITFPSAFTTRTGEAHWELLSKARAIDSQCFVINAAQCGQHQVGTDPNDLSKVIKRISYGDSIIVDPWGEVLARGEKYTDELKHDDDGDYYELIQAELKLDDSESIRKNMPLLDHRRPDVFGYEI

SEQ ID NO: 72687 - DNA, 1059 bp, Ustilago maydis 521
  CDS (1)..(1059)
atggacttttgcggagacagccacaaccagcatttgtcagacggggcctggtatcggctgcagcatccgtgcgctttgctgtcctccttttcacaccttgtctatcctattcctcatacacgctttcggatcacgcgggaatattacaaagcattgaagcttaactctcttctccgtcatattcgtgattcggtcaagttggcattggaggttaacttggtgaaacgttgcactactcaacgggaacttgggcacttgcgaaagtcagcctgtcgcataacaaattggcacgaacgtaaatccatcatggtcgtagcagcagtagctcaactcaaatccacatctgtgattgcggacaacctagccgcttcagtgtctcttatacgatcagctgcactggcaggcgccaaagcgatctttctaccggaagccactgactttatcgcacccacagcgcaggttgcatcgctcactcgatcgcgtgacaacctcgacttcattcgaggcatccagaccgctgcgcgcgaagcatccatctgggtctcggtcggcatccacgagccgccctcttgccaacaagacgaaattgattctcgcgatactaagggtcgactgcgatgctacaatactcaattgttgatcgatcattcaggcgaaattctggatcgctatcgaaaactgcatctctttgacgttgacatcaagggaggacttaaaatcttggaaagcgattctacgatcaagggggaccgactcttgacgccgagacagacgccatttggaaaactaggcatgttgacatgctacgatttgaggtttcctgaaccgtccttgtccttgaggcggcaaggtgcgcaggtcttgacctacccctcggcatttacagtaagaacaggcgctgcgcactgggaggtcttgttgagagcgagggcgatcgaaactcagagctacgtgctcgccgccgcccaggtgggcgctcatgatggtacaaaaagggtttcgtggggtcatgccatgatcgttgatccctgggggtccgtggttgcccaatgcccgtaa

SEQ ID NO: 72688 - protein, 352 aa, Ustilago maydis 521
MDFCGDSHNQHLSDGAWYRLQHPCALLSSFSHLVYPIPHTRFRITREYYKALKLNSLLRHIRDSVKLALEVNLVKRCTTQRELGHLRKSACRITNWHERKSIMVVAAVAQLKSTSVIADNLAASVSLIRSAALAGAKAIFLPEATDFIAPTAQVASLTRSRDNLDFIRGIQTAAREASIWVSVGIHEPPSCQQDEIDSRDTKGRLRCYNTQLLIDHSGEILDRYRKLHLFDVDIKGGLKILESDSTIKGDRLLTPRQTPFGKLGMLTCYDLRFPEPSLSLRRQGAQVLTYPSAFTVRTGAAHWEVLLRARAIETQSYVLAAAQVGAHDGTKRVSWGHAMIVDPWGSVVAQCP

SEQ ID NO: 72689 - DNA, 825 bp, Acinetobacter sp. ADP1
  CDS (1)..(825): transl_table=11
atgactttactctctgttgcccaaatgaactcgcaaaatgacattgaagtaaatttcggtgttgtagagcatctcattaaacagagtaaagctaaagatgcggagttgatcgtttttcctgaaaattttatctgttttgctgcaggtaaacagcgcgaaaccgctgcacagtttgaagtgattcaacagcgtcttgaaaaactggcgcatcaatataatatctggattattgcgggaactctcccttgcccgtttcgtccagatggatctatcatttctgatggacgtgtacgtaccgtgagcctatgtattactccagaaaagacagaagctcgttatgacaaaattcatttatttgatgtccaagtaggggatgctgttggtggctatcaggaatctaggttttttgagcctggggatcagattgttattgccaaaacgccttttggtaacattggcatgatggtttgctatgatttacgctttcctgaattggctttaaatttaagagcacaaggtgcaagaattttgactgcaccagcagcttttacttatacaacaggtcaaatgcactggcagcttttgctacaggcgcgtgccatggatagtcagtgtgtagtgcttggtgcagcacaacaaggctggcatggtgaaaagcgtcaaacatgggggcatactgcggctacaaatagtcgcggtcagctcttagagatggttcatgaagaaggtactgctttgattactgtaacatttgatcaaactgaacaagatcatgttcgtgaatcgatgccactgatgcaacatcgtcgtttacttaagctttaa

SEQ ID NO: 72690 - protein, 274 aa, Acinetobacter sp. ADP1
MTLLSVAQMNSQNDIEVNFGVVEHLIKQSKAKDAELIVFPENFICFAAGKQRETAAQFEVIQQRLEKLAHQYNIWIIAGTLPCPFRPDGSIISDGRVRTVSLCITPEKTEARYDKIHLFDVQVGDAVGGYQESRFFEPGDQIVIAKTPFGNIGMMVCYDLRFPELALNLRAQGARILTAPAAFTYTTGQMHWQLLLQARAMDSQCVVLGAAQQGWHGEKRQTWGHTAATNSRGQLLEMVHEEGTALITVTFDQTEQDHVRESMPLMQHRRLLKL

SEQ ID NO: 72691 - DNA, 798 bp, Erwinia carotovora subsp. atroseptica SCRI1043
  CDS (1)..(798): transl_table=11
atgaaagtcgcgctgggacaattcgctgttgaccgcaagtggcaacaaaacgccacgacaatcgctgaatttatgtcagcagcacagcaaaacggtgcagatctgctggtgctgccggagggcgtgctggctcgcgatatcaccaatcccaacatggtgctcaccgccgcccagccgcttgatggcccgtttatttcacatctgctggaagccagcaagggcagcaacctgacgaccatgctgtgtgtgcatatcccgaacggagaggggaaagtctggaatacgctgctggcgctgcgcaacggcgagatcatcgcccaataccgaaagctgcacttgtatgatgcattctccgtacaggaatcagaaaacgtactagcaggtgaagcgattccaccgctgttgaccatcgctgggttgaacgttgggctgatgacctgctatgacattcgcttccctgagcttgcacgccgtctggttctggacggcgcagacgtacttgtcctcccttccgcctggattaaagggccgctgaaagaagcgcattgggagctgctggtgcgcgcaagagcactggaaaacaccacttatctcgtcgccgttggcgaatgcggcgtcaagaatatcggcaacagtatggttgtcgatcctctgggcgttgtcgtggttcaagcaccggaaacacccgctcttatctatgccgacattgaaccagaacggctggcgtacgctcgtcaggctcttccggtactggctaatcgccgctttcaaaaacccacactggaaggggaaaactaa

SEQ ID NO: 72692 - protein, 265 aa, Erwinia carotovora subsp. atroseptica SCRI1043
MKVALGQFAVDRKWQQNATTIAEFMSAAQQNGADLLVLPEGVLARDITNPNMVLTAAQPLDGPFISHLLEASKGSNLTTMLCVHIPNGEGKVWNTLLALRNGEIIAQYRKLHLYDAFSVQESENVLAGEAIPPLLTIAGLNVGLMTCYDIRFPELARRLVLDGADVLVLPSAWIKGPLKEAHWELLVRARALENTTYLVAVGECGVKNIGNSMVVDPLGVVVVQAPETPALIYADIEPERLAYARQALPVLANRRFQKPTLEGEN

SEQ ID NO: 72693 - DNA, 798 bp, Erwinia carotovora subsp. atroseptica SCRI1043; identical to SEQ ID NO: 72691
  CDS (1)..(798): transl_table=11

SEQ ID NO: 72694 - protein, 265 aa, Erwinia carotovora subsp. atroseptica SCRI1043; identical to SEQ ID NO: 72692

SEQ ID NO: 72695 - DNA, 807 bp, Legionella pneumophila subsp. pneumophila str. Philadelphia 1
  CDS (1)..(807): transl_table=11
atgaatcgagtagcgcttgtgcaaatggtatcatctgccaaaatagcagataatttgcaactcactgaacaatatttaattgaagccagggcacaggaagccagtttggttgttctacctgagaattttgcttttatgggaatgaatgaacgagagaagttgcagattgccgaatattatggtcaaggacctatacaacaaagaataagtgagttagcgagagatttgcgggtatggataatagcaggaacaatcccgttaaaaagtatgggttcaaaggtaagagcaagttgtatagtttatgatgataaaggcctaaatgttgctcgttatgataaaattcatttatttgatgtcatagtttccgagcaggaaaaacaccaggaatcgttaactatagaagcaggaaaagatatagcgcttgtggatacgccagtggggaaaattgggttaaccatctgttatgacttgcgttttccggaattgtaccaatatttaacccaaagaggcgcacaattactttcagttccgtctgcttttactgcggtaactggagcggcgcattgggaggtcttactcagagcaagagcaatcgaaaatttatgttatgtcttagctcctaatcagggtgggactcatgaaaacgggcgtcatacttatgggcatagtatggtggtggaaccatggggtaaagtgttggcacaaaaagaagaagggcagggagtaattctggctgatattgatttagagagattgtcacagttgagaagacaatttccgtgtgttgaacatcatgttttaatgtaa

SEQ ID NO: 72696 - protein, 268 aa, Legionella pneumophila subsp. pneumophila str. Philadelphia 1
MNRVALVQMVSSAKIADNLQLTEQYLIEARAQEASLVVLPENFAFMGMNEREKLQIAEYYGQGPIQQRISELARDLRVWIIAGTIPLKSMGSKVRASCIVYDDKGLNVARYDKIHLFDVIVSEQEKHQESLTIEAGKDIALVDTPVGKIGLTICYDLRFPELYQYLTQRGAQLLSVPSAFTAVTGAAHWEVLLRARAIENLCYVLAPNQGGTHENGRHTYGHSMVVEPWGKVLAQKEEGQGVILADIDLERLSQLRRQFPCVEHHVLM

SEQ ID NO: 72697 - DNA, 828 bp, Burkholderia mallei ATCC 23344
  CDS (1)..(828): transl_table=11
atgaccgatcgccacgcctcagcctcgccgttcccggtcgccgcgctgcagatggtcagcacgcccgatcgcgagcgcaatctcgccgaagccggccggctgatcgccgatgcggcggcctcgggcgcacggctcgtgctgctgcccgaatatttctgcttcatgagccaccaggacaccgacaagctcgcgctcgcggaagcgtaccgtgacggcccgatccagcgctttctcgccgagcgcgcgaaggcgcacggcatctgggtgatcggcggcacgctgccgctgaaggcgcccgagccgtcgcgcgtgctgaacacgacgctcgtgttcgatccgcaaggccgcgaggccgcccgctacgacaagatccatctgttcaacttcgagaagggcgacgagtcgttcgacgaggcgcgcacgatccgcccgggcgacgcggtgcgcacgttcgacgcgccgttcggccgggtcgggctgtcggtctgctacgatctgcgctttccggagctgtaccggcgaatgggcgactgcgcgatgatcgtcgtgccgtcggcgttcacgtacacgacggggcgcgcgcactgggagacgctgttgcgcgcccgcgcggtcgagaaccagtgctacgtgctcgccgccgcgcaaggcggcaagcacgagaacggccgccgcacgtgggggcgcagcatgctcgtcgatccgtggggcgagatcgtcgcggtgcgcgacgaaggcgcgggcgtcgtcgcgggcgagatcgatcccgcgcggatcgccgacgtgcggcagagcctgcccgcgtggcggcatcgcgtgctcgcgtga

SEQ ID NO: 72698 - protein, 275 aa, Burkholderia mallei ATCC 23344
MTDRHASASPFPVAALQMVSTPDRERNLAEAGRLIADAAASGARLVLLPEYFCFMSHQDTDKLALAEAYRDGPIQRFLAERAKAHGIWVIGGTLPLKAPEPSRVLNTTLVFDPQGREAARYDKIHLFNFEKGDESFDEARTIRPGDAVRTFDAPFGRVGLSVCYDLRFPELYRRMGDCAMIVVPSAFTYTTGRAHWETLLRARAVENQCYVLAAAQGGKHENGRRTWGRSMLVDPWGEIVAVRDEGAGVVAGEIDPARIADVRQSLPAWRHRVLA

SEQ ID NO: 72699 - DNA, 828 bp, Burkholderia pseudomallei K96243
  CDS (1)..(828): transl_table=11
atgaccgatcgccacgcctcagcctcgccgttcccggtcgccgcgctgcagatggtcagcacgcccgatcgcgagcgcaatctcgccgaagccggccggctgatcgccgatgcggcggcctcgggcgcacggctcgtgctgctgcccgaatatttctgcttcatgggccaccaggacaccgacaagctcgcgctcgcggaagcgtaccgtgacggcccgatccagcgctttctcgccgagcgcgcgaaggcgcacggcatctgggtgatcggcggcacgctgccgctgaaggcgcccgagccgtcgcgcgtgctgaacacgacgctcgtgttcgatccgcaaggccgcgaggccgcccgctacgacaagatccacctgttcaacttcgagaagggcgacgagtcgttcgacgaggcgcgcacgatccgcccgggcgacgcggtgcgcacgttcgacgcgccgttcggccgggtcgggctgtcggtctgctacgatctgcgctttccggagctgtaccggcgaatgggcgactgcgcgatgatcgtcgtgccgtcggcgttcacgtacacgacggggcgcgcgcactgggagacgctgttgcgcgcccgcgcggtcgagaaccagtgctacgtgctcgccgccgcgcaaggcggcaagcacgagaacggccgccgcacgtgggggcgcagcatgctcgtcgatccgtggggcgagatcgtcgcggtgcgcgacgaaggcgcgggcgtcgtcgcgggcgagatcgatcccgcgcggatcgccgacgtgcggcagagcctgcccgcgtggcggcatcgcgtgctcgcgtga

SEQ ID NO: 72700 - protein, 275 aa, Burkholderia pseudomallei K96243
MTDRHASASPFPVAALQMVSTPDRERNLAEAGRLIADAAASGARLVLLPEYFCFMGHQDTDKLALAEAYRDGPIQRFLAERAKAHGIWVIGGTLPLKAPEPSRVLNTTLVFDPQGREAARYDKIHLFNFEKGDESFDEARTIRPGDAVRTFDAPFGRVGLSVCYDLRFPELYRRMGDCAMIVVPSAFTYTTGRAHWETLLRARAVENQCYVLAAAQGGKHENGRRTWGRSMLVDPWGEIVAVRDEGAGVVAGEIDPARIADVRQSLPAWRHRVLA

SEQ ID NO: 72701 - DNA, 822 bp, Methylococcus capsulatus str. Bath
  CDS (1)..(822): transl_table=11
atgaaaaaaatgatttgtgcagcggttcaaatggcttccggaccgcaagtcgggtcgaatctgctggaggccggccggctcgtcaagcaggccgcggaggccggcgccaggctggtggtgctgccggagaatttcgcgatcatgggcatgaccgaaaccgacaaactcggtgtggcggaaaccgacggcagcgggccgatccaggagtttctcgcgggcgcggccgagcgccacaaggtctggctggtcggcgggaccatgccgatgtgcgccggggacggccgggtgcgggcatcgtgcctggtctacgacgaccacgggagacgggtcggccgctacgacaagatacatctgttcgacgtcgtggtgccgggtaccgaggaaacctaccgcgaatccctgaccatcgaacccggcaccgtgccgctggtgctggattcgccgttcggcgcgctggggatagccatctgctacgatctccggttccctgaactgttccgccgcatggcgcaacaagggctggacctcctcgccgtgccggcggctttcaccgcccgcaccggggcggcgcactgggaaatcctggtgcgcgcgcgcgcggtcgaaaatctctgttataccgtggcatccaaccagggcggcttccacctgaacggacgggagaccttcggccatagcatggtggtcgatccctggggcaaggtgcttgcgtcgctgcccacgggcgccggcatcgtctgtgccgaaatcgaccgcgagcgtctggcgcaggtacgcgcctccttccccgtgctcgaacaccggcgcctgcattgcgcctga

SEQ ID NO: 72702 - protein, 273 aa, Methylococcus capsulatus str. Bath
MKKMICAAVQMASGPQVGSNLLEAGRLVKQAAEAGARLVVLPENFAIMGMTETDKLGVAETDGSGPIQEFLAGAAERHKVWLVGGTMPMCAGDGRVRASCLVYDDHGRRVGRYDKIHLFDVVVPGTEETYRESLTIEPGTVPLVLDSPFGALGIAICYDLRFPELFRRMAQQGLDLLAVPAAFTARTGAAHWEILVRARAVENLCYTVASNQGGFHLNGRETFGHSMVVDPWGKVLASLPTGAGIVCAEIDRERLAQVRASFPVLEHRRLHCA

SEQ ID NO: 72703 - DNA, 831 bp, Silicibacter pomeroyi DSS-3
  CDS (1)..(831): transl_table=11
atgaaaaccgcgctgctgcaactcacctcgtcggacgacccggcggccaatctggacatggttcggggcatggttgccgaggccgcggcacagggcgcccgctgggtgctgacacccgaggtgaccaattgtgtctcgaacagcaccacacgccagcgcgaggtgttgcagcacgaagaggacgacatcaccctggccgggctcagggcgcaggcgaccgagctgggcatctggctgctgatcggctcgctcgggctcaagacgcatgacgccgatgggcggtttgccaaccgctcgttcatgatcggaccggatggggggatcgtggcccgctatgacaagatccacatgttcgacgtgcaggtaaccgagaccgaaacctttcgcgaatcggccaattaccggcccggtgaccgggccgtgctggccccgaccgaattcggcaccgtgggcatgacgatctgctacgatctgcgctttccgcatctgcacgcggcgctggcacaggcgggggcgaccgtcctgaccgttccggcagccttttcgccggtgaccggtgccgcacattgggaatcgctgctcagggcgcgcgcgatcgagacgggctgctgggtattggccccggcacagaccggcacccacccaaacagccgcggcaaaccgcgccgcactcacggtcacagcctggtcgttgcgccctggggagaggtgcggatcgacgcaggcagcgaaccggggattcacatcttcgatctggatgatacatctgttacagaggcccggcgcagagtcccaagcttgactcacaaacgcgccttcgatggaccctga

SEQ ID NO: 72704 - protein, 276 aa, Silicibacter pomeroyi DSS-3
MKTALLQLTSSDDPAANLDMVRGMVAEAAAQGARWVLTPEVTNCVSNSTTRQREVLQHEEDDITLAGLRAQATELGIWLLIGSLGLKTHDADGRFANRSFMIGPDGGIVARYDKIHMFDVQVTETETFRESANYRPGDRAVLAPTEFGTVGMTICYDLRFPHLHAALAQAGATVLTVPAAFSPVTGAAHWESLLRARAIETGCWVLAPAQTGTHPNSRGKPRRTHGHSLVVAPWGEVRIDAGSEPGIHIFDLDDTSVTEARRRVPSLTHKRAFDGP

SEQ ID NO: 72705 - DNA, 846 bp, Pseudomonas syringae pv. syringae B728a
  CDS (1)..(846): transl_table=11
atgtccttcgcggtgattcagatggtcagccaaagcgatgtcctggccaatctggccagcgctcggcgtttgctggagcaggcagccgacggtggcgcgcggctggcggtgctgcccgaaaacttcgttgcgatggggcgccgtgacgtcgccgatatcgggcgtgccgaggcgcaggggcacggaccgatcctgccatggttgaaactggccgctcgcgacctcaagttatggattgttgccggaaccttgccactgccgccggatgagcggccggatggcaaggtgacggcgtgttcgctgttgatcgatgagcacggtgagcaggtggcccgttatgacaaactgcatctgttcgatgtggatgtcgctgacaaccgtggccgctatcgtgaatcggatgactatgctcatgggagcagggtggtggtagccgatacgccggtggggcgtctggggctgaccgtctgttatgacctgcgctttcccgagctgtacaccgcgctgcgtgaagccggtgctgaactgataaccgcgccgtcagccttcactgcggtaacgggggctgcgcactgggacattctgatccgcgcgcgagccatcgaaacccagtgttacgtgctggcggcggcacagggcggggtccatccggggcctcgcgagacttacggacacgcggccatcgttgatccatggggccgcgtactggccgagcaggcgcagggtgaagcggtgctgctggccacacgcgacagtgaagaacaggcgtccatacgggcgcggatgccggtgtccagtcaccggcgctttttttcgcaggacgccatgcggcctgcttcggagtga

SEQ ID NO: 72706 - protein, 281 aa, Pseudomonas syringae pv. syringae B728a
MSFAVIQMVSQSDVLANLASARRLLEQAADGGARLAVLPENFVAMGRRDVADIGRAEAQGHGPILPWLKLAARDLKLWIVAGTLPLPPDERPDGKVTACSLLIDEHGEQVARYDKLHLFDVDVADNRGRYRESDDYAHGSRVVVADTPVGRLGLTVCYDLRFPELYTALREAGAELITAPSAFTAVTGAAHWDILIRARAIETQCYVLAAAQGGVHPGPRETYGHAAIVDPWGRVLAEQAQGEAVLLATRDSEEQASIRARMPVSSHRRFFSQDAMRPASE

SEQ ID NO: 72707 - DNA, 840 bp, Pseudomonas fluorescens Pf-5
  CDS (1)..(840): transl_table=11
atgtctcttgcggtgattcaaatggtcagccagagcgatgtcctggccaatctgcagcaggctcggagcctgctcgaacaggctgctgccggcggtgcaaagctggccgtcctgccggaaaacttcgccgccatggggcgccgcgacatggcggccattggtcgcgccgaagcgctgggcgaaggtccgatcctgccatggttgaaacaggccgcccgcgacctcaggttatggatagtggccggcaccttgccgttgccccccgtcgatcagcccgaggccaagtccaatgcctgttcgttgctggtggatgaccaggggcagttcgtggcgcgctacgacaagctgcacctgttcgatgtcgatgtggcggacaatcgcggacgctaccgtgaatccgatgactatgctcatggagaccgggtggtggtggcggatactccggtggggagggtcggtcttacagtctgttatgacctgcgctttcccgagctgtacagcgagttgcgcgccgctggcgccgagttgatcaccgcgccttcggcgtttaccgcggtcaccggtgcggctcattgggaggtgctgattcgcgcccgtgccatcgagacccagtgctatgtgctggcggcggcccagggcggcgtgcatcccggcccgcgggaaacctacggccatgcggcgatcgtcgacccctgggggcggatagtggcgcaacaggatcaaggtcaaggcgtgctgctggccgagcgcgacagcagcgaacaggcgtccatccgggcgcggatgccggtgttcagtcaccggcgcattttctcgcaaggcgtgcaacggcttgcataa

SEQ ID NO: 72708 - protein, 279 aa, Pseudomonas fluorescens Pf-5
MSLAVIQMVSQSDVLANLQQARSLLEQAAAGGAKLAVLPENFAAMGRRDMAAIGRAEALGEGPILPWLKQAARDLRLWIVAGTLPLPPVDQPEAKSNACSLLVDDQGQFVARYDKLHLFDVDVADNRGRYRESDDYAHGDRVVVADTPVGRVGLTVCYDLRFPELYSELRAAGAELITAPSAFTAVTGAAHWEVLIRARAIETQCYVLAAAQGGVHPGPRETYGHAAIVDPWGRIVAQQDQGQGVLLAERDSSEQASIRARMPVFSHRRIFSQGVQRLA

SEQ ID NO: 72709 - DNA, 822 bp, Colwellia psychrerythraea 34H
  CDS (1)..(822): transl_table=11
atggttaaattgagtgcaatacagttatcatcagcagctaacgtcgaaacgaaccttgctaagatagctgagttgctatctaaaattactgctagccaagaggacgttcagcatttagtcgtactgcctgagtgttgcttgtattttggtagtaaagacagtgaacaattggatttggcaatagcatcagccacaggcaatgacctttgcttagcgcttggagagcttgccaaaaaatttaaagtttacttagttgctggcactatccctattttatcgacatcttcaactaaatttactaatagcagttgtgttttcaatcccgagggagagttgatagggcaatacgataaaattcatttattcgatgttaatgtcagcgatagcaccaagagctattgtgaatctcgctatactcaagcgggtaaagaaataagcatggttaataccgaattcgctaatattgggctatcagtttgcttcgatttgcggtttcccaatttgtttcagcaactatcgattgcgggcgctgacattattaccgtacctagtgcctttacaagagtaacgggcaaagcacattggcaaacattattgcaagcaagggctattgaaaatcaagtttatattgtagcagcagggcaagaaggcgttcatgaaaatggtcgcgaaacttgggggcattcaatgatcattaacccttggggcgaaattgaacaaagtattgaaacgggtgaaggttatatttcaatcgactatcactccgaagaattaacacgcatacgtcaaagcatgcctttgaactcgccgctgaataaataa

SEQ ID NO: 72710 - protein, 273 aa, Colwellia psychrerythraea 34H
MVKLSAIQLSSAANVETNLAKIAELLSKITASQEDVQHLVVLPECCLYFGSKDSEQLDLAIASATGNDLCLALGELAKKFKVYLVAGTIPILSTSSTKFTNSSCVFNPEGELIGQYDKIHLFDVNVSDSTKSYCESRYTQAGKEISMVNTEFANIGLSVCFDLRFPNLFQQLSIAGADIITVPSAFTRVTGKAHWQTLLQARAIENQVYIVAAGQEGVHENGRETWGHSMIINPWGEIEQSIETGEGYISIDYHSEELTRIRQSMPLNSPLNK

SEQ ID NO: 72711 - DNA, 846 bp, Pseudomonas syringae pv. phaseolicola 1448A
  CDS (1)..(846): transl_table=11
atgtcctttgctgtgattcagatggtcagccaaagcgatgtccaggctaatctggtcagcgctcgccgcttgctggagcaggcagccgaaggtggcgcgcggctcgcggtgctgcccgaaaactttgttgccatggggcggcgtgacgtggccgacatcggtcgtgccgaagctcatgggcatgggccgatcctgccatggttgaaactggccgctcgcgacctcaagttatggattgttgccggaaccttgccactgccgccggatgagcgacccgatggcaaggtgacggcgtgttcgttgctgatcgatgaacacggtgagcaggtggcccggtatgacaagctgcatctgtttgatgtggatgttgctgacaatcggggccgctaccgtgaatccgatgactatgctcacggaaacaatgtggtggtggccgatacacctgtagggcgcgtggggctgacagtctgttatgacttgcgctttcccgagctgtacaccgcgctgcgggaggccggtgctgaactgattaccgcgccgtcagcttttactgcggtaacgggtgctgcgcactgggacattctgatccgggcgcgcgccatcgaaacccagtgttacgtgctggcggcggcacagggcggggtccatccggggcctcgcgagacttacgggcacgcggccatcgttgatccatggggccgcgtactggccgagcaggcacagggtgaagccgtgctgctggccaagcgcgacagtgaagaacaggcgtccataagggcgcggatgccggtgtccagtcaccggcgctttttttcgcaggacgccatgcggcctgcttcggagtga

SEQ ID NO: 72712 - protein, 281 aa, Pseudomonas syringae pv. phaseolicola 1448A
MSFAVIQMVSQSDVQANLVSARRLLEQAAEGGARLAVLPENFVAMGRRDVADIGRAEAHGHGPILPWLKLAARDLKLWIVAGTLPLPPDERPDGKVTACSLLIDEHGEQVARYDKLHLFDVDVADNRGRYRESDDYAHGNNVVVADTPVGRVGLTVCYDLRFPELYTALREAGAELITAPSAFTAVTGAAHWDILIRARAIETQCYVLAAAQGGVHPGPRETYGHAAIVDPWGRVLAEQAQGEAVLLAKRDSEEQASIRARMPVSSHRRFFSQDAMRPASE

SEQ ID NO: 72713 - DNA, 825 bp, Prochlorococcus marinus str. NATL2A
  CDS (1)..(825): transl_table=11
gtgtcagattttttggctgcggccttacagctaacaagtacctcagacatagactcaaacctcaatgctgctgaagaacaaattgagttagcagcaaggcgtggggctgatcttgttggacttcctgaaaactttgcatttttgggtgaagatcagaaaaaattaaaaattgcatcttcaatatatgaaaaatgcaatagttttttagtaacaatggcaaggagatatcaagttgttttacttggaggtggtttccctgttccagctggagatggaataagaactttaaatagagccgagttgtttggaaaggacggtcaatctctagcaagatatgacaagattcatctttttgatgttgatctacctgaaggaaatacttatagggaatctgaaacaattgtttcaggaagtgaatctccaccagtagttgatgtgcctggtctttgcaaaattggattatctatttgttacgatgtgcgattccctgaactttatcgggatttggtaaataaaggcgcagatttattaatgattccagctgcttttacagcttttacgggaaaggatcattggcaagtcttgctccaagcaagagctattgaaaacactgcttatgttgttgcaccagcgcaaactggtcgtcactatggcagaagacaaagtcatgggcatgcgatggtaattgatccatgggggacagttttagcagatgcaggggttgttcaaggagcagcaatagctcctgctgataaagaaagagtagagagaattagaggacaaatgcccagcctgaaacatcgaaaaacagagctttttatttga

SEQ ID NO: 72714 - protein, 274 aa, Prochlorococcus marinus str. NATL2A
MSDFLAAALQLTSTSDIDSNLNAAEEQIELAARRGADLVGLPENFAFLGEDQKKLKIASSIYEKCNSFLVTMARRYQVVLLGGGFPVPAGDGIRTLNRAELFGKDGQSLARYDKIHLFDVDLPEGNTYRESETIVSGSESPPVVDVPGLCKIGLSICYDVRFPELYRDLVNKGADLLMIPAAFTAFTGKDHWQVLLQARAIENTAYVVAPAQTGRHYGRRQSHGHAMVIDPWGTVLADAGVVQGAAIAPADKERVERIRGQMPSLKHRKTELFI

SEQ ID NO: 72715 - DNA, 822 bp, Ralstonia eutropha JMP134
  CDS (1)..(822): transl_table=11
atgcaagcccctgccccgttccgtgttgccgccatccagaccgtgaccggcacgtcgctcgacgccaacctcgcacgtgctgaatcgctgattgccgaagccgcgcgcggcggcgcggaactggtgctgttgcccgaatacttctgcatgatgggccagcgcgaatccgacaagatcgccatccgcgaacaggacggcgacggccccgtgcaacggttcctggccgatgccgcgaagcgccaccgcgtctggctggtggggggtaccctgccgatgtggtgcggcgacgacgaccgcgtctacaacacgtcgctcgcgttcgacccgcgcggcgaacgcgtggcgcgctacgacaaaatccacctgttcggctttacgcgcggcgcggaaagctatgacgaatcgcgcaccatcctcgcgggcaacacgcccgtcagcttcgacgcgccatgtggacgcgtagcaatgtcggtgtgctacgacctgcgcttccctgaactctatcgcggtctggccggcggcgacggcgcgagcctgatcctgatgcccgccgccttcacctacaccaccggacaggcacactgggaaatcctgttgcgtgcgcgtgcgatcgaaaaccagtgctatgtgcttgccgcggcacagggcggcaagcacgagaatggccggcgtacctggggccattcgatgctggtcgacccatggggcgaagtgctggccatgctgcccgaaggcgaaggcgtggtcagcggcgtgatcgacccggcgcggctagccgaagtccgacagaacctgcccgcgctgcgacaccgggtgctgtag

SEQ ID NO: 72716 - protein, 273 aa, Ralstonia eutropha JMP134
MQAPAPFRVAAIQTVTGTSLDANLARAESLIAEAARGGAELVLLPEYFCMMGQRESDKIAIREQDGDGPVQRFLADAAKRHRVWLVGGTLPMWCGDDDRVYNTSLAFDPRGERVARYDKIHLFGFTRGAESYDESRTILAGNTPVSFDAPCGRVAMSVCYDLRFPELYRGLAGGDGASLILMPAAFTYTTGQAHWEILLRARAIENQCYVLAAAQGGKHENGRRTWGHSMLVDPWGEVLAMLPEGEGVVSGVIDPARLAEVRQNLPALRHRVL

SEQ ID NO: 72717 - DNA, 816 bp, Anabaena variabilis ATCC 29413
  CDS (1)..(816): transl_table=11
atgaagtcttatttagctgctgctattcaaatgaccagtgtgcctgatttacacaagaatttggcacaagcggaagaattaattgatctggcggtgcgtcggggtgctgagttagtgggtttgccagaaaatttttcttttatgggtgaagaacaggataaactggctcaagcagaagcgatcgctcgtgaaagtgagatttttattaaaacgatggcgcagcgctaccaagttactctgttaggtggtagtttccccgtaccggtgagtgatacaggtagagtctataacaccactattctcgtcagtcccagtggtgaagaacttgctcgctacaataaagtacacctttttgatgtcaatgttcctgatggtaacacataccgcgaatctagcactgttgtcgccggtcagcaattaccccctgtccatttctcagaaaatttaggcaatatcggcgtttctatttgttacgatgtccgcttcccagaactctaccgccatctctcagacaagggaacagatatcatttttatacctgctgctttcactgcttttacaggcaaagaccactggcaagtcttgctacaagccagggctattgaaaatacagcctatgtaattgcacctgctcaaacaggtaataactacggtcgccgcctcacccacggacacgctgtggttatcgatccctggggaacaattttagctgatgccggggacaaaccaggaattgcgatcgcagaaatcaatccttcacgcctagagcaagtccgccgccaaatgccttccttgcaacaccgtgtatttagttga

SEQ ID NO: 72718 - protein, 271 aa, Anabaena variabilis ATCC 29413
MKSYLAAAIQMTSVPDLHKNLAQAEELIDLAVRRGAELVGLPENFSFMGEEQDKLAQAEAIARESEIFIKTMAQRYQVTLLGGSFPVPVSDTGRVYNTTILVSPSGEELARYNKVHLFDVNVPDGNTYRESSTVVAGQQLPPVHFSENLGNIGVSICYDVRFPELYRHLSDKGTDIIFIPAAFTAFTGKDHWQVLLQARAIENTAYVIAPAQTGNNYGRRLTHGHAVVIDPWGTILADAGDKPGIAIAEINPSRLEQVRRQMPSLQHRVFS

SEQ ID NO: 72719 - DNA, 861 bp, Pseudomonas fluorescens PfO-1
  CDS (1)..(861): transl_table=11
atgtctttagcggtgattcaaatggtcagccagagcgatgtgctggccaatctgcgcgatgcccgacgtttgctcgaacacgcatctaacgccggtgcgaagctggcggtgctgccggaaaatttcgcggccatgggccgtcgcgacatcgccgatatcggccgcgccgaagcactcggcgaaggcccgattctgccgtggttgaaacagaccgcccgtgacctcaagttatggattgtggccggcaccttgccgttgccgccggtggggcagcctgaggccaagtcccatgcctgctcgctgctggtgaatgatcagggcgaaatcgttgcgcgctatgacaagttgcacctgttcgatgtcgacgtggcggacaatcgcggccgttaccgcgaatccgatgactatgcttatggcagtggcgtggtggtcgcggacaccccggtcgggcgactgggcctgacggtgtgctacgacctgcgtttcccggagctgtacagcgaattgcgcgcagccggggctgaactgattaccgcaccgtcggccttcaccgcggtgaccggtgcggcgcactgggatgtactgatccgcgcgcgggccattgaaacccagtgctacgtgctggcggccgctcagggcgggacgcatccggggccgcgggaaacctttgggcacggggcgattgtcgacccgtggggccgcgtgctggcacagcaggagcagggcgaagccgtactgctggccgagcgcgacagcaatgaacaagcgtccatccgggcgcgaatgccggtgacgggtcatcggcggtttttttcgcagggcgcacagcgacctgcttcagaacacgaatttaaggcgtaa

SEQ ID NO: 72720 - protein, 286 aa, Pseudomonas fluorescens PfO-1
MSLAVIQMVSQSDVLANLRDARRLLEHASNAGAKLAVLPENFAAMGRRDIADIGRAEALGEGPILPWLKQTARDLKLWIVAGTLPLPPVGQPEAKSHACSLLVNDQGEIVARYDKLHLFDVDVADNRGRYRESDDYAYGSGVVVADTPVGRLGLTVCYDLRFPELYSELRAAGAELITAPSAFTAVTGAAHWDVLIRARAIETQCYVLAAAQGGTHPGPRETFGHGAIVDPWGRVLAQQEQGEAVLLAERDSNEQASIRARMPVTGHRRFFSQGAQRPASEHEFKA

SEQ ID NO: 72721 - DNA, 804 bp, Rhodobacter sphaeroides 2.4.1
  CDS (1)..(804): transl_table=11
atgagagttagcttgatccagatgaattccgccgagaacaaggagcggaatctggacgtggcggaggagatgatccgcaaggcggtcggggtcgagaaacccgacctggtggtgctgccggaatatttcgccttcctcggcgaggggcgggaggcggtccacggcaatggcgaggccttcccggaggggccgacctaccggcgcttctcggcgctggcgtccgaactgggcgtgacgctgcatctgggctcgatggtcgagaaggccgggaacggccattacaacaccacgctcgtcttcggccccgacggcgccgagatcgcccgctaccgcaagatgcacctcttcgacatcgacgtgccgggcggcatgtcctaccgcgagtccgacacgatcagccgcggcgaggaggtcgtgacctaccgggtgggcgagaccacggtcggctgcgccatctgctacgacatccgcttcccggaactcttccgcgcgctgcgcgacaagggggcggaggtgatcgtgctgcccgcggccttcacgctgatgacgggcaaggatcactgggaggtgctggcgcgggcgcgcgccatcgagacccagacctatttcctcgccgtgggccagaccggctcgcatgccgaagggcgcaaatggtgctggggccatacgatggcgatcgacccctggggccatgtcgtggcccaatgttccgacggcgagggtctgacgaccgccgtcgtcgatcccgcccgtatcgaggccgtccgccgtgacgtgcccgtggcccagcaccacgttctctga

SEQ ID NO: 72722 - protein, 267 aa, Rhodobacter sphaeroides 2.4.1
MRVSLIQMNSAENKERNLDVAEEMIRKAVGVEKPDLVVLPEYFAFLGEGREAVHGNGEAFPEGPTYRRFSALASELGVTLHLGSMVEKAGNGHYNTTLVFGPDGAEIARYRKMHLFDIDVPGGMSYRESDTISRGEEVVTYRVGETTVGCAICYDIRFPELFRALRDKGAEVIVLPAAFTLMTGKDHWEVLARARAIETQTYFLAVGQTGSHAEGRKWCWGHTMAIDPWGHVVAQCSDGEGLTTAVVDPARIEAVRRDVPVAQHHVL

SEQ ID NO: 72723 - DNA, 828 bp, Burkholderia sp. 383
  CDS (1)..(828): transl_table=11
atgaccgaccacacccgttccgccacgcccttccaggtcgccgcgctgcagatggtgagcacgccggacgtcgcgcgcaatctcgccgaagcccgccgcctgatcgcggaagccgccggcgaaggcgcgcagctcgtgctgctgcccgagtatttctgcttcatgggccaccgcgacaccgacaagctcgcgctcgccgaaccctaccaggacggcccgatccagcacttcctcgcggacgccgcacgtcgccacggcatctgggtgatcggcggcacgctaccgttgaaggcgccggagcccgatcgcgtgctcaacacgacgctcgtgttcgatccgtccggcaacgaagccgcgcgctacgacaagatccacctgttcaacttcgagaaaggcgacgagtcgttcgacgaggcgcgcacgattcgcgcgggcgatacggtcgtcgcgttcgacgcgccgttcgggcgggtcggcctgtcggtctgttacgatctccgctttccggagctgtatcgcaggctgggtgactgcgcgctgatcgtcgtcccgtcggcgtttacgtatacgacgggccgcgcgcactgggaaacgctgttgcgcgcgcgggccgtcgagaaccagtgttacgtgctcgcggccgcgcaaggcggcaagcacgagaacggccggcgcacctggggccacagcatgctgatcgacccgtggggcgagatagtcgcggtccgcgacgtgggcgccagcgtcgtgctcggcgcgatcgatccgcagcgcatcgccgacgtgcgccagagcctgcccgcgtggcggcaccgcgtgctcacctga

SEQ ID NO: 72724 - protein, 275 aa, Burkholderia sp. 383
MTDHTRSATPFQVAALQMVSTPDVARNLAEARRLIAEAAGEGAQLVLLPEYFCFMGHRDTDKLALAEPYQDGPIQHFLADAARRHGIWVIGGTLPLKAPEPDRVLNTTLVFDPSGNEAARYDKIHLFNFEKGDESFDEARTIRAGDTVVAFDAPFGRVGLSVCYDLRFPELYRRLGDCALIVVPSAFTYTTGRAHWETLLRARAVENQCYVLAAAQGGKHENGRRTWGHSMLIDPWGEIVAVRDVGASVVLGAIDPQRIADVRQSLPAWRHRVLT

SEQ ID NO: 72725 - DNA, 828 bp, Synechococcus sp. CC9605
  CDS (1)..(828): transl_table=11
gtgcaagtgagcgacttcctggcggctgctgtccagctgacgagcggtcaggatccagagctcaacttcaatgcggctgaagagcagattgacctggctgcccgccgtggtgccgagctgatcggcctgccggagaatttcgccttcatgggtgaggacacccgccgcttggagttggccccgaccctggcggagcagaccagtcgctttctggtgaccatggcccgtcgctatcaggtggcgctgctcggcgggggctttcccgtgccggtgggtgatggatcgcgaactctgaaccgcgctgagctcgtcgaccgtgacggcatgctcctgggctgttacgacaaaattcacctctttgatgtcgatttgccggacggcaacacctatcgcgagtcggcaactgtgaacccaggtagggatttgcctccggtggttgagattcccggtctctgcaaggtgggactgtccatttgctacgacgtgcggtttcctgagctctatcgccatctcgtcggtgccggcgcagacctgctgatgatccctgcggcattcacagccttcaccggaaaagaccactggcaggtgcttctgcaggccagggccattgagaacacggcctatgtgctggctccggcccagaccggtgtgcatcacggtcgtcggcaaagccatggccacgccctggtgattgatccctggggcacggtccttgctgatgcaggtgtgcaggctggagctgccattgctccggtcaacacgagtcacctcggccatgttcggggtcagatgccgagccttcggcaccgccaacccgctcttttctga

SEQ ID NO: 72726 - protein, 275 aa, Synechococcus sp. CC9605
MQVSDFLAAAVQLTSGQDPELNFNAAEEQIDLAARRGAELIGLPENFAFMGEDTRRLELAPTLAEQTSRFLVTMARRYQVALLGGGFPVPVGDGSRTLNRAELVDRDGMLLGCYDKIHLFDVDLPDGNTYRESATVNPGRDLPPVVEIPGLCKVGLSICYDVRFPELYRHLVGAGADLLMIPAAFTAFTGKDHWQVLLQARAIENTAYVLAPAQTGVHHGRRQSHGHALVIDPWGTVLADAGVQAGAAIAPVNTSHLGHVRGQMPSLRHRQPALF

SEQ ID NO: 72727 - DNA, 828 bp, Prochlorococcus marinus str. MIT 9312
  CDS (1)..(828): transl_table=11
ttgactgattttttggtggctgcattgcaaattacaagcacttctaatgtagaagcaaattttgttgaagcggaggaacagattgaattagcagctcgaagaggtgctgagttaatcggattgcctgagaattttgcttttttaggagaagatgacgaaaaacttagattagctcctgaattgtcaatgaagtgtacaaacttcctaaaaactatgtcacagagatatcaagtttttctattgggaggaggatatcctgttccagctggtgatgatagacatactttaaatagatcagcactctttggaagagatggacaggttttggcaaaatatgacaaaatccatttgttcgatgttgatttgccagacggaaatttatataaggaatcatctactattttatctggggaggagtatccacctgttgtagatgtcccaggtttatgcaaaatagggttatcgatttgttacgacgttagattccctgaactttatagatatttgtcttctaatggtgcagagctaattatgattcccgcagcttttacagcatttactggaaaagatcattggcaaatcctattacaagcaagagcgattgagaatacagcatatgtagttgctccagcgcaaactggggttcattatggaagaaggcaaagtcatggccatgcaatggtaattgacccatggggcactgttttgtctgatgctgggaaaactcagggggccgcaatagcgcctgcggataaaaaaagagtaaagaagattagggagcagatgccaagccttaaacatagaaaaaataaattgttttcaaactaa

SEQ ID NO: 72728 - protein, 275 aa, Prochlorococcus marinus str. MIT 9312
MTDFLVAALQITSTSNVEANFVEAEEQIELAARRGAELIGLPENFAFLGEDDEKLRLAPELSMKCTNFLKTMSQRYQVFLLGGGYPVPAGDDRHTLNRSALFGRDGQVLAKYDKIHLFDVDLPDGNLYKESSTILSGEEYPPVVDVPGLCKIGLSICYDVRFPELYRYLSSNGAELIMIPAAFTAFTGKDHWQILLQARAIENTAYVVAPAQTGVHYGRRQSHGHAMVIDPWGTVLSDAGKTQGAAIAPADKKRVKKIREQMPSLKHRKNKLFSN

SEQ ID NO: 72729 - DNA, 831 bp, Synechococcus elongatus PCC 7942
  CDS (1)..(831): transl_table=11
atgaagtcttacttggccgcagctgtgcagatgaccagtctgccggatctcgaaaagaatctcactcaagcggaagaatggatcgacctagccgtgcggcggggtgctgagcttgttggtctgccagagaacttttcatttttaggggaagaggcccaaaaggttcagcaagcccctgagattgctgaacgcaccgaaaagttcctgaaaacgatggcccagcgctatcaaattacgttgttgggcgggggcttcccggttccagccgagcacaatcacgtcaccaacacactacttctcgttgggcctgatggtcagaccctagcccagtacaacaaggttcacctgttcgatgtcgacctcccggatggcaacacctatcaggagtcggcaacggttctcgctggtcgtgagtatccgcccgtctatgactcggaacgttttgggcgcttgggattttcgatttgctatgacgtccgcttcccggaactttatcgccatctagccaatcagtcggcagaagtgatttttgtgccagcggcattcactgcctttaccggcaaagatcactggcaggtactgctgcaggcccgagcgattgagaatacggcatatatcattgcgccggcacaaacgggtgttcattacggacgccgtcaaacccatggccacgccatgattgtcgatccgtgggggattgttttggccaatgcagggcgcgagcctggcctcgcgatcgctgaaatctcgcctcggcggctggctaccgtgcgccagcagatgccctgtctccaacaccgcgtcctttcaactacagtcccgagtgcataa

SEQ ID NO: 72730 - protein, 276 aa, Synechococcus elongatus PCC 7942
MKSYLAAAVQMTSLPDLEKNLTQAEEWIDLAVRRGAELVGLPENFSFLGEEAQKVQQAPEIAERTEKFLKTMAQRYQITLLGGGFPVPAEHNHVTNTLLLVGPDGQTLAQYNKVHLFDVDLPDGNTYQESATVLAGREYPPVYDSERFGRLGFSICYDVRFPELYRHLANQSAEVIFVPAAFTAFTGKDHWQVLLQARAIENTAYIIAPAQTGVHYGRRQTHGHAMIVDPWGIVLANAGREPGLAIAEISPRRLATVRQQMPCLQHRVLSTTVPSA

SEQ ID NO: 72731 - DNA, 828 bp, Burkholderia thailandensis E264
  CDS (1)..(828): transl_table=11
atgaccgatcgccatgcttcagcctcgccgttcccggttgccgcgctgcagatggtcagcacgcccgatcgcgagcgcaatctcgccgaagccggccggctgatcgccgacgcggcggatgcgggcgcgcggctcgtgctgctgcccgagtacttctgcttcatgggccaccaggacaccgacaagctcgcgctcgcggaagcctaccgggacggcccgatccagcgctttctcgccgagcgcgcgaaggcgcacggcgtctgggtgatcggcggcacgctgccgctctcggcgcccgagccgtcgcgcgtgctgaacacgacgctcgtgttcgatccgcaaggccgcgaggccgcccgctacgacaagatccacctgttcaacttcgagaagggcgacgaatcgttcgacgaggcgcgcacgatccgtccgggcgacgcggtgcgcacgttcgacgcgccgttcggccgggtcgggctgtcggtctgctacgatctgcgctttccggagctgtaccggcggatgggcgactgcgcgatgatcgtcgtgccgtcggcgttcacgtacacgacgggccgcgcgcactgggagacgctgctgcgcgcgcgcgcggtcgagaaccagtgctacgtgctcgccgccgcgcaaggcggcaagcacgagaacggccgccgcacgtggggccacagcatgctcgtcgacccgtggggcgaagtcgtcgcggtgcgcgacgaaggcgcgggcgtcgtcgcgggcgaaatcgatcccgcgcggatcgccgacgtgcggcagagcctgcccgcgtggcggcaccgcgtgctcgcgtga

SEQ ID NO: 72732 - protein, 275 aa, Burkholderia thailandensis E264
MTDRHASASPFPVAALQMVSTPDRERNLAEAGRLIADAADAGARLVLLPEYFCFMGHQDTDKLALAEAYRDGPIQRFLAERAKAHGVWVIGGTLPLSAPEPSRVLNTTLVFDPQGREAARYDKIHLFNFEKGDESFDEARTIRPGDAVRTFDAPFGRVGLSVCYDLRFPELYRRMGDCAMIVVPSAFTYTTGRAHWETLLRARAVENQCYVLAAAQGGKHENGRRTWGHSMLVDPWGEVVAVRDEGAGVVAGEIDPARIADVRQSLPAWRHRVLA

SEQ ID NO: 72733 - DNA, 858 bp, Methylobacillus flagellatus KT
  CDS (1)..(858): transl_table=11
atggccatcaaatcaagagaaaaagttgccaagagcaagaacaagaactccatccctggcattcaccgcattgccgccatccagatggcctcagggccctacgtcgcagccaatctgagcgaggcggagcgcctgatcgaaattgccgtcaacatgggggccaggttaatcgccttgccggaatactttgccatcatgggtctcaaggataccgacaaggtcgccgtccgggaaaaggaaggcagcggccccatccagcgctttctttcgaagacggccaagaaacaccaggtctggatcatcggcggctcggtaccgctggaatgcgggaacccggataaggtgcgcaacacctgcctggttttcgacgacaggggcaaacaagtggcacgctacgataaaatccacctgttcggattcgagaaaggcgacgagcattaccaggaaaagaaaaccatagagcctggaaacaaggtagtgaccgtagacacgccttttggcaagctcgggctttccatttgttatgacctgcgctttcccgagctataccgcgccatgggggaagtcgacatcattgccgtgccatcggcctttaccgagacgacaggcaaagcgcattgggaaacgttggtgcgggcgcgtgcaatcgagaacctctgctacgtcattgcaccaggccagggcggttatcatgcatccgggcgtgagacacatggcaacagcatgatcgtggatccgtggggcgtcgtgcaggacaggctgccgcgcggctcaggcatcgtgatttcctccatcaataccgcctacctgaaaagtctgcgcaagagcctgccagcattaaaacaccgcaagctttga

SEQ ID NO: 72734 - protein, 285 aa, Methylobacillus flagellatus KT
MAIKSREKVAKSKNKNSIPGIHRIAAIQMASGPYVAANLSEAERLIEIAVNMGARLIALPEYFAIMGLKDTDKVAVREKEGSGPIQRFLSKTAKKHQVWIIGGSVPLECGNPDKVRNTCLVFDDRGKQVARYDKIHLFGFEKGDEHYQEKKTIEPGNKVVTVDTPFGKLGLSICYDLRFPELYRAMGEVDIIAVPSAFTETTGKAHWETLVRARAIENLCYVIAPGQGGYHASGRETHGNSMIVDPWGVVQDRLPRGSGIVISSINTAYLKSLRKSLPALKHRKL

SEQ ID NO: 72735 - DNA, 825 bp, Burkholderia xenovorans LB400
  CDS (1)..(825): transl_table=11
gtgtccagcggttccctggaaagcgccttccgtgtcgccgcgctgcaaatggtgagcacaccggatcgcgagcgcaatctcgccgaagccgggcgtctgatcgccgaggccgccgccgaaggcgcgcaactcgtcctgctgcctgagtacttctgcttcatgggcttcaaggacacggacaagctcgccgtgcgcgaaccctatcaggacggaccgatccagcgctttctcgccgacgccgcgcgccgccaccagatctgggtgatcggcggcacgctgccgttgatgtcgcctgaagcctcgcgcgtgctgaacaccacgctggtgttcgacccgcagggcaacgaggccgcgcgctacgacaagatccacctgttcaacttcgaaaagggcgcggaatcgttcgacgaagcgcgcaccatctgccccggcggcgaagtgcgcagcttcgaggcgccgttcggccgcgtgggtctgtcggtctgctacgatctgcgctttccggagctgtaccggcgcatgggcgactgcgcgctgatcgtggtgccgtcggcgttcacttacacgaccggccgcgcgcattgggaaatgctgctgcgcgcgcgggcggtcgaaaaccagtgttacgtgctggccgcggcgcaaggcggcaaacatgaaaatggccgccgtacgtggggccacagcatgctgatcgacccgtggggcgaaatcgtcgcgctgcgcgacgagggcgcaggcgtggtcgccggcaatctcgagcgtgcgcgcatcgacgaagtgcgacagagtctgcccgcctggcgtcatcgtgtgctcagttga

SEQ ID NO: 72736 - protein, 274 aa, Burkholderia xenovorans LB400
MSSGSLESAFRVAALQMVSTPDRERNLAEAGRLIAEAAAEGAQLVLLPEYFCFMGFKDTDKLAVREPYQDGPIQRFLADAARRHQIWVIGGTLPLMSPEASRVLNTTLVFDPQGNEAARYDKIHLFNFEKGAESFDEARTICPGGEVRSFEAPFGRVGLSVCYDLRFPELYRRMGDCALIVVPSAFTYTTGRAHWEMLLRARAVENQCYVLAAAQGGKHENGRRTWGHSMLIDPWGEIVALRDEGAGVVAGNLERARIDEVRQSLPAWRHRVLS

SEQ ID NO: 72737 - DNA, 837 bp, Ralstonia metallidurans CH34
  CDS (1)..(837): transl_table=11
atgatgcggataaaagtcgctgccatccagatcgacagccggcaggaccgcgaggctaacctggcggcactcgaacactggattcttgccgccgcgtcggacggcgcgaaactgatcgttacgccggagtacagcgatgtccgcggcgatgccaacgcgctacaggcggccgccagcgcggttccgggcccggtctccgagcacatctcctcgctggcgcaacgcaccggttgctggattcatctgggctcgatgcatgaacgcctgccaggcgagacccgcctcggcaatagcggcatcacgttcgcgccagatggtggcattgccgcacgctatcgcaaggtgcacctgtacgacgccgtggtgaatggcaaaccctatcgcgagtcagccgacttcgcgccgggggacggcctgcataccgtggacgctgccggcctgaccctgggtctgagcatctgctacgacctgcgcttcggcgagctgtaccggaccctgcgcgcacgcggcgccaacgtgctgctggtgcccgccgcttttaacgtgcacaccggacgcgaccactgggagacgctgctgcgggcccgtgccatcgaaaaccagtgctacgtgattgccgccgcgcagatcggcggcccgggacccgccctgccctgcctggggcgcagcatgatcattgacccctggggcaccgtgctggcctgtatgccggacaccaccggcttcatcaccgccgaactcgatacagagcgcgtggccggcctgcgcgaggcgcttccggcatgggagcatcgacgcacggatctgtacttcggcggcattcagaactcaggctga

SEQ ID NO: 72738 - protein, 278 aa, Ralstonia metallidurans CH34
MMRIKVAAIQIDSRQDREANLAALEHWILAAASDGAKLIVTPEYSDVRGDANALQAAASAVPGPVSEHISSLAQRTGCWIHLGSMHERLPGETRLGNSGITFAPDGGIAARYRKVHLYDAVVNGKPYRESADFAPGDGLHTVDAAGLTLGLSICYDLRFGELYRTLRARGANVLLVPAAFNVHTGRDHWETLLRARAIENQCYVIAAAQIGGPGPALPCLGRSMIIDPWGTVLACMPDTTGFITAELDTERVAGLREALPAWEHRRTDLYFGGIQNSG

SEQ ID NO: 72739 - DNA, 834 bp, Silicibacter sp. TM1040
  CDS (1)..(834): transl_table=11
atggttcggattgcgctcctgcagatgacgtcttccgacttgccggaagagaaccttgcagcggcgcgcgaaatgatcgcgcgcacggccgctgcaggggcgcagtttgtgttgacgccagaggtcaccaattgcctctcgaccagccggacacagcaacaggctgttttgcatcccgaagagaacgaccccacccttgccggtctgcgtgatgcggctcggcagcatggggtttggctgtcgatcggctctcttggggtgaaaaccaccgatgcggacggccggtttgccaaccggcagtttctgatttcccccgatggcgagatcaaggcgcgctatgacaagatccacatgtttgatgtggaggtcacgcctgaagagacctatcgcgaatccgatggctaccgccctggaacccgcgccgtgcttgcggacgctggatttgcaaagatcggtatgacgatctgttacgatgtgcgctttcctgcgttgcatcgtcgtcttgcccaagccggggcagaaatcatcacggcgccggctgccttcagtcatgtgacgggagcagcgcattggcacagcctcctgcgggcgcgggcgattgaaaccgggtgtttcgtgcttgccgctgcgcagacgggggttcacgacaccagtcgtggcgctgcccgccagacctatgggcattcgcttgccgttgccccttggggcgagattttggcggatgctggcaccgaaactggaattacctgcgttgacctcgatctcgaagcggtgaaaaaggcgcgcaaacgcgtcccgtctctgacgcacgaccgggagtttgacggaccctga

SEQ ID NO: 72740 - protein, 277 aa, Silicibacter sp. TM1040
MVRIALLQMTSSDLPEENLAAAREMIARTAAAGAQFVLTPEVTNCLSTSRTQQQAVLHPEENDPTLAGLRDAARQHGVWLSIGSLGVKTTDADGRFANRQFLISPDGEIKARYDKIHMFDVEVTPEETYRESDGYRPGTRAVLADAGFAKIGMTICYDVRFPALHRRLAQAGAEIITAPAAFSHVTGAAHWHSLLRARAIETGCFVLAAAQTGVHDTSRGAARQTYGHSLAVAPWGEILADAGTETGITCVDLDLEAVKKARKRVPSLTHDREFDGP

SEQ ID NO: 72741 - DNA, 804 bp, Myxococcus xanthus DK 1622
  CDS (1)..(804): transl_table=11
atgcacctcatcgccgccgcgcagatggtgtccaccgccgacaaggcccacaacctggaagccgcgacccggctcgtccggcgcgccgtcgcactgggtgcccggctggtgggcctccccgagaacttctcctggatggggccagagcccgagcggcaggacgccgccgaggggctcgacggtccgacgctgtcccagatggccagcctggcccgggagctgaaggtgacgctgctggccggcagcgtgctggagacgggcgcgccgggtgggcgcctctacaacaccagcgtcctcttcggccccggcggcgagcggctggccgtgtaccggaaaatccacctcttcgacgtcgaggtgggagatggtgcgacctatcaggagtccgcggcggtggcgccggggacggaggtggtctccgcggagacggaggtcggccggctggggctatccgtctgctacgacctgcgattccccgaactgtaccggcggctgtcccgcgaaggcgccacgctgctggcggtcccggcggccttcaccctcatgacgggcaaggaccactgggaagtgctcctgcgggcccgcgccatcgagaaccaggcgtacgtgctggcgcccgctcagggaggacggcactccgccaaccgcgtcacctatggccacgccctggtggtggacccgtggggcctggtgactgcgcgggcctccgagggagaggggctcgcgctggcgccggtggacccggagctgcaagcgcgcatccgacgcaacctcccctgcctggagcaccgccgtttgaactag

SEQ ID NO: 72742 - protein, 267 aa, Myxococcus xanthus DK 1622
MHLIAAAQMVSTADKAHNLEAATRLVRRAVALGARLVGLPENFSWMGPEPERQDAAEGLDGPTLSQMASLARELKVTLLAGSVLETGAPGGRLYNTSVLFGPGGERLAVYRKIHLFDVEVGDGATYQESAAVAPGTEVVSAETEVGRLGLSVCYDLRFPELYRRLSREGATLLAVPAAFTLMTGKDHWEVLLRARAIENQAYVLAPAQGGRHSANRVTYGHALVVDPWGLVTARASEGEGLALAPVDPELQARIRRNLPCLEHRRLN

SEQ ID NO: 72743 - DNA, 831 bp, Rubrobacter xylanophilus DSM 9941
  CDS (1)..(831): transl_table=11
ttggaaggacgcaccgtctgtgccgcggcgatccagatgtcctccacgccggacaggggggagaaccggcgggtggccgaagccctgatccgggaggccgccgccgcgggggcgaccctggtcgccctcccggagctctggagctgtcacgggctggaggaggtctaccgcgagaacgcggagcccatccccggcccgaccacggagtttctgggctcgctggcgagggagctggggatctacctgctcggcggctccatcctggagcgggtgtccggctcggaacggctggggaacacctccacgctgtacgccccggacggctccctggtcgccgtctaccgcaaggtccacctcttcgacgtggaggtctccgggcgcaggtacctggagagcgcgaacatcgccccgggcggcgaggcggtggcggcgaaggcggggcccgtcaccgtgggcctctcggtctgctacgacgtccgcttcccggagctctaccgcctgctggccctccgcggcgcggaggtgctcgcggtccccgccgccttcaccctccagacgggcaaggaccactgggagctgctcctgcgggcccgcgccgtggagaaccaggcctacgtcctcgccccggcgcagtggggccggaaggcggacggccgctggacctacgggcgctccatgatcgtggacccctgggggactgtgctctccacctgcccggaccgcgacggctacgcgctggccaccctggacctcggctacctggagcgcctgcgcgcggagttcccctcgctggcgaaccgccgcccgcgggtctaccgcgggctctgctga

SEQ ID NO: 72744 - protein, 276 aa, Rubrobacter xylanophilus DSM 9941
MEGRTVCAAAIQMSSTPDRGENRRVAEALIREAAAAGATLVALPELWSCHGLEEVYRENAEPIPGPTTEFLGSLARELGIYLLGGSILERVSGSERLGNTSTLYAPDGSLVAVYRKVHLFDVEVSGRRYLESANIAPGGEAVAAKAGPVTVGLSVCYDVRFPELYRLLALRGAEVLAVPAAFTLQTGKDHWELLLRARAVENQAYVLAPAQWGRKADGRWTYGRSMIVDPWGTVLSTCPDRDGYALATLDLGYLERLRAEFPSLANRRPRVYRGLC

SEQ ID NO: 72745 - DNA, 813 bp, Nostoc punctiforme PCC 73102
  CDS (1)..(813)
atgaagtcttatttagccgccgctattcaattgacaagtgtgcccgatctacacaaaaatctggctcaggcagaagaattaatcgagcttgccgtgcgtcgaggtgctgaattggtaggcttgccagaaaacttttcctacatgggagaagaaaaagataaactcgcacaaggtgatgcgatcgctcttgaaagtgaaaaatttctcaaaaaaatggctcaacgctttcaaattacgatcttgggcggcagctttccacttcctgtagacaatacaggcaaagtttataacaccactctacttatcgacccaagcggtcaagaactttcccgctactacaaagtacacctattcgatgttgatgttcctgacggcaacacctatcgggaatccagcactgttgtggctggtacgcaattaccccccgtccatttttcagaaaaactcggtaatctaggactttctatttgttatgatgtccggttccctgaactgtatcgtcatttagcagagaagggagccgatgttatctttattcccgccgcctttaccgcctttactggcaaagatcactggcaagtactactacaagccagagccatcgaaaataccgcctacgtcattgctcctgcccaaacggggaataactacggccgccgtctaacccacggccacgccgttattattgacccttggggtgtaattttagccgatgctggggaaaaaccgggaattgcgatcgcagaaatcaagccaactaggttagaacaagtccgtcgtcaaatgccttctttacaacatcgggtgttctag

SEQ ID NO: 72746 - protein, 270 aa, Nostoc punctiforme PCC 73102
MKSYLAAAIQLTSVPDLHKNLAQAEELIELAVRRGAELVGLPENFSYMGEEKDKLAQGDAIALESEKFLKKMAQRFQITILGGSFPLPVDNTGKVYNTTLLIDPSGQELSRYYKVHLFDVDVPDGNTYRESSTVVAGTQLPPVHFSEKLGNLGLSICYDVRFPELYRHLAEKGADVIFIPAAFTAFTGKDHWQVLLQARAIENTAYVIAPAQTGNNYGRRLTHGHAVIIDPWGVILADAGEKPGIAIAEIKPTRLEQVRRQMPSLQHRVF

SEQ ID NO: 72747 - DNA, 849 bp, Pseudomonas aeruginosa UCBPP-PA14
  CDS (1)..(849)
atgtccattgccgtgatccagatggtcagccaggacgacgtgacggccaacctggccgccgcccgtcgcctgctggaacaggccgccgagggtggggcgcggctcgccgtgttgccggaaaacttcgccgccatgggccggcgcgacctggccgaactggggcgcgccgaggcgcgggggaacgggccgatcctgtcgtggttgaattctgccgctcgcgacctcaggttgtggatagtcgctggaacgctgccgctgccgccggatgggcaacccgaggcgaaggcgaatgcctgttcgctgctgattgacgagcacggagagcgggtcgcccgctacgacaagctgcacctgttcgatgtggacgtagccgatgcgcggggccgctatcgtgaatccgacgactatgctttcggtcagaagatcgtggtggcggatacgccggtcggtcgccttggcctgacggtctgctacgacctgcgttttccggaactctataccgcgctgcgcgaggccggcgcagagctgatcacggcgccgtcggcgttcaccgcggtgaccggcgcggcgcactggcaagtgctggtccgcgcccgtgccatcgagacccagtgctacctgctggcggccggacagggtggcgtccacccacggggccgggagacgttcggccattcggccatcgtcgatccctggggccgggtcctggccgagcggccgcagggcgaagcggtgctgctggcggcgcgcgacgccgcagaacaggcggatatccgccggcgcatgccggtggtggcgcacagacgatttttcccgccggccgaaccgcggccggcgcgtacggagtga

SEQ ID NO: 72748 - protein, 282 aa, Pseudomonas aeruginosa UCBPP-PA14
MSIAVIQMVSQDDVTANLAAARRLLEQAAEGGARLAVLPENFAAMGRRDLAELGRAEARGNGPILSWLNSAARDLRLWIVAGTLPLPPDGQPEAKANACSLLIDEHGERVARYDKLHLFDVDVADARGRYRESDDYAFGQKIVVADTPVGRLGLTVCYDLRFPELYTALREAGAELITAPSAFTAVTGAAHWQVLVRARAIETQCYLLAAGQGGVHPRGRETFGHSAIVDPWGRVLAERPQGEAVLLAARDAAEQADIRRRMPVVAHRRFFPPAEPRPARTE

SEQ ID NO: 72749 - DNA, 819 bp, Rubrivivax gelatinosus PM1
  CDS (1)..(819)
atgaagatcgcagccgtgcagatggtgtccacgccgcgcgtcgcggagaacctggcgcgggcccgggcgctgatcggccgggcggccgacgccggggccgagctggtggccctgccggagtacttctgcctgatgggccagcgcgacaccgacaagctcgacgtggccgaggccgacggcagcggcccgattcaggacctgctggccgccgctgcccgcgagtgcggcgtgtggctggtgggcggcacgctgcccttgcgcatcgacgggcgccgcgaccgggcccacaacaccacgctggtgttcggccccgacggccggcgcgtggcgcgctacgacaaggtccacctgttccgcttcgacgacggcgagcgacgctacgacgaggccgccacgctgctgccgggcgccacgccggtagccatcgcgctcaccgaccgcgccgggcacacctggcgtgtcggcctcagcatctgctacgacctgcgctttcccgagctgtaccgcgcgctctgcgtgccgccctgcgacctgctgctggtgccggccgccttcacctaccccaccggccaggcgcactgggagctgttgctgcgcgcgcgggcggtcgagaaccagtgcatggtgctggcgccggcgcagggcggccgccacgagaacggccgccgcacctggggtcacacgatgatcgtcggcccctggggcgacgtactggcggtgcaggccgaggacgagggtgtggtgatcgcgagcctcgacgctgcccgcatggcgcaggtgcgcgcgcaactgcctgcgctgcagcaccgcgtgctgtag

SEQ ID NO: 72750 - protein, 272 aa, Rubrivivax gelatinosus PM1
MKIAAVQMVSTPRVAENLARARALIGRAADAGAELVALPEYFCLMGQRDTDKLDVAEADGSGPIQDLLAAAARECGVWLVGGTLPLRIDGRRDRAHNTTLVFGPDGRRVARYDKVHLFRFDDGERRYDEAATLLPGATPVAIALTDRAGHTWRVGLSICYDLRFPELYRALCVPPCDLLLVPAAFTYPTGQAHWELLLRARAVENQCMVLAPAQGGRHENGRRTWGHTMIVGPWGDVLAVQAEDEGVVIASLDAARMAQVRAQLPALQHRVL

SEQ ID NO: 72751 - DNA, 828 bp, Burkholderia vietnamiensis G4
  CDS (1)..(828): transl_table=11
atgaccgatccgacccgttccgccacgcccttccgggttgccgcgctgcagatggtgagcacgccggacgtcgcgcgcaatctcgccgacgccggccacctgatcgagcaggcggcggcagacggcgcgcaactggtgctgctgcccgagtatttctgcttcatgggccaccgcgacaccgacaagctcgcgctcgccgaaccctatcgcgacgggccgatccagcagttcctcgcgcaggccgcgcagcggcatcgcgtctgggtgatcggcggcacgctgccgctgcaggcgccggagcccgaccgcgtgctgaacacgacgctcgtgttcgacccgagcggccgcgaggccgcccgctacgacaagatccacctgttcaacttcgagaaaggcgacgaatcgttcgacgaggcgcgcacgatccgcgcgggcgacacggtcgtcgcgttcgacgcgccgttcgggcgggtcggcctgtcggtctgctacgatctgcgctttcccgagctgtaccgccggatgggcgattgcgcactgctcgtcgtgccgtcggcgtttacgtatacgacgggccgcgcgcactgggaaacgctgctgcgcgcgcgggccgtcgagaaccagtgctacgtgctggccgccgcgcagggcggcaagcacgagaacggccggcgcacgtggggccacagcatgctgatcgatccgtggggcgaaatcgtcgcggtccgcgacgaaggcgcaggcgtcgtggccggcgcgctcgacccgcagcgcatcgccgacgtgcgccagagcctgcccgcgtggcggcatcgcgtgctggcctga

SEQ ID NO: 72752 - protein, 275 aa, Burkholderia vietnamiensis G4
MTDPTRSATPFRVAALQMVSTPDVARNLADAGHLIEQAAADGAQLVLLPEYFCFMGHRDTDKLALAEPYRDGPIQQFLAQAAQRHRVWVIGGTLPLQAPEPDRVLNTTLVFDPSGREAARYDKIHLFNFEKGDESFDEARTIRAGDTVVAFDAPFGRVGLSVCYDLRFPELYRRMGDCALLVVPSAFTYTTGRAHWETLLRARAVENQCYVLAAAQGGKHENGRRTWGHSMLIDPWGEIVAVRDEGAGVVAGALDPQRIADVRQSLPAWRHRVLA

SEQ ID NO: 72753 - DNA, 819 bp, Crocosphaera watsonii WH 8501
  CDS (1)..(819): transl_table=11
atgaaaccttatctcgctgctgctattcaaatgacaagcaagcccaatctagaacaaaatctagtggaggctgaagaactgattgaacttgctgtacgtcgtggtgcagaattaatcggtttaccagaaaattttgcttttctagggaaagaagaagataagctgagccaagcccaagaaatttcccaaaaagctgaaaaattcgtcaaaactatggcccaacgctttcaagtaaccattttaggtggggggtttcccgtccccgtcgaaggtgatggaagtaaagcttacaacacggctattttagttgatcccacaggacaagaagtatctcgttaccaaaaagcgcatttattcgatgttgatgttcctgatggtaatacctatcgagaatcaagtacagtgatgccaggaaaacagttacctgatatttatgcttcacaagacttaggcaacttaggactatctatctgttatgatgtgcgcttccctgagttatatcgtcatttatccagacaaggggtagaagttttatttgttcccgctgcttttaccgcttttactggcaaagatcactggcaagttctcttacaagcaagagccatcgaaaacacctgctatatcgtagccccggctcaaacaggcaaccactacgccagacgctttacccacggtcacgccgttatcatagacccttggggcattattttagacgatgcaggacaacaacccggtatggccttagcagaaattaaccccaaccgtgttaaacaagtacgtcaacaaatgccttctctacaacatcgtgtctttgtgtaa

SEQ ID NO: 72754 - protein, 272 aa, Crocosphaera watsonii WH 8501
MKPYLAAAIQMTSKPNLEQNLVEAEELIELAVRRGAELIGLPENFAFLGKEEDKLSQAQEISQKAEKFVKTMAQRFQVTILGGGFPVPVEGDGSKAYNTAILVDPTGQEVSRYQKAHLFDVDVPDGNTYRESSTVMPGKQLPDIYASQDLGNLGLSICYDVRFPELYRHLSRQGVEVLFVPAAFTAFTGKDHWQVLLQARAIENTCYIVAPAQTGNHYARRFTHGHAVIIDPWGIILDDAGQQPGMALAEINPNRVKQVRQQMPSLQHRVFV

SEQ ID NO: 72755 - DNA, 852 bp, Mesorhizobium sp. BNC1
  CDS (1)..(852): transl_table=11
atgacggccgtccgcgtcgctgcgctgcagatgcgctccggcacggagccggaggcaaatctttccgcttttgaagcgcttgtgcgtgaagcggcggcccgaggcgcaaaatatgtgcaaagcccggagatgacgggcgcgcttgtgcgctctcgcgaggcgcttatggcgcggattaagccggcggatgaaaacccgctcgtgcggcgtgccgcggagttggcgcgcgaactttcgatatatgtgcatctcggttcgacggcgattcccctcgatggcggcaaggttgcgaacagggcctttctgttcggccccgacggaacgttgatcgccacctatgacaagatccacatgttcgatgtcgatctcgacaagggggaaagctggcgcgaatcggcgacctacgcgccgggcgcacggaccgtcgtggcggcgcttcccttcgcccgcatcggacttgccgtttgttacgatctgcggtttccccagcttttccgcgcgcaggcgctggcaggcgccgaggtgctgaccgtgcctgccgcctttacccggcagaccggcgaggcgcactggcatgttctgacgcgtgcgcgggccatcgaaaacggtgcctgggtcatcgcggcggcacagggcgggttgcatgaggaccgccgcgagaccttcggtcactcgctgatcgtcgatccttgggggcggatcgtcgccgaggcaaatcatgatgaaccggcggtggtgctggctgagatcgatccggcggcttcggcggaggcgcggcagaaaatcccgaatctcaagaacgctcgcgaattcaggatagaagaagcttcttaccgcgaggtgacagcgtga

SEQ ID NO: 72756 - protein, 283 aa, Mesorhizobium sp. BNC1
MTAVRVAALQMRSGTEPEANLSAFEALVREAAARGAKYVQSPEMTGALVRSREALMARIKPADENPLVRRAAELARELSIYVHLGSTAIPLDGGKVANRAFLFGPDGTLIATYDKIHMFDVDLDKGESWRESATYAPGARTVVAALPFARIGLAVCYDLRFPQLFRAQALAGAEVLTVPAAFTRQTGEAHWHVLTRARAIENGAWVIAAAQGGLHEDRRETFGHSLIVDPWGRIVAEANHDEPAVVLAEIDPAASAEARQKIPNLKNAREFRIEEASYREVTA

SEQ ID NO: 72757 - DNA, 951 bp, Silicibacter sp. TM1040
  CDS (1)..(951): transl_table=11
atggcggtcgcacggtgccgcagatctttgttggcgacattcacgtgggcggttgtgacgagcttcacgctctggaccgggcagggaagctcgactcgctgctggcgtcctgatccgatggttcggattgcgctcctgcagatgacgtcttccgacttgccggaagagaaccttgcagcggcgcgcgaaatgatcgcgcgcacggccgctgcaggggcgcagtttgtgttgacgccagaggtcaccaattgcctctcgaccagccggacacagcaacaggctgttttgcatcccgaagagaacgaccccacccttgccggtctgcgtgatgcggctcggcagcatggggtttggctgtcgatcggctctcttggggtgaaaaccaccgatgcggacggccggtttgccaaccggcagtttctgatttcccccgatggcgagatcaaggcgcgctatgacaagatccacatgtttgatgtggaggtcacgcctgaagagacctatcgcgaatccgatggctaccgccctggaacccgcgccgtgcttgcggacgctggatttgcaaagatcggtatgacgatctgttacgatgtgcgctttcctgcgttgcatcgtcgtcttgcccaagccggggcagaaatcatcacggcgccggctgccttcagtcatgtgacgggagcagcgcattggcacagcctcctgcgggcgcgggcgattgaaaccgggtgtttcgtgcttgccgctgcgcagacgggggttcacgacaccagtcgtggcgctgcccgccagacctatgggcattcgcttgccgttgccccttggggcgagattttggcggatgctggcaccgaaactggaattacctgcgttgacctcgatctcgaagcggtgaaaaaggcgcgcaaacgcgtcccgtctctgacgcacgaccgggagtttgacggaccctga

SEQ ID NO: 72758 - protein, 316 aa, Silicibacter sp. TM1040
MAVARCRRSLLATFTWAVVTSFTLWTGQGSSTRCWRPDPMVRIALLQMTSSDLPEENLAAAREMIARTAAAGAQFVLTPEVTNCLSTSRTQQQAVLHPEENDPTLAGLRDAARQHGVWLSIGSLGVKTTDADGRFANRQFLISPDGEIKARYDKIHMFDVEVTPEETYRESDGYRPGTRAVLADAGFAKIGMTICYDVRFPALHRRLAQAGAEIITAPAAFSHVTGAAHWHSLLRARAIETGCFVLAAAQTGVHDTSRGAARQTYGHSLAVAPWGEILADAGTETGITCVDLDLEAVKKARKRVPSLTHDREFDGP

SEQ ID NO: 72759 - DNA, 816 bp, Trichodesmium erythraeum IMS101
  CDS (1)..(816): transl_table=11
atgaaatcctatctcgctgcggctatatcaatgacaagtgtgcctgacttggcaaaaaacttattacaagcagaagaattaatagacttagctatccgtcaaggtgcagaattagttaccttgccagaaaatttttctttcttaggtggagaggaagaaaaaatatctcaagcagaagcgatcgctaaggagagtgaaaagtttctcaaaacaattgctcaaaaatatcaaatcacaattttaggaggtggttatccagtaccgacaacaaatggcaaagtttacaatgttgcatctttaattgagcctaatggcatagaagtagcaaggtatgaaaaagcacatttatttgatgttaacttacccgatggtaatacttatcaagaatcaaatacggtcaaagcaggaatgaagttaccatcagtgtatgaatctaaagattatggaaatttaggtatatcagtatgctatgatgtaagattccctgaactctatcgacatctttcaaatgcaggagctgaagttttatttataccagcggcttttactgcatacacaggaaaagaccattggcaagtattactccaagcacgagctatagaaaatacctgttatattatcgccccggcccaaacaggtaatcactacggtagaagacaaactcatggccatgcaatgatagttgacccctggggtttgattttggcagataccggggacaaaccaggagtggcgatcgcagaaattgaccctactcgcttagaacaagttcgtaggcaaatgccgtccctccaacatagggtatttatatcttga

SEQ ID NO: 72760 - protein, 271 aa, Trichodesmium erythraeum IMS101
MKSYLAAAISMTSVPDLAKNLLQAEELIDLAIRQGAELVTLPENFSFLGGEEEKISQAEAIAKESEKFLKTIAQKYQITILGGGYPVPTTNGKVYNVASLIEPNGIEVARYEKAHLFDVNLPDGNTYQESNTVKAGMKLPSVYESKDYGNLGISVCYDVRFPELYRHLSNAGAEVLFIPAAFTAYTGKDHWQVLLQARAIENTCYIIAPAQTGNHYGRRQTHGHAMIVDPWGLILADTGDKPGVAIAEIDPTRLEQVRRQMPSLQHRVFIS

SEQ ID NO: 72761 - DNA, 822 bp, Vibrio sp. Ex25
  CDS (1)..(822)
atggaacgtgttggcattattcaaatgacatcgggtccagatatcaccgcgaatctggactttattgaaaaacagtgtgctttggcgagtaagcaaggtgccaagcttgtccttacccctgaaaatacggtgctgtttgccaaccgcgaagcgtaccatcaacatgcagagccacttgggagtggcgtgattcaacagcggctctctgaaatcgcaagaaagaaccagttaacactgattgtcggaagcatgcccattcaaaccgcaaaaggtgtcacgaccacaacgcttgtattgccgccgcacggtaaatgcatggctcactatgacaaactgcatatgtttgatgtcgacgtagccgatggttatggtagttatcgtgagtcggatacgtttatggcgggtaatcaaatagtcgtggcggaaaccgatatcggcagcgttggattgagcatttgttacgatcttcgttttcctgagctttataaagtattacgccaagaaggcgcggatatcattgtggtgcctgctgcgtttaccgctgtgacggggcaagctcactgggaagtattattgcgagctagagcgattgagacacaatgttggattttggcgagcggacaaactggaacgcatccatgtggacgaaaaacatggggacactcaatggtcgttgacccttggggacgtattcataaacagcttcaggatgaagtaggcttattggtgacagagatagatttgtcacaaagccaacaagtaaggcagaatatgccgctgactcaacacagtcgctttcaaaatgaattgagacggaaataa

SEQ ID NO: 72762 - protein, 273 aa, Vibrio sp. Ex25
MERVGIIQMTSGPDITANLDFIEKQCALASKQGAKLVLTPENTVLFANREAYHQHAEPLGSGVIQQRLSEIARKNQLTLIVGSMPIQTAKGVTTTTLVLPPHGKCMAHYDKLHMFDVDVADGYGSYRESDTFMAGNQIVVAETDIGSVGLSICYDLRFPELYKVLRQEGADIIVVPAAFTAVTGQAHWEVLLRARAIETQCWILASGQTGTHPCGRKTWGHSMVVDPWGRIHKQLQDEVGLLVTEIDLSQSQQVRQNMPLTQHSRFQNELRRK

SEQ ID NO: 72763 - DNA, 849 bp, Shewanella sp. ANA-3
  CDS (1)..(849): transl_table=11
atgcgcatcagcctgttgcaatgtcagagcagtcgcgacgtcagcgcgaatctgttgtttatcgaatcgcagcttgaagaattaacccgtgagcgcctgcaatgggataaagatgccccgcatttagtggtgctgccagaatgcagtctgctgtttggtggccatgagagtcaacaactcgcctatgcgggcgacagtcatcttagcccgttaaaatccgccttaagtgccttagccgcccgttactgcgtgtatatggtggcgggaaccatccccgcgctggcggaggatggacgtgtctacagccgttgttatctgtttgatgataaaggtgataccttagggcaatacgataaactgcatctgtttgacgtggatgtcgccgacggcactaagcaataccgcgagagtgaaaccttttgccccggcaatcatataagcgtcatcgacaccccttttggcaaaattggcttgaccatctgttatgatttacgctttccggatttattcagggcgctacgcctcgcgggagccgaggttattaccgtgccttcggcctttactaaggtcaccggagaagcccattggcaggtgttattacaggccagagccattgaaacccaatgctttattttggccgccgcccaatggggcgcccataacgaaggcagtcgcgagacctggggacagagcatggtgataagcccttggggcgaggtgattgccgagcagaaaaccggtataggttgggtgcatgccgatatcgatgtggccgaggtgcacagcatccgcagtaaaatgcccgtggcgcaacataatcgctttactgcaccgaaccttaagccttga

SEQ ID NO: 72764 - protein, 282 aa, Shewanella sp. ANA-3
MRISLLQCQSSRDVSANLLFIESQLEELTRERLQWDKDAPHLVVLPECSLLFGGHESQQLAYAGDSHLSPLKSALSALAARYCVYMVAGTIPALAEDGRVYSRCYLFDDKGDTLGQYDKLHLFDVDVADGTKQYRESETFCPGNHISVIDTPFGKIGLTICYDLRFPDLFRALRLAGAEVITVPSAFTKVTGEAHWQVLLQARAIETQCFILAAAQWGAHNEGSRETWGQSMVISPWGEVIAEQKTGIGWVHADIDVAEVHSIRSKMPVAQHNRFTAPNLKP

SEQ ID NO: 72765 - DNA, 849 bp, Shewanella sp. MR-7
  CDS (1)..(849): transl_table=11
atgcgcatcagcctgttgcaatgtcagagcagtcgcgacgtcagcgcgaatctgttgtttatcgaatcgcagcttgaggaattaacccgtcagcgtctgcaatgggataaagatgctcctcatttagtggtgctgccagaatgcagcctgctgtttggtggccatgagagtcagcaactcgcctatgccggcgacagtcatcttagcccgttaaaatctgccttaagtgccttagctgcccgttactgcgtgtatatggtggcgggaaccatccccgcgctggcggaggatgggcgcgtctacagccgttgttatctgtttgatgataaaggtgataccttagggcaatacgataaactgcatctgtttgatgtggatgttgccgacggcactaagcaataccgcgagagtgaaaccttctgccctggcaatcatatcagcgtcattgacaccccttttggcaaaattggcttgaccatctgttatgatttacgctttccggatttattcagggcgctacgcctcgcaggagccgagattatcaccgtgccttcggccttcactaaggtcacgggagaagcccattggcaggtgttattacaggccagagccattgaaacccaatgctttattttggctgccgcccaatggggcgcccataacgaaggcagtcgcgagacctgggggcagagcatggtaataggtccttggggcgaggtgattgtcgagcagaaaaccggtacaggttgggtgcatgccgatatcgatgtggccgaggtgcacagcatccgcagtaaaatgcccgtggcgcaacataatcgctttactgcaccgaaccttaaaccttga

SEQ ID NO: 72766 - protein, 282 aa, Shewanella sp. MR-7
MRISLLQCQSSRDVSANLLFIESQLEELTRQRLQWDKDAPHLVVLPECSLLFGGHESQQLAYAGDSHLSPLKSALSALAARYCVYMVAGTIPALAEDGRVYSRCYLFDDKGDTLGQYDKLHLFDVDVADGTKQYRESETFCPGNHISVIDTPFGKIGLTICYDLRFPDLFRALRLAGAEIITVPSAFTKVTGEAHWQVLLQARAIETQCFILAAAQWGAHNEGSRETWGQSMVIGPWGEVIVEQKTGTGWVHADIDVAEVHSIRSKMPVAQHNRFTAPNLKP

SEQ ID NO: 72767 - DNA, 828 bp, Alkalilimnicola ehrlichei MLHE-1
  CDS (1)..(828): transl_table=11
atggcgattagggacgacaagcgggtgcgcgcggctgcggtgcagatggcctcgggcccgaatctggccggcaatctcgccgaggtcgagcggctgatcggccaggcggccgagcagggcgcggagctggtgggcctgccggagaactttgccctcatggggcgccgggaggccgataaactggacgtggccgagagcgacggtgaggggcccatccaggacctgctggccaagctcgccagccgccaccgcatccacctggtggccggtaccctccccctgcgcagcgagaaccccggcaaggtgcgggccgcctgcctgctctacggtcccgatggccgtcgcctgggccgatacgacaaggtgcaccttttcgacgtcggcgtcagcccgaccgaggcctaccgcgagtccgacaccctggagcccggctctcgcgcggtggtggtggagaccgagctgggccgcatcggcctggcggtctgttacgatgtccgattcccggaacagttccgggagatggcgcggcaggggatggagatcctggtcctcccctccgcgttcaccgccgtcaccggtgccgcccactggcgcacgctggtcaccgcccgggccatcgagaacctctgctttacggtggcccccgatcagggcgggcgccatgccagcgggcgggaaacctacggcgacagcctcatcgtcgacccctggggcagcgtgctggccagccgcgccaagggggccggtgtggtggtcgccgatctcgacctgcaccgccaggccgagatccgccgccgctttccggcgctgacacaccgtaaattctga

SEQ ID NO: 72768 - protein, 275 aa, Alkalilimnicola ehrlichei MLHE-1
MAIRDDKRVRAAAVQMASGPNLAGNLAEVERLIGQAAEQGAELVGLPENFALMGRREADKLDVAESDGEGPIQDLLAKLASRHRIHLVAGTLPLRSENPGKVRAACLLYGPDGRRLGRYDKVHLFDVGVSPTEAYRESDTLEPGSRAVVVETELGRIGLAVCYDVRFPEQFREMARQGMEILVLPSAFTAVTGAAHWRTLVTARAIENLCFTVAPDQGGRHASGRETYGDSLIVDPWGSVLASRAKGAGVVVADLDLHRQAEIRRRFPALTHRKF

SEQ ID NO: 72769 - DNA, 849 bp, Shewanella sp. MR-4
  CDS (1)..(849): transl_table=11
atgcgcatcagcctgttgcaatgtcagagcagtcgcgacgtcagcgcgaatctgttgtttatcgaatcgcagcttgaggaattaacccgtcagcgtctgcaatgggataaagatgctcctcatttagtggtgctgccagaatgcagcctgctgtttggtggccatgagagtcagcaactcgcctatgccggcgacagtcatcttagcccgttaaaatctgccttaagtgccttagccgcccgttactgcgtgtatatggtggcgggaaccatccccgcgctggcggaggatgggcgagtctacagccgttgttatctgtttgatgataaaggtgataccttagggcaatacgataaactgcatctgtttgatgtggatgttgccgacggcactaagcaataccgcgagagtgaaaccttctgccccggcaatcatatcagcgtcatcgacaccccgtttggcaaaattggcttgaccatctgttatgatttacgctttccggatttattcagggcgctgcgcctcgcgggagccgagattattaccgtgccttcggcctttactaaggtcacgggagaagcccattggcaggtattattacaggccagagccattgaaacccaatgctttattttggccgctgcccaatggggcgcacacaacgaaggcagtcgcgagacctgggggcagagcatggtaataggtccttggggcgaggtgattgccgagcagaaaaccggtacaggttgggtgcatgccgatatcgatgtggccgaggtgcacagcatccgcagtaaaatgcccgtggcgcaacataatcgctttactgcaccgaaccttaagccttga

SEQ ID NO: 72770 - protein, 282 aa, Shewanella sp. MR-4
MRISLLQCQSSRDVSANLLFIESQLEELTRQRLQWDKDAPHLVVLPECSLLFGGHESQQLAYAGDSHLSPLKSALSALAARYCVYMVAGTIPALAEDGRVYSRCYLFDDKGDTLGQYDKLHLFDVDVADGTKQYRESETFCPGNHISVIDTPFGKIGLTICYDLRFPDLFRALRLAGAEIITVPSAFTKVTGEAHWQVLLQARAIETQCFILAAAQWGAHNEGSRETWGQSMVIGPWGEVIAEQKTGTGWVHADIDVAEVHSIRSKMPVAQHNRFTAPNLKP

SEQ ID NO: 72771 - DNA, 831 bp, Sulfitobacter sp. EE-36
  CDS (1)..(831): transl_table=11
atgcaggcggcgctgatccagctgaacgtcagcgatacaccggcccgcaatctggcgggcacggtagagatggtgcgcgatgccgcggcgcagggggcggcgtttgtcctcacgcccgaggtcacgaactgcgtctcgaccagccgcgaccaccagcgcagcgttttgcagcacgaagacgatgacatcaccctcgccgccctgcgggatgtggcgcgagaggcgggcatctggctgctgatcgggtcgcttgggctgaaaacgcgggatgcggacgggcgctttgccaaccggtcgttcctgattgatccgcaggggcagatcaaagcccgctacgacaagatccatatgttcgacgtggatatcgacgcgggcgaaagctaccgcgaatcggcgggctaccgccccggcgatcaggcggttgtggcgcagacgcctttcgccaaaatcgggatgagcatttgctatgacatgcgctttcccaagctctatcaggcgctggcggatgcgggggccacgatcctgaccatgcccgccgcgttttcgccggtgaccggtgccgcgcattggcacatgctgctgcgggtccgcgcgatcgagacagggtgtttcgtgttagcccccgcgcagaccggcacccatgccagcgacagccacaagacccgcgacacctatggccattcgctggttgttgccccgtggggcgaggtgctgctggatgcgggcaccgcgccgggcatttatccgttcacgctggacatggcgcgtgtacaagaggcacgtacccgcgtacccagtcttgccaaccggcgggatttcaaggcaccttag

SEQ ID NO: 72772 - protein, 276 aa, Sulfitobacter sp. EE-36
MQAALIQLNVSDTPARNLAGTVEMVRDAAAQGAAFVLTPEVTNCVSTSRDHQRSVLQHEDDDITLAALRDVAREAGIWLLIGSLGLKTRDADGRFANRSFLIDPQGQIKARYDKIHMFDVDIDAGESYRESAGYRPGDQAVVAQTPFAKIGMSICYDMRFPKLYQALADAGATILTMPAAFSPVTGAAHWHMLLRVRAIETGCFVLAPAQTGTHASDSHKTRDTYGHSLVVAPWGEVLLDAGTAPGIYPFTLDMARVQEARTRVPSLANRRDFKAP

SEQ ID NO: 72773 - DNA, 825 bp, Prochlorococcus marinus str. MIT 9211
  CDS (1)..(825): transl_table=11
ttgacggactttttgtcggctgcattgcaattaactagcacctcaaatgttgaggcaaatttatctgctgcagaggagcaaatagagattgcggctcgaagaggagcagatttagttggtttgccagagaattttgcctttattggaaatgatgaagaccgtcttgaaatggcatcagagttagctgaaaagagcagtcgttttttggtaaccatggcgaggagatatcaaattgttcttttaggaggtggataccctgtccctgcagaagatggcaagaggactctgaacagatctgagcttgttggtcgggatggtcaactacttggtagatatgacaagattcatctatttgatgttgatcttccagatgggaataaatacagggaatcagaaactattgtttctggtaacctacttccatcagttatagatgttcctggtttatgccgagtaggtttatctatttgctatgacgttagattcccagaattgtacagacaccttgttgataatggtgctgaactattaatgattccagcagcatttacagcatttactggaaaagatcattggcaagtattacttcaggcaagggctatagagaatacagcttatgtcgtagcaccagcccaaactggtgaacattatcggcgcagacaaagtcatggtcacgctatgattattgatccttggggaacagtccttgcagatgctggagtacaggaaggagctgctattgcgcctgtagataattcaagagttaaaagtattcgtgaacaaatgcctagtatcaagcacaggaagcaagaattatttagttga

SEQ ID NO: 72774 - protein, 274 aa, Prochlorococcus marinus str. MIT 9211
MTDFLSAALQLTSTSNVEANLSAAEEQIEIAARRGADLVGLPENFAFIGNDEDRLEMASELAEKSSRFLVTMARRYQIVLLGGGYPVPAEDGKRTLNRSELVGRDGQLLGRYDKIHLFDVDLPDGNKYRESETIVSGNLLPSVIDVPGLCRVGLSICYDVRFPELYRHLVDNGAELLMIPAAFTAFTGKDHWQVLLQARAIENTAYVVAPAQTGEHYRRRQSHGHAMIIDPWGTVLADAGVQEGAAIAPVDNSRVKSIREQMPSIKHRKQELFS

SEQ ID NO: 72775 - DNA, 822 bp, Synechococcus sp. RS9917
  CDS (1)..(822): transl_table=11
gtgagcgacttcctggcggcggctgtgcaactcacgagcggctctgatccagaggccaacttggcggcggcggaagaacagatcgatctggcggcccgacgcggtgccgagctggtgggcctacccgaaaatttcgcctacatgggcgacgatccgcgccgcctcgaactggcccccaccctcgcggagcagtgcgagcgcttcctggtcaccatggcctgtcgctaccagctggccatcctcggcggcggttttccagtgccggtcggcgacggccagcacacctatcaacgggcccagctggtgggccgcgatggccagctgctggcgagctacgacaagattcacctctttgatgtggatctgccggacggcagtacctaccgggaatccgccagcttcagtccgggccacaaccatccaccggttgtcaccatccccggtctctgccgggtgggggtgtccatttgctacgacctgcgcttccctgagctctaccgccatctcgtcggtgatggagccgaggtgttgatgatcccagccgccttcactgccttcaccgggaaggatcactggcaggttctgctgcaggcccgggcaatcgagaacacggcctatgtgttggcaccggctcagacggggctccactacggccggcgtcagacccatggtcacgccatggtgatcgacccctggggcacggtgctcgccgatgccggcgttgcgcccggtgctgccatcgccccgatcgatcccgaccacctgaagcggatccgcggccagatgcccagccttgaacatcgccggcccgcgctgttctga

SEQ ID NO: 72776 - protein, 273 aa, Synechococcus sp. RS9917
MSDFLAAAVQLTSGSDPEANLAAAEEQIDLAARRGAELVGLPENFAYMGDDPRRLELAPTLAEQCERFLVTMACRYQLAILGGGFPVPVGDGQHTYQRAQLVGRDGQLLASYDKIHLFDVDLPDGSTYRESASFSPGHNHPPVVTIPGLCRVGVSICYDLRFPELYRHLVGDGAEVLMIPAAFTAFTGKDHWQVLLQARAIENTAYVLAPAQTGLHYGRRQTHGHAMVIDPWGTVLADAGVAPGAAIAPIDPDHLKRIRGQMPSLEHRRPALF

SEQ ID NO: 72777 - DNA, 819 bp, Synechococcus sp. WH 5701
  CDS (1)..(819): transl_table=11
gtgacgagctttctggctgccgcagtgcaactcaccagcacgcccgatccggacgccaacttcgccgcagccgaagagcagatcgagctcgccacccggcgcggcgccgagctggtgggccttccggagaacttcgccttcatgggcgacgacaaccgccgcctggagctggcccccagcctggcggaccgctgcagccgcttcctcgtcaccatggcgcggcgttaccaggtgaccctcctcggcggtggttttcccgtgcccgccggcgagcgggtcacctacaaccgggcggaactggtgggccgcgacggccagctgctcgcccgctacgacaagatccatctcttcgatgtggatctgcccgacggcaacacctacagggaatcggaaaccgtgcgatccggcaccgccctgccgcccgtggtcgatgcccccggcctctgccggatcggcctctcgatctgttacgacgttcgcttccctgagctctaccgccacctggccggtgccggcgctgagttgatcatgattccggctgccttcaccgccttcaccggcaaggaccactggcaggtgctgctgcaggctcgggcaatcgagaacaccgcctacgtcctggctccggcccagacgggcctgcactacggacgccgccagagccacggccacgctctggtgatcgatccctggggcacggtcctggccgatgccggcattggtgtcgggcttgcggtggcccccgtcgaccctgaccatggccagcgggtccgtgcccagatgccgagcctcaaccaccgtcgtccttcgctgttctga

SEQ ID NO: 72778 - protein, 272 aa, Synechococcus sp. WH 5701
MTSFLAAAVQLTSTPDPDANFAAAEEQIELATRRGAELVGLPENFAFMGDDNRRLELAPSLADRCSRFLVTMARRYQVTLLGGGFPVPAGERVTYNRAELVGRDGQLLARYDKIHLFDVDLPDGNTYRESETVRSGTALPPVVDAPGLCRIGLSICYDVRFPELYRHLAGAGAELIMIPAAFTAFTGKDHWQVLLQARAIENTAYVLAPAQTGLHYGRRQSHGHALVIDPWGTVLADAGIGVGLAVAPVDPDHGQRVRAQMPSLNHRRPSLF

SEQ ID NO: 72779 - DNA, 822 bp, Synechococcus sp. WH 7805
  CDS (1)..(822): transl_table=11
gtgagtgattttctggcggctgccgtgcaactcaccagcacttccgatccagagaccaacttcagtgctgctgaggaacagattgatctggcggcccgtcggggcgccgaactgatcggacttcctgagaatttcgccttcatcggtgaacccgaacagcgtctggcgatcgcaccggcactcgccgatcaggcgtcccagtttctgatcaccatggcgcgtcgctaccaggtggtgattctcggcgggggatttcctgttccggtgggagatggtgctcacacctggcagagagctcagctggtgggacgggatggtcaggtcctggccagttacgacaaaatccacctgtttgatgtggatcttcctgacgggagttcctaccgggaatccagcagtttcatgccgggttcctcaccgcctccagtcgtggatgttcctggactgtgtcgggtgggggtgtccatctgctacgacgtgcgcttccctgagctgtatcgccatctcgtcggcgctggcgccgagttgctgatgattccagctgcctttacggctttcacgggtaaagatcactggcaggtgctgcttcaggcccgcgcgatcgagaacacggcttacgtgttggctccggctcagacggggagcgatgtcggacgtcgtttcagtcatggtcattccatggtgatcgatccttggggaaccgttctggcagatgccggggtgtcccagggggctgccgtcgctcctgtcgatctggatcacctcgcccgtattcgcagtcagatgccctgtctgcaacaccgccgatccacggtgttctga

SEQ ID NO: 72780 - protein, 273 aa, Synechococcus sp. WH 7805
MSDFLAAAVQLTSTSDPETNFSAAEEQIDLAARRGAELIGLPENFAFIGEPEQRLAIAPALADQASQFLITMARRYQVVILGGGFPVPVGDGAHTWQRAQLVGRDGQVLASYDKIHLFDVDLPDGSSYRESSSFMPGSSPPPVVDVPGLCRVGVSICYDVRFPELYRHLVGAGAELLMIPAAFTAFTGKDHWQVLLQARAIENTAYVLAPAQTGSDVGRRFSHGHSMVIDPWGTVLADAGVSQGAAVAPVDLDHLARIRSQMPCLQHRRSTVF

SEQ ID NO: 72781 - DNA, 831 bp, Oceanospirillum sp. MED92
  CDS (1)..(831): transl_table=11
atggcacgtgttgctgcggttcaaatgtgctcaggccaagatttgaatgccaacttagctcagttggatggcttgattgagcaggctgtagcatccaatgctgaattacttctgctgcccgaaaactttgctttattggattctcaggccttaatcgaattggcttttgaagaaagccgctctcccagtgttttgaacaggctgaagcagatagcgcatgaaaaagggatatggctgatagctggaagctttccctggttatgtgattcccctcaaaatggcaaaacaaaagtcttttcccgtagtctgctaatagacccccaaggtgagttgaaggcgcattacgacaaagtacacctttttgatgtagatgttgaagataagcacgctgcttaccgtgaatcagattacttcaccccaggcaaagagttagttgttgagcaaacttctgttggctgtttcggcctctctatctgctatgacctgcgttttccagagcactatcagaggctagcggatatgggggcgaatattatgttggtaccttcagcttttaccgctgtcacagggaaggcgcattgggaggttttgctacgtgccagggcgatagagacccaaagctacgtcattgcggctaatcaggcgggtaagcatacagctagtaggtcaagctgggggcactcgatgatcgtggatccttgggggaaagtgcttgcggaatgtcataatgacgggcctggtttggcggttgcggacatcgatttgcaggaggttcgtaacaggcgtaaagcgatgcctgttacgttacatcgagctaaagcagggttttag

SEQ ID NO: 72782 - protein, 276 aa, Oceanospirillum sp. MED92
MARVAAVQMCSGQDLNANLAQLDGLIEQAVASNAELLLLPENFALLDSQALIELAFEESRSPSVLNRLKQIAHEKGIWLIAGSFPWLCDSPQNGKTKVFSRSLLIDPQGELKAHYDKVHLFDVDVEDKHAAYRESDYFTPGKELVVEQTSVGCFGLSICYDLRFPEHYQRLADMGANIMLVPSAFTAVTGKAHWEVLLRARAIETQSYVIAANQAGKHTASRSSWGHSMIVDPWGKVLAECHNDGPGLAVADIDLQEVRNRRKAMPVTLHRAKAGF

SEQ ID NO: 72783 - DNA, 933 bp, Xanthobacter autotrophicus Py2
  CDS (1)..(933): transl_table=11
atgacggatcagggcgggttcagcatccaggaaagagcgggcctcatgacctcggccgacacatccgacaccctccgcatcgcactggtgcagttgcgcagcggccgggatccggcagccaatctcgacgccaccgtagccctggtgcgcgaggccgcgcgggacggggcgcgctatgtgcagacgcccgaggtcaccaacctcatggagctggaccgcgccgtcctgttcgagaagctgcgggaggaggcggacgacgccaccctcaaagccctgcgccagctggcgcaggagctgggcatcttcctccacatcggctcgctggccctgaaggtgtcggacaagaaggcggtcaaccgcgccttcatggtcggacccgacggcgagatcatcgcccgctacgacaagatccacatgttcgacgtggatctgggcaacggcgaaagctatcgcgaatcctccgcctaccgccccggcgagcgggcgatcctggccaatgtgggcgcgttccgcttcggcctcaccatctgctacgacctgcgcttcccctccctctaccgggccctggccgagggtggagcgcaagtgctcaccgtgccatccgccttcacccggcccaccggggaggcgcactggcacgtgctgctgcgggcgcgggccatcgagaacggcgcctatgtgctggcggccgcccagggcggcaagcatgagaacggccgggagaccttcggccattcgctggtggtggacccctggggccgtgtgatcgccgaaggcggcgccgaccccggcgtgatcctcgccgagatcgacctgaaggaagtcgccgccgctcgcgcgcgcatcccctccctctccaacggccgccggttcgagatcgccgagccgggccagaccatcggccacctcagcgtggtgcgggcttcgtcatga

SEQ ID NO: 72784 - protein, 310 aa, Xanthobacter autotrophicus Py2
MTDQGGFSIQERAGLMTSADTSDTLRIALVQLRSGRDPAANLDATVALVREAARDGARYVQTPEVTNLMELDRAVLFEKLREEADDATLKALRQLAQELGIFLHIGSLALKVSDKKAVNRAFMVGPDGEIIARYDKIHMFDVDLGNGESYRESSAYRPGERAILANVGAFRFGLTICYDLRFPSLYRALAEGGAQVLTVPSAFTRPTGEAHWHVLLRARAIENGAYVLAAAQGGKHENGRETFGHSLVVDPWGRVIAEGGADPGVILAEIDLKEVAAARARIPSLSNGRRFEIAEPGQTIGHLSVVRASS

SEQ ID NO: 72785 - DNA, 846 bp, marine gamma proteobacterium HTCC2207
  CDS (1)..(846): transl_table=11
atgagcaataataggtcctttatcgccgcagctgttcagttgcggccgcaacaatccttgcagcagaatctagcggcggcaggcgcactgattgagcaggcggcagaagctggcagtagactggtggtattaccggaaaactttgcctatcttggccgaaaagatcttactgaggtgggtctggcagagcagtctacggggccggcctatgaattcctcgccaagcaggctcaacgccacagtctttggttggtcggtggcaccgtgcctgtgagtgatgccaatttatcaaggccttttgcccgttcatggttatttgatccccagggcgatttagtccagcactacgataaaattcatttgtttgatgttgatgtgccgacatccaaagaggggattttacagcaggcgacataccgtgagtcagacgattatcgcagtgctgcgactgtagtagttgcagagactgacccctgtcggctgggtatgagcgtctgctatgacctacgttttgcggagctgtttcgtcagttggctgacgccgatgctcaggttgtcgcagtgccagccgcctttacggcagccacaggtcgcgaccactgggagcttttattgcgggcgcgggcggtggaaaatcaactatttgtgattggtgccaatatggttgatcgcgaccatccacgccgcggtctctggggcggtagtgcgattgttgatccttggggaaacgtattggcccgagttgatgatgaggctggggtagcgattgccgagattaatttagatcgactggatgagatacgtgccaaaatgccggttgcccaacatcgtaagctggctctgtaa

SEQ ID NO: 72786 - protein, 281 aa, marine gamma proteobacterium HTCC2207
MSNNRSFIAAAVQLRPQQSLQQNLAAAGALIEQAAEAGSRLVVLPENFAYLGRKDLTEVGLAEQSTGPAYEFLAKQAQRHSLWLVGGTVPVSDANLSRPFARSWLFDPQGDLVQHYDKIHLFDVDVPTSKEGILQQATYRESDDYRSAATVVVAETDPCRLGMSVCYDLRFAELFRQLADADAQVVAVPAAFTAATGRDHWELLLRARAVENQLFVIGANMVDRDHPRRGLWGGSAIVDPWGNVLARVDDEAGVAIAEINLDRLDEIRAKMPVAQHRKLAL

SEQ ID NO: 72787 - DNA, 813 bp, Plectonema boryanum
  CDS (1)..(813): transl_table=11
atgaagtcttatttagctgctgctgtgcaaatgaacagcttgcccgatctgcaaaagaatttggcgcaagcagaagaattgatcgagattgcagttcgacgaggtgcagaattaatcggcttgcctgagaatttttcgtttctcggagatgaagaaggaaaaattgcgcaagcagacgagatcgccgttgaaagcgaaaagtttctcaaaacaatggcgcaacgtttccaagtgacaattctaggtggcggttatcctgtccctgttgagcctgggaaggtctacaatacggcgttgctcgttgctccgaatggagaagaacttgcccgttacgaaaaggttcacctgtttgacgtgaatttgcccgatggtaatacgtatcgggaatcggcaactgtcgttgcaggaacaagagtcccaccgattcatccttccaaggatctcggaaatatcggtttgtctgtttgctatgacgtgagatttcccgagctttaccgtcaaatgactcagcttggcgcagaagttctgtttgttccggcagcctttacggcgcataccggaaaagaccactggcaagtattgttgcaagcaagagcgatcgagaatacctgttatgtgattgcccctgcccaaaccggacgacataattctctgcgacaatcgcatggacacgccatgattattgacccgtggggcgtgatcttagcagatgccggagaaatgactggagtcgcgatcgcggaaattgcacccggtcgattggagcaggtgagacgacagatgccttcgttgcagcatcgggtatttagttga

SEQ ID NO: 72788 - protein, 270 aa, Plectonema boryanum
MKSYLAAAVQMNSLPDLQKNLAQAEELIEIAVRRGAELIGLPENFSFLGDEEGKIAQADEIAVESEKFLKTMAQRFQVTILGGGYPVPVEPGKVYNTALLVAPNGEELARYEKVHLFDVNLPDGNTYRESATVVAGTRVPPIHPSKDLGNIGLSVCYDVRFPELYRQMTQLGAEVLFVPAAFTAHTGKDHWQVLLQARAIENTCYVIAPAQTGRHNSLRQSHGHAMIIDPWGVILADAGEMTGVAIAEIAPGRLEQVRRQMPSLQHRVFS

SEQ ID NO: 72789 - DNA, 834 bp, Candidatus Kuenenia stuttgartiensis
  CDS (1)..(834): transl_table=11
atggaaatattgtcgattgccgcaattcaaatgtgctctgtacatgaccgtaataagaacctgaacacagcacgtgtacttatggaaaaggcagtgcaaaagggtgccaggttgattgcgctccctgaaaatttttcgtttatcggacaggaaagagaaaacataacattcgcggaagagagagaaaccggggaaattgttcattttctcaaaaaattttcaatgaaacatagtgtagcgattattggcgggagtgttccgctcagatcatcaagcaaagcaaaagttacgaacacctgcctggtttttgatcaatctggtgtgataatagggagttatgataaaattcatctgtttgattttcaccttgatgacaagactgtttacagggaatctcattatgtgaaacatgggaaacatattgaaacggtaaaacttttcgggcatatcatggggctgtgtatttgctatgatttacgtttcccggagctttttcgcaagctgatgctgcgtggaatggaagtcttgtttgcgccgtccgcatttacaatggaaacaggaaaggatcattgggaaattctcttgcgggcgcgcgccatcgaaaaccagtgttatgtggtagcgcccgcccaatacggacggcataacgatgagcgcatcagttacggcagaacgatgatcattgacccgtggggacgtattatggcgcaatgccaggacatggaagacgttattgtttgcgaaattgattttgcgtttcttggcgaagtgagaaaacgtcttccctgtttaaagcacattcgccgcaaactatttttcttaggtgaggcatga

SEQ ID NO: 72790 - protein, 277 aa, Candidatus Kuenenia stuttgartiensis
MEILSIAAIQMCSVHDRNKNLNTARVLMEKAVQKGARLIALPENFSFIGQERENITFAEERETGEIVHFLKKFSMKHSVAIIGGSVPLRSSSKAKVTNTCLVFDQSGVIIGSYDKIHLFDFHLDDKTVYRESHYVKHGKHIETVKLFGHIMGLCICYDLRFPELFRKLMLRGMEVLFAPSAFTMETGKDHWEILLRARAIENQCYVVAPAQYGRHNDERISYGRTMIIDPWGRIMAQCQDMEDVIVCEIDFAFLGEVRKRLPCLKHIRRKLFFLGEA

SEQ ID NO: 72791 - DNA, 852 bp, Medicago truncatula
  CDS (1)..(852)
atggccactaattcagtccgagttgccgcagctcaaatgacatccatcaccgacctcgcttccaatttctccacctgctctcgtcttgtgaaagaagctgcatcagctggagcaaaattgctttgttttcctgaagcattctcttttgtgggtgctaaggatggtgatagtgttagtattgctcaacctttggatggacctattatggaccaatactgctctttagccagagagtcaagtatttggttgtcacttggtggctttcaagaaaaaggatctgatcctcgacatttgtttaatacacatgttgttgtagatgacactgggaaaattcaaaccacttatagaaaaatacacctgtttgatgtggatgttcctggtggaagggtatataaagaaagtaattttacagaatcaggcaaggatattgttgcagtagacagtcctattgggcgtttgggccttagtgtttgctatgatttgagatttcctgagctttatcagttgttgcgtttccaacatggagcacagatactattggtgcctgcagcattcactaaagtgactggtgaagcacactgggagattcttcttcgtgctcgtgcaatcgagaatcaatgctatgtcatagctgctgcgcaagctggcacacacaatgacaaaagagaaagttatggtgacacattgattatcgatccatgggggaccgttgttggtcgcttaccagatcgtttgtccacgggaattgtggtagctgatattgatttatcattagttgattcagtaagagagaagatgcctattgctaagcaaaggaagccatttgacttctggaaagctgcttctctatag

SEQ ID NO: 72792 - protein, 283 aa, Medicago truncatula
MATNSVRVAAAQMTSITDLASNFSTCSRLVKEAASAGAKLLCFPEAFSFVGAKDGDSVSIAQPLDGPIMDQYCSLARESSIWLSLGGFQEKGSDPRHLFNTHVVVDDTGKIQTTYRKIHLFDVDVPGGRVYKESNFTESGKDIVAVDSPIGRLGLSVCYDLRFPELYQLLRFQHGAQILLVPAAFTKVTGEAHWEILLRARAIENQCYVIAAAQAGTHNDKRESYGDTLIIDPWGTVVGRLPDRLSTGIVVADIDLSLVDSVREKMPIAKQRKPFDFWKAASL

SEQ ID NO: 72793 - DNA, 879 bp, Aspergillus oryzae
  CDS (1)..(879)
atggccgctctattgaaacagccgttgaaattagccctggtgcagctcgcctccggcgcggacaaagccgttaatttggcccacgctcgcactaaggtcctggaggcagcacaggcaggagccaagctcatcgtccttccggaatgcttcaactcgccatacggaacccaatattttcccaaatacgccgagactcttctcccttcgccccctaccgaagatcaatccccttcctaccatgccctgtcagccatcgctgccgaagccaaggcctacctcgtaggaggtagcatccccgaactagaacccacaacgaagaaatactataacacctccctcgtgttctctcccactggctcgttaatagggacccaccgcaagacccatttgttcgacatcgatattccaggaaagatcactttcaaggagagcgaggtcctgtcgcccggaaaccagttgacaattgttgatcttcccgactatggaaagatcggccttgccatttgctacgatatccgtttcccggaggcggccatgattgctgcgcgaaagggcgcttttgcactcatctacccgggcgcgttcaacatgaccaccggtcccatgcactggtctctgttggcacgcgctcgtgcggtggataaccagctgtatgtggggctgtgtagcccagcgcgcgatatggaggccacttaccacgcatggggtcacagtttgatagccaacccagccgcggaagtcctagtagaggcggaagacaaagagactattgtctatgctgatctggacaatgacaccattcaaagcacaaggaagggcattcctgtctatacgcagaggcggtttgatctgtacccagatgtgagcgctgagaaatag

SEQ ID NO: 72794 - protein, 292 aa, Aspergillus oryzae
MAALLKQPLKLALVQLASGADKAVNLAHARTKVLEAAQAGAKLIVLPECFNSPYGTQYFPKYAETLLPSPPTEDQSPSYHALSAIAAEAKAYLVGGSIPELEPTTKKYYNTSLVFSPTGSLIGTHRKTHLFDIDIPGKITFKESEVLSPGNQLTIVDLPDYGKIGLAICYDIRFPEAAMIAARKGAFALIYPGAFNMTTGPMHWSLLARARAVDNQLYVGLCSPARDMEATYHAWGHSLIANPAAEVLVEAEDKETIVYADLDNDTIQSTRKGIPVYTQRRFDLYPDVSAEK

SEQ ID NO: 72795 - DNA, 783 bp, Aspergillus oryzae
  CDS (1)..(783)
atgactgccaatctggcccagtgccagatactggtgcgcaaagccgttgctgctggagctagagcattgtttctccctgaagcgacagactatatagggtcctcgccagcagaaacaatctcacttgcgcgctccgtgcatgatagtgaattcgtactgggcctgcagaaggaggccgtgcagtctaatttacacataaatgtcggcattcatgaaccatctccggatggaagagtaaagaatacccttatctggatcaatgaaaagggcatcattacacagcgctatcagaaagttcatctatttgatgtagaactcaaaggcggtccggtactgaaggagagcgcgagtgtcgagaaaggcatggaaattttacctccattcgagacccctgttggacatgtcggcttagctatatgcttcgatctccggttccccgaaattagtctggctttgaagcggcaaaatgcccagcttatcacttatccttcagcattcacggttcccacgggaaaggcccattgggaaacactcctacgggccagggctatcgagactcagtcatatgtgatagcagcggcgcaagcagggcctcacaatgaaaaaagaagaagctatggccattcgatgattgtgaacccctggggagagattgtagctcagcttggcgacgaatatacagaaccgcagatcgccttcgcggatattgatttggaccttctagcgaaggttaggagagagataccacttcttagaaggacagatatatatccagaggtataa

SEQ ID NO: 72796 - protein, 260 aa, Aspergillus oryzae
MTANLAQCQILVRKAVAAGARALFLPEATDYIGSSPAETISLARSVHDSEFVLGLQKEAVQSNLHINVGIHEPSPDGRVKNTLIWINEKGIITQRYQKVHLFDVELKGGPVLKESASVEKGMEILPPFETPVGHVGLAICFDLRFPEISLALKRQNAQLITYPSAFTVPTGKAHWETLLRARAIETQSYVIAAAQAGPHNEKRRSYGHSMIVNPWGEIVAQLGDEYTEPQIAFADIDLDLLAKVRREIPLLRRTDIYPEV

SEQ ID NO: 72797 - DNA, 843 bp, Edwardsiella ictaluri
  CDS (1)..(843): transl_table=11
atgaggaatgccaacgtcgccttactgcaactgtgcagcggcgaaaacagccgcgccaacctggcacagattgagcagcagttgaagcaactcaacggcaatatcaggctggcgttgaccccggagaatgcgctgctgttcagcgacgccgcggggtaccgccagcacgctgagcgggagggtgacggtccgcttcaggcggcggtgtgctctctggcacgtcgctacggggtgtggctgttggtcggctcaatgccgctgtacagccgcgaggatgtcggtggcattacctccagcagtctgctgtttgacgacggcggcacgctgcgcgcccgctacgataagctgcacatgttcgacgtcgaggtgcgtgacgcgcacggccgttaccgcgagtctgacgtttaccgtcacggtgaaatggtgacggtggtggatacgccggttggccgcctggggatgaccatttgctacgatctgcgctttcccggcctgttccaggcgctgcgcgcgcagggggcggagattatctcggtaccggctgcttttacccgggtgacgggggaggcgcattgggaggtgctgctgcgcgcccgggcgatagaaaaccagtgctatattctggcgtcggcccaggtcggcagccacggagatacccggcgcacctggggccacagcatggcagtggacggctggggccgcgtgctgcagcagaacaccgacgctgtacggccgataaagattaacgtgaataccaactcactgagcgtgctgcgcgatcagatgccactggcacagcacaaccgattccagcctgagctgatccatcttcaccaagggtaa

SEQ ID NO: 72798 - protein, 280 aa, Edwardsiella ictaluri
MRNANVALLQLCSGENSRANLAQIEQQLKQLNGNIRLALTPENALLFSDAAGYRQHAEREGDGPLQAAVCSLARRYGVWLLVGSMPLYSREDVGGITSSSLLFDDGGTLRARYDKLHMFDVEVRDAHGRYRESDVYRHGEMVTVVDTPVGRLGMTICYDLRFPGLFQALRAQGAEIISVPAAFTRVTGEAHWEVLLRARAIENQCYILASAQVGSHGDTRRTWGHSMAVDGWGRVLQQNTDAVRPIKINVNTNSLSVLRDQMPLAQHNRFQPELIHLHQG

SEQ ID NO: 72799 - DNA, 825 bp, Aspergillus oryzae
  CDS (1)..(825)
atggttattgcagctgtggggcaattatgctcgactgcgagcatgactgccaatctggcccagtgccagatactggtgcgcaaagccgttgctgctggagctagagcattgtttctccctgaagcgacagactatatagggtcctcgccagcagaaacaatctcacttgcgcgctccgtgcatgatagtgaattcgtactgggcctgcagaaggaggccgtgcagtctaatttacacataaatgtcggcattcatgaaccatctccggatggaagagtaaagaatacccttatctggatcaatgaaaagggcatcattacacagcgctatcagaaagttcatctatttgatgtagaactcaaaggcggtccggtactgaaggagagcgcgagtgtcgagaaaggcatggaaattttacctccattcgagacccctgttggacatgtcggcttagctatatgcttcgatctccggttccccgaaattagtctggctttgaagcggcaaaatgcccagcttatcacttatccttcagcattcacggttcccacgggaaaggcccattgggaaacactcctacgggccagggctatcgagactcagtcatatgtgatagcagcggcgcaagcagggcctcacaatgaaaaaagaagaagctatggccattcgatgattgtgaacccctggggagagattgtagctcagcttggcgacgaatatacagaaccgcagatcgccttcgcggatattgatttggaccttctagcgaaggttaggagagagataccacttcttagaaggacagatatatatccagaggtataa

SEQ ID NO: 72800 - protein, 274 aa, Aspergillus oryzae
MVIAAVGQLCSTASMTANLAQCQILVRKAVAAGARALFLPEATDYIGSSPAETISLARSVHDSEFVLGLQKEAVQSNLHINVGIHEPSPDGRVKNTLIWINEKGIITQRYQKVHLFDVELKGGPVLKESASVEKGMEILPPFETPVGHVGLAICFDLRFPEISLALKRQNAQLITYPSAFTVPTGKAHWETLLRARAIETQSYVIAAAQAGPHNEKRRSYGHSMIVNPWGEIVAQLGDEYTEPQIAFADIDLDLLAKVRREIPLLRRTDIYPEV

SEQ ID NO: 72801 - DNA, 951 bp, Arabidopsis thaliana
  CDS (1)..(951)
atgaacgcttactctgtttctctcgacttcactaaaccttctctattcacacgcatcactctctcttctcagattcctctaaccatggccaccactgtaaacaaaacagttcgtgtcgcagctgctcaaatgacatcggtcaatgatctaatgaccaacttcgccacttgctctcgtctcgttcaagaagcagcattggctggtgcaaagctgatttgcttccctgagaacttctcttttgtgggagataaggaaggagagagtgtgaaaattgctgaaccattagatggcccagtgatggaacggtattgctctctcgccagggattcaaatatatggttgtctcttggaggttttcaagagagatttgatgatactcatttgtgtaatacacatgttgtgatcgatgatgctggaatgatccgagacacttatcagaaaatgcatttgtttgatgttgatgttcctggtggaagctcgtacaaagaaagcagctttacagttccagggacaaagattgtttccgtagacagccctgtcgggcgcttaggccttactgtatgctacgatttgaggttccctaagatatatcagcaactgagatttgaacagaaagctcaggttttactagtaccatcagctttcaccaaggtcactggggaggcacactgggagattcttcttcgagcccgagcaattgaaactcaatgttatgtcatagctgctgctcaagcaggaaagcataatgagaaaagagaaagttatggtgacacactgatcattgatccgtggggaactgtagttggaaggttacctgatcgtgtttcgaccggcattgtcgtggcagatattgatttttcattgattgactcagtgagaacaaaaatgccaatagataaggtaaaaatacagacttcacaaacttgtttttctgttggaccaaacggttaa

SEQ ID NO: 72802 - protein, 316 aa, Arabidopsis thaliana
MNAYSVSLDFTKPSLFTRITLSSQIPLTMATTVNKTVRVAAAQMTSVNDLMTNFATCSRLVQEAALAGAKLICFPENFSFVGDKEGESVKIAEPLDGPVMERYCSLARDSNIWLSLGGFQERFDDTHLCNTHVVIDDAGMIRDTYQKMHLFDVDVPGGSSYKESSFTVPGTKIVSVDSPVGRLGLTVCYDLRFPKIYQQLRFEQKAQVLLVPSAFTKVTGEAHWEILLRARAIETQCYVIAAAQAGKHNEKRESYGDTLIIDPWGTVVGRLPDRVSTGIVVADIDFSLIDSVRTKMPIDKVKIQTSQTCFSVGPNG

SEQ ID NO: 72803 - DNA, 957 bp, Arabidopsis thaliana
  CDS (1)..(957)
atggcttcttctttcaaccctgaacaagctagagttccctctgctcttcctctcccagctcctccgttgaccaaattcaacatcggattgtgtcagctatctgttacatctgacaaaaagagaaacatctctcatgctaaaaaagccattgaagaagctgcttctaaaggagctaagcttgttctcttacccgaaatttggaacagtccgtattccaatgatagttttccagtttatgcggaggagattgatgcaggtggtgatgcttctccttcaacggcaatgctttctgaagtttccaaacgtctcaagattacaatcattggtggatctataccagaaagagttggagatcgtttgtataacacttgctgtgtctttggttccgatggagagctaaaagctaagcatcggaagatacatttatttgatatagacattcccgggaagattacttttatggaatccaaaactcttactgctggagagacaccaacaatcgttgacacaggttataatcttggtttgccaaatataattccagatgtagggcgtattggaataggcatctgttatgatatcaggttccaggagttagctatgatatatgctgcaagaggggctcatttgctgtgctacccgggagcctttaacatgacaactggaccattgcattgggaattactacaaagggccagggctacggataatcagttatatgtggcgacatgctcacctgccagagattcaggagctggctacactgcttgggggcactcaacactcgttgggccttttggagaagtactagcaacgactgagcatgaggaggccattatcatagcagagattgattactctatccttgaacaacgaaggactagccttccattgaataggcagcggcggggagatctttaccagcttgtagacgtacagcgcttagactctaaatga

SEQ ID NO: 72804 - protein, 318 aa, Arabidopsis thaliana
MASSFNPEQARVPSALPLPAPPLTKFNIGLCQLSVTSDKKRNISHAKKAIEEAASKGAKLVLLPEIWNSPYSNDSFPVYAEEIDAGGDASPSTAMLSEVSKRLKITIIGGSIPERVGDRLYNTCCVFGSDGELKAKHRKIHLFDIDIPGKITFMESKTLTAGETPTIVDTGYNLGLPNIIPDVGRIGIGICYDIRFQELAMIYAARGAHLLCYPGAFNMTTGPLHWELLQRARATDNQLYVATCSPARDSGAGYTAWGHSTLVGPFGEVLATTEHEEAIIIAEIDYSILEQRRTSLPLNRQRRGDLYQLVDVQRLDSK

SEQ ID NO: 72805 - DNA, 876 bp, Saccharomyces cerevisiae
  CDS (1)..(876)
atgagtgcttcgaagattctttcacaaaaaattaaagttgcgttggtccaactgtcaggctcgagtcctgacaaaatggccaatcttcaaagggctgcaacgttcattgaaagggctatgaaggaacagccggataccaagttggtcgtattgccagaatgcttcaattctccgtactccactgatcagtttagaaagtattcagaagttatcaatccgaaagagccttcgacgtcagttcaatttctgtctaatttagccaataagtttaaaatcatcttggtaggaggaacaattccggaattggatccaaagacagacaaaatctacaacacctctataattttcaacgaggatggcaagttgattgacaagcatcggaaggtccatcttttcgatgtagacattcctaacggtatatcgttccatgaaagtgaaaccttgagccctggagagaagtctactaccattgacacgaaatatggtaagtttggcgtaggtatatgctatgacatgaggtttccggaactcgcaatgctaagtgcacgcaagggtgcgtttgccatgatctaccctagtgcattcaacactgtcacagggcccttgcattggcatttactggcaagaagcagggcagttgacaaccaagtgtacgtgatgttatgttctcccgcaaggaatctacagagttcttaccatgcatatggccactctatagtggtggaccctagaggcaagattgtagctgaagctggcgagggagaagagattatttatgctgaattagatcccgaagtcattgagtcatttagacaagcggtacccttaaccaaacaaagaagatttgacgtgtactccgatgtaaatgcgcattag

SEQ ID NO: 72806 - protein, 291 aa, Saccharomyces cerevisiae
MSASKILSQKIKVALVQLSGSSPDKMANLQRAATFIERAMKEQPDTKLVVLPECFNSPYSTDQFRKYSEVINPKEPSTSVQFLSNLANKFKIILVGGTIPELDPKTDKIYNTSIIFNEDGKLIDKHRKVHLFDVDIPNGISFHESETLSPGEKSTTIDTKYGKFGVGICYDMRFPELAMLSARKGAFAMIYPSAFNTVTGPLHWHLLARSRAVDNQVYVMLCSPARNLQSSYHAYGHSIVVDPRGKIVAEAGEGEEIIYAELDPEVIESFRQAVPLTKQRRFDVYSDVNAH

SEQ ID NO: 72807 - DNA, 819 bp, Synechocystis sp
  CDS (1)..(819): transl_table=11
atgaaaccgtatttagccgctgccctgcaaatgaccagccgccccaacctcaccgagaatttacaagaagcagaggagttgatcgatttggcggtgcgccagggggcagaattggtgggtttgccggagaattttgcttttttgggcaatgaaactgaaaagctagaacaggcaacggcgatcgccacggcgacggaaaaatttttacagaccatggcccaacggttccaggtgactatcctggcggggggctttccctttccggtggcaggggaagcaggcaaagcctataacacagctactctaattgcccccaatgggcaggaattggcccggtaccacaaagtgcatttgtttgatgttaatgtgcccgacggcaatacctactgggaatcggccacggtgatggctgggcaaaaatatcccccagtgtaccactccgacagctttggtaatttggggctgtccatttgctacgacgttcgtttccctgaattgtatcgttacctttcccgccaaggagcagatgttctgtttgtgcccgccgctttcactgcctacaccggcaaggaccattggcaagtgttgctccaggcccgggccattgaaaatacctgctacgtcattgccccggcccaaactggttgtcattacgaaagacggcatacccatgggcatgccatgatcattgacccctggggagtgatcctggccgatgcgggggaaaaaccagggttggcgatcgccgaaattaacccagaccgcctcaaacaggtgcgccaacaaatgccttcgctgcaacatcgggtatttgtctga

SEQ ID NO: 72808 - protein, 272 aa, Synechocystis sp
MKPYLAAALQMTSRPNLTENLQEAEELIDLAVRQGAELVGLPENFAFLGNETEKLEQATAIATATEKFLQTMAQRFQVTILAGGFPFPVAGEAGKAYNTATLIAPNGQELARYHKVHLFDVNVPDGNTYWESATVMAGQKYPPVYHSDSFGNLGLSICYDVRFPELYRYLSRQGADVLFVPAAFTAYTGKDHWQVLLQARAIENTCYVIAPAQTGCHYERRHTHGHAMIIDPWGVILADAGEKPGLAIAEINPDRLKQVRQQMPSLQHRVFV

SEQ ID NO: 72809 - DNA, 969 bp, Schizosaccharomyces pombe
  CDS (1)..(969)
atgaacagtaaattttttggactcgttcaaaaaggcacaagatccttttttccttcattaaatttttgctatacaaggaacatcatgtctgtctcagcttcatctctggttcctaaagattttcgtgcttttcgtattggcttggttcagcttgccaataccaaagacaagagcgaaaatttacaactcgctcgtttaaaagtattggaagccgctaaaaacggttctaatgtcattgtattaccagaaattttcaattcaccatatggtactggttactttaatcagtatgctgaacctatagaggaatcatctccttcttaccaagctttatcctctatggcaaaggatactaagacttacttatttggcggttctattcctgaacgcaaggatggcaaattatacaacactgcaatggtgtttgatccttctggaaaattgatagccgttcatcggaaaattcatttattcgatattgacattcctggtggagttagcttccgcgaatctgatagtctttcacctggcgacgccatgactatggttgacactgaatacgggaagtttggtttgggtatttgttacgatatacgatttccggaactcgctatgatagcagctagaaatggctgtagtgtgatgatttaccctggagcatttaatttgtccacaggccctttacattgggaactacttgcacgagcccgagcagttgataatgagatgttcgttgcttgctgtgcccctgctagagatatgaacgctgactatcattcatggggacattctactgttgtagaccctttcggaaaagttattgctactactgatgaaaaaccgtctatcgtttacgcagatattgatccctctgtcatgtctaccgctcgaaacagcgttcctatctatactcaacgccgctttgatgtttattcagaagtattacctgctcttaagaaagaggaatag

SEQ ID NO: 72810 - protein, 322 aa, Schizosaccharomyces pombe
MNSKFFGLVQKGTRSFFPSLNFCYTRNIMSVSASSLVPKDFRAFRIGLVQLANTKDKSENLQLARLKVLEAAKNGSNVIVLPEIFNSPYGTGYFNQYAEPIEESSPSYQALSSMAKDTKTYLFGGSIPERKDGKLYNTAMVFDPSGKLIAVHRKIHLFDIDIPGGVSFRESDSLSPGDAMTMVDTEYGKFGLGICYDIRFPELAMIAARNGCSVMIYPGAFNLSTGPLHWELLARARAVDNEMFVACCAPARDMNADYHSWGHSTVVDPFGKVIATTDEKPSIVYADIDPSVMSTARNSVPIYTQRRFDVYSEVLPALKKEE

SEQ ID NO: 72811 - DNA, 26 bp, Artificial sequence
  primer
atgactagtaaattaaaacgggttgc

SEQ ID NO: 72812 - DNA, 26 bp, Artificial sequence
  primer
tcaatgaaataaatcgtctcttctct

SEQ ID NO: 72813 - protein, 347 aa, Artificial sequence
  consensus sequence
  Variant (2)..(3): Xaa in position 2 to 3 is any amino acid
  Variant (5)..(6): Xaa in position 5 to 6 is any amino acid
  Variant (8)..(10): Xaa in position 8 to 10 is any amino acid
  Variant (11)..(14): Xaa in position 11 to 14 is any or no amino acid
  Variant (16)..(16): Xaa in position 16 is any amino acid
  Variant (17)..(25): Xaa in position 17 to 25 is any or no amino acid
  Variant (27)..(29): Xaa in position 27 to 29 is any amino acid
  Variant (30)..(37): Xaa in position 30 to 37 is any or no amino acid
  Variant (39)..(41): Xaa in position 39 to 41 is any amino acid
  Variant (42)..(43): Xaa in position 42 to 43 is any or no amino acid
  Variant (46)..(72): Xaa in position 46 to 72 is any amino acid
  Variant (73)..(83): Xaa in position 73 to 83 is any or no amino acid
  Variant (85)..(89): Xaa in position 85 to 89 is any amino acid
  Variant (90)..(93): Xaa in position 90 to 93 is any or no amino acid
  Variant (95)..(112): Xaa in position 95 to 112 is any amino acid
  Variant (113)..(126): Xaa in position 113 to 126 is any or no amino acid
  Variant (128)..(132): Xaa in position 128 to 132 is any amino acid
  Variant (133)..(135): Xaa in position 133 to 135 is any or no amino acid
  Variant (137)..(137): Xaa in position 137 is any amino acid
  Variant (139)..(139): Xaa in position 139 is any amino acid
  Variant (144)..(148): Xaa in position 144 to 148 is any amino acid
  Variant (149)..(160): Xaa in position 149 to 160 is any or no amino acid
  Variant (163)..(167): Xaa in position 163 to 167 is any amino acid
  Variant (169)..(181): Xaa in position 169 to 181 is any amino acid
  Variant (182)..(192): Xaa in position 182 to 192 is any or no amino acid
  Variant (194)..(196): Xaa in position 194 to 196 is any amino acid
  Variant (200)..(200): Xaa in position 200 is any amino acid
  Variant (204)..(204): Xaa in position 204 is any amino acid
  Variant (206)..(217): Xaa in position 206 to 217 is any amino acid
  Variant (218)..(228): Xaa in position 218 to 228 is any or no amino acid
  Variant (230)..(230): Xaa in position 230 is any amino acid
  Variant (234)..(235): Xaa in position 234 to 235 is any amino acid
  Variant (236)..(236): Xaa in position 236 is any or no amino acid
  Variant (239)..(240): Xaa in position 239 to 240 is any amino acid
  Variant (243)..(244): Xaa in position 243 to 244 is any amino acid
  Variant (246)..(247): Xaa in position 246 to 247 is any amino acid
  Variant (251)..(251): Xaa in position 251 is any amino acid
  Variant (253)..(258): Xaa in position 253 to 258 is any amino acid
  Variant (260)..(261): Xaa in position 260 to 261 is any amino acid
  Variant (263)..(263): Xaa in position 263 is any amino acid
  Variant (265)..(269): Xaa in position 265 to 269 is any amino acid
  Variant (270)..(291): Xaa in position 270 to 291 is any or no amino acid
  Variant (294)..(297): Xaa in position 294 to 297 is any amino acid
  Variant (302)..(308): Xaa in position 302 to 308 is any amino acid
  Variant (309)..(342): Xaa in position 309 to 342 is any or no amino acid
  Variant (344)..(346): Xaa in position 344 to 346 is any amino acid
AXXQXXSXXXXXXXNXXXXXXXXXXAXXXXXXXXXXXAXXXXXPEXXXXXXXXXXXXXXXXXXXXXXXXXXXXXXXXXXXXXXAXXXXXXXXXGXXXXXXXXXXXXXXXXXXXXXXXXXXXXXXXXGXXXXXXXXYXKXHLFDXXXXXXXXXXXXXXXXXESXXXXXGXXXXXXXXXXXXXXXXXXXXXXXXGXXXCYDXRFPXLXXXXXXXXXXXXXXXXXXXXXXXPXAFTXXXTGXXHWXXLXXARAXEXXXXXXAXXQXGXXXXXXXXXXXXXXXXXXXXXXXXXXXGHXXXXDPWGXXXXXXXXXXXXXXXXXXXXXXXXXXXXXXXXXXXXXXXXXRXXXP

SEQ ID NO: 72814 - protein, 17 aa, Artificial sequence
  protein pattern
  Variant (3)..(3): Xaa in position 3 is any amino acid
  Variant (4)..(4): Xaa in position 4 is Ala or Asp
  Variant (7)..(8): Xaa in position 7 to 8 is any amino acid
  Variant (10)..(10): Xaa in position 10 is Ala, Gly, Ile, Leu or Val
  Variant (11)..(11): Xaa in position 11 is any amino acid
  Variant (15)..(15): Xaa in position 15 is Ile, Leu or Val
  Variant (16)..(16): Xaa in position 16 is Asp or Glu
  Variant (17)..(17): Xaa in position 17 is Asn, Ser or Thr
TGXXHWXXLXXARAXXX

SEQ ID NO: 72815 - protein, 10 aa, Artificial sequence
  protein pattern
  Variant (2)..(2): Xaa in position 2 is any amino acid
  Variant (3)..(3): Xaa in position 3 is Ala, Ser or Thr
  Variant (4)..(4): Xaa in position 4 is any amino acid
  Variant (5)..(5): Xaa in position 5 is Ile, Leu or Val
  Variant (6)..(6): Xaa in position 6 is Ala, Ile or Val
  Variant (7)..(7): Xaa in position 7 is Ala, Asp, Glu, Gly, Asn or Ser
GXXXXXXPWG

SEQ ID NO: 72816 - protein, 9 aa, Artificial sequence
  protein pattern
  Variant (2)..(2): Xaa in position 2 is any amino acid
  Variant (4)..(4): Xaa in position 4 is Leu or Met
  Variant (7)..(7): Xaa in position 7 is Ile or Val
  Variant (8)..(8): Xaa in position 8 is any amino acid
  Variant (9)..(9): Xaa in position 9 is Ile, Leu or Val
KXHXFDXXX

SEQ ID NO: 72817 - DNA, 315 bp, Saccharomyces cerevisiae
  CDS (1)..(315)
atgttaaggagggaaacttcaacaatatacaggacacacaaaaaaagcaacagtagtatactcaggagccagcgggaccagactagagtggattccttggtagaggagtctcccatgggcgatttcgggatcaataaccagcctacacagcctggcgtgatatactactttgtagagctgactaatttaggcatacaggaaaacacaagcagtaataataacaacaacaataatcatggtgacgatgaaaacggcagtcgatacggccacggcagcagtctgggtggagacgttcactctcgccgttgttcatga

SEQ ID NO: 72818 - protein, 104 aa, Saccharomyces cerevisiae
MLRRETSTIYRTHKKSNSSILRSQRDQTRVDSLVEESPMGDFGINNQPTQPGVIYYFVELTNLGIQENTSSNNNNNNNHGDDENGSRYGHGSSLGGDVHSRRCS

SEQ ID NO: 72819 - DNA, 25 bp, Artificial sequence
  primer
atgttaaggagggaaacttcaacaa

SEQ ID NO: 72820 - DNA, 23 bp, Artificial sequence
  primer
tcatgaacaacggcgagagtgaa

SEQ ID NO: 72821 - DNA, 528 bp, Saccharomyces cerevisiae
  CDS (1)..(528)
atggtccttttacacaaaagcacacatatatttcctaccgattttgcctctgtttcacgcgccttttttaatagataccccaatccatactccccccatgtactatccatagacacaatatcaaggaacgttgatcaagaaggaaatttgcgcacaacgaggctgttgaaaaagtccggaaagctgcccacatgggtcaaaccctttttaagaggtataacagaaacatggataatcgaagtttccgtagtgaaccccgctaactccacaatgaaaacttacactaggaatctggatcacactggaatcatgaaggttgaagaatatactacctatcaatttgacagtgctacaagtagtacgatagcagacagccgggtgaagttttcaagtggcttcaatatgggtatcaaatctaaggtagaggattggtcgcgcactaaatttgacgaaaacgttaagaaaagcagaatgggcatggcatttgttatccaaaaactcgaagaggcgagaaatcctcagttttga

SEQ ID NO: 72822 - protein, 175 aa, Saccharomyces cerevisiae
MVLLHKSTHIFPTDFASVSRAFFNRYPNPYSPHVLSIDTISRNVDQEGNLRTTRLLKKSGKLPTWVKPFLRGITETWIIEVSVVNPANSTMKTYTRNLDHTGIMKVEEYTTYQFDSATSSTIADSRVKFSSGFNMGIKSKVEDWSRTKFDENVKKSRMGMAFVIQKLEEARNPQF

SEQ ID NO: 72823 - DNA, 552 bp, Arabidopsis thaliana
  CDS (1)..(552)
atggtaaaagcatacagacaagagcatgtttacaagcatccgtgggagcgggtgagtgctgcttcatggaggaagtttgcagaccctgaaaacaaacgcatcctttctcacatccttgaagtcgataccttgaacaggaaactcgacactgagaccgggaaactccacaccacgcgtgctctcaccatccatgctcctggtccatggtttctccataggatcattggtcaggacatctgtcactgtgttgaatcaacagttgtagatggcaaatcacgttctatgcagctaacaacaaagaacattagtctcaaaaagttcattgaagtggaggagaggataagatatgatccgcatccagataatccatcagcctggactgtttgtagccaggagacaagcattcggatcaaacccttgtcggctctggcctcaatggctgagaaggttgaacagaagtgcgcagagaaattcatgcagaatagcgctaaaggaagagaggttatggagaggatttgtaagtatatggaagcagaatccgctcggatctaa

SEQ ID NO: 72824 - protein, 183 aa, Arabidopsis thaliana
MVKAYRQEHVYKHPWERVSAASWRKFADPENKRILSHILEVDTLNRKLDTETGKLHTTRALTIHAPGPWFLHRIIGQDICHCVESTVVDGKSRSMQLTTKNISLKKFIEVEERIRYDPHPDNPSAWTVCSQETSIRIKPLSALASMAEKVEQKCAEKFMQNSAKGREVMERICKYMEAESARI

SEQ ID NO: 72825 - DNA, 516 bp, Schizosaccharomyces pombe 972h-
  CDS (1)..(516)
atgactgcaatatgtactgacaaaaccgagttaaatgcttcctggaatacagtctcttcagcttggctcactagatatccaaatccgtatagtcttcacgtagtctcagctgatgtactcgagcgatatgtggatgatgaaggtcgactatataccgaaagattacttgttaaacagggaagactgcccagatgggcatcggatcttttgaatgttaacaagtcttacatactcgaaagatctgtcattgatccctcaaagcaggaattaaaatccgaaacgttcaatttggatcatgtgaaaattctccgcgtaatagagtacagtcgatttatccaaagctcagaaaactgctcaaaaactatagtagacacgattgccaagtttgtctcacccttaagatttggtcttggtcgtagggttcaaaagtacagtctaaaacgatttcaagaacagctatcgagctctcgtcgcgggcttttatatgtaatccaacaaaagtttcaaccttcttaa

SEQ ID NO: 72826 - protein, 171 aa, Schizosaccharomyces pombe 972h-
MTAICTDKTELNASWNTVSSAWLTRYPNPYSLHVVSADVLERYVDDEGRLYTERLLVKQGRLPRWASDLLNVNKSYILERSVIDPSKQELKSETFNLDHVKILRVIEYSRFIQSSENCSKTIVDTIAKFVSPLRFGLGRRVQKYSLKRFQEQLSSSRRGLLYVIQQKFQPS

SEQ ID NO: 72827 - DNA, 522 bp, Eremothecium gossypii
  CDS (1)..(522)
atggttttatggtacaagaacacgcatgtgttcgagcgggacttccaaacggtgtcgctggcgttcttcaaccggtacccgaacccctatgcggcccacgtactgtcgatcgacacgatcgcgcgcgacgtcgacgccgacgggcgcctccacaccacccggctgatcaagaagatgggcaagctgcccgcgtgggcgcggccgctgctggggcgcatctccgagtcgtggatcatcgagatgagcagcgtggacgccgcgcgccaggagatgcgcacctacacgcgcaatctggaccacaccaaggtcatcaaggtcgaggagtacacttgctaccgcttccgcgacggcgccacggtcgccgacagccgcgtgcgcttcagcagcggcatccgcatgggcatcaagggccgcatcgagagctggtcgcaccgcacgttcgacgagaacatcaagcgcagccggctcggcatggccttcgtcatggacaagctggaggagcgcgcgaagctgctgctctag

SEQ ID NO: 72828 - protein, 173 aa, Eremothecium gossypii
MVLWYKNTHVFERDFQTVSLAFFNRYPNPYAAHVLSIDTIARDVDADGRLHTTRLIKKMGKLPAWARPLLGRISESWIIEMSSVDAARQEMRTYTRNLDHTKVIKVEEYTCYRFRDGATVADSRVRFSSGIRMGIKGRIESWSHRTFDENIKRSRLGMAFVMDKLEERAKLLL

SEQ ID NO: 72829 - DNA, 699 bp, Magnaporthe grisea 70-15
  CDS (1)..(699)
atggttctcacccacacaaccaaccacacatactcccacccgtttccaactgtaacccttgccttcttcctccgctactgctcgccgcagatcaacccttttgcggcccatgtactcagtaccgatacaatctcgagccacgtggatgccgatggcagactacacacaactcgcatccacttgaaaaagtcacgtctgcctggggccgtcttcaagttgcttccaacgagtattaccggcggcgggtcaaacaacaaggcatcatatgtgctcgaaacgagcatcgtagacatacgagaaggttggatgaagactgagagtcgaaatctcaactttgtcggagttttatctgtcgtggagaagcagacatacaccacaccgaccgaggcaaacaacaatgctactaccaccaacgtcgaaacaaatgttgtctttcggtctaggcttggggagaagcttagggagaagatcggacagtcacagcagcagcaagagcctcgagagggctggttctcgcgtcttgggaccaagggcatccagcggagtatcgagaacatggcgtctaccaagaccctggatcagcttggcaagagtcgcgagggtatgctggtggtgctcgagaggttgcgtaataccggcctcgtcaacataatggagcttaccagaagagccaaggaagcgcagtccggcacagtctga

SEQ ID NO: 72830 - protein, 232 aa, Magnaporthe grisea 70-15
MVLTHTTNHTYSHPFPTVTLAFFLRYCSPQINPFAAHVLSTDTISSHVDADGRLHTTRIHLKKSRLPGAVFKLLPTSITGGGSNNKASYVLETSIVDIREGWMKTESRNLNFVGVLSVVEKQTYTTPTEANNNATTTNVETNVVFRSRLGEKLREKIGQSQQQQEPREGWFSRLGTKGIQRSIENMASTKTLDQLGKSREGMLVVLERLRNTGLVNIMELTRRAKEAQSGTV

SEQ ID NO: 72831 - DNA, 564 bp, Magnaporthe grisea 70-15
  CDS (1)..(564)
atgaaggtctttacaaacaaggacactttcaactactcatgggaggaggtgtcgacggccaactggaggaaatactgcccatggaacgacaagtcgacgcatgtcatcgccgtcgacaccatctcgcgttccgtcgactcccagaccggtatcctgcgcaccgagaggctcatcacctgccggcaaaacgccccggactgggtgtgcaaagtactcggcgccagcaatggcgagtcgctcatgtacgaggtgtcgtacgtcgacgcggcgaacaaaaaggtcactatggtctcgcagaacatgacgtggtcaaacctgataaacgtccaggagaccgttgtctacagcccgctcaacgacaagcagacccagttcgttcaggacgccaagatcaccgctctgtgcggcggctggcagaagatcaggaactcgatcgaggacgccatagtcacccgtttccgtgagaacgccgccaagggccgcgagggcttcgagtccgtcctggccatgagcaggcgtgtctttgccgaggagagggctcgtcaggttgtcatggctcaatga

SEQ ID NO: 72832 - protein, 187 aa, Magnaporthe grisea 70-15
MKVFTNKDTFNYSWEEVSTANWRKYCPWNDKSTHVIAVDTISRSVDSQTGILRTERLITCRQNAPDWVCKVLGASNGESLMYEVSYVDAANKKVTMVSQNMTWSNLINVQETVVYSPLNDKQTQFVQDAKITALCGGWQKIRNSIEDAIVTRFRENAAKGREGFESVLAMSRRVFAEERARQVVMAQ

SEQ ID NO: 72833 - DNA, 699 bp, Gibberella zeae PH-1
  CDS (1)..(699)
atggttctcactcgcacgacaaaccacacctactcccacccgttccctaccgtcactctcgcctactttctacgatactcgtctcctcaacttaatcccttcgccgcccatgttctcagcaccgacactatcgagaactatgtcgacccaaagactagccgacttcacaccactcgcatccacttgaaaaagagtcgaatgcccagtgctgtatacaagctactccctgccagtgttactggtggtggctctggcgacaagacttcatacattatggagacgagcgttgtcgatatcaaggagggttggatgaagacggagatgcgaaacctcgacttcacgggtattctctctgtggtcgagaagcaggagtttaatatccccaacgagggcacggcccagaatcccaacgagaccgctgtgacgactatggttcagttcagatcgaggatcggagataagattcggggtaagttgggccaagctcaagaagacggctggttcaagaatggcatcatcggtagctggggcaagaagggtattcaacgcagcatcgagagtatcgcctctaccaaaactcaggatcagatgggcaagagccgtgacggcatgaagatggttctcgagcgcctgcgcaacaacggtgtgattggcgtcctcgagaccattaggagagaacgtcagcgtcaacttgcttaa

SEQ ID NO: 72834 - protein, 232 aa, Gibberella zeae PH-1
MVLTRTTNHTYSHPFPTVTLAYFLRYSSPQLNPFAAHVLSTDTIENYVDPKTSRLHTTRIHLKKSRMPSAVYKLLPASVTGGGSGDKTSYIMETSVVDIKEGWMKTEMRNLDFTGILSVVEKQEFNIPNEGTAQNPNETAVTTMVQFRSRIGDKIRGKLGQAQEDGWFKNGIIGSWGKKGIQRSIESIASTKTQDQMGKSRDGMKMVLERLRNNGVIGVLETIRRERQRQLA

SEQ ID NO: 72835 - DNA, 555 bp, Candida glabrata CBS 138
  CDS (1)..(555)
atggttttggttcataggagtgtgcatgtgtttgagaatgactttgcgtctgtgtcctgtgcgttcttcaaccggtacccgaacccatactcgcggacagtgaagtcgatagacacgttgaaccagcaggtgctggacggcaagctgcacacgacgcggttgctgcggaagaccgggaacatgcctgtgtgggctcgtcctttcctcgggaggatatctgagtcctgggtgatagaggtgtctgtggtggacccgcagcgcgggaggatggagacgttcaccaagaacctggaccacaccaggatcatgcaggtggaggagtacagcacatacgactacaacttcgagacgcggaagaccagcgtggtgagccgagtgaagttttccagtgggttcaccacggggctgcgtgagcgtctggagaactggtcgaggtccatattcgacgagaacgtcaagtacagcaggcaaggtatgctgtttgtgatgaagaagatcgaagagaagaggaacaagaggtccttgctgcagcaaatccagaacatcgagccttga

SEQ ID NO: 72836 - protein, 184 aa, Candida glabrata CBS 138
MVLVHRSVHVFENDFASVSCAFFNRYPNPYSRTVKSIDTLNQQVLDGKLHTTRLLRKTGNMPVWARPFLGRISESWVIEVSVVDPQRGRMETFTKNLDHTRIMQVEEYSTYDYNFETRKTSVVSRVKFSSGFTTGLRERLENWSRSIFDENVKYSRQGMLFVMKKIEEKRNKRSLLQQIQNIEP

SEQ ID NO: 72837 - DNA, 555 bp, Candida glabrata CBS 138; identical to SEQ ID NO: 72835
  CDS (1)..(555)

SEQ ID NO: 72838 - protein, 184 aa, Candida glabrata CBS 138; identical to SEQ ID NO: 72836

SEQ ID NO: 72839 - DNA, 675 bp, Candida glabrata CBS 138
  CDS (1)..(675)
atgagactatttcagaatacatgcgagtttgcgtatccgtgggatcaggttactgctgcgaactggaacaagtatccgaacgaggtgtctacgcatgtggttgctgtggatgtgctgaggcgggagctgtctgcgagcgggaggcagctggtgacggagcggttgatcactgtcaagcagagtgtgccgcggtgggtgctgctggtggtgggtgcctctaagcagagctatgtgcgggaggtgtctaccgtggacctggacacgcggacgctgacgatgcggagttgcaacctgaccttctggaacatcatgaaggtgtacgagaccgtgaagtacatgccggacgctgtgaacccggacaagaccgtgttcaagcaggaggcgcagatcagcgtgtgtggcacgctgggcaggttctgcaacaaagtcgaggagtggagcgtgcagaggttcggcgagaacgcaaagaaaggtaagatggggtttgacctggtgctaaaagtgttcaacgagcactggaaccagatcaacagcgacatagaaaacgtcttcaacgagaccgtcgaggacgtcaggtctaccgccgggaacttgatcaaagaaacggagagaacgtactctaacatcctcggcaccaaccaagagatattctctgaagcattcaacaagaaatga

SEQ ID NO: 72840 - protein, 224 aa, Candida glabrata CBS 138
MRLFQNTCEFAYPWDQVTAANWNKYPNEVSTHVVAVDVLRRELSASGRQLVTERLITVKQSVPRWVLLVVGASKQSYVREVSTVDLDTRTLTMRSCNLTFWNIMKVYETVKYMPDAVNPDKTVFKQEAQISVCGTLGRFCNKVEEWSVQRFGENAKKGKMGFDLVLKVFNEHWNQINSDIENVFNETVEDVRSTAGNLIKETERTYSNILGTNQEIFSEAFNKK

SEQ ID NO: 72841 - DNA, 525 bp, Kluyveromyces lactis NRRL Y-1140
  CDS (1)..(525)
atggtcctctggcataataattcacatacgtttggaaattcattcgatgctgtcaccatagcattttttaaccgatacccaaacccatatgcctctcatgttttgagtatcgacactctttctagacgtgtcgatgatgatgggagacttatatctattagattgattaaaaagatggggaagcttcccaattgggtgaaaccttttcttggaaagatatctgaatcctggatcattgaacattcagtggtcgataccaagaagggagaaatgctgacttatactaggaatttagatcatacgaagattataaaagtggaagaatatactaggtttgaaaaagacgggaatagcactcaggtgaaatccatggtcaagttcagtagtggatttgggattgggattagaaacagaatcgagagctggtcacatagcaagttcgatgagaatattcagaagagcaggaagggcatgactttcgttttgcaaagactggatctctcgttaaacaaaacttcgagctga

SEQ ID NO: 72842 - protein, 174 aa, Kluyveromyces lactis NRRL Y-1140
MVLWHNNSHTFGNSFDAVTIAFFNRYPNPYASHVLSIDTLSRRVDDDGRLISIRLIKKMGKLPNWVKPFLGKISESWIIEHSVVDTKKGEMLTYTRNLDHTKIIKVEEYTRFEKDGNSTQVKSMVKFSSGFGIGIRNRIESWSHSKFDENIQKSRKGMTFVLQRLDLSLNKTSS

SEQ ID NO: 72843 - DNA, 534 bp, Debaryomyces hansenii CBS767
  CDS (1)..(534)
atggttcaagtatttgagaatgcccatgtgtttaaccacgatttccccacggttagtcttgcatatttgaataggtaccccaatccgtacgcaaagcatgtcttgagtattgatactcttgacagatatatggacacggatgggtgtctcaggaccaccaagataattgtaaagaccgggaggttgcccaagtttatcaagccgtttttagggacgcatttggactcgtggatcatcgagaagaccatcatcaaccccaaaactaaccaaatgctctcatacacatcgaatgtggaccacaggaaattcattaggatcgaggagtacatgaagtactctgcagatagtccatttagtacattggtggagagcaaggtgaggttttcctccaacttgtttggattcaagcagaaaattgaagagtggagccgcaacaggttctcatcaaacatggccaattctagagaaggattgaagtatgtggttgacaaattgaacgagaggaaagaggtatggatgaggagaagtacgtag

SEQ ID NO: 72844 - protein, 177 aa, Debaryomyces hansenii CBS767
MVQVFENAHVFNHDFPTVSLAYLNRYPNPYAKHVLSIDTLDRYMDTDGCLRTTKIIVKTGRLPKFIKPFLGTHLDSWIIEKTIINPKTNQMLSYTSNVDHRKFIRIEEYMKYSADSPFSTLVESKVRFSSNLFGFKQKIEEWSRNRFSSNMANSREGLKYVVDKLNERKEVWMRRST

SEQ ID NO: 72845 - DNA, 591 bp, Oryza sativa (japonica cultivar-group)
  CDS (1)..(591)
atggtggtgtacacgcaggagcacgtgtaccggcacccgtgggaccgcgtcacggcggcggcgtggcggaagttcaccgacccggcgtcgcgcacggcgctctcccacgtcgccgacgtccacaccctccaccgccgcgtcgacccggaggcggggcggctgcaggctgcgcgctccatcacggtgcgctccccgccgctccccttcatcctccgccgcctcctccccgccgcggcgtcgtccccgtccggcgcggcgctctgccactgcgtcgagacctcgctcgtcgacgcgccgcgccgcgccatggacgtcgtcgtccgcaacgtctccctccgcggcctcatcgaggtcgaggagcggtccacctaccggccgcacccggagcggcccgaggagtggacgcagttcaggcaggagaccacgatccggtgccgaccgctctcggccctcgccgccgtcgcggagaaggtcgagacccgctgcgccgagagattcctgcagaacagcgccaaggggagggaggtcgtcgagcggatctgccggtatctcgaggccgaggccgccggtgctgcatcctccgccatctga

SEQ ID NO: 72846 - protein, 196 aa, Oryza sativa (japonica cultivar-group)
MVVYTQEHVYRHPWDRVTAAAWRKFTDPASRTALSHVADVHTLHRRVDPEAGRLQAARSITVRSPPLPFILRRLLPAAASSPSGAALCHCVETSLVDAPRRAMDVVVRNVSLRGLIEVEERSTYRPHPERPEEWTQFRQETTIRCRPLSALAAVAEKVETRCAERFLQNSAKGREVVERICRYLEAEAAGAASSAI

SEQ ID NO: 72847 - DNA, 549 bp, Yarrowia lipolytica CLIB122
  CDS (1)..(549)
atggtcaagttcttccagtccagccattcccacgacttttccaccgtctccctggcttttttcaaccggtaccccaacccgtacgcctcgcacgtgcttgccgccgacacaattgagcgatatgtggacacagatggaaatctgcacaccacgcgtctaattctcaagcagggccggctgcctaggttcgtcaagcctttcctcaagcacatttctgagtcttggattatcgagaagtctgttgtcgaccccaagcagatggagatggagacctggagctcgaatctcgagcaccgatacatcctcaaggtcgaggagcgaaccacgtatcgacgtgagggcgccggaacctggtcgcagaaccaggtctcctttgttagcaactttgccggctggggagtcaaggaccgaatcgaaaagtggtccctcgaccgatttggggagaacaccgctaagagccgacagggcatggcctttgtcatggacctgctcaaggagaagggtctgatgcatttccagcgagttcagcttggacatgacttcaagtaa

SEQ ID NO: 72848 - protein, 182 aa, Yarrowia lipolytica CLIB122
MVKFFQSSHSHDFSTVSLAFFNRYPNPYASHVLAADTIERYVDTDGNLHTTRLILKQGRLPRFVKPFLKHISESWIIEKSVVDPKQMEMETWSSNLEHRYILKVEERTTYRREGAGTWSQNQVSFVSNFAGWGVKDRIEKWSLDRFGENTAKSRQGMAFVMDLLKEKGLMHFQRVQLGHDFK

SEQ ID NO: 72849 - DNA, 567 bp, Aspergillus nidulans FGSC A4
  CDS (1)..(567)
atgaaggtcttttcatctctttgcacgttcgactactcgtgggaggaggtttcaaccgccaactggaggaaatattgtccctggaatgataagtcgacgcatgttgtgggggtagatactctctcgcggggggtggaccccgagacaggaattttgcgaactgagcgattgatcacatgcaaccaatccgtaccgcaatgggtatcgtcgttgtttggaggtagcccgacctcccatgtttacgaggtttcatatgtcgaccctatttccaagaaagtaacaatgtgctcgacaaaccttacatgggccaatgttttgaacgtgcgcgagactgtcatctaccaaccgtcggtgacaaacccttcgtctaagaccgaatttcagcaggaagcgaagataactgctctctgcggaggctggcaaaagattaagaacaaggtggaagaggcaagcgtcgagcgatttagagaaaatgccaagcgtggcagggaaggcttcgaagccgtccttgagatgagtcgacgagttttcagcgagcagcgcgctctcgaatccagcgtggcatga

SEQ ID NO: 72850 - protein, 188 aa, Aspergillus nidulans FGSC A4
MKVFSSLCTFDYSWEEVSTANWRKYCPWNDKSTHVVGVDTLSRGVDPETGILRTERLITCNQSVPQWVSSLFGGSPTSHVYEVSYVDPISKKVTMCSTNLTWANVLNVRETVIYQPSVTNPSSKTEFQQEAKITALCGGWQKIKNKVEEASVERFRENAKRGREGFEAVLEMSRRVFSEQRALESSVA

SEQ ID NO: 72851 - DNA, 801 bp, Aspergillus oryzae
  CDS (1)..(801)
atgaagttcttcgagaacgtatttacttacgattactccttccctgctgtctctcttgcctacttcctgcgctatcctaacccgtattctcgccatgtcctcacgactgatgttatcgatcgctacgtcgatcccaagacacagcgtctccatacaattcgccttcatttaaagaaatcaaaagtccccgctggcatactcaaattgcttcccaagggcatgggaggatccgacaattccggtcaaagctatattctagagaccacggtcgtcgaccccaaggaaggctggatggaaagtgaatcacgtaacatggaatggactggtatcctcagtgtcgttgagaagcaggtttaccaacgtcagccaattgaaggggctcttgatagtctcgaggggcttgcccttgacgacaagagaggcgagcagacgaccgtgaagacgaccgtcacgttccgttctcgtttcggacaaggaaagctgctcggaagaagaaagtcagacccaattggtgaccacaatgtcgaggctgaagaggatgcgccgaagaggggctttttctcctctctatcaaccgctggtattcagcggacaattgaactcattggggtgaagcggacccgggatgctgtgcttaagagcaaacaaggcatgaatgttgtcttagaacgtttgcgtagcggtggaatagtcggtgtcctcgaggggatgcgccaggatcgggaggcagcctttggacctgaaggcccttggaagcgtgtttgggccaggggccatgcacatatcgaagacgatgactag

SEQ ID NO: 72852 - protein, 266 aa, Aspergillus oryzae
MKFFENVFTYDYSFPAVSLAYFLRYPNPYSRHVLTTDVIDRYVDPKTQRLHTIRLHLKKSKVPAGILKLLPKGMGGSDNSGQSYILETTVVDPKEGWMESESRNMEWTGILSVVEKQVYQRQPIEGALDSLEGLALDDKRGEQTTVKTTVTFRSRFGQGKLLGRRKSDPIGDHNVEAEEDAPKRGFFSSLSTAGIQRTIELIGVKRTRDAVLKSKQGMNVVLERLRSGGIVGVLEGMRQDREAAFGPEGPWKRVWARGHAHIEDDD

SEQ ID NO: 72853 - DNA, 573 bp, Aspergillus oryzae
  CDS (1)..(573)
atgaaggtcttctcctctacttgtactttcgattactcttgggaggaggtatcaacggcgaactggcgcaagtactgcccgtggaatgacaagtccacacatgttgtggcggtagacacgttatcccggactattgactcagaaactggtatcttgcgcacagagcgtcttattacatgtgatcaatccgtgccgcaatgggttctttctcttttcggaggaagcgctacctcgcatgtttacgaggtctcctacgttgacccaaaatcgaagaaagttacaatgtgctcgaccaacctcacatggtccaatgttttgaatgtccaagagactgtcacctatcaaccatcctcagcgaagccggcttgtaccacgaatttcaaccaggaagccaagatcactgctctctgcggcgggtggcaaaagatcaagaacaaggtagaagaggcaagtgtggagagattcagtcaaaacgctaaaaggggtcgagaagggtttgaggccgtgcttgagatgagtcgacgggtattcggtgaacaacgcgagcgtgagaacgatagacttcagtcatga

SEQ ID NO: 72854 - protein, 190 aa, Aspergillus oryzae
MKVFSSTCTFDYSWEEVSTANWRKYCPWNDKSTHVVAVDTLSRTIDSETGILRTERLITCDQSVPQWVLSLFGGSATSHVYEVSYVDPKSKKVTMCSTNLTWSNVLNVQETVTYQPSSAKPACTTNFNQEAKITALCGGWQKIKNKVEEASVERFSQNAKRGREGFEAVLEMSRRVFGEQRERENDRLQS

SEQ ID NO: 72855 - DNA, 564 bp, Magnaporthe grisea
  CDS (1)..(564)
atgaaggtctttacaaacaaggacactttcaactactcatgggaggaggtgtcgacggccaactggaggaaatactgcccatggaacgacaagtcgacgcatgtcatcgccgtcgacaccatctcgcgttccgtcgactcccagaccggtatcctgcgcaccgagaggctcatcacctgccggcaaaacgccccggactgggtgtgcaaagtactcggcgccagcaatggcgagtcgctcatgtacgaggtgtcgtacgtcgacgcggcgaacaaaaaggtcactatggtctcgcagaacatgacgtggtcaaacctgataaacgtccaggagaccgttgtctacagcccgctcaacgacaagcagacccagttcgttcaggacgccaagatcaccgctctgtgcggcggctggcagaagatcaggaactcgatcgaggacgccatagtcacccgtttccgtgagaacgccgccaagggccgcgagggcttcgagtccgtcctggccatgagcaagcgtggctttgccgaggagagggctcgtcaggttgtcatggctcaatga

SEQ ID NO: 72856 - protein, 187 aa, Magnaporthe grisea
MKVFTNKDTFNYSWEEVSTANWRKYCPWNDKSTHVIAVDTISRSVDSQTGILRTERLITCRQNAPDWVCKVLGASNGESLMYEVSYVDAANKKVTMVSQNMTWSNLINVQETVVYSPLNDKQTQFVQDAKITALCGGWQKIRNSIEDAIVTRFRENAAKGREGFESVLAMSKRGFAEERARQVVMAQ

SEQ ID NO: 72857 - DNA, 25 bp, Artificial sequence
  primer
atggtccttttacacaaaagcacac

SEQ ID NO: 72858 - DNA, 24 bp, Artificial sequence
  primer
tcaaaactgaggatttctcgcctc

SEQ ID NO: 72859 - protein, 210 aa, Artificial sequence
  consensus sequence
  Variant (2)..(3): Xaa in position 2 to 3 is any amino acid
  Variant (5)..(8): Xaa in position 5 to 8 is any amino acid
  Variant (10)..(10): Xaa in position 10 is any amino acid
  Variant (11)..(14): Xaa in position 11 to 14 is any or no amino acid
  Variant (16)..(19): Xaa in position 16 to 19 is any amino acid
  Variant (22)..(24): Xaa in position 22 to 24 is any amino acid
  Variant (27)..(31): Xaa in position 27 to 31 is any amino acid
  Variant (33)..(34): Xaa in position 33 to 34 is any amino acid
  Variant (35)..(35): Xaa in position 35 is any or no amino acid
  Variant (37)..(37): Xaa in position 37 is any amino acid
  Variant (39)..(39): Xaa in position 39 is any amino acid
  Variant (41)..(41): Xaa in position 41 is any amino acid
  Variant (43)..(50): Xaa in position 43 to 50 is any amino acid
  Variant (52)..(62): Xaa in position 52 to 62 is any amino acid
  Variant (63)..(71): Xaa in position 63 to 71 is any or no amino acid
  Variant (73)..(75): Xaa in position 73 to 75 is any amino acid
  Variant (77)..(77): Xaa in position 77 is any amino acid
  Variant (79)..(79): Xaa in position 79 is any amino acid
  Variant (82)..(92): Xaa in position 82 to 92 is any amino acid
  Variant (94)..(101): Xaa in position 94 to 101 is any amino acid
  Variant (103)..(103): Xaa in position 103 is any amino acid
  Variant (105)..(107): Xaa in position 105 to 107 is any amino acid
  Variant (109)..(114): Xaa in position 109 to 114 is any amino acid
  Variant (115)..(132): Xaa in position 115 to 132 is any or no amino acid
  Variant (134)..(152): Xaa in position 134 to 152 is any amino acid
  Variant (153)..(188): Xaa in position 153 to 188 is any or no amino acid
  Variant (190)..(195): Xaa in position 190 to 195 is any amino acid
  Variant (197)..(203): Xaa in position 197 to 203 is any amino acid
  Variant (205)..(205): Xaa in position 205 is any amino acid
  Variant (207)..(209): Xaa in position 207 to 209 is any amino acid
VXXAXXXXYXXXXXNXXXXHVXXXDTXXXXXDXXXGXLXTXRXXXXXXXXPXXXXXXXXXXXXXXXXXXXXSXXXEXSXVDXXXXXXXXXXXNXXXXXXXXVXEXXXYXXXXXXXXXXXXXXXXXXXXXXXXTXXXXXXXXXXXXXXXXXXXXXXXXXXXXXXXXXXXXXXXXXXXXXXXXXXXXXXXEXXXXXXFXXXXXXXRXGXXXV

SEQ ID NO: 72860 - protein, 57 aa, Artificial sequence
  protein pattern
  Variant (2)..(2): Xaa in position 2 is Ser or Thr
  Variant (3)..(3): Xaa in position 3 is any amino acid
  Variant (5)..(7): Xaa in position 5 to 7 is any amino acid
  Variant (8)..(8): Xaa in position 8 is Lys or Arg
  Variant (10)..(11): Xaa in position 10 to 11 is any or no amino acid
  Variant (13)..(14): Xaa in position 13 to 14 is any or no amino acid
  Variant (16)..(16): Xaa in position 16 is Asp or Pro
  Variant (17)..(17): Xaa in position 17 is any amino acid
  Variant (18)..(18): Xaa in position 18 is Ala or Ser
  Variant (19)..(20): Xaa in position 19 to 20 is any amino acid
  Variant (22)..(22): Xaa in position 22 is any amino acid
  Variant (23)..(23): Xaa in position 23 is Ala, Gly, Ser or Thr
  Variant (24)..(24): Xaa in position 24 is any amino acid
  Variant (26)..(26): Xaa in position 26 is Thr or Val
  Variant (27)..(27): Xaa in position 27 is Ile or Leu
  Variant (28)..(28): Xaa in position 28 is Ala, Asp, Glu, Asn or Ser
  Variant (29)..(29): Xaa in position 29 is Asn, Gln, Arg or Ser
  Variant (30)..(30): Xaa in position 30 is any amino acid
  Variant (31)..(31): Xaa in position 31 is Ile, Met or Val
  Variant (32)..(56): Xaa in position 32 to 56 is any amino acid
  Variant (57)..(57): Xaa in position 57 is Gly, Leu or Val
VXXAXXXXYXXPXXNXXXXXVXXXDXXXXXXXXXXXXXXXXXXXXXXXXXXXXXXXX

SEQ ID NO: 72861 - protein, 23 aa, Artificial sequence
  protein pattern
  Variant (2)..(9): Xaa in position 2 to 9 is any amino acid
  Variant (10)..(10): Xaa in position 10 is Asp, Glu, Gln or Ser
  Variant (11)..(11): Xaa in position 11 is Asn or Gln
  Variant (12)..(14): Xaa in position 12 to 14 is any amino acid
  Variant (15)..(15): Xaa in position 15 is Gly or Ser
  Variant (17)..(17): Xaa in position 17 is any amino acid
  Variant (18)..(21): Xaa in position 18 to 21 is any or no amino acid
  Variant (23)..(23): Xaa in position 23 is Ile, Leu, Met or Val
EXXXXXXXXXXXXXXRXXXXXVX

SEQ ID NO: 72862 - DNA, 1569 bp, Saccharomyces cerevisiae; identical to SEQ ID NO: 45655
  CDS (1)..(1569)

SEQ ID NO: 72863 - protein, 522 aa, Saccharomyces cerevisiae; identical to SEQ ID NO: 45656

SEQ ID NO: 72864 - DNA, 1176 bp, Schizosaccharomyces pombe 972h-; identical to SEQ ID NO: 45535
  CDS (1)..(1176)

SEQ ID NO: 72865 - protein, 391 aa, Schizosaccharomyces pombe 972h-; identical to SEQ ID NO: 45536

SEQ ID NO: 72866 - DNA, 1317 bp, Schizosaccharomyces pombe 972h-; identical to SEQ ID NO: 45537
  CDS (1)..(1317)

SEQ ID NO: 72867 - protein, 438 aa, Schizosaccharomyces pombe 972h-; identical to SEQ ID NO: 45538

SEQ ID NO: 72868 - DNA, 1551 bp, Magnaporthe grisea 70-15; identical to SEQ ID NO: 45567
  CDS (1)..(1551)

SEQ ID NO: 72869 - protein, 516 aa, Magnaporthe grisea 70-15; identical to SEQ ID NO: 45568

SEQ ID NO: 72870 - DNA, 1527 bp, Gibberella zeae PH-1; identical to SEQ ID NO: 45569
  CDS (1)..(1527)

SEQ ID NO: 72871 - protein, 508 aa, Gibberella zeae PH-1; identical to SEQ ID NO: 45570

SEQ ID NO: 72872 - DNA, 1599 bp, Candida glabrata CBS 138; identical to SEQ ID NO: 45595
  CDS (1)..(1599)

SEQ ID NO: 72873 - protein, 532 aa, Candida glabrata CBS 138; identical to SEQ ID NO: 45596

SEQ ID NO: 72874 - DNA, 1569 bp, Kluyveromyces lactis NRRL Y-1140; identical to SEQ ID NO: 45605
  CDS (1)..(1569)

SEQ ID NO: 72875 - protein, 522 aa, Kluyveromyces lactis NRRL Y-1140; identical to SEQ ID NO: 45606

SEQ ID NO: 72876 - DNA, 1773 bp, Debaryomyces hansenii CBS767; identical to SEQ ID NO: 45611
  CDS (1)..(1773)

SEQ ID NO: 72877 - protein, 590 aa, Debaryomyces hansenii CBS767; identical to SEQ ID NO: 45612

SEQ ID NO: 72878 - DNA, 1527 bp, Yarrowia lipolytica CLIB122; identical to SEQ ID NO: 45633
  CDS (1)..(1527)

SEQ ID NO: 72879 - protein, 508 aa, Yarrowia lipolytica CLIB122; identical to SEQ ID NO: 45634

SEQ ID NO: 72880 - DNA, 1497 bp, Aspergillus nidulans FGSC A4; identical to SEQ ID NO: 45579
  CDS (1)..(1497)

SEQ ID NO: 72881 - protein, 498 aa, Aspergillus nidulans FGSC A4; identical to SEQ ID NO: 45580

SEQ ID NO: 72882 - DNA, 1506 bp, Aspergillus oryzae
  CDS (1)..(1506)
atggggttgacgcagcgaatctcaaaatggctgccctcttcgccgagtctccctgtggatgacgtttcgcgcgaaaagggccgcaacatttccaggttcgcgtttttcaagagaagaatacgcttgaagggcaattcatcgatttctataccattgggatttgttttactatttccatgccttgtaatagtcctggttttgcttctttttgtccgacacccttcttctcccggtggtattctaatcccagctggcacacctccatctataagtgaaaagcatgacaaggtcttcgcctcgggatgtctgcaggtcgagaaagaggttgagggtaagcgtgcgaatgccgcgtttgtcgttctcgctaggaacaaggaattggacggagtcatccagtctttgaagtcaattgagagacatttcaaccgatggttccactatccttatgtgttcctgaacgacggcgattttgatgacactttcaaggataccgtgaagaattatacaagtgctcctgtggaattcggcaaaattgacgataccatgtggggttatcctaaatgggttgaccacgaagtggcaaaggaaggcatcagaaagcagggcgacgccgctatcatgtatggtggaatggagagttaccaccatatgtgcagattctattctggattcttttacaaacatccccttctcatgaagtacgaatggtactggcgtctggagccagagatcagctacttctgtgacataacctacgaccctttcgtcaaaatggctgaagcaaataaaacatatggatttacgattgctgtcaaagaactccgtgagactgtccctaacatcttccgctatgcctcggcctataagcggaagcacaatctcgagtcaaagggactttgggagatgttcctcgaaaggccacctgaggaggagcctaagcccgaggaagggaaacaggacaagcttccggaggaaatcctgcagaatgagcctggagagaatactgttcccgatgtcgaccctgaggccatggaaggcgaaaagtataacatgtgccatttctggagtaactttgaaatcgcacgcttggattggttccgcagtaaggaatacgaagaattttttgaaatgatggataggagtggtggtttctggatggaaagatggggtgatgcgcccatccactcgctagctgcaggtgttcttctgtcgcccagcgacatccactacttccgtgattttgggtaccgtcatacgaccatccaacattgccccgccaacgctcccgcccgacaactcccacgaatcccgtggctcgaaatgaccacggaagatgagaaagcgcggttcgaagaggacgagtattgggcaaatgccgaccccgtgaaagagaacggtgtcggttgcaggtgcagatgtgacacagatatcgtggatgttgagggtaaacaaggcagctgtcttgccgagtgggtagaagttgcgggaggctgggcttctccctag

SEQ ID NO: 72883 - protein, 501 aa, Aspergillus oryzae
MGLTQRISKWLPSSPSLPVDDVSREKGRNISRFAFFKRRIRLKGNSSISIPLGFVLLFPCLVIVLVLLLFVRHPSSPGGILIPAGTPPSISEKHDKVFASGCLQVEKEVEGKRANAAFVVLARNKELDGVIQSLKSIERHFNRWFHYPYVFLNDGDFDDTFKDTVKNYTSAPVEFGKIDDTMWGYPKWVDHEVAKEGIRKQGDAAIMYGGMESYHHMCRFYSGFFYKHPLLMKYEWYWRLEPEISYFCDITYDPFVKMAEANKTYGFTIAVKELRETVPNIFRYASAYKRKHNLESKGLWEMFLERPPEEEPKPEEGKQDKLPEEILQNEPGENTVPDVDPEAMEGEKYNMCHFWSNFEIARLDWFRSKEYEEFFEMMDRSGGFWMERWGDAPIHSLAAGVLLSPSDIHYFRDFGYRHTTIQHCPANAPARQLPRIPWLEMTTEDEKARFEEDEYWANADPVKENGVGCRCRCDTDIVDVEGKQGSCLAEWVEVAGGWASP

SEQ ID NO: 72884 - DNA, 1554 bp, Saccharomyces cerevisiae; identical to SEQ ID NO: 45659
  CDS (1)..(1554)

SEQ ID NO: 72885 - protein, 517 aa, Saccharomyces cerevisiae; identical to SEQ ID NO: 45660

SEQ ID NO: 72886 - DNA, 26 bp, Artificial sequence
  primer
atgttgctaataagaaggacgataaa

SEQ ID NO: 72887 - DNA, 25 bp, Artificial sequence
  primer
ctagtttccgaactgtcttagatag

SEQ ID NO: 72888 - protein, 453 aa, Artificial sequence
  consensus sequence
  Variant (2)..(3): Xaa in position 2 to 3 is any amino acid
  Variant (5)..(6): Xaa in position 5 to 6 is any amino acid
  Variant (9)..(18): Xaa in position 9 to 18 is any amino acid
  Variant (19)..(23): Xaa in position 19 to 23 is any or no amino acid
  Variant (26)..(26): Xaa in position 26 is any amino acid
  Variant (29)..(29): Xaa in position 29 is any amino acid
  Variant (31)..(31): Xaa in position 31 is any amino acid
  Variant (34)..(38): Xaa in position 34 to 38 is any amino acid
  Variant (40)..(44): Xaa in position 40 to 44 is any amino acid
  Variant (46)..(46): Xaa in position 46 is any amino acid
  Variant (48)..(48): Xaa in position 48 is any amino acid
  Variant (52)..(52): Xaa in position 52 is any amino acid
  Variant (54)..(55): Xaa in position 54 to 55 is any amino acid
  Variant (64)..(65): Xaa in position 64 to 65 is any amino acid
  Variant (67)..(69): Xaa in position 67 to 69 is any amino acid
  Variant (72)..(77): Xaa in position 72 to 77 is any amino acid
  Variant (79)..(82): Xaa in position 79 to 82 is any amino acid
  Variant (83)..(83): Xaa in position 83 is any or no amino acid
  Variant (87)..(92): Xaa in position 87 to 92 is any amino acid
  Variant (94)..(95): Xaa in position 94 to 95 is any amino acid
  Variant (97)..(109): Xaa in position 97 to 109 is any amino acid
  Variant (110)..(111): Xaa in position 110 to 111 is any or no amino acid
  Variant (113)..(113): Xaa in position 113 is any amino acid
  Variant (115)..(116): Xaa in position 115 to 116 is any amino acid
  Variant (117)..(118): Xaa in position 117 to 118 is any or no amino acid
  Variant (121)..(122): Xaa in position 121 to 122 is any amino acid
  Variant (127)..(127): Xaa in position 127 is any amino acid
  Variant (132)..(132): Xaa in position 132 is any amino acid
  Variant (135)..(135): Xaa in position 135 is any amino acid
  Variant (142)..(144): Xaa in position 142 to 144 is any amino acid
  Variant (146)..(146): Xaa in position 146 is any amino acid
  Variant (151)..(151): Xaa in position 151 is any amino acid
  Variant (154)..(157): Xaa in position 154 to 157 is any amino acid
  Variant (161)..(162): Xaa in position 161 to 162 is any amino acid
  Variant (167)..(168): Xaa in position 167 to 168 is any amino acid
  Variant (170)..(172): Xaa in position 170 to 172 is any amino acid
  Variant (175)..(175): Xaa in position 175 is any amino acid
  Variant (178)..(183): Xaa in position 178 to 183 is any amino acid
  Variant (186)..(187): Xaa in position 186 to 187 is any amino acid
  Variant (192)..(192): Xaa in position 192 is any amino acid
  Variant (195)..(209): Xaa in position 195 to 209 is any amino acid
  Variant (210)..(213): Xaa in position 210 to 213 is any or no amino acid
  Variant (215)..(216): Xaa in position 215 to 216 is any amino acid
  Variant (218)..(251): Xaa in position 218 to 251 is any amino acid
  Variant (252)..(299): Xaa in position 252 to 299 is any or no amino acid
  Variant (301)..(301): Xaa in position 301 is any amino acid
  Variant (304)..(304): Xaa in position 304 is any amino acid
  Variant (315)..(318): Xaa in position 315 to 318 is any amino acid
  Variant (320)..(323): Xaa in position 320 to 323 is any amino acid
  Variant (325)..(327): Xaa in position 325 to 327 is any amino acid
  Variant (329)..(334): Xaa in position 329 to 334 is any amino acid
  Variant (339)..(339): Xaa in position 339 is any amino acid
  Variant (347)..(347): Xaa in position 347 is any amino acid
  Variant (350)..(355): Xaa in position 350 to 355 is any amino acid
  Variant (357)..(361): Xaa in position 357 to 361 is any amino acid
  Variant (367)..(367): Xaa in position 367 is any amino acid
  Variant (370)..(370): Xaa in position 370 is any amino acid
  Variant (372)..(375): Xaa in position 372 to 375 is any amino acid
  Variant (379)..(379): Xaa in position 379 is any amino acid
  Variant (381)..(391): Xaa in position 381 to 391 is any amino acid
  Variant (392)..(420): Xaa in position 392 to 420 is any or no amino acid
  Variant (422)..(422): Xaa in position 422 is any amino acid
  Variant (423)..(426): Xaa in position 423 to 426 is any or no amino acid
  Variant (428)..(428): Xaa in position 428 is any amino acid
  Variant (433)..(433): Xaa in position 433 is any amino acid
  Variant (435)..(440): Xaa in position 435 to 440 is any amino acid
  Variant (441)..(442): Xaa in position 441 to 442 is any or no amino acid
  Variant (444)..(448): Xaa in position 444 to 448 is any amino acid
  Variant (450)..(452): Xaa in position 450 to 452 is any amino acid
DXXFXXGCXXXXXXXXXXXXXXXNAXFVXLXRNXXXXXVXXXXXSXEXHFNXWXXYPYVFLNDXXFXXXFKXXXXXXTXXXXXEFGXXXXXXWXXPXXXXXXXXXXXXXXXQXDXXXXYGXXESYHXMCRFXSGXFYKHPLXXXYXWYWRXEPXXXXFCDXXYDPFXXMXXXNKXYGXXXXXXELXXTVPNXFRXXXXXXXXXXXXXXXXXXXWXXFXXXXXXXXXXXXXXXXXXXXXXXXXXXXXXXXXXXXXXXXXXXXXXXXXXXXXXXXXXXXXXXXXXXXXXXXXXXXXXXXXXEXYNXCHFWSNFEIAXXXXFXXXXYXXXFXXXXXXGGFWXERWGDAPXHSXXXXXXLXXXXXHYFRDXGYXHXXXXHCPXNXXXXXXXXXXXXXXXXXXXXXXXXXXXXXXXXXXXXXXXXDXXXXXGXGCRCXCXXXXXXXXEXXXXXCXXXW

SEQ ID NO: 72889 - protein, 60 aa, Artificial sequence
  protein pattern
  Variant (2)..(2): Xaa in position 2 is any or no amino acid
  Variant (4)..(4): Xaa in position 4 is any amino acid
  Variant (5)..(5): Xaa in position 5 is any or no amino acid
  Variant (10)..(10): Xaa in position 10 is any amino acid
  Variant (15)..(15): Xaa in position 15 is Phe or Tyr
  Variant (18)..(18): Xaa in position 18 is any amino acid
  Variant (20)..(20): Xaa in position 20 is Phe or Tyr
  Variant (21)..(21): Xaa in position 21 is any amino acid
  Variant (23)..(23): Xaa in position 23 is Glu or Pro
  Variant (25)..(25): Xaa in position 25 is Leu, Met or Val
  Variant (26)..(26): Xaa in position 26 is any amino acid
  Variant (27)..(27): Xaa in position 27 is Asp or Lys
  Variant (28)..(28): Xaa in position 28 is any amino acid
  Variant (29)..(29): Xaa in position 29 is Asp, Glu or Gln
  Variant (34)..(34): Xaa in position 34 is Ile, Leu or Val
  Variant (37)..(37): Xaa in position 37 is Asp or Glu
  Variant (38)..(38): Xaa in position 38 is Ile or Val
  Variant (39)..(39): Xaa in position 39 is any amino acid
  Variant (40)..(40): Xaa in position 40 is Phe or Tyr
  Variant (41)..(41): Xaa in position 41 is any amino acid
  Variant (44)..(44): Xaa in position 44 is Ile or Leu
  Variant (45)..(45): Xaa in position 45 is Ser or Thr
  Variant (50)..(51): Xaa in position 50 to 51 is any amino acid
  Variant (53)..(53): Xaa in position 53 is any amino acid
  Variant (54)..(54): Xaa in position 54 is Asp, Glu, Lys or Arg
  Variant (55)..(55): Xaa in position 55 is any amino acid
  Variant (56)..(56): Xaa in position 56 is Gly or Asn
  Variant (58)..(58): Xaa in position 58 is any amino acid
  Variant (60)..(60): Xaa in position 60 is Ala or Gly
YXGXXESYHXMCRFXSGXFXXHXLXXXXXWYWRXEPXXXXXCDXXYDPFXXMXXXXKXYX

SEQ ID NO: 72890 - protein, 58 aa, Artificial sequence
  protein pattern
  Variant (9)..(12): Xaa in position 9 to 12 is any amino acid
  Variant (14)..(14): Xaa in position 14 is Asp, Asn or Arg
  Variant (15)..(15): Xaa in position 15 is Asn or Ser
  Variant (16)..(17): Xaa in position 16 to 17 is any amino acid
  Variant (19)..(19): Xaa in position 19 is Glu, Asn or Gln
  Variant (20)..(20): Xaa in position 20 is any amino acid
  Variant (21)..(21): Xaa in position 21 is Phe or Tyr
  Variant (23)..(24): Xaa in position 23 to 24 is any amino acid
  Variant (25)..(25): Xaa in position 25 is Leu or Met
  Variant (26)..(26): Xaa in position 26 is Asp or Glu
  Variant (27)..(28): Xaa in position 27 to 28 is any amino acid
  Variant (32)..(32): Xaa in position 32 is Trp or Tyr
  Variant (33)..(33): Xaa in position 33 is any amino acid
  Variant (41)..(41): Xaa in position 41 is Phe, Ile or Val
  Variant (44)..(44): Xaa in position 44 is Ile or Leu
  Variant (45)..(45): Xaa in position 45 is Ala or Gly
  Variant (46)..(46): Xaa in position 46 is Ala, Ile or Leu
  Variant (47)..(47): Xaa in position 47 is Ala, Gly or Ser
  Variant (48)..(49): Xaa in position 48 to 49 is any amino acid
  Variant (51)..(51): Xaa in position 51 is Ala, Asp, Gly, Asn or Ser
  Variant (52)..(53): Xaa in position 52 to 53 is any amino acid
  Variant (54)..(54): Xaa in position 54 is Asp or Gln
  Variant (55)..(55): Xaa in position 55 is Ile or Val
FWSNFEIAXXXXFXXXXYXXXFXXXXXXGGFXXERWGDAPXHSXXXXXXLXXXXXHYF

SEQ ID NO: 72891 - protein, 57 aa, Artificial sequence
  protein pattern
  Variant (3)..(3): Xaa in position 3 is Ala, Ser or Thr
  Variant (6)..(6): Xaa in position 6 is Ile, Met or Val
  Variant (8)..(8): Xaa in position 8 is Ala or Thr
  Variant (11)..(11): Xaa in position 11 is any amino acid
  Variant (12)..(12): Xaa in position 12 is Asp or Glu
  Variant (13)..(14): Xaa in position 13 to 14 is any amino acid
  Variant (15)..(15): Xaa in position 15 is Asp or Gly
  Variant (16)..(16): Xaa in position 16 is Leu or Val
  Variant (17)..(17): Xaa in position 17 is Ile, Leu or Val
  Variant (18)..(18): Xaa in position 18 is any amino acid
  Variant (19)..(19): Xaa in position 19 is Ser or Thr
  Variant (20)..(20): Xaa in position 20 is Ile, Leu or Met
  Variant (21)..(21): Xaa in position 21 is any amino acid
  Variant (23)..(23): Xaa in position 23 is Ile, Leu or Val
  Variant (25)..(25): Xaa in position 25 is any amino acid
  Variant (26)..(26): Xaa in position 26 is His or Arg
  Variant (29)..(29): Xaa in position 29 is any amino acid
  Variant (30)..(30): Xaa in position 30 is His or Trp
  Variant (31)..(31): Xaa in position 31 is Phe or Tyr
  Variant (32)..(32): Xaa in position 32 is any amino acid
  Variant (36)..(36): Xaa in position 36 is any amino acid
  Variant (38)..(38): Xaa in position 38 is Leu or Met
  Variant (40)..(40): Xaa in position 40 is Asp or Asn
  Variant (41)..(41): Xaa in position 41 is Ala, Asp, Glu, Gly or Gln
  Variant (42)..(42): Xaa in position 42 is Asp, Glu or Pro
  Variant (44)..(44): Xaa in position 44 is Asp, Glu, Asn, Ser or Thr
  Variant (45)..(45): Xaa in position 45 is Ala, Asp or Glu
  Variant (46)..(46): Xaa in position 46 is any amino acid
  Variant (48)..(50): Xaa in position 48 to 50 is any amino acid
  Variant (51)..(51): Xaa in position 51 is Ile or Val
  Variant (52)..(54): Xaa in position 52 to 54 is any amino acid
  Variant (56)..(56): Xaa in position 56 is Ala, Asp, Asn, Ser, Thr or Val
  Variant (57)..(57): Xaa in position 57 is Ala or Gly
NAXFVXLXRNXXXXXXXXXXXSXEXXFNXXXXYPYXFXNXXXFXXXFXXXXXXXTXX

SEQ ID NO: 72892 - protein, 22 aa, Artificial sequence
  protein pattern
  Variant (2)..(2): Xaa in position 2 is Ile or Leu
  Variant (3)..(4): Xaa in position 3 to 4 is any amino acid
  Variant (9)..(9): Xaa in position 9 is Ile or Leu
  Variant (12)..(12): Xaa in position 12 is any amino acid
  Variant (13)..(13): Xaa in position 13 is Ala or Thr
  Variant (14)..(14): Xaa in position 14 is any amino acid
  Variant (15)..(15): Xaa in position 15 is Ala or Ser
  Variant (16)..(16): Xaa in position 16 is Phe, His or Tyr
  Variant (17)..(20): Xaa in position 17 to 20 is any amino acid
  Variant (21)..(21): Xaa in position 21 is Ala, Asp, Gly or Asn
  Variant (22)..(22): Xaa in position 22 is Gly, Ile, Leu or Val
EXXXTVPNXFRXXXXXXXXXXX

SEQ ID NO: 72893 - protein, 20 aa, Artificial sequence
  protein pattern
  Variant (3)..(3): Xaa in position 3 is Phe, Ile or Leu
  Variant (6)..(6): Xaa in position 6 is any amino acid
  Variant (8)..(8): Xaa in position 8 is any amino acid
  Variant (9)..(9): Xaa in position 9 is any or no amino acid
  Variant (11)..(11): Xaa in position 11 is any amino acid
  Variant (12)..(12): Xaa in position 12 is any or no amino acid
  Variant (15)..(15): Xaa in position 15 is Gly or Pro
  Variant (16)..(16): Xaa in position 16 is any amino acid
  Variant (17)..(17): Xaa in position 17 is Glu, Asn or Ser
  Variant (18)..(19): Xaa in position 18 to 19 is any amino acid
  Variant (20)..(20): Xaa in position 20 is Ala, Cys, Asp, Gly or Ser
RDXGYXHXXIXXHCXXXXXX

SEQ ID NO: 72894 - protein, 15 aa, Artificial sequence
  protein pattern
  Variant (2)..(2): Xaa in position 2 is any amino acid
  Variant (3)..(3): Xaa in position 3 is Ala, Gly, Pro or Val
  Variant (4)..(4): Xaa in position 4 is any amino acid
  Variant (5)..(5): Xaa in position 5 is Asp, Glu, Asn or Ser
  Variant (6)..(6): Xaa in position 6 is any amino acid
  Variant (8)..(8): Xaa in position 8 is any amino acid
  Variant (13)..(13): Xaa in position 13 is any amino acid
  Variant (15)..(15): Xaa in position 15 is Asp or Pro
DXXXXXGXGCRCXCX

SEQ ID NO: 72895 - protein, 15 aa, Artificial sequence
  protein pattern
  Variant (2)..(2): Xaa in position 2 is any amino acid
  Variant (3)..(3): Xaa in position 3 is Ile, Leu or Val
  Variant (4)..(4): Xaa in position 4 is Asp, Gly or Pro
  Variant (5)..(5): Xaa in position 5 is Asp, Glu or Pro
  Variant (6)..(7): Xaa in position 6 to 7 is any amino acid
  Variant (9)..(9): Xaa in position 9 is Asp, Glu, Gly or Asn
  Variant (10)..(10): Xaa in position 10 is Phe or Tyr
  Variant (11)..(11): Xaa in position 11 is Asp, Asn or Pro
  Variant (12)..(13): Xaa in position 12 to 13 is any amino acid
  Variant (14)..(14): Xaa in position 14 is Ile or Val
  Variant (15)..(15): Xaa in position 15 is Asp, Lys or Arg
GXXXXXXWXXXXXXX

SEQ ID NO: 72896 - DNA, 1263 bp, Saccharomyces cerevisiae
  CDS (1)..(1263)
atgtctaagggaaaagtttgtttggcttattctggtggtttagatacctccgtcattttggcttggctactagaccaaggctacgaagttgtagctttcatggctaatgtagggcaagaagaagatttcgatgccgccaaggaaaaggccttgaagatcggtgcctgcaagttcgtttgtgtggattgtcgtgaagattttgtcaaggatattctattcccagctgtacaggtcaacgctgtgtacgaagacgtttatctgttgggtacctctttggcaagacctgttattgccaaagcccaaattgacgtcgctaaacaggagggctgtttcgcggtctctcatggttgtaccggtaaaggtaatgatcaaatcagattcgaattgtcattttacgctctgaagccagacgttaagtgtattacaccatggagaatgcctgaatttttcgaaagatttgctggcagaaaggatttgttagactatgctgcacaaaagggtattcccgtcgcccaaaccaaggccaagccatggtctactgacgaaaaccaagcccacatttcttacgaggcaggtatcttggaagacccagataccaccccaccaaaggacatgtggaaattgatcgtcgatccaatggatgctccggaccaaccacaagatttgaccattgactttgaacgtggtcttccagtcaagttgacctacaccgacaacaagacttccaaggaagtttccgttaccaagcctttggatgttttcttggccgcatccaacttagcaagggccaacggtgttggtagaatcgatattgtagaagatcgttacattaacttgaaatccagaggttgttacgaacaggctccattgactgttttgagaaaagctcatgttgatttggaaggtttgactttagacaaagaagtccgtcaattgagagactcattcgtcacaccaaactactccagattgatatataacggtttcctacttcacccagagtgtgagtacatcagatctatgatccaaccatcccaaaatagcgttaacggtactgtcagggttagactgtataagggtaacgtcatcattctgggcagatctacaaagactgaaaagttgtacgatccgacagaatcctctatggatgagttgaccggtttcttacctaccgataccaccggtttcattgccatccaggccattagaattaaaaaatacggtgaatccaaaaaaaccaaaggtgaagagttgactttgtaa

SEQ ID NO: 72897 - protein, 420 aa, Saccharomyces cerevisiae
MSKGKVCLAYSGGLDTSVILAWLLDQGYEVVAFMANVGQEEDFDAAKEKALKIGACKFVCVDCREDFVKDILFPAVQVNAVYEDVYLLGTSLARPVIAKAQIDVAKQEGCFAVSHGCTGKGNDQIRFELSFYALKPDVKCITPWRMPEFFERFAGRKDLLDYAAQKGIPVAQTKAKPWSTDENQAHISYEAGILEDPDTTPPKDMWKLIVDPMDAPDQPQDLTIDFERGLPVKLTYTDNKTSKEVSVTKPLDVFLAASNLARANGVGRIDIVEDRYINLKSRGCYEQAPLTVLRKAHVDLEGLTLDKEVRQLRDSFVTPNYSRLIYNGFLLHPECEYIRSMIQPSQNSVNGTVRVRLYKGNVIILGRSTKTEKLYDPTESSMDELTGFLPTDTTGFIAIQAIRIKKYGESKKTKGEELTL

SEQ ID NO: 72898 - DNA, 1383 bp, Agrobacterium tumefaciens str. C58
  CDS (1)..(1383): transl_table=11
gtggctggtcatcacccatcgtcatgcctgcccatcaattgttttgtcgcttatctcacggaaaagcgcttcacacatttcgggttgcactgtaaaagtgccgaaatcccaaggaaatggcggtgccccgatgccgtcatcatgcagatggacatcattatggcactcccgaaagacgttaagaaagtcgttctcgcctattccggcggcctcgacacctcgatcatcctgaaatggcttcagacggaactcggcgccgaggtcgtgaccttcaccgccgatctcggccagggcgaagagcttgagccggcacgcaagaaggctgagatgctgggcatcaaggaaatctttgtcgaggacgttcgcgaagagttcgtgcgtgatttcgtgtttccgatgttccgcgccaatgccgtttatgaaggcgtctatctgctcggcacgtcgattgcccgtccgctgatttccaagcacctgatcgagatcgccaagaagaccggcgctgacgccatcgcccacggcgccaccggcaagggcaacgaccaggtccgcttcgagctttcggcctatgcgttgaaccctgacatcaagatcattgcgccctggcgcgactggacgttcaagagccgtaccgacctcctgaacttcgccgaacagcaccagatcccggtcgccaaggacaagaagggtgaagcgcctttctccgttgacgccaacctcttgcactcctcctccgagggcaaggtgctggaagacccggcggtggaagcacctgaatatgtgcatatgcgcaccatttccccggaagcggctcccgacaaggcgaccgtcatcaaggtcggtttccgcaagggcgatgcctgctccatcaacggtgttgaaatgtcgcccgcgacgcttcttgccacgctcaacaactacggtcgcgaaaacggcatcggccgcctcgatctggtcgagaaccgtttcgtcggcatgaagtcacgcggcgtttacgagacgcccggcggcacgatcctgctggcagcgcaccgcgccatcgaatccatcacactcgaccggggtgccgcgcatctcaaggacgatctgatgccgcgttacgctgagcttatctattacggcttctggttttcgccggagcgcgaaatgctgcaggccctgatcgacaagagccaggaacatgtcgaaggcgaagtgacgctgaagctctacaagggcaatgtcatggtaaccggccgcgagagcgagaagtcgctgtattccgacgcgctggtgaccttcgaggacgaccacggcgcttacgaccagaaggatgctgctggcttcatcaagctcaatgcgctgcgtcttcgcacgctcgccaagcgtaacctcaacaagtaa

SEQ ID NO: 72899 - protein, 460 aa, Agrobacterium tumefaciens str. C58
MAGHHPSSCLPINCFVAYLTEKRFTHFGLHCKSAEIPRKWRCPDAVIMQMDIIMALPKDVKKVVLAYSGGLDTSIILKWLQTELGAEVVTFTADLGQGEELEPARKKAEMLGIKEIFVEDVREEFVRDFVFPMFRANAVYEGVYLLGTSIARPLISKHLIEIAKKTGADAIAHGATGKGNDQVRFELSAYALNPDIKIIAPWRDWTFKSRTDLLNFAEQHQIPVAKDKKGEAPFSVDANLLHSSSEGKVLEDPAVEAPEYVHMRTISPEAAPDKATVIKVGFRKGDACSINGVEMSPATLLATLNNYGRENGIGRLDLVENRFVGMKSRGVYETPGGTILLAAHRAIESITLDRGAAHLKDDLMPRYAELIYYGFWFSPEREMLQALIDKSQEHVEGEVTLKLYKGNVMVTGRESEKSLYSDALVTFEDDHGAYDQKDAAGFIKLNALRLRTLAKRNLNK

SEQ ID NO: 72900 - DNA, 1335 bp, Rhodopirellula baltica SH 1
  CDS (1)..(1335): transl_table=11
gtgctgcttgactttccggccaggatccttctgaccgtccttgcgtgtttcgcaccggacaacttaaatgcgaggccttcaaacatagccgattcccccgcatttggatgcagatctgagatgaaaagttgtgtgctggcctattccggtggtctcgatacgtccgtcattctgggctggctccaggaccaaggctacgaagttcactgtgtttacgtggacctcgggcagccctgtgaggatcgcgatgccatcatggagaaggctcgtacctgcggggccaagtcctctcgtttggtggacgttcgtgaagaactgtgccgcgattttgctttccccgtgttggcgtggcaagccaagtacgaacaaatctatctgctgggcacctcgatcgctcgcccgctgatcagcaaggtttgcttggaagtggctcgcgaagtcggcgcgaccgcctacgctcacggagcaacaggcaaaggcaatgaccaatgtcgtttccaacttgctgccgaagctcttgatccaaacatcgaaatgatcgctccttggcgaatcaaatcgttccgcgatgccttccctggccgcaccgaactgatcgagtactgcgacgtgaagcgaattcctgtcaaagcctcgactgcaaagccatacagcagcgatgaaaacgtcctgcacatttcctacgaagcgggcaagcttgaagaactcgacgtcaacggcgtggagctggtcgaattcggaatgggcgtttcacctcaagatgctcccgacaaaccagaagaagtcacgatcggttttgaatccggcgtaccaaaaacgttgaatggcaaagccgtcaacgctttggaaatggtcgagcaactcaatgacatcgctggacgcaacggcgtcggtcgcatcgacatggtcgaaaatcgtttcgtcggcatgaagagccgcggtgtttacgagtcgcccggcatgactgtgttgtacgacgcattgatgtacgtcgaacaactcaccatggaccgcgacctgatgcaccttcgcgaccgcatggctcccgaagtggctgaaatggtttactacggtttctggtacacgcccaagatggacgcactgatgtcgttcatcgaaaccgctcagcgtccagtcaccggcgaagtcacgttgcaactctacaagggcaacatcatggtgtcttcacgaaccagcccaaacagcttgtacgacgaagagatcgcaaccatggaaggcggcggctcgtacaaccaagacgacgccgaaggcttcctgcgaatccaaggcttgccgtcgcgagtccaaggccgcgtgtcaccacgcaagttctaa

SEQ ID NO: 72901 - protein, 444 aa, Rhodopirellula baltica SH 1
MLLDFPARILLTVLACFAPDNLNARPSNIADSPAFGCRSEMKSCVLAYSGGLDTSVILGWLQDQGYEVHCVYVDLGQPCEDRDAIMEKARTCGAKSSRLVDVREELCRDFAFPVLAWQAKYEQIYLLGTSIARPLISKVCLEVAREVGATAYAHGATGKGNDQCRFQLAAEALDPNIEMIAPWRIKSFRDAFPGRTELIEYCDVKRIPVKASTAKPYSSDENVLHISYEAGKLEELDVNGVELVEFGMGVSPQDAPDKPEEVTIGFESGVPKTLNGKAVNALEMVEQLNDIAGRNGVGRIDMVENRFVGMKSRGVYESPGMTVLYDALMYVEQLTMDRDLMHLRDRMAPEVAEMVYYGFWYTPKMDALMSFIETAQRPVTGEVTLQLYKGNIMVSSRTSPNSLYDEEIATMEGGGSYNQDDAEGFLRIQGLPSRVQGRVSPRKF

SEQ ID NO: 72902 - DNA, 1245 bp, Eremothecium gossypii
  CDS (1)..(1245)
atggcacgcggaaaggtttgcttggcatactcaggaggcctggacacttcggtgatcctcgcctggttactggagcagggttatgaagtggtagcgtttatggctaatggtgggcaagaagaagatttccaggctgcggaagagaaggcattgaagataggagcatccaagtttgtgtgcgttgactgccgtgagcagttcgtgacggatgtcttgtttcctgcggtgcaggtgaacgcggtgtacgaagatgtttatctactggggacgtcgcttgcacggcccgtgattgccaaggcacagattgacatcgcggagcaggagcattgttttgcggtcgctcacggatgcactgggaagggcaacgatcagatccggtttgagcttgcgttctacgcgctgaagccagacgtccaggttatcgcgccatggcgggaccctgcgtttttcgaccggtttgcaggtagaaatgacttgctagagtatgcggcagagaaacagatacctgttgcgcagaccaaggccaaaccgtggtctaccgacgagaacgaggcgcatatatcgtacgaggctggaattttggaggatcccgatgtcacaccaccggcagacatgtggaagctcacgacagacccgcttcaagcaccaagtgagcctgaggacgtgacgttggtgttcaaggagggtgtccccactcagatgatttacaaggatggagaggcgagcaaaccgttggatatttttcttgcggcttccaaagtggcgcgtagaaacggcgttggcagaatcgacatcgtggaaaaccgttacatcaacctgaagtcgcgtggctgctacgaacaggcaccactgacactcctgcgccgggcccacgtggatctcgagggtctcaccctggacaaagaagttcggcatttgcgtgaccaatttgttacgccgacttactctcgcctcctctacaatggctcctacttttctccggaatgcgagtatatccgtagcatgattaagccatcccaaattacggtaaatggccaggttcgcttgagactttacaagggtaatgtcattgtgttgggcaggtcctcggaaactgagaacttgtatgatgcgacggagtcctccatggacgaattgaccggattccagccgactgataccactggtttcatcgctattcaagcaattcgcatgaaaaagtacggtcaatccaagaaggacaaaggtgaatccctgacttcgtaa

SEQ ID NO: 72903 - protein, 414 aa, Eremothecium gossypii
MARGKVCLAYSGGLDTSVILAWLLEQGYEVVAFMANGGQEEDFQAAEEKALKIGASKFVCVDCREQFVTDVLFPAVQVNAVYEDVYLLGTSLARPVIAKAQIDIAEQEHCFAVAHGCTGKGNDQIRFELAFYALKPDVQVIAPWRDPAFFDRFAGRNDLLEYAAEKQIPVAQTKAKPWSTDENEAHISYEAGILEDPDVTPPADMWKLTTDPLQAPSEPEDVTLVFKEGVPTQMIYKDGEASKPLDIFLAASKVARRNGVGRIDIVENRYINLKSRGCYEQAPLTLLRRAHVDLEGLTLDKEVRHLRDQFVTPTYSRLLYNGSYFSPECEYIRSMIKPSQITVNGQVRLRLYKGNVIVLGRSSETENLYDATESSMDELTGFQPTDTTGFIAIQAIRMKKYGQSKKDKGESLTS

SEQ ID NO: 72904 - DNA, 1221 bp, Magnaporthe grisea 70-15
  CDS (1)..(1221)
atgtccaaaggtcgcgtctgcttagcctactctggaggtcttgatacctctggctacaccgtcgtctgcttcctcgccaatgtcggccaggaggaggactgggatgaggtcaaggccaaggccaagaagcttggtgctgaggagatggtgatcctcgacctgcagaaggagtttgtcgagcagatcgtcttccgcgccatccagtgcaacgccatatacgaggacaggtacctgctgggcacctcgctggcccgccccatcatcgcccgcgcccaggtccgcgtcgccgagcagtacaactgccagtacgtcagccacggctgcaccggcaagggcaacgaccaggtccgcttcgagctcgccttcaaggcctgcaacccttccatcgaggttattgccccatggaggctgcccgagttcatctccaagttccagggtcgtcaagacctgctcaagtacgccgaggagaagaacatccccgtctcttccagccccaaggccccctggtccatggacgacaacctcgtccactgcagctacgaggccggcgtgctcgaggaccccgaccacacccctcccaaggagctgtggactcgtaccgttgaccccgtcgacgcccctgccactcctcaggagttcactgttgagttcgagaagggtatccccacaaaggttacggtcgacggtaaggagacgaccggctcggttgaggtcttcaagctgctcaacaagctgggccacgaccacggtgttggccgtatcgacattgtcgagaaccgcttcatcggcctcaagtctcgtggctgctacgacacccctggtttgaccattgcccgcctggcccacttggatctcgagggtctggtcatggactccaaggtccgtgagattcgtgaccagttctgtactctgtcgtggtctcgccagctgtacaacggcatgtacttcagcccggagcgcgagttcgtcgagaactcgatcatcttcagccaggagaacgtcaccggtcaggtcaggttggccgtctacaagggcaacacttacgtcctgggccgcaagagcgacgccagcaacctctactcggagcaggacgcttccatggactcgctcgagggcttctcgcccatggacacgactggcttcatcgagatcaatgccatccgcctgaagaaatacggtctgcaaaagatcaaggacggcaagccccttactcagtcatga

SEQ ID NO: 72905 - protein, 406 aa, Magnaporthe grisea 70-15
MSKGRVCLAYSGGLDTSGYTVVCFLANVGQEEDWDEVKAKAKKLGAEEMVILDLQKEFVEQIVFRAIQCNAIYEDRYLLGTSLARPIIARAQVRVAEQYNCQYVSHGCTGKGNDQVRFELAFKACNPSIEVIAPWRLPEFISKFQGRQDLLKYAEEKNIPVSSSPKAPWSMDDNLVHCSYEAGVLEDPDHTPPKELWTRTVDPVDAPATPQEFTVEFEKGIPTKVTVDGKETTGSVEVFKLLNKLGHDHGVGRIDIVENRFIGLKSRGCYDTPGLTIARLAHLDLEGLVMDSKVREIRDQFCTLSWSRQLYNGMYFSPEREFVENSIIFSQENVTGQVRLAVYKGNTYVLGRKSDASNLYSEQDASMDSLEGFSPMDTTGFIEINAIRLKKYGLQKIKDGKPLTQS

SEQ ID NO: 72906 - DNA, 1185 bp, Gibberella zeae PH-1
  CDS (1)..(1185)
atggctcccgaacgtgtttgccttgcctactctggtggtcttgacaccagcaccatcctccgatggttggtcctccagggctaccaggtcgtctgcttccttgccgactgtggtcaggaggaggactttgacgccgtcaaggtcaaggctgagaagctcggcgctgagcgcatgatcatcctcgatgttcagcaggagcttatcgacgagcttgtctggcctgctgtccagtgcaatgccatctacgaggaccgatacctcctcggaaccagtcttgctcgccctgtcattgctagggccatggtcaaggtcgccaaggagcacaactgcacaattctcagccacggatgcactggcaagggtaacgagtacgactctcttttcaacacagttttggcatatggacgtgccgatctgctcaagttcgcctccgagcagaacattcccgttagctctacccccaaggccccttggtctatggacgacaacatcatccactgctcttacgaggccggtattctcgagcaaaccgagcttgagccccccaaggacatgtggaagcgcactgttgaccccatgaaggcccccgatgagcccacccccttcgttattcacttcgagcagggtgttcccgtcaagctcgaggttgcaggcaagaccatcactggatctctcgagatcttcaaggaggctaacgagatcggccgaatcaacggtattggacgtgtcgacattgtcgagtcccgattcattggtctcaagagccgaggctgctacgacacccccggtctcaccatcctccgacaggcccacatcgaccttgagggacttgtccttgactccaaggttcgagccatccgtgaccgtcttactcaggactggtctgcctgcatctacaacggcatgtacttcagccctgagcgtgagcttgtcgagcacgccatcaagttctctcagcgccaggttgagggtaaggtgagccttgtcgcctacaagggcaacgcctacgtcgtcggacgatccagcgagacctccaacctctactccgaggacgagagcagcatggacaccctcgacatgaactggactcctcaggacaccaccggctttatcgccatccagggtatccgcctcgagaagtacggcgccaggaagatcaaggacggcgagcctcttgccccttag

SEQ ID NO: 72907 - protein, 394 aa, Gibberella zeae PH-1
MAPERVCLAYSGGLDTSTILRWLVLQGYQVVCFLADCGQEEDFDAVKVKAEKLGAERMIILDVQQELIDELVWPAVQCNAIYEDRYLLGTSLARPVIARAMVKVAKEHNCTILSHGCTGKGNEYDSLFNTVLAYGRADLLKFASEQNIPVSSTPKAPWSMDDNIIHCSYEAGILEQTELEPPKDMWKRTVDPMKAPDEPTPFVIHFEQGVPVKLEVAGKTITGSLEIFKEANEIGRINGIGRVDIVESRFIGLKSRGCYDTPGLTILRQAHIDLEGLVLDSKVRAIRDRLTQDWSACIYNGMYFSPERELVEHAIKFSQRQVEGKVSLVAYKGNAYVVGRSSETSNLYSEDESSMDTLDMNWTPQDTTGFIAIQGIRLEKYGARKIKDGEPLAP

SEQ ID NO: 72908 - DNA, 1248 bp, Gibberella zeae PH-1
  CDS (1)..(1248)
atgtcaaaaggccgtgtttgtcttgcctactctggaggactcgatacctctacgatcctaaaatggcttatccttgagggatatgaggttgtgtgtttcctcgccgacgttggccaagttgaggactttgatgctgtcgagaagaaggctctggctctcggtgctgagcgtatgatcattgagaacctacagaaggaattcatcgaacaaatcgtcttccgagcgattcagtgcaacgccatctacgaggatcgatatcttcttggaaccgcccttgctcgacccgtcatcgctcgtgctcaggtccgagtcgctgagaagtacaactgcaaccttctgagccatggctgcactggtaaaggaaacgaccaagttcgtttcgaactcgccttcaaggcctgcaacccttcgatcaaaatcattgccccttggcgactacctgagttctgtgaaaagttccagggccgacaagatcttctcaagttcgctgccgagaacaacatccccgtctcatccacccccaaggctccttggagccaagacgagaatcttgttcactgctcgtatgaagctggcatccttgaggatcctgaccacacccctcccaaggacctgtggacccagacagtcgaccctctcgaggcccccgacaagcctttcaactttgccgtccacttcgagaagggcctacctgtcaaggttgccacccctgaccaggaggccactgactcagtagagctcttcaagcttctcaacaagattggacacgatcacggcgttggccgaattgacattgtcgagaaccgatggatcggactcaaaagccgtggctgctacgatacccatggcttgaccattgctcgtctcgctcacgttgatctcgagggccttgtccttgactccaaggtccgtaagcttcgagatcaatttgtgactgttgaatggtctcagtgcctctacagcggcatgtacttctctcccgagcgtgagtggctcgatgaggctatcgtctctgctcagaagggcgtcaatggccaggtccgtctccaagtgtacaagggcaacgtctacgttctcggacgatcgagcgagaccagctccctctattcccaggaggacgcttccatggacagccttgacaccttctctcccatggatagcactggctttatcgctatccagtccattcgattggagaagtatggcgttcaaaaagccaaggatggtcaacctctcagccagtcttga

SEQ ID NO: 72909 - protein, 415 aa, Gibberella zeae PH-1
MSKGRVCLAYSGGLDTSTILKWLILEGYEVVCFLADVGQVEDFDAVEKKALALGAERMIIENLQKEFIEQIVFRAIQCNAIYEDRYLLGTALARPVIARAQVRVAEKYNCNLLSHGCTGKGNDQVRFELAFKACNPSIKIIAPWRLPEFCEKFQGRQDLLKFAAENNIPVSSTPKAPWSQDENLVHCSYEAGILEDPDHTPPKDLWTQTVDPLEAPDKPFNFAVHFEKGLPVKVATPDQEATDSVELFKLLNKIGHDHGVGRIDIVENRWIGLKSRGCYDTHGLTIARLAHVDLEGLVLDSKVRKLRDQFVTVEWSQCLYSGMYFSPEREWLDEAIVSAQKGVNGQVRLQVYKGNVYVLGRSSETSSLYSQEDASMDSLDTFSPMDSTGFIAIQSIRLEKYGVQKAKDGQPLSQS

SEQ ID NO: 72910 - DNA, 1263 bp, Candida glabrata CBS 138
  CDS (1)..(1263)
atgtctaaaggaaaagtttgtttggcatactctggtggtctagatacctccatcatcctagcttggttgctagaacaaggctacgaagttgttgctttcatggccgatgtcggtcaggaagaagacttcgaagccgctagagctaaggctttgaagattggtgctaccaaggttgttatcagtgacgtccgtgaacaatttgttaaggatatcatcttccctgccgtccaagtcaacgctgtctacgaagatgtctatttgctaggtacttctttggctagaccagttattgctaaggctcaaatcgatgttgctgaacaagaaggttgtttcgccgtttctcacggttgtaccggtaagggtaacgatcaaatcagattcgaactatctttctacgctttgaagccagacgtccaagtgatcgctccatggagattgccagaattcttcaacagatttgccggtagaaaggatctattggactacgccgcagaaaagggtatcccagtcgcacaaaccaaggccaagccatggtccaccgatgaaaacatggcgcacatctcttacgaggctggtatcctagaagacccaaatactaccccaccaaaggatatgtggaagttgattaccgacccaatggatgctccaaacactccacaagatatcacgctagatttcgaaaagggtatccctgttaagctaacatacaaggacaacgctactggtaaggaacatgtagtcactgacgccttggagttggcccttcacgtctctaacttgggtagagccaacggtgtcggcagaatcgacattgttgaaaaccgttacattaacttgaagtccagaggttgttacgagcaagccttgctaactattttgagaaaggcccacgtcgatcttgaaggtctggtgctagacaaggaagtccgtcaattgagagaccaatttgtcactaccacttactccaagctgctgtacaacggttcttacttcaccccagaatgtgaattcatcagagccatgatcgagccatctcaaaagaccgtcaacggtacagtcagactttctctatacaagggtaacgtgatagtactaggaagatactctaacactgaatccctgtatgacgccactgaatcctcaatggatgagctaacaggtttcctacctaccgataccaccggtttcatcgccatccaagccatcagagtcaagaagttcggtgaagccaagaaggccagcggtgagaagatcactttatag

SEQ ID NO: 72911 - protein, 420 aa, Candida glabrata CBS 138
MSKGKVCLAYSGGLDTSIILAWLLEQGYEVVAFMADVGQEEDFEAARAKALKIGATKVVISDVREQFVKDIIFPAVQVNAVYEDVYLLGTSLARPVIAKAQIDVAEQEGCFAVSHGCTGKGNDQIRFELSFYALKPDVQVIAPWRLPEFFNRFAGRKDLLDYAAEKGIPVAQTKAKPWSTDENMAHISYEAGILEDPNTTPPKDMWKLITDPMDAPNTPQDITLDFEKGIPVKLTYKDNATGKEHVVTDALELALHVSNLGRANGVGRIDIVENRYINLKSRGCYEQALLTILRKAHVDLEGLVLDKEVRQLRDQFVTTTYSKLLYNGSYFTPECEFIRAMIEPSQKTVNGTVRLSLYKGNVIVLGRYSNTESLYDATESSMDELTGFLPTDTTGFIAIQAIRVKKFGEAKKASGEKITL

SEQ ID NO: 72912 - DNA, 1263 bp, Kluyveromyces lactis NRRL Y-1140
  CDS (1)..(1263)
atgtctaaaggtaaggtttgtttggcatactccggtggtttggatacctctgtgattttggcctggttgttagaacaagggtacgaagttgttgccttcatggccaatgttggtcaagaagaagatttcgaagctgctgaaaagaaggctttactaattggtgctaccaagtttgttctagttgactgcagagaagaattcgtcaaggacgttttgttcccagctgttcaagttaacgcggtatacgaagacgtttatctgttaggtacctctttggctagacctgttatcgctaaggctcaaatcgacgtcgctaagcaagaaggttgtttcgctgtttctcatggttgcaccggtaagggtaacgatcaaattagattcgaattgggtttctacgcattgaaaccagacgtcaaggtcattgccccatggagagatccaactttcttcgacagatttgctggtagaaaagatctattggcttatgctgccgaaaagaacatccctgtgttccaaaccgcttctaaaccatggtccactgatgagaacttggctcatatctcctacgaagctggtattctagaagatccaaaccaaactcctccaaacgatatgtggaagttgatcactggtccagaagatgctccagatcaaccacaagatttggatatcgttttcgaaaagggtttgccagtgaagttgacttacaaggatgccgcttctggcaaagaaactactgctacttcaccattggatatcttcttgacttctgcgaaattggctagagctaacggtgttggtagaatcgatatcgttgaaaatcgttacatcaacttgaaatctagaggttgttacgaacaagctccattgtccgtcttgagaagagctcacgttgacttggaaggtttgactttggacaaagaagtccgtgccttgagagatcaatttgtcactccaaattactccagattgttgtacaacggttcatacttcactccagaatgtgaatatatcagatctatgatccaaccttcccaatctacagttaacggtaccgttagattgagactatacaagggtaacatcattgtgctaggcagatactcagagactgagaacctatacaatcctgatgaatcttctatggatatattgactggtttccaaccaaccgacactaccggtttcatcgctattcaagcgatcagagtaaaaaagtacggtgaatccaaggctgccaagggtgaagaactaactttataa

SEQ ID NO: 72913 - protein, 420 aa, Kluyveromyces lactis NRRL Y-1140
MSKGKVCLAYSGGLDTSVILAWLLEQGYEVVAFMANVGQEEDFEAAEKKALLIGATKFVLVDCREEFVKDVLFPAVQVNAVYEDVYLLGTSLARPVIAKAQIDVAKQEGCFAVSHGCTGKGNDQIRFELGFYALKPDVKVIAPWRDPTFFDRFAGRKDLLAYAAEKNIPVFQTASKPWSTDENLAHISYEAGILEDPNQTPPNDMWKLITGPEDAPDQPQDLDIVFEKGLPVKLTYKDAASGKETTATSPLDIFLTSAKLARANGVGRIDIVENRYINLKSRGCYEQAPLSVLRRAHVDLEGLTLDKEVRALRDQFVTPNYSRLLYNGSYFTPECEYIRSMIQPSQSTVNGTVRLRLYKGNIIVLGRYSETENLYNPDESSMDILTGFQPTDTTGFIAIQAIRVKKYGESKAAKGEELTL

SEQ ID NO: 72914 - DNA, 1251 bp, Debaryomyces hansenii CBS767
  CDS (1)..(1251)
atgtctaaaggtaaggtttgtttggcatactcaggtggtttagatacctcagtcattttggcttggttattggaagaaggatatgaagttatcgcttatttggctaacattggtcaagaggaagacttcgaagaagccgaaagaaaggctttagcaattggtgccaccaagtttgttgttgttgatgtcagaaaggaattcgttgaacaagtttgtttcccagctatccaaactaacgctatttacgagaatgtctacttattaggtacttcgttagctagaccagttattgctcaagctcacatcaaggttgctgaagaaaacggatgttttgctgtttctcacggttgtactggtaagggtaacgatcaagttagatttgaattagctttttatgcattgaaaccagatgttactgttattgctccatggagagacccagactttttcaacagatttgcaggtagaaaagatttattagaatatgctggttctaagaacatcccagttgctcaaaccaaggctaagccatggtcaaccgacgaaaacttggcccatatttccttcgaagctggtattttagaagatcctgataccactccacctaaggatatgtggaaattgactgtcgacccactcgatgctccagataccccagaagatttctctgtttactttgaaaaaggtataccaaagaaattgatcttagatggtggtaagaaggtcattactgaaccagtcgaattgtttactgaagctaacgctttagccagaagaaatggtgtcggtagaattgatattgttgagaacagattcattggtatcaaatctagaggttgttatgaaactcctggtttgaccattttaagatctgcacacattgatttggaaggtttgactcttgatcgtgaagtccgtgccattagagatcaatttgttaccactacttactccaaattattgtacaatggtatgtactttacaccagaatgtgagtatgttagaaccatgattgacccatcccaaaagaccgtaaatggtgttgtcagagctagagcttacaagggatccttgtctattttaggtagatcttctgatactgaaaagttatatgacgaaaccgaatcatctatggacgaattaactggcttttccccagaagacacatccggatttattgccgttcaatccattagaatcaaaaaatatggtgaagcagttagagaaaagggtaatacattatctttataa

SEQ ID NO: 72915 - protein, 416 aa, Debaryomyces hansenii CBS767
MSKGKVCLAYSGGLDTSVILAWLLEEGYEVIAYLANIGQEEDFEEAERKALAIGATKFVVVDVRKEFVEQVCFPAIQTNAIYENVYLLGTSLARPVIAQAHIKVAEENGCFAVSHGCTGKGNDQVRFELAFYALKPDVTVIAPWRDPDFFNRFAGRKDLLEYAGSKNIPVAQTKAKPWSTDENLAHISFEAGILEDPDTTPPKDMWKLTVDPLDAPDTPEDFSVYFEKGIPKKLILDGGKKVITEPVELFTEANALARRNGVGRIDIVENRFIGIKSRGCYETPGLTILRSAHIDLEGLTLDREVRAIRDQFVTTTYSKLLYNGMYFTPECEYVRTMIDPSQKTVNGVVRARAYKGSLSILGRSSDTEKLYDETESSMDELTGFSPEDTSGFIAVQSIRIKKYGEAVREKGNTLSL

SEQ ID NO: 72916 - DNA, 1407 bp, Aspergillus nidulans FGSC A4
  CDS (1)..(1407)
atgggcaaaggaaagatctgtgtcgccttcagcggtggtctcgacaccagcgttatcttgaaatggctcatcgatgagggctacgaggttgtcgctttcactgccgatgttggccaggaagaggacttcgccgccatcaaggagaaagctctgaagctcggtgccgtcaaggccgaagttgtcgatcttcgccgcgagtttgttgaggaactctgcttccccgccattgcttgcaacgccatttacgagaacgtctacctcctcggtacctctctggctcgtcccgtcattgctcgtgctcagatcgaagttgctaagcgggaaggatgctttgctgtctcccacggttgtaccggcaagggtaacgatcaggtccgtttcgagctcgccttctacgctctccagcccgacatcaaggtcatcgctccttggcgtgacccccgtttctacgagcgcttcgccggtcgcaacgatctcctcgcctacgccgctgagaagggtatccccgtcacttccaccaaggccaagccctggagtatggacgaaaatctggcccactgctcttatgaggctggtatcctggaggaccctgacatcactcctcccaccgacatgtggaagcttactgtcgacccccttgccgctcccgacaagcccgaggatttcaccgtccacttcgagaagggtctccccgttaagctcgagtacaccgagaacggccagcagaagactgctacggacgctgttgacatcttcttgactgccaacgccatcgctcgccgtaacggtatcggccgtatcgacattgttgagaaccgtttcatcggtatcaagtctcgcggctgctacgagacccctggtctcacctgcctgcgctccgcacacgttgaccttgagggtcttgtgctcgaccgtgaggttcgtgctctgcgtgaccagttcgttactatcaactactccaagctcctttacaacggtctctacttctctccggagcgtgagttccttgagcaggccatccctgcctcccagaagtcggtcaacggcaaggttcgctgccgcgcctacaagggcaacatgatcatcctcggccgttcctctgagaccgagaagctgtacgatatgtccgagtccagcatggacgagattggtgactttgctcccaccgagactaccggattcattggcgtgtctgccatccgtctgaagaagtacggtcagatgaagcaggccgctggcgagaagctaaaagtgatatggaataacacgctcgagggatatcccgcaacttcagcccctgtttctctccgcattcagggcggccaggcatggtctgaaactcacctatctaatgcgtcctcggacgaaaatcctgccgactatgggccaaacccaatcagcgattga

SEQ ID NO: 72917 - protein, 468 aa, Aspergillus nidulans FGSC A4
MGKGKICVAFSGGLDTSVILKWLIDEGYEVVAFTADVGQEEDFAAIKEKALKLGAVKAEVVDLRREFVEELCFPAIACNAIYENVYLLGTSLARPVIARAQIEVAKREGCFAVSHGCTGKGNDQVRFELAFYALQPDIKVIAPWRDPRFYERFAGRNDLLAYAAEKGIPVTSTKAKPWSMDENLAHCSYEAGILEDPDITPPTDMWKLTVDPLAAPDKPEDFTVHFEKGLPVKLEYTENGQQKTATDAVDIFLTANAIARRNGIGRIDIVENRFIGIKSRGCYETPGLTCLRSAHVDLEGLVLDREVRALRDQFVTINYSKLLYNGLYFSPEREFLEQAIPASQKSVNGKVRCRAYKGNMIILGRSSETEKLYDMSESSMDEIGDFAPTETTGFIGVSAIRLKKYGQMKQAAGEKLKVIWNNTLEGYPATSAPVSLRIQGGQAWSETHLSNASSDENPADYGPNPISD

SEQ ID NO: 72918 - DNA, 1482 bp, Candida albicans SC5314
  CDS (1)..(1482): transl_table=12
atgactaattcggtaattggacaattgaaaaattttttaaccgcgcttaacctattatccattcattcatcaagaaaagaaattttttttttcttaaactataaaagggatagtaaaaacttgttgaacgaaaatttcatatatcttttctttttctctttcttttcttttcttctctttttattccattcaatttatacacacacatatacacaaaacaccaacagaaacatgtcaaagggaaaagtttgtttagcctattcaggtggtttggacacctcagtcatcttagcctggttattagaacaaggttatgaagtcattgctttcttagccaacattggacaagaagaagattttgaagaagctgaaaaaaaggcattagccattggtgccaccaaatttgttgtggttgatgtcagaaaagaatttgttgaaaaagtttgtttcccagcaattcaatcaaatgccatttatgaaaatgtttatttgttaggtacttcattagctagaccagtcattgctcaagcacaaattaaagttgctgaagaaaatggttgttttgccgtttctcacggttgtactggtaaaggtaatgaccaggttagatttgaattgagtttctatgcattgaaaccagatgttgtggtcattgctccatggagagacccagaattcttccaaagatttgctggtagaaaagatcttttagattatgctgcttctaaaaacatcccagtggcacaaaccaaagctaaaccatggtctactgatgaaaacttggctcatatttcatttgaagctggtattttggaaaatccagatactactccaccaaaagatatgtggaaattaactgtggatccaactgatgccccagataaaccagaaactttctcagttgtttttgaaaaagggttaccagtgaaattgatcttggatgacagtaaaaaagaaattactgatccagtagaattattcattgaagctaattctttagctagaagaaatggggttggtagaattgatattgtggagaatagatttattggtattaaatccagaggttgttatgaaactccaggtttgaccatcttaagaaatactcacgttgatttagaaggattgactttagatcgtgaagttagagccatcagagatcaatttgtgacaccaacttgggccaaaatcttatacaatggtatgtacttcacaccagaaggagaatacgttcgttcaatgattcctccatctcaagtcactgttaatggagttgttagagctgctgcttataaaggatctgtcaccatattaggtagatcttcagacactgaaaaattatacgatgaaaccgaatcatcaatggatgaattgaccggattctcaccagaagatactagtgggtttattgctgtgcaagccattagaatcaagaaatacggtgaagctgccagagaaaagggtaaaccattggatttgtaa

SEQ ID NO: 72919 - protein, 493 aa, Candida albicans SC5314
MTNSVIGQLKNFLTALNLLSIHSSRKEIFFFLNYKRDSKNLLNENFIYLFFFSFFSFLLFLFHSIYTHTYTQNTNRNMSKGKVCLAYSGGLDTSVILAWLLEQGYEVIAFLANIGQEEDFEEAEKKALAIGATKFVVVDVRKEFVEKVCFPAIQSNAIYENVYLLGTSLARPVIAQAQIKVAEENGCFAVSHGCTGKGNDQVRFELSFYALKPDVVVIAPWRDPEFFQRFAGRKDLLDYAASKNIPVAQTKAKPWSTDENLAHISFEAGILENPDTTPPKDMWKLTVDPTDAPDKPETFSVVFEKGLPVKLILDDSKKEITDPVELFIEANSLARRNGVGRIDIVENRFIGIKSRGCYETPGLTILRNTHVDLEGLTLDREVRAIRDQFVTPTWAKILYNGMYFTPEGEYVRSMIPPSQVTVNGVVRAAAYKGSVTILGRSSDTEKLYDETESSMDELTGFSPEDTSGFIAVQAIRIKKYGEAAREKGKPLDL

SEQ ID NO: 72920 - DNA, 1281 bp, Ustilago maydis 521
  CDS (1)..(1281)
atgccaggacagaccggaaaggtgctgttggcctactctggtggactcgacacgtccaccatccttgcatggcttatcgatgagggctacgatgtcatcgccttcatggccgatgttggtcaggaggaggacttcgaggctgctcgctccaaggcgctcaaatgcggtgccaaggacttcatccttgccgatctcaggcgcgaatttatcgaggagctcatcttccctgccgtccaggccaacgccatctacgaggatgtctacctgctcggcacctcgctcgctcgtcctgtcattgcccgcggcatgatcgaggctgctgaaaagaccggctgccagttcgtctcgcacggctgcaccggtaagggcaacgaccaggtccgattcgagcttgccttctacggtctcaagcccgacatcaaggtgattgctccatggcgtatccccgagttcttcaaccgctttgccggccgatctgctttgctcgagtacgccgagtccaagggtatccctgttacccagaccaaggccaagccctggtcgaccgacgagaacctcttccacatctcgtacgaggctggtattctcgaagaccctaacaccacgcctcctgctgacatgtggaagctcaccaagagccccgagtcggctcccgacactcccgagcgtatcgtgatcgagttcaagcagggtcttccctccaaggtcaaggtgctctccacgggtaaggagcacactgaccccgtcgacgtcttcctcacgcttaacgctcttgcccgtgccaacggtatcggccgtatcgacattgtcgaaaaccgtttcatcggtgtcaagtcgcgtggctgctacgagtcgcccggtgccaccatcctgcgcgccgctcacttggacctggagggtctcacgctcgaccgcgaggttcgtcgtatccgtgaccaggtgatcactcagaagttctcggaacagctctactacggtttcttcttctcgcccgaatgcgagtttgtccgttcgtgcattccccaatcgcaaaagacggtcaacggtcaggtcaaggtggcgctgtacaagggtaacgtcattatcgagggccgaagctccgaggaattgctgtacgacgagaagttcacctcaatggacgagcagggtggtttcgattcggcggccaccagcggtttcatcaccgttcaggctatccgtctgcgccgatatggtctcggtctcagcgagaagggtcagggtggctcggatcgcgagaccgcctacgctatccgcaagtga

SEQ ID NO: 72921 - protein, 426 aa, Ustilago maydis 521
MPGQTGKVLLAYSGGLDTSTILAWLIDEGYDVIAFMADVGQEEDFEAARSKALKCGAKDFILADLRREFIEELIFPAVQANAIYEDVYLLGTSLARPVIARGMIEAAEKTGCQFVSHGCTGKGNDQVRFELAFYGLKPDIKVIAPWRIPEFFNRFAGRSALLEYAESKGIPVTQTKAKPWSTDENLFHISYEAGILEDPNTTPPADMWKLTKSPESAPDTPERIVIEFKQGLPSKVKVLSTGKEHTDPVDVFLTLNALARANGIGRIDIVENRFIGVKSRGCYESPGATILRAAHLDLEGLTLDREVRRIRDQVITQKFSEQLYYGFFFSPECEFVRSCIPQSQKTVNGQVKVALYKGNVIIEGRSSEELLYDEKFTSMDEQGGFDSAATSGFITVQAIRLRRYGLGLSEKGQGGSDRETAYAIRK

SEQ ID NO: 72922 - DNA, 1185 bp, Ehrlichia ruminantium str. Welgevonden
  CDS (1)..(1185): transl_table=11
atgaaaaaaatagttctagcttattctggtgggttagatacttctgttatattaaaatggttacaagaaaattataattgtgaagtagtagtatttaccgcagatataggacaagaagacgacatgtctgttattcaaaaaaaagcagctgcgttaaatgtaaaggaaatttttatagaagatttaaaggaagaatttgttagagatttcgtattccctatgtttagagcaaacactatatatgagggatattacctacttggaacatctatagcaagaccattaatagccaaaagacaaattgaaatagctcatcttacaggagcagatgctgtagcacatggtgcaactggaaaaggaaacgaccaagtaagatttgagtttggatattattgttgtgatccaaacataaaagtaattgctccttggcgtcagtgggaattaacatcaagacacagtcttatagaatatgcaagaaaaaataacataaatgttcctttagataaagtaaatgaaccaccatattcaatagatgcaaatttattacatatctcatacgaaggaaagtctcttgaagatccatatgttgaaccagattatactatgctttccagatcattgacaccagagctagcaagtagtattccggaatacatagaaattacctttgaacaaggagatccaatagcaatcaatgacatatcactttcaccagctaatttattacatcaattaaataagattggtggaaaacatggtataggaattgttgacatagtagaaaatcgttacataggaataaaatcaaggggaatatatgaaactcctggaggaacaattcttctacatgcacatcgtgctatagaaagcataacattagatagagaatctgctcatcttaaagatgagattatgccaaaatatgcaaagttaatatataatggttattggtggactactgaaaggaaaatgctacaatcattaatagataaatcacaagaaaaagttaatggaactgtacgcataaagctatataagggatcagttatagttgtaggtcgtaaatctaataatagcttatattcatataatttagcaagctttgatagtgaatctcagggttacgatcacaaagacgcagaaggatttataaaagttaattctttaaggttaaaaaaatcttaa

SEQ ID NO: 72923 - protein, 394 aa, Ehrlichia ruminantium str. Welgevonden
MKKIVLAYSGGLDTSVILKWLQENYNCEVVVFTADIGQEDDMSVIQKKAAALNVKEIFIEDLKEEFVRDFVFPMFRANTIYEGYYLLGTSIARPLIAKRQIEIAHLTGADAVAHGATGKGNDQVRFEFGYYCCDPNIKVIAPWRQWELTSRHSLIEYARKNNINVPLDKVNEPPYSIDANLLHISYEGKSLEDPYVEPDYTMLSRSLTPELASSIPEYIEITFEQGDPIAINDISLSPANLLHQLNKIGGKHGIGIVDIVENRYIGIKSRGIYETPGGTILLHAHRAIESITLDRESAHLKDEIMPKYAKLIYNGYWWTTERKMLQSLIDKSQEKVNGTVRIKLYKGSVIVVGRKSNNSLYSYNLASFDSESQGYDHKDAEGFIKVNSLRLKKS

SEQ ID NO: 72924 - DNA, 1218 bp, Pseudomonas syringae pv. syringae B728a
  CDS (1)..(1218): transl_table=11
atggcggacgtaaacaaggtagttctcgcgtattccggtggcctggatacttcggtaatcctcaagtggctgcaagatacgtacaactgcgaagtggtgacctttaccgctgacctgggtcagggtgaagaagtcgagccggcacgcgccaaggctcaggccatgggcgtgaaagaaatctacatcgatgacctgcgcgaagagttcgtgcgcgatttcgtcttcccgatgttccgtgccaacactgtctatgaaggcgagtacctgctgggtacctccatcgcccgtccgttgatcgccaaacgtctgatcgagatcgccaacgaaaccggcgctgacgccatttcccacggcgcaaccggcaagggtaacgaccaggtacgtttcgagctgggtgcctacgcgctcaagccaggcgtcaaggtcatcgctccgtggcgcgaatgggatctgctgtcgcgtgagaaactgatggactacgccgagaagcacaacattcccattgagcgtcacggcaagaagaaatctccgtactccatggacgccaacctgctgcacatctcttatgaaggcggcgtgctggaagacacctggaccgagcacgaagaagacatgtggcgctggaccaagtcccctgaggacgcgccaaacgttgcgacctaccttgagctgacctatcgcaatggcgacatcgttgccctggatggtgtcgaaatgaccccggccactgtgctcgcgaccctgaaccgcatcggtggcgaaaacggtatcggccgtctggatatcgttgaaaaccgttatgtgggcatgaagtcccgtggctgctacgagacgcctggtggcaccatcatgctgcgtgctcaccgtgccatcgagtcgatcaccctggaccgcgaagtcgcccacctcaaggacgaactcatggccaagtatgccagcctgatctacacaggttactggtggagccctgagcgcctgatgctgcagcagatgatcgacgcgtcccaggttcacgtgaacggcgttgtgcgtctgaagttgtacaagggcaatgtgatcgtcaccggtcgcaagtcggatgattcgctgttcgacgccaacattgccaccttcgaagacgacgcaggtgcctacgatcaggccgatgcagcgggcttcatcaagctcaacgcattgcgcatgcggattgccgccaacaagggccgcaagctgttctga

SEQ ID NO: 72925 - protein, 405 aa, Pseudomonas syringae pv. syringae B728a
MADVNKVVLAYSGGLDTSVILKWLQDTYNCEVVTFTADLGQGEEVEPARAKAQAMGVKEIYIDDLREEFVRDFVFPMFRANTVYEGEYLLGTSIARPLIAKRLIEIANETGADAISHGATGKGNDQVRFELGAYALKPGVKVIAPWREWDLLSREKLMDYAEKHNIPIERHGKKKSPYSMDANLLHISYEGGVLEDTWTEHEEDMWRWTKSPEDAPNVATYLELTYRNGDIVALDGVEMTPATVLATLNRIGGENGIGRLDIVENRYVGMKSRGCYETPGGTIMLRAHRAIESITLDREVAHLKDELMAKYASLIYTGYWWSPERLMLQQMIDASQVHVNGVVRLKLYKGNVIVTGRKSDDSLFDANIATFEDDAGAYDQADAAGFIKLNALRMRIAANKGRKLF

SEQ ID NO: 72926 - DNA, 1218 bp, Pseudomonas fluorescens Pf-5
  CDS (1)..(1218): transl_table=11
atggcggacgttaacaaggtcgttctggcgtattcgggcggcctggacacttcggtgatcctcaagtggctgcaggatacttacaactgtgaagtagtgactttcactgctgacctgggccaaggcgaagaggtcgagccggcccgcgccaaggcgcaagccatgggcgtcaaagagatctatatcgacgatctgcgcgaagagttcgtgcgtgatttcgtcttcccgatgttccgcgccaacaccgtctacgaaggcgagtacctgctgggtacttccatcgctcgtccgttgatcgccaagcgcctgatcgaaatcgccaacgaaaccggcgccgacgccatttcccatggcgccaccggcaagggcaacgatcaggtgcgtttcgaactgggcgcctacgccctcaagccgggtgtgaaggtgattgccccttggcgcgagtgggacctgctgtcccgcgagaagctgatggactacgccgagaagcacgggatcccgatcgagcgtcacggcaagaagaaatccccgtactcgatggatgccaacctgctgcacatctcctatgaaggtggcgtgctggaagacacctggaccgagcacgaagaagacatgtggcgctggactgtctccccggagaaggccccagataccccgcaatacctggaactgacctaccgcaacggcgatatcgtggcactggacggcgtcgagatgaccccggccaccgtgctggcgaccctgaaccgcatcggtggcgaacacggtatcggtcgtctggacatcgtcgagaaccgttacgtgggcatgaagtcccgcggctgctatgagacacctggcggcaccatcatgctgcgtgctcaccgcgccatcgagtccatcaccctggaccgcgaagtggctcacctcaaagacgagctgatgcccaagtacgccagcctgatctacaccggctactggtggagccctgagcgtctgatgctgcaacagatgatcgacgcctcccaggcccacgtgaatggtgtggtacgcctgaagctgtacaagggcaatgtgatcgtgaccggtcgcaagtctgacgagtcgctgttcgacgccaacatcgctaccttcgaagaggacggcggtgcctacaaccaggcggacgcagctggcttcatcaagctcaacgccctgcgcatgcgcattgccgcgaacaagggtcggaccctggtctga

SEQ ID NO: 72927 - protein, 405 aa, Pseudomonas fluorescens Pf-5
MADVNKVVLAYSGGLDTSVILKWLQDTYNCEVVTFTADLGQGEEVEPARAKAQAMGVKEIYIDDLREEFVRDFVFPMFRANTVYEGEYLLGTSIARPLIAKRLIEIANETGADAISHGATGKGNDQVRFELGAYALKPGVKVIAPWREWDLLSREKLMDYAEKHGIPIERHGKKKSPYSMDANLLHISYEGGVLEDTWTEHEEDMWRWTVSPEKAPDTPQYLELTYRNGDIVALDGVEMTPATVLATLNRIGGEHGIGRLDIVENRYVGMKSRGCYETPGGTIMLRAHRAIESITLDREVAHLKDELMPKYASLIYTGYWWSPERLMLQQMIDASQAHVNGVVRLKLYKGNVIVTGRKSDESLFDANIATFEEDGGAYNQADAAGFIKLNALRMRIAANKGRTLV

SEQ ID NO: 72928 - DNA, 1239 bp, Psychrobacter arcticus 273-4
  CDS (1)..(1239): transl_table=11
atggctcagcttgatccaaaaactattaataaaatcgtgttggcatattcagggggtcttgatacctcaatcatcgctcgatggctacaagaaacctatgatgcagaagtgattacttttaccgctgacatcggtcaaggtgaagaagttgagcctgcacgtgccaaagctgaagccatgggtatcaaacatatccatatcgaagacttgcgtgaagagtttgctcgtgactacgtattcccaatgttccgtgccaacgccatctatgaaggcgagtatttgcttggcacttctatcgcccgtccactaatcgctaagcgtttggttgaaattgccaaagaacacaacgctgatgccatcagccatggcgcgaccggtaaaggtaatgaccaagtgcggtttgagcttggtgctgttgcactgtctcctgatgtcgtgactatcgcgccttggcgtgagtgggatttatcgagccgtgaaagcttgatggaatatgctaaagagcataatatctccatcgactatgctggtaataagaaaaaatctccgtattcaatggacgccaacttactacacatctcatatgaaggtggcatcttagaagatccgtatgctgaagcagaagatgatatgtggcgctggtcagttagcccagaacaagcacctgacgtgccgcaatatctggagttagagtatgcaaaaggtgatatcgttgcgattgatggtgaagcgcttaagccttatgaagtaatgattaagctcaatgaaattggcggtaagcatggtatcggacgtttagatatcgttgaaaaccgttacgttggcatgaagtcacgcggctgctatgaaacaccagctggcaccattatgctaaaagcgcatcgcggcattgagtcattgacacttgaccgtgaagcggcacatctaaaagatgagctgatgccacgttatgctaagactatctacaacggctattggttcagccctgagcgtatgatgctacaggcgttgattgataagtcacaagagtatgttaatggtacggtacgtgtcaaattatacaaaggtgcggtaagcgtcgttggtcgtaagtcagatgactcattatttgatgaaaaaatcgcgacttttgaagatgatgcgggcgcctatgatcaaaaagatgcagaaggtttcattcgtctaaatggtctacgtttggcaattgaagccagccgtggtcgcgatttatcaaaataa

SEQ ID NO: 72929 - protein, 412 aa, Psychrobacter arcticus 273-4
MAQLDPKTINKIVLAYSGGLDTSIIARWLQETYDAEVITFTADIGQGEEVEPARAKAEAMGIKHIHIEDLREEFARDYVFPMFRANAIYEGEYLLGTSIARPLIAKRLVEIAKEHNADAISHGATGKGNDQVRFELGAVALSPDVVTIAPWREWDLSSRESLMEYAKEHNISIDYAGNKKKSPYSMDANLLHISYEGGILEDPYAEAEDDMWRWSVSPEQAPDVPQYLELEYAKGDIVAIDGEALKPYEVMIKLNEIGGKHGIGRLDIVENRYVGMKSRGCYETPAGTIMLKAHRGIESLTLDREAAHLKDELMPRYAKTIYNGYWFSPERMMLQALIDKSQEYVNGTVRVKLYKGAVSVVGRKSDDSLFDEKIATFEDDAGAYDQKDAEGFIRLNGLRLAIEASRGRDLSK

SEQ ID NO: 72930 - DNA, 1218 bp, Pseudomonas syringae pv. phaseolicola 1448A
  CDS (1)..(1218): transl_table=11
atggcggacgtaaacaaggtagttctcgcgtattccggtggcctggatacttcggtaatcctcaagtggctgcaagatacgtacaactgcgaagtggtgacctttaccgctgacctgggtcagggtgaagaagtcgagccggcgcgcgccaaggctcaggccatgggcgtgaaagaaatctacatcgatgacctgcgcgaagaattcgtgcgtgatttcgtgttcccgatgttccgtgccaacaccgtctatgaaggcgagtacctgctgggcacttccatcgctcgcccgctgatcgccaagcgcctgatcgagatcgccaacgaaaccggcgctgatgccatttcccatggtgccaccggcaaaggcaacgatcaggtgcgtttcgaattgggcgcctacgcgctcaagccaggggtcaaagtgattgctccgtggcgtgaatgggacctgctgtctcgtgaaaagctgatggactacgccgagaagcacaacattccgatcgagcgtcacggcaagaagaaatccccgtactcgatggatgccaatctgctgcacatctcctatgagggcggcgtgctggaagacacctggaccgagcacgaagaagacatgtggcgctggaccaagtcccctgaggacgcgccgaacgttgcaacttatctggagctgacctaccgcaatggcgacatcgttgcgctggacggcgttgagatgacgcctgccactgtgttggcgaccctgaaccgcatcggtggcgaaaacggcatcggacgtctggatatcgttgaaaaccgctacgtgggcatgaagtcccgtggctgctacgagacaccgggcggcaccatcatgctgcgcgctcaccgcgccattgaatcgatcaccctggaccgtgaagtcgcccacctcaaggacgaactgatggccaagtacgccagcctgatctacaccggttactggtggagcccggagcgtcttatgctgcagcagatgatcgacgcgtctcaggcccatgtgaacggtgttgtacgtctgaagctttataagggcaatgtgatcgtcaccggtcgcaagtcggacgattcattgttcgatgccaatattgctacctttgaagatgacgcaggcgcctatgatcaggctgatgcggcaggcttcataaagctcaatgccttgcgtatgcgtattgctgcgaataaaggccgcaagctgttctga

SEQ ID NO: 72931 - protein, 405 aa, Pseudomonas syringae pv. phaseolicola 1448A
MADVNKVVLAYSGGLDTSVILKWLQDTYNCEVVTFTADLGQGEEVEPARAKAQAMGVKEIYIDDLREEFVRDFVFPMFRANTVYEGEYLLGTSIARPLIAKRLIEIANETGADAISHGATGKGNDQVRFELGAYALKPGVKVIAPWREWDLLSREKLMDYAEKHNIPIERHGKKKSPYSMDANLLHISYEGGVLEDTWTEHEEDMWRWTKSPEDAPNVATYLELTYRNGDIVALDGVEMTPATVLATLNRIGGENGIGRLDIVENRYVGMKSRGCYETPGGTIMLRAHRAIESITLDREVAHLKDELMAKYASLIYTGYWWSPERLMLQQMIDASQAHVNGVVRLKLYKGNVIVTGRKSDDSLFDANIATFEDDAGAYDQADAAGFIKLNALRMRIAANKGRKLF

SEQ ID NO: 72932 - DNA, 1407 bp, Dechloromonas aromatica RCB
  CDS (1)..(1407): transl_table=11
atgagcgatatcaagaaggttgtgctggcctattcgggcggtctggatacttcggtcatcctcaagtggctgcaggatgtttacaagtgtgaagtcgttaccttcacggccgacctcggtcagggtgaggaactggagccggcgcgtgccaaggcactgaaggccggcatcaagccgaagaacatttatatcgacgacgtgcgcgaggagttcgtccgcgacttcgtcttcccgatgttccgtgccaacaccgtctatgaaggcgaatacctgctcggtacctccatcgcccgtccgctgattgccaagcgtctgatcgagatcgtcaatgaaaccggtgccgatgccatctgtcatggcgcaaccggcaaagggaacgatcaggtccgtttcgaactcggtgcctatgcgctgaagccgggcatcaaggtcattgccccgtggcgcgagtgggacctgatgtcccgtgaaaaattgatggcctatgccgagaagcatggcatcgagattgacatgaagcacaagaagggcggctccccgtactcgatggatgccaacctgctgcacatctcctatgaaggtcgccatctggaagacccggcggccgaggctgaagagtcgatgtggcggtggactgtgtcgccggaaaaggcaccgaacaaggccgagtacctcgatctggaatttgccaagggtgatgtcgtcgcggtcaatggcaagaagctgaaggctcatgaagtgctggccctgctcaacgagttgggtggcaagcacggcatcggccgtctcgatctggttgagaaccgctatgtcggcatgaagtcacgtggctgttacgaaaccccgggcggcaccattctgctgcgcgcccaccgcgccatcgagtcggtgacccttgaccgcgaagttgcccacctcaaggatgacctgatgccgcgctacgccagcctggtgtacaacggctactggtggagcccggagcgtaaggcgctgcaggtgctgatcgatcacacgcaacagacggtcaacggcgttgttcgcctgaagctgtacaagggcaacgtcatcgtcgtcggtcgcgattcgaagacggattcgctgttcgactcgaccattgccacttttgaggatgacgccggtgcttacgaccagcgcgatgcaggcggctttatcaagctgaatgcgctgcgtttacgtattgcggccaatctggctggccgcaaggctggcaagccggttgcgaagaaggctgctgccaagcctgtcaccaaagctgtccccaaggcggttgccaagccggtgacgaaggctgtagcaaaggccgctgaaaaaccggttgccgccaaagctaccgccaagcctgtcaaggctccggtcaagaagccaatcgccaaaaagaagggctaa

SEQ ID NO: 72933 - protein, 468 aa, Dechloromonas aromatica RCB
MSDIKKVVLAYSGGLDTSVILKWLQDVYKCEVVTFTADLGQGEELEPARAKALKAGIKPKNIYIDDVREEFVRDFVFPMFRANTVYEGEYLLGTSIARPLIAKRLIEIVNETGADAICHGATGKGNDQVRFELGAYALKPGIKVIAPWREWDLMSREKLMAYAEKHGIEIDMKHKKGGSPYSMDANLLHISYEGRHLEDPAAEAEESMWRWTVSPEKAPNKAEYLDLEFAKGDVVAVNGKKLKAHEVLALLNELGGKHGIGRLDLVENRYVGMKSRGCYETPGGTILLRAHRAIESVTLDREVAHLKDDLMPRYASLVYNGYWWSPERKALQVLIDHTQQTVNGVVRLKLYKGNVIVVGRDSKTDSLFDSTIATFEDDAGAYDQRDAGGFIKLNALRLRIAANLAGRKAGKPVAKKAAAKPVTKAVPKAVAKPVTKAVAKAAEKPVAAKATAKPVKAPVKKPIAKKKG

SEQ ID NO: 72934 - DNA, 1188 bp, Methanosarcina barkeri str. fusaro
  CDS (1)..(1188): transl_table=11
atggcaaagaaagttgcacttgcatattcaggagggcttgacacctcagtgtgcatccctatccttaaggaaaagtacggatacgacgaagtagttacgatttcagtcgatgtcggccagcctgaagaggaaatcaagcgggcagacgcaaaagccgagaagatcagcaacaagcattatacgatcgatgcaaaggaagagttcgttaaagattacgtcttccccctgatcaaagccaacggaagctacgaaggctatgtaatgggaacctcaattgcccgcccgttgatcgcaaaaaaagtggtcgaggctgccaggaaagaaggagcagtagcccttgcgcacggctgcacaggaaaaggcaatgaccagctccgtttcgaggccgttttccgccagaccgacatggatgttatcgccccaatgcgggaaatgaacctgacccgcgagtgggaaatcgactatgcaaaagagcacggaatcccggtggaagtcacaaagtccaagccctggagcgttgacgaaaacatctggagccgcagcatcgaaggcggcaggcttgaagacccctcttttgtcccgccggaagagatcttcgagtggacaacctcgcctgaaaaaacccctgaacagcccaggattgttgacatcggttttgaagctggagtcccggtttcccttgacggcgaaaaaatgagcggctacgcccttgtgaagaaaatgaatgaaatcgcaggcgaaaacggcgttggcagaaccgatatgattgaagaccgcgtgctcggcttaaaagctcgcgagaactatgaacacccggctgcaaccgttcttctggcagcacacgccgacctcgagaaactcgtcctgacccgcagcgaactcaagttcaagaagatcgtggacgaccagtggtccgaacttgcctattacgggcttgtggacgagccgctttatgccgacctgaacgcttttatcgacaagtcccaggaaagggttacaggtacagtgaaagtcaggctctacaaaggcgccctcacaatcctttcccgcagctcgccgaatgctctctattctgaagacctggtttcgtttgacagccagaccattgaccagaaggactcagaagggtttgcgaagtatcacgggttccaggcgaggatgtacaggaaggttatggataagcagtaa

SEQ ID NO: 72935 - protein, 395 aa, Methanosarcina barkeri str. fusaro
MAKKVALAYSGGLDTSVCIPILKEKYGYDEVVTISVDVGQPEEEIKRADAKAEKISNKHYTIDAKEEFVKDYVFPLIKANGSYEGYVMGTSIARPLIAKKVVEAARKEGAVALAHGCTGKGNDQLRFEAVFRQTDMDVIAPMREMNLTREWEIDYAKEHGIPVEVTKSKPWSVDENIWSRSIEGGRLEDPSFVPPEEIFEWTTSPEKTPEQPRIVDIGFEAGVPVSLDGEKMSGYALVKKMNEIAGENGVGRTDMIEDRVLGLKARENYEHPAATVLLAAHADLEKLVLTRSELKFKKIVDDQWSELAYYGLVDEPLYADLNAFIDKSQERVTGTVKVRLYKGALTILSRSSPNALYSEDLVSFDSQTIDQKDSEGFAKYHGFQARMYRKVMDKQ

SEQ ID NO: 72936 - DNA, 1371 bp, Thiobacillus denitrificans ATCC 25259
  CDS (1)..(1371): transl_table=11
atggccgcgtcgtcggcatcgaaatcgaaaaggcgagccaggccgccaatctcgacattctcaagatcggcggcttcccgggccagatcgagatcatcgacacgaacacttccggctccacccattaatccagcgactcccatgagcgacatcaagaaagttgtactggcctattccggcggcctcgacacctcggtcatcctgaaatggctgcaggacacctaccaatgcgaggtggtgaccttcaccgccgacctcggccagggcgaggaactcgaaccggcgcggcagaaggcactgcagttcggcatcaaacctgaacagatctacatcgacgacctgcgcgaggaattcgtgcgcgacttcgtcttcccgatgttccgcgcgaataccgtgtacgaaggcgaatatctgctcggcacgtcgatcgcgcggccgctgatcgccaagcggctgatcgagatcgtcaacgcaaccggcgccgacgcgatctgtcacggcgccaccggtaagggcaacgaccaggtgcgcttcgaactcggcgcctacgcgctgaaacccgacgtcaaggtcatcgcgccgtggcgcgagtgggacctgctctcgcgcgagaagctgctcgcctacgcagaatcccatggcattccgatcgacatgaagcatcgccagggcggctcgccttattcgatggacgcgaacctgctgcatatttcctacgaaggccgccacctcgaggaccccagcgccgaagccgaagaagacatgtggcgctggaccgtgtcgcccgagaaggcgcccgacgcggccgaatacatcgaactgacctacgcgaaaggtgatgtcgtcgcgatcgacggccagcaaatgcctgcccacgaagtgctcgccaagctcaacgaactgggcggcaagcacggcatcggccggctcgacctcgtcgagaaccgctacgtcggcatgaagtcgcggggctgctacgaaacgcccggcggcaccatcctgctgaaggcgcaccgtgcgatcgagtcgatcacgctcgatcgcgaggtcgcgcatctgaaggacgacctgatgccgcgctacgccagcctgatctacaacggctactggtgggcgcccgagcggcgcgcgctgcaggtgctgatcgaccacacgcaggcgcacgtcaacggcacggtgcggctcaagctctacaagggcaacgtcatcgtcgtcggccgcgattcgaagaacgattcgctgttcgactcgaccatcgcaaccttcgaggacgacgcgggcgcctacgatcagaaggacgccggcggtttcatcaagctcaacgcgctgcgcatgcgcatcgccgcaaaactcgacgcacggagaaaataa

SEQ ID NO: 72937 - protein, 456 aa, Thiobacillus denitrificans ATCC 25259
MAASSASKSKRRARPPISTFSRSAASRARSRSSTRTLPAPPINPATPMSDIKKVVLAYSGGLDTSVILKWLQDTYQCEVVTFTADLGQGEELEPARQKALQFGIKPEQIYIDDLREEFVRDFVFPMFRANTVYEGEYLLGTSIARPLIAKRLIEIVNATGADAICHGATGKGNDQVRFELGAYALKPDVKVIAPWREWDLLSREKLLAYAESHGIPIDMKHRQGGSPYSMDANLLHISYEGRHLEDPSAEAEEDMWRWTVSPEKAPDAAEYIELTYAKGDVVAIDGQQMPAHEVLAKLNELGGKHGIGRLDLVENRYVGMKSRGCYETPGGTILLKAHRAIESITLDREVAHLKDDLMPRYASLIYNGYWWAPERRALQVLIDHTQAHVNGTVRLKLYKGNVIVVGRDSKNDSLFDSTIATFEDDAGAYDQKDAGGFIKLNALRMRIAAKLDARRK

SEQ ID NO: 72938 - DNA, 1218 bp, Pseudomonas fluorescens PfO-1
  CDS (1)..(1218): transl_table=11
atggcggacgtaaacaaggtcgttctggcgtattccggcggcctggacacttcggtgatcctcaagtggctgcaggatacttataactgtgaagtcgtgaccttcaccgctgacctgggtcagggcgaagaggtcgagccggctcgcgccaaggcgcaggccatgggcgtcaaagaaatctacatcgacgacctgcgcgaagaattcgtgcgtgacttcgtgttcccgatgttccgcgccaacaccgtttacgaaggcgagtacctgctgggtacttccattgcgcgtccgctgatcgccaagcgtctgatcgaaatcgccaacgaaaccggcgccgacgccatttcccacggcgcaaccggcaagggcaacgaccaggtgcgtttcgaactgggtgcctacgcgctcaagccaggcgtgaaagtgatcgccccttggcgcgagtgggacctgctgtcccgcgagaaactgatggactacgccgagaagcacgcgatcccgatcgagcgtcacggcaagaagaaatccccgtactcgatggacgccaacctgctgcacatctcctatgaaggcggcgtgctggaagacacctggaccgagcacgaagaagacatgtggcgctggaccgtctccccggagaaggctcccgacaccccgcaatacctggaactgacctaccgcaacggcgacatcgtcgcgctggacggcgtcgaaatgactccggccaccgtactggcgaccctgaacaggatcggtggcgagcacggcatcggccgtctggacatcgtcgagaaccgttatgtcggcatgaagtcccgtggctgctacgaaaccccgggcggcaccatcatgctgcgcgctcaccgcgccatcgaatcgatcaccctggaccgcgaagtcgctcacctcaaagacgagctgatgccgaagtacgccagcctgatctacaccggttactggtggagccctgagcgtctgatgctgcaacagatgatcgacgcttctcaggtcaacgtgaacggcgttgtgcgccttaagctgtacaagggcaacgtgatcgtgaccggccgcaagtccgacgattcgctgttcgacgccaacatcgcgaccttcgaagaagacggcggcgcctacaaccaggccgacgcggcgggcttcatcaagctcaacgcactgcgcatgcgtattgctgccaacaagggccgcaagttgttctaa

SEQ ID NO: 72939 - protein, 405 aa, Pseudomonas fluorescens PfO-1
MADVNKVVLAYSGGLDTSVILKWLQDTYNCEVVTFTADLGQGEEVEPARAKAQAMGVKEIYIDDLREEFVRDFVFPMFRANTVYEGEYLLGTSIARPLIAKRLIEIANETGADAISHGATGKGNDQVRFELGAYALKPGVKVIAPWREWDLLSREKLMDYAEKHAIPIERHGKKKSPYSMDANLLHISYEGGVLEDTWTEHEEDMWRWTVSPEKAPDTPQYLELTYRNGDIVALDGVEMTPATVLATLNRIGGEHGIGRLDIVENRYVGMKSRGCYETPGGTIMLRAHRAIESITLDREVAHLKDELMPKYASLIYTGYWWSPERLMLQQMIDASQVNVNGVVRLKLYKGNVIVTGRKSDDSLFDANIATFEEDGGAYNQADAAGFIKLNALRMRIAANKGRKLF

SEQ ID NO: 72940 - DNA, 1227 bp, Rhodobacter sphaeroides 2.4.1
  CDS (1)..(1227): transl_table=11
atgtccgccccgaagaaagtcgtccttgcctattccggcgggctcgacacctcgatcatcctgaagtggctgcagaccgaatatggctgcgaggtcgtgaccttcaccgccgacctcggccagggcgaggagcttgagcccgcccgcgagaaggcggtgatgctgggcatcaagccagaaaacattttcattgaggatgtgcgcgaagagttcgtgcgcgacttcgtcttcccgatgttccgggcgaacgcgctttacgaagggctctatctgctcggcacctcgatcgcgcggccgctgatcgccaagcggctggtcgagatcgcggcccagaccggcgccgacgcggtggcccacggcgccaccggcaagggcaacgaccaggttcgcttcgaactgacggcctatgcgctcgacccggcgatcaaggtgatcgcgccctggcgcgaatgggacctgacttcgcgcacgaaactcctcgaattcgccgaacagaaccagatcccgatcgccaagaacaagcgcggcgaagcgcccttctcggtcgatgcgaacctgctgcacacctcgtccgagggccgcgtgctggagaacccgggcgaggaagccccggattacgtctaccagcgcaccgtcgatcccgagaaggcgcccgacgcgcccgagttcgtggagatcgccttcgagaagggcgatgcggtcgccatcaacggcgaagccatgtcgcccgcgaccatcctcacgaagctcaacgagcttggcggcaagcacggggtgggccgtctcgatctggtggaaaaccgtttcgtcggcatgaagtcgcgcgggatctacgagacgcccggcggcacgatcctgctggaggcccaccgcggcatcgaacagatcacgctcgactcgggcgcaggccacctgaaggattcgatcatgccgcgctatgccgagctgatctacaacggcttctggtacagccccgagcgcgagatgcttcaggcactgatcgacaagtcgcaggaacatgtcaccggcaccgtgcgcgtcaagctttacaagggcttcgcccgcaccgtcgcccgttggtcggagcattcgctttattccgagaagcacgtcaccttcgaggaggatgcgggcgcctacgaccagaaggacgcggccggcttcatccggctgaacgccctgcggctgaagctgatcgcgacacgcaacgcccgcgtgaagggctga

SEQ ID NO: 72941 - protein, 408 aa, Rhodobacter sphaeroides 2.4.1
MSAPKKVVLAYSGGLDTSIILKWLQTEYGCEVVTFTADLGQGEELEPAREKAVMLGIKPENIFIEDVREEFVRDFVFPMFRANALYEGLYLLGTSIARPLIAKRLVEIAAQTGADAVAHGATGKGNDQVRFELTAYALDPAIKVIAPWREWDLTSRTKLLEFAEQNQIPIAKNKRGEAPFSVDANLLHTSSEGRVLENPGEEAPDYVYQRTVDPEKAPDAPEFVEIAFEKGDAVAINGEAMSPATILTKLNELGGKHGVGRLDLVENRFVGMKSRGIYETPGGTILLEAHRGIEQITLDSGAGHLKDSIMPRYAELIYNGFWYSPEREMLQALIDKSQEHVTGTVRVKLYKGFARTVARWSEHSLYSEKHVTFEEDAGAYDQKDAAGFIRLNALRLKLIATRNARVKG

SEQ ID NO: 72942 - DNA, 1206 bp, Carboxydothermus hydrogenoformans Z-2901
  CDS (1)..(1206): transl_table=11
atggcggaaaaagtagttttggcttattccggtggcctggatacctcgattatcattccctggcttaaagaaaattacggttacgaagtcattgccatggtggccgatgtgggccagggggaagaattagagcctttaagggaaaaggcgattaaaagcggcgctgccaaaatatatattgaagatgttaaggaagagtttgtccgggattttgtttttcccatgctgaaagcaggagcggtgtacgaaaataaataccttctgggaacttcggtagcccgtccgcttattgctaaaaagttggtggagatagcggaaaaggaaggggcggtggcggtagctcacggggcaaccggtaagggtaacgaccaggtacgttttgaacttaccgttaaagcgttaaatccggatttaaaaatcatcgctccctggcgggaatgggagataaaatcccgggaagatgccattgattatgccgaaaagagagggattccggtaccggttaccaagaagcagccttacagcatggatagaaacctctggcatctttcccacgaagggggtattttagaagacccggccgttgaaccgccggaagatgtgctcctacttaccaaccctccggaaaaagcaccggaccagccggagtatgtagaaatagagtttgttaaaggagaaccggtagcggtaaacggggaaaaactttcgccggtggaattaatttttaagcttaatgagcttggcggaaagcacggaattggtattgccgacatggtggaaaaccgtttggtgggtatgaaatcccggggagtatacgaaactcccggagggaccattttaacctttgctcaccgggagttagagagcttaactttagaccggcagaccatgcactttaaacagatggtagccttaaagtatgccgaacttatttacgatggcttatggtttacgcctctaagggaagctctggaagcttttgtggacaaaacccaggaaacggttacaggaaaagtcagagttaagctttacaaaggaaatatttacccggccggtataacttctccttactccctttatgttaaagatttagctacctttggtgaagataacctctataaccagaaggatgccgaaggatttattaatttatttggtcttccacttaaagtaagggctatgacccagaaaccataccagaagtag

SEQ ID NO: 72943 - protein, 401 aa, Carboxydothermus hydrogenoformans Z-2901
MAEKVVLAYSGGLDTSIIIPWLKENYGYEVIAMVADVGQGEELEPLREKAIKSGAAKIYIEDVKEEFVRDFVFPMLKAGAVYENKYLLGTSVARPLIAKKLVEIAEKEGAVAVAHGATGKGNDQVRFELTVKALNPDLKIIAPWREWEIKSREDAIDYAEKRGIPVPVTKKQPYSMDRNLWHLSHEGGILEDPAVEPPEDVLLLTNPPEKAPDQPEYVEIEFVKGEPVAVNGEKLSPVELIFKLNELGGKHGIGIADMVENRLVGMKSRGVYETPGGTILTFAHRELESLTLDRQTMHFKQMVALKYAELIYDGLWFTPLREALEAFVDKTQETVTGKVRVKLYKGNIYPAGITSPYSLYVKDLATFGEDNLYNQKDAEGFINLFGLPLKVRAMTQKPYQK

SEQ ID NO: 72944 - DNA, 1221 bp, Geobacter metallireducens GS-15
  CDS (1)..(1221): transl_table=11
atggccaaagtgcacaaagacgtgaaaaagatcgtcctcgcctactcgggcgggctcgacacctccatcatcctcaagtggctcaagaacgagtacggctgcgaggtcatagccttctccgccgacctgggccagggcgacgagcttgccccgatccgcgacaaagccttcgctaccggcgccgacaaggtctatatcgacgatctgaaggaagagttcgtcagggacttcgtattccccatgttccgcgccaacgccatctacgagggtcactacctcctgggcacctccatcgcccggccactcatcgccaagcgccagatggagatcgcgaagatcgagggagccgacgccgtatcccatggcgccaccggcaaggggaacgatcaggtccgtttcgagctggcctactaccactttgacccggccatcacggttgtggtcccgtggcgggagtggaagctcaacagccgccaggccctggtgaactacgccaagaaaaacgggattccgatcccggtcaccaagaagcgtccctggtcctcggaccgcaacatgcttcacatctccttcgaagggggtatcctggaggatacctgggccgagccccccgagaacatgtacgtgctcaccaaggcgccggagaaggcccccaacaagccccagttcgtggagatcgagttcaagaacggcaacgccgtggccgttgacggcgagaagatgagcccggcccagcttctggcccacctgaactacatcggcggcgagcacggcatcggccgggtggacctgctggagaaccgttccgtggggatgaagtcacggggcgtgtacgagacccccggcggcaccatcctgcgcgaggcccactcggcggtggagcagatcaccatggaccgcgaagtcatgagaatccgcgactcccttatccccgagtacgcccgccaggtctattccggctactggttctccccggagcgggaaatgctccagaccctgattgacgactcccagaagtgcgtgaacggcgtggcccgggtgaagctctacaaggggcattgccgcaccgtaggccgcaagtccgagaccaactccctcttcaacctggatttcgccaccttcgagaaggatcaggtattcaaccaggccgacgccaccggcttcatcaagatcaactccctgcggctgcggatcagggcgctcatgcaggggaaaaagtag

SEQ ID NO: 72945 - protein, 406 aa, Geobacter metallireducens GS-15
MAKVHKDVKKIVLAYSGGLDTSIILKWLKNEYGCEVIAFSADLGQGDELAPIRDKAFATGADKVYIDDLKEEFVRDFVFPMFRANAIYEGHYLLGTSIARPLIAKRQMEIAKIEGADAVSHGATGKGNDQVRFELAYYHFDPAITVVVPWREWKLNSRQALVNYAKKNGIPIPVTKKRPWSSDRNMLHISFEGGILEDTWAEPPENMYVLTKAPEKAPNKPQFVEIEFKNGNAVAVDGEKMSPAQLLAHLNYIGGEHGIGRVDLLENRSVGMKSRGVYETPGGTILREAHSAVEQITMDREVMRIRDSLIPEYARQVYSGYWFSPEREMLQTLIDDSQKCVNGVARVKLYKGHCRTVGRKSETNSLFNLDFATFEKDQVFNQADATGFIKINSLRLRIRALMQGKK

SEQ ID NO: 72946 - DNA, 1203 bp, Desulfovibrio desulfuricans G20
  CDS (1)..(1203): transl_table=11
atgggtaaagaaatcaaaaaggtagtgcttgcctattccggcgggctggatacgtcggtcatcctgaagtggattgccaagacatatgattgcgaagtggtgacgctgactgccgatctggggcaggaggaagatctggacggcgtggatgaaaaagcgctgcgcacaggggccaccagagcctatgtggaagacctgcgcgaagagttcgcccgcgatttcatttttcccatgatgcgtgcctgcgccatttacgaaggccgctatctgctgggcacttccatcgcccgtccgctcattacccgccgtctggtggaaatagcccacgcggaaggagcacaggcagtggcccacggtgctaccggcaaaggcaacgatcaggtgcggttcgagctggcttccgccgcacttgacccgtcgctcaaggtcattgctccgtggcgcgaatgggatttccgctcccgtaccgacctgctcaactttgctgcagaaaatgatattcccgttatttctgccggtaaccgcaaactgtacagtatggacagaaacatgctgcactgcagctttgaaggcggcgaactggaagacccgtggaacgagccgggaccgggcagttatatcatggcagtaccggtagagcaggctcctgacgagccggaatacatcaccatcgattttgaaaaaggcaacgccgtggcaatcaacggtcaggccatgtcgcctgccgccatcatcaaaacgctgaacacacttggcggcaagcacggtgtaggacgtctggacatggtggaaaaccgttttgtgggcatgaagtcgcgcggtgtgtatgaaacccccggcggcaccgtgctgcatgcggcacaccgcgacctcgaaggcatatgccttgaccgtgaagccctgcatctgcgcgacagcctgataccccgctacgccgcggccgtgtacaacggtttctggtactcgccggagcgcgaagccctgcaggctctggtagacaagacacaggaaaacgtgaccggaacagtgcgcgtgaagctgtataaaggcaatgtcgtgcccgtgggccgcaagtcgccgtattcactgtaccgtatggatcttgcgacctttgaggaagatgaagtttacaatcaggcagacgccgccggctttatccgcctgaacagtctgcgcattcagggttacggcaggagaagctga

SEQ ID NO: 72947 - protein, 400 aa, Desulfovibrio desulfuricans G20
MGKEIKKVVLAYSGGLDTSVILKWIAKTYDCEVVTLTADLGQEEDLDGVDEKALRTGATRAYVEDLREEFARDFIFPMMRACAIYEGRYLLGTSIARPLITRRLVEIAHAEGAQAVAHGATGKGNDQVRFELASAALDPSLKVIAPWREWDFRSRTDLLNFAAENDIPVISAGNRKLYSMDRNMLHCSFEGGELEDPWNEPGPGSYIMAVPVEQAPDEPEYITIDFEKGNAVAINGQAMSPAAIIKTLNTLGGKHGVGRLDMVENRFVGMKSRGVYETPGGTVLHAAHRDLEGICLDREALHLRDSLIPRYAAAVYNGFWYSPEREALQALVDKTQENVTGTVRVKLYKGNVVPVGRKSPYSLYRMDLATFEEDEVYNQADAAGFIRLNSLRIQGYGRRS

SEQ ID NO: 72948 - DNA, 1260 bp, Rhodospirillum rubrum ATCC 11170
  CDS (1)..(1260): transl_table=11
ttgggttccggctgcattcctcccatggtcaagaaggcgctttccatgaagaaaggtgacgtgaagaaggttgttctcgcctattccggcggtttggacacctcgatcatcttgcgttggctgcaagacgaatacgactgcgaggtggtgaccttcaccgccgatatcggtcagggcgaggaactggagccggcgcgccagaaggccgagatgatggggatcaaggagatctacatcgaggacctgcgcgaggaattcgtccgcgactacgttttcccgatgttccgcgccaataccctttatgaaggcgtctatctgctgggcacctcgatcgcccggccgctgatcggcaagcgtctggtcgagatcgccgaggcgaccggcgccgacgccgtcagccacggcgcgaccggcaagggcaacgatcaggtgcggttcgagctgaccgcctatgcgctcaagcccgacatcaagatcatcgcgccttggcgcacctgggatctgcacagccgcaccaagctgatcgaatacgccatgcgccaccagatccccgtgcccaaggacaagcacggcgaggcgccctattcgatggacgccaatcttctgcacatctcctatgaaggcaaggccctggagaacccctggaccgagcccagcgaggacatgttccgcctgacggtcagcccggaagccgcccccgacaaggcccagtacatcgaggtcgatttcgagcgcggcgatgccgtggccatcgatggcgaaaagctgaccccggccgccctgctcgccaagctcaacgagatcggcggccgccatggcgtgggccgtctggatctggtcgaaaaccgctatgtcggcatgaagtcgcgcggcgtttatgaaaccccgggcggcaccatcttgcaggtcgcccaccgcgccgtggaaagcctgacccttgatcgcgaggtcatgcacctgcgcgacgagctgatgccgcgctatgccaagctgatctacaacggcttctggttcgcccccgagcgcctgatgctgcaggccgccatcgatcagacccagcagacggtgaccggcaccgcccgcctgaagctctacaagggcaatgtcagcgtcgtcggccgcaaggcggcgaaaagcctctatcgcatggactatgtcaccttcgaggaagacaccgtctatgaccagcacgacgccgaaggcttcatcaaactgaacgccctgcgtctgcgtctgggcaagatggcccgcgacagctga

SEQ ID NO: 72949 - protein, 419 aa, Rhodospirillum rubrum ATCC 11170
MGSGCIPPMVKKALSMKKGDVKKVVLAYSGGLDTSIILRWLQDEYDCEVVTFTADIGQGEELEPARQKAEMMGIKEIYIEDLREEFVRDYVFPMFRANTLYEGVYLLGTSIARPLIGKRLVEIAEATGADAVSHGATGKGNDQVRFELTAYALKPDIKIIAPWRTWDLHSRTKLIEYAMRHQIPVPKDKHGEAPYSMDANLLHISYEGKALENPWTEPSEDMFRLTVSPEAAPDKAQYIEVDFERGDAVAIDGEKLTPAALLAKLNEIGGRHGVGRLDLVENRYVGMKSRGVYETPGGTILQVAHRAVESLTLDREVMHLRDELMPRYAKLIYNGFWFAPERLMLQAAIDQTQQTVTGTARLKLYKGNVSVVGRKAAKSLYRMDYVTFEEDTVYDQHDAEGFIKLNALRLRLGKMARDS

SEQ ID NO: 72950 - DNA, 1227 bp, Moorella thermoacetica ATCC 39073
  CDS (1)..(1227): transl_table=11
atgaaaggagtctttactgtggccgaaaaggtagttctcgcctattccggcgggctggatacctccattattatcccctggctcaaggaaacctatggttatgaggttatcgccgtggccgtcgatgtcggccagggagaagagctggaacccctggaggaaaaggctataaagagcggggccagcaagatctatattctggataaaaagaaggagtttgtggaggagtacatctggcccaccctcaaggccggcgctgtttacgagggcaagtacctcctgggcacctccttcgcccggcccctcattgccaaatgcctggtggaggtcgccgcacaggaaggggccacggccgtggcccacggagccaccggcaagggcaacgaccaggtgcgtttcgaactgggggttaaggccttaaatccccagctaaaggtcatcgctccctggcggatctggaacatccgctcccgggaagaggccatggactacgccgccgcccggggcatcccggtgccggtgactaaagaccggccctacagcatggaccgtaacctctggcacttgagccacgagggaggcgatctcgaggatccctggaatgcacccggggacgacctttacctgataatcaccccgccggaacaggccccggataaaccgacttatgtaaccatcgactttgaaaagggtattccggtagccgtggacggggaaaaactggacgccgtcgccctggtggagaagctcaatgacctggcggcggccaacggtgtgggcatagttgacattgtagaaaatcgcctggttggtatgaagtcccggggcgtttatgaaacccccggggggacgatcctctatacagcccaccgggaactggagtacctcaccctggaccgcatgaccatgcatttcaaagaaatggtggccgccaagtacgccgagctggtttacgacggcaactggttctcacccttgaaaaaagccctggacgcctttgtggacagcacccaggagacggtgacgggcacggtgcgtctaaaactctataaaggcagctgcaccccggccggggtcaaatcaccttattccatctacaacgaggacctggtcaccttcggtgccggcggtgactacgaccataaggacgccaccggtttcatcaacctcttcggcctgcccttgaaggtacgggcgctgatggaacaaaaaactggactgagatag

SEQ ID NO: 72951 - protein, 408 aa, Moorella thermoacetica ATCC 39073
MKGVFTVAEKVVLAYSGGLDTSIIIPWLKETYGYEVIAVAVDVGQGEELEPLEEKAIKSGASKIYILDKKKEFVEEYIWPTLKAGAVYEGKYLLGTSFARPLIAKCLVEVAAQEGATAVAHGATGKGNDQVRFELGVKALNPQLKVIAPWRIWNIRSREEAMDYAAARGIPVPVTKDRPYSMDRNLWHLSHEGGDLEDPWNAPGDDLYLIITPPEQAPDKPTYVTIDFEKGIPVAVDGEKLDAVALVEKLNDLAAANGVGIVDIVENRLVGMKSRGVYETPGGTILYTAHRELEYLTLDRMTMHFKEMVAAKYAELVYDGNWFSPLKKALDAFVDSTQETVTGTVRLKLYKGSCTPAGVKSPYSIYNEDLVTFGAGGDYDHKDATGFINLFGLPLKVRALMEQKTGLR

SEQ ID NO: 72952 - DNA, 1206 bp, Syntrophus aciditrophicus SB
  CDS (1)..(1206): transl_table=11
gtggataccggtgtaaaaaaagtagttcttgcttattctggcggactggatacgtcagtcatcgtccaatggttgatcgaaacatacggatgcgaagtcattgcctttgccgctgacgtcggtcagaaggaagaactggaaggattaagggaaaaagccataaaaaccggggccagtaaaatctatatcgaggatctccgcgaagaattcgcccgggattttgtttttccggcactgcgggcaaacgccatctacgaggggacctatctgctgggaacatcgctggcaagacctttgattgccaaacgccaggtggaaattgcccgggcggaaggggcggatgcggtttgtcatggggcaacgggtaaagggaatgatcaggtgcggttcgaattgacctacatggccttggagccgaacatccggatcatttcggcctggaaggatccaaactggcatttcaaatcccgggaagacatgtttgattacgcggaaaagcacaatatcccgcttcctctcacgcgggaaaagccttacagcagcgaccgcaatctgttgcatatctcacatgagggcgccatcctggaagatccctgggcggaaccgcctgaagacatttttacgatatccttatctcctgaagcagcaccggataagccgacttacgtggaaatcgatttcgaacagggaaatcccgttgctctcgacggtgcacgtctgagtccggcagccctgatggagaagatgaatgacatagcgggggccaacggcatcggccgtgtcgatatggtggaaaaccggttcgtcggaatgaaatcccgaggggtttatgagacgccgggagggaccgtgctctgggcggcacaccgcgccctggagtctctcaccatggacagggaggtgatgctgatgcgcgattctctcattcccaaatacgcccagctggcttacaatggattctggtatgccccggaaatggaagccctgcaggccttgatcgatgaaacccagaaaaaggcaacgggcacggtccggatgaaactctacaagggcaactctattgtcgtcggcagaaagtccccatattccctgtatagtgaagactttgcaacctttgaaaaagatcaggtttacaatcagatggatgcaacggggttcattcggctcaatgcattgagactgcgaatcgcggccatgaagaaataa

SEQ ID NO: 72953 - protein, 401 aa, Syntrophus aciditrophicus SB
MDTGVKKVVLAYSGGLDTSVIVQWLIETYGCEVIAFAADVGQKEELEGLREKAIKTGASKIYIEDLREEFARDFVFPALRANAIYEGTYLLGTSLARPLIAKRQVEIARAEGADAVCHGATGKGNDQVRFELTYMALEPNIRIISAWKDPNWHFKSREDMFDYAEKHNIPLPLTREKPYSSDRNLLHISHEGAILEDPWAEPPEDIFTISLSPEAAPDKPTYVEIDFEQGNPVALDGARLSPAALMEKMNDIAGANGIGRVDMVENRFVGMKSRGVYETPGGTVLWAAHRALESLTMDREVMLMRDSLIPKYAQLAYNGFWYAPEMEALQALIDETQKKATGTVRMKLYKGNSIVVGRKSPYSLYSEDFATFEKDQVYNQMDATGFIRLNALRLRIAAMKK

SEQ ID NO: 72954 - DNA, 1215 bp, Novosphingobium aromaticivorans DSM 12444
  CDS (1)..(1215): transl_table=11
atgtccgatatcaagaaggtcgtcctcgcctactccggcggtctcgacacctccgtcatcctcaagtggctgcaggtcacctacaactgcgaggtggtcaccttcaccgccgacctcggccagggcgaggagctcgaacccgcgcgcgccaaggcaaagctgatgggcgtgcccgatcaccacatctacatcgacgacctgcgcgaggaattcgtgcgcgacttcgtcttcccgatgatgcgcgccaatgcccgctacgagggcgattacctgctcggcacctcgatcgcccgtccgctgatctccaagcgcctgatcgaaatcgcgcgcgaaaccggagccgatgccgtcgcccacggcgcgaccggcaagggcaacgaccaggtccgcttcgaactgtccgcctacgccctcgaaccgggcatcaaggttatcgcgccctggcgcgaatgggatctcaccagccgcaccgcgctgatcgcctgggccgaagcgcaccagattccggtccccaaggacaagcgcggcgaaagcccgttctcgaccgacgccaacctcctccacacctcgtccgaaggcaaggtgctggaagatccgtggcaggaaaccccggactacgtctactcgcgcaccgtcaatccggaagacgcgcccgacacccctgagtacatcaccatcgacttcgagaagggcgatggcgtcgcgctcaacggcgaggccatgtcgcccgccacgctgctcgccgccctcaacgacctcggccgcaagcacggcatcggccgtctcgatctcgtcgagaaccgcttcgtcggcatgaagagccgcggcatgtacgaaacgcccggcggcgagatctatgcccgtgcccatcgcggcatcgaaagcatcaccctcgaccggggcgcggcgcacctcaaggacgagctgatgcccaagtacgcggagctgatctacaacggcttctggttctcgcccgagcgcgagatgctgcaggccgcgatcgatcactcgcaggcccgcgtgaacggcaccgtccggctcaagctctacaagggcagcgcctcggtcgtcggccgcaagtcgcccgacagcctctactccgaacgccacgtgacgttcgaggacgatgccggcgcctacgaccagaaggacgcggcgggcttcatcaagctcaacgccctgcgccttcgcctgctggcgcagcagggccgctga

SEQ ID NO: 72955 - protein, 404 aa, Novosphingobium aromaticivorans DSM 12444
MSDIKKVVLAYSGGLDTSVILKWLQVTYNCEVVTFTADLGQGEELEPARAKAKLMGVPDHHIYIDDLREEFVRDFVFPMMRANARYEGDYLLGTSIARPLISKRLIEIARETGADAVAHGATGKGNDQVRFELSAYALEPGIKVIAPWREWDLTSRTALIAWAEAHQIPVPKDKRGESPFSTDANLLHTSSEGKVLEDPWQETPDYVYSRTVNPEDAPDTPEYITIDFEKGDGVALNGEAMSPATLLAALNDLGRKHGIGRLDLVENRFVGMKSRGMYETPGGEIYARAHRGIESITLDRGAAHLKDELMPKYAELIYNGFWFSPEREMLQAAIDHSQARVNGTVRLKLYKGSASVVGRKSPDSLYSERHVTFEDDAGAYDQKDAAGFIKLNALRLRLLAQQGR

SEQ ID NO: 72956 - DNA, 1182 bp, Ehrlichia chaffeensis str. Arkansas
  CDS (1)..(1182): transl_table=11
atgaaaaaaatagtattagcttattcagggggattagatacctcagttatattaaaatggctccaagaaaattataattgtgaagtagtagtatttactgcagatttaggtcaaaatgatgatatgtctgcaataagacaaaaggcagctgcatcaaatgtaaaagaaatttttatagaagacttaaaagaagaatttgtaaaagatttcgtattccccatgtttagagcaaatactgtatatgaaggatattacttattgggaacatctatagcaaggccattaatagctaaacgacaaattgaaatagctcaccttacaggagcagatgctgtagcacatggagcaactggaaaaggaaatgaccagattagatttgaatttggatattattcatgcgatccaaatataaaggtaatagcaccttggcgtcagtgggaattgacttcaagaaatagtttaatagaatatgcaaaaaagcatggtattgatgttcctttagataaagcaagtgaaccaccatattctatagatgcaaacctattacatacctcatacgaaggcaaatctttagaagatccatatattgaacctgattatacaatgctctccaaatcagtaattccagaattagctagtgatactccagaatatatagaaatttcctttaaaaacggagatccacatgcaataaataatgtacccctttcacctgcaaatctattacaacaattgaatataataggtggtagacatggtataggaattattgacatagtagaaaatcgctatataggcataaaatcaagaggagtatacgaaactcctggaggaacaattcttttacacgcacaccgtgctatagaaagtataactttagacagagaagcagcacaccttaaggatgaaataatgccaagatatgctaaactaatatataatggatattggtggactactgaaagaaagatgttacaagcacttattgataaatcacaagacaaagtaaatggagtagtacgcttaaaattatacaaaggatctgttatggttgtaggacgaacatcagaaaatagcttatattcacataacctagcaagctttgactcatcaggaaattataatcatacagacgcagaaggatttattaaaataaattctctaagattaagaaatagctaa

SEQ ID NO: 72957 - protein, 393 aa, Ehrlichia chaffeensis str. Arkansas
MKKIVLAYSGGLDTSVILKWLQENYNCEVVVFTADLGQNDDMSAIRQKAAASNVKEIFIEDLKEEFVKDFVFPMFRANTVYEGYYLLGTSIARPLIAKRQIEIAHLTGADAVAHGATGKGNDQIRFEFGYYSCDPNIKVIAPWRQWELTSRNSLIEYAKKHGIDVPLDKASEPPYSIDANLLHTSYEGKSLEDPYIEPDYTMLSKSVIPELASDTPEYIEISFKNGDPHAINNVPLSPANLLQQLNIIGGRHGIGIIDIVENRYIGIKSRGVYETPGGTILLHAHRAIESITLDREAAHLKDEIMPRYAKLIYNGYWWTTERKMLQALIDKSQDKVNGVVRLKLYKGSVMVVGRTSENSLYSHNLASFDSSGNYNHTDAEGFIKINSLRLRNS

SEQ ID NO: 72958 - DNA, 1230 bp, Desulfitobacterium hafniense Y51
  CDS (1)..(1230): transl_table=11
atgttaagaaaggaagttatccctatgaaaaaggtagtgcttgcgtattccggaggattagatacctcgatcatcatcccttggctgaaagagaattatggctatgaagtcattgctatggccgctgacctgggacaaggagaagagctggagcctctccacgaaaaagcgattaagagcggagccagtaaattatatatcgaagatctgcaagaagaattcgttactgatttcatctaccccaccctaaaagccggagctgtctatgaaggcaaatatcttttgggaacctcctttgcccgtcccctgattgcccaacgtttagtagagattgcggcaaaagagggagctgtggccattgctcacggtgccacgggaaaaggaaacgaccaggttcgctttgagctggctgtcaaagccttaaatcctgatctggagatcatagctccttggcggatttgggatatcaagtcccgggaagatgctattgactatgctgttgagaggggaattcctgtccctgtaacgaaagatcgcccttacagtatggaccgcaatgtctggcatctcagccatgaaggaggcgatttagaagatccttggaatgagcccaaaaaggatctctatctccttggggtttcaccggaagatgctcccgacgaagccgagtacctggaactggattttgaacaaggtattcctgtttctttaaacggagaaaagttaggtcctgttcagcttttggagaccctcaatgaggttggcggcaaacacggcattggcattgtggacatggtggaaaaccgcttagtaggaatgaaatcccggggggtttatgagactcccggtggtaccattctctatacagctcatcaagccctggaacatttgaccttggatcgtttgacccttcattataaggagcaaatcgccctgaaatacgctgaattggtttacgacggcgtttggcattctcctttgcgggaagccctggatgccttcgtggatgttacccagaaaaatgtcaccggaacggtacgcctgaagctttataaaggcaattgcagcttagccggtgtgaaatccccctactccctctatagtgaagaatttgctaccttcggacgggatggggtctataaccaaaaggatgctgaaggtttcatcaatctcttcggtcttcctcttaaagtaagagcgttaatggaaaagaaatcagggttgagataa

SEQ ID NO: 72959 - protein, 409 aa, Desulfitobacterium hafniense Y51
MLRKEVIPMKKVVLAYSGGLDTSIIIPWLKENYGYEVIAMAADLGQGEELEPLHEKAIKSGASKLYIEDLQEEFVTDFIYPTLKAGAVYEGKYLLGTSFARPLIAQRLVEIAAKEGAVAIAHGATGKGNDQVRFELAVKALNPDLEIIAPWRIWDIKSREDAIDYAVERGIPVPVTKDRPYSMDRNVWHLSHEGGDLEDPWNEPKKDLYLLGVSPEDAPDEAEYLELDFEQGIPVSLNGEKLGPVQLLETLNEVGGKHGIGIVDMVENRLVGMKSRGVYETPGGTILYTAHQALEHLTLDRLTLHYKEQIALKYAELVYDGVWHSPLREALDAFVDVTQKNVTGTVRLKLYKGNCSLAGVKSPYSLYSEEFATFGRDGVYNQKDAEGFINLFGLPLKVRALMEKKSGLR

SEQ ID NO: 72960 - DNA, 1230 bp, Saccharophagus degradans 2-40
  CDS (1)..(1230): transl_table=11
atgtctacaaacagttcgatcaaaaaagttgttctagcctattctggcggcttggatacttctgtaattgttaaatggttacaagagacctacaactgtgaagtagtgacctttaccgctgatattggccaaggtgaagaagtggagcccgcgcgtgctaaagccgaagcgttgggtgtgaaagaaatttacattgatgacttgcgcgaagagttcgtacgcgattacgtattcccaatgttccgcgcgaatactatctatgaaggtgaataccttctaggtacctctattgcacgcccacttattgctaagcgcttaattgaaattgccaacgaaactggtgctgatgccatttctcatggtgcgactggtaaaggtaacgatcaggtgcgttttgagctgggtgcatacgcccttaagcctggcattcatgttattgccccatggcgcgattgggatttaacttcccgcgaaacccttatggactactgcgctaagcacaatattcctgttgattacaccaaagcgaagaagaaatcgccttactctatggatgctaacttactgcacatttcttatgaaggcggtattttggaagatccatgggcagaagcagaagaagacatgtggcgctggagtgttagcccagaagctgcgccagatcagcctgaataccttgagcttaccttcaagcacggtgatattgttgccatcgacggcgtagaaatgtctcctgccactgtactcgaaaccttgaacaagcgcggtggtgcacacggcgtgggtcgtttagatatcgtagaaaaccgctatgtaggcatgaagtctcgcggttgttacgaaaccccagggggcaccattatattgcgcgctcacagagcaatcgaatctattactctcgatcgcgaagtggctcaccttaaagattcattaatgcccaagtacgccgaaatgatttataacggttactggtggagcccagagcgtcaaatgttacaaaccgctatcgataactcgcaaggcccagtaaatggcgatgtgcgggttaaattgtataaaggtagcgtaaccgttgtgggtcgtcgttctaacgacagcctatttgacgaaaaaatagcaacattcgaagacgatgctggtgcttacaaccagaaagatgccgaaggctttattaaactcaatgctctgagaatgcgtattgcagctcagaagggacgtaaactgctgtaa

SEQ ID NO: 72961 - protein, 409 aa, Saccharophagus degradans 2-40
MSTNSSIKKVVLAYSGGLDTSVIVKWLQETYNCEVVTFTADIGQGEEVEPARAKAEALGVKEIYIDDLREEFVRDYVFPMFRANTIYEGEYLLGTSIARPLIAKRLIEIANETGADAISHGATGKGNDQVRFELGAYALKPGIHVIAPWRDWDLTSRETLMDYCAKHNIPVDYTKAKKKSPYSMDANLLHISYEGGILEDPWAEAEEDMWRWSVSPEAAPDQPEYLELTFKHGDIVAIDGVEMSPATVLETLNKRGGAHGVGRLDIVENRYVGMKSRGCYETPGGTIILRAHRAIESITLDREVAHLKDSLMPKYAEMIYNGYWWSPERQMLQTAIDNSQGPVNGDVRVKLYKGSVTVVGRRSNDSLFDEKIATFEDDAGAYNQKDAEGFIKLNALRMRIAAQKGRKLL

SEQ ID NO: 72962 - DNA, 1230 bp, Saccharophagus degradans 2-40; identical to SEQ ID NO: 72960
  CDS (1)..(1230): transl_table=11

SEQ ID NO: 72963 - protein, 409 aa, Saccharophagus degradans 2-40; identical to SEQ ID NO: 72961

SEQ ID NO: 72964 - DNA, 1221 bp, Methylobacillus flagellatus KT
  CDS (1)..(1221): transl_table=11
atgagtgatgtgaacaaagtcgtgctggcctattccggcggcctggatacctctgtgatcctgaagtggctgcaggatacctaccagtgtgaagtggtgacctttacagcagatatcggccaaggtgaggagctcgaacctgcgcgcgaaaaagccaggcaatttggcgtcaaggaaatctatattgatgacctacgcgaagaatttgtgcgcgacttcgtattcccgatgttccgcgccaataccgtctatgaaggcgaatacctgctcggcacttcgattgcgcgaccactgatcgccaagcgcctgatcgagatcgcccaggaaaccaatgccgatgcggtctcgcatggggctactggcaagggcaatgaccaggtgcgcttcgagctgggagcctatgcgctcaaccccaacatcaagatcattgcgccttggcgcgaatgggacttgctcagccgtgaaaagctcctggcttatgccgagaagcatggcatcccggtcgaaatgaagcatcgtcaaggcggtagcccttacagtatggatgccaaccttctgcatatctcctacgaaggtcgtcacttagagaacccggcggcggaagccgaggaggatatgtggcgttggacggtatcgccagagcgcgcgccagatgaagccgagtaccttgagattgaatatcgcaacggtgaccccatctcattgaatgggaagacactgaaaccacatgaactgcttgcggaactgaaccgcctgggcggcaagcatggcattggtcgtctcgacctggtggaaaaccgctatgtaggcatgaagtcgcgcggctgttacgagaccccgggcggcaccatcctgctcaaggcgcaccgcgcgatcgagtccatcaccctggatcgcgaagtggcccacctgaaggacgacctgatgccgcgctatgcaagcatgatctacaacggttactggtggagccctgaacgcctggccttgcaggcattgatcgaccatacgcagcagaccgtcaatggctgggtcaagctcaagctgtacaagggcaatgtgatcgtgacgggccgtgattcagggacagattcgctgtttgacccgaatatcgcgaccttcgaggacgatgccggtgcctatgatcaccgcgatgcgggtgggttcatcaagctgaatgccttgcgcctgcgtattgcagctaatctgcgcaacaaaaaataa

SEQ ID NO: 72965 - protein, 406 aa, Methylobacillus flagellatus KT
MSDVNKVVLAYSGGLDTSVILKWLQDTYQCEVVTFTADIGQGEELEPAREKARQFGVKEIYIDDLREEFVRDFVFPMFRANTVYEGEYLLGTSIARPLIAKRLIEIAQETNADAVSHGATGKGNDQVRFELGAYALNPNIKIIAPWREWDLLSREKLLAYAEKHGIPVEMKHRQGGSPYSMDANLLHISYEGRHLENPAAEAEEDMWRWTVSPERAPDEAEYLEIEYRNGDPISLNGKTLKPHELLAELNRLGGKHGIGRLDLVENRYVGMKSRGCYETPGGTILLKAHRAIESITLDREVAHLKDDLMPRYASMIYNGYWWSPERLALQALIDHTQQTVNGWVKLKLYKGNVIVTGRDSGTDSLFDPNIATFEDDAGAYDHRDAGGFIKLNALRLRIAANLRNKK

SEQ ID NO: 72966 - DNA, 1227 bp, Burkholderia xenovorans LB400
  CDS (1)..(1227): transl_table=11
atgagcgatatcaagaaagtcgtgctcgcctattcgggcggcctcgacacctccgtcatcctgaagtggttgcaggacaattacgacgccgaagtcgtcacgttcacggccgacatcggccagggcgaagagctggaaccggcgcgcaagaaagccctgcaactcggcatcaagccggaaaacatctttatcgaagacctgcgcgaagaattcgtgcgtgacttcgtgttcccgatgttccgcgccaacacgatctatgaaggcgagtacctgctgggcacctcgatcgcgcgtccgctgatcgccaagcgtcagatcgaaatcgcgcgcgccaccggcgcacaagcggtgtcgcacggcgcaaccggcaagggcaacgaccaggttcgcttcgaactcggttactacgcgctggaaccgggcatcaaggtgatcgcgccgtggcgcgaatgggacctgctgtcgcgcgaaaagctgctcgcgtatgccgaaaaggccggcattccaattgaaatgaagcacaagcaaggcggcgcgccgtattcgatggacgcgaacctgctgcacatttcgttcgaaggccgtcacctggaagatccgaaagcggaagcggaagccgacatgtggcgttggaccgtctcgccggaagaagcgccggaccaggctgaatacctcgacatcgagtacgagcacggcgatccggttgcaatcaacggcaagcgtctgtcgcctgcggaaatgctcaccgaactgaaccgtctgggcggcaagcacggcatcggccgtctcgacctggtggaaaaccgttatgtcggcatgaagtcgcgcggctgctacgaaacgccgggcggcacgatcatgctgaaggcgcaccgcggcatcgagtcgatcacgctcgaccgtgaagtggctcacctgaaagacgatctgatgccccgctacgccgcattgatttataacggctactggtggagcccggagcgccgcgcgcttcaggtgctgatcgaccatacgcaagagaaggtcaacggctgggtgcgtgtgaagctgtacaagggcagcgtgtcggttgtcgcgcgcgattcgaaggaaacgctgttcgacaagaccatcgcaacgttcgacgacgacggcggcgcctacaaccaggccgacgccggcggcttcatcaagctgaacgcactgcgtatgcggattgcggaaaacgcgcgtcgtcagcgtggctga

SEQ ID NO: 72967 - protein, 408 aa, Burkholderia xenovorans LB400
MSDIKKVVLAYSGGLDTSVILKWLQDNYDAEVVTFTADIGQGEELEPARKKALQLGIKPENIFIEDLREEFVRDFVFPMFRANTIYEGEYLLGTSIARPLIAKRQIEIARATGAQAVSHGATGKGNDQVRFELGYYALEPGIKVIAPWREWDLLSREKLLAYAEKAGIPIEMKHKQGGAPYSMDANLLHISFEGRHLEDPKAEAEADMWRWTVSPEEAPDQAEYLDIEYEHGDPVAINGKRLSPAEMLTELNRLGGKHGIGRLDLVENRYVGMKSRGCYETPGGTIMLKAHRGIESITLDREVAHLKDDLMPRYAALIYNGYWWSPERRALQVLIDHTQEKVNGWVRVKLYKGSVSVVARDSKETLFDKTIATFDDDGGAYNQADAGGFIKLNALRMRIAENARRQRG

SEQ ID NO: 72968 - DNA, 1185 bp, Methanococcoides burtonii DSM 6242
  CDS (1)..(1185): transl_table=11
atgtcaaagaaagtagcacttgcgtattccggaggacttgacacatctatctgtatccctctcctcaaggaagaatacggatacgatgaagtaattacagtagcagtcgatgtgggacagccaaaggaagatgtcgcacaggcagaagagaaagcaaagaagatcagtgacaagcatttcacgcttgatgttcgcgaagagttcgtgaacgactatatcttcccgcttataagagccaacggcgactacgaaggctatgtaatgggcacatccattgcacgcccgctcatcgccaagaaggtagttgagatagcagagcaggaaggcgcagttgcactcgcacacggttgcaccggcaaaggcaacgaccaacttcgtttcgaggcagtgttcaggctcaccgacatggatgtcatcgcacctatgagagagatgaacctcacccgtgaatgggagatcgaatacgctaaagaacatggcatacctgtgggagtcaccactgcaaagccatggagcgttgatgagaacatctggagcagaagcatcgaaggcggaaagctcgaagaccctggatatatccctcctgaagagatatacaaatggacaacagctccggaagatgcacctgacgctcagatcatcgagatcggattcgagaacggtgtgccggtatcccttgatggtcagaagatgggcggtgtcgaacttatcgagaagatgaacatcattgcaggaacacatggcgtaggtcgtaccgacatgatcgaggaccgtgtcctcggactcaaggcacgtgagaactacgaacatcctgcagcaacagttctgcttgcggcacacaaagacctcgaaaagctcgtgcttacccgtgcagagctcaagttcaaggcaacggtcgacgcccagtggtctgagcttgcatactacggcctcgtggatgaacccctctacgatgacctcaatgctttcattgacaagacacaggaacgtgtcgcaggtacagtaacaatgaagctctacaaaggtagcgtcctcgttcttgcaaggacatccccgtatgccctttactcagaagagctcgtatcctttgatggcacaagcatcgaccagaaggatgctgaagggtttgccaaatatcacggattccaggcacgcctgtacagaaaattcgtagttaagaactaa

SEQ ID NO: 72969 - protein, 394 aa, Methanococcoides burtonii DSM 6242
MSKKVALAYSGGLDTSICIPLLKEEYGYDEVITVAVDVGQPKEDVAQAEEKAKKISDKHFTLDVREEFVNDYIFPLIRANGDYEGYVMGTSIARPLIAKKVVEIAEQEGAVALAHGCTGKGNDQLRFEAVFRLTDMDVIAPMREMNLTREWEIEYAKEHGIPVGVTTAKPWSVDENIWSRSIEGGKLEDPGYIPPEEIYKWTTAPEDAPDAQIIEIGFENGVPVSLDGQKMGGVELIEKMNIIAGTHGVGRTDMIEDRVLGLKARENYEHPAATVLLAAHKDLEKLVLTRAELKFKATVDAQWSELAYYGLVDEPLYDDLNAFIDKTQERVAGTVTMKLYKGSVLVLARTSPYALYSEELVSFDGTSIDQKDAEGFAKYHGFQARLYRKFVVKN

SEQ ID NO: 72970 - DNA, 1218 bp, Acidobacteria bacterium Ellin345
  CDS (1)..(1218): transl_table=11
atgcgtgaaaaaatcgttcttgcttattccggaggccttgatacctccatcatcattccttggctgaaggaaaactatagctgcgacgtcattgccatggttggtgacgtcggacagggcgacgacatcgatgccgtcgtagcgaaggctcataaaacgggcgcttccaaagtcatcgtaaaggacctccgcgaggagttcctcacccagtacgtctatcccgcgatctccaccggcgcggtctacgagcacaagtatctgctcggaacttcgctcgcacgtccgccgatcgcgaaggcgcaagtcgaagtcgcactcgccgaaggcgccactgcggtctcgcacggctgcactggcaagggcaacgaccaggtccgcttcgaacatgccttccaggcgctcgcgccggaactcaagatcatcgctccctggcgcgaatggacgctgaagtcccgcgaagattgtctcgactacgccgaagcccatggcatctccgttgcgcagagccgcgagaagatccactcccgcgatcgcaacttgctgcacgttagccacgagggcggggaactcgaagatcccaacaacgctccactcgataccacttggacgtggaccaagtccccgcaggaagcgcccgatcgcgtcgaagaagtcaccatcggattcgaaggcggcgtgccggtttccatcaacggcatgaagctcgaaccgctcgcgctcatcgagttgctcaatgaaattggcgcgcgcaacgccatcggccgcatcgatctcgtcgagaaccgcttcgtcggcatcaagtcgcgtggctgctatgagacccccggcggatctctgctgctcgccgcgcatcgcgaactcgaggccctctgtctcgatcgcgacaccctgcactacaagcaggaagtcgcgctcaagtgggcggaactcgtgtacttcggcctctggttcacgccgctgcgcgaatcgctcgacgctttcgtcgcgagcacgcagaagaacattgccggcgccgtgaagctcgccctctacaagggcaacatcgccgtagccgggcgcacctcgcccaaatcgctctatcgtcccgacatcgccagcttcaccatgggtgcgggctacgaccagaaggacgccgaaggcttcatccgcattctcggactgcccgcgcgttcgcgtgcgctcatcgagaacgccggcaaagaaaaggtgtcgaaatga

SEQ ID NO: 72971 - protein, 405 aa, Acidobacteria bacterium Ellin345
MREKIVLAYSGGLDTSIIIPWLKENYSCDVIAMVGDVGQGDDIDAVVAKAHKTGASKVIVKDLREEFLTQYVYPAISTGAVYEHKYLLGTSLARPPIAKAQVEVALAEGATAVSHGCTGKGNDQVRFEHAFQALAPELKIIAPWREWTLKSREDCLDYAEAHGISVAQSREKIHSRDRNLLHVSHEGGELEDPNNAPLDTTWTWTKSPQEAPDRVEEVTIGFEGGVPVSINGMKLEPLALIELLNEIGARNAIGRIDLVENRFVGIKSRGCYETPGGSLLLAAHRELEALCLDRDTLHYKQEVALKWAELVYFGLWFTPLRESLDAFVASTQKNIAGAVKLALYKGNIAVAGRTSPKSLYRPDIASFTMGAGYDQKDAEGFIRILGLPARSRALIENAGKEKVSK

SEQ ID NO: 72972 - DNA, 1224 bp, Silicibacter sp. TM1040
  CDS (1)..(1224): transl_table=11
atgtccgcgcccaagaaagttgtgctggcctactccggtggccttgatacttcgatcatcctgaaatggttgcagaccgaatacggctgcgaggttgtcacctttactgccgatctcggccagggcgaggaactggagcctgcacgaaaaaaagcagagcttctcggcattaaacccgaaaacatctttatcgaggacatccgcgaggagttcgtccgcgatttcgtcttcccgatgttccgtgccaatgcggtctacgaaggtctctacctgctgggcacctcgattgcgcgcccgctgatctccaaacgtcttgtcgagatcgcagaggcaactggcgctgatgccgtgtcccatggtgcaaccggcaagggcaacgaccaggtccggttcgagctgtccgcctatgctctgaaccccgacattaaggtgattgcaccttggcgcgagtgggatctgacctcgcgcaccaaactgctggaatttgccgaggcaaaccagatcccgattgcaaaggacaagcgtggcgaggcgcctttctcggtcgacgcaaacctgctgcacacctcctctgagggtaaggttctggaagatccggcagaaatggcgcccgattacgtctatcagcgtaccgtaaacccggaagatgcgcccaacgagcccgagttcatcgaaatcacctttgaaaaaggcgatgcggttgcgatcaacggcgaggccatgtcgcctgcgacgatcctgaccaagctcaacgaatatggccgcaagcacggcattggccgtctggatttcgtcgagaaccgctttgtcggcatgaaatcccgcggcatctacgaggccccgggcggcgacatcctgctcgaagcacaccgtggcattgaacagatcaccctcgatagcggcgcgggccatctcaaggactcgatcatgccgcgttatgcagagctgatctataatggcttctggtactctccggagcgtgaaatgctgcaggccctgattgatgagagccagaagcacgtcaccggcaccgtacgcgtaaagctttacaaaggctccgcaaaaacggttggtcgctggtccgaacactcgctctattccgaggcacatgtgacctttgaagaagacgcgggcgcctacgatcaaaaagacgcgcagggcttcatccagctcaacgcattgcgtctgaagcttttggcagcgcgcaaccgtcgagtaaaataa

SEQ ID NO: 72973 - protein, 407 aa, Silicibacter sp. TM1040
MSAPKKVVLAYSGGLDTSIILKWLQTEYGCEVVTFTADLGQGEELEPARKKAELLGIKPENIFIEDIREEFVRDFVFPMFRANAVYEGLYLLGTSIARPLISKRLVEIAEATGADAVSHGATGKGNDQVRFELSAYALNPDIKVIAPWREWDLTSRTKLLEFAEANQIPIAKDKRGEAPFSVDANLLHTSSEGKVLEDPAEMAPDYVYQRTVNPEDAPNEPEFIEITFEKGDAVAINGEAMSPATILTKLNEYGRKHGIGRLDFVENRFVGMKSRGIYEAPGGDILLEAHRGIEQITLDSGAGHLKDSIMPRYAELIYNGFWYSPEREMLQALIDESQKHVTGTVRVKLYKGSAKTVGRWSEHSLYSEAHVTFEEDAGAYDQKDAQGFIQLNALRLKLLAARNRRVK

SEQ ID NO: 72974 - DNA, 1473 bp, Magnetospirillum magnetotacticum MS-1
  CDS (1)..(1473)
atgaagggcgaagtcaagaaggtcgttctggcctattccggcggtctcgatacctccatcatcctgcgctggctgcaagatcagtacagttgcgaagtggtgaccttcaccgccgatctcggccagggcgaggaactggaaccggcccgcgccaaggcccgcctgatgggcatcaaggaagagaacatcttcatcgacgacctgcgcgaggaattcgtgaaggacttcgtcttccccatgttccgcgccaatgcgctgtacgagggcgtctatctgctgggcacctccatcgcccggccgctgatctccaagcgtcagatcgagatcgccaatctggtgggcgccgatgccgtgtcccacggcgccaccggcaagggcaatgatcaggtccgcttcgagatgggctattacgccttgaagcccgacatcaaggtcatcgcgccctggcgtctgtgggacctgaactcgcgcaccgccctgctggacttcgccgagaagcatcagattcccatcgccaaggacaagcgcggcgaggcgccttattccaccgacgccaatctgctgcacatctcctatgagggcaaggcgctggaagatccgtggatcgagcccaatgacgacatgtacacccgctcggtcagcccggagaacgcccccgacaagcccacttatgtggaaatcgagttcgagaagggcgacgccgtggccatcgacggcgtgcgcctgtcgcccgccgccctgctgaccaagctcaaccagttgggcggggccaacggcatcggccgtctggatctggtggaaaaccgcttcgtcggcatgaagagccgcggcgtctacgagacccccggcggctcggtgctgatcgtggcgcatcgcgccgtggaaagcctgacgctcgatcgcggcgaggcccacctcaaggacgagctgatgccccgttatgccgagctgatctataacggcttctggttcagccccgaacgtgtcgccatccagaccatgatcgacaaggtcagcgagaacgtctccggcaccgtgcggctcaagctttacaagggcgtcgcctcggtggtcggccgcaagtcgcccaggtcgctctatcgcatggactacgtcactttcgagaaagacagcgtctatgatcagcgcgacgcccaggggcttcatcaagctgaacgcactgcgcatgcgtctggccaagatggcgcgcggctaagcaataacacctactactctgcgaatattatgagggccccgccgcggcggggccctttgtttttgagcgatttgatctatccgctttacgcattccatgggcttttatactattggatagaatcgacgcaatctgcatggtcaaagctttgccttccgcctcccgccgctcttccgcctcggccgtccccatcaagtggtggcccctggtgttatggggtctggccatggggatcgtcgtggcctggacggccgtga

SEQ ID NO: 72975 - protein, 490 aa, Magnetospirillum magnetotacticum MS-1
MKGEVKKVVLAYSGGLDTSIILRWLQDQYSCEVVTFTADLGQGEELEPARAKARLMGIKEENIFIDDLREEFVKDFVFPMFRANALYEGVYLLGTSIARPLISKRQIEIANLVGADAVSHGATGKGNDQVRFEMGYYALKPDIKVIAPWRLWDLNSRTALLDFAEKHQIPIAKDKRGEAPYSTDANLLHISYEGKALEDPWIEPNDDMYTRSVSPENAPDKPTYVEIEFEKGDAVAIDGVRLSPAALLTKLNQLGGANGIGRLDLVENRFVGMKSRGVYETPGGSVLIVAHRAVESLTLDRGEAHLKDELMPRYAELIYNGFWFSPERVAIQTMIDKVSENVSGTVRLKLYKGVASVVGRKSPRSLYRMDYVTFEKDSVYDQRDAQGLHQAERTAHASGQDGARLSNNTYYSANIMRAPPRRGPLFLSDLIYPLYAFHGLLYYWIESTQSAWSKLCLPPPAALPPRPSPSSGGPWCYGVWPWGSSWPGRP

SEQ ID NO: 72976 - DNA, 1218 bp, Clostridium thermocellum ATCC 27405
  CDS (1)..(1218): transl_table=11
atgagtcaaaaagaaaaagtaatccttgcctattccggcggtctggatacttcaataatcattccctggcttaaagaaaattatgactatgaagtcattgcaatggcagctgacgttggacagggcgaagagcttgaacccttaagagagaaagctataaaaaccggggcaagcaaaatatatattgaagacttgaaagaagaatttgtgacagactttattttccccacattaaaagcaggtgccgtatatgaaggaaaatatcttttgggtacatcctttgcaagacctcttatagcaaagagaatggttgaaattgccttaaaagaaggcgctacagcagtcgctcacggagcaacgggaaaaggaaacgaccaggtccgtttcgagctgaccgtcaaagctcttgctccccatcttaaaatcattgctccgtggagaatatgggacattaaatccagagaagatgaaatcgaatacgcccaggcaagaaacatccccattcctgtatcaaaagaagacaactacagcatggacagaaacctctggcacctcagccatgaaggcttggatttggaagacccatggaacgaaccgcagtatgacaaaatattaaagctcatggttccgccggaaaaagctccggacaaacccacctatgttgaaatatattttgaaaagggtatacctaaaaaagttaacggtgtggaatacggacctgtggagcttattgaagttcttaacaaaatcggcggtgaaaacggtataggaatcgttgacatagtggaaaacagattggtcggaatgaaatccagaggcgtttatgaaactccgggtggaaccattctttatgcggctcacagagagcttgagcttttgtgtcttgaccgtgacactctccattacaaagatcttgtggctcaaagatttgcagagcttgtttattacggacagtggtatactcctctgcgtgaggctatttcagcctttgttgatgttactcaggagacggttaccggtacagtaagattaaaactttacaaaggaaatataataagcgcgggagccaaatccgattattccctctacagtgaagaactttccacgttcggagaagacaatgtatacaatcaaaaggatgccgaaggatttataaatctctttggtcttccgatgaaggttcaggctcttatgaaagaaaagaataaaggcaaataa

SEQ ID NO: 72977 - protein, 405 aa, Clostridium thermocellum ATCC 27405
MSQKEKVILAYSGGLDTSIIIPWLKENYDYEVIAMAADVGQGEELEPLREKAIKTGASKIYIEDLKEEFVTDFIFPTLKAGAVYEGKYLLGTSFARPLIAKRMVEIALKEGATAVAHGATGKGNDQVRFELTVKALAPHLKIIAPWRIWDIKSREDEIEYAQARNIPIPVSKEDNYSMDRNLWHLSHEGLDLEDPWNEPQYDKILKLMVPPEKAPDKPTYVEIYFEKGIPKKVNGVEYGPVELIEVLNKIGGENGIGIVDIVENRLVGMKSRGVYETPGGTILYAAHRELELLCLDRDTLHYKDLVAQRFAELVYYGQWYTPLREAISAFVDVTQETVTGTVRLKLYKGNIISAGAKSDYSLYSEELSTFGEDNVYNQKDAEGFINLFGLPMKVQALMKEKNKGK

SEQ ID NO: 72978 - DNA, 1206 bp, Prosthecochloris aestuarii DSM 271
  CDS (1)..(1206): transl_table=11
atgagcaaggaaaaaatcgctctcgcctattccggcggactcgacacctcggtgatgatcaaatggcttaaagacaaatatgatgccgagatcgtggctgtcacaggaaacctcggccaggaaaaagaggtggaaaacctcgaagaaaaagctatcgcaaccggagcatccagcttcgcttttctcgatcttcgcaaagaatttgtagaaagctgcatctggccggccctgaaagcaggtgcgctctacgaggatgtctatcccctggctacagcgctcggtcgcccgctgattgcaaaagcgctcgtcgatatcgcgctggaaaacaactgcaccatgctcgctcacggctgcaccggcaaaggcaatgatcaggttcgtttcgaggtcaccttcgcctcactcgctccacagcttgccgtgctggcaccgttgcgtgaatgggagttcacgtcacgcgaagcagaaatcgcctacgcaatggagcataacatcccggtttcagccaccaagaaaagcccatactctatcgatgaaaacatctggggaatcagcattgagtgcggtgttctcgaagatccgatgacgccggcccctgaagatgcctatcagatcacaacgtcacctgaaaaagcgccagacaaggctgctgtgattgacattgaatttgaacagggtgttcctgtcgcactggacggaaaagccatggagggtcttgacctcatcgttgagctcaacaaggtaggcgcagctcatggcgtaggccgtctcgatatggtcgaaaaccgtgttgtcggcatcaaatccagagagatctacgaagccccggcagcaaccatcctgcacttcgcacaccgtgagctcgaacgcctgaccctggaaaaatcggtcttccagtacaagaaaaacgtcagtcaggattacgccaacctgatctacaacggcacctggttttcgccgatgcgtgaagcgcttgacggatttatcgaagctacacagaaaacggtcaccggccttgttcgcgtcaaactcttcaaaggctcggtaacattgctcggcagaacctcgccatggtcactctacaatgaggatctggcaacctatacggaagccgataccttcaaccacaaagcagccgaaggcttcatccacctctacggtctcggtctgaaaacatggagtgaagtcaaagccaataacagctga

SEQ ID NO: 72979 - protein, 401 aa, Prosthecochloris aestuarii DSM 271
MSKEKIALAYSGGLDTSVMIKWLKDKYDAEIVAVTGNLGQEKEVENLEEKAIATGASSFAFLDLRKEFVESCIWPALKAGALYEDVYPLATALGRPLIAKALVDIALENNCTMLAHGCTGKGNDQVRFEVTFASLAPQLAVLAPLREWEFTSREAEIAYAMEHNIPVSATKKSPYSIDENIWGISIECGVLEDPMTPAPEDAYQITTSPEKAPDKAAVIDIEFEQGVPVALDGKAMEGLDLIVELNKVGAAHGVGRLDMVENRVVGIKSREIYEAPAATILHFAHRELERLTLEKSVFQYKKNVSQDYANLIYNGTWFSPMREALDGFIEATQKTVTGLVRVKLFKGSVTLLGRTSPWSLYNEDLATYTEADTFNHKAAEGFIHLYGLGLKTWSEVKANNS

SEQ ID NO: 72980 - DNA, 1224 bp, Magnetococcus sp. MC-1
  CDS (1)..(1224): transl_table=11
atgtccaacggtattgataaggttgtgctggcttactcggggggtttggatacctccatcattttgaagtggcttcaggatgagtatcagtgtgaggtggtcgctttctgtgcagacctgggtcaggcggaggagttggagcctgcgcgtgccaaggcggaaaagtttggggttaaagagatctacattgatgacctcaaagaggagtttgtgcgggattttgtctttcccatgtaccgcgccaacacattgtatgagggggtttaccacctgggtacctccattgcgcggcccttgattgccaaacgtcagattgaaattgccaatgccacaggtgcccaagcggtctctcacggggcgacgggtaagggtaatgatcaggtccgttttgagctgggttattatgcgttgcgtcccgatattcgcgtcattgcaccttggcgggagtgggacttgaccagccgtgacaagctgtttgcgtatgccgaaaagcatggtattccggtccccaccgacaagcgtggtgaggtcccttactcgatggaccgcaacctgctgcacatctcctttgagggcaaggcgctggaggatccatgggttgagcccgatgaagagatgtttgtcttatcggtttcaccggaaaaggcccccgatcaggccacctatgtggagctgaccttccgccagggcgatttggtcgccattgatgaccaggagatgagccccgccacgctgctggccaagctcaaccagttgggtgggcgcaacggcattggtcgcttggatctggtagaaaaccgctatgtgggcatgaaatcacggggagtttacgagaccccgggtggcaccattttgggggtggcacaccgtgcgatggagtcgctgacgttggatcgtgaagtggcccatatgaaagatgagttgatgccgcgctatgccaagttgatttacaacggctactggttttcgcccgagcgggccatgttgcagacgatgattgatgcctcgcagacctttgttaacggcaaggtgcgggtcaagctctacaagggcaatgtggttgtggtggggcgccaatcggaaaactcactgtttgatccggcaatcgctacctttgaagatgataaaggtgcctataatcaagcggatgcagatgggtttatcaaacttaatgcgctgcgcatgcgcattgcggcgatgctgcgcaacggccccaaggtttaa

SEQ ID NO: 72981 - protein, 407 aa, Magnetococcus sp. MC-1
MSNGIDKVVLAYSGGLDTSIILKWLQDEYQCEVVAFCADLGQAEELEPARAKAEKFGVKEIYIDDLKEEFVRDFVFPMYRANTLYEGVYHLGTSIARPLIAKRQIEIANATGAQAVSHGATGKGNDQVRFELGYYALRPDIRVIAPWREWDLTSRDKLFAYAEKHGIPVPTDKRGEVPYSMDRNLLHISFEGKALEDPWVEPDEEMFVLSVSPEKAPDQATYVELTFRQGDLVAIDDQEMSPATLLAKLNQLGGRNGIGRLDLVENRYVGMKSRGVYETPGGTILGVAHRAMESLTLDREVAHMKDELMPRYAKLIYNGYWFSPERAMLQTMIDASQTFVNGKVRVKLYKGNVVVVGRQSENSLFDPAIATFEDDKGAYNQADADGFIKLNALRMRIAAMLRNGPKV

SEQ ID NO: 72982 - DNA, 1260 bp, Mesorhizobium sp. BNC1
  CDS (1)..(1260): transl_table=11
atgcccgcgacacgaactcactcggaaaagacgatggcgacacataaagatgttaagaaggtcgtgctggcctattccggcggcctcgacacctcgatcatcctgaaatggctgcagacggaactcggcgccgaggtggtgaccttcaccgccgaccttggccagggcgaggagcttgagcccgctcgccgtaaggccgagatgctgggtatcaaggagatccacatcgaggatctgcgcgaggaattcgtccgcgatttcgtcttcccgatgttccgcgcaaatgcgctttacgaaggcacttatctgctcggcacttccattgcacggccgctgatcgccaagcgccttgtcgaaatcgccgccgaaacgggggcagacgccatcgctcacggcgcgacgggcaagggcaacgaccaggtccgcttcgaactcaccgcctatgcgctgaaccccgacatcaaggtgatcgctccgtggcgtgactggacgttcaagtcccgcacggaccttctgaacttcgcgcgcgaccatcagattccagtgcccagcgacaagcagggtgaggcgcccttctccgtcgacgccaatcttctgcactcttcctccgaggggaaagtgctggaagatccatggagcgagcccccggaatatgtccaccagcgcacggtttcgcccttcgatgcgccggaccgggcaacggagatcacgatcggcttcaagcgcggcgacgccgtgtcgctcaacggcgaggcggtgtcccccgccacgttgttggccaagctgaacgatcttggccgcgacaatggcatcggccgcatcgacctggttgaaaaccgctttgtcggcatgaaatcccgcggcgtctatgaaacgccaggaggcacgatccttcttgccgcccatcgcgcaatcgaatcgatcacgctcgaccggggcgccgcgcaccttaaggatgagctcatgccacgctatgccgagctcatttataacgggttctggtactcgcccgagcgtgagatgctccaggcgctcatcgacaagagccaggaggatgtcgagggcgaagtgcggctgaagctctataagggcaacgtcatcgtcacgggccgtcgttcggacaagtctctttattcggatgcgctcgtcactttcgaggatgatcgcggcgcctatgatcaaaaggatgcggcagggttcatccgcctcaatgcgctaagattgaggacgctcgcggcgcgcaagcggcttcaaggctga

SEQ ID NO: 72983 - protein, 419 aa, Mesorhizobium sp. BNC1
MPATRTHSEKTMATHKDVKKVVLAYSGGLDTSIILKWLQTELGAEVVTFTADLGQGEELEPARRKAEMLGIKEIHIEDLREEFVRDFVFPMFRANALYEGTYLLGTSIARPLIAKRLVEIAAETGADAIAHGATGKGNDQVRFELTAYALNPDIKVIAPWRDWTFKSRTDLLNFARDHQIPVPSDKQGEAPFSVDANLLHSSSEGKVLEDPWSEPPEYVHQRTVSPFDAPDRATEITIGFKRGDAVSLNGEAVSPATLLAKLNDLGRDNGIGRIDLVENRFVGMKSRGVYETPGGTILLAAHRAIESITLDRGAAHLKDELMPRYAELIYNGFWYSPEREMLQALIDKSQEDVEGEVRLKLYKGNVIVTGRRSDKSLYSDALVTFEDDRGAYDQKDAAGFIRLNALRLRTLAARKRLQG

SEQ ID NO: 72984 - DNA, 1209 bp, Alkalilimnicola ehrlichei MLHE-1
  CDS (1)..(1209): transl_table=11
atgagcgacgtcaagaaggtggtgctcgcctattccggcggtctcgacacctcggtcatcctgcaatggctgcgcgagacctacgactgcgaggtggtgaccttcaccgccgacctggggcagggcgaggagctggagccggcacgcaagaaggccgaggcctttggcatcaaagagatctacatcgacgatctgcgcgaggagttcgtccgcgatttcgtcttccccatgttccgggccaacgccatctacgagggtgagtacctgctcggcacctccatcgcccggccgctgatcgccaaacgccaggtggagatcgcccgcgagaccggcgccgacgccgtctcccacggggccaccggcaagggcaacgaccaggtgcgcttcgagctcggctactacggcctggagccgaacattaaggtgatcgccccctggcgcgaatgggatctcaactcccgcgagaagctgctggcctacgccgagaagcacggcatctccatcgagggcaagcagtccggcggctcgccctactccatggacgcgaacctgttgcacatctcctacgagggcggggtcctggaggacacttggaccgagtgcgaggaggccatgtggcgctggacgcgctcgcccgaggcggccccggacgaggcccaatatatcgacatcgagtttcagggcggcgacccggtgagtatcgacggcgagaagctcagccccgccgcgctgctgagccggctcaacgacctgggcgccatgcacggcgttggccggatcgatatcgtcgagaaccgctatgtgggcatgaagtcccgcggctgctacgaaaccccgggcggcaccatcctgctgcgcgcccaccgggccatcgagtccatcaccctggaccgcgagagcgcccacctgaaggacgaggtgatgcccaagtacgccgagttgatctacaacggctactggtggagcccggagcgcgaggccatgcaggcgttgatcgatgccacccagcgccgggtcaacggcgtggtgcggctgaagctctacaaggggaatgtcattgtggtgggacgcgattccgcgaacgattcgctgttcgaccagaccattgccaccttcgaggatgatcgcggcgcctacgatcagaaggacgccgagggctttatccgcctcaacgccctgcgcctgcgtatcgcccagcggcgcggctga

SEQ ID NO: 72985 - protein, 402 aa, Alkalilimnicola ehrlichei MLHE-1
MSDVKKVVLAYSGGLDTSVILQWLRETYDCEVVTFTADLGQGEELEPARKKAEAFGIKEIYIDDLREEFVRDFVFPMFRANAIYEGEYLLGTSIARPLIAKRQVEIARETGADAVSHGATGKGNDQVRFELGYYGLEPNIKVIAPWREWDLNSREKLLAYAEKHGISIEGKQSGGSPYSMDANLLHISYEGGVLEDTWTECEEAMWRWTRSPEAAPDEAQYIDIEFQGGDPVSIDGEKLSPAALLSRLNDLGAMHGVGRIDIVENRYVGMKSRGCYETPGGTILLRAHRAIESITLDRESAHLKDEVMPKYAELIYNGYWWSPEREAMQALIDATQRRVNGVVRLKLYKGNVIVVGRDSANDSLFDQTIATFEDDRGAYDQKDAEGFIRLNALRLRIAQRRG

SEQ ID NO: 72986 - DNA, 1221 bp, Sulfitobacter sp. EE-36
  CDS (1)..(1221): transl_table=11
atgtccgcgcccaaaaaagttgtgctcgcctattctggtgggcttgatacctcgatcatcctgaaatggctgcaaaccgaatatggttgcgaggtggttacctttaccgctgacctcggccaaggcgaagagcttgagcccgcccgcgccaaagctgaaatgatgggcgcatccgagatttacgtggaagacgtgcgtgaagaattcgtgcgcgatttcgtcttccccatgttccgcgccaatgcggtctatgaaggcctatacctgttgggcacctccatcgcgcgccctctgatttccaagcgccttgttgaaatcgccgccgaaaccggtgccgatgccgttgcgcacggcgcgacaggcaagggcaacgatcaggttcgtttcgaattggcggcctacgcgctgaaccccgacatcaaggtgatcgcgccatggcgggaatgggacctgtccagccggactaaattgatcgaatttgccgaaaaacatcagatccctgtggcgaaggacaaacgtggtgaagcgccgtttagcgtggacgcgaacctgctgcacacctcttcggaaggcaaagtgcttgaggatccggccgtggacgcgcccgactatgtgtaccagcgcacggtctcgccagagcaagcaccagatacgcccgagtatgtggaaatcgggtttgaacgtggcgatgcggtaagcatcaacggcgaagccatgtcgcccgcgacacttctggctaaattgaacgaacttggcggcaaacatggctgcgggcgccttgaccttgtcgagggtcgttttgtcgggatgaaatcccgcggtatttacgaaacgccgggcggcaccttgctgcttgaagcacaccgcgggatcgaatcgatcaccctcgaccgtggggcgatgcacctgaaggacgagctgatgccgcgctatgcggagctgatctataacggtttctggtacagccccgagcgcaccatgctgcaagcggcgattgatgcctcgcaaacccatgtaaccggtacagttcgactgaaattgtacaaaggccacgtgcgtaccgtcggccgctggtcggatcattcgctgtattccgaagcccacgtgacatttgaagatgatgctggggcctatgatcaaaaagacgcggcgggcttcattcagctgaacgcgctgcgtctcaagctcttggccgcacgcgataagcgcctcaaagggtaa

SEQ ID NO: 72987 - protein, 406 aa, Sulfitobacter sp. EE-36
MSAPKKVVLAYSGGLDTSIILKWLQTEYGCEVVTFTADLGQGEELEPARAKAEMMGASEIYVEDVREEFVRDFVFPMFRANAVYEGLYLLGTSIARPLISKRLVEIAAETGADAVAHGATGKGNDQVRFELAAYALNPDIKVIAPWREWDLSSRTKLIEFAEKHQIPVAKDKRGEAPFSVDANLLHTSSEGKVLEDPAVDAPDYVYQRTVSPEQAPDTPEYVEIGFERGDAVSINGEAMSPATLLAKLNELGGKHGCGRLDLVEGRFVGMKSRGIYETPGGTLLLEAHRGIESITLDRGAMHLKDELMPRYAELIYNGFWYSPERTMLQAAIDASQTHVTGTVRLKLYKGHVRTVGRWSDHSLYSEAHVTFEDDAGAYDQKDAAGFIQLNALRLKLLAARDKRLKG

SEQ ID NO: 72988 - DNA, 1227 bp, Roseovarius nubinhibens ISM
  CDS (1)..(1227): transl_table=11
atgtccgcgcccaaaaaagtcgttctggcctattccggtggcctcgatacctcgatcatcctgaaatggctgcaaaccgaatacggttgcgaagtggtgaccttcaccgccgatctcggccagggtgaagagcttgatcccgcccgcaagaaggcagagctgctcggcatcaatcccgacaatatctatatcgaggacatccgcgaggaattcgtccgcgatttcgtcttcccgatgttccgcgccaatgcgctctacgagggccagtatctgctcggcacctccatcgcccgcccgctgatctccaaacgtctggtcgagattgccgccgaaaccggcgccgatgccgtggcccatggcgccaccggcaagggcaatgatcaggtccggttcgaactcgcggcctatgcgctcaaccccgacatcaaggtgatcgccccctggcgcgaatgggatctcacctcgcggaccaagctgctggaatttgccgaggcgaaccagatcccgatcgccaaggacaagcgcggcgaagcccccttctcggtcgatgccaacctcctgcacacctcctccgagggcaaagtgctcgagaacccgggcgaagaggcccccgattacgtctatcagcgcaccgtctcccccgaggacgcgcccgacaccgccgagatcatcgagatcggctttgaacgcggcgacgcggtgagcatcaatggcgaggcgatgagccccgccaccctgctcacccgcctcaacgagctgggcggcaagcatggcatcggccgtctcgatttcgtcgaaaaccgctttgtcggcatgaaatcgcgcggcatctacgagaccccgggcggcaccgtgctgctcgaggcgcatcgcggcatcgaacagatcaccctcgacagcggcgcaggccatctcaaggacagcctgatgccccgctatgccgagctgatctacaacggtttctggtactcgcccgaacgcgaaatgctgcaggccgccatcgacaagagccaggaacatgtgaccggcaccgtccggatcaagctctacaaaggcgcggccacctgcatcgcccgctggtcggatcactcgctctattccgaggcccatgtgaccttcgaagaagacgccggtgcctatgatcagaccgacgcgcagggcttcattcagctcaacgcgctgcggctcaagcttctcgccgcccgcaagcgccgtctcggcagctaa

SEQ ID NO: 72989 - protein, 408 aa, Roseovarius nubinhibens ISM
MSAPKKVVLAYSGGLDTSIILKWLQTEYGCEVVTFTADLGQGEELDPARKKAELLGINPDNIYIEDIREEFVRDFVFPMFRANALYEGQYLLGTSIARPLISKRLVEIAAETGADAVAHGATGKGNDQVRFELAAYALNPDIKVIAPWREWDLTSRTKLLEFAEANQIPIAKDKRGEAPFSVDANLLHTSSEGKVLENPGEEAPDYVYQRTVSPEDAPDTAEIIEIGFERGDAVSINGEAMSPATLLTRLNELGGKHGIGRLDFVENRFVGMKSRGIYETPGGTVLLEAHRGIEQITLDSGAGHLKDSLMPRYAELIYNGFWYSPEREMLQAAIDKSQEHVTGTVRIKLYKGAATCIARWSDHSLYSEAHVTFEEDAGAYDQTDAQGFIQLNALRLKLLAARKRRLGS

SEQ ID NO: 72990 - DNA, 1224 bp, Oceanicola batsensis HTCC2597
  CDS (1)..(1224): transl_table=11
atgagcgcgccgaagaaagtcgtcctggcctattccgggggcctcgacacctcgatcatcctgaaatggctgcagaccgaatacggttgcgaggtcgtgaccttcaccgccgacctcggccagggcgaagagctcgaacccgcccgcaagaaggccgaattgctcggcatcagccccgagaacatctatatcgaagacatccgcgaggaattcacccgcgacttcgtcttcccgatgttccgcgccaatgccctctacgaggggctttacctgctgggcacctccatcgcccgccccctgatctccaagcggctggtcgagatcgccgaggaaaccggcgccgatgccgtcgcccacggggccaccggcaagggcaacgatcaggtgcggttcgagctttccgcctatgccctgaaccccgaaatcaaggtgatcgccccctggcgtgaatgggacctgacctcgcgcaccaggcttctggaatttgccgaggcgaaccagatcccgatcgccaaggacaagcgcggcgaggcgccgttctcggtcgatgcgaacctcctgcacacctcctccgagggcaaggtgctggaaaaccccgccgacgaggccccggattacgtcctgcagcgcatcacccgccccgaggacgcgccggaccagccggaattcgtcgagatcacgttcgagaagggggatgccgtcgccatcgacggtgaggccatgtcccccgccacgatcctgacgaagctgaacgagttgggcggcaagcacgggatcggcatcctcgacctggtcgagaaccgctttgtcggcatgaagtcccgtggcgtctacgagacccccggcggcaccgtcctgctcgaggcgcatcgcggcatcgaacagatcacgctcgacagcggcgcgggtcacctcaaggactcgatcatgccccgctacgcggaactcatctacaacggcttctggttctctcccgagcgcgagatgctgcaggccctgatcgacaagagccaggaacacgtctcgggcaccgtccggctgaagctctacaagggctccgcccgcaccgtcgcgcgctggtccgaccattcgctttattccgaagcccacgtgaccttcgaggaagacgccggcgcctacgaccagaaggacgcccagggcttcattcagctcaacgcgctgcgcttgaagcttctggccgcccgggaccggcggttgaaatag

SEQ ID NO: 72991 - protein, 407 aa, Oceanicola batsensis HTCC2597
MSAPKKVVLAYSGGLDTSIILKWLQTEYGCEVVTFTADLGQGEELEPARKKAELLGISPENIYIEDIREEFTRDFVFPMFRANALYEGLYLLGTSIARPLISKRLVEIAEETGADAVAHGATGKGNDQVRFELSAYALNPEIKVIAPWREWDLTSRTRLLEFAEANQIPIAKDKRGEAPFSVDANLLHTSSEGKVLENPADEAPDYVLQRITRPEDAPDQPEFVEITFEKGDAVAIDGEAMSPATILTKLNELGGKHGIGILDLVENRFVGMKSRGVYETPGGTVLLEAHRGIEQITLDSGAGHLKDSIMPRYAELIYNGFWFSPEREMLQALIDKSQEHVSGTVRLKLYKGSARTVARWSDHSLYSEAHVTFEEDAGAYDQKDAQGFIQLNALRLKLLAARDRRLK

SEQ ID NO: 72992 - DNA, 1209 bp, Photobacterium sp. SKA34
  CDS (1)..(1209): transl_table=11
atgagcaagattaataaagttgtattagcctattctggcggtttagatacatcggctatcattccatggttgaaagaaaactatgattgtgaagttgtcgcattcgtagctgatgtgggtcaaggcgaagaagagctggttggtattgaagaaaaagcattggcttcaggagcttcatcttgttacatcgccgatcttaaagaagagatggtgaaagattatatctacccatccttaaaaaccggtgctgtgtacgaaggtaaatacctactgggtacttcaatggcgcgtccaattattgctaaagcacaagttgaatgtgcattggaatttggtgcagatgcgttatgtcatggatgtactggtaaaggtaacgatcaggtacgttttgaaggtgcatttgccgcactagcaccacagcttaaagtaattgctccttggcgtgaatgggatctacgtagtcgtgaagcgctattagattaccttgctgagcgtgatattccatgtacggcatcgcttgaaaaaatttactctcgtgatgcgaatgcatggcacgtatcaacagaaggtggggtgttagaagatacatggaatgcacccaacgatttatgttgggtatggacaaaagatccagaacaagcgccggatcaagcggaaacagtcacgctactgattgaacaaggtgaagtcgttgcggttgatggtgaagcgatgacgccatacaacgtgctaacgtacctgaatgaaaaaggtatcgatcacggtgttggtcgtatcgatattgtagaaaaccgtctagtcggtatgaagtctcgtggttgttatgaaacacccggagggacgattatgatggaagcgctacgtgcggtagagcagctagtactcgataaagaatcgttcgatttccgtcaaacattgggtcttaaagcgtcacaccttatctatgatggtcgttggttcacgccattatgtcagtcattaattgcagctgctgatgagttagcaaaagatgtgagtggtgaagtggtcgttaagctgtacaaaggtcaagcaaccgtgactcagaagcgctcaactaacagcttatattctgaagagtttgcgacctttggtgaagatgatgtttatgatcacagccatgctggcggtttcattcgtctttactcactagcaagtcgtattcgtgctttaaatagccaaaagaaataa

SEQ ID NO: 72993 - protein, 402 aa, Photobacterium sp. SKA34
MSKINKVVLAYSGGLDTSAIIPWLKENYDCEVVAFVADVGQGEEELVGIEEKALASGASSCYIADLKEEMVKDYIYPSLKTGAVYEGKYLLGTSMARPIIAKAQVECALEFGADALCHGCTGKGNDQVRFEGAFAALAPQLKVIAPWREWDLRSREALLDYLAERDIPCTASLEKIYSRDANAWHVSTEGGVLEDTWNAPNDLCWVWTKDPEQAPDQAETVTLLIEQGEVVAVDGEAMTPYNVLTYLNEKGIDHGVGRIDIVENRLVGMKSRGCYETPGGTIMMEALRAVEQLVLDKESFDFRQTLGLKASHLIYDGRWFTPLCQSLIAAADELAKDVSGEVVVKLYKGQATVTQKRSTNSLYSEEFATFGEDDVYDHSHAGGFIRLYSLASRIRALNSQKK

SEQ ID NO: 72994 - DNA, 1227 bp, Oceanospirillum sp. MED92
  CDS (1)..(1227): transl_table=11
atgtccgagatcaaaaaggtcgttctggcctactccggtggattggatacttccgttatcgttcgctggttacaagatgaatacaacgcagaagttgttacttttactgctgacctgggtcagggtgaagaggttgagcctgcgcgtgccaaagcagaagctctgggtgtaaaagaaatttacatcgaagacctgcgtgaagagtttgtacgtgatttcgtattcccaatgttccgtgcaaacacaatctatgaaggcgagtaccttctgggtacttctatcgcacgcccgttaattgcaaaacgtctgattgaaattgcaaacgaaacgggtgctgatgcgatttctcacggtgcaacaggtaaaggtaatgaccaggttcgcttcgagttgggtgcttatgcgctgaaaccgggtgtacacgtgattgcgccatggcgtgaatgggatctgacttcccgtgagacgctgatgaaatactgtgaagatcataatatcccagttgatttctcaagcagcaagaagaaatctccgtactcaatggatgctaacctgcttcatatctcttatgagggtgatattcttgaagatccatggcaggaagctgaagaggatatgtggcgctggtccgtttctcctgagcaagctccagatgaacctacttatctggaactgacttacgagaagggtgatatcgttgcgatcaatggcgagaaaatgagcccggctactgttcttgaatacctgaacaaggtgggtggcgagaatggtatcggtcgtttggatatcgttgaaaaccgcttcgttggcatgaaatctcgtggttgttatgaaacaccgggcggaacgattatgctgcgtgctcaccgcgctatcgaatcaatcacgcttgaccgtgaagcagcgcacctgaaagatgagctgatgccacgctacgcgaaagtaatctacaacggcttctggtggtcagaagagcgtaagatgctgcagaagatgatcgatgagtcccagcaggttgttaacggtgatgttcgcctgaagctgtacaaaggcaatgtggttgtcgtgggtcgtcgttctgaagatagcttgtttgatgaaaacattgcgacttttgaagatgatgcgggttcttacgaccagaaagatgccgctggctttatcaagctgaacgcattgcgtatgcgtattgctgctggcaaagggcgtaatcttctcgacgattaa

SEQ ID NO: 72995 - protein, 408 aa, Oceanospirillum sp. MED92
MSEIKKVVLAYSGGLDTSVIVRWLQDEYNAEVVTFTADLGQGEEVEPARAKAEALGVKEIYIEDLREEFVRDFVFPMFRANTIYEGEYLLGTSIARPLIAKRLIEIANETGADAISHGATGKGNDQVRFELGAYALKPGVHVIAPWREWDLTSRETLMKYCEDHNIPVDFSSSKKKSPYSMDANLLHISYEGDILEDPWQEAEEDMWRWSVSPEQAPDEPTYLELTYEKGDIVAINGEKMSPATVLEYLNKVGGENGIGRLDIVENRFVGMKSRGCYETPGGTIMLRAHRAIESITLDREAAHLKDELMPRYAKVIYNGFWWSEERKMLQKMIDESQQVVNGDVRLKLYKGNVVVVGRRSEDSLFDENIATFEDDAGSYDQKDAAGFIKLNALRMRIAAGKGRNLLDD

SEQ ID NO: 72996 - DNA, 1230 bp, Xanthobacter autotrophicus Py2
  CDS (1)..(1230): transl_table=11
atggcgcgtgacgtgaagaaggtggtgctggcctattccggtggcctcgacacctccgtgatcctgaaatggctccagaccacctacaagtgcgaggtgatcaccttcaccgccgatcttgggcagggcgaggagctggagccggcgcgcaagaaggcgcagctgctcggcatcaaggacgaaaacatcttcatcgaggacgtgcgcgaggaattcgtcgccgagtacgtcttccccatgttccgcgccaatgcggtctatgaagggctgtaccttctgggcacctccatcgcccggcccctgatcgccaagaagcagatcgagatcgcccgcaagatgggcgccgacgccgtctcccacggcgccaccggcaagggcaacgaccaggtacgcttcgagctcggctattatgcgctggagccggagatcaccgtcatcgccccctggcgcgagtgggatctgacctcccgcacccgcctgctggagttcgccgagcagcaccagatcccgatcgccaaggacaagcgcggcgaggccccgttctcggtggacgcgaacctcctgcactcctcctccgagggcaaggtgctggaagacccggccgaggacgcgccggaatacgtctaccagcgcaccatttcccccgaggccgcccccgacgagcccaccatcatcaccatcgccttcgacaagggcgatgcggtggccatcaacggcgaggcgctctcccccgccaccctgctgaccaagctcaacgagctgggcaaggccaacggcatcggccggctcgacctcgtggaaaaccgcttcgtgggcatgaagagccgcggcgtctacgagacccccggcggcaccatcctgctcgccgcccatcgcggcatcgagagcatcacgctcgatcgcggcgcggcccacctcaaggacgagctgatgccccgctatgcggagctgatctacaacggcttctggttctcccccgagcgggagatgctgcaggccgccatcgaccactcccaggcctatgtgaccggcgaagtgacggtgaagctctacaagggcaacaccacggtcatcggccgcaaaagcccctattcgctctacaatcaggaactggtcaccttcgaggaaggcgcggtcgcctacgaccaccgcgacgcggcgggcttcatcaagctcaacgccctgcgcctgcgcaccctcggcagccgggcccgcaagatctcggagtga

SEQ ID NO: 72997 - protein, 409 aa, Xanthobacter autotrophicus Py2
MARDVKKVVLAYSGGLDTSVILKWLQTTYKCEVITFTADLGQGEELEPARKKAQLLGIKDENIFIEDVREEFVAEYVFPMFRANAVYEGLYLLGTSIARPLIAKKQIEIARKMGADAVSHGATGKGNDQVRFELGYYALEPEITVIAPWREWDLTSRTRLLEFAEQHQIPIAKDKRGEAPFSVDANLLHSSSEGKVLEDPAEDAPEYVYQRTISPEAAPDEPTIITIAFDKGDAVAINGEALSPATLLTKLNELGKANGIGRLDLVENRFVGMKSRGVYETPGGTILLAAHRGIESITLDRGAAHLKDELMPRYAELIYNGFWFSPEREMLQAAIDHSQAYVTGEVTVKLYKGNTTVIGRKSPYSLYNQELVTFEEGAVAYDHRDAAGFIKLNALRLRTLGSRARKISE

SEQ ID NO: 72998 - DNA, 1218 bp, marine gamma proteobacterium HTCC2207
  CDS (1)..(1218): transl_table=11
gtgtcatcagttaataaagttgttttagcctactccggtggattagatacctcggttatcgtcaaatggttgcaggaagaatataactgcgaagtcgttaccttcactgccgatatcggccagggtgaagaagtcgaacccgctcgcgccaaggctgaagctttgggcgtaaaagaaatttatattgatgatctacgcgaagaatatgctcgcgattttgtcttccccatgttccgtgccaacacaatttatgagggcgagtatctgctcggcacctctattgcccgtccgttgattgccaagagactgatcgaaattgccaatgaaactggcgccgacaccatatcccatggcgctactggcaagggcaatgatcaggtgcgttttgaactgggtgcctatgcgctaaagccaggcattaaagtgattgccccgtggcgagagtgggatctgaattcccgcgacaagctaatggaatactgtgaaaagcacagcattccggttgagatgaagcgtggcaaaaaatcccccttctccatggacgcgaacttgctgcacatctcctacgagggtggcaacttggaagacccttggtccgaagctgaagacgatatgtggcgttggacggttgctccagagcaggcccccgatgaagcttgttatatgaatatcagctatgagaagggcgatatagttgctattgatggcgaagccatgtctccggccacggttattgaatacttaaataaggttgccggcgctcacggtgttggccgtctagatatagttgagaaccgctatgtgggtatgaagtcacgcggctgttacgagacaccagcaggcactgtgatgatgaaggcgcaccgcgctatcgaatccatcacccttgatcgcgaagtggcgcatatgaaagatgagttgatgccgcgctacgccaagttaatttataacggttactggtgggcacctgagcgtctgatgttgcaaaccgctatagatcaaagtcaggatgttgttaacggtgatgtgcgcattaagctctacaaaggcagtgtgagtgttgttggccgcaagtcagatgacagtctgttcgatgccaatatagccacctttgacgatgatggcggtgcctataaccaagccgacgctgaaggctttattaagcttaatgcactgcgtttgcgtattgctgctaataagggtcgcgatattctgtaa

SEQ ID NO: 72999 - protein, 405 aa, marine gamma proteobacterium HTCC2207
MSSVNKVVLAYSGGLDTSVIVKWLQEEYNCEVVTFTADIGQGEEVEPARAKAEALGVKEIYIDDLREEYARDFVFPMFRANTIYEGEYLLGTSIARPLIAKRLIEIANETGADTISHGATGKGNDQVRFELGAYALKPGIKVIAPWREWDLNSRDKLMEYCEKHSIPVEMKRGKKSPFSMDANLLHISYEGGNLEDPWSEAEDDMWRWTVAPEQAPDEACYMNISYEKGDIVAIDGEAMSPATVIEYLNKVAGAHGVGRLDIVENRYVGMKSRGCYETPAGTVMMKAHRAIESITLDREVAHMKDELMPRYAKLIYNGYWWAPERLMLQTAIDQSQDVVNGDVRIKLYKGSVSVVGRKSDDSLFDANIATFDDDGGAYNQADAEGFIKLNALRLRIAANKGRDIL

SEQ ID NO: 73000 - DNA, 1212 bp, delta proteobacterium MLMS-1
  CDS (1)..(1212): transl_table=11
atgctacctaaagtcaacaaaatcgtcctggcctactccggtggtctggatacctcggttattctgcgctggctcaaggagacctgccagtgcccggtgatcgcctacgccgccgatatcggccagaccgaagactgggaggcggtgcgggccaaggggttggccaccggcgccgacgaggtggtgatcgccgatctcaaggaagagtttgtccgcgattatgtcttcccggccttccgggccaacgccatctatgaaggttcctacctgctgggcacctccctggcccggccggtgatcgccaaggagcaggtgcggttggccgaagtccatggggccgatgcggtcagccacggcgccaccggcaagggcaacgaccaggtccgcttcgagcttggctacatggctttgaaccccgatttgcagatcatcgccccctggcgcgtctgggatctcaattcccgccgcaagttgatggcctatgccgaaaagcatggtatcccggtgccggtgagccacgaaaaaccttacagttccgatgaaaatctgctgcatatcagctttgaaggcggggtattggaagatccctggcaggagccggaagagaggatgtttcagctctcggtttccccggagcaggccccggataagcccacctatatcgagctggagtttgccggcggcaacccggtggccatcgacggggaaagactggcgccggccgccatgctggcccggctcaaccaattgggggggcaaaacggcatcggccggctggatatggtggagaatcgctttgtcggcatgaagtcccgtggcgtttatgaaaccccgggcgggaccatcctgcgctgcgcccatcgcgatctcgagaccatcaccctggatcgcgaggtgatgcggatccgtgattccctggtgccccgctattcggagttgatctacaacggcttctggttcgccccggagatgcaactgctgcaaagcaccatggaccagacccaggccacggtcaacggggtggtacggctcaagctctacaagggcaactgcctgccggtgggtcgcaagtccgacaactccctgtatcaggagagcttcgccacctttgaagaggacagcgtctatcaccaggccgacgccgaaggttttatccgcctgcaggggctacgcctcaggatgcaggccctgcggggggagattaacaggtga

SEQ ID NO: 73001 - protein, 403 aa, delta proteobacterium MLMS-1
MLPKVNKIVLAYSGGLDTSVILRWLKETCQCPVIAYAADIGQTEDWEAVRAKGLATGADEVVIADLKEEFVRDYVFPAFRANAIYEGSYLLGTSLARPVIAKEQVRLAEVHGADAVSHGATGKGNDQVRFELGYMALNPDLQIIAPWRVWDLNSRRKLMAYAEKHGIPVPVSHEKPYSSDENLLHISFEGGVLEDPWQEPEERMFQLSVSPEQAPDKPTYIELEFAGGNPVAIDGERLAPAAMLARLNQLGGQNGIGRLDMVENRFVGMKSRGVYETPGGTILRCAHRDLETITLDREVMRIRDSLVPRYSELIYNGFWFAPEMQLLQSTMDQTQATVNGVVRLKLYKGNCLPVGRKSDNSLYQESFATFEEDSVYHQADAEGFIRLQGLRLRMQALRGEINR

SEQ ID NO: 73002 - DNA, 1206 bp, Desulfitobacterium hafniense DCB-2
  CDS (1)..(1206): transl_table=11
atgaaaaaggtagtgcttgcgtattccggaggattagatacctcgatcatcatcccttggctgaaagagaattatggctatgaagtcattgctatggccgctgacctgggacaaggagaagagctggagcctctccacgaaaaagcgattaagagcggagccagtaaattatatatcgaagatctgcaagaagaattcgttactgatttcatctaccccaccctaaaagccggagctgtctatgaaggcaaatatcttttgggaacctcctttgcccgtcccctgattgcccaacgtttagtagagattgcggcaaaagagggagctgtggccattgctcacggtgccacgggaaaaggaaacgaccaggttcgctttgagctggctgtcaaagccttaaatcctgatctggagatcatagctccttggcggatttgggatatcaagtcccgggaagatgctattgactatgctgttgagaggggaattcctgtccctgtaacgaaagatcgcccttacagtatggaccgcaatgtctggcatctcagccatgaaggaggcgatttagaagatccttggaatgagcccaaaaaggatctctatctccttggggtttcaccggaagatgctcccgacgaagccgagtacctggaactggattttgaacaaggtattcctgtttctttaaacggagaaaagttaggtcctgttcagcttttggagactctcaatgaggttggcggcaaacacggcattggcattgtggacatggtggaaaaccgcttagtaggaatgaaatcccggggggtttatgagactcccggtggtaccattctctatacagctcatcaagccctggaacatttgaccttggatcgtttgacccttcattataaggagcaaatcgccctgaaatacgctgaattggtttacgacggcgtttggcattctcctttgcgggaagccctggatgccttcgtggatgttacccagaaaaatgtcaccggaacggtacgcctgaagctttataaaggcaattgcagcttagccggtgtgaaatccccctactccctctatagtgaagaatttgctaccttcggacgggatggggtctataaccaaaaggatgctgaaggtttcatcaatctcttcggtcttcctcttaaagtaagagcgttaatggaaaagaaatcagggttgagataa

SEQ ID NO: 73003 - protein, 401 aa, Desulfitobacterium hafniense DCB-2
MKKVVLAYSGGLDTSIIIPWLKENYGYEVIAMAADLGQGEELEPLHEKAIKSGASKLYIEDLQEEFVTDFIYPTLKAGAVYEGKYLLGTSFARPLIAQRLVEIAAKEGAVAIAHGATGKGNDQVRFELAVKALNPDLEIIAPWRIWDIKSREDAIDYAVERGIPVPVTKDRPYSMDRNVWHLSHEGGDLEDPWNEPKKDLYLLGVSPEDAPDEAEYLELDFEQGIPVSLNGEKLGPVQLLETLNEVGGKHGIGIVDMVENRLVGMKSRGVYETPGGTILYTAHQALEHLTLDRLTLHYKEQIALKYAELVYDGVWHSPLREALDAFVDVTQKNVTGTVRLKLYKGNCSLAGVKSPYSLYSEEFATFGRDGVYNQKDAEGFINLFGLPLKVRALMEKKSGLR

SEQ ID NO: 73004 - DNA, 1398 bp, Medicago truncatula
  CDS (1)..(1398)
atggcgcagttgaatgcaattcttacatactcatccccagctattgctcctaccaaacatgcaaaagagcacctgctgcatcaccggttctgccaggcaaagccttcttcattaagagagttgagtccaagaagaagttttggtgctgcaagtaaacctcaagttataaaagctgtgctatataaagacgtagaaatttctgagaccaagaaggttgctggactaaaaggtaaattgaataaggttgttctggcttatagtggtggcttagacacatcggttgttgtcccctggctgagagagaactatggctgtgatgttgtttgcttcactgctgatctaggccaaggggcaagtgaattggaaggtttagaagagaaggcaaaagccagcggagcttctcagttagtcgtgaaggatttgaaggaggaatttgttagggattatgtattcccttgcctgcgtgccggtgcaatttatgagaggaagtatttgcttggaactgcaatagctcgccctgtaattgcaaaggctatggtggatattgccaatgaagttggagctgatgctgttcgatttgaactctccttttttgctctgaatcccaagttaaatgtcgtggctccatggagggagtgggatattacagggagagaagatgctattgagtatgctaagaagcatgatgtaccggttcctgtaaccaaaaaatccatatatagcagggataggaacctttggcacataactcatgagggtgatgttttggaagatccagcaaatgaacctaaaaaggatatgtacatgttgactgtagacccagaggatgctccaaacgagccagaatatgtggagattggatttgagttaggcattccagtatcgctgaacgggaagaggctttctccaggaaatttggttgctgagctgaatgagataggtggaaggcatggaataggccgtgtcgacttggttgaagaccgcattgtaggcatgaagagccgaggagtttacgaaactccaggtggcaccattctcttcactgcagcaagagacttagagactttgactcttgatcgtgaaacacttcagcttaaagactcattagcacttaaatatgcagagttagtgtatgctggaagatggtttgatccacttcgcgaatcgatggattcattcatggagaagatctcacagactacaacaggttcagtgagtttgaaactgtataaaggtagtgcttctgtgacgggtcggaagagtccttatagtttatatagggaagatatttcttcatttgagagtggggagatatataatcatgctgatgctgttgggtttataaagctttatggtcttccaatgaggatcagagccatgatggaacaaggcatttaa

SEQ ID NO: 73005 - protein, 465 aa, Medicago truncatula
MAQLNAILTYSSPAIAPTKHAKEHLLHHRFCQAKPSSLRELSPRRSFGAASKPQVIKAVLYKDVEISETKKVAGLKGKLNKVVLAYSGGLDTSVVVPWLRENYGCDVVCFTADLGQGASELEGLEEKAKASGASQLVVKDLKEEFVRDYVFPCLRAGAIYERKYLLGTAIARPVIAKAMVDIANEVGADAVRFELSFFALNPKLNVVAPWREWDITGREDAIEYAKKHDVPVPVTKKSIYSRDRNLWHITHEGDVLEDPANEPKKDMYMLTVDPEDAPNEPEYVEIGFELGIPVSLNGKRLSPGNLVAELNEIGGRHGIGRVDLVEDRIVGMKSRGVYETPGGTILFTAARDLETLTLDRETLQLKDSLALKYAELVYAGRWFDPLRESMDSFMEKISQTTTGSVSLKLYKGSASVTGRKSPYSLYREDISSFESGEIYNHADAVGFIKLYGLPMRIRAMMEQGI

SEQ ID NO: 73006 - DNA, 1254 bp, Aspergillus oryzae
  CDS (1)..(1254)
atggctaccgagaagccccgtgtctgtcttgcctactctggcggtctggataccagctgcattcttcgctggttgatcgaggagggctacgaggttgtctgcttcctcggcaatgtcggccaggaggaagactgggccgctgttgaggagaaggccctcaagatcggtgccaagaagatggtgattgaggatctgcgccgggagttcgtcgaggagctctgcttccctgccatccagtgcaatgccatctatgagggtcgctacctcctgggaaccagcttggctcgtcccgttatcgcccgcgcccagatgcgtgtcgctcagcgtgaaggctgccagtttgtcagccacggtgctaccggcaagggtaacgaccaggtccgtttcgaactggctttctatgccatccagccctccatcaagatcatcgccccttggcgtgatcccaagttcttcaagcgtttcgctggccgtaacgatctcctcgactatgccgcccagaccggcatccctgttacctccactaaggccaagccctggtccatggacgccaactccgcccactgcagttacgaggccggtgttctggaggaccccaaccacacccctcccgctgacatgtggaccatgaccgccgaccctctgaacgcccctaacgagcctgccgacatcaccatccagttcgagcagggtatccccactaagctcgtcactcccgagaagacatacaccgactccgttgagctcttcaacgctctcaacaagctcggctacacccacggtgttggccgtattgatattgtcgagaaccgcttcatcggtctcaagagccgtggctgctatgactcccctgctatgaccatcctccgcgccgcccatctcgacctcgagggtctcgtcctggacggccaggtccgctctctccgtgatcagttcgtcacccacaactggtccatcctcctctacaatggctactacttcagccccgagcgtgagttcatcgagaacagtctgaagttcagtcagaagcgcgtcaacggtgaggtccgtgtgcgcctctacaagggtagcccttacatccttggtcgctccagcagcaccgagaagctgtacgatgccgaggaggcttccatggactccctcgaggacttcgagcctaccgacaccaccggtttcattgccatcagctccatccgtctcaagaagtacggtctgcagaaggctgaggagggcgagaacctcagccgggcttag

SEQ ID NO: 73007 - protein, 417 aa, Aspergillus oryzae
MATEKPRVCLAYSGGLDTSCILRWLIEEGYEVVCFLGNVGQEEDWAAVEEKALKIGAKKMVIEDLRREFVEELCFPAIQCNAIYEGRYLLGTSLARPVIARAQMRVAQREGCQFVSHGATGKGNDQVRFELAFYAIQPSIKIIAPWRDPKFFKRFAGRNDLLDYAAQTGIPVTSTKAKPWSMDANSAHCSYEAGVLEDPNHTPPADMWTMTADPLNAPNEPADITIQFEQGIPTKLVTPEKTYTDSVELFNALNKLGYTHGVGRIDIVENRFIGLKSRGCYDSPAMTILRAAHLDLEGLVLDGQVRSLRDQFVTHNWSILLYNGYYFSPEREFIENSLKFSQKRVNGEVRVRLYKGSPYILGRSSSTEKLYDAEEASMDSLEDFEPTDTTGFIAISSIRLKKYGLQKAEEGENLSRA

SEQ ID NO: 73008 - DNA, 1278 bp, Agaricus bisporus
  CDS (1)..(1278)
atgcctgaaaacaaaggtcgtgttcttttagcctactctggtggtctagatacctcttgtatccttgcatggttgattgaagaaggatatgaagtctatgcattcatggcagatgtaggccaagaagaagactatgcagctgcagaacagaaagctttgaaagtcggagcaaagaaattcttcttggccgatctcaaacgagaattcgttactgaactcatttatcctgcagttcaagctaactgtatctacgaaaatgtttatctccttggtacatcacttgctcgacctgttattgcccgtggaatgattgaagttgcagacaaagagggttgcgattacgtctctcacggttgcactggaaaaggcaacgaccaagtccgatttgaactcgctttctacggtctcaaacctgatatcaaagttatcgctccttggcgaattcccgaattctacaaccgcttcgccggacgacaagcccttcttcaatatgccgccgaacaaaatattcctgtccaacaaactgttgcaaaaccatggtcaacagatgaaaatctcttccacatctcatacgaagctggtatcctcgaagatcccaacgtcactcctcccgacgacatgtggaaactcaccaccgctcccgaagatgcccccacctcacccgaacgtatcatcctcgaattccaaaacggtttacccaccaaagtcatcgttcctgaacaacaaaaagaatatacagatgctgtagaaattttcactgctctaaacactctcgcaaggaaacatggtataggtcgtatcgatatcgtcgaaaatcggtttataggagtcaaatctcgtggttgttacgaatcacctggagctactatccttcgtgtcgcccatatggatcttgaaggtcttaccctcgatcgtaatgtgcgagctcttcgagaccaatttacaactatcgctctgagtcgaatcttgtataacggtcattacttctcgcctgaacgcgagttcgttactagctctattccttcgagtcaacgaactgtgaatggcatcgttagactgaaactttacaagggtaacactattgttgaaggccgtgaatccagtgaaggtctgtatgatgctgctcagtcctccatggacgaacttggtggtttcgagcctacagatactaccggattcatttctatcgagtctatcagactcaaaaaatgggctcaatcaaaggcagccaaaggtcagtctggcgtcacggccaaggatgtctatggtagctcttag

SEQ ID NO: 73009 - protein, 425 aa, Agaricus bisporus
MPENKGRVLLAYSGGLDTSCILAWLIEEGYEVYAFMADVGQEEDYAAAEQKALKVGAKKFFLADLKREFVTELIYPAVQANCIYENVYLLGTSLARPVIARGMIEVADKEGCDYVSHGCTGKGNDQVRFELAFYGLKPDIKVIAPWRIPEFYNRFAGRQALLQYAAEQNIPVQQTVAKPWSTDENLFHISYEAGILEDPNVTPPDDMWKLTTAPEDAPTSPERIILEFQNGLPTKVIVPEQQKEYTDAVEIFTALNTLARKHGIGRIDIVENRFIGVKSRGCYESPGATILRVAHMDLEGLTLDRNVRALRDQFTTIALSRILYNGHYFSPEREFVTSSIPSSQRTVNGIVRLKLYKGNTIVEGRESSEGLYDAAQSSMDELGGFEPTDTTGFISIESIRLKKWAQSKAAKGQSGVTAKDVYGSS

SEQ ID NO: 73010 - DNA, 1194 bp, Streptomyces griseus subsp
  CDS (1)..(1194): transl_table=11
gtgaccgagcgcgtcgttctcgcttactcgggcggcctggacacctccgtcgccatcggctggatcgccgaggagacgggtgccgaggtcatcgccgtcgccgtggacgtcggccagggcggcgaggacctggacgtcatccgcaagcgcgcgctcgcctgcggtgccgtcgaggccgaggtcgcggacgcgagggacgagttcgccgaggagtactgcctcccggcgatcaaggccaacgccctctacatggaccgctatccgctggtctcggccctctcccggccgacgatcgtcaagcacctcgtcgccgccgcccgcaagcacggcgccgggaccgtcgcccacggctgcaccggcaagggcaacgaccaggtccgtttcgaggccggcatctccgcgctcggtcccgacctgaagtgcatcgccccggtccgcgactacgcgatgacccgggaccgggcgatcgccttctgcgaggagaagaacctcccgatcgcgaccaccaggaagtccccgtactccatcgaccagaacgtcttcgggcgcgccgtcgagacgggcttcctggaggacatctggaacgccccgatcgaggacatctacgagtacaccgccgaccccgccgtcccgcgcgaggccgacgaggtggtcatctccttcaaggagggcgtgcccgtggccgtcgacggccgtcccgtcaccgtcctccaggcgatccagcagctcaacgagcgggccggcgcccagggcgtcggccggatcgacatggtcgaggaccggctcgtgggcatcaagtcccgcgaggtgtacgaggcgcccggcgccatcgcactgatcaccgcccaccaggagctggagaacgtcaccgtcgagcgcgaactggcccgctacaagcggcaggtcgagcagcggtggggcgagatggtctacgacggcctgtggttctccccgctgaagcgcgccctggacggcttcatcaacgaggccaaccagcacgtcaccggcgacatccggatgaccctgcacgccggccgagccgtcgtcaccggccggaagtccgaggagtcgctgtacgacttcaacctcgcgacctacgactcgggcgacaccttcgaccagtccaaggcgcagggcttcatcgagatcttcggtctctccgccaagatcgccgccaggcgcgacctcgcctga

SEQ ID NO: 73011 - protein, 397 aa, Streptomyces griseus subsp
MTERVVLAYSGGLDTSVAIGWIAEETGAEVIAVAVDVGQGGEDLDVIRKRALACGAVEAEVADARDEFAEEYCLPAIKANALYMDRYPLVSALSRPTIVKHLVAAARKHGAGTVAHGCTGKGNDQVRFEAGISALGPDLKCIAPVRDYAMTRDRAIAFCEEKNLPIATTRKSPYSIDQNVFGRAVETGFLEDIWNAPIEDIYEYTADPAVPREADEVVISFKEGVPVAVDGRPVTVLQAIQQLNERAGAQGVGRIDMVEDRLVGIKSREVYEAPGAIALITAHQELENVTVERELARYKRQVEQRWGEMVYDGLWFSPLKRALDGFINEANQHVTGDIRMTLHAGRAVVTGRKSEESLYDFNLATYDSGDTFDQSKAQGFIEIFGLSAKIAARRDLA

SEQ ID NO: 73012 - DNA, 1248 bp, Pichia pastoris
  CDS (1)..(1248)
atgtctaaaggaaaagtttgtttggcctactccggtggtttggatacctccatcatcctagcttggttgttggagcagggatacgaagtcgttgcctttttagccaacattggtcaagaggaagactttgaggctgctagagagaaagctctgaagatcggtgctaccaagtttatcgtcagtgacgttaggaaggaatttgttgaggaagttttgttcccagcagtccaagttaacgctatctacgagaacgtctacttactgggtacctctttggccagaccagtcattgccaaggcccaaatagaggttgctgaacaagaaggttgttttgctgttgcccacggttgtaccggaaagggtaacgatcaggttagatttgagctttccttttatgctctgaagcctgacgttgtctgtatcgccccatggagagacccagaattcttcgaaagattcgctggtagaaatgacttgctgaattacgctgctgagaaggatattccagttgctcagactaaagccaagccatggtctactgatgagaacatggctcacatctccttcgaggctggtattctagaagatccaaacactactcctccaaaggacatgtggaagctcactgttgacccagaagatgcaccagacaagccagagttctttgacgtccactttgagaagggtaagccagttaaattagttctcgagaacaaaactgaggtcaccgatccggttgagatctttttgactgctaacgccattgctagaagaaacggtgttggtagaattgacattgtcgagaacagattcatcggaatcaagtccagaggttgttatgaaactccaggtttgactctactgagaaccactcacatcgacttggaaggtcttaccgttgaccgtgaagttagatcgatcagagacacttttgttaccccaacctactctaagttgttatacaacgggttgtactttaccccagaaggtgagtacgtcagaactatgattcagccttctcaaaacaccgtcaacggtgttgttagagccaaggcctacaaaggtaatgtgtataacctaggaagatactctgaaaccgagaaattgtacgatgctaccgaatcttccatggatgagttgaccggattccaccctcaagaagctggaggatttatcacaacacaagccatcagaatcaagaagtacggagaaagtgtcagagagaagggaaagtttttgggactttaa

SEQ ID NO: 73013 - protein, 415 aa, Pichia pastoris
MSKGKVCLAYSGGLDTSIILAWLLEQGYEVVAFLANIGQEEDFEAAREKALKIGATKFIVSDVRKEFVEEVLFPAVQVNAIYENVYLLGTSLARPVIAKAQIEVAEQEGCFAVAHGCTGKGNDQVRFELSFYALKPDVVCIAPWRDPEFFERFAGRNDLLNYAAEKDIPVAQTKAKPWSTDENMAHISFEAGILEDPNTTPPKDMWKLTVDPEDAPDKPEFFDVHFEKGKPVKLVLENKTEVTDPVEIFLTANAIARRNGVGRIDIVENRFIGIKSRGCYETPGLTLLRTTHIDLEGLTVDREVRSIRDTFVTPTYSKLLYNGLYFTPEGEYVRTMIQPSQNTVNGVVRAKAYKGNVYNLGRYSETEKLYDATESSMDELTGFHPQEAGGFITTQAIRIKKYGESVREKGKFLGL

SEQ ID NO: 73014 - DNA, 1224 bp, Agrobacterium tumefaciens
  CDS (1)..(1224): transl_table=11
atggcactcccgaaagacgttaagaaagtcgttctcgcctattccggcggcctcgacacctcgatcatcctgaaatggcttcagacggaactcggcgccgaggtcgtgaccttcaccgccgatctcggccagggcgaagagcttgagccggcacgcaagaaggctgagatgctgggcatcaaggaaatctttgtcgaggacgttcgcgaagagttcgtgcgtgatttcgtgtttccgatgttccgcgccaatgccgtttatgaaggcgtctatctgctcggcacgtcgattgcccgtccgctgatttccaagcacctgatcgagatcgccaagaagaccggcgctgacgccatcgcccacggcgccaccggcaagggcaacgaccaggtccgcttcgagctttcggcctatgcgttgaaccctgacatcaagatcattgcgccctggcgcgactggacgttcaagagccgtaccgacctcctgaacttcgccgaacagcaccagatcccggtcgccaaggacaagaagggtgaagcgcctttctccgttgacgccaacctcttgcactcctcctccgagggcaaggtgctggaagacccggcggtggaagcacctgaatatgtgcatatgcgcaccatttccccggaagcggctcccgacaaggcgaccgtcatcaaggtcggtttccgcaagggcgatgcctgctccatcaacggtgttgaaatgtcgcccgcgacgcttcttgccacgctcaacaactacggtcgcgaaaacggcatcggccgcctcgatctggtcgagaaccgtttcgtcggcatgaagtcacgcggcgtttacgagacgcccggcggcacgatcctgctggcagcgcaccgcgccatcgaatccatcacactcgaccggggtgccgcgcatctcaaggacgatctgatgccgcgttacgctgagcttatctattacggcttctggttttcgccggagcgcgaaatgctgcaggccctgatcgacaagagccaggaacatgtcgaaggcgaagtgacgctgaagctctacaagggcaatgtcatggtaaccggccgcgagagcgagaagtcgctgtattccgacgcgctggtgaccttcgaggacgaccacggcgcttacgaccagaaggatgctgctggcttcatcaagctcaatgcgctgcgtcttcgcacgctcgccaagcgtaacctcaacaagtaa

SEQ ID NO: 73015 - protein, 407 aa, Agrobacterium tumefaciens
MALPKDVKKVVLAYSGGLDTSIILKWLQTELGAEVVTFTADLGQGEELEPARKKAEMLGIKEIFVEDVREEFVRDFVFPMFRANAVYEGVYLLGTSIARPLISKHLIEIAKKTGADAIAHGATGKGNDQVRFELSAYALNPDIKIIAPWRDWTFKSRTDLLNFAEQHQIPVAKDKKGEAPFSVDANLLHSSSEGKVLEDPAVEAPEYVHMRTISPEAAPDKATVIKVGFRKGDACSINGVEMSPATLLATLNNYGRENGIGRLDLVENRFVGMKSRGVYETPGGTILLAAHRAIESITLDRGAAHLKDDLMPRYAELIYYGFWFSPEREMLQALIDKSQEHVEGEVTLKLYKGNVMVTGRESEKSLYSDALVTFEDDHGAYDQKDAAGFIKLNALRLRTLAKRNLNK

SEQ ID NO: 73016 - DNA, 1485 bp, Arabidopsis thaliana
  CDS (1)..(1485)
atggctgaaatctcggcgacttcgtttccttcttcttcttcctctgctctcgtcatccgtagctcccacaatggtagcttaaaatgtcagaatgtagctgttccaaaaactacttcccagttccaagagttatctctgaaacgaagccagcttgttggcaatgccgttgttaccggtcatgttaccggatcccgcagctgcaagaatcaagctattcgagctgttctatccggtgatggaaccgccttgactactgattcaaaggaggctggacttcgtggaaaactgaaaaaggtcgttctagcttacagtggaggcttagacacctctgtcattgtgccatggcttaaggagaactatggttgtgaagttgtgtgcttcactgctgatgttggtcagggcataaaagagttagagggtttagaacaaaaggctaaggctagtggtgcttctcagttggtcgttaaggatctcacagaggagtttgtgaaagatttcatcttcccttgtcttagagctggtgccatctatgaacgaaaatacttgcttggtacctccatggctcgacctgtcattgctaaggccatggttgatgtagcagcagaggttggagctgatgccgttgcacatgggtgtactggaaaaggaaatgaccaggttcggtttgagctcaccttcttttcattaaaccctgaacttaaagttgtggcaccatggagagaatgggaaatccaaggccgagaagatgctattgagtatgcaaagaagcataatgttcccgtcccagtgacaaagaagtccatttacagccgggacagaaacctgtggcaccttagtcatgagggtgatctattggaagatccagcaaacgagccaaagaaagatatgtacatgatgagtgtggatcctgaagatgctcctgatcagcctgaatacatcgagatcgggatagaatctggacttccagtggcgctgaacgggaaggctctgagtccagccacacttctggccgagctaaacacaataggaggaaagcacgggattgggcggattgacatggttgagaaccgtctggttgggatgaaatcacgaggtgtgtatgaaactcctggaggcactatcctctttgcagctgtacaggaactagaatccctcactctagacagagagagtattcaggtaaaagacacattagcactgaaatatgcagagatggtctacgcaggaagatggtttgatccgcttagggagtccatggacgctttcatggagaagataaccgagacaaccacgggatctgtgacactgaagctgtacaaaggatctgtgtcggttacagggcgtcagagtcctaacagtctgtatagacaggacatatcttcgtttgaagggagtgagatctacaaccaagcggatgcagccgggtttattcgtctttacgggcttccaatgaaaattagagctatgcttaagaaaattagctag

SEQ ID NO: 73017 - protein, 494 aa, Arabidopsis thaliana
MAEISATSFPSSSSSALVIRSSHNGSLKCQNVAVPKTTSQFQELSLKRSQLVGNAVVTGHVTGSRSCKNQAIRAVLSGDGTALTTDSKEAGLRGKLKKVVLAYSGGLDTSVIVPWLKENYGCEVVCFTADVGQGIKELEGLEQKAKASGASQLVVKDLTEEFVKDFIFPCLRAGAIYERKYLLGTSMARPVIAKAMVDVAAEVGADAVAHGCTGKGNDQVRFELTFFSLNPELKVVAPWREWEIQGREDAIEYAKKHNVPVPVTKKSIYSRDRNLWHLSHEGDLLEDPANEPKKDMYMMSVDPEDAPDQPEYIEIGIESGLPVALNGKALSPATLLAELNTIGGKHGIGRIDMVENRLVGMKSRGVYETPGGTILFAAVQELESLTLDRESIQVKDTLALKYAEMVYAGRWFDPLRESMDAFMEKITETTTGSVTLKLYKGSVSVTGRQSPNSLYRQDISSFEGSEIYNQADAAGFIRLYGLPMKIRAMLKKIS

SEQ ID NO: 73018 - DNA, 1230 bp, Azoarcus sp
  CDS (1)..(1230): transl_table=11
atgagcgacgtcaagaaagcggtgcttgcctattcgggcgggctggatacctcggtcatcctgaagtggctgcaggatacctatcagtgcgaagtggtgacgttcacggccgacctcggccagggcgaagagctcgagcccgcgcgccagaaagcgctgaagttcggcatcaagcccgacaacatcttcatcgacgacctgcgcgaagagttcgtgcgcgacttcgtcttcccgatgttccgctgcaacacggtttatgagggcgaatacctgctcggcacgtcgatcgcccgtccgctgatcgccaagcgccagatcgagatcgcgcgcgcgaccggcgctgacgcggtgtcgcacggcgcaaccggcaagggcaacgaccaggtccgcttcgaactcggctattacgcgctgatgccgggcgtgaaagtcatcgcgccgtggcgcgaatgggaccttttgtcgcgcgagaagctgctcgcgtacgccgagaagcacggcatcccgatcgagatgaagcacaagcagggcggctcgccgtattcgatggacgcgaacctgctgcacatctcgttcgaaggccgccacctcgagaacccggctgcggaagccgaggagtcgatgtggcgctggaccgtgtcaccggaagcggcgcccgacgcggccgagtacctcgacctcgaattcgagcgcggcgacctcgtcgcgatcaacggcacgcgcatgaaggcgcacgagctgctcgcgaagctcaacgagctcggcggcaagcatggcatcggccgcctcgacctcgtcgaaaaccgctatgtcggcatgaagagccgcggctgctacgaaaccccgggcggcacgatcctgctgcgtgcccaccgcgcgatcgaatccgtgacgctcgaccgcgaagtcgcgcacctcaaggacgacctgatgccgcgctacgccagcctgatctacaacggctactggtggagcccggagcgtcgcgcgctgcaggcgctgatcgacaacacgcaggaatcggtcaacggttgggtgcgcgtcaagctctacaagggcaacgtcatcgtcaccggccgcgactcgaagaccgattcgctgttcgacccgacgatcgcgacgttcgaggacgaccagggcgcctacaaccagaaggacgcgcacggcttcatccgcctcaacgcgctgcgcatgcgcatcgcggcgaacgcgcagacgaagcgcggctaa

SEQ ID NO: 73019 - protein, 409 aa, Azoarcus sp
MSDVKKAVLAYSGGLDTSVILKWLQDTYQCEVVTFTADLGQGEELEPARQKALKFGIKPDNIFIDDLREEFVRDFVFPMFRCNTVYEGEYLLGTSIARPLIAKRQIEIARATGADAVSHGATGKGNDQVRFELGYYALMPGVKVIAPWREWDLLSREKLLAYAEKHGIPIEMKHKQGGSPYSMDANLLHISFEGRHLENPAAEAEESMWRWTVSPEAAPDAAEYLDLEFERGDLVAINGTRMKAHELLAKLNELGGKHGIGRLDLVENRYVGMKSRGCYETPGGTILLRAHRAIESVTLDREVAHLKDDLMPRYASLIYNGYWWSPERRALQALIDNTQESVNGWVRVKLYKGNVIVTGRDSKTDSLFDPTIATFEDDQGAYNQKDAHGFIRLNALRMRIAANAQTKRG

SEQ ID NO: 73020 - DNA, 1206 bp, Bacillus anthracis
  CDS (1)..(1206): transl_table=11
atggagaagaaaaaagttgtattagcatattccggaggtcttgatacttccgttgcaattaaatggttacaagagaagaattatgatattatcgcgctttgtttagacttaggggaaggtaaagacttagcatttgtaaaagaaaaggcactttcagtaggtgcaattaaatcatatatgattgatgttcaagaagaatttgcaaacgaatatgcattgatggcgatgcaagcacacacgttatacgaagggaaatatcctctcgtttcggcgttatctcgtccacttatcgcaaagaaattagtagaaattgcagaacaagaaggagcgactgcagttgcacacggatgtacagggaaagggaatgatcaagttcgttttgaagtttctattcaagcattaaatccttacttagaagtaattgcacctgtacgtgaatggaaatggtcacgtgaagaagaaattgcctatgcaaaagaaaataatgtaccgattccaattaatttagatagcccgttttcaatcgatcaaaatttatggggacgcagcaatgaatgcggcattttagaagatccatgggcagcgccgccagaagatgcatatgagatgacattggcattagaagacacaccgaataaaccagaatttgtagaaattggctttgaagcaggcgtaccgactactttaaatggcactgcatatccactttcagaacttattaaaacgttaaatgcacttgctggaaaacatggcgttggacgtatcgatcacgtagaaaatcgtcttgttggtattaaatcacgtgaagtatacgaatgcccagcagcaatgacattaattacggcgcataaagaacttgaagatttaacacttgtaaaagaagtagcacattttaaaccgatgattgagcaaaaaataacagagcttatttataacggtttatggttctcgcctttaaaacaagcgcttcatgctttcttacaagaaacgcaaaagaatgtaacaggcacggtgcgtgtgaaattatttaaaggtcatgcaattgtagaagggcgtaaatctgagtactctttatacgatgaaaaattagcaacgtatactgctcaggatgaatttaatcatgatgcagcagttggattcatttcattattcggtttaccgacgaaagtatatagccaagtgaatcaaaagaaggtggaagcgtga

SEQ ID NO: 73021 - protein, 401 aa, Bacillus anthracis
MEKKKVVLAYSGGLDTSVAIKWLQEKNYDIIALCLDLGEGKDLAFVKEKALSVGAIKSYMIDVQEEFANEYALMAMQAHTLYEGKYPLVSALSRPLIAKKLVEIAEQEGATAVAHGCTGKGNDQVRFEVSIQALNPYLEVIAPVREWKWSREEEIAYAKENNVPIPINLDSPFSIDQNLWGRSNECGILEDPWAAPPEDAYEMTLALEDTPNKPEFVEIGFEAGVPTTLNGTAYPLSELIKTLNALAGKHGVGRIDHVENRLVGIKSREVYECPAAMTLITAHKELEDLTLVKEVAHFKPMIEQKITELIYNGLWFSPLKQALHAFLQETQKNVTGTVRVKLFKGHAIVEGRKSEYSLYDEKLATYTAQDEFNHDAAVGFISLFGLPTKVYSQVNQKKVEA

SEQ ID NO: 73022 - DNA, 1206 bp, Bacillus thuringiensis subsp
  CDS (1)..(1206): transl_table=11
atggataagaaaaaagttgtattagcatattccggaggtcttgatacttccgttgcaattaaatggttacaagagaagaattatgatattatcgcgctttgtttagacttaggggaaggtaaagacttagcatttgtaaaagaaaaggcactttcagtaggtgcaattaaatcatatatgattgatgttcaagaagaatttgcaaacgaatatgcattgatggcgatgcaagcacacacgttatacgaagggaaatatcctctcgtttcggcgttatctcgtccacttatcgcaaagaaattagtagaaattgcagaacaagaaggagcgactgcagttgcacacggatgtacagggaaagggaatgatcaagttcgttttgaagtttctattcaagcattaaatccttacttagaagtaattgcacctgtacgtgaatggaaatggtcacgtgaagaagaaattgcctatgcaaaagaaaataatgtaccgattccaattaatttagatagcccgttttcaatcgatcaaaatttatggggacgcagcaatgaatgtggcattttagaagatccatgggcagcgccgccagaagatgcatatgagatgacattggcattagaagacacaccgaataaaccagaatttgtagaaattggctttgaagcaggcgtaccgactactttaaatggcactgcatatccactttcagaacttattaaaacgttaaatgcacttgcaggaaaacatggcgttggacgtatcgatcacgtagaaaatcgtcttgttggtattaaatcacgtgaagtatacgaatgcccagcagcaatgacattaattacggcgcataaagaacttgaagatttaacacttgtaaaagaagtagcacactttaaaccgatgattgagcaaaaaataacagagcttatttataacggtttatggttctcgcctttaaaacaagcgcttcatgctttcttacaagaaacgcaaaagaatgtaacaggcatggtgcgtgtgaaattatttaaaggtcatgcaattgtagaagggcgtaaatctgagtactctttatacgatgaaaaattagcaacatatactgctcaggatgaatttaatcatgatgcagcagttgggttcatttcattattcggtttaccgacgaaagtatacagccaagtgaatcaaaagaaggtggaagcgtga

SEQ ID NO: 73023 - protein, 401 aa, Bacillus thuringiensis subsp
MDKKKVVLAYSGGLDTSVAIKWLQEKNYDIIALCLDLGEGKDLAFVKEKALSVGAIKSYMIDVQEEFANEYALMAMQAHTLYEGKYPLVSALSRPLIAKKLVEIAEQEGATAVAHGCTGKGNDQVRFEVSIQALNPYLEVIAPVREWKWSREEEIAYAKENNVPIPINLDSPFSIDQNLWGRSNECGILEDPWAAPPEDAYEMTLALEDTPNKPEFVEIGFEAGVPTTLNGTAYPLSELIKTLNALAGKHGVGRIDHVENRLVGIKSREVYECPAAMTLITAHKELEDLTLVKEVAHFKPMIEQKITELIYNGLWFSPLKQALHAFLQETQKNVTGMVRVKLFKGHAIVEGRKSEYSLYDEKLATYTAQDEFNHDAAVGFISLFGLPTKVYSQVNQKKVEA

SEQ ID NO: 73024 - DNA, 1212 bp, Bacillus subtilis
  CDS (1)..(1212): transl_table=11
atgtcagaacagaaaaaagtcgtattagcatactcaggaggtcttgatacttccgtcgcaataaaatggcttcaggagcaaggatataatgtaatcgcctgctgcctggatgtcggtgagggcaaagatttggcatttgttcagcagaaagcgcttgaagtcggcgcgacaaactcctacgtgatcgatgcaaaagaagaatttgcacaggattacgcgcttatctctttgcaggcccacacaatgtatgaaggaaaatacccgcttgtttcggcattatctcgaccgctgatcgcgaaaaaactggttgaaattgcggaaaaagaagatgcacaggcgattgcccacggatgcacagggaaaggaaatgaccaggttcgtttcgaagtctccattaaatcattaaaccctgacctagaagtcatcgcgccggttcgcgaatggcagtggtcacgtgaagaagaaattgaatatgcggctagccgcggcattccgattccgatcaatcttgacagcccgtattctatcgaccaaaacctctggggacgcgccaatgagtgcggcattttagaagatccatgggcggcgccgccagaaggtgcatacgatttaacagctccgctggaaaaaacgccggacacgccggaagtgattgaaattgcatttgaacagggcgtgcctgtctccattgacggtgtttcctactcgctttctgagctgatcttgaagctgaatgaaatggcgggcgcgcacggtgtcggacgtatcgaccacgtggaaaaccgcctcgtcggcattaaatcccgggaagtatacgaatgccctggtgcgatgacactgatcaaagcgcataaagaattagaagatttgacactggtgaaagaggtagcccactttaaaccgatcatcgagcaaaaaatgtcagaaatcatttacaacggcttatggttctcaccgttaaaagacgcgctgcacgctttcttaaaagaaacgcaaaagcatgtcacaggcattgtccgcgtgaagctgtttaaaggccatgcaattgtagaaggacgtaaatcggaatactctctatatgatgaaaaacttgcaacatatacaaaagacgatgcatttgatcaccatgcagcaatcggatttatcgagctttggggacttccgacaaaagtgaacagcatcgtgaaaaagaaggagcagattaaagcatga

SEQ ID NO: 73025 - protein, 403 aa, Bacillus subtilis
MSEQKKVVLAYSGGLDTSVAIKWLQEQGYNVIACCLDVGEGKDLAFVQQKALEVGATNSYVIDAKEEFAQDYALISLQAHTMYEGKYPLVSALSRPLIAKKLVEIAEKEDAQAIAHGCTGKGNDQVRFEVSIKSLNPDLEVIAPVREWQWSREEEIEYAASRGIPIPINLDSPYSIDQNLWGRANECGILEDPWAAPPEGAYDLTAPLEKTPDTPEVIEIAFEQGVPVSIDGVSYSLSELILKLNEMAGAHGVGRIDHVENRLVGIKSREVYECPGAMTLIKAHKELEDLTLVKEVAHFKPIIEQKMSEIIYNGLWFSPLKDALHAFLKETQKHVTGIVRVKLFKGHAIVEGRKSEYSLYDEKLATYTKDDAFDHHAAIGFIELWGLPTKVNSIVKKKEQIKA

SEQ ID NO: 73026 - DNA, 1221 bp, Brucella melitensis
  CDS (1)..(1221): transl_table=11
atgagcaagtggaaagacgttaagaaagtcgttctcgcctattcgggcggcctcgacacctcgatcatcctgaagtggcttcagacggaactgggcgcggaagtcgtgacctttaccgctgatctcggccagggcgaggaacttgaaccggcccgcaagaaagcggaaatgctgggcatcaaggaaatcttcattgaggacgtgcgcgaagaattcgtgcgcgatttcgtcttcccgatgttccgcgccaatgccgtctatgaaggcgtctatctgctcggcacatcgattgcccgcccactgatctccaagcatctgatcgacatcgccaaaaaaaccggcgccgacgccatcgcccatggcgcgaccggcaagggcaacgaccaggttcgcttcgagctttcggcctatgcgctgaacccggacatcaagatcatcgctccatggcgcgactggtcgttcaagagccgcacgcagcttctcgaatttgccgaacagcaccagattccggttgccaaggacaaaaagggcgaagcaccgttctccgtcgatgccaacctgctgcactcctcgtcggagggcaaggttctggaagacccatcgcaggaagcgccggaatatgtgcatatgcgcactatttcgccggaaaccgcgcccgacaaggcaacgatcatcaagatcggctttgaaaagggcgatgccgtttcaatcaatggcgagcgcctgtcgccagcgacccttcttgccaagctcaacgactatggccgcgacaatggcattggccgtctcgacctcgtggaaaaccgcttcgtcggcatgaagtcgcgcggcgtctacgaaacgccgggcggtacgatcctgcttgcagcgcaccgcgccattgaatcgatcacgctcgaccgtggtgcggcgcacctgaaagacgagctgatgccgcgctatgcggaactgatctattatggcttctggttctcgccggaacgcgaaatgctgcaagcggccatcgatcacagccagcgccatgtcgaaggcgaagtcacgctcaagctctacaagggcaatgtgatggtgatcggtcgcgaatcggccaagtcgctctattccgacaagctcgtgacctttgaagacgatcagggcgcctacgaccagaaggatgcggcaggcttcatcaagctcaatgcgctgcgtctgcgcacactggctgcacgcgaccgcaaataa

SEQ ID NO: 73027 - protein, 406 aa, Brucella melitensis
MSKWKDVKKVVLAYSGGLDTSIILKWLQTELGAEVVTFTADLGQGEELEPARKKAEMLGIKEIFIEDVREEFVRDFVFPMFRANAVYEGVYLLGTSIARPLISKHLIDIAKKTGADAIAHGATGKGNDQVRFELSAYALNPDIKIIAPWRDWSFKSRTQLLEFAEQHQIPVAKDKKGEAPFSVDANLLHSSSEGKVLEDPSQEAPEYVHMRTISPETAPDKATIIKIGFEKGDAVSINGERLSPATLLAKLNDYGRDNGIGRLDLVENRFVGMKSRGVYETPGGTILLAAHRAIESITLDRGAAHLKDELMPRYAELIYYGFWFSPEREMLQAAIDHSQRHVEGEVTLKLYKGNVMVIGRESAKSLYSDKLVTFEDDQGAYDQKDAAGFIKLNALRLRTLAARDRK

SEQ ID NO: 73028 - DNA, 1221 bp, Brucella suis
  CDS (1)..(1221): transl_table=11
atgagcaagtggaaagacgttaagaaagtcgttctcgcctattcgggcggcctcgacacctcgatcatcctgaagtggcttcagacggaactgggcgcggaagtcgtgacctttaccgctgatctcggccagggcgaggaacttgaaccggcccgcaagaaagcggaaatgctgggcatcaaggaaatcttcattgaggacgtgcgcgaagaattcgtgcgcgatttcgtcttcccgatgttccgcgccaatgccgtctatgaaggcgtctatctgctcggcacatcgattgcccgcccactgatctccaagcatctgatcgacatcgccaaaaaaaccggcgccgacgccatcgcccatggcgcgaccggcaagggcaacgaccaggttcgcttcgagctttcggcctatgcgctgaacccggacatcaagatcatcgctccatggcgcgactggtcgttcaagagccgcacgcagcttctcgaatttgccgaacagcaccagattccggttgccaaggacaaaaagggcgaagcaccgttctccgtcgatgccaacctgctgcactcctcgtcggagggcaaggttctggaagacccatcgcaggaagcgccggaatatgtgcatatgcgcactatttcgccggaaaccgcgcccgacaaggcaacgatcatcaagatcggctttgaaaagggcgatgccgtttcaatcaatggcgagcgcctgtcgccagcgacccttcttgccaagctcaacgactatggccgcgacaatggcattggccgtctcgacctcgtggaaaaccgcttcgtcggcatgaagtcgcgcggcgtctacgaaacgccgggcggtacgatcctgcttgcagcgcaccgcgccattgaatcgatcacgctcgaccgtggtgcggcgcacctgaaagacgagctgatgccgcgctatgcggaactgatctattatggcttctggttctcgccggaacgcgaaatgctgcaagcggccatcgatcacagccagcaccatgtcgaaggcgaagtcacgctcaagctctacaagggcaatgtgatggtgatcggtcgcgaatcggccaagtcgctctattccgacaagctcgtgacctttgaagacgatcagggcgcctacgaccagaaggatgcggcaggcttcatcaagctcaatgcgctgcgtctgcgcacactggctgcacgcgaccgcaaataa

SEQ ID NO: 73029 - protein, 406 aa, Brucella suis
MSKWKDVKKVVLAYSGGLDTSIILKWLQTELGAEVVTFTADLGQGEELEPARKKAEMLGIKEIFIEDVREEFVRDFVFPMFRANAVYEGVYLLGTSIARPLISKHLIDIAKKTGADAIAHGATGKGNDQVRFELSAYALNPDIKIIAPWRDWSFKSRTQLLEFAEQHQIPVAKDKKGEAPFSVDANLLHSSSEGKVLEDPSQEAPEYVHMRTISPETAPDKATIIKIGFEKGDAVSINGERLSPATLLAKLNDYGRDNGIGRLDLVENRFVGMKSRGVYETPGGTILLAAHRAIESITLDRGAAHLKDELMPRYAELIYYGFWFSPEREMLQAAIDHSQHHVEGEVTLKLYKGNVMVIGRESAKSLYSDKLVTFEDDQGAYDQKDAAGFIKLNALRLRTLAARDRK

SEQ ID NO: 73030 - DNA, 1221 bp, Campylobacter jejuni
  CDS (1)..(1221): transl_table=11
atgaaaaatgaagtaaaaaaagtagttttagcgtattctggagggcttgatacgagcattattttaaaatggcttcaagatgagtataattgtgaagttgtaacttttacagcagatattggtcaaggcgaagaactcgaacctgcgagaaaaaaagccctttctttaggcataaaagaagaaaatattttcattaaagatttaagagatgaatttgttaaagattatgtatttcctatgtttagagccaatgcaatttatgaaggagagtatcttttaggaacaagtatagcaagaccactcatagcaaaaactcaagcacaaattgccctgcaaacaggtgctgatgcggtaagtcatggcgccacaggcaaaggaaatgatcaagtgcgttttgaacttggttatcttgcttttagtcccgatttaaaaatcatcgctccatggcgtgagtgggatttaaacagtcgtgaaaaactccttgcttatgcgcaaaaacatggcattgatatttctaagaaaaaaggaaaatccccttattctatggacgcaaatttacttcatatttcttacgaaggacttgttttagaagatcctgcacacgcacctgaagaagatatgtggagatggagtaaaagcccaaaagacgctccaaatgaaagtgaaattatagaacttgatttccaaaaaggagatttagtagcgataaatggagaaaaactaagtcctgcaggacttttaaccaaacttaacgaactaggctgcaaacacggtataggacgccttgatatagtagaaaatcgctatgtaggcatgaaaagccgtggttgttacgaaactccaggcggtactatacttttaaaagcacatagagcgcttgaaagcatcacgcttgatagagaagcagcacacttaaaagatgaactcatgccaaaatacgcgagtttaatttataatggctattggttctcgcctgaaagaatgatgcttcaagccttaatcgatgagtctcaaattcacgccaatggcagagtaaagctcgagctttataaaggcaatgtgatggttataggacgcgaaagtgcgaacgatagcttgtttaacgcagcttattgtacttttgaagaagatgaagtgtataatcaaaaagacgcagcaggctttatcaagcttaatgctttgcgttttatcatcgcaggaaaaaatggaagaaaattttaa

SEQ ID NO: 73031 - protein, 406 aa, Campylobacter jejuni
MKNEVKKVVLAYSGGLDTSIILKWLQDEYNCEVVTFTADIGQGEELEPARKKALSLGIKEENIFIKDLRDEFVKDYVFPMFRANAIYEGEYLLGTSIARPLIAKTQAQIALQTGADAVSHGATGKGNDQVRFELGYLAFSPDLKIIAPWREWDLNSREKLLAYAQKHGIDISKKKGKSPYSMDANLLHISYEGLVLEDPAHAPEEDMWRWSKSPKDAPNESEIIELDFQKGDLVAINGEKLSPAGLLTKLNELGCKHGIGRLDIVENRYVGMKSRGCYETPGGTILLKAHRALESITLDREAAHLKDELMPKYASLIYNGYWFSPERMMLQALIDESQIHANGRVKLELYKGNVMVIGRESANDSLFNAAYCTFEEDEVYNQKDAAGFIKLNALRFIIAGKNGRKF

SEQ ID NO: 73032 - DNA, 1221 bp, Campylobacter jejuni
  CDS (1)..(1221): transl_table=11
atgaaaaatgaagtaaaaaaagtagttttagcgtattctggggggcttgatacgagcattattttaaaatggcttcaagatgagtataattgtgaagttgtaacttttacagcagatattggtcaaggtgaagaactcgaacctgcaagaaaaaaagccctttctttaggcataaaagaagaaaatattttcattaaagatttaagagatgaatttgttaaagattatgtatttcctatgtttagagccaatgcgatttatgaaggagaatatcttttaggaacaagtatagcaagaccacttatagcaaaaactcaagcacaaatcgccctgcaaacaggtgctgatgcagtaagtcatggtgccacaggtaaaggaaatgatcaagtgcgttttgaacttggttatcttgcttttaatcccgatttaaaaatcatcgctccatggcgtgagtgggatttaaacagtcgtgaaaaactccttgcttatgcacaaaaacacggtattgatatttctaagaaaaaaggaaaatctccttattctatggacgcaaatttacttcatatttcttacgaaggacttgtcttagaagatcctgcacacgcacctgaagaagatatgtggagatggagtaaaagcccaaaagatgctccaaatgaaagtgaaattatagaacttgatttccaaaaaggagatttagtagcgataaatggagaaaaactaagtcctgcaggacttttaaccaaacttaacgaactaggctgcaaacacggtataggacgccttgatatagtagaaaatcgctatgtaggtatgaaaagccgtggttgttacgaaacaccaggtggtaccatacttttaaaagcacacagagcgcttgaaagcatcacgcttgatagagaagcagcacacttaaaagatgaactcatgccaaaatacgcgagtttaatttataatggctattggttctcgcctgaaagaatgatgcttcaagccttaatcgatgagtctcaaattcacgccaatggcagagtaaaactcgagctttataaaggcaatgtgatagttataggacgcgaaagttcgaacgatagcttgtttaacgcagcttattgtacttttgaagaagatgaagtgtataatcaaaaagacgcagcaggctttatcaagcttaatgctttgcgttttatcatcgcaggaaaaaatggaagaaaattttaa

SEQ ID NO: 73033 - protein, 406 aa, Campylobacter jejuni
MKNEVKKVVLAYSGGLDTSIILKWLQDEYNCEVVTFTADIGQGEELEPARKKALSLGIKEENIFIKDLRDEFVKDYVFPMFRANAIYEGEYLLGTSIARPLIAKTQAQIALQTGADAVSHGATGKGNDQVRFELGYLAFNPDLKIIAPWREWDLNSREKLLAYAQKHGIDISKKKGKSPYSMDANLLHISYEGLVLEDPAHAPEEDMWRWSKSPKDAPNESEIIELDFQKGDLVAINGEKLSPAGLLTKLNELGCKHGIGRLDIVENRYVGMKSRGCYETPGGTILLKAHRALESITLDREAAHLKDELMPKYASLIYNGYWFSPERMMLQALIDESQIHANGRVKLELYKGNVIVIGRESSNDSLFNAAYCTFEEDEVYNQKDAAGFIKLNALRFIIAGKNGRKF

SEQ ID NO: 73034 - DNA, 1227 bp, Caulobacter crescentus
  CDS (1)..(1227): transl_table=11
atggccgacaagtccgtgaagaaggtcgtgctcgcctattcgggcggtctcgacacctcgatcatcctcaagtggctgcagaccgaatacggcgctgaggtcatcaccttcacggccgacctcggccaaggcgaagagatcgagccggcccgcgccaaggccctggccgccggcgtcaagcccgagaacatcttcatcgaggacgtccgcgaagagttcgtgcgcgactacgtcttcccgatgttccgcgccaacacggtctatgagggccagtacctcctgggcacatcgatcgcccgtccgctgatcgccaagaagcagatcgagatcgcccgcaagatgggcgcagacgccgtcagccacggcgcgaccggcaagggcaacgaccaggtccgcttcgagctcggctattatggcctcgagcccgacatcaccgtgatcgccccctggcgcgagtgggacttcaagtcccgcgaggccctgctggacttcgccgagaagcaccagatccagatcaccaaggacaaacgcggcgaagcgccgttcagcgtcgacgccaacctgctgcactcctcgtccgagggtaaggtcctggaggacccggcggtcgaggctcccgagttcgtccacatgcgcaccattgcgccggaagacgcgccggacgcgccgaccatcatcaccatcgacttcgaaaagggtgacccggtcgccatcgacggcgtggcgatgagcccggccaccctgctgaccaagctgaacgaactgggccgcgacaacggcgtcggccgtctggacctcgtggaaaaccgcttcgtcggcatgaagtcgcgcggcgtctacgagacccccggcggcaccatcctgctggccgcccaccgcggcatcgagagcatcacgctggaccggggcgccatgcacctgaaggacgagctgatgccgaagtatgcttcgctcgtctataacggcttctggttctcgcccgagcgcgagatgctgcaggccgctatcgactacagccaggacaaggtcaccggccgcgtccgcgtgaagctgtacaagggcaatgtcacggtcatcggccgcgagagcccctactcgctgtatgaccaggacttggtgaccttcgaagaaggcaaggtcgcctacgaccaccgcgacgccggcggcttcatcaagctcaacgccctgcgcctgcgggtcctggccaagcgcgacaagcgcggctag

SEQ ID NO: 73035 - protein, 408 aa, Caulobacter crescentus
MADKSVKKVVLAYSGGLDTSIILKWLQTEYGAEVITFTADLGQGEEIEPARAKALAAGVKPENIFIEDVREEFVRDYVFPMFRANTVYEGQYLLGTSIARPLIAKKQIEIARKMGADAVSHGATGKGNDQVRFELGYYGLEPDITVIAPWREWDFKSREALLDFAEKHQIQITKDKRGEAPFSVDANLLHSSSEGKVLEDPAVEAPEFVHMRTIAPEDAPDAPTIITIDFEKGDPVAIDGVAMSPATLLTKLNELGRDNGVGRLDLVENRFVGMKSRGVYETPGGTILLAAHRGIESITLDRGAMHLKDELMPKYASLVYNGFWFSPEREMLQAAIDYSQDKVTGRVRVKLYKGNVTVIGRESPYSLYDQDLVTFEEGKVAYDHRDAGGFIKLNALRLRVLAKRDKRG

SEQ ID NO: 73036 - DNA, 1206 bp, Chlorobium tepidum
  CDS (1)..(1206): transl_table=11
atgagcaaggaaaaaattgcggtcgcctactccggcggccttgacacgtcagtcatgatcaaatggctgaaggacaagtatgaaggggcggaaatcgttgccgtcacgggcaacctcggccagaagatggaggtcgacaacctcgaacagaaagccatagccaccggcgcaaagtcgttccacttcgtcgatctgcgcaaaaccttcgtcgaagagtacatctggaaagcactaaaagctggcgcgttgtacgaggatgtgtacccactggccactgcgctcggacgcccgctgctcgccaaggcgctcgtcgatgtggcgctcgccgaagggtgcaccatgctcacccacggctgcaccggtaagggcaacgaccaggtgcgcttcgaggtcgccttcgccgcgctcgccccgcatatgaaggtggtcgccccgctgcgcgagtgggagttcacctcacgcgagcaggagatcgcctacgcgatggagcacaacatcccggtttcggcgaccaagaaaaatccctactcgatcgacgagaacatctggggcatcagcatcgagtgcggcgtgctcgaagatccgatggtcgctcccccggctgacgcctaccagatcactacggctcccgaacttgcacccgacgagccgaccgttgtcgatatcgagtttgcccagggggtgcccgtggcgctcgacggccagcagatggagggtctcgacctcatcgtcagactcaacgaactcggcgcgatgaacggcgtcggcaggctcgacatgatcgagaaccgtgtcgtcggcatcaagtctcgcgaaatctacgaagccccggcagccaccatcctgcacttcgcccaccgcgagctcgaacgcctcacgctcgaaaagtcggtcttccagtacaagcgcaatatcggccaggactacgccaacctcatctacaacggcacctggttctcgccaatgcgcaaagcgctcgacgcctttgtggacgagacgcagaagccggtcaccggcatggtcagaatcaagctctacaaaggctcgatgaccctgctcggccgcacctcgcccaactcgctctacaacgaagcgctggccacctataccgaagccgataccttcgaccacaaatctgccgaaggtttcatcaaaatctacggattgggcctgaagactttccacgaggtaaacaagagcgagtga

SEQ ID NO: 73037 - protein, 401 aa, Chlorobium tepidum
MSKEKIAVAYSGGLDTSVMIKWLKDKYEGAEIVAVTGNLGQKMEVDNLEQKAIATGAKSFHFVDLRKTFVEEYIWKALKAGALYEDVYPLATALGRPLLAKALVDVALAEGCTMLTHGCTGKGNDQVRFEVAFAALAPHMKVVAPLREWEFTSREQEIAYAMEHNIPVSATKKNPYSIDENIWGISIECGVLEDPMVAPPADAYQITTAPELAPDEPTVVDIEFAQGVPVALDGQQMEGLDLIVRLNELGAMNGVGRLDMIENRVVGIKSREIYEAPAATILHFAHRELERLTLEKSVFQYKRNIGQDYANLIYNGTWFSPMRKALDAFVDETQKPVTGMVRIKLYKGSMTLLGRTSPNSLYNEALATYTEADTFDHKSAEGFIKIYGLGLKTFHEVNKSE

SEQ ID NO: 73038 - DNA, 1227 bp, Chromobacterium violaceum
  CDS (1)..(1227): transl_table=11
atgtctgacatcaagaaagtggttttggcgtattccggcggtctggatacctcggtgatcctgaagtggctgcaagacgagtatcaatgcgaagtggtgaccttcaccgccgacatcggccagggcgaggaagtggagccggcgcggcagaaagcggtttcgctgggcatcaagccggaaaacatcttcatcgaggacctgcgcgaggagttcgtccgcgatttcgtctacccgatgttccgcgccaacactatttacgaaggcgaatacctgctgggcacctcgatcgcccggccgctgatcgccaagcgtcagatcgagatcgccaaccaggttggcgccgacgcggtatcgcacggcgccaccggcaagggcaacgaccaggtgcgcttcgagctcggttattacgcgctgaagccggatgtgaaagtgatcgcgccgtggcgcgagtgggacctgctgtcgcgcgagaagctgctggcctacgccgaaacccacggcatcgacatcagcaagaagaagaacggcggcagtccgtactcgatggacgccaatctgctgcacatttcctacgaaggcacggtgctggaagatccggcccaggagccggaagaggatatgtggctgtggagcgtgagtccggagaacgcgccggaccaggccgagtacgtggagctggaataccgcaagggcgacatcgtcgccgtcaacggccaagcgctgagcccggccggcgtgctgaccgagctgaaccgcctgggcaacaagcacggcatcggccgcttggacatcgtcgagaaccgctacgtgggcatgaagtcgcgcggctgctatgaaaccccgggcggcaccatcatgctgaaggcgcaccgcgcgatcgagtccatcacgctggaccgcgaagtggcccacctgaaggacgagctgatgccgaaatacgcgcagctgatctacaccggttactggtggagcccggagcgcgcgatgctgcagcagatgatagacgcgtcgcaggccacggtgaacggctgggtgcggctgaagctgtacaagggcaatgtgatcgtcgtcggccgcgaatccaagaccgattcgctgttcgacccgaccatcgccaccttcgacgaggacggcggcgcctacaaccatgccgacgcggccggcttcatccgcctgaacgcgctgcggatgcgcatcgctgccaatgcgcggaacaagcgcggctga

SEQ ID NO: 73039 - protein, 408 aa, Chromobacterium violaceum
MSDIKKVVLAYSGGLDTSVILKWLQDEYQCEVVTFTADIGQGEEVEPARQKAVSLGIKPENIFIEDLREEFVRDFVYPMFRANTIYEGEYLLGTSIARPLIAKRQIEIANQVGADAVSHGATGKGNDQVRFELGYYALKPDVKVIAPWREWDLLSREKLLAYAETHGIDISKKKNGGSPYSMDANLLHISYEGTVLEDPAQEPEEDMWLWSVSPENAPDQAEYVELEYRKGDIVAVNGQALSPAGVLTELNRLGNKHGIGRLDIVENRYVGMKSRGCYETPGGTIMLKAHRAIESITLDREVAHLKDELMPKYAQLIYTGYWWSPERAMLQQMIDASQATVNGWVRLKLYKGNVIVVGRESKTDSLFDPTIATFDEDGGAYNHADAAGFIRLNALRMRIAANARNKRG

SEQ ID NO: 73040 - DNA, 1206 bp, Corynebacterium glutamicum
  CDS (1)..(1206): transl_table=11
atgactaaccgcatcgttcttgcatactccggcggtctggacaccactgtggcaattccatacctgaagaagatgattgatggtgaagtcatcgcagtttccctcgacctgggccagggtggagagaacatggacaacgttcgccagcgtgcattggatgccggtgcagctgagtccatcgttgttgatgcaaaggatgagttcgctgaggagtactgcctgccaaccatcaaggcaaacggcatgtacatgaagcagtacccactggtttctgcaatctcccgcccactgatcgtcaagcacctcgttgaggctggcaagcagttcaacggtacccacgttgcacacggctgcactggtaagggcaacgaccaggttcgtttcgaggtcggcttcatggacaccgatccaaacctggagatcattgcacctgctcgtgacttcgcatggacccgcgacaaggctatcgccttcgccgaggagaacaacgttccaatcgagcagtccgtgaagtccccattctccatcgaccagaacgtctggggccgcgctattgagaccggttacctggaagatctgtggaatgctccaaccaaggacatctacgcatacaccgaggatccagctctgggtaacgctccagatgaggtcatcatctccttcgagggtggcaagccagtctccatcgatggccgtccagtctccgtactgcaggctattgaagagctgaaccgtcgtgcaggcgcacagggcgttggccgccttgacatggttgaggaccgtctcgtgggcatcaagtcccgcgaaatctacgaagcaccaggcgcaatcgcactgattaaggctcacgaggctttggaagatgtcaccatcgagcgcgaactggctcgctacaagcgcggcgttgacgcacgttgggctgaggaagtatacgacggcctgtggttcggacctctgaagcgctccctggacgcgttcattgattccacccaggagcacgtcaccggcgatatccgcatggttctgcacgcaggttccatcaccatcaatggtcgtcgttccagccactccctgtacgacttcaacctggctacctacgacaccggcgacaccttcgaccagaccctggctaagggctttgtccagctgcacggtctgtcctccaagatcgctaacaagcgcgatcgcgaagctggcaacaactaa

SEQ ID NO: 73041 - protein, 401 aa, Corynebacterium glutamicum
MTNRIVLAYSGGLDTTVAIPYLKKMIDGEVIAVSLDLGQGGENMDNVRQRALDAGAAESIVVDAKDEFAEEYCLPTIKANGMYMKQYPLVSAISRPLIVKHLVEAGKQFNGTHVAHGCTGKGNDQVRFEVGFMDTDPNLEIIAPARDFAWTRDKAIAFAEENNVPIEQSVKSPFSIDQNVWGRAIETGYLEDLWNAPTKDIYAYTEDPALGNAPDEVIISFEGGKPVSIDGRPVSVLQAIEELNRRAGAQGVGRLDMVEDRLVGIKSREIYEAPGAIALIKAHEALEDVTIERELARYKRGVDARWAEEVYDGLWFGPLKRSLDAFIDSTQEHVTGDIRMVLHAGSITINGRRSSHSLYDFNLATYDTGDTFDQTLAKGFVQLHGLSSKIANKRDREAGNN

SEQ ID NO: 73042 - DNA, 1209 bp, Deinococcus radiodurans
  CDS (1)..(1209): transl_table=11
atgagcaaggaaaaaatcgtactcgcgtacagcggcggcttagacacctccatcatcctcaagtggctccagaccgagcgcaactacgacgtggtgtgcttcaccgccgacctcgggcagggcgacgaggtggaagaagcccgtgtcaaggcgttgaacaccggcgcggtggcggcctacgcccttgacctgcgcgaagaattcgtgcgcgactacgtgtttccgatgatgcgctcctcggcgctgtacgagggctactacctgctcggcacgtccatcgcccggcccctgattgccaagaagatggtcgagattgccgagaaggagggcgcggtcgccatttcgcacggcgcgaccggcaagggcaacgatcaggtgcgcttcgagatgagcgcctacgccctcaagcccgacatcgtgaccgtggccccctggcgtgactgggactttcagggccgcgccgacctcgaagcctttgcccgcgagcacggcattccggtgcccaccaccaagaaagacccctggagcatggacgccaacatgctgcacatctcctatgagggcggcccgctcgaagacccctggactgagccgcccacccacatgttcaagctgacggtgaaccccgaggacgcgccgagcgaggccgaatacgtcgaaatcgagtacgtgaacggcgacccggtgagcatcaacggtgaacagctctcgcccgccgcgctgctgacgaaggcgaacgaaatcgccgggcgtcacggcgtgggccgcatcgacctcgtggagaaccgcttcgtgggcatgaagtcgcgcggcgtgtacgaaacgcccggcggcacgctgctgtaccacgcccgccgcgccgtggaaagcctgaccctcgaccgcgaagtgctgcatcagcgcgacgccctggggccgaagtacgccgaactggtctataacggcttctggttcgcccccgagcgcgaagccttgcaggtctactttgaccatgtggccaaaagcgtgacgggcaccgctcgcctgaagttgtacaagggcaactgcatcgtggcaggccgcaaggccgagcgcagcctctacgacaaggacctcgtgagcttcgaggcgggcggtgactacaaccagcacgacgccggagccttcatcaagctcaactcgctgcggatgcgggtgcaaaagcgcgtggaggataaagggaagaagtaa

SEQ ID NO: 73043 - protein, 402 aa, Deinococcus radiodurans
MSKEKIVLAYSGGLDTSIILKWLQTERNYDVVCFTADLGQGDEVEEARVKALNTGAVAAYALDLREEFVRDYVFPMMRSSALYEGYYLLGTSIARPLIAKKMVEIAEKEGAVAISHGATGKGNDQVRFEMSAYALKPDIVTVAPWRDWDFQGRADLEAFAREHGIPVPTTKKDPWSMDANMLHISYEGGPLEDPWTEPPTHMFKLTVNPEDAPSEAEYVEIEYVNGDPVSINGEQLSPAALLTKANEIAGRHGVGRIDLVENRFVGMKSRGVYETPGGTLLYHARRAVESLTLDREVLHQRDALGPKYAELVYNGFWFAPEREALQVYFDHVAKSVTGTARLKLYKGNCIVAGRKAERSLYDKDLVSFEAGGDYNQHDAGAFIKLNSLRMRVQKRVEDKGKK

SEQ ID NO: 73044 - DNA, 1197 bp, Desulfotalea psychrophila
  CDS (1)..(1197): transl_table=11
atgagcgttgataaaattgtactcgcctattcaggcggtttagatacatctgttattttaaagtggttggccaatgagtatgaatgtcctgttgttgcctattctgctaatattggccagatagaggattgggatgcagttaaggaaaagggtatggccaccggtgccgataaggtaatcgtttccgacctgcagaaggaatttgttgaagattatatcttccccgcctttcgtgcatctgcaatttacgagggcacctatcttcttggtacctctcttgcccgtccacttatctctaaagagcaggtacgtattgcccatgcagagggtgccaacgccgtaagtcatggcgccaccggtaagggtaacgatcaggttcgttttgagctcggttatatcggtcttgatcctagtctgcagatcattgctccatggcgtacctgggatctcaactcccgtaccagacttgaagagtatgctaagcagcataatattcctgtgccaaccaccaagaaaaacccctatagctccgatgagaacctgcttcacatcagctttgagggcggcatccttgagagcccatggaatgagcctgatccggatatgttcaaactcaccgtctctcctgagatggccccggacaagcctacctatctggaaatcacctttcaaaacggtgatcctatagcccttgatggcgttgccatggaaccacttgagcttttcagagcgcttaataaggttgccggtgaaaatgctgttggtcgtcttgatcttgtcgagaaccgtttcgttggtatgaagagtcgtggtgtctatgagactcctggtggaaccctgctctatcatgctcaccgtgatcttgagaccatctgtctcgatcgtgaggtgatgaagattcgtgactctttggtgcctcgttatgctgagcttatctacaatggtttctggttctcacctgagcgcgagcttctccagatgaccatggatactgcccagaagaccgtaagcggtgtggtacgtatgaagctttataagggcaactgtttttctgttggccgtaagtctgatcagagtctttacaaagaagattttgccacctttgaagcagatgatgtatatgaccagggcgatgccaccggttttatccgtctcaatggccttcgtttgaagatcaacgcactgcagggcaagtaa

SEQ ID NO: 73045 - protein, 398 aa, Desulfotalea psychrophila
MSVDKIVLAYSGGLDTSVILKWLANEYECPVVAYSANIGQIEDWDAVKEKGMATGADKVIVSDLQKEFVEDYIFPAFRASAIYEGTYLLGTSLARPLISKEQVRIAHAEGANAVSHGATGKGNDQVRFELGYIGLDPSLQIIAPWRTWDLNSRTRLEEYAKQHNIPVPTTKKNPYSSDENLLHISFEGGILESPWNEPDPDMFKLTVSPEMAPDKPTYLEITFQNGDPIALDGVAMEPLELFRALNKVAGENAVGRLDLVENRFVGMKSRGVYETPGGTLLYHAHRDLETICLDREVMKIRDSLVPRYAELIYNGFWFSPERELLQMTMDTAQKTVSGVVRMKLYKGNCFSVGRKSDQSLYKEDFATFEADDVYDQGDATGFIRLNGLRLKINALQGK

SEQ ID NO: 73046 - DNA, 1191 bp, Desulfovibrio vulgaris
  CDS (1)..(1191): transl_table=11
atgtccggtatcaagaaggtcgttctcgcctactctggcggtctcgatacgtccgtcatcctgaagtggctcgccgtcacctataactgcgaagtggtgaccctcaccgccgacctcggtcaggaagaggacctcgacggcgtggacgacaaggccatgcgcacgggagcctcccgcgcctacgtcgaagacctgcaggaagagttcgcccgcgacttcatcttccccatgatgcgcgccggggcggtctatgaaggccgctacctgctgggcacctccatcgcgcgcccgctcatcgccaagcgccttgtcgagatcgctcgcgccgaaggcgcgcaggccgtggcccacggcgccaccggcaagggcaacgaccaggtgcgcttcgaactggcagtgaacgccctcgcacccgacctgcgcgtcatcgcgccgtggcgagaatgggacctgcgctcgcgcacgcagctcaacgccttcgccgaagagcacggcatccccatctccagttcggccaagcagtacagcatggaccgcaacatgctccactgcagcttcgagggcggcgaacttgaagacccgtggaacgaacccggccccaacagctacgtcatggccgttcccatggaacaggcccccgacgaggccgagtacatcagcatcgacttcgaacacggcaaccccgtggccgtgaacggcgaacgcctctcgcccgccgcgctggtcaagaagctcaacagcatcggcggacgtcacggcatcggccgtctcgacatggtcgagaaccgcttcgtgggcatcaagtcgcgcggcgtgtacgagacccccggcggtacgctcatccacatcgcccaccgagacctcgaaggcatctgcatcgaccgcgagaccatgcacctgcgcgacgccatgctgccccgctacgccgcagccatctacaacggcttctggttcgcccccgaacgcgaggccatgcaggcgatgatcgacgtctcgcagcagcgcgtcaccggcaccgtgcgcctgaagctgtacaagggcaatgcgtggcccgtgggtcgccagtcgcccaacaccctctactgccacgacctcgccaccttcgaagactgcgccacctacgaccacaaggacgcggcaggcttcatcaaactgcagggtctgcgcatccgcggttacaagaagggatag

SEQ ID NO: 73047 - protein, 396 aa, Desulfovibrio vulgaris
MSGIKKVVLAYSGGLDTSVILKWLAVTYNCEVVTLTADLGQEEDLDGVDDKAMRTGASRAYVEDLQEEFARDFIFPMMRAGAVYEGRYLLGTSIARPLIAKRLVEIARAEGAQAVAHGATGKGNDQVRFELAVNALAPDLRVIAPWREWDLRSRTQLNAFAEEHGIPISSSAKQYSMDRNMLHCSFEGGELEDPWNEPGPNSYVMAVPMEQAPDEAEYISIDFEHGNPVAVNGERLSPAALVKKLNSIGGRHGIGRLDMVENRFVGIKSRGVYETPGGTLIHIAHRDLEGICIDRETMHLRDAMLPRYAAAIYNGFWFAPEREAMQAMIDVSQQRVTGTVRLKLYKGNAWPVGRQSPNTLYCHDLATFEDCATYDHKDAAGFIKLQGLRIRGYKKG

SEQ ID NO: 73048 - DNA, 1221 bp, Geobacter sulfurreducens
  CDS (1)..(1221): transl_table=11
atggccaaagcgcacaaagacgtcaagaagatcgtccttgcctattcgggcggactcgacacatccatcatcctcaagtggctcaagaacgagtacggctgcgaggtcatcgccttctccgccgatctgggccaaggcgacgaactggcgccgatccgcgacaaggccatcgcaaccggcgccgacaaggtctacatcgacgacctgaaggaagaattcgtcaaggacttcgtattccccatgttccgcgccaacgccatttacgaggggcactacctcctgggcacctccatcgcccgccccctcatcgccaagcgtcagatggagatcgcgaagatcgagggtgccgacgccgtttcccacggcgccaccggcaaggggaacgaccaggtccgcttcgagctggcctactaccactttgacccggccatcaccgtggttgccccctggcgcgagtggaagctcaacagccgccaggccctggtgaactacgccaggaagaacgggatcccgatcccggtcaccaagaagcgtccctggtcctcggaccgcaacctcctccacatctccttcgagggcggcatcctggaggatacctgggccgagccccccgagaacatgtacgtgctgaccaaggcgccggaaaaggcccccaacaagccccagttcgtggagatcgaattcaaaaacggcaatgccgtggccgttgacggcgagaagatgagcccggcccagctcctggctcacctgaactacatcggcggcgagcacggtatcggccgggtcgatctcctggagaaccgctccgtgggcatgaagtcccggggcgtgtacgagacccccggcggcaccatcctgcgcgaggcccactcggcggtggagcagatcaccatggaccgcgaggtcatgcggatccgcgactccctcatccccgagtacgcccgccaggtctatgccggctactggttctcgccggagcgggagatgctccagaccctgatcgacgattcccagaagtgcgtgaacggcgtggcccgggtgaaactctacaaggggcactgccgtaccgtggggcgcaagtccgagaccaactctctcttcaacctggacttcgccaccttcgaaaaggatcaggtcttcaaccaggccgacgccaccggcttcatcaagatcaactccctgcggctgcggatcaggtcgctcatgcaggggaagaagtag

SEQ ID NO: 73049 - protein, 406 aa, Geobacter sulfurreducens
MAKAHKDVKKIVLAYSGGLDTSIILKWLKNEYGCEVIAFSADLGQGDELAPIRDKAIATGADKVYIDDLKEEFVKDFVFPMFRANAIYEGHYLLGTSIARPLIAKRQMEIAKIEGADAVSHGATGKGNDQVRFELAYYHFDPAITVVAPWREWKLNSRQALVNYARKNGIPIPVTKKRPWSSDRNLLHISFEGGILEDTWAEPPENMYVLTKAPEKAPNKPQFVEIEFKNGNAVAVDGEKMSPAQLLAHLNYIGGEHGIGRVDLLENRSVGMKSRGVYETPGGTILREAHSAVEQITMDREVMRIRDSLIPEYARQVYAGYWFSPEREMLQTLIDDSQKCVNGVARVKLYKGHCRTVGRKSETNSLFNLDFATFEKDQVFNQADATGFIKINSLRLRIRSLMQGKK

SEQ ID NO: 73050 - DNA, 1215 bp, Helicobacter hepaticus
  CDS (1)..(1215): transl_table=11
atggcagcgattaaaaaggttgttttggcatatagtggcggacttgatacgagtgtgattttaaaatggctcggagataattatcattgtgaggtggtaacctttacagctgatattggacagggtgaagaggttgagcctgcacgagaaaaggctttaaagcttggtataaaaagtgaaaatatttttattgaagatttaagagaggagtttatcaaagattttgtctttcctatgtttcgtgcaaatacaatttatgagggagaatatttgcttggcacaagcattgcacgccctcttattgcaaaaagacttgttgagattgctaaaagtgttggggctgatgccatagcacacggagcgacaggaaagggaaatgaccaagtgcgatttgagctcggagcctacgcgcttaatccagatattaaagtcattgcgccttggcgtgaatgggatttgaatagtcgtgaaaaactcttagcctatgcagaatctgcagggattgctattgaaaaaaagcaaaataaatcgccttattcaatggacgcaaacttattgcatattagctatgagggacagattctagaagacccaaatgtagaaccagaagaggatatgtggcgatggagtgtttcaccacttaatgcgccagataagccagaatctattagcattgagtttcaaaatggcgatggcgtggcgataaatggagaaaagctaagtcctgcgaatttttgggtaaatctcaatgagctaggcggaaagcacggcattgggcggcttgatttggtagaaaatcgctatgtgggtatgaaatctcgtgggtgttatgaaacacccggaggcacaatatatttaaaagctcatcgtgcgatagaatctttgtgtcttgatagggaagaggcacatttaaaagattctataatgccaaagtatgcagagctcatttataatggctattggtttagcccagagcgcgaggcattacaagcacttattgataagacacagcaaaaagtaagtggagtagtgcgccttaagctctataaagggaatgtcattgttatagggcgagaatctaaaaattctttatttaatgcagcatatagcacttttgaggaagattctgtatataatcaaaaagatgccgcagggtttattaaacttaatgctttacgctttatcatcgcaggaaaggcaaatagggacaaataa

SEQ ID NO: 73051 - protein, 404 aa, Helicobacter hepaticus
MAAIKKVVLAYSGGLDTSVILKWLGDNYHCEVVTFTADIGQGEEVEPAREKALKLGIKSENIFIEDLREEFIKDFVFPMFRANTIYEGEYLLGTSIARPLIAKRLVEIAKSVGADAIAHGATGKGNDQVRFELGAYALNPDIKVIAPWREWDLNSREKLLAYAESAGIAIEKKQNKSPYSMDANLLHISYEGQILEDPNVEPEEDMWRWSVSPLNAPDKPESISIEFQNGDGVAINGEKLSPANFWVNLNELGGKHGIGRLDLVENRYVGMKSRGCYETPGGTIYLKAHRAIESLCLDREEAHLKDSIMPKYAELIYNGYWFSPEREALQALIDKTQQKVSGVVRLKLYKGNVIVIGRESKNSLFNAAYSTFEEDSVYNQKDAAGFIKLNALRFIIAGKANRDK

SEQ ID NO: 73052 - DNA, 1212 bp, Leptospira interrogans serogroup Icterohaemorrhagiae serovar
  CDS (1)..(1212): transl_table=11
atggcgcaaaacaaacctgttaagaaaatcgttctcgcttattccggtggattggatacgtccgtaattcttacctggttgaaagatacatacggttgcgaagtaatcgcttttactgcggatataggtcaaaaggaagaactttccggactagaagaaaaaggaattaaaacaggagcttctaaggtttatatccaagatttgcgtttagagtttgctagagattttattttcccagccattcaaggaaatgcaatttatgaaatgaggtatcttcttggaacctctttggctcggcctttaattgccaaggcaatggtagaagtggccgaaaaagaaggtgcagacgcatttgcacacggggccactggcaaaggaaatgaccaagttcgctttgaattaggagtcaaatccttagctcctgaaaaaacaatcatcgctccttggagaatctggagttttggcggtagatcagatctaattgaatacgcaaaatccaaaggaattccagttccagtaactgcggaaaaaccgtattcgatggaccgcaatctaatgcatatatcttatgaaggtggaatattagaagatccttataaagaaccagatgagaaaatgtttttattaacaacctctcccgaaaaagctcccgatgctcctgaatatttggaactcgatttcgaagaaggaaattgtgtagcaatcaacggtaagaaaatgaatcctcttgaaatcatggaaacgctcaatacgattgcgggcaaacatggagtgggaagagttgacatcgttgaaaaccgactcgtaggaatcaaatctagaggagtttacgaaactcccggcgggactatattatttttagctcatagagacttagaatcgattacgatcgatcgagacacacaacatcataaagataaactttccatcgaatttgcagaactcatttataacggacattggttttcttccagaatgaaagcagttcgagcttttattacagaaacacaaagatatgttagtggaaccgtaagaataaaactttacaaagggatttgttctgttgtaggaagaaaatcccaagtatctctttacaacccagaaatggcgactttcgaaaaagaagaattatacaatcagaaagacgccgaaggttttataaacatctacggcttacccgctcaagaaacggcaaggcttcgcaaaaaatga

SEQ ID NO: 73053 - protein, 403 aa, Leptospira interrogans serogroup Icterohaemorrhagiae serovar
MAQNKPVKKIVLAYSGGLDTSVILTWLKDTYGCEVIAFTADIGQKEELSGLEEKGIKTGASKVYIQDLRLEFARDFIFPAIQGNAIYEMRYLLGTSLARPLIAKAMVEVAEKEGADAFAHGATGKGNDQVRFELGVKSLAPEKTIIAPWRIWSFGGRSDLIEYAKSKGIPVPVTAEKPYSMDRNLMHISYEGGILEDPYKEPDEKMFLLTTSPEKAPDAPEYLELDFEEGNCVAINGKKMNPLEIMETLNTIAGKHGVGRVDIVENRLVGIKSRGVYETPGGTILFLAHRDLESITIDRDTQHHKDKLSIEFAELIYNGHWFSSRMKAVRAFITETQRYVSGTVRIKLYKGICSVVGRKSQVSLYNPEMATFEKEELYNQKDAEGFINIYGLPAQETARLRKK

SEQ ID NO: 73054 - DNA, 1212 bp, Leptospira interrogans
  CDS (1)..(1212): transl_table=11
atggcgcaaaacaaacctgttaagaaaatcgttctcgcttattccggtggattggatacgtccgtaattcttacctggttgaaagatacatacggttgcgaagtaatcgcttttactgcggatataggtcaaaaggaagaactttccggactagaagaaaaaggaattaaaacaggagcttctaaggtttatatccaagatttgcgtttagagtttgctagagattttattttcccagccattcaaggaaatgcaatttatgaaatgaggtatcttcttggaacctctttggctcggcctttaattgccaaggcaatggtagaagtggccgaaaaagaaggtgcagacgcatttgcacacggggccactggcaaaggaaatgaccaagttcgctttgaattaggagtcaaatccttagctcctgaaaaaacaatcatcgctccttggagaatctggagttttggcggtagatcagatctaattgaatacgcaaaatccaaaggaattccagttccagtaactgcggaaaaaccgtattcgatggaccgcaatctaatgcatatatcttatgaaggtggaatattagaagatccttataaagaaccagatgagaaaatgtttttattaacaacctctcccgaaaaagctcccgatgctcctgaatatttggaactcgatttcgaagaaggaaattgtgtagcaatcaacggtaagaaaatgaatcctcttgaaatcatggaaacgctcaatacgattgcgggcaaacatggagtgggaagagttgacatcgttgaaaaccgactcgtaggaatcaaatctagaggagtttacgaaactcccggcgggactatattatttttagctcatagagacttagaatcgattacgatcgatcgagacacacaacatcataaagataaactttccatcgaatttgcagaactcatttataacggacattggttttcttccagaatgaaagcagttcgagcttttattacagaaacacaaagatatgttagtggaaccgtaagaataaaactttacaaaggggtttgttctgttgtaggaagaaaatcccaagtatctctttacaacccagaaatggcgactttcgaaaaagaagaattatacaatcagaaagacgccgaaggttttataaacatctacggcttacccgctcaagaaacggcaaggcttcgcaaaaaatga

SEQ ID NO: 73055 - protein, 403 aa, Leptospira interrogans
MAQNKPVKKIVLAYSGGLDTSVILTWLKDTYGCEVIAFTADIGQKEELSGLEEKGIKTGASKVYIQDLRLEFARDFIFPAIQGNAIYEMRYLLGTSLARPLIAKAMVEVAEKEGADAFAHGATGKGNDQVRFELGVKSLAPEKTIIAPWRIWSFGGRSDLIEYAKSKGIPVPVTAEKPYSMDRNLMHISYEGGILEDPYKEPDEKMFLLTTSPEKAPDAPEYLELDFEEGNCVAINGKKMNPLEIMETLNTIAGKHGVGRVDIVENRLVGIKSRGVYETPGGTILFLAHRDLESITIDRDTQHHKDKLSIEFAELIYNGHWFSSRMKAVRAFITETQRYVSGTVRIKLYKGVCSVVGRKSQVSLYNPEMATFEKEELYNQKDAEGFINIYGLPAQETARLRKK

SEQ ID NO: 73056 - DNA, 1185 bp, Methanosarcina acetivorans
  CDS (1)..(1185): transl_table=11
atggtaaagaaagttgcacttgcatattccggtgggcttgacacctctgtgtgcatccccatcctcaaggaaaagtacgggtacgatgaagtaattacaatttcagtagacgtcggccagcccgaagaagagatcaaaaaagctgatgcaaaagccgagaagatcagcaacaaacactacacgatcgatgcaaaggaagagttcgtaaaagactacatcttccccctgatcaaagccaacggagactacgaaggctatgtcatgggcacatcggtagcccgcccgctgattgccaaaaaagtggtggaagctgccattaaagaaggcgcagtcgcccttgcccacggctgtaccggaaaaggcaacgaccagctccgcttcgaagccgtcttccgccagaccgacatggacgtaatcgcccccatgcgggagatgaacctgacccgcgagtgggaaatcgactacgcaaaagagcacggaatcccggtagaagttacaaaagccaagccctggagcgttgacgaaaatatctggagccgcagcatcgaaggcggaaagcttgaagacccctcctttgtcccgccggaagagatcttcgagtggaccaaatccgcagaagatgccccgaacgagcccaggatcgttgacatcgactttgaagccggagtccctgtagccctcgacggcgaaaagctcggcggttacgcccttgtcaggaagctgaacgaaattgcaggcgagaacggcgtcggcaggacagatatgatcgaagaccgtgtccttggcttaaaagcccgcgagaactacgagcacccggctgcaaccgtcctcctcgcagcccacgccgacctcgagaaactcgtcctgacccgcggggaactgaagttcaagaagatcgtcgacgaacagtggtccgaacttgcctattacgggcttgttgacgagccgctttatgccgacctcaacgcctttatcgacaagtcccaggaaagggtcacgggtacagtgaaagtgaagctctacaaaggcgcacttactatccttgcccgcagctcgccaaatgcactttattctgaggatctggtttcttttgacagccagaccattgaccagaaggatgcggaagggtttgcgaagtatcacgggttccaggcgaggatgtacaggaaagtaatggagaaataa

SEQ ID NO: 73057 - protein, 394 aa, Methanosarcina acetivorans
MVKKVALAYSGGLDTSVCIPILKEKYGYDEVITISVDVGQPEEEIKKADAKAEKISNKHYTIDAKEEFVKDYIFPLIKANGDYEGYVMGTSVARPLIAKKVVEAAIKEGAVALAHGCTGKGNDQLRFEAVFRQTDMDVIAPMREMNLTREWEIDYAKEHGIPVEVTKAKPWSVDENIWSRSIEGGKLEDPSFVPPEEIFEWTKSAEDAPNEPRIVDIDFEAGVPVALDGEKLGGYALVRKLNEIAGENGVGRTDMIEDRVLGLKARENYEHPAATVLLAAHADLEKLVLTRGELKFKKIVDEQWSELAYYGLVDEPLYADLNAFIDKSQERVTGTVKVKLYKGALTILARSSPNALYSEDLVSFDSQTIDQKDAEGFAKYHGFQARMYRKVMEK

SEQ ID NO: 73058 - DNA, 1227 bp, Methylococcus capsulatus
  CDS (1)..(1227): transl_table=11
atgtcaagctcaaacgtcaagaaagtcgctctggcctactccggcggcctcgacacctcggtcattttgaagtggctgcaagaaacctatggctgtgaagtcgtgaccttcaccgccgatctcggccagggcgaggaagtcgagcctgcccgcgccaaagcccaggccatgggcgtcaaggaaatctacatcgacgacctacgcgaggagttctcccgtgacttcgtcttccccatgttccgcgccaatgccatctatgaaggcgaatatctgctgggcacctccatcgcccgcccgctgatcgccaaacgcctgatcgagatcgccaacgaaaccggcgccgatgccatcgcccacggcgccaccggcaagggcaacgaccaggtgcgcttcgaactgggcgcctatgccctgcggccggacattcgcgtcatcgccccctggcgggagtgggaactgacctcgcgcgaaaccctgctggcctatgccgaaagccggggcatcccaatcgaaatgaagcgcggcaaaacctcgccctattccatggatgccaatctgctgcacatctcctacgaaggcggcatcctggaagacccttgggccgagccggaggaaaccatgtggcgctggtccgtctcgcccgaaaacgctccggaccggccgacctatgtcgagttgacctacgaacacggtgacatcgtcgccatcgatggcgaacggatgacagccgcggcggttctggcccgcctgaatcagttgggcggcgccaacggcatcggccggctcgacattgtggaaaaccgttacgtcggaatgaaatcacgcggctgctacgagacccccggcggtaccatcatgctgaaggcgcaccgcgccatcgagtccatcacgctggaccgggaggtcgcccatctcaaggatgagctgatgccacgctacgccagcctgatctacaacggctattggtggagcccggaacgccggatgctgcagcagatgatcgatgcctcccaggcaacggtgaacggtgtagtgcgggtgaagctgtataaaggcaacgtcagcgtcgtcggccgcaagtcggagtccaacagcctgttcgacatgaacatcgccaccttcgaggacgaccgtggcgcctatgaccagaaggacgcggaaggcttcatcaagctcaacgcgttgcgcctgcgcatcgccggccggaaaggcgcgagcttcgcataa

SEQ ID NO: 73059 - protein, 408 aa, Methylococcus capsulatus
MSSSNVKKVALAYSGGLDTSVILKWLQETYGCEVVTFTADLGQGEEVEPARAKAQAMGVKEIYIDDLREEFSRDFVFPMFRANAIYEGEYLLGTSIARPLIAKRLIEIANETGADAIAHGATGKGNDQVRFELGAYALRPDIRVIAPWREWELTSRETLLAYAESRGIPIEMKRGKTSPYSMDANLLHISYEGGILEDPWAEPEETMWRWSVSPENAPDRPTYVELTYEHGDIVAIDGERMTAAAVLARLNQLGGANGIGRLDIVENRYVGMKSRGCYETPGGTIMLKAHRAIESITLDREVAHLKDELMPRYASLIYNGYWWSPERRMLQQMIDASQATVNGVVRVKLYKGNVSVVGRKSESNSLFDMNIATFEDDRGAYDQKDAEGFIKLNALRLRIAGRKGASFA

SEQ ID NO: 73060 - DNA, 1215 bp, Nitrosomonas europaea
  CDS (1)..(1215): transl_table=11
atggataaagtcaagaaagcagtactggcattttcaggggggctggatacctcagtcattttgaaatggctgcaggatacctatcagtgtgaggtggttacttttacggcggatatcggccagggcgaggagattgagccggcacgtgccaaagccgtacagtttggcatcagggaaatcttcatcgaggatctgcgcgaagagttcgtgcgtgactatgtttttcccatgttccgtgccaatacgatttatgaaggggaatatctgctcgggaccagtattgcccggccgctgattgccaaacgtcaggttgaaattgcgcagcagaccggcgcggatgcggtttctcacggtgctaccgggaagggaaatgaccaggtacgttttgagcttggttactatgcgttgcagccggatattcgggtaattgctccctggcgcgagtgggatctgacttcgcgtgaaaaactgctgacttatgccgagaagcagggtatcccgatcgaaatgaagcagaaggcaggatcgccctacagcatggacgccaatctgctccatatttcttatgaggggcgtgcgctggaagatccggctgcggagccggaggagagtatgtggcgctggacagtctcgcctgaaactgctccgagtgagcctgaatatctggatctggaatatgaacgcggtgatattgttgcattgaacggtgaaaggttgtctcccgcagccattctgaccaggcttaaccagttgggtggaaaacatggtatcggccgtctcgatctggtggaaaaccgttatgtcgggatgaaatcacgcggctgttatgaaacgcctggtggcacgatcatgttgcgtgcccatcgtgcaatcgaatccattacgcttgaccgcgaagttgcgcatttgaaagatgatctgatgccgcgttatgcagcgctgatttataacggttactggtggagtccggaaagaaaactgttgcaggtgctcatcgatgaatcccaggtgaatgtgaatggccgggtcagagtcaaattgtataagggtaatgtgatggttgtcgggcgtgattcccggaccgactcgttatttgaccccgacattgcgacatttgaagaagatggtggggcttatcatcaggctgatgcagcaggtttcatcaagctcaatgcgctgagaatgcggattgcaaaagctctccgcaggtgctga

SEQ ID NO: 73061 - protein, 404 aa, Nitrosomonas europaea
MDKVKKAVLAFSGGLDTSVILKWLQDTYQCEVVTFTADIGQGEEIEPARAKAVQFGIREIFIEDLREEFVRDYVFPMFRANTIYEGEYLLGTSIARPLIAKRQVEIAQQTGADAVSHGATGKGNDQVRFELGYYALQPDIRVIAPWREWDLTSREKLLTYAEKQGIPIEMKQKAGSPYSMDANLLHISYEGRALEDPAAEPEESMWRWTVSPETAPSEPEYLDLEYERGDIVALNGERLSPAAILTRLNQLGGKHGIGRLDLVENRYVGMKSRGCYETPGGTIMLRAHRAIESITLDREVAHLKDDLMPRYAALIYNGYWWSPERKLLQVLIDESQVNVNGRVRVKLYKGNVMVVGRDSRTDSLFDPDIATFEEDGGAYHQADAAGFIKLNALRMRIAKALRRC

SEQ ID NO: 73062 - DNA, 1203 bp, Nocardia farcinica
  CDS (1)..(1203): transl_table=11
atgtccgagcgcgtcgtactcgcctactccggtgggctggacacctccgtcgccatcagctggatcggcaaggagaccggcgccgaggtcgtggccgtcgccatcgatctgggccagggcggcgaggacatgaacgtggtgcgccagcgcgcgctggactgcggtgcggtcgagtcgatcgtgatcgacgcccgcgacgaattcgccgagcagtactgcctgccgaccatccaggccaacgccctctacatgggccagtacccgctggtctcggcgatcagccggccgctgatcgtcaagcacctggtcgaggccgccaagttccacggcgccgacaccgtcgcgcacggctgcaccggcaagggcaacgaccaggtgcgcttcgaggtcggcatcggcgcgctcgcgcccgacctgaacgtgatcgccccggtgcgcgactacgcctggacccgggagaaggccatcgccttcgccgaggagaacaagctcccgatcaacgtcaccaagaagtcgccgttctccatcgaccagaacgtgtggggccgtgccgtcgagaccggcttcctcgaggatctgtggaacgcgccgaccaaggacgtctacgactacaccgccgaccccacggtcaacttcgaggcgcccgacgaactgatcatcaccttcgacaagggtgtgccggtcgccatcgacggccgtccggtcagcgtgctcgaggcgatcgtggagctgaaccaccgcgccggccgccagggcgtcggccgcctggacatggtcgaggaccggctggtgggcatcaagagccgcgagatctacgaggcgccgggcgcgatcaccctgatcaccgcgcaccaggcgctcgagcacgtcaccatcgagcgcgagctgggccgctacaagcgccaggtcgagcagcgctggggcgagctggcctacgacggcctgtggttctccccgctcaagcgcgcgctggacgccttcgtgcaggacacccagcagcacgtgtccggcgacatccggatggtgctgcacggcggctcggccgtggtcaacggccgccgctccgagcagtcgctctacgacttcaacctcgccacctacgacgagggcgacaccttcgaccagtcgctggccaagggcttcgtgcagatccacggcctgtcgtccaaggtggccgcgcgccgcgacctgaaccagaagtag

SEQ ID NO: 73063 - protein, 400 aa, Nocardia farcinica
MSERVVLAYSGGLDTSVAISWIGKETGAEVVAVAIDLGQGGEDMNVVRQRALDCGAVESIVIDARDEFAEQYCLPTIQANALYMGQYPLVSAISRPLIVKHLVEAAKFHGADTVAHGCTGKGNDQVRFEVGIGALAPDLNVIAPVRDYAWTREKAIAFAEENKLPINVTKKSPFSIDQNVWGRAVETGFLEDLWNAPTKDVYDYTADPTVNFEAPDELIITFDKGVPVAIDGRPVSVLEAIVELNHRAGRQGVGRLDMVEDRLVGIKSREIYEAPGAITLITAHQALEHVTIERELGRYKRQVEQRWGELAYDGLWFSPLKRALDAFVQDTQQHVSGDIRMVLHGGSAVVNGRRSEQSLYDFNLATYDEGDTFDQSLAKGFVQIHGLSSKVAARRDLNQK

SEQ ID NO: 73064 - DNA, 1218 bp, Pseudomonas aeruginosa
  CDS (1)..(1218): transl_table=11
atggcggatgtgaagaaggtagtcctggcgtattccggcggcctggatacctcggtaattctgaagtggttgcaagatacctataactgcgaagtggtgaccttcaccgccgacctcggccagggcgaggaagtcgaaccggctcgcgccaaggcccgcgcgatgggcgtcaaggaaatctacatcgacgacctgcgcgaagaattcgtccgcgacttcgtctacccgatgttccgcgccaacaccgtctacgaaggcgagtacctgctgggcacctccatcgctcgtccgctgatcgccaagcgcctgatcgagatcgccaacgagaccggcgccgacgccatctcccacggcgccaccggcaagggcaacgaccaggtccgcttcgagctgggcgcctacgcgctgaagcccggcgtcaaggtgatcgcgccctggcgcgagtgggacctgctgtcccgcgagaagctgatggactatgccgagaagcacggcatcccgatcgagcgccacggcaagaagaagtcgccgtactcgatggacgccaacctcctgcatatctcctacgaagggggcgtgctggaagatacctggaccgagcacgaagaagacatgtggaagtggaccgcttccccggaaaacgcgccggacaccccgacctacatcgagctgacctaccgcaagggcgacatcgtcgccatcgacggcaaggacatgaccccggccgaggtgctcaccgagctgaaccgcgtcggcgggatcaacggcatcggccgcctcgacatcgtcgagaaccgctatgtcggcatgaagtcccgtggctgctacgagacccccggcggcaccatcatgctcaaggcccaccgcgccatcgagtcgatcaccctggaccgcgaagtggcccacctgaaagacgagctgatgcccaagtacgccagcctgatctacaccggctactggtggagcccggagcgcctgatgctgcagcagatgatcgacgcctcgcaggtcaacgtgaacggcgtagtgcgcctgaagctgtacaagggcaacgtcgtggtggtgggccgcaagtccgacgactcgctgttcgacgccaacatcgcgaccttcgaggaagacggcggcgcctacaaccaggccgatgccgcgggcttcatcaagctcaacgcgctgcgcatgcgcatcgccgcgaacaagggccgcacgctgtcctga

SEQ ID NO: 73065 - protein, 405 aa, Pseudomonas aeruginosa
MADVKKVVLAYSGGLDTSVILKWLQDTYNCEVVTFTADLGQGEEVEPARAKARAMGVKEIYIDDLREEFVRDFVYPMFRANTVYEGEYLLGTSIARPLIAKRLIEIANETGADAISHGATGKGNDQVRFELGAYALKPGVKVIAPWREWDLLSREKLMDYAEKHGIPIERHGKKKSPYSMDANLLHISYEGGVLEDTWTEHEEDMWKWTASPENAPDTPTYIELTYRKGDIVAIDGKDMTPAEVLTELNRVGGINGIGRLDIVENRYVGMKSRGCYETPGGTIMLKAHRAIESITLDREVAHLKDELMPKYASLIYTGYWWSPERLMLQQMIDASQVNVNGVVRLKLYKGNVVVVGRKSDDSLFDANIATFEEDGGAYNQADAAGFIKLNALRMRIAANKGRTLS

SEQ ID NO: 73066 - DNA, 1218 bp, Pseudomonas putida
  CDS (1)..(1218): transl_table=11
atggcggacgtaaaaaaggtcgtactggcgtattccggcggccttgatacttcggtgattctcaagtggctgcaggatacctacaactgcgaagtggtgaccttcaccgctgacctggggcagggcgaagaggtcgaaccggcccgtgccaaggcccaggcaatgggcgttaaagagatctacatcgacgacctgcgcgaagaattcgtgcgtgatttcgtgttcccgatgttccgcgccaacaccgtctacgaaggcgagtacctgctgggtacttccatcgcccgtccgctgatcgccaagcgcctgatcgaaatcgccaacgaaaccggcgctgacgccatttcccatggcgccaccggcaagggtaacgaccaggtgcgcttcgagctgggtgcctatgccctgaagccaggcgtcaaggtcatcgctccatggcgcgagtgggacctgctgtcccgcgaaaagctgatggactacgccgagaagcacggcatcccgatcgagcgccacggcaagaagaagtcgccgtactcgatggacgccaacctgctgcacatctcctacgagggcggtgtcctggaagatacctggaccgagcacgaagaagacatgtggcgctggagtgtctcgcctgagaatgccccggaccaggctacctacatcgagctgacctaccgcaatggtgacatcgttgccatcgacggcgtcgagaaatccccggccaccgtcctggcagacctgaaccgtatcggtggtgccaacggcatcggccgtctggacatcgtcgaaaaccgttacgtcggcatgaagtcgcgcggttgctacgaaacgcctggcggtaccatcatgctcaaggcacaccgtgccatcgagtcgatcaccctggaccgcgaagtcgctcacctgaaagatgagctgatgccaaagtatgccagcctgatctacaccggctactggtggagcccggagcgtctgatgctgcaacagatgatcgatgcttcgcaggtcaacgtgaatggtgtggtgcgcctgaaactgtacaagggcaacgtgaccgtggttggccgcaagtcggacgattcgctgttcgatgccaacatcgccacctttgaagaagatggtggtgcctacaaccaggcagatgctgctggcttcatcaagctcaatgcactgcgtatgcgcattgccgccaacaagggccgttcgctgctctga

SEQ ID NO: 73067 - protein, 405 aa, Pseudomonas putida
MADVKKVVLAYSGGLDTSVILKWLQDTYNCEVVTFTADLGQGEEVEPARAKAQAMGVKEIYIDDLREEFVRDFVFPMFRANTVYEGEYLLGTSIARPLIAKRLIEIANETGADAISHGATGKGNDQVRFELGAYALKPGVKVIAPWREWDLLSREKLMDYAEKHGIPIERHGKKKSPYSMDANLLHISYEGGVLEDTWTEHEEDMWRWSVSPENAPDQATYIELTYRNGDIVAIDGVEKSPATVLADLNRIGGANGIGRLDIVENRYVGMKSRGCYETPGGTIMLKAHRAIESITLDREVAHLKDELMPKYASLIYTGYWWSPERLMLQQMIDASQVNVNGVVRLKLYKGNVTVVGRKSDDSLFDANIATFEEDGGAYNQADAAGFIKLNALRMRIAANKGRSLL

SEQ ID NO: 73068 - DNA, 1218 bp, Pseudomonas syringae pv
  CDS (1)..(1218): transl_table=11
atggcggacgtaaacaaggtagttctcgcgtattccggtggcctggatacttcggtaatcctcaagtggctgcaagatacgtacaactgcgaagtggtgacctttaccgctgacctgggtcagggtgaagaagtcgaaccggcacgcgccaaggctcaggccatgggcgtgaaagaaatctacatcgatgacctgcgcgaagagttcgtgcgcgatttcgtgttcccgatgttccgtgccaataccgtctatgaaggcgagtacctgctgggcacttccattgctcgtccgctgattgccaagcgtctgatcgagatcgccaacgaaaccggcgctgacgccatttcccacggcgcaaccggtaaaggcaatgaccaggtacgtttcgagctgggcgcctacgcgctcaagccgggcgtcaaggtgattgctccgtggcgtgaatgggacctgctgtcgcgcgaaaagctgatggattacgccgagaagcacaatattccgatcgagcgtcacggcaagaagaaatccccgtactcgatggatgccaacctgctgcacatctcctatgaaggcggcgtgctggaagacacctggaccgagcacgaagaagacatgtggcgctggaccaagtcccctgaggacgcgccgaacgttgcaacctacctcgagctgacctatcgcaatggcgacatcgtcgctctggacggcgtcgacatgaccccggctaccgtactcgctaccctgaaccgcattggcggcgaaaacggtatcggtcgtctggacatcgttgaaaaccgttacgtgggcatgaagtcccgtggttgctacgaaaccccgggcggcaccatcatgctgcgtgctcaccgcgccatcgaatcgatcaccctggaccgcgaagtcgcccacctcaaggacgaattgatggtcaagtacgccagcctgatctacacaggttactggtggagccctgagcgtctgatgctgcaacagatgatcgacgcgtcccaggtgcacgtgaacggtgttgtgcgtctgaagctgtataaaggcaacgtgatcgttactggccgcaagtccgacgattcactgttcgacgccaacatcgccacctttgaagacgacgcaggtgcctacgatcaggccgatgcagcgggcttcatcaagctgaatgcgttgcgcatgcgtatcgctgcaaacaaaggccgcaagctgttctga

SEQ ID NO: 73069 - protein, 405 aa, Pseudomonas syringae pv
MADVNKVVLAYSGGLDTSVILKWLQDTYNCEVVTFTADLGQGEEVEPARAKAQAMGVKEIYIDDLREEFVRDFVFPMFRANTVYEGEYLLGTSIARPLIAKRLIEIANETGADAISHGATGKGNDQVRFELGAYALKPGVKVIAPWREWDLLSREKLMDYAEKHNIPIERHGKKKSPYSMDANLLHISYEGGVLEDTWTEHEEDMWRWTKSPEDAPNVATYLELTYRNGDIVALDGVDMTPATVLATLNRIGGENGIGRLDIVENRYVGMKSRGCYETPGGTIMLRAHRAIESITLDREVAHLKDELMVKYASLIYTGYWWSPERLMLQQMIDASQVHVNGVVRLKLYKGNVIVTGRKSDDSLFDANIATFEDDAGAYDQADAAGFIKLNALRMRIAANKGRKLF

SEQ ID NO: 73070 - DNA, 1224 bp, Rhizobium loti
  CDS (1)..(1224): transl_table=11
atgtccaagaccaaagacgtcaagaaagtcgtgctcgcctattccggcggcctcgacacatccatcatcctgaaatggctgcagaccgaactcggcgccgaagtcgtcaccttcaccgccgatctcggccagggtggcgagttggagccggcacgcaagaaggccgagatgatgggcatcaaggacatccgcatcgtcgatgtgcgggaggaattcgtcgccgacttcgtcttcccgatgttccgtgccaacaccgtctatgaaggcacctatctgctcggcacctcgatcgcgcggccgctgatctccaagcaccttgtcgacatcgccagggagaccggcgccgatgcgatcgcccatggcgccaccggcaagggcaacgaccaggtccgcttcgagctgtcggcctatgcgctgaaccccgatatcaaagtcatcgcgccctggcgcgactggtcgttcaagtcgcgcaccgacctgatcaacttcgccgagcagcaccagatcccggtggccaaggacaaaaggggcgaggcgccgttctcggtcgacgccaacctgctgcactcctcttccgagggcaaggtgctggaagatccgtggagcgagccgccggaattcgtccaccagcgcacggtctcgccgatggacgcgccggacaaggtaaccgagatcgagatcgagttcctgaagggcgacccgatcgcgctcaacggcaagaagctgtcgccggcgaccatgctggccgccctcaacgatcttggccgcgacaacggcatcggccggctcgacctggtcgagaaccgtttcgtcggcatgaaatcgcgcggcgtctacgagacgccaggcggcgccatcctgatcgtggcccaccgcgccatcgaatcgatcacgctcgaccgcggcgccgcgcacctcaaggacgagttcatgccgcgctacgccgagctcatctacaacggcttctggttctcgcccgagcgcctgatgctgcaggcgatgatcgacaagagccaggaagacgtcgaaggcacggtacggttgaagctctacaagggcaatgtcatggtcaccggccgcaagtcgaagaagacgctctattccgacgcgctggtcaccttcgaggacgatcgcggcgcctacgaccagaaggacgccgccggcttcatccgcctcaatgcgctgaggctgcgcacgctggctgcgcgcaaccgcaagggctga

SEQ ID NO: 73071 - protein, 407 aa, Rhizobium loti
MSKTKDVKKVVLAYSGGLDTSIILKWLQTELGAEVVTFTADLGQGGELEPARKKAEMMGIKDIRIVDVREEFVADFVFPMFRANTVYEGTYLLGTSIARPLISKHLVDIARETGADAIAHGATGKGNDQVRFELSAYALNPDIKVIAPWRDWSFKSRTDLINFAEQHQIPVAKDKRGEAPFSVDANLLHSSSEGKVLEDPWSEPPEFVHQRTVSPMDAPDKVTEIEIEFLKGDPIALNGKKLSPATMLAALNDLGRDNGIGRLDLVENRFVGMKSRGVYETPGGAILIVAHRAIESITLDRGAAHLKDEFMPRYAELIYNGFWFSPERLMLQAMIDKSQEDVEGTVRLKLYKGNVMVTGRKSKKTLYSDALVTFEDDRGAYDQKDAAGFIRLNALRLRTLAARNRKG

SEQ ID NO: 73072 - DNA, 1218 bp, Rhizobium meliloti
  CDS (1)..(1218): transl_table=11
atggcatcgcataaagacgtgaagaaggtcgttctcgcctattccggcggtctcgacacctcgatcatcctcaaatggctgcagacggaactgggcgccgaagtggtgaccttcaccgcggacctcggccagggcgaagaactggagccggcgcgcaagaaggcggagatgctcggcatcaaggagatctatatcgaggacgtccgcgaggaattcgtgagggacttcgtgttcccgatgttccgcgccaatgccgtctatgaaggcgtctacctgctcggcacctccatcgcccgtccgctgatctccaaacacctcatcgatatcgccaggaagaccggcgccgacgcgatcgcccatggcgcgaccggcaagggcaacgaccaggtccgcttcgaactttcggcttacgcgctcaatccggacatcaagatcatcgccccctggcgcgactggtcgttcaagagccgcaccgatctgctcgaattcgccgagaagcaccagattccggtcgccaaggacaagaagggcgaggcgcctttctccgtcgacgccaacctcctgcactcctcctcggaaggaaaagtgctggaggacccggcccgggaagctcccgaatacgtgcacatgcgcaccatttcgccggaagcggcacctgacaaggcaaccgtcatcaaggtcggcttcgaacgtggcgatgccgtgtcgatcgacggggtacgcatgtcgccggcaacgcttcttgcgaagctcaacgaatacggccgcgacaacggcatcggccgcctggacctcgtcgagaaccgtttcgtcggcatgaagtcgcgcggcgtctacgaaacccccggcggcacgatcctgcttgcggcccatcgtgcgatcgagagcatcacgctcgaccgcggcgcggcgcatctgaaggacgagctgatgccgcgctatgccgagctcatctattacggcttctggttctctccggagcgcgaaatgctgcaggcggcgatcgacaggagccaggagcatgtggaaggcgaagtgacgctgaagctctacaagggcaatgtcatggtcatcggccgcgaaagcggcaagtcgctctattccgacaagctcgtcaccttcgaggacgatcagggcgcctacgaccagaaggatgccgccggcttcatcaagctcaacgcgctgcgtctgcgcacgctggcagcgcgcaaccggtaa

SEQ ID NO: 73073 - protein, 405 aa, Rhizobium meliloti
MASHKDVKKVVLAYSGGLDTSIILKWLQTELGAEVVTFTADLGQGEELEPARKKAEMLGIKEIYIEDVREEFVRDFVFPMFRANAVYEGVYLLGTSIARPLISKHLIDIARKTGADAIAHGATGKGNDQVRFELSAYALNPDIKIIAPWRDWSFKSRTDLLEFAEKHQIPVAKDKKGEAPFSVDANLLHSSSEGKVLEDPAREAPEYVHMRTISPEAAPDKATVIKVGFERGDAVSIDGVRMSPATLLAKLNEYGRDNGIGRLDLVENRFVGMKSRGVYETPGGTILLAAHRAIESITLDRGAAHLKDELMPRYAELIYYGFWFSPEREMLQAAIDRSQEHVEGEVTLKLYKGNVMVIGRESGKSLYSDKLVTFEDDQGAYDQKDAAGFIKLNALRLRTLAARNR

SEQ ID NO: 73074 - DNA, 1233 bp, Schizosaccharomyces pombe
  CDS (1)..(1233)
atgccccaagaagtaaaacgttgcgttctcgcctattcaggtggtcttgacacctcctgtatcctcgcctggcttattgaagaaggttgggaggtcatctgctatatggctaatgttggtcaagaggaagattgggatgcagcccgtgaaaaggccttgaaggtgggtgctaagaaggtttacgttgaggacttgcgtgaagagttcatcaatgacaccgtcattcctgctgctcaagctaacgccatttacgaaaatgtttatctcttgggcacttctcttgctcgtcctatcattgctcgccgtcagatccaaatcgccgagaaggaaaactgtatcgctgtctctcacggttgcactggtaagggcaacgatcaagttcgtttcgaattggcatattacgctttgaagccagacgttcaagtcattgctccttggcgtttgcctgtatttttcgagcgcttcgccggtcgtaaggatttgctcgaatatgctgctgctaagggcattcccgttactcaaaccaccaaaaagccttggtctatggatgaaaacattgtacattgctcgtatgaagctggaatcctcgaggatcccagtatgactcctcccaaggacatgtggaagctcaccgttgatcccaaagacgctcctgatgaggttgaagagctcagcattcactttgaaaagggtgctcccaccaaattagagtgcaaggatggtacctttagcggagtcgtttccatcttctaccaattgaacgctatcgctcgtcgtaacggtgttggtcgtatcgatattgttgaaaaccgtttctctggtttgaagagtcgtggttgttacgaaactcctggcttaaccattttgcgtactgctcatatggacttggaaggtttaacaatggaacgtgaagttcgtgctctccgtgaccaattcgttactttcaatctcgctaaaattttgtacaatggacaatttttctctccctgcactcgtatgcttttagcagctaacaacgtttctcaagaggtagtaaacggtgtagttaaactttctgtctacaagggcaatgtcactgtcctcggtcgtaaatctgatactgctcatctttatgacgagaaattgtcatctatggatgagcttggtggatttgaccctacatggacctctggtttcatccaaatcgagtctatgcgtttgcgtaactctgatgaaggaaaacattggatgtaa

SEQ ID NO: 73075 - protein, 410 aa, Schizosaccharomyces pombe
MPQEVKRCVLAYSGGLDTSCILAWLIEEGWEVICYMANVGQEEDWDAAREKALKVGAKKVYVEDLREEFINDTVIPAAQANAIYENVYLLGTSLARPIIARRQIQIAEKENCIAVSHGCTGKGNDQVRFELAYYALKPDVQVIAPWRLPVFFERFAGRKDLLEYAAAKGIPVTQTTKKPWSMDENIVHCSYEAGILEDPSMTPPKDMWKLTVDPKDAPDEVEELSIHFEKGAPTKLECKDGTFSGVVSIFYQLNAIARRNGVGRIDIVENRFSGLKSRGCYETPGLTILRTAHMDLEGLTMEREVRALRDQFVTFNLAKILYNGQFFSPCTRMLLAANNVSQEVVNGVVKLSVYKGNVTVLGRKSDTAHLYDEKLSSMDELGGFDPTWTSGFIQIESMRLRNSDEGKHWM

SEQ ID NO: 73076 - DNA, 1215 bp, Streptomyces avermitilis
  CDS (1)..(1215): transl_table=11
ttgcagtgtgaggagaagcccgtgaccgagcgcgtcgtactcgcctactcgggtggtctggacacctccgtcgccatcggctggatcgccgaggagacgggcgccgaggtcatcgccgtcgcggtcgacgtcggccagggcggcgaggacctggacgtcatccgcaagcgcgcgctcgcctgcggtgccgtcgaggccgaggtcgcggacgccaaggacgagttcgccgacgagtactgcctcccggcggtcaaggccaacgccctctacatggaccgctacccgctggtctccgccctctcccggccgaccatcgtcaagcacctcgtcgccgccgcccagaagcacggcgccaccacggtcgcccacggctgcaccggcaagggcaacgaccaggtgcggttcgaggccggcatcgtcgccctcgcccccggcctcaagtgcatcgccccggtccgtgactacgcgatgacccgggacaaggcgatcgccttctgcgaggagaagcggctcccgatcgccaccaccaagaagtccccgtactccatcgaccagaacgtcttcgggcgcgcggtcgagacgggcttcctggaggacatctggaacgcgccgatcgaggacatctacgagtacacctcgaacccggccgagccccgcgaggccgacgaggtcgtcatctccttcaaggagggcgtcccggtcgccatcgacggccggcccgtcaccgtgctccaggcgatccagcagctcaacgagcgcgccggcgcccagggcgtcggccggatcgacatggtcgaggaccggctcgtgggcatcaagtcccgcgaggtgtacgaggctccgggcgcgatcgctctcatcacggcccaccaggagctggagaacgtcaccgtcgagcgtgaactcgcccgctacaagcggcaggtcgagcagcgctggggcgagctggtctacgacggccagtggttctccccgctcaagcgcgccctggagggcttcatcgacgaggccaaccagcacgtcaacggcgacatccggatgaccctgcacggcggccgcgccgtcgtcaccggccggcgctccgagacgtcgctctacgacttcaacctcgccacgtacgacacgggcgacagcttcgaccaggccgcggccaagggcttcatcgacatctacagcctgtcgtcgaagatcgccgccaagcgcgacctggcgtaa

SEQ ID NO: 73077 - protein, 404 aa, Streptomyces avermitilis
MQCEEKPVTERVVLAYSGGLDTSVAIGWIAEETGAEVIAVAVDVGQGGEDLDVIRKRALACGAVEAEVADAKDEFADEYCLPAVKANALYMDRYPLVSALSRPTIVKHLVAAAQKHGATTVAHGCTGKGNDQVRFEAGIVALAPGLKCIAPVRDYAMTRDKAIAFCEEKRLPIATTKKSPYSIDQNVFGRAVETGFLEDIWNAPIEDIYEYTSNPAEPREADEVVISFKEGVPVAIDGRPVTVLQAIQQLNERAGAQGVGRIDMVEDRLVGIKSREVYEAPGAIALITAHQELENVTVERELARYKRQVEQRWGELVYDGQWFSPLKRALEGFIDEANQHVNGDIRMTLHGGRAVVTGRRSETSLYDFNLATYDTGDSFDQAAAKGFIDIYSLSSKIAAKRDLA

SEQ ID NO: 73078 - DNA, 1194 bp, Streptomyces clavuligerus
  CDS (1)..(1194): transl_table=11
gtgaccgagcgcgtcgtactcgcctactcgggcggtctggacacctccgtcgccatcggctggatcgccgaggagacgggcgccgaggtcatcgccgtcgccgtggacgtcggccagggcggcgaggacctggacgtcatccgcaagcgcgcgctcgcctgcggtgccgtggaggccgaggtggccgacgccaaggacgagttcgccgaggagtactgcctccctgcgatcaaggccaacgcccgctacatggaccggtacccgctggtgtccgcgctctcccggcccgcgatcgtcaagcacctggtcgccgccgcgaagaagcacgacgcctcgatcgtggcgcacggctgcaccggcaaggggaatgaccaggtccgtttcgaggccggtatccaggccctcggcccggacctcaagtgcatcgcgccggtccgtgactacgccatgacccgggacaaggccatcgccttctgcgaggccaagcagctcccgatcgccaccaccaagaagtccccgtactccatcgaccagaacgtcttcggccgggccatcgagaccggcttcctggaggacatctggaacgcgccgatcgaggacatcttcgagtacacctccaacccggccgagccccgcgaggccgacgaggtggtcatctccttcgcctccggtgtcccggtcgccatcgacggccgccccgtcaccgtgctccaggccatccagcagctcaacgagcgcgcgggcgcccagggcatcggccggatcgacatggtcgaggaccggctggtcggcatcaagtcccgtgaggtgtacgaggcgccgggcgcgatcgcgctgatcaccgcccaccaggagctggagaacgtcaccgtcgagcgcgaactggcccgcttcaagcggcaggtcgagcagcgctggggcgagctggtctacgacggcctgtggttctccccgctcaagcgcgccctggacggcttcatcgaggaggccaaccagcaggtcaccggcgacatccggatgaccctgcacgcgggcaccgccgtggtcaccggccgccgctccgagcggtcgctgtacgacttcgacctcgcgacctacgacacgggcgacaccttcgaccagtccaaggcccagggcttcatcgacatcttcgccctctccgcgaagatcgccgccaagcgcgacctggtctga

SEQ ID NO: 73079 - protein, 397 aa, Streptomyces clavuligerus
MTERVVLAYSGGLDTSVAIGWIAEETGAEVIAVAVDVGQGGEDLDVIRKRALACGAVEAEVADAKDEFAEEYCLPAIKANARYMDRYPLVSALSRPAIVKHLVAAAKKHDASIVAHGCTGKGNDQVRFEAGIQALGPDLKCIAPVRDYAMTRDKAIAFCEAKQLPIATTKKSPYSIDQNVFGRAIETGFLEDIWNAPIEDIFEYTSNPAEPREADEVVISFASGVPVAIDGRPVTVLQAIQQLNERAGAQGIGRIDMVEDRLVGIKSREVYEAPGAIALITAHQELENVTVERELARFKRQVEQRWGELVYDGLWFSPLKRALDGFIEEANQQVTGDIRMTLHAGTAVVTGRRSERSLYDFDLATYDTGDTFDQSKAQGFIDIFALSAKIAAKRDLV

SEQ ID NO: 73080 - DNA, 1206 bp, Symbiobacterium thermophilum
  CDS (1)..(1206): transl_table=11
atggcgaagaagaagtgcgtgctggcctactcaggcgggctggatacctcggtggcgatccactggatcaaggagaactacgacgccgatgtggtcgcgctggcggtggacgtgggcgccaacgacaaggacctggagttcatccggcagaaggcgctttccatcggcgccgtgaagagctacgtctacgatgccaggaaagagttcgcctacgacttcatcctgccgacgctccaggccaacgcctgttacgagtccaagtactacctctcggcggcgctttcccggccgctgatcgcgaagctgctggtccagatcgccgaggaggaaggggccgacttcgtcgcccacggctgcacgggcaagggcaatgaccaggtgcggttcgaggtctccgtggccgccctcaaccccaacctgcaggtgctcgccccggtgcgggagtggggatggagccgggaggaggagatcgactacgcccagaaacatggcatcccggtcccggtgggcaaggagaacccgttctccatcgacgtgaacctgtggggccgctcctgcgaggccggcgtcctggaggacccgtgggcggaggcgccggaggaggccttcgagtggaccgtgaatccgaaggatgcccccgacgagcccgagtacgtggagatcggcttcgagcagggcgtgccggtctcgttgaacggcgaggcgctggacctggtgaccctgatcgagcggctgcacgccatcgccggccgccacggggtgggccgcatcgaccacgtggagaaccgactggtcggcatcaagtcccgggaggtgtacgagatgccggcggcggcggtgctcaccctggcgcacaaggagctggagaccatcaccctgccccgggagctgcaccacttcaagctgggcctggagcagaagtacgccgaactggtctacaacggcctctggttccacccgctgaaggaggccctggacgctttcatcaagaagtcccaggagacggtgaccggcacggtgcgggtgagactcttcaagggctcggccttctgcgtgggccggacttcgccctacacgctctactcctacgacctggccacctacgacaaggcggacaagttcgaccacaaggcggccaaggggttcatcgacatcttcggcctgcccaccaaggtctacgccgccgtgcagaagagcaaggcctga

SEQ ID NO: 73081 - protein, 401 aa, Symbiobacterium thermophilum
MAKKKCVLAYSGGLDTSVAIHWIKENYDADVVALAVDVGANDKDLEFIRQKALSIGAVKSYVYDARKEFAYDFILPTLQANACYESKYYLSAALSRPLIAKLLVQIAEEEGADFVAHGCTGKGNDQVRFEVSVAALNPNLQVLAPVREWGWSREEEIDYAQKHGIPVPVGKENPFSIDVNLWGRSCEAGVLEDPWAEAPEEAFEWTVNPKDAPDEPEYVEIGFEQGVPVSLNGEALDLVTLIERLHAIAGRHGVGRIDHVENRLVGIKSREVYEMPAAAVLTLAHKELETITLPRELHHFKLGLEQKYAELVYNGLWFHPLKEALDAFIKKSQETVTGTVRVRLFKGSAFCVGRTSPYTLYSYDLATYDKADKFDHKAAKGFIDIFGLPTKVYAAVQKSKA

SEQ ID NO: 73082 - DNA, 1230 bp, Thermotoga maritima
  CDS (1)..(1230): transl_table=11
atgaaagagaaagtcgttcttgcatacagtggtggtctcgatacttccgtcattttgaagtggctctgcgaaaagggcttcgacgtgatagcttacgttgcaaacgttggacagaaggacgatttcgttgcaataaaagaaaaggccttgaaaacaggcgcttcaaaagtctacgtggaagacctcagaagggaattcgtcacagattacatattcaccgcactccttggaaacgccatgtacgaaggaaggtaccttcttggaaccgctatcgcaagacctctcatagccaaaagacaggtggagatagccgagaaagaaggagcacagtacgttgcgcacggtgcgaccgggaaaggaaacgaccaggtgaggttcgagctcacctacgccgctttgaatccaaatctcaaagttatctcaccctggaaagaccctgaatttctcgccaaattcaagggcagaacagatctcataaactacgccatggagaaagggattccaatcaaagtctccaaaaaaagaccctacagcgaagacgaaaacctcatgcacatttcccacgaagcgggcaaactggaggatcccgcacacatacctgacgaagacgtgttcacatggacagtctccccaaaggacgctccggatgaagaaaccttgctcgagatccatttcgaaaacggcattccggtgaaagttgtgaacctcaaagatggaacagaaaagacagatcccctcgaactcttcgaatatctgaacgaagtaggtgcgaaaaatggagtgggaagactcgacatggtcgaaaacagattcataggtataaaatcaagaggggtgtacgaaactccgggcgcgacgatcctgtggatcgcacacagagatctcgaaggaatcaccatggacaaagaagtcatgcacctgagagacatgctcgctccgaagttcgcggagctcatatacaacggtttctggttttctccagaaatggagttcctcctcgcagcgttcagaaaagcacaggagaacgtgaccggaaaggtgacggtatccatatacaaaggaaacgtcatgcccgttgcgaggtattcaccgtattcactgtacaatccggaactttcgagcatggacgtcgaaggaggattcgatgccactgactcgaagggcttcatcaacattcacgccctgaggttgaaggtccaccagctcgtgaaaaaggggtatcagagatga

SEQ ID NO: 73083 - protein, 409 aa, Thermotoga maritima
MKEKVVLAYSGGLDTSVILKWLCEKGFDVIAYVANVGQKDDFVAIKEKALKTGASKVYVEDLRREFVTDYIFTALLGNAMYEGRYLLGTAIARPLIAKRQVEIAEKEGAQYVAHGATGKGNDQVRFELTYAALNPNLKVISPWKDPEFLAKFKGRTDLINYAMEKGIPIKVSKKRPYSEDENLMHISHEAGKLEDPAHIPDEDVFTWTVSPKDAPDEETLLEIHFENGIPVKVVNLKDGTEKTDPLELFEYLNEVGAKNGVGRLDMVENRFIGIKSRGVYETPGATILWIAHRDLEGITMDKEVMHLRDMLAPKFAELIYNGFWFSPEMEFLLAAFRKAQENVTGKVTVSIYKGNVMPVARYSPYSLYNPELSSMDVEGGFDATDSKGFINIHALRLKVHQLVKKGYQR

SEQ ID NO: 73084 - DNA, 1203 bp, Thermus thermophilus
  CDS (1)..(1203): transl_table=11
atgaagatcgtcttggcctactccggcggactggacaccagcatcatcctgaagtggctcaaggagacctatggggccgaggtcatcgcctttaccgcggacatcggccagggggaggaggtggaggaggcccgggagaaggcgctgaggacgggggcttccaaggccatcgccctggacctcaaggaggagtttgtccgcgacttcgtcttccccatgatgcgggctggcgcggtgtacgagggctactacctcctcggcacctccatcgcgaggcctttgatcgccaagcacctggtgcggatcgccgaggaggagggggcggaggccatcgcccacggggccacggggaaggggaacgaccaggtgcgctttgagctcaccgcctacgccctgaagcccgacatcaaggtcatcgccccctggcgggagtggagcttccagggccgcaaggagatgatcgcctacgccgaggcccacggcatccccgtccccgtgacccaggagaagccttactccatggacgccaacctcttgcatatttcctacgagggcggggtcctcgaggacccctgggccgagccccccaaggggatgttccgcatgacccaagaccccgaggaggcccccgacgccccggagtacgtggaggtggagttttttgagggcgaccccgtggcggtgaacggggagaggctttccccggcggccctcctgcagaggctcaacgagctcggggggcggcacggggtgggccgggtggacatcgtggagaaccgcttcgtgggcatgaagtcccggggggtctacgagaccccgggggggacgatcctctaccacgccaggcgggcggtggaaagcctcaccctggaccgcgaggtcctccaccaaagggacatgctctcccccaagtacgccgagctcgtctactacggcttctggtacgccccggagcgggaggcccttcaggcctactttgaccacgtggcgaagaacgtcaccggcgtggcccggctcaagctctacaaggggaacgtctacgtggtgggaaggaaggccccgaagagcctctaccgccaggacctggtctcctttgacgaggcagggggctacgaccagaaggacgccgagggcttcatcaagatccaggccctgcgcctccgggtgcgggcccttgtggagagggagggccatggcgcatag

SEQ ID NO: 73085 - protein, 400 aa, Thermus thermophilus
MKIVLAYSGGLDTSIILKWLKETYGAEVIAFTADIGQGEEVEEAREKALRTGASKAIALDLKEEFVRDFVFPMMRAGAVYEGYYLLGTSIARPLIAKHLVRIAEEEGAEAIAHGATGKGNDQVRFELTAYALKPDIKVIAPWREWSFQGRKEMIAYAEAHGIPVPVTQEKPYSMDANLLHISYEGGVLEDPWAEPPKGMFRMTQDPEEAPDAPEYVEVEFFEGDPVAVNGERLSPAALLQRLNELGGRHGVGRVDIVENRFVGMKSRGVYETPGGTILYHARRAVESLTLDREVLHQRDMLSPKYAELVYYGFWYAPEREALQAYFDHVAKNVTGVARLKLYKGNVYVVGRKAPKSLYRQDLVSFDEAGGYDQKDAEGFIKIQALRLRVRALVEREGHGA

SEQ ID NO: 73086 - DNA, 1233 bp, Thermoanaerobacter tengcongensis
  CDS (1)..(1233): transl_table=11
atgttaaaaggtgaaaaagtggtactggcatattcgggaggacttgacacctcagtgattataccatggttaaaagaaaattatgaatgtgaaataatagcggtatgcgtggatgtagggcaaagggaagacctaaggtatataaaagataaagctttagcaagtggtgccagcaaagtatatattgaagatgtcaaagaggagtttgtaaaagactatatatttcctacattaaaagcgggggctatatatgaaggaaaataccttctgggaacttcaatggcaaggcctttaattgccaaaaaacttgtagaaattgctcacaaggaaggtgccaaggcgatagcccatggtgcgacaggcaaaggcaatgaccaggtgaggtttgaagtttcaatacgtgctcttgatccttcaataaaaataatagcaccatggagaatatgggaattaaaatcgagggaagatgaaatagaatatgctaaaaagaaaggaatacctattcctgtaactaaagaaaaaatatacagtgtagacagcaatctgtggcatgtgagtcatgagggaggagaccttgaagacccgtggaatgagcctaaaagtgatatttacgatatagttactcctccagagaaagtctcagataagccggaatatgtctatatagagtttgaaaagggcattcctgtaaaggtaaatggaaaaacgctaagccctgtcaaattaatagaagaattaaatgaaattggaggaagaaatggggtagggatagttgaccttgttgaaaatagacttgtaggaatgaaatctcgtggtgtttacgagactcctgcaggaacgttactttatattgctcacagagaacttgagtaccttgtacttgataaagaaacgatgaggtttaaagagttggtagcacagaaatatgcggatctggtctataacggcctctggttttcacctctcaaaacagctttggatgcttttattgatgagacgcagaaaaatgtaacgggtgttgtaaggctaaagctttataaaggaaatgtcataaatgcgggtgcaaaatctccctattctctttacaacgaagaattcgcaacttttggtaaagatgaagtttacaaccaaaaagacgcagaaggatttataaacctctttgggctttctttaaaaattagggctttgatggaaatgggaaggaaggatatggatgaagctgtggggaggtag

SEQ ID NO: 73087 - protein, 410 aa, Thermoanaerobacter tengcongensis
MLKGEKVVLAYSGGLDTSVIIPWLKENYECEIIAVCVDVGQREDLRYIKDKALASGASKVYIEDVKEEFVKDYIFPTLKAGAIYEGKYLLGTSMARPLIAKKLVEIAHKEGAKAIAHGATGKGNDQVRFEVSIRALDPSIKIIAPWRIWELKSREDEIEYAKKKGIPIPVTKEKIYSVDSNLWHVSHEGGDLEDPWNEPKSDIYDIVTPPEKVSDKPEYVYIEFEKGIPVKVNGKTLSPVKLIEELNEIGGRNGVGIVDLVENRLVGMKSRGVYETPAGTLLYIAHRELEYLVLDKETMRFKELVAQKYADLVYNGLWFSPLKTALDAFIDETQKNVTGVVRLKLYKGNVINAGAKSPYSLYNEEFATFGKDEVYNQKDAEGFINLFGLSLKIRALMEMGRKDMDEAVGR

SEQ ID NO: 73088 - DNA, 1215 bp, Wolinella succinogenes
  CDS (1)..(1215): transl_table=11
atgtccaaaaaaatcaacaaaatcgtccttgcctattcgggaggtcttgacaccagcgtcatcttgaaatggcttcaagagcagtatcagtgtgaagtggtcaccttcacggcggatatcggtcaaggcgaagaggtcgagcctgcacgcgccaaagcgaaacttcttggaatcaaagaggagaacattttcatcaaagatctcaaagaggaatttgtccgcgactatgtttttcccatgtttcgagccaataccctttatgaaggcgaataccttctaggtacctctatcgctagaccccttatcgccaagcacctcgtggagatcgccaaagaggtcggagcggatgccatctctcatggcgccacaggcaaaggaaacgaccaagtgcgatttgagcttggaggctatgcgctcatgcccgatgtcaaagtggtcgccccctggagagagtgggatctaaactctcgtgaaaaactcctcgcctacgccgaaaaacatgggattcccatcgagaaaaagggcaaaaaatctccctactctatggacgccaacctcctgcatatctcctatgaagggggaatcctcgaagatcccgccagcgaacctgaggaggatatgtggagatggagcgtctctcctttggacgcacccgatgctccagagaggatcaccattgagtttgaaaggggcgatgccgtagggattaatggcgtgaaaatgtctcccgccaccctcctagccgagctcaatcgcctaggaggcaaacatggaatcgggcggcttgatcttgtggagaatcgctatgtcggaatgaaatctcgcggatgctatgaaactcccggaggcacgattcttctcaaagctcaccgcgccatcgaatcgctaaccctagatcgagaagagactcacctcaaagatgagatgatgccacgctacgctagcctcatctacaatggctactggttctctcctgagcgccgcgccctccaagccctcatcgatgagacacaaaaaaatgtcacgggcagcgttgggctcaaactctataagggcaatgtcatccttgcgggccgcacctccgagcgatcgctcttcaacaccgcctactccacctttgaagaggatagcgtctataaccaaaaagatgccgaaggcttcatcaagctcaacgctctacgcttcatcatcgcaggcaaggcgaatccatcatga

SEQ ID NO: 73089 - protein, 404 aa, Wolinella succinogenes
MSKKINKIVLAYSGGLDTSVILKWLQEQYQCEVVTFTADIGQGEEVEPARAKAKLLGIKEENIFIKDLKEEFVRDYVFPMFRANTLYEGEYLLGTSIARPLIAKHLVEIAKEVGADAISHGATGKGNDQVRFELGGYALMPDVKVVAPWREWDLNSREKLLAYAEKHGIPIEKKGKKSPYSMDANLLHISYEGGILEDPASEPEEDMWRWSVSPLDAPDAPERITIEFERGDAVGINGVKMSPATLLAELNRLGGKHGIGRLDLVENRYVGMKSRGCYETPGGTILLKAHRAIESLTLDREETHLKDEMMPRYASLIYNGYWFSPERRALQALIDETQKNVTGSVGLKLYKGNVILAGRTSERSLFNTAYSTFEEDSVYNQKDAEGFIKLNALRFIIAGKANPS

SEQ ID NO: 73090 - DNA, 1227 bp, Zymomonas mobilis
  CDS (1)..(1227): transl_table=11
atgaccgaaaaagtaaaacgcgtcgtgctcgcctattcaggtggacttgataccagcgttattttgaaatggttacaagaacattatggctgtgaagtcgtcacttttacggctgacctcggtcaaggcgaagagcttgaacccgcccgtaaaaaagccgaaatgatgggcattaagcctgaacatatttttatggacgatctccgcgaagaatttgttcgcgattttgttttcccaatgatgcgtgccaatgccctttatgaaggtcagtatttgctcggcacctcgattgcgagaccgttaatcgccaaacgccagattgaaatcgcgcgtcaggtcggtgccgatgccgtggcgcatggggcaaccggaaaaggaaatgaccagattcgttttgaactcggttattatgccttggcaccggatattaaggttatcgctccttggcgcgaatgggatctgaacagccgtagcaaattgattgcttatgctgaatcccgtcagattgcggttccgaaagataaacgcggcgaatcgcctttctcggtcgattccaatttgctccacacctcttcagaaggtaaaattctcgaagatccgtggcaggaagtgccggattatgtctattcccgcacggttaaccccgaagatgctccaaatacgccggaaatcatcaccattgatttcgaacgcggtgatgccatcgccattaacggtgaagccttgtcaccggcagaattgctgaccaagctcaacgaactgggtcgcaagcatggtatcggtcgtcttgatctggtcgaaaaccgttatatcggcatgaaatcacgcggtatgtatgaaaccccgggcggcacgattctgattcaggctcatcgcggtatcgaacagctgaccttggatggtggcgctatgcatctgaaagatgaattgatgccgcgctatgccgagctgatctataacggtttctggtattctccagaacgtgaaatgttgcaggccgctattgaccatagtcaggccagagtcagcggcacggttcgtctgaagctctataagggcagtgtgaatgttatcggccgtaaatcgccgaattcgctctattccgaaaaggtcgtgacctttgaagatgatgccggtgcttataaccagcaggatgcagctggctttatcaagctcaatgctttgcgtttgcgtttactcggtgaacgtaacgctaaaggcctttaa

SEQ ID NO: 73091 - protein, 408 aa, Zymomonas mobilis
MTEKVKRVVLAYSGGLDTSVILKWLQEHYGCEVVTFTADLGQGEELEPARKKAEMMGIKPEHIFMDDLREEFVRDFVFPMMRANALYEGQYLLGTSIARPLIAKRQIEIARQVGADAVAHGATGKGNDQIRFELGYYALAPDIKVIAPWREWDLNSRSKLIAYAESRQIAVPKDKRGESPFSVDSNLLHTSSEGKILEDPWQEVPDYVYSRTVNPEDAPNTPEIITIDFERGDAIAINGEALSPAELLTKLNELGRKHGIGRLDLVENRYIGMKSRGMYETPGGTILIQAHRGIEQLTLDGGAMHLKDELMPRYAELIYNGFWYSPEREMLQAAIDHSQARVSGTVRLKLYKGSVNVIGRKSPNSLYSEKVVTFEDDAGAYNQQDAAGFIKLNALRLRLLGERNAKGL

SEQ ID NO: 73092 - DNA, 25 bp, Artificial sequence
  primer
atgtctaagggaaaagtttgtttgg

SEQ ID NO: 73093 - DNA, 25 bp, Artificial sequence
  primer
ttacaaagtcaactcttcacctttg

SEQ ID NO: 73094 - protein, 417 aa, Artificial sequence
  consensus sequence
  Variant (2)..(3): Xaa in position 2 to 3 is any amino acid
  Variant (14)..(14): Xaa in position 14 is any amino acid
  Variant (16)..(17): Xaa in position 16 to 17 is any amino acid
  Variant (20)..(21): Xaa in position 20 to 21 is any amino acid
  Variant (22)..(26): Xaa in position 22 to 26 is any or no amino acid
  Variant (29)..(32): Xaa in position 29 to 32 is any amino acid
  Variant (35)..(35): Xaa in position 35 is any amino acid
  Variant (38)..(38): Xaa in position 38 is any amino acid
  Variant (39)..(39): Xaa in position 39 is any or no amino acid
  Variant (41)..(47): Xaa in position 41 to 47 is any amino acid
  Variant (50)..(52): Xaa in position 50 to 52 is any amino acid
  Variant (54)..(60): Xaa in position 54 to 60 is any amino acid
  Variant (61)..(62): Xaa in position 61 to 62 is any or no amino acid
  Variant (64)..(66): Xaa in position 64 to 66 is any amino acid
  Variant (69)..(74): Xaa in position 69 to 74 is any amino acid
  Variant (76)..(82): Xaa in position 76 to 82 is any amino acid
  Variant (85)..(85): Xaa in position 85 is any amino acid
  Variant (86)..(86): Xaa in position 86 is any or no amino acid
  Variant (93)..(93): Xaa in position 93 is any amino acid
  Variant (97)..(97): Xaa in position 97 is any amino acid
  Variant (99)..(99): Xaa in position 99 is any amino acid
  Variant (101)..(105): Xaa in position 101 to 105 is any amino acid
  Variant (107)..(109): Xaa in position 107 to 109 is any amino acid
  Variant (112)..(112): Xaa in position 112 is any amino acid
  Variant (114)..(114): Xaa in position 114 is any amino acid
  Variant (115)..(115): Xaa in position 115 is any or no amino acid
  Variant (118)..(118): Xaa in position 118 is any amino acid
  Variant (130)..(133): Xaa in position 130 to 133 is any amino acid
  Variant (136)..(136): Xaa in position 136 is any amino acid
  Variant (138)..(139): Xaa in position 138 to 139 is any amino acid
  Variant (140)..(141): Xaa in position 140 to 141 is any or no amino acid
  Variant (147)..(148): Xaa in position 147 to 148 is any amino acid
  Variant (149)..(156): Xaa in position 149 to 156 is any or no amino acid
  Variant (158)..(163): Xaa in position 158 to 163 is any amino acid
  Variant (165)..(168): Xaa in position 165 to 168 is any amino acid
  Variant (171)..(176): Xaa in position 171 to 176 is any amino acid
  Variant (177)..(180): Xaa in position 177 to 180 is any or no amino acid
  Variant (182)..(182): Xaa in position 182 is any amino acid
  Variant (184)..(184): Xaa in position 184 is any amino acid
  Variant (186)..(186): Xaa in position 186 is any amino acid
  Variant (188)..(189): Xaa in position 188 to 189 is any amino acid
  Variant (191)..(191): Xaa in position 191 is any amino acid
  Variant (193)..(193): Xaa in position 193 is any amino acid
  Variant (195)..(197): Xaa in position 195 to 197 is any amino acid
  Variant (202)..(215): Xaa in position 202 to 215 is any amino acid
  Variant (216)..(216): Xaa in position 216 is any or no amino acid
  Variant (218)..(219): Xaa in position 218 to 219 is any amino acid
  Variant (222)..(229): Xaa in position 222 to 229 is any amino acid
  Variant (230)..(230): Xaa in position 230 is any or no amino acid
  Variant (232)..(233): Xaa in position 232 to 233 is any amino acid
  Variant (235)..(236): Xaa in position 235 to 236 is any amino acid
  Variant (238)..(240): Xaa in position 238 to 240 is any amino acid
  Variant (242)..(252): Xaa in position 242 to 252 is any amino acid
  Variant (253)..(261): Xaa in position 253 to 261 is any or no amino acid
  Variant (264)..(269): Xaa in position 264 to 269 is any amino acid
  Variant (271)..(271): Xaa in position 271 is any amino acid
  Variant (274)..(274): Xaa in position 274 is any amino acid
  Variant (276)..(276): Xaa in position 276 is any amino acid
  Variant (281)..(282): Xaa in position 281 to 282 is any amino acid
  Variant (284)..(284): Xaa in position 284 is any amino acid
  Variant (289)..(289): Xaa in position 289 is any amino acid
  Variant (292)..(292): Xaa in position 292 is any amino acid
  Variant (295)..(295): Xaa in position 295 is any amino acid
  Variant (297)..(300): Xaa in position 297 to 300 is any amino acid
  Variant (303)..(305): Xaa in position 303 to 305 is any amino acid
  Variant (307)..(308): Xaa in position 307 to 308 is any amino acid
  Variant (312)..(329): Xaa in position 312 to 329 is any amino acid
  Variant (330)..(330): Xaa in position 330 is any or no amino acid
  Variant (332)..(332): Xaa in position 332 is any amino acid
  Variant (334)..(334): Xaa in position 334 is any amino acid
  Variant (336)..(337): Xaa in position 336 to 337 is any amino acid
  Variant (339)..(350): Xaa in position 339 to 350 is any amino acid
  Variant (352)..(353): Xaa in position 352 to 353 is any amino acid
  Variant (355)..(355): Xaa in position 355 is any amino acid
  Variant (357)..(357): Xaa in position 357 is any amino acid
  Variant (359)..(361): Xaa in position 359 to 361 is any amino acid
  Variant (366)..(370): Xaa in position 366 to 370 is any amino acid
  Variant (373)..(373): Xaa in position 373 is any amino acid
  Variant (375)..(377): Xaa in position 375 to 377 is any amino acid
  Variant (378)..(378): Xaa in position 378 is any or no amino acid
  Variant (380)..(395): Xaa in position 380 to 395 is any amino acid
  Variant (396)..(397): Xaa in position 396 to 397 is any or no amino acid
  Variant (400)..(400): Xaa in position 400 is any amino acid
  Variant (404)..(407): Xaa in position 404 to 407 is any amino acid
  Variant (408)..(416): Xaa in position 408 to 416 is any or no amino acid
KXXLAYSGGLDTSXIXXWLXXXXXXXEVXXXXADXGQXXEXXXXXXXKAXXXGXXXXXXXXXDXXXEFXXXXXXPXXXXXXXYEXXYLLGTSXARPXIXKXXXXXAXXXGAXAXXHGXTGKGNDQVRFEXXXXALXPXXXXIAPWRXXXXXXXXXXRXXXXXXAXXXXIPXXXXXXXXXXPXSXDXNXXHXSXEXXXLEDPXXXXXXXXXXXXXXXPXXAPXXXXXXXXXFXXGXXVXXXGXXXXXXXXXXXXXXXXXXXXLNXXXXXXGXGRXDXVENRXXGXKSRGXYEXPGXTXXXXAHXXXEXXTLDXXXXXXXXXXXXXXXXXXXYXGXWXXPXXXXXXXXXXXXQXXVXGXVXXXLYKGXXXXXGRXSXXXXLXXXXXXXXXXXXXXXXXXDAXGFIXXXXXXXXXXXXXL

SEQ ID NO: 73095 - protein, 26 aa, Artificial sequence
  protein pattern
  Variant (2)..(2): Xaa in position 2 is any amino acid
  Variant (5)..(5): Xaa in position 5 is Ile, Leu or Val
  Variant (7)..(7): Xaa in position 7 is any amino acid
  Variant (10)..(10): Xaa in position 10 is Asp, Gly, Asn or Ser
  Variant (12)..(13): Xaa in position 12 to 13 is any amino acid
  Variant (14)..(14): Xaa in position 14 is Gly or Asn
  Variant (15)..(15): Xaa in position 15 is Ile, Leu, Met or Val
  Variant (19)..(19): Xaa in position 19 is Glu or Gly
  Variant (20)..(20): Xaa in position 20 is any amino acid
  Variant (22)..(23): Xaa in position 22 to 23 is any amino acid
  Variant (24)..(24): Xaa in position 24 is any or no amino acid
  Variant (26)..(26): Xaa in position 26 is Ala, Gly or Leu
GXGRXDXVEXRXXXXKSRXXYXXXPX

SEQ ID NO: 73096 - protein, 26 aa, Artificial sequence
  protein pattern
  Variant (6)..(6): Xaa in position 6 is Phe, Ile, Leu, Met or Val
  Variant (10)..(10): Xaa in position 10 is Ile, Leu, Pro or Val
  Variant (12)..(18): Xaa in position 12 to 18 is any amino acid
  Variant (19)..(20): Xaa in position 19 to 20 is any or no amino acid
  Variant (22)..(25): Xaa in position 22 to 25 is any amino acid
  Variant (26)..(26): Xaa in position 26 is Ala or Cys
LLGTSXARPXIXXXXXXXXXAXXXXX

SEQ ID NO: 73097 - protein, 44 aa, Artificial sequence
  protein pattern
  Variant (2)..(2): Xaa in position 2 is any amino acid
  Variant (4)..(7): Xaa in position 4 to 7 is any amino acid
  Variant (8)..(8): Xaa in position 8 is Glu, Pro, Ser or Thr
  Variant (9)..(12): Xaa in position 9 to 12 is any amino acid
  Variant (13)..(13): Xaa in position 13 is Ile, Leu, Met or Val
  Variant (14)..(20): Xaa in position 14 to 20 is any amino acid
  Variant (21)..(21): Xaa in position 21 is Ala, Gln, Ser or Thr
  Variant (22)..(24): Xaa in position 22 to 24 is any amino acid
  Variant (25)..(25): Xaa in position 25 is Ala, Glu, Asn, Ser or Thr
  Variant (27)..(27): Xaa in position 27 is any amino acid
  Variant (28)..(28): Xaa in position 28 is Ala or Val
  Variant (29)..(29): Xaa in position 29 is any amino acid
  Variant (30)..(30): Xaa in position 30 is Ile, Leu, Met or Val
  Variant (31)..(31): Xaa in position 31 is any amino acid
  Variant (36)..(40): Xaa in position 36 to 40 is any amino acid
  Variant (41)..(41): Xaa in position 41 is Ala, Gly, Gln or Ser
  Variant (42)..(43): Xaa in position 42 to 43 is any amino acid
  Variant (44)..(44): Xaa in position 44 is Ala, Ser or Thr
YXGXXXXXXXXXXXXXXXXXXXXXXGXXXXXLYKGXXXXXXXXX

SEQ ID NO: 73098 - protein, 14 aa, Artificial sequence
  protein pattern
  Variant (2)..(2): Xaa in position 2 is any or no amino acid
  Variant (4)..(4): Xaa in position 4 is any or no amino acid
KXVXLAYSGGLDTS

SEQ ID NO: 73099 - protein, 14 aa, Artificial sequence
  protein pattern
  Variant (3)..(3): Xaa in position 3 is any amino acid
  Variant (4)..(4): Xaa in position 4 is Ala, Cys or Thr
  Variant (5)..(6): Xaa in position 5 to 6 is any amino acid
  Variant (7)..(7): Xaa in position 7 is Ala, Gly, Ile, Leu or Val
  Variant (8)..(8): Xaa in position 8 is Asp or Asn
  Variant (9)..(9): Xaa in position 9 is Gly, Ile, Leu or Val
  Variant (12)..(12): Xaa in position 12 is any amino acid
  Variant (13)..(13): Xaa in position 13 is any or no amino acid
EVXXXXXXXGQXXE

SEQ ID NO: 73100 - protein, 24 aa, Artificial sequence
  protein pattern
  Variant (2)..(2): Xaa in position 2 is any amino acid
  Variant (3)..(3): Xaa in position 3 is any or no amino acid
  Variant (6)..(6): Xaa in position 6 is any amino acid
  Variant (7)..(7): Xaa in position 7 is Ala, Asp, Glu or Gly
  Variant (8)..(8): Xaa in position 8 is Ile or Leu
  Variant (10)..(10): Xaa in position 10 is any amino acid
  Variant (11)..(11): Xaa in position 11 is Ile, Leu or Val
  Variant (12)..(12): Xaa in position 12 is Cys, Thr or Val
  Variant (13)..(13): Xaa in position 13 is Ile, Leu, Met or Val
  Variant (14)..(20): Xaa in position 14 to 20 is any amino acid
  Variant (21)..(21): Xaa in position 21 is Lys or Arg
  Variant (22)..(23): Xaa in position 22 to 23 is any amino acid
  Variant (24)..(24): Xaa in position 24 is Phe, Ile, Leu or Val
LXXAHXXXEXXXXXXXXXXXXXXX

SEQ ID NO: 73101 - DNA, 1323 bp, Saccharomyces cerevisiae
  CDS (1)..(1323)
atgcttgctgtcagaagattaacaagatacacattccttaagcgaacgcatccggtgttatatactcgtcgtgcatataaaattttgccttcaagatctactttcctaagaagatcattattacaaacacaactgcactcaaagatgactgctcatactaatatcaaacagcacaaacactgtcatgaggaccatcctatcagaagatcggactctgccgtgtcaattgtacatttgaaacgtgcgcccttcaaggttacagtgattggttctggtaactgggggaccaccatcgccaaagtcattgcggaaaacacagaattgcattcccatatcttcgagccagaggtgagaatgtgggtttttgatgaaaagatcggcgacgaaaatctgacggatatcataaatacaagacaccagaacgttaaatatctacccaatattgacctgccccataatctagtggccgatcctgatcttttacactccatcaagggtgctgacatccttgttttcaacatccctcatcaatttttaccaaacatagtcaaacaattgcaaggccacgtggcccctcatgtaagggccatctcgtgtctaaaagggttcgagttgggctccaagggtgtgcaattgctatcctcctatgttactgatgagttaggaatccaatgtggcgcactatctggtgcaaacttggcaccggaagtggccaaggagcattggtccgaaaccaccgtggcttaccaactaccaaaggattatcaaggtgatggcaaggatgtagatcataagattttgaaattgctgttccacagaccttacttccacgtcaatgtcatcgatgatgttgctggtatatccattgccggtgccttgaagaacgtcgtggcacttgcatgtggtttcgtagaaggtatgggatggggtaacaatgcctccgcagccattcaaaggctgggtttaggtgaaattatcaagttcggtagaatgtttttcccagaatccaaagtcgagacctactatcaagaatccgctggtgttgcagatctgatcaccacctgctcaggcggtagaaacgtcaaggttgccacatacatggccaagaccggtaagtcagccttggaagcagaaaaggaattgcttaacggtcaatccgcccaagggataatcacatgcagagaagttcacgagtggctacaaacatgtgagttgacccaagaattcccattattcgaggcagtctaccagatagtctacaacaacgtccgcatggaagacctaccggagatgattgaagagctagacatcgatgacgaatag

SEQ ID NO: 73102 - protein, 440 aa, Saccharomyces cerevisiae
MLAVRRLTRYTFLKRTHPVLYTRRAYKILPSRSTFLRRSLLQTQLHSKMTAHTNIKQHKHCHEDHPIRRSDSAVSIVHLKRAPFKVTVIGSGNWGTTIAKVIAENTELHSHIFEPEVRMWVFDEKIGDENLTDIINTRHQNVKYLPNIDLPHNLVADPDLLHSIKGADILVFNIPHQFLPNIVKQLQGHVAPHVRAISCLKGFELGSKGVQLLSSYVTDELGIQCGALSGANLAPEVAKEHWSETTVAYQLPKDYQGDGKDVDHKILKLLFHRPYFHVNVIDDVAGISIAGALKNVVALACGFVEGMGWGNNASAAIQRLGLGEIIKFGRMFFPESKVETYYQESAGVADLITTCSGGRNVKVATYMAKTGKSALEAEKELLNGQSAQGIITCREVHEWLQTCELTQEFPLFEAVYQIVYNNVRMEDLPEMIEELDIDDE

SEQ ID NO: 73103 - DNA, 1380 bp, Saccharomyces sp
  CDS (103)..(1278)
ctttaattttcttttatcttactctcctacataagacatcaagaaacaattgtatattgtacaccccccccctccacaaacacaaatattgataatataaagatgtctgctgctgctgatagattaaacttaacttccggccacttgaatgctggtagaaagagaagttcctcttctgtttctttgaaggctgccgaagggcctttcaaggttactgtgattggatctggtaactggggtactactattgccaaggtggttgccgaaaattgtaagggatacccagaagttttcgctccaatagtacaaatgtgggtgttcgaagaagagatcaatggtgaaaaattgactgaaatcataaatactagacatcaaaacgtgaaatacttgcctggcatcactctacccgacaatttggttgctaatccagacttgattgattcagtcaaggatgtcgacatcatcgttttcaacattccacatcaatttttgccccgtatctgtagccaattgaaaggtcatgttgattcacacgtcagagctatctcctgtctaaagggttttgaagttggtgctaaaggtgtccaattgctatcctcttacatcactgaggaactaggtattcaatgtggtgctctatctggtgctaacattgccaccgaagtcgctcaagaacactggtctgaaacaacagttgcttaccacattccaaaggatttcagaggcgagggcaaggacgtcgaccataaggttctaaaggccttgttccacagaccttacttccacgttagtgtcatcgaagatgttgctggtatctccatctgtggtgctttgaagaacgttgttgccttaggttgtggtttcgtcgaaggtctaggctggggtaacaacgcttctgctgccatccaaagagtcggtttgggtgagatcatcagattcggtcaaatgtttttcccagaatctagagaagaaacatactaccaagagtctgctggtgttgctgatttgatcaccacctgcgctggtggtagaaacgtcaaggttgctaggctaatggctacttctggtaaggacgcctgggaatgtgaaaaggagttgttgaatggccaatccgctcaaggtttaattacctgcaaagaagttcacgaatggttggaaacatgtggctctgtcgaagacttcccattatttgaagccgtataccaaatcgtttacaacaactacccaatgaagaacctgccggacatgattgaagaattagatctacatgaagattagatttattggagaaagataacatatcatacttcccccacttttttcgaggctcttctatatcatattcataaattagcattatgtcatttctcataactactt

SEQ ID NO: 73104 - protein, 391 aa, Saccharomyces sp
MSAAADRLNLTSGHLNAGRKRSSSSVSLKAAEGPFKVTVIGSGNWGTTIAKVVAENCKGYPEVFAPIVQMWVFEEEINGEKLTEIINTRHQNVKYLPGITLPDNLVANPDLIDSVKDVDIIVFNIPHQFLPRICSQLKGHVDSHVRAISCLKGFEVGAKGVQLLSSYITEELGIQCGALSGANIATEVAQEHWSETTVAYHIPKDFRGEGKDVDHKVLKALFHRPYFHVSVIEDVAGISICGALKNVVALGCGFVEGLGWGNNASAAIQRVGLGEIIRFGQMFFPESREETYYQESAGVADLITTCAGGRNVKVARLMATSGKDAWECEKELLNGQSAQGLITCKEVHEWLETCGSVEDFPLFEAVYQIVYNNYPMKNLPDMIEELDLHED

SEQ ID NO: 73105 - DNA, 2946 bp, Saccharomyces sp
  CDS (1439)..(2593)
gaattcgagcctgaagtgctgattaccttcaggtagacttcatcttgacccatcaaccccagcgtcaatcctgcaaatacaccacccagcagcactaggatgatagagataatatagtacgtggtaacgcttgcctcatcacctacgctatggccggaatcggcaacatccctagaattgagtacgtgtgatccggataacaacggcagtgaatatatcttcggtatcgtaaagatgtgatataagatgatgtatacccaatgaggagcgcctgatcgtgacctagaccttagtggcaaaaacgacatatctattatagtggggagagtttcgtgcaaataacagacgcagcagcaagtaactgtgacgatatcaactctttttttattatgtaataagcaaacaagcacgaatggggaaagcctatgtgcaatcaccaaggtcgtcccttttttcccatttgctaatttagaatttaaagaaaccaaaagaatgaagaaagaaaacaaatactagccctaaccctgacttcgtttctatgataataccctgctttaatgaacggtatgccctagggtatatctcactctgtacgttacaaactccggttattttatcggaacatccgagcacccgcgccttcctcaacccaggcaccgccccaggtaaccgtgcgcgatgagctaatcctgagccatcacccaccccacccgttgatgacagcaattcgggagggcgaaaataaaactggagcaaggaattaccatcaccgtcaccatcaccatcatatcgccttagcctctagccatagccatcatgcaagcgtgtatcttctaagattcagtcatcatcattaccgagtttgttttccttcacatgatgaagaaggtttgagtatgctcgaaacaataagacgacgatggctctgccattggttatattacgcttttgcggcgaggtgccgatgggttgctgaggggaagagtgtttagcttacggacctattgccattgttattccgattaatctattgttcagcagctcttctctaccctgtcattctagtattttttttttttttttttggttttacttttttttcttcttgcctttttttcttgttactttttttctagttttttttccttccactaagctttttccttgatttatccttgggttcttctttctactcctttagattttttttttatatattaatttttaagtttatgtattttggtagattcaattctctttccctttccttttccttcgctccccttccttatcaatgcttgctgtcagaagattaacaagatacacattccttaagcgaacgcatccggtgttatatactcgtcgtgcatataaaattttgccttcaagatctactttcctaagaagatcattattacaaacacaactgcactcaaagatgactgctcatactaatatcaaacagcacaaacactgtcatgaggaccatcctatcagaagatcggactctgccgtgtcaattgtacatttgaaacgtgcgcccttcaaggttacagtgattggttctggtaactgggggaccaccatcgccaaagtcattgcggaaaacacagaattgcattcccatatcttcgagccagaggtgagaatgtgggtttttgatgaaaagatcggcgacgaaaatctgacggatatcataaatacaagacaccagaacgttaaatatctacccaatattgacctgccccataatctagtggccgatcctgatcttttacactccatcaagggtgctgacatccttgttttcaacatccctcatcaatttttaccaaacatagtcaaacaattgcaaggccacgtggcccctcatgtaagggccatctcgtgtctaaaagggttcgagttgggctccaagggtgtgcaattgctatcctcctatgttactgatgagttaggaatccaatgtggcgcactatctggtgcaaacttggcaccggaagtggccaaggagcattggtccgaaaccaccgtggcttaccaactaccaaaggattatcaaggtgatggcaaggatgtagatcataagattttgaaattgctgttccacagaccttacttccacgtcaatgtcatcgatgatgttgctggtatatccattgccggtgccttgaagaacgtcgtggcacttgcatgtggtttcgtagaaggtatgggatggggtaacaatgcctccgcagccattcaaaggctgggtttaggtgaaattatcaagttcggtagaatgtttttcccagaatccaaagtcgagacctactatcaagaatccgctggtgttgcagatctgatcaccacctgctcaggcggtagaaacgtcaaggttgccacatacatggccaagaccggtaagtcagccttggaagcagaaaaggaattgcttaacggtcaatccgcccaagggataatcacatgcagagaagttcacgagtggctacaaacatgtgagttgacccaagaattcccaattattcgaggcagtctaccagatagtctacaacaacgtccgcatggaagacctaccggagatgattgaagagctagacatcgatgacgaatagacactctccccccccctccccctctgatctttcctgttgcctctttttcccccaaccaatttatcattatacacaagttctacaactactactagtaacattactacagttattataattttctattctctttttctttaagaatctatcattaacgttaatttctatatatacataactaccattatacacgctattatcgtttacatatcacatcaccgttaatgaaagatacgacaccctgtacactaacacaattaaataatcgccataaccttttctgttatctatagcccttaaagctgtttcttcgagcttttcactgcag

SEQ ID NO: 73106 - protein, 384 aa, Saccharomyces sp
MTAHTNIKQHKHCHEDHPIRRSDSAVSIVHLKRAPFKVTVIGSGNWGTTIAKVIAENTELHSHIFEPEVRMWVFDEKIGDENLTDIINTRHQNVKYLPNIDLPHNLVADPDLLHSIKGADILVFNIPHQFLPNIVKQLQGHVAPHVRAISCLKGFELGSKGVQLLSSYVTDELGIQCGALSGANLAPEVAKEHWSETTVAYQLPKDYQGDGKDVDHKILKLLFHRPYFHVNVIDDVAGISIAGALKNVVALACGFVEGMGWGNNASAAIQRLGLGEIIKFGRMFFPESKVETYYQESAGVADLITTCSGGRNVKVATYMAKTGKSALEAEKELLNGQSAQGIITCREVHEWLQTCELTQEFPIIRGSLPDSLQQRPHGRPTGDD

SEQ ID NO: 73107 - DNA, 2946 bp, Klebsiella pneumoniae
  CDS (1439)..(2593)
gaattcgagcctgaagtgctgattaccttcaggtagacttcatcttgacccatcaaccccagcgtcaatcctgcaaatacaccacccagcagcactaggatgatagagataatatagtacgtggtaacgcttgcctcatcacctacgctatggccggaatcggcaacatccctagaattgagtacgtgtgatccggataacaacggcagtgaatatatcttcggtatcgtaaagatgtgatataagatgatgtatacccaatgaggagcgcctgatcgtgacctagaccttagtggcaaaaacgacatatctattatagtggggagagtttcgtgcaaataacagacgcagcagcaagtaactgtgacgatatcaactctttttttattatgtaataagcaaacaagcacgaatggggaaagcctatgtgcaatcaccaaggtcgtcccttttttcccatttgctaatttagaatttaaagaaaccaaaagaatgaagaaagaaaacaaatactagccctaaccctgacttcgtttctatgataataccctgctttaatgaacggtatgccctagggtatatctcactctgtacgttacaaactccggttattttatcggaacatccgagcacccgcgccttcctcaacccaggcaccgccccaggtaaccgtgcgcgatgagctaatcctgagccatcacccaccccacccgttgatgacagcaattcgggagggcgaaaataaaactggagcaaggaattaccatcaccgtcaccatcaccatcatatcgccttagcctctagccatagccatcatgcaagcgtgtatcttctaagattcagtcatcatcattaccgagtttgttttccttcacatgatgaagaaggtttgagtatgctcgaaacaataagacgacgatggctctgccattggttatattacgcttttgcggcgaggtgccgatgggttgctgaggggaagagtgtttagcttacggacctattgccattgttattccgattaatctattgttcagcagctcttctctaccctgtcattctagtattttttttttttttttttggttttacttttttttcttcttgcctttttttcttgttactttttttctagttttttttccttccactaagctttttccttgatttatccttgggttcttctttctactcctttagattttttttttatatattaatttttaagtttatgtattttggtagattcaattctctttccctttccttttccttcgctccccttccttatcaatgcttgctgtcagaagattaacaagatacacattccttaagcgaacgcatccggtgttatatactcgtcgtgcatataaaattttgccttcaagatctactttcctaagaagatcattattacaaacacaactgcactcaaagatgactgctcatactaatatcaaacagcacaaacactgtcatgaggaccatcctatcagaagatcggactctgccgtgtcaattgtacatttgaaacgtgcgcccttcaaggttacagtgattggttctggtaactgggggaccaccatcgccaaagtcattgcggaaaacacagaattgcattcccatatcttcgagccagaggtgagaatgtgggtttttgatgaaaagatcggcgacgaaaatctgacggatatcataaatacaagacaccagaacgttaaatatctacccaatattgacctgccccataatctagtggccgatcctgatcttttacactccatcaagggtgctgacatccttgttttcaacatccctcatcaatttttaccaaacatagtcaaacaattgcaaggccacgtggcccctcatgtaagggccatctcgtgtctaaaagggttcgagttgggctccaagggtgtgcaattgctatcctcctatgttactgatgagttaggaatccaatgtggcgcactatctggtgcaaacttggcaccggaagtggccaaggagcattggtccgaaaccaccgtggcttaccaactaccaaaggattatcaaggtgatggcaaggatgtagatcataagattttgaaattgctgttccacagaccttacttccacgtcaatgtcatcgatgatgttgctggtatatccattgccggtgccttgaagaacgtcgtggcacttgcatgtggtttcgtagaaggtatgggatggggtaacaatgcctccgcagccattcaaaggctgggtttaggtgaaattatcaagttcggtagaatgtttttcccagaatccaaagtcgagacctactatcaagaatccgctggtgttgcagatctgatcaccacctgctcaggcggtagaaacgtcaaggttgccacatacatggccaagaccggtaagtcagccttggaagcaggaaaggaattgcttaacggtcaatccgcccaaggcataatcacatgcagagaagttcacgagtggctacaaacatgtgagttgacccaagaattcccaattattcgaggcagtctaccagatagtctacaacaacgtccgcatggaagacctaccggagatgattgaagagctagacatcgatgacgaatagacactctccccccccctccccctctgatctttcctgttgcctctttttcccccaaccaatttatcattatacacaagttctacaactactactagtaacattactacagttattataattttctattctctttttctttaagaatctatcattaacgttaatttctatatatacataactaccattatacacgctattatcgtttacatatcacatcaccgttaatgaaagatacgacaccctgtacactaacacaattaaataatcgccataaccttttctgttatctatagcccttaaagctgtttcttcgagcttttcactgcag

SEQ ID NO: 73108 - protein, 384 aa, Klebsiella pneumoniae
MTAHTNIKQHKHCHEDHPIRRSDSAVSIVHLKRAPFKVTVIGSGNWGTTIAKVIAENTELHSHIFEPEVRMWVFDEKIGDENLTDIINTRHQNVKYLPNIDLPHNLVADPDLLHSIKGADILVFNIPHQFLPNIVKQLQGHVAPHVRAISCLKGFELGSKGVQLLSSYVTDELGIQCGALSGANLAPEVAKEHWSETTVAYQLPKDYQGDGKDVDHKILKLLFHRPYFHVNVIDDVAGISIAGALKNVVALACGFVEGMGWGNNASAAIQRLGLGEIIKFGRMFFPESKVETYYQESAGVADLITTCSGGRNVKVATYMAKTGKSALEAGKELLNGQSAQGIITCREVHEWLQTCELTQEFPIIRGSLPDSLQQRPHGRPTGDD

SEQ ID NO: 73109 - DNA, 1299 bp, Saccharomyces cerevisiae
  CDS (1)..(1299)
atgcttgctgtcagaagattaacaagatacacattccttaagcgaacgcatccggtgttatatactcgtcgtgcatataaaattttgccttcaagatctactttcctaagaagatcattattacaaacacaactgcactcaaagatgactgctcatactaatatcaaacagcacaaacactgtcatgaggaccatcctatcagaagatcggactctgccgtgtcaattgtacatttgaaacgtgcgcccttcaaggttacagtgattggttctggtaactgggggaccaccatcgccaaagtcattgcggaaaacacagaattgcattcccatatcttcgagccagaggtgagaatgtgggtttttgatgaaaagatcggcgacgaaaatctgacggatatcataaatacaagacaccagaacgttaaatatctacccaatattgacctgccccataatctagtggccgatcctgatcttttacactccatcaagggtgctgacatccttgttttcaacatccctcatcaatttttaccaaacatagtcaaacaattgcaaggccacgtggcccctcatgtaagggccatctcgtgtctaaaagggttcgagttgggctccaagggtgtgcaattgctatcctcctatgttactgatgagttaggaatccaatgtggcgcactatctggtgcaaacttggcaccggaagtggccaaggagcattggtccgaaaccaccgtggcttaccaactaccaaaggattatcaaggtgatggcaaggatgtagatcataagattttgaaattgctgttccacagaccttacttccacgtcaatgtcatcgatgatgttgctggtatatccattgccggtgccttgaagaacgtcgtggcacttgcatgtggtttcgtagaaggtatgggatggggtaacaatgcctccgcagccattcaaaggctgggtttaggtgaaattatcaagttcggtagaatgtttttcccagaatccaaagtcgagacctactatcaagaatccgctggtgttgcagatctgatcaccacctgctcaggcggtagaaacgtcaaggttgccacatacatggccaagaccggtaagtcagccttggaagcagaaaaggaattgcttaacggtcaatccgcccaagggataatcacatgcagagaagttcacgagtggctacaaacatgtgagttgacccaagaattcccaattattcgaggcagtctaccagatagtctacaacaacgtccgcatggaagacctaccggagatgattga

SEQ ID NO: 73110 - protein, 432 aa, Saccharomyces cerevisiae
MLAVRRLTRYTFLKRTHPVLYTRRAYKILPSRSTFLRRSLLQTQLHSKMTAHTNIKQHKHCHEDHPIRRSDSAVSIVHLKRAPFKVTVIGSGNWGTTIAKVIAENTELHSHIFEPEVRMWVFDEKIGDENLTDIINTRHQNVKYLPNIDLPHNLVADPDLLHSIKGADILVFNIPHQFLPNIVKQLQGHVAPHVRAISCLKGFELGSKGVQLLSSYVTDELGIQCGALSGANLAPEVAKEHWSETTVAYQLPKDYQGDGKDVDHKILKLLFHRPYFHVNVIDDVAGISIAGALKNVVALACGFVEGMGWGNNASAAIQRLGLGEIIKFGRMFFPESKVETYYQESAGVADLITTCSGGRNVKVATYMAKTGKSALEAEKELLNGQSAQGIITCREVHEWLQTCELTQEFPIIRGSLPDSLQQRPHGRPTGDD

SEQ ID NO: 73111 - DNA, 1197 bp, Yarrowia lipolytica
  CDS (40)..(1197)
atgagcgctctacttagatcgtccctgcgttttaaacacatgtccgccgtcaaccgtctcacacaacagcttcgactgctgaccgcctccgcgcctctcagcgcagccaacaccgccggcaaggctcctttcaaggtcgccgttgttggttctggtaactggggaaccaccgtcgccaagattgtcgccgagaactgcactgctcaccccgagctctttgagcccgaggttcgagtctgggttcgagaagagaaggtcaacggcaagaacctgaccgacattttcaacgctgagcacgagaacgtgcgatacctccctaaaatcaaacttcctcacaacctgatcgccgagccggatctgctcaaggccgtcgagggtgccaacatcatcgtcttcaacctgccccatcagttcctggctggtgtctgcaagcagctcaagggccacgtcaaccccaaggctagagccatctcctgcctcaagggtctagatgtcaccccccagggtgtttacctgctctccgacgttatcgagaacgagaccggtctccactgcggtgttctgtccggggctaacctcgccaccgagatcgctctggagaagtactccgagactaccgttgcttacaaccgacccaaggacttctttggcgagggtgatgtgaccaacgatgtgctcaaggctctgttccaccgaccctacttccatgtgcgatgcgttcaggacgtcgccggtgtctccatcggaggtgcccttaagaacgttgttgccctttgcgccggtttcgtcgagggcaagaactggggagacaacgccaaggccgcaattatgcgacgaggcatgcttgagatgatcaacttctccaagcgattcttccccgaaactgatattaacactcttacagtcgagtctgccggtgtggccgatctcatcacctcgtgcgctggaggccgaaacttcaaggtcggccgagcattcggaaaggagagcggctccggcaagaccatccaggacgtggagaaggagcttctcaacggccagtccgcccagggcgtcatcacatgtaacgaggtccacgagctgctcaagaacaagaacatgcagaaggacttccctctgttcgagtccacctggggcattatccacggtgagctcaagattgatgatctccccgagattctttaccacgccaactag

SEQ ID NO: 73112 - protein, 385 aa, Yarrowia lipolytica
MSAVNRLTQQLRLLTASAPLSAANTAGKAPFKVAVVGSGNWGTTVAKIVAENCTAHPELFEPEVRVWVREEKVNGKNLTDIFNAEHENVRYLPKIKLPHNLIAEPDLLKAVEGANIIVFNLPHQFLAGVCKQLKGHVNPKARAISCLKGLDVTPQGVYLLSDVIENETGLHCGVLSGANLATEIALEKYSETTVAYNRPKDFFGEGDVTNDVLKALFHRPYFHVRCVQDVAGVSIGGALKNVVALCAGFVEGKNWGDNAKAAIMRRGMLEMINFSKRFFPETDINTLTVESAGVADLITSCAGGRNFKVGRAFGKESGSGKTIQDVEKELLNGQSAQGVITCNEVHELLKNKNMQKDFPLFESTWGIIHGELKIDDLPEILYHAN

SEQ ID NO: 73113 - DNA, 1203 bp, Arabidopsis thaliana
  CDS (1)..(1203)
atgcgcttccgatcattcttcttctcctcctctatcttctccctttcacattctcgctctccttctctttcttcctctcgtttctcctctctctccgccgctatgtctcctgctctcgagaaatcccgacaaggcaatggtggatgtaatgatgattcgaaatctaaggtcacggtcgttggtagtggcaattggggaagtgttgctgctaagctcattgcttctaatgccctcaagcttccttctttccatgatgaagtgaggatgtgggtgtttgaggaggttctaccaaatggtgagaagctcaatgatgttatcaacaagaccaatgaaaatgtcaagtacctccctgggattaagctaggaagaaatgttgttgcggatcctgaccttgaaaatgcagtgaaggacgcgaacatgttggtttttgttacaccgcatcagtttatggatggtatatgcaagaagttagatggaaagatcacaggagatgttgaggctatatctcttgttaaaggaatggaagtgaagaaggaaggtccttgtatgatctcaagtctcatttccaagcaacttggtatcaattgttgtgttcttatgggcgcaaacattgcaaacgagatagctgtggagaagtttagtgaagcaacggttggatatagagggagtagagaaatagcggacacatgggttcagttgtttagtactccgtattttatggtcacaccggtccatgatgtggaaggagtagagttatgtgggactttgaagaatgtagttgctattgcagcgggtttcgtggacggtttggaaatgggtaataacacaaaggctgcaatcatgaggattggtctaagagagatgaaagcactctcaaagcttttgtttccatctgttaaagatagtactttcttcgagagctgcggtgtagcagatgtcattacaacttgcttaggaggaagaaaccggagagttgcggaagcatttgcaaaaagcagaggaaaaaggtcttttgatgagcttgaagcagagatgctacaagggcaaaagctacagggggtatcgacggcaagagaggtctacgaggtgttgaaacattgtggatggttggagatgtttccgctcttttcaacggttcaccaaatctgcactggtcgtcttcaacctgaagccatcgtccaataccgcgagaacaaactataa

SEQ ID NO: 73114 - protein, 400 aa, Arabidopsis thaliana
MRFRSFFFSSSIFSLSHSRSPSLSSSRFSSLSAAMSPALEKSRQGNGGCNDDSKSKVTVVGSGNWGSVAAKLIASNALKLPSFHDEVRMWVFEEVLPNGEKLNDVINKTNENVKYLPGIKLGRNVVADPDLENAVKDANMLVFVTPHQFMDGICKKLDGKITGDVEAISLVKGMEVKKEGPCMISSLISKQLGINCCVLMGANIANEIAVEKFSEATVGYRGSREIADTWVQLFSTPYFMVTPVHDVEGVELCGTLKNVVAIAAGFVDGLEMGNNTKAAIMRIGLREMKALSKLLFPSVKDSTFFESCGVADVITTCLGGRNRRVAEAFAKSRGKRSFDELEAEMLQGQKLQGVSTAREVYEVLKHCGWLEMFPLFSTVHQICTGRLQPEAIVQYRENKL

SEQ ID NO: 73115 - DNA, 1002 bp, Oryza sativa (japonica cultivar-group)
  CDS (1)..(1002)
atggagaacggacacgccaagaatcttgtggccgtcatcggcagcggcaactggggcagcgtcgcctcccgcctcatcgcttctaacaccgctaagttgccctcctttcatgatgaagtaaggatgtgggtgtttgaagaaatattaccaacaggcaagaagctctctgagtccattaaccaagcaaatgagaattgcaaatacttacctggtataaagctcggagctaatgtaattgctgatcctgatttggagaatgcagtgaaagatgcaaatatgcttgtttttgtgactccccatcaatttgtggagggtatatgtaagaagcttgtgggtaaactaaggccaggaactgagggtatctccctcatcaagggcatggagattgctgttgagaaattcagtgaagcgacaattggatataagaaagacaaggaagtggcaacccgatgggctaaactttttacaacaccttacttcctggtttctgttgtagaggatattgaaggagttgaattatgtggaacactgaaaaatgtcgtggccattgcagcaggtcttgttgatggtttggatatggggaacaataccaaggctgcaataatgaggattggtttgcgggaaatgcgtgctttctctaagcttctatcccctacagtcagggacaacactttctttgagagctgtggtgtggctgacctaataactacatgccttggtgggagaaacagaagagtcgctgaggcctttgcacgaaatggtggcaaaaggtcttttgatgagttggaggccgagatgctacatggccaaaaacttcagggagtgtccacagcaaaagaagtttatgaagtcttgacttatcgagggtggcaagaattgtttcctcttctgtccacagtgcatgagatttgtattggtcagctacctcctacatcaatagttgaatacagtgagcacacgcccaacctctccatcatcaatggttctaatgcgtattactga

SEQ ID NO: 73116 - protein, 333 aa, Oryza sativa (japonica cultivar-group)
MENGHAKNLVAVIGSGNWGSVASRLIASNTAKLPSFHDEVRMWVFEEILPTGKKLSESINQANENCKYLPGIKLGANVIADPDLENAVKDANMLVFVTPHQFVEGICKKLVGKLRPGTEGISLIKGMEIAVEKFSEATIGYKKDKEVATRWAKLFTTPYFLVSVVEDIEGVELCGTLKNVVAIAAGLVDGLDMGNNTKAAIMRIGLREMRAFSKLLSPTVRDNTFFESCGVADLITTCLGGRNRRVAEAFARNGGKRSFDELEAEMLHGQKLQGVSTAKEVYEVLTYRGWQELFPLLSTVHEICIGQLPPTSIVEYSEHTPNLSIINGSNAYY

SEQ ID NO: 73117 - DNA, 1302 bp, Magnaporthe grisea 70-15
  CDS (1)..(1302)
atggcttcacttgggagctacgcgaagaaacacaaggtcacgatcattggatcggggaactggggctctaccattgccaagattgtggccgagagcacaagagaacacaaggatgttttcgaagaagatgtgcagatgtgggtgtttgaggagaaggttacaatcccaaaggattcgccatactacgagagcgaagagccacaaaagctcacagaggtaatcaacaaacaccacgaaaacgtcaagtacctccctggtatcaaactgccatccaacatcattgccaacccctcgctcaccgacgctgtccgcgactcatccgtcctcgtcttcaacttgccccatgagttcctcggcaaggtttgccagcagctcaatggtcacattgtaccatttgcccgaggaatatcttgcatcaagggcgtggacgtgtcgggctccggcatcaacctgttttgcgaggtcatcggcgagaaattgggcatttactgtggtgcactctccggagccaacgtggcatctcagattgctgcagaggaaggcgtcagcgagaccactatcgcctacgacccgccgcccattgacagcagccgcgcggctactccccgcgaccgctcgcctaactacgattccaccagcgcaaacaagcttcctgacttgaccgtgacgtcggccgactccaacgggaaagatgacaggggccgcaggaccaaggcgaaactgactcctgtacctgagtcgtatccgccactcgaccacgggacattgcaaattctcttcgaccgtccttacttttccgtttccatggtgtctgacgtggctggcgtgtcgctcagcggtgccttgaagaacatcgtcgccctcgctgctggatttgtcgacggcaagggctggggttccaacgtgcagtcggcagtgattcgagttggcctggcagaaatgctcaaattcgcccgcgagttctttggggagtcggtcgatccgttcacgattctgctcgaaagtgccggcgtggctgatgtcatcacatcatgcatcagtggaagaaatttccgttgcgcgagcatggcagtcaagcgaggtgtatccgttgctgaaatcgaggaaaaggaacttaatggacagaagttgcagggaacctctaccgccaaagaagtaaacagcctgttgaaggcacgtggcagggagggcgactatcccctgttcaccactgttaatgaaattcttgaaggcaaggcgagagtggacgaccttcccaagctcgtcatccgacaaaagcacaccatcgagaaatcaggctag

SEQ ID NO: 73118 - protein, 433 aa, Magnaporthe grisea 70-15
MASLGSYAKKHKVTIIGSGNWGSTIAKIVAESTREHKDVFEEDVQMWVFEEKVTIPKDSPYYESEEPQKLTEVINKHHENVKYLPGIKLPSNIIANPSLTDAVRDSSVLVFNLPHEFLGKVCQQLNGHIVPFARGISCIKGVDVSGSGINLFCEVIGEKLGIYCGALSGANVASQIAAEEGVSETTIAYDPPPIDSSRAATPRDRSPNYDSTSANKLPDLTVTSADSNGKDDRGRRTKAKLTPVPESYPPLDHGTLQILFDRPYFSVSMVSDVAGVSLSGALKNIVALAAGFVDGKGWGSNVQSAVIRVGLAEMLKFAREFFGESVDPFTILLESAGVADVITSCISGRNFRCASMAVKRGVSVAEIEEKELNGQKLQGTSTAKEVNSLLKARGREGDYPLFTTVNEILEGKARVDDLPKLVIRQKHTIEKSG

SEQ ID NO: 73119 - DNA, 1254 bp, Gibberella zeae PH-1
  CDS (1)..(1254)
atggcgagcttgggcgctccttcaaagaagcacaaggtgaccattgtgggatccggcaactggggctcaactattgccaagatagttgctgaaaacacccgcgcacacaaggaactcttcgaggaagatgtccagatgtgggtctacgaggagaacgtaacaattcccaaggagtctaaactctatgacgaagccaacggcgatgcaccccaaaaactcacagaggtcatcaacaagcaccacgagaacgtcaagtacctaccgggcattcctctgcccacaaacctcatcgccaaccccgacatccgcgacgctgtcaaggactcctccatccttgttttcaacctgccccaccagtttatcgcaaacgtctgcaagcagatcaacggacatattctcccctttgctcgaggaatcagctgtatcaagggtgttaatgttactgacacagacattagcttgttcagcgagtggattggcgatggactaggtatctactgtggtgccctcagtggtgctaacctggctcgagaaattgccgaggagaagtggtcagagacaaccatcgcttatgatcctcctgctcttgataacagcagagctcccacacctcgatccggtagccccaacccaacaatgggtgagctccctgaagcccatcacaaggacgttcgtggtcgaacatccaagacaaagttgaccgccatgcccgctgagtaccctcctctggaccagcactgcttccgaacgctgttccaccgaccttacttccacgttcagatggtttccgacgtcgctggtgtatccctgagcggtgcgttgaagaacgtcgttgctttggcagctggtttcgtcgatggccgaggctggggtgacaatgccaaggcagccatcatgcgtgttggacttatggagatggtcaagtttggcaaggagttctttggtgagactgtccacaccgccacctttacagagtcatctgctggtgttgccgatctgatcacatcctgttccggaggccgtaacttccgatgtgccaagatggctgtccaaaagggcattagcgttcaagaagtcgagaagcaggagctcaatggtcaaaagatccagggtacaaccaccgccgaggaggtgaacagtttcctcaaggctcgaggtctcgagtcggagtatcctctgttcacagccgtcaacgccattttgaacggcgaggcgcaggtggacgatattcctactcttatccaggattcttga

SEQ ID NO: 73120 - protein, 417 aa, Gibberella zeae PH-1
MASLGAPSKKHKVTIVGSGNWGSTIAKIVAENTRAHKELFEEDVQMWVYEENVTIPKESKLYDEANGDAPQKLTEVINKHHENVKYLPGIPLPTNLIANPDIRDAVKDSSILVFNLPHQFIANVCKQINGHILPFARGISCIKGVNVTDTDISLFSEWIGDGLGIYCGALSGANLAREIAEEKWSETTIAYDPPALDNSRAPTPRSGSPNPTMGELPEAHHKDVRGRTSKTKLTAMPAEYPPLDQHCFRTLFHRPYFHVQMVSDVAGVSLSGALKNVVALAAGFVDGRGWGDNAKAAIMRVGLMEMVKFGKEFFGETVHTATFTESSAGVADLITSCSGGRNFRCAKMAVQKGISVQEVEKQELNGQKIQGTTTAEEVNSFLKARGLESEYPLFTAVNAILNGEAQVDDIPTLIQDS

SEQ ID NO: 73121 - DNA, 1320 bp, Kluyveromyces lactis NRRL Y-1140
  CDS (1)..(1320)
atgattcctagtagttgtgttattggtagaagttttggttataatttgatacatcaaaacatatcaagcaagctcagaggtatattcaaacattatactaaaagttctactgctaatacaataaaaattacaaacacaaacacgatttccaacatgagtccagcttccgatagattaaagcaaacttcctcgattctttctaagtccgttgaacctcaagccgatgcacctttcaaggttacagttgtcggttctggtaactggggtactactatcgccaaggttgttgctgaaaactgtgctttgagacctaacctatttgtcaacagagttgatatgtgggttttcgaagaaaacattaacggtgaaaagttgactgaaatcatcaacactcgtcacgaaaacgtcaaatatttgccaggtattaagcttccaagtaatttggttgctaacccagacttggtcgatgctgctaaggacgctgatatccttgtctttaacattcctcatcaattcttgccaagaatctgttctcaactaaagggtaacgtgaagcctcaggctcgtgctatctcttgtttgaagggtttcgacgtcggtaaggatggtgttaagctattgtctacttatatcaaggaaactttgaatatcgaatgtggtgctctatccggtgctaacttggctccagaagtcgccaaggaaaattggtccgaaaccactgttgcataccaaatcccagaagattacaagggtccaggtaaggatgttgaccattctttgttgaaagccttgttccacagaccttacttccacgtcaacgtcattgaagatgttgctggtatttcggtcgcgggtgctttgaagaacgttatcgccttaggttgtggttacgttgaaggtttgggctggggtaacaacgccagtgctgccattcaaagagtcggtctctctgaaatgatcaaatttggtcgtactttcttcccagaatgtaaggtcgaaacttacttccaagaatctgccggtgttgctgatttgatcaccacttgtgccggtggtagaaacgtaagagttgcgaaacacatggccatcactggtaagtctgctgaagaagctgaaaaggagctattgaacggtcaatccgctcaaggtattatcacaactaaggaagtccacgaatggttggctacctgtggtaagactgctgagttcccattgttcgaagctatctaccaaatcacttacggtaatgcttctatggaacaaatcccagacatgatcgaagacttcgaaggtatcgactacaacgtcaagaagcattaa

SEQ ID NO: 73122 - protein, 439 aa, Kluyveromyces lactis NRRL Y-1140
MIPSSCVIGRSFGYNLIHQNISSKLRGIFKHYTKSSTANTIKITNTNTISNMSPASDRLKQTSSILSKSVEPQADAPFKVTVVGSGNWGTTIAKVVAENCALRPNLFVNRVDMWVFEENINGEKLTEIINTRHENVKYLPGIKLPSNLVANPDLVDAAKDADILVFNIPHQFLPRICSQLKGNVKPQARAISCLKGFDVGKDGVKLLSTYIKETLNIECGALSGANLAPEVAKENWSETTVAYQIPEDYKGPGKDVDHSLLKALFHRPYFHVNVIEDVAGISVAGALKNVIALGCGYVEGLGWGNNASAAIQRVGLSEMIKFGRTFFPECKVETYFQESAGVADLITTCAGGRNVRVAKHMAITGKSAEEAEKELLNGQSAQGIITTKEVHEWLATCGKTAEFPLFEAIYQITYGNASMEQIPDMIEDFEGIDYNVKKH

SEQ ID NO: 73123 - DNA, 1170 bp, Debaryomyces hansenii CBS767
  CDS (1)..(1170)
atgtcacaatatagagccaatcaaagattacaacagttatcgaatatattacgtcctaatcagcttagtgctgaaaaatcgttaaagccagaaactccattcaaggttgctgtgattggatccggtaactgggggactacaattgccaaggttttagccgaaaacacggccgaaaagccagacacttttgctaaacaggtcgatatgtgggttttccaagagaagattgatggtactaacttgactgagatcatcaacaataagcacgaaaatgtgaaatatttgccaggggttaagttgccagaaaacttgcatgcagagcctgatatcgttaaggctgcgcaaggtgccgatttattggtattcaacttgcctcatcaatttttacctaagatctgtaagcagttgaaaggtactttgaagccaaccaccagagcaatttcgtgtttgaaagggttagaagttactccagatgggtgcaaattgttatcaacttacattactgaaaacttaggaatcgaatgtggtgctttatctggtgctaacttggctccagaagttgctagatgcaaatggtctgaaactactgttgcatacaacattccagctgactttaaaggtccaggtaaagatattgatagtgctgttttaaaggaagcattccacagaccttactttcatgtaaatgttattgaagatgttgcaggtgtttctgtagctggtgcattgaagaacattgttgcgattgctgtgggctttgttgaaggattaggctggggtgacaatgctaaatcggctattatgagagttggtttaattgaaactatcaatttttcaaatatgtttttcccaaattctaagccaactacattcacccacgaatctgctggtgttgctgatttaatcaccacttgttccggtggtagaaatgttaaggtcggtagacatatgtcgaaaacaggcgaatctgctgaagaagcagaaaagaaattattgaatggccaatcctcgcaaggtatcatcactgcaaaggaagtccatgagttattaagcaatgttggtaagactgatcaattcccattatttgaagctacttatcaaattatatacggtgatgaatctattcaaaacttgccaaacttattagaagaccattcattattcaaatag

SEQ ID NO: 73124 - protein, 389 aa, Debaryomyces hansenii CBS767
MSQYRANQRLQQLSNILRPNQLSAEKSLKPETPFKVAVIGSGNWGTTIAKVLAENTAEKPDTFAKQVDMWVFQEKIDGTNLTEIINNKHENVKYLPGVKLPENLHAEPDIVKAAQGADLLVFNLPHQFLPKICKQLKGTLKPTTRAISCLKGLEVTPDGCKLLSTYITENLGIECGALSGANLAPEVARCKWSETTVAYNIPADFKGPGKDIDSAVLKEAFHRPYFHVNVIEDVAGVSVAGALKNIVAIAVGFVEGLGWGDNAKSAIMRVGLIETINFSNMFFPNSKPTTFTHESAGVADLITTCSGGRNVKVGRHMSKTGESAEEAEKKLLNGQSSQGIITAKEVHELLSNVGKTDQFPLFEATYQIIYGDESIQNLPNLLEDHSLFK

SEQ ID NO: 73125 - DNA, 1254 bp, Aspergillus nidulans FGSC A4
  CDS (1)..(1254)
atgggctctcttggaccgtataagcaaaagcacaaggtgactgtggtgggatcgggtaactggggcaccgctatagccaaaatcgtcgccgagaatactgccagcaaccctgcggtctttgagaaggatgttcagatgtgggttttcgaggaaaaggtcgagattccgaaatcgtcgaagcattatgatcctgcctcttctctttgccagggcccgcagaatctgacagatattatcaaccatacccatgagaatatcaagtacctccccggaattacccttccggaaaacttgattgccaatccatcgctagtcgacgcggttcaagacagcactatcctcgtcttcaacctaccccatcaattcatcatcaatatttgtgaacagatcaagggcaagattgtcccatacgcgcgtggaatttcttgcataaagggcgtggatgtgaatgaggaaggagtccacctgttttccgaaacaattggaaagattctcgggatctactgtggcgccctgtccggtgccaacatcgcgaatgaggtcgcccaggaaaagtggtccgagtctagcattggttatgatccaccgcattttgactctaaagccccttctcctcccaaccgatccccttccgcatcgactgacaatatcctgcacttcgagcacaaagacgtttcgggtcaactttcgcgggtaaagctacaggctctaccttccgaatttcctcccatcgaccatgcccttctcaagtcgctattccaccgtccttacttccatattggtgtggtaagtgacgtcgcaggtgtttcgttaggaggtgcccttaagaatgtcgttgctgtcgcggcagggtgggttgtgggcaaaggatggggagacaatgcgaaggctgcaattatgcgagttgggcttttggaaatggtgaagttcggcgaacagtttttcggtgctaccatcaacactcgcaccttcactgaagaaagtgctggtgttgccgatctaatcacgagttgcagtggcggacgaaacttccgctgcgcaaagcttagcattgaaagaaaccagccgattgagaaaatcgaggagacagagttgaacggccagaagctgcaaggcactttgactgcagtcgaagtcaacagtttcttgaaaaagcaaggtttagaagaagagttcccattgtttactgcagtctaccgagttcttcaaggcaccatgtctgtggacgagattccttctttcattgagcggtaa

SEQ ID NO: 73126 - protein, 417 aa, Aspergillus nidulans FGSC A4
MGSLGPYKQKHKVTVVGSGNWGTAIAKIVAENTASNPAVFEKDVQMWVFEEKVEIPKSSKHYDPASSLCQGPQNLTDIINHTHENIKYLPGITLPENLIANPSLVDAVQDSTILVFNLPHQFIINICEQIKGKIVPYARGISCIKGVDVNEEGVHLFSETIGKILGIYCGALSGANIANEVAQEKWSESSIGYDPPHFDSKAPSPPNRSPSASTDNILHFEHKDVSGQLSRVKLQALPSEFPPIDHALLKSLFHRPYFHIGVVSDVAGVSLGGALKNVVAVAAGWVVGKGWGDNAKAAIMRVGLLEMVKFGEQFFGATINTRTFTEESAGVADLITSCSGGRNFRCAKLSIERNQPIEKIEETELNGQKLQGTLTAVEVNSFLKKQGLEEEFPLFTAVYRVLQGTMSVDEIPSFIER

SEQ ID NO: 73127 - DNA, 1224 bp, Aspergillus nidulans FGSC A4
  CDS (1)..(1224)
atggcaccaacaaagaaacaccaggtctccgtcatcggctccggtaactggggctcaacaattggcaagattctcgccgagaatacctcagaacataccgacaccttcgaaactccagtgcgaatgtgggtattcgaagaagaaatcaccgtcccttccgattctccccaccacagcaaatatggcgacaagccacaaaaattgacgcagattatcaacgaaacgcacgagaatgttaagtatctgccaggcatcaaactgcctgacaaccttatcgcaacgccagacatcaaagaagccgtcaaggatgccagtatcctcgtcttcaacctcccgcaccagtttatcggcaagacactcgaccaaatcaagggacaccatttaccttatgcccgtggagtcagctgtatcaagggcgttgatgtttcagacgggaaggtgacgctcttctccgagcttatcatgcagaaactaggtatatactgtggcgcattatcgggtgcgaacattgcgcctgaggttgcggccgaaagactatgcgagacgacaattggatacgaccccccgcctatggatcttacctctagtgacggctcgcctgaggataacctgccccatgtagatggccagcgccagaaggacctgagctcgacggatataaagttggagcgtgtgccgcaggattatccgcatgtgaatgatgaactcctcgagaagatgttcgagcggccgtacttcctcgtacatgttatcaaggatgttgcaggggttgcgttgggtggagcgttaaagaacattgttgccctggcagctggatttgtcgccggaaagcagtggggtgaaaatacgaaggcggcgattatccggcagggtgtaggagagatgatccggtttggacggacgtggtttccttcctcggtcaatgagaagacatttacagaggagagcgcgggcattgcggacctggtagctagctgctatggcggccggaacgtaaggtccgcaacgcacgctgtggagaaaggggtgagcgttgctgagattgagaagacagagatgaatggacaaaagttgcagggggtttcgactgctcagacggtgtacgggttcctggagaagcacggcaagacagacgaattccccttgttctgtgctgtgtacaatatcatcgaaggaaaagcacaggtggatgatcttccggcgttgcttaacaggaagaaatag

SEQ ID NO: 73128 - protein, 407 aa, Aspergillus nidulans FGSC A4
MAPTKKHQVSVIGSGNWGSTIGKILAENTSEHTDTFETPVRMWVFEEEITVPSDSPHHSKYGDKPQKLTQIINETHENVKYLPGIKLPDNLIATPDIKEAVKDASILVFNLPHQFIGKTLDQIKGHHLPYARGVSCIKGVDVSDGKVTLFSELIMQKLGIYCGALSGANIAPEVAAERLCETTIGYDPPPMDLTSSDGSPEDNLPHVDGQRQKDLSSTDIKLERVPQDYPHVNDELLEKMFERPYFLVHVIKDVAGVALGGALKNIVALAAGFVAGKQWGENTKAAIIRQGVGEMIRFGRTWFPSSVNEKTFTEESAGIADLVASCYGGRNVRSATHAVEKGVSVAEIEKTEMNGQKLQGVSTAQTVYGFLEKHGKTDEFPLFCAVYNIIEGKAQVDDLPALLNRKK

SEQ ID NO: 73129 - DNA, 1116 bp, Candida albicans SC5314
  CDS (1)..(1116): transl_table=12
atgactacttccccatatccaattgaaactccatttaaagtttgtattgtcggttccggtaactggggtactgcagttgcaaaattagttgctgaaaactgtgctgaaaaaccaaatattttccaaagagacgttaaaatgtgggttttcgaagaagaaattgaaggtagaaaattgacagaaataattaacaccgaacatgaaaatgttaaatacttgccagaaattaaattgccaactaacttggttgccaacccagacattgttgacactgttcaagatgccgacttgattgttttcaatattccacatcaattcttgggtagaattgtcaaacaaatcgaaggtaaagtgaaaccaactgctagagccatttcatgtttgaaaggtttggatgtgagtccagaaggttgcaaattgttgtcaacctctatcactgatactttgaagatttactgtggtgtcttatctggtgctaatattgccaacgaagttgccaaaggtaactggtcagaaacttccattgcctacactgttccagaagatttcagaggtgccggtaaagatattgatccatttattttgaaagaagctttccacagaccatacttccatgtcagagttattgaagatgttgttggtgcctctattgctggtgccttaaagaatgtcattgcctgttctgttggtttcgttgaaggtgctggctggggtgacaatgctaaagctgctattatgagaatcggtatcaaagaaaccatccgttttgcttcttactgggaattgttcaagatcaaggctttgtctccaccaaacccaaaaactttcaccgaagaaagtgctggtgttgctgatttgatcactacttgctcaggtggtagaaatgttaaagtcgccagatacatgattaaaaacaatgtcgatgcatttgaagctgaaaaaattgttttgaaaggacaaagttctcaaggtatcttgactgccaaagaagttcacgaattgttaacaaatttcaaccttcaagacgaattcccattactcgaagccacctataaagttatctacgagaatggtagtgttgacgatttcccacaattattagaaggtgatcaataa

SEQ ID NO: 73130 - protein, 371 aa, Candida albicans SC5314
MTTSPYPIETPFKVCIVGSGNWGTAVAKLVAENCAEKPNIFQRDVKMWVFEEEIEGRKLTEIINTEHENVKYLPEIKLPTNLVANPDIVDTVQDADLIVFNIPHQFLGRIVKQIEGKVKPTARAISCLKGLDVSPEGCKLLSTSITDTLKIYCGVLSGANIANEVAKGNWSETSIAYTVPEDFRGAGKDIDPFILKEAFHRPYFHVRVIEDVVGASIAGALKNVIACSVGFVEGAGWGDNAKAAIMRIGIKETIRFASYWELFKIKALSPPNPKTFTEESAGVADLITTCSGGRNVKVARYMIKNNVDAFEAEKIVLKGQSSQGILTAKEVHELLTNFNLQDEFPLLEATYKVIYENGSVDDFPQLLEGDQ

SEQ ID NO: 73131 - DNA, 1212 bp, Candida albicans SC5314
  CDS (1)..(1212): transl_table=12
atgtatactactgccaataaccgtttaactcaattgacacaaatcttactgccaatagtcaatgatgctgatagttcatttgctcaatatttattacaaaacccaacatttgctcctaatccagaatcatctttaaatcctgaaaaaccattcaaaattgctgttgttggatcaggtaattggggtactaccattgctaaaattgttgctgaaaatgctttagctagaccacatttatttagtcattatgttaatatgtgggtatttgaagaaaaaattaatggtgaaaatttgactcaaatcataaatcaacgccatgaaaatattaaatatttaccaggggttaaattacctaataatttaattgctcaaccagatattgttactgccgttaaaggtgccgatttaattattttcaatttacctcatcaatttttacctaagattttaaaacaattgaaaggtaatgtacctaaaactactagagccatttcttgtttgaaaggtttagaagttagtaaagatggttgtaaattattatcaacttatattaccgaagaattaggaatagtatgtggagctttactgggagccaatttagccccagaaattgctcgtggtaaatggtcagaaactactgtggcttataaattaccaaatgattatcgtggtgccggtaaagatattgataaattagtattaaaagcttgcttccatcgtccttatttccatgttaacgttattgaagatgttgctggtgtttctgtggcgggggctttgaaaaatattgttgccttagccgtggggtttgttgaaggtttaggttggggtgataatgctaaagcagccattatgagagttggattattagaaacaattaagttttctgaaacatttttcccacaatctcaagctgatacttttactgctgaatctgctggtgtagctgatttaattactacttgtgctggtggtagaaatgttaaagttggtagatatatggctgaaactggtgtttctgctgaagaagccgaaaagaaattattaaatggtcaaagttctcaaggtatagttactgctaaagaagttcatgaattattgacttatgttaataaattggaagaattcccattatttgaagctacgtatcaaattgcttttggttctgaatcaattgaaaatttaccaaacttgttaaataccactgcttaa

SEQ ID NO: 73132 - protein, 403 aa, Candida albicans SC5314
MYTTANNRLTQLTQILSPIVNDADSSFAQYLLQNPTFAPNPESSLNPEKPFKIAVVGSGNWGTTIAKIVAENALARPHLFSHYVNMWVFEEKINGENLTQIINQRHENIKYLPGVKLPNNLIAQPDIVTAVKGADLIIFNLPHQFLPKILKQLKGNVPKTTRAISCLKGLEVSKDGCKLLSTYITEELGIVCGALSGANLAPEIARGKWSETTVAYKLPNDYRGAGKDIDKLVLKACFHRPYFHVNVIEDVAGVSVAGALKNIVALAVGFVEGLGWGDNAKAAIMRVGLLETIKFSETFFPQSQADTFTAESAGVADLITTCAGGRNVKVGRYMAETGVSAEEAEKKLLNGQSSQGIVTAKEVHELLTYVNKLEEFPLFEATYQIAFGSESIENLPNLLNTTA

SEQ ID NO: 73133 - DNA, 1071 bp, Ustilago maydis 521
  CDS (1)..(1071)
atgtcaaccgcctcgacatcaagctcttcaaagaagcacaaagtggtgattgtcggctctggaaattggggctctgctatcgctcgtattgccggtcagaacacacaacgacactcggacacgtttcaacgcgaagtgcagatgtacgtgttcgaagaagattacaacggcaaacctctctcgcaggtcatcaacgagacacacgagaatcccaagtacctgcccggatgcaagcttccggataacgtcattgccaacccaaaccctgtcgatgcggtcaaggatgcgacgctgttggtgttcgttttaccgcatcagtttatccgatcggtgtgcaagcagttgaagggccatgtgaacccagatgcacacgcgatctcgatgatcaagggtgtcgaagtcaaggatggcaagatctcaatctttgctgatgtgatccaagaagcgctcggggtgtcgtgctccgctttatctggagctaacatcgcgaacgaggtggcgcaggacaagttctcagaaaccacaatcggtcatcgacccgatgcaaaaggtcgagaaaacgccgagctgttcttcaagctattcgacacgcctaccttcaaagtagggatcatcgaggatgtggcgggagtaagtctgtgtggggcgttgaagaatgtcgttgcgatcgccgcaggtttcacggatggattgggttggggagacaatgccaaagcggcggtgatgcgcatcggtctgatggagatgaagcgcttcagcgaggagttcttcgagggaatcaaacccgagaccttcacagaaacgagtgcgggcgtcgctgatctcatcaccacctgcctcggcggaaggaatcgaaagtgcgccgaggcgttcgtcaagaccggcaaaccattcgatcagctcgaaaaagagttgctcaatggtcaaaagttgcaaggaacagagaccgcaagggaggtacacgaattgttggcggcccgaggcaaggtcgacgactatccgttgttcaaggctgtctattcgatcgcatacgagggcattgacgctcacgatttgacgagtcgtctgtag

SEQ ID NO: 73134 - protein, 356 aa, Ustilago maydis 521
MSTASTSSSSKKHKVVIVGSGNWGSAIARIAGQNTQRHSDTFQREVQMYVFEEDYNGKPLSQVINETHENPKYLPGCKLPDNVIANPNPVDAVKDATLLVFVLPHQFIRSVCKQLKGHVNPDAHAISMIKGVEVKDGKISIFADVIQEALGVSCSALSGANIANEVAQDKFSETTIGHRPDAKGRENAELFFKLFDTPTFKVGIIEDVAGVSLCGALKNVVAIAAGFTDGLGWGDNAKAAVMRIGLMEMKRFSEEFFEGIKPETFTETSAGVADLITTCLGGRNRKCAEAFVKTGKPFDQLEKELLNGQKLQGTETAREVHELLAARGKVDDYPLFKAVYSIAYEGIDAHDLTSRL

SEQ ID NO: 73135 - DNA, 1164 bp, Saccharomycopsis fibuligera
  CDS (1)..(1164)
atgtctggtgctgctaaacgcctttctcaagttagtggaattttgaacccaggtgccacttctgaagatacaaccttgattgttcctgtgaaaccattcaagatcagtgttattggctctggcaattggggtaccactattgccaaagtggttgctgaatctactggcgaaaatcctgaccttttccaaaaagatgttcacatgtgggtatttcaagaaaaaatcgatggcgaaaacttgactgatattatcaacacaaagcatgaaaatgtcaagtacttacccgatgtcaaattgccagagaatgtgattgctgaaccggatattactaaaactgttatcaattcagacttgattattttcaatattccccaccagtttttgggtaatgtgtgcaagcaattgaaaggccatgttccaacaaccgctagagccgtttcttgtttgaaaggtcttgatgttacccctcaaggctgtaacttgttgtcttcttacatcactgaaaatttgggcatctactgtggcgctttatctggcgctaacttggctccagaagtcgctaatcaaaaatggtcagaaaccactattgcttacaatgagccagatgatttcagaggccaaggtaaagatattgacaaggctattcttaaaaaacttttccacagaccatacttccatgttagagttattgctgatgtgccaggtgtttcagtggctggtgctttgaaaaacgttgttgctatggctgctggttttgttgaaggtatgggatggggcgataatgccaaatctgccattatgagaattggtttggttgaaattgtcaaatttgctgacaaatattatccagaatcagattcaaaaacttttactgaggaaagcgctggcgttgctgacttgattactacttgctctggcggtagaaacgtcagagttggtaaatacatggctgaaaccggtaaggatgccactgaagcagaaaaagttttgttgaatggtcaatcttctcaaggtattgtcactactaaggaagtgcacgatttgttggaaaatgacaacgctactcatgaattcccattgtttgaagctacttatcaaatcatctataatggtttgccaatggataagttgccatctttgatagaatctattggtgataactga

SEQ ID NO: 73136 - protein, 387 aa, Saccharomycopsis fibuligera
MSGAAKRLSQVSGILNPGATSEDTTLIVPVKPFKISVIGSGNWGTTIAKVVAESTGENPDLFQKDVHMWVFQEKIDGENLTDIINTKHENVKYLPDVKLPENVIAEPDITKTVINSDLIIFNIPHQFLGNVCKQLKGHVPTTARAVSCLKGLDVTPQGCNLLSSYITENLGIYCGALSGANLAPEVANQKWSETTIAYNEPDDFRGQGKDIDKAILKKLFHRPYFHVRVIADVPGVSVAGALKNVVAMAAGFVEGMGWGDNAKSAIMRIGLVEIVKFADKYYPESDSKTFTEESAGVADLITTCSGGRNVRVGKYMAETGKDATEAEKVLLNGQSSQGIVTTKEVHDLLENDNATHEFPLFEATYQIIYNGLPMDKLPSLIESIGDN

SEQ ID NO: 73137 - DNA, 1164 bp, Saccharomycopsis fibuligera
  CDS (1)..(1164)
atgtctggtgctgctcaacgtctttctcaaattagtggtattttgaacccaggcactacttctgaaaacaccattttgattgttccagaaaagccattcaagatcagtgtcattggctctggtaactggggtactactattgctaaagtcattgctgaatctactggcgaaaacccagaacttttccaaaaagatgttcatatgtgggtcttccaagaaaaaattgatggtagaaacttaactgacattatcaatactgaacacgaaaatgtcgagtatttgccagaagtcaaattgccagaaaatgttattgctgaaccagatatcaccaaaaccgttgaaggttctgacttgattgtcttcaacattcctcatcaattcttgggtaatgtgtgcagacaattgaaaggtcatgttccaaccactgctagagctgtttcttgtttgaagggtctcgatgttactcctcaaggctgcaaattgttgtcttcttacatcactgaaaacttgggcatctactgtggtgctttatctggtgctaacttagctccagaagttgctagacaaaaatggtctgaaactactgttgcttataatgagccagctgatttcagaggtcaaggtaaagacattgacaaggctattcttaagaaagttttccacagaccatacttccacgtcagagttgttggtgatgtgccaggtgtttctttagctggtgctttgaagaatgttgttgccatggctgctggtttcgtggaaggtttaggttggggtgacaatgctaaatctgccattatgagaattggtttggtcgaaatcatcaaatttgctcaaaaatacttcccagaatctgacccaaagacttttactgaagaatccgctggtgttgccgacttgattaccacttgttctggcggtagaaatgttagagttggtaaatacatggctgaaacaggtaaagatgccgctgaagctgaaaaagttttgttgaatggtcaatcctctcaaggtattgttactactaaggaagtccatgacttgttggctaatgacaatgctactcaagattttccattgtttgaggctacttaccaaatcatctacaatggcttgccaatgggtaagttgccatctttgttggaatctgctggtgacaactaa

SEQ ID NO: 73138 - protein, 387 aa, Saccharomycopsis fibuligera
MSGAAQRLSQISGILNPGTTSENTILIVPEKPFKISVIGSGNWGTTIAKVIAESTGENPELFQKDVHMWVFQEKIDGRNLTDIINTEHENVEYLPEVKLPENVIAEPDITKTVEGSDLIVFNIPHQFLGNVCRQLKGHVPTTARAVSCLKGLDVTPQGCKLLSSYITENLGIYCGALSGANLAPEVARQKWSETTVAYNEPADFRGQGKDIDKAILKKVFHRPYFHVRVVGDVPGVSLAGALKNVVAMAAGFVEGLGWGDNAKSAIMRIGLVEIIKFAQKYFPESDPKTFTEESAGVADLITTCSGGRNVRVGKYMAETGKDAAEAEKVLLNGQSSQGIVTTKEVHDLLANDNATQDFPLFEATYQIIYNGLPMGKLPSLLESAGDN

SEQ ID NO: 73139 - DNA, 1047 bp, Medicago truncatula
  CDS (1)..(1047)
atgaataaggtcaccattgttggtagtggcaattggggtagtgttgccgcaaaacttattgcatcaaacaccatcaagctcagtaatttccacgatgaagtgaggatgtgggtatttgaggaaactttaccaaatggggataagctcactgatgtcatcaaacaaaccaatgaaaatgttaagtacctcccaggagtcaagctaggtcaaaatgtagttgcagatccagaccttgaaaatgcagttaaggatgcaaacatgctggtatttgtaacaccacatcaattcatggaaggaatatgcaaaaggcttgatgggaaaataaggacagatgcagaagggatttctctagtaaaagggatggaggtcaagaaggaaggtgcatccatgatctctactttaatctccaatcaattgaaaatcaattgttctgttttaatgggggccaatatagcaaatgagattgcaatgcagaaatttagtgaggcaacaattggatacagagaaaataaagaagctgcagagagatgggttcagttgttcaacactccttattttaatgtgacatctgttcaggatgttgaaggagttgaaatgtgtggaaccctgaaaaatatagttgctatagctgcaggttttattgatggcttggaaatgggaaataacacaaaatctgcaataatgagaattggtctgaaagagatgatggcattttcaaagctgttgtttccatcggtcaagtacagtacctttttcgagagctgtggtgtagctgaccttatcacaacatgcatgggtggaagaaataggaaagttgctgctgcttatgcaagaaatggcggaaagaggtcttttgatgaacttgaagcagagttgcttaaaggccagaaattgcagggtgtgttaactgcaaaagaggtttatgaggttcttaccgctcgcggatgggtagagaggtttccactcttcacaacagtgtacgaaatcagctcaggtctccttccaccatcagctatagttgaattcaacaataaaagtaagttgtag

SEQ ID NO: 73140 - protein, 348 aa, Medicago truncatula
MNKVTIVGSGNWGSVAAKLIASNTIKLSNFHDEVRMWVFEETLPNGDKLTDVIKQTNENVKYLPGVKLGQNVVADPDLENAVKDANMLVFVTPHQFMEGICKRLDGKIRTDAEGISLVKGMEVKKEGASMISTLISNQLKINCSVLMGANIANEIAMQKFSEATIGYRENKEAAERWVQLFNTPYFNVTSVQDVEGVEMCGTLKNIVAIAAGFIDGLEMGNNTKSAIMRIGLKEMMAFSKLLFPSVKYSTFFESCGVADLITTCMGGRNRKVAAAYARNGGKRSFDELEAELLKGQKLQGVLTAKEVYEVLTARGWVERFPLFTTVYEISSGLLPPSAIVEFNNKSKL

SEQ ID NO: 73141 - DNA, 1230 bp, Aspergillus oryzae
  CDS (1)..(1230)
atgccacagcaaaagaaacaacacaccgtagccgttatcggctccggaaactggggctcaacaattgccaaaatcctcgccgaaaatacagcctcacaccccgaactcttcaccccgaaggtccaaatgtgggtattcgaagaacagattcagatcccgtccgactccccccaccactctaaatacggcgacaagccccagaaccttaccgaggtgatcaacgccgtacacgagaacgtgaagtacctaccggggatccgactcccagagaacgtggttgcgaacccgaacctcgaggacgtggtgaaagatgcaacgatcctggtcttcaacctcccgcatcagtttatcgagaagacactggatcagattaaggggaagcacttgccgtacgcgagggcgatatcgtgcgtgaagggcgtagatgtgacggatgggatggtgacgttgttttcagagctgattatggagaagctggcgatttattgtgggtcgttgtctggggcaaatattgcgccggaggttgcggcggagaagttcagtgagacgactattggatatgatacgccgccgatggatgtcaaagccgaggatggaagtccggaggacaataagattaagattgatgagcagaggcaggtgaaaacgaggccgacgcatacaaagttgacgcgggtgccgcaggagcttgtgacggttgatgcggagctgtggcggacgttgtttggacgaccgtatttccatgtcaatgtggtggatgatgtcgcgggcgttgcgctgagcggtgcgctgaaaaatatcgtggcattggcggcaggtttcgtcgccgggaaaggatggggagaaaatggcaaagcggcagtcattcgggttggggtggtggagatggtgaagtttggacggacttggttcccacagtctgtcaatgagaggacgtttacggaggaaagtgcgggcattgctgatctggtcgcatcttgttctgctggaaggaacttccggtctgcgaagcatgccgtggagaagggggtgaatgtagatgagattgaaaagactgagatgaacgggcagaagttgcagggaacgtcaacggcgaagtccgttcacgaattccttgagaagcatgggaaagtgcaggacttccccttgttcgatgctgtatatggcattctcgaaggcaagaccagcgtggacagtttgccaaagttgctggacaagaggttcggttag

SEQ ID NO: 73142 - protein, 409 aa, Aspergillus oryzae
MPQQKKQHTVAVIGSGNWGSTIAKILAENTASHPELFTPKVQMWVFEEQIQIPSDSPHHSKYGDKPQNLTEVINAVHENVKYLPGIRLPENVVANPNLEDVVKDATILVFNLPHQFIEKTLDQIKGKHLPYARAISCVKGVDVTDGMVTLFSELIMEKLAIYCGSLSGANIAPEVAAEKFSETTIGYDTPPMDVKAEDGSPEDNKIKIDEQRQVKTRPTHTKLTRVPQELVTVDAELWRTLFGRPYFHVNVVDDVAGVALSGALKNIVALAAGFVAGKGWGENGKAAVIRVGVVEMVKFGRTWFPQSVNERTFTEESAGIADLVASCSAGRNFRSAKHAVEKGVNVDEIEKTEMNGQKLQGTSTAKSVHEFLEKHGKVQDFPLFDAVYGILEGKTSVDSLPKLLDKRFG

SEQ ID NO: 73143 - DNA, 1482 bp, Aspergillus oryzae
  CDS (1)..(1482)
atgctgtccccaatacatcttctatctcgccggacttgccttcgttcaattgccactgcgattgatcaacctcggttcccggttttcctccagcaacagtcactctccactccattttcgtcgtctctagtctactcaaaggctttaaagttccccagaccaacctcaactcgactcatttcttgttcattttcacgtctatatacaacatctgtgaacgaccttgccaaaatgagttcccttaccccctaccagcgcaaacacaaggtcacggtgatcggctcaggaaactggggcaccgctattgccaagattgtcgctgaaaataccgctagcaaccctgccatcttcgaaaaggatgttcaaatgtgggtttttgaagagaacgtggaagttccaaagacctcccctcactataacccatcttcgcccttatgccagggtccccagaagttaacagagataatcaataagacacatgagaatgtcaagtatttgccaggaatcaaccttcctacaaatttgcacgccaatccctcattggaggactccgttaaggacagcactatccttgttttcaatttgcctcatcagttcattatcaagacttgtgagcagatcaagggcaagattctgccatatgcgcgtggtatttcttgcatcaagggtgtcgatgtgcgggaagatggaatcagtcttttctcagaaaccatcggcaagattcttgggatctactgtggcgccctctccggtgcaaacatcgccagcgaggttgcccaggagaagtggtctgagtcaagcattgcttacgatcctccccatctagattcgaaagccccctcgcccaatcgctcgccttcctcatcgacggtggatgtggttcacttcacgcataaggacgtttcgggacaactatctcgggttaaactgcaggcgttgccctccgagtatcctcccattgaccatgctgtcctgaagacgcttttccatcgtccctacttccatatcagtgtggtgagtgatgttgcaggcgtttcccttggcggtgcgctcaaaaatgtcgtcgctattgccgcaggttgggttgaaggcatgggatggggtgacaacgccaaagctgccgtcatgcgagtcgggctgttggagatggtcaagttcggtgaaatgttcttcggtgcgaccatcaacactcggacgttcacagaggaaagtgccggtgttgccgacttgatcactagctgcagtggtggtcgcaacttccgttgtgccaagctgagcattgaaagaaagcagccgatcggaaaggtcgaagagacggagctcaatggtcagaagctccagggcactttgactgcgattgaagtaaacaaattcttgaagaaccaaggcgttgaagaagaataccccttgttgacggccgtctataaaatcctagaaggcactatgtctgttgaggatatcccttcttatattgagcggtaa

SEQ ID NO: 73144 - protein, 493 aa, Aspergillus oryzae
MLSPIHLLSRRTCLRSIATAIDQPRFPVFLQQQSLSTPFSSSLVYSKALKFPRPTSTRLISCSFSRLYTTSVNDLAKMSSLTPYQRKHKVTVIGSGNWGTAIAKIVAENTASNPAIFEKDVQMWVFEENVEVPKTSPHYNPSSPLCQGPQKLTEIINKTHENVKYLPGINLPTNLHANPSLEDSVKDSTILVFNLPHQFIIKTCEQIKGKILPYARGISCIKGVDVREDGISLFSETIGKILGIYCGALSGANIASEVAQEKWSESSIAYDPPHLDSKAPSPNRSPSSSTVDVVHFTHKDVSGQLSRVKLQALPSEYPPIDHAVLKTLFHRPYFHISVVSDVAGVSLGGALKNVVAIAAGWVEGMGWGDNAKAAVMRVGLLEMVKFGEMFFGATINTRTFTEESAGVADLITSCSGGRNFRCAKLSIERKQPIGKVEETELNGQKLQGTLTAIEVNKFLKNQGVEEEYPLLTAVYKILEGTMSVEDIPSYIER

SEQ ID NO: 73145 - DNA, 2106 bp, Dunaliella salina
  CDS (1)..(2106)
atgcttctccagaaaggaaacattggcaaggggatcgcccagcctgtgcagcgccgaggagtgccctcagccttgcgccacgccccgcttgcgaacaaggtcgccaccccagcggtcgctccccaaggcctcttgaggcctatcctgagtgaaaggggcagcccagcgttgctgaagcgccaacgggcgctggatgtcgtgttgcgcgctgcggagaccgagcaggaggcggagaatgccggcacggtggtgcccggggatgggtgggagagcttccccccgcccccgtacgagccctctgagcaggtcctcgacctgtggcagcaggcggatgccgtgtgtttcgatgtggaccgcaccgtgacaactgacgcctcagttggcctgctggccaagttcatgggcatcgaggatgaggcacagtccctgacggagcaggccaacaggggcgagatcaacctcaccaaggcctttgaggatcgcctggccaaactgaacttcacccccacagacattgaccgattccttgaggagcaccctgctcacacccgcctggttccgggtgtggagaacctcattgcagccctgaaggctcgtggagtggaggtgttcctcatctctggcggcttcagggagatggccctgcccattgcttcccacctcaagatccctgcaaagaacgtgttctgcaacaccatgtcctggcagctggacgaccatggtgagcccgtccgcctgcagggcctggacatgacccgcgccgcagagagccacttcaaatcgcgcgctattgagcgcattaggaggaagtacccctacaacaacatcatcatggttggagatggcttcagtgacctggaggccatgcagggctcccccgatggagcagatgccttcatctgcttcggtggcgtcatgcaacgacctgccgtggccagccaggccgactggtttgtgcgctcatacgatgagctgatggccaagctgaagcgctacaaggtgaccatggtgggctccggggcctgggcctgcacagccgtgcgcatggtggcccagagcacagcagaggccgcccagctgccaggctccgtgttcgagaaggaggtgaccatgtgggtgcacgaggagaagcactccggccgcaacctgatcgagtacatcaacgagaaccatgagaaccccatctacttgcctggcattgacctgggcgagaacgtcaaggccacctccgatttgatcgaggcggtccgtggcgctgatgccctcatcttctgcgcaccccatcaattcatgcatggcatttgcaagcagctggctgctgcgcgcgtcgtcggccgcggcgtgaaggccatcagcttgaccaagggcatgcgtgtgcgtgctgagggcccgcagctcattagccagatggtgtcccgtatcctgggcatcgactgctcagtgctcatgggtgctaacattgctggcgacattgccaaggaggagctgtctgaggctgtgattgcctatgccaaccgcgagtctggcagcctgtggcagcagctgttccagcgcccctacttcgccattaacctgcttgcggatgtgccgggcgctgagatgtgcggtaccctgaagaacatcgtggctgtgggcgcaggcattggtgacggcctgggcgtaggccccaacagtaaagcctccatcctgcgacaaggcctgagtgagatgaggaagttctgcaagttcatctccccctcagtgcgcgatgacaccttcttcgagtcctgcggtgtagctgatttgattgccagcagctatggcggccgcaacaggcgcgtggctgaggcctgggcccagaagaggatcgctggtgatgaccaggtcacgttcgagaagcttgagaaggagatgctgaacggccagaagctgcagggtgtgctaacaagcgacgaggtccaagaaatcctgcacgcacgtggctgggagctggaattccccttgttcaccaccatcaacagaatcatccatggcgaggtcccaccaaccatgatcttgaggtaccgcgtggcctgctccatgcccagcatgcctccagctcgccgtgtagtgaacgactactactaa

SEQ ID NO: 73146 - protein, 701 aa, Dunaliella salina
MLLQKGNIGKGIAQPVQRRGVPSALRHAPLANKVATPAVAPQGLLRPILSERGSPALLKRQRALDVVLRAAETEQEAENAGTVVPGDGWESFPPPPYEPSEQVLDLWQQADAVCFDVDRTVTTDASVGLLAKFMGIEDEAQSLTEQANRGEINLTKAFEDRLAKLNFTPTDIDRFLEEHPAHTRLVPGVENLIAALKARGVEVFLISGGFREMALPIASHLKIPAKNVFCNTMSWQLDDHGEPVRLQGLDMTRAAESHFKSRAIERIRRKYPYNNIIMVGDGFSDLEAMQGSPDGADAFICFGGVMQRPAVASQADWFVRSYDELMAKLKRYKVTMVGSGAWACTAVRMVAQSTAEAAQLPGSVFEKEVTMWVHEEKHSGRNLIEYINENHENPIYLPGIDLGENVKATSDLIEAVRGADALIFCAPHQFMHGICKQLAAARVVGRGVKAISLTKGMRVRAEGPQLISQMVSRILGIDCSVLMGANIAGDIAKEELSEAVIAYANRESGSLWQQLFQRPYFAINLLADVPGAEMCGTLKNIVAVGAGIGDGLGVGPNSKASILRQGLSEMRKFCKFISPSVRDDTFFESCGVADLIASSYGGRNRRVAEAWAQKRIAGDDQVTFEKLEKEMLNGQKLQGVLTSDEVQEILHARGWELEFPLFTTINRIIHGEVPPTMILRYRVACSMPSMPPARRVVNDYY

SEQ ID NO: 73147 - DNA, 1056 bp, Oryza sativa
  CDS (1)..(1056)
atggagaacggacacgccaagaatcttgtggccgtcatcggcagcggcaactggggcagcgtcgcctcccgcctcatcgcttctaacaccgctaagttgccctcctttcatgatgaagtaaggatgtgggtgtttgaagaaatattaccaacaggcaagaagctctctgagtccattaaccaagcaaatgagaattgcaaatacttacctggtataaagctcggagctaatgtaattgctgatcctgatttggagaatgcagtgaaagatgcaaatatgcttgtttttgtgactccccatcaatttgtggagggtatatgtaagaagcttgtgggtaaactaaggccaggaactgagggtatctccctcatcaagggcatggaggtcaagatggaaggaccatgcatgatatctaaattaattacaaacatacttggaatcaattgctgtgtccttatgggtgctaacattgcaaatgagattgctgttgagaaattcagtgaagcgacaattggatataagaaagacaaggaagtggcaacccgatgggctaaactttttacaacaccttacttcctggtttctgttgtagaggatattgaaggagttgaattatgtggaacactgaaaaatgtcgtggccattgcagcaggtcttgttgatggtttggatatggggaacaataccaaggctgcaataatgaggattggtttgcgggaaatgcgtgctttctctaagcttctatcccctacagtcagggacaacactttctttgagagctgtggtgtggctgacctaataactacatgccttggtgggagaaacagaagagtcgctgaggcctttgcacgaaatggtggcaaaaggtcttttgatgagttggaggccgagatgctacatggccaaaaacttcagggagtgtccacagcaaaagaagtttatgaagtcttgacttatcgagggtggcaagaattgtttcctcttctgtccacagtgcatgagatttgtattggtcagctacctcctacatcaatagttgaatacagaatccactga

SEQ ID NO: 73148 - protein, 351 aa, Oryza sativa
MENGHAKNLVAVIGSGNWGSVASRLIASNTAKLPSFHDEVRMWVFEEILPTGKKLSESINQANENCKYLPGIKLGANVIADPDLENAVKDANMLVFVTPHQFVEGICKKLVGKLRPGTEGISLIKGMEVKMEGPCMISKLITNILGINCCVLMGANIANEIAVEKFSEATIGYKKDKEVATRWAKLFTTPYFLVSVVEDIEGVELCGTLKNVVAIAAGLVDGLDMGNNTKAAIMRIGLREMRAFSKLLSPTVRDNTFFESCGVADLITTCLGGRNRRVAEAFARNGGKRSFDELEAEMLHGQKLQGVSTAKEVYEVLTYRGWQELFPLLSTVHEICIGQLPPTSIVEYRIH

SEQ ID NO: 73149 - DNA, 1110 bp, Debaryomyces hansenii
  CDS (1)..(1110)
atgacttctacaccatttaatattgaaaaaccattcagagttgccatcattggatccggtaactggggtactgctgttgctaagatcgtatctgaaaacacggctgaaaaaccagaagtgttcgaaaagcaagtgaacatgtgggtttttgaagaagaagttgacggacaaaagttgactgaaatcatcaacaccaaacacgaaaacgttaagtacttgccagaagtcaagttgccggaaaacttggttgcaaacccagacgttgttgacactgtcaaggatgcagacttattaattttcaacattccacatcaattcttaccaagagtgtgtaagcaattggttggccatgtcaagccatctgccagagccatctcctgtttgaagggtttggaagttggcccagaaggttgtaagttgttatcgcaatctatcaacgatactttaggtgtccactgtggtgtcttatctggtgccaacattgccaacgaagttgccagagaaagatggtctgaaaccaccattgcctacaacattccagaagatttcagaggtaagggtagagatatcgacgaatacgtcttaaagcaattattccacagaacctacttccatgtcagagtcatcaatgacatcataggtgcttctttcgctggtgctttgaagaatgttgttgcctgtgctgttggtttcgttatcggtgccggctggggtgacaacgctaaggccgctatcatgagaatcggtatcagagaaatcatccactttgcctcttactaccaaaagttcggtgtcaagggtccagctccagaatccactactttcactgaggaatctgccggtgtcgctgacttaatcaccacttgttccggtggtagaaatgtcaaggttgctagatacatgattgaaaacaacgttgacgcttgggaagccgaaaagattgtcttaaagggtcaatcttctcaaggtatcttaactgccaaggaagtccacgaattgttaaccaactacaacttatcgaatgaattcccattattcgaagctacatacagaatcatttatgaaaatgccgatgtcaacgaattcccagtcatcttagaaagagattag

SEQ ID NO: 73150 - protein, 369 aa, Debaryomyces hansenii
MTSTPFNIEKPFRVAIIGSGNWGTAVAKIVSENTAEKPEVFEKQVNMWVFEEEVDGQKLTEIINTKHENVKYLPEVKLPENLVANPDVVDTVKDADLLIFNIPHQFLPRVCKQLVGHVKPSARAISCLKGLEVGPEGCKLLSQSINDTLGVHCGVLSGANIANEVARERWSETTIAYNIPEDFRGKGRDIDEYVLKQLFHRTYFHVRVINDIIGASFAGALKNVVACAVGFVIGAGWGDNAKAAIMRIGIREIIHFASYYQKFGVKGPAPESTTFTEESAGVADLITTCSGGRNVKVARYMIENNVDAWEAEKIVLKGQSSQGILTAKEVHELLTNYNLSNEFPLFEATYRIIYENADVNEFPVILERD

SEQ ID NO: 73151 - DNA, 1116 bp, Kluyveromyces thermotolerans
  CDS (1)..(1116)
atgtccgctgccgacagactgaatcagacccacgacatcctatccgaatccgtgcaagccgtggaaaaccctttcaaagtcaccgtgattgggtccggtaactggggtaccaccatctccaaggttgtggccgagaacgctgcgctaagaccacacttgttcgtcaagcgtgtcgacatgtgggtgtttgaggagaccgtcgacggccagaagttgaccgagatcatcaacaccaagcaccagaacgtcaagtacctgcctaacatcgacctgccagagaacctggtcgccaacccagacttggtctctgccgtcaaggacgccgacatcctggtcttcaacatccctcaccagttcttgccacgcattgtctcccagttgcagggcaacatcaagaaggacgcccgtgccatctcctgtttgaagggtttcgacgtgtccaaggacggtgtcaagctgctatccacctacgtcaccgagaagctcggaatcacctgtggtgccctttccggtgctaacttggccccagaggttgccaaggagaactggtccgagaccactgttgcctacgagttgccaaaggacttcaagggcgagggcaaggacgtcgaccacgccgtcttgaaggctttgttccacagaccatacttccacgtcaacgtcattgacgatgtcgctggtatctctgttgccggtgccttgaagaacgttgtcgctctaggttgcggtttcgtcgagggtctaggctggggtaacaacgcctccgctgccatccagagagttggtttgggtgagatcatcaagttcggtcagatgttcttcccagactcccgtgtcgagacctactaccaggagtccgccggtgttgctgacttgatcaccacctgctctggtggtagaaacgtcagagtcgccacccacatggccaagactggtaagtctgccgaggagtgcgagaaggagctgttgaacggccagtccgcccaggtattcacacatgtaaggaggtccacgagtggttggccgagtgcggtaagaccgatgaattcgttctgttcgaggccgtttaccagattgtctacgagaacgctcctatggacactttgccagacatga

SEQ ID NO: 73152 - protein, 371 aa, Kluyveromyces thermotolerans
MSAADRLNQTHDILSESVQAVENPFKVTVIGSGNWGTTISKVVAENAALRPHLFVKRVDMWVFEETVDGQKLTEIINTKHQNVKYLPNIDLPENLVANPDLVSAVKDADILVFNIPHQFLPRIVSQLQGNIKKDARAISCLKGFDVSKDGVKLLSTYVTEKLGITCGALSGANLAPEVAKENWSETTVAYELPKDFKGEGKDVDHAVLKALFHRPYFHVNVIDDVAGISVAGALKNVVALGCGFVEGLGWGNNASAAIQRVGLGEIIKFGQMFFPDSRVETYYQESAGVADLITTCSGGRNVRVATHMAKTGKSAEECEKELLNGQSAQVFTHVRRSTSGWPSAVRPMNSFCSRPFTRLSTRTLLWTLCQT

SEQ ID NO: 73153 - DNA, 1101 bp, Candida albicans
  CDS (1)..(1101): transl_table=12
atgactacatccccatatccaattgaaactccatttaaagtttgtattgtcggttccggtaactggggtactgcagttgcaaaattagttgctgaaaactgtgctgaaaaaccaaatattttccaaagagacgttaaaatgtgggttttcgaagaagaaattgaaggtagaaaattgacagaaataattaacaccgaacatgaaaatgttaaatacttgccagaaattaaattgccaactaacttggttgccaacccagacattgttgacactgttcaagatgccgacttgattgttttcaatattccacatcaattcttgggtagaattgtcaaacaaatcgaaggtaaagtgaaaccaactgctagagccatttcatgtttgaaaggtttggatgtgagtccagaaggttgcaaattgttgtcaacctctatcactgatactttgaagatttactgtggtgtcttatctggtgctaatattgccaacgaagttgccaaaggtaactggtcagaaacttccattgcctacactgttccagaagatttcagaggtgccggtaaagatattgatccatttattttgaaagaagctttccacagaccatacttccatgtcagagttattgaagatgttgttggtgcctctattgctggtgccttaaagaatgtcattgcctgttctgttggtttcgttgaaggtgctggctggggtgacaatgctaaagctgctattatgagaatcggtatcaaagaaaccatccgttttgcttcttactgggaattgttcaagatcaaggctttgtctccaccaaacccaaaaactttcaccgaagaaagtgctggtgttgctgatttgatcactacttgctcaggtggtagaaatgttaaagtcgccagatacatgattaaaaacaatgtcgatgcatttgaagctgaaaaaattgttttgaaaggacaaagttctcaaggtatcttgactgctaaagaagttcacgaattgttaacaaatttcaaccttcaagacgaattcccattactcgaagccacctataaagttatctacgagaatggtagtgttgatgatttccccaattattag

SEQ ID NO: 73154 - protein, 366 aa, Candida albicans
MTTSPYPIETPFKVCIVGSGNWGTAVAKLVAENCAEKPNIFQRDVKMWVFEEEIEGRKLTEIINTEHENVKYLPEIKLPTNLVANPDIVDTVQDADLIVFNIPHQFLGRIVKQIEGKVKPTARAISCLKGLDVSPEGCKLLSTSITDTLKIYCGVLSGANIANEVAKGNWSETSIAYTVPEDFRGAGKDIDPFILKEAFHRPYFHVRVIEDVVGASIAGALKNVIACSVGFVEGAGWGDNAKAAIMRIGIKETIRFASYWELFKIKALSPPNPKTFTEESAGVADLITTCSGGRNVKVARYMIKNNVDAFEAEKIVLKGQSSQGILTAKEVHELLTNFNLQDEFPLLEATYKVIYENGSVDDFPNY

SEQ ID NO: 73155 - DNA, 1182 bp, Cryptococcus neoformans var
  CDS (1)..(1182)
atgtctgccccctctacggccccttcctcccctgaggttgttcagcagttctctgacctcgatatcggttctaccgtcacaaccccagcggtgacccgtccttcttctccttcacccccatcactccctccttctccgctttccagtggtaagcacaaaattgccgtcatcggttctggatcatggggaactgctctcgccaaaattgctgccgagaatgcctggcgccgcaaagacgagttccactccgaggttaggatgtgggtgcgtgagaagattgtgaacggcaagcctcttacgcacatcatcaacaaaacgcaccttaactcgcgatatcttcccgatgtcgttcttcctcggaaccttgttgccgttccgcatcttaaagacgtcgttaaggatgcgactctcatcgtcttcgtcgtacctcatcaattcctgcataccgttcttaatgaacttgcgagacccggcgttcttttacgcggtgctaaggctgtgagcgccatcaaaggcgtggaggtgaacggtaccgatattcagacttttgctagcttgattgaagccaaagttgggttgccgtgctcagccttgagcggtgccaatatcgcccttgaagtggctatgggtcaattctgcgaaacaactatcggttgccctacatccgaccaatctctgttatggcacgccgtcttcaacgcgccttctttccgggtcaatgccgtggaggacgtcagcggagtgtctcttgccggtgcacttaaaaacatagtggcactcgctgccggtatggtggacggcttgggattaggaggtaacaccaaggctgccattatgcgaatcgggctgaaggagatgacccaattctgtttggagttctttgagggcagtcaacctgaaacattttccaacgaatccgcaggtgtcgctgaccttaccgtcacttgtttctcggggaggaatcgaaaatgcgctgaagagtttgtcaagtctgggcagccatttgatgttattgagaggaagttgctcaacggtcagaaacttcaaggtaccgccacagccgaagaagtcaatgcgttcctcgttgcgcgaaagcgtgcccatgcctatccgttgttcgaaaaggtatacaagattgctttcgagggcatgcccccaaagaaccttgttgtggggttgtaa

SEQ ID NO: 73156 - protein, 393 aa, Cryptococcus neoformans var
MSAPSTAPSSPEVVQQFSDLDIGSTVTTPAVTRPSSPSPPSLPPSPLSSGKHKIAVIGSGSWGTALAKIAAENAWRRKDEFHSEVRMWVREKIVNGKPLTHIINKTHLNSRYLPDVVLPRNLVAVPHLKDVVKDATLIVFVVPHQFLHTVLNELARPGVLLRGAKAVSAIKGVEVNGTDIQTFASLIEAKVGLPCSALSGANIALEVAMGQFCETTIGCPTSDQSLLWHAVFNAPSFRVNAVEDVSGVSLAGALKNIVALAAGMVDGLGLGGNTKAAIMRIGLKEMTQFCLEFFEGSQPETFSNESAGVADLTVTCFSGRNRKCAEEFVKSGQPFDVIERKLLNGQKLQGTATAEEVNAFLVARKRAHAYPLFEKVYKIAFEGMPPKNLVVGL

SEQ ID NO: 73157 - DNA, 1203 bp, Candida glabrata
  CDS (1)..(1203)
atgtctaactccgctgctggcaggttgaaccagacctctcatatcttgaatgagtctataaagaacgacgacatctcgctgcgccgctctcagccatccaccacgtctttgcaagcccttgagcacccattcaaggtcaccgtgattggttccggtaactggggtaccactattgccaaagttgttgctgagaacactgctttgaacccacacctgtttgtgtcccgtgtggacatgtgggtgttcgaagagaagatcgacggcaagaacctgactgagattatcaatgagcagcacgagaacgtcaagtacttgcctgacatcaagctgcctgagaacctggtcgctaacccaaacctgatcgactcagtgaaaggtgccgacatactgatcttcaacatccctcaccagttcttgccccgtattgtgtcaaacttgaagaaccacgtcgggccacacgtcagagccatctcttgtctgaaaggttttgaagttggcaagaaaggtgtacagcttttgtcctcttatgtgaccgatgagttgggaatacagtgtggtgcactatccggtgctaacttggccccagaagtcgcaaaggagcactggtctgagactaccgttgcttaccacattccaaaggacttcagaggtgaaggaaaggacgttgaccacaagttgctaaaggctctgttccacagaccatacttccatgtcaatgttatcgaagatgttgcaggtatctccattgcaggtgctctaaagaacgttgttgctctgggttgtgggtttgttgagggtctaggctggggtaacaacgctgctgccgcaattcaaagagtcggtctaggtgaaatcatcaagttcggccaaatgttcttcccagaatccagagttcaaacttactaccaagaatctgcaggtgtcgctgatctaattaccacttgctccggtggtagaaacgtcagagttgctaagcatatggccaagaccggtaagtctgctctcgatgccgaaaaggaactactaaatggccagtccgcacagggtatcattacttgtaaagaagtccacgaatggttggagacttgtgagatgactcatgagttcccattgttcgaagcagtctaccaaattgtttacaacaacgtcccaatgaagaacttgccagatatgatcgaagaattggaatgcatcgctgattga

SEQ ID NO: 73158 - protein, 400 aa, Candida glabrata
MSNSAAGRLNQTSHILNESIKNDDISLRRSQPSTTSLQALEHPFKVTVIGSGNWGTTIAKVVAENTALNPHLFVSRVDMWVFEEKIDGKNLTEIINEQHENVKYLPDIKLPENLVANPNLIDSVKGADILIFNIPHQFLPRIVSNLKNHVGPHVRAISCLKGFEVGKKGVQLLSSYVTDELGIQCGALSGANLAPEVAKEHWSETTVAYHIPKDFRGEGKDVDHKLLKALFHRPYFHVNVIEDVAGISIAGALKNVVALGCGFVEGLGWGNNAAAAIQRVGLGEIIKFGQMFFPESRVQTYYQESAGVADLITTCSGGRNVRVAKHMAKTGKSALDAEKELLNGQSAQGIITCKEVHEWLETCEMTHEFPLFEAVYQIVYNNVPMKNLPDMIEELECIAD

SEQ ID NO: 73159 - DNA, 1182 bp, Pichia jadinii
  CDS (1)..(1182)
atgttaaggattggaaagctgaatttgtccacaatgtcctctgctcaacaaagattggcccaagtcggctcacacctcactgctcaaaagcaatcgcttgctccacagcgtccttacaagatcaccgttatcggctctggtaactggggtaccacgattgccaaagttttggctgagaatgccggcttgagacctcacctgttccagcaccaagttgacatgtgggtctttgaagagaagatcaacggcgtgaacttgacggagatcatcaacacacagcatgagaatgtcaagtacttgccgggtattaagcttccaaagaacttgcacgccgagccttccatcgtcaaggctgctgaaggtgccgatttgttggtgttcaacattccacatcaattcttgccaggtatctgcaaacagttgtccaaggcaaccctcaagccacacgtgagagccatctcttgtttgaagggtttggaagtcactccaaacggctgcaagctgctttctacctatatcactgagcacttgggtgtccactgtggtgccctttcaggtgctaacttggctccagaagttgcaaaggagaagtggtctgagaccacagttgcctacagattgccaaatgacttccaaggccacgggaaagatattgaccgttacgtactaagagctgctttccacagaccttacttccatgttcgtgtcattgaagatgttgccggtgtctcacttgctggtgcattgaaaaacgttgttgctctcggtgtcggtttcgtccatggtttgaactggggtgataacgctgcttctgccattcagagatttggtttgaacgagaccatcaagttcgcagaagtcttcttcccaggtgaaaccaaccaggatacctttaccaaggaatctgctggtgttgctgatttgatcacaacctgttctggaggtagaaacgtcagagttgccaaggccatggcaatcactggtaaatctgcagttgaagttgaaagggagttgcttaacggtcaatcagcccaaggtatcatcacctctaaagaagttcacgagttgttggctgcaaagaatttgacaaaggagttcccattgttcgaggccatctaccaaatcgtctatggtactgaatccatcgagagattaccagagttgatcgaagaggatgaatag

SEQ ID NO: 73160 - protein, 393 aa, Pichia jadinii
MLRIGKLNLSTMSSAQQRLAQVGSHLTAQKQSLAPQRPYKITVIGSGNWGTTIAKVLAENAGLRPHLFQHQVDMWVFEEKINGVNLTEIINTQHENVKYLPGIKLPKNLHAEPSIVKAAEGADLLVFNIPHQFLPGICKQLSKATLKPHVRAISCLKGLEVTPNGCKLLSTYITEHLGVHCGALSGANLAPEVAKEKWSETTVAYRLPNDFQGHGKDIDRYVLRAAFHRPYFHVRVIEDVAGVSLAGALKNVVALGVGFVHGLNWGDNAASAIQRFGLNETIKFAEVFFPGETNQDTFTKESAGVADLITTCSGGRNVRVAKAMAITGKSAVEVERELLNGQSAQGIITSKEVHELLAAKNLTKEFPLFEAIYQIVYGTESIERLPELIEEDE

SEQ ID NO: 73161 - DNA, 1176 bp, Saccharomyces bayanus
  CDS (1)..(1176)
atgtctgctgctgctgatagattaaacttaacttccggccacttgaatgctggtagaaagagaagttcctcttctgtttctttgaaggctgccgaaaagcctttcaaggttactgtgattggatctggtaactggggtactactattgccaaggtggttgccgaaaattgtaagggatacccagaagttttcgctccaatagtacaaatgtgggtgttcgaagaagagatcaatggtgaaaaattgactgaaatcataaatactagacatcaaaacgtgaaatacttgcctggcatcactctacccgacaatttggttgctaatccagacttgattgattcagtcaaggatgtcgacatcatcgttttcaacattccacatcaatttttgccccgtatctgtagccaattgaaaggtcatgttgattcacacgtcagagctatctcctgtctaaagggttttgaagttggtgctaaaggtgtccaattgctatcctcttacatcactgaggaactaggtattcaatgtggtgctctatctggtgctaacattgccactgaagtcgctcaagaacactggtctgaaacaacagttgcttaccacattccaaaggatttcagaggcgagggcaaggacgtcgaccataaggttctaaaggccttgttccacagaccttacttccacgttagtgtcatcgaagatgttgctggtatctccatctgtggtgctttgaagaacgttgttgccttaggttgtggtttcgtcgaaggtctaggctggggtaacaacgcttctgctgccatccaaagggtcggtttgggtgagatcatcagattcggtcaaatgtttttcccagaatctagagaagaaacatactaccaagagtctgctggtgttgctgatttgatcaccacctgcgctggtggtagaaacgtcaaggttgctaggctaatggctacttctggtaaggacgcctgggaatgtgaaaaggagttgttgaatggccaatccgctcaaggtttaattacctgcaaagaagttcacgaatggttggaaacatgtggctctgtcgaagacttcccattatttgaagccgtataccaaatcgtttacaacaactacccaatgaagaacctgccggacatgattgaagaattagatctacatgaagattag

SEQ ID NO: 73162 - protein, 391 aa, Saccharomyces bayanus
MSAAADRLNLTSGHLNAGRKRSSSSVSLKAAEKPFKVTVIGSGNWGTTIAKVVAENCKGYPEVFAPIVQMWVFEEEINGEKLTEIINTRHQNVKYLPGITLPDNLVANPDLIDSVKDVDIIVFNIPHQFLPRICSQLKGHVDSHVRAISCLKGFEVGAKGVQLLSSYITEELGIQCGALSGANIATEVAQEHWSETTVAYHIPKDFRGEGKDVDHKVLKALFHRPYFHVSVIEDVAGISICGALKNVVALGCGFVEGLGWGNNASAAIQRVGLGEIIRFGQMFFPESREETYYQESAGVADLITTCAGGRNVKVARLMATSGKDAWECEKELLNGQSAQGLITCKEVHEWLETCGSVEDFPLFEAVYQIVYNNYPMKNLPDMIEELDLHED

SEQ ID NO: 73163 - DNA, 1158 bp, Schizosaccharomyces pombe
  CDS (1)..(1158)
atgtctggatatggtcaacaaggtgtttctgctgccaacatcgacagcatccgccccaagaaacgtttgtcaattggtgtagttggctccggtaactggggtactgccattgccaagatttgcggtgaaaatgcccgtgcccacggtcaccatttcagaagtaaggtccgcatgtgggtctttgaggaggagattgagtacaagggtgagaagagaaagctcaccgaagtattcaacgaagctcacgagaatgtcaaatacttacccggcatcgaatgccctcccaacgttattgccgtccccgatgttcgtgaggtcgctagacgtgccgacatccttgtctttgtcgttcctcatcaatttattgaacgcgtttgcgaccaaatggtcggtctcattcgccctggtgccgttggtatttcctgtatcaagggtgttgctgtcagcaaggaaggcgtccgcctttactctgaggttatcagcgagaaactcggtatttactgtggtgttctttctggtgctaacgttgcaaacgaagttgcccgtgagcaattctgtgagactactattggtttcaaccctcctaatgaagttgatatccctcgcgagcaaatcgccgccgtctttgatcgcccttacttctcagttgtctccgttgacgacgttgccggtgtcgccttgggtggtgctttgaagaacgtagttgccatggccgttggtttcgctgatggtttggaatggggcggtaataccaaggccgctattatgcgtcgtggtttgttggagatgcaaaagtttgctactaccttcttcgactctgatcctcgtaccatggttgagcaatcttgcggtatcgctgacttggtcacttcttgtttgggtggccgtaacaatcgttgtgctgaagcatttgtcaagactggtaaatctttagagacgcttgaaaaagagctcttaggtggtcaacttcttcaaggagctgccacttccaaggatgttcatgaattccttctcaccaaggatatggtcaaggatttccccttgttcactgccgtttataacatttcctatgaagacatggatcccaaggatttgatcatcgtccttcaaccccttaaggaggactctgagaacgagggcggtactgaaaccgagtaa

SEQ ID NO: 73164 - protein, 385 aa, Schizosaccharomyces pombe
MSGYGQQGVSAANIDSIRPKKRLSIGVVGSGNWGTAIAKICGENARAHGHHFRSKVRMWVFEEEIEYKGEKRKLTEVFNEAHENVKYLPGIECPPNVIAVPDVREVARRADILVFVVPHQFIERVCDQMVGLIRPGAVGISCIKGVAVSKEGVRLYSEVISEKLGIYCGVLSGANVANEVAREQFCETTIGFNPPNEVDIPREQIAAVFDRPYFSVVSVDDVAGVALGGALKNVVAMAVGFADGLEWGGNTKAAIMRRGLLEMQKFATTFFDSDPRTMVEQSCGIADLVTSCLGGRNNRCAEAFVKTGKSLETLEKELLGGQLLQGAATSKDVHEFLLTKDMVKDFPLFTAVYNISYEDMDPKDLIIVLQPLKEDSENEGGTETE

SEQ ID NO: 73165 - DNA, 1197 bp, Yarrowia lipolytica
  CDS (1)..(1197)
atgagcgctctacttcgatcgtccctgcgttttaaacacatgtccgccgtcaaccgtctcacacaacagcttcgactgctgaccgcctccgcgcctctcagcgcagccaacaccgccggcaaggctcctttcaaggtcgccgttgttggttctggtaactggggaaccaccgtcgccaagattgtcgccgagaactgcactgctcaccccgagctctttgagcccgaggttcgagtctgggttcgagaagagaaggtcaacggcaagaacctgaccgacattttcaacgctgagcacgagaacgtgcgatacctccctaaaatcaaacttcctcacaacctgatcgccgagccggatctgctcaaggccgtcgagggtgccaacatcatcgtcttcaacctgccccatcagttcctggctggtgtctgcaagcagctcaagggccacgtcaaccccaaggctagagccatctcctgcctcaagggtctagatgtcaccccccagggtgtttacctgctctccgacgttatcgagaacgagaccggtctccactgcggtgttctgtccggggctaacctcgccaccgagatcgctctggagaagtactccgagactaccgttgcttacaaccgacccaaggacttctttggcgagggtgatgtgaccaacgatgtgctcaaggctctgttccaccgaccctacttccatgtgcgatgcgttcaggacgtcgccggtgtctccatcggaggtgcccttaagaacgttgttgccctttgcgccggtttcgtcgagggcaagaactggggagacaacgccaaggccgcaattatgcgacgaggcatgcttgagatgatcaacttctccaagcgattcttccccgaaactgatattaacactcttacagtcgagtctgccggtgtggccgatctcatcacctcgtgcgctggaggccgaaacttcaaggtcggccgagcattcggaaaggagagcggctccggcaagaccatccaggacgtggagaaggagcttctcaacggccagtccgcccagggcgtcatcacatgcaacgaggtccacgagctgctcaagaacaagaacatgcagaaggacttccctctgttcgagtccacctggggcattatccacggtgagctcaagattgatgatctccccgagattctttaccacgccaactag

SEQ ID NO: 73166 - protein, 398 aa, Yarrowia lipolytica
MSALLRSSLRFKHMSAVNRLTQQLRLLTASAPLSAANTAGKAPFKVAVVGSGNWGTTVAKIVAENCTAHPELFEPEVRVWVREEKVNGKNLTDIFNAEHENVRYLPKIKLPHNLIAEPDLLKAVEGANIIVFNLPHQFLAGVCKQLKGHVNPKARAISCLKGLDVTPQGVYLLSDVIENETGLHCGVLSGANLATEIALEKYSETTVAYNRPKDFFGEGDVTNDVLKALFHRPYFHVRCVQDVAGVSIGGALKNVVALCAGFVEGKNWGDNAKAAIMRRGMLEMINFSKRFFPETDINTLTVESAGVADLITSCAGGRNFKVGRAFGKESGSGKTIQDVEKELLNGQSAQGVITCNEVHELLKNKNMQKDFPLFESTWGIIHGELKIDDLPEILYHAN

SEQ ID NO: 73167 - DNA, 1206 bp, Zygosaccharomyces rouxii
  CDS (1)..(1206)
atggccgctactgacagattaaaccaaacctctgatatcctatcgcaatctatgaagaagaccgactcatcaatgtcagtcgttaccgctgagaatccatacaaagtttccgtcgtcggctctggtaactggggtaccaccatcgccaaggtcgttgccgaaaacaccaaggaaaagccagaattgttccaagaacgtgtggacatgtgggtgtttgaagaacagatcgacggtactccattggcccaaatcatcaacaccaagcaccagaacgtgaaatacttgccaaacatcgaccttccggacaatttggtcgctaacccagacttgattgccaccacgaaggacgccgatgtgattgttttcaacgttccccatcaatttttgggccgtatcgttgctcaaatgaagggtcaaatcaaaccaactgcacgtgcggtctcctgtctaaagggtttcgaagttggtccaaagggtgtgcagcttctatctgactacgtcactcaagaattgggtatcgaatgtggtgctctatctggtgctaacttggccccagaagtcgccaaggaacactggtccgagaccaccgtcgcttaccacatcccagacgacttcaagggtgacggtaaggacatcgaccaccgtgtcttgaagcagttgttccacagaccatacttccacgtgaatgtgattgacgatgttgctggtatctccatcgcaggtgcattgaagaacgtggtcgccttgggttgcggtttcgttaccggtctaggttggggtaacaacgccgccgccgccatccaacgtgtcggtttgggtgaaatcatcaagttcggtaggatgttcttcccagaatccaaggtggagacttactaccaagaatccgcaggtgttgctgacttgatcaccacctgttccggtggtagaaacgtccgtgttgccaccgaaatggccaagactggtaagagcggtgagcaagtcgaaaaagacatcttgaacggtcaatccgctcaaggtttggtcacctgtaaggaagttcaccagtggttagaatctagtggaaacaccgaagacttcccattgttcgaggctgtctaccagatcacttacgaaaacgtgcccatgaaggagttgccatctatgatcgaagaattggatatcgatagcacatcgaagtgcgtattgagttacaagatgggtctctag

SEQ ID NO: 73168 - protein, 401 aa, Zygosaccharomyces rouxii
MAATDRLNQTSDILSQSMKKTDSSMSVVTAENPYKVSVVGSGNWGTTIAKVVAENTKEKPELFQERVDMWVFEEQIDGTPLAQIINTKHQNVKYLPNIDLPDNLVANPDLIATTKDADVIVFNVPHQFLGRIVAQMKGQIKPTARAVSCLKGFEVGPKGVQLLSDYVTQELGIECGALSGANLAPEVAKEHWSETTVAYHIPDDFKGDGKDIDHRVLKQLFHRPYFHVNVIDDVAGISIAGALKNVVALGCGFVTGLGWGNNAAAAIQRVGLGEIIKFGRMFFPESKVETYYQESAGVADLITTCSGGRNVRVATEMAKTGKSGEQVEKDILNGQSAQGLVTCKEVHQWLESSGNTEDFPLFEAVYQITYENVPMKELPSMIEELDIDSTSKCVLSYKMGL

SEQ ID NO: 73169 - DNA, 1269 bp, Candida glabrata
  CDS (1)..(1269)
atgtttgttcggttagccaggatacccaggatcacacgccactatcgcttaggattattttcgacacagccgaaacctaaacctaacgagtatctgtactatcgaaacaaacacaagtctaaaatggaagctccaatcaagagatcaagctctgctgtctccctagttgaactagagagagagccattcaaggtcactgttatcggttctggtaactggggtaccaccatcgccaaggttgtcgctgagaacaccaaggccaaccctcaggtcttccaggaaagagtcgacatgtgggtcttcgacgagaacatcgacggcaccatgctgaccgagatcatcaacaccaagcaccagaacgtcaagtacttgccaaacattgacctgccagagaacctggtcgccaatccagacttgctgaagtctgtcgagggcgccgacatcctggtcttcaacatcccacatcagttcttgcctaagatcgtcgaccaactgcgtggtcacgtcgaacctcacgtcagagccatctcctgtctaaagggtttcgaggtcggcaagaagggtgtccaattgctaagcacatacatcaccgaagagctaggcatcgagtgtggtgccctatcgggtgctaacctggccccagaggtcgccaaggagcactggtccgaaaccaccgtcgcttaccacattccaaaggactaccaaggtgacggtatggacgtcgaccacaaggtcctaaagctgctgttccacagaccatacttccacgtcagtgtcatcgacgatgtcgccggtatctccatcgccggtgccctaaagaacgtcgtcgccctaggttgtggtttcgtcgagggtctaggctggggtaacaacgccgccgccgccatccaaagagtcggtctaggtgagatcatcaagttcggtcaaatgttcttccctgaatccagagtcgaaacctactaccaagagtccgccggtgtcgccgacttgatcaccacctgttccggtggtagaaacgttagagtcgccacccacatggccaagaccggtaagtctgccgaggactccgaaaaggaattgctaaacggccaatccgctcaaggtgtcatcacatgtaaggaagtccacgaatggttgtccacttgtgaaatgattgaagagttcccattgttcgaagccgtctacaagattgtttacgaggatgtcccaatgcacaagctaccagaaatgatcgaagaattggatgacattgttgttgctggccaataa

SEQ ID NO: 73170 - protein, 422 aa, Candida glabrata
MFVRLARIPRITRHYRLGLFSTQPKPKPNEYLYYRNKHKSKMEAPIKRSSSAVSLVELEREPFKVTVIGSGNWGTTIAKVVAENTKANPQVFQERVDMWVFDENIDGTMLTEIINTKHQNVKYLPNIDLPENLVANPDLLKSVEGADILVFNIPHQFLPKIVDQLRGHVEPHVRAISCLKGFEVGKKGVQLLSTYITEELGIECGALSGANLAPEVAKEHWSETTVAYHIPKDYQGDGMDVDHKVLKLLFHRPYFHVSVIDDVAGISIAGALKNVVALGCGFVEGLGWGNNAAAAIQRVGLGEIIKFGQMFFPESRVETYYQESAGVADLITTCSGGRNVRVATHMAKTGKSAEDSEKELLNGQSAQGVITCKEVHEWLSTCEMIEEFPLFEAVYKIVYEDVPMHKLPEMIEELDDIVVAGQ

SEQ ID NO: 73171 - DNA, 1185 bp, Pichia jadinii
  CDS (1)..(1185)
atgactgatatcggagaatccgagagtgacatatcaacagacgtttccgcattgccaatgcttagccatagtgtgtcatacacgtcgattcagaagcctccgtttgttgtctcggtcattgggtctggtaactggggtaccacagtggccaagatcattgccgagaacacaagggagaacccgttgctgtttgagcagaaggtgagaatgtgggtgtacgaggaggagttcgaaggctccaacctttccgacatcatcaacactgagcacgtgaacaagaagtaccttcctggtatcaagttgccggataacttggttgcggtgcctgacctgttggaggctgtccagtactccaacatcctgatcttcaacatcccacaccagcatctggagaagatcctgagccagcttcgtggtaacattgatccacgagcacgtgcgatctcctgtcttaaggggcttcgtgtcaatttagatggtgttgagctactaccagatatcatccaagatgcactgggtatccactgtggtgttcttgccggagccaacttggcacaagaggtggcagaacagagattcagtgagaccaccgttggatatccattgccggcagattataagcctggtgatgttgaccataccgttctctatacgctgtttcacagaccttacttccatgtccatgtcattgaggatattgccggtatctcttgcgcgggggccttgaagaacatcattgccatctctgtcggattcgtcgaaggtttggagtggggtgataatgcgaaggctgcgatgctgagacgtggattgttagaaatgatcaaattcggtcgtaagttcttccctggttgtcttgtcagttcgttcacagaagaaagtgcaggtgtcgctgatctcttcacaacatgtaccggtggtcgtaacttcaagctggccaagatcatggctcagaccggtaagtcggctcatgaggttgaaaaggagattcttaacggtcagagtgcgcaaggtttaatcactgcgaaggagatccacgagctgatcaagaacaaagggtgtgaagaagagttcccattattcgaaaccacctaccagattcttttccacggagtgcgtattggcattctaccttacatgttggagaacaagtggtccatctctaagccaaactattccagttga

SEQ ID NO: 73172 - protein, 394 aa, Pichia jadinii
MTDIGESESDISTDVSALPMLSHSVSYTSIQKPPFVVSVIGSGNWGTTVAKIIAENTRENPLLFEQKVRMWVYEEEFEGSNLSDIINTEHVNKKYLPGIKLPDNLVAVPDLLEAVQYSNILIFNIPHQHLEKILSQLRGNIDPRARAISCLKGLRVNLDGVELLPDIIQDALGIHCGVLAGANLAQEVAEQRFSETTVGYPLPADYKPGDVDHTVLYTLFHRPYFHVHVIEDIAGISCAGALKNIIAISVGFVEGLEWGDNAKAAMLRRGLLEMIKFGRKFFPGCLVSSFTEESAGVADLFTTCTGGRNFKLAKIMAQTGKSAHEVEKEILNGQSAQGLITAKEIHELIKNKGCEEEFPLFETTYQILFHGVRIGILPYMLENKWSISKPNYSS

SEQ ID NO: 73173 - DNA, 1122 bp, Schizosaccharomyces pombe
  CDS (1)..(1122)
atgactgtggctgctttgaacaaactcagcgctctctccggaagtattcaaaaatctttttcacctaaacttatttctgttggtatcatcggatcaggaaattggggaaccgctattgctaaaatatgtggtgaaaatgccaaggctcatcctgatattttccatcctcaagtacacatgtggatgtatgaagagaagattcaacatgagggaaaagagtgcaatctcacggaagtttttaacactactcatgaaaacgttaaatatctcaaaggtatcaaatgcccttctaacgtcttcgcaaacccggacattcgtgatgtaggttcacgtagcgacattctggtatgggttctccctcaccagttcgttgtgcgtatttgcaatcaattgaagggatgcctaaagaaggatgctgttgcaatttcatgcatcaaaggtgtatctgtcaccaaggaccgtgttcgcctcttttctgatattatcgaagaaaacacgggaatgtattgtggcgttctctctggcgccaacattgccagcgaagttgctcaagagaagttttgcgaaactactatcggatatttgcctaatagttctgttaatccccgctatactcctaagactatccaagctttgtttaaccgtccctacttccgtgtcaacattgttgaggatgttcctggtgttgctttgggcggtgcactcaagaatatcgtcgctgtcgctgccggtattattgatggacttgaattgggagataataccaaatctgctgttatgcgcattggccttctggaaatgcagaaattcggcaggatgtttttcgattgtaagcctcttactatgagcgaggaatcttgtggcatagccgatttaattacaacttgcttaggcggccgtaaccacaaatgcgctgtggcatttgtcaagacaggaaagcccatgcatgttgttgaacaagaacttcttgatggtcagaagttgcaaggtgcagctaccgcgaaggaggtttatgagttccttgataaccagaataaggtaagcgaattcccattgtttacagctgtttatcgcattgtttatgagggacttccacctaataagcttctggaggctatttaa

SEQ ID NO: 73174 - protein, 373 aa, Schizosaccharomyces pombe
MTVAALNKLSALSGSIQKSFSPKLISVGIIGSGNWGTAIAKICGENAKAHPDIFHPQVHMWMYEEKIQHEGKECNLTEVFNTTHENVKYLKGIKCPSNVFANPDIRDVGSRSDILVWVLPHQFVVRICNQLKGCLKKDAVAISCIKGVSVTKDRVRLFSDIIEENTGMYCGVLSGANIASEVAQEKFCETTIGYLPNSSVNPRYTPKTIQALFNRPYFRVNIVEDVPGVALGGALKNIVAVAAGIIDGLELGDNTKSAVMRIGLLEMQKFGRMFFDCKPLTMSEESCGIADLITTCLGGRNHKCAVAFVKTGKPMHVVEQELLDGQKLQGAATAKEVYEFLDNQNKVSEFPLFTAVYRIVYEGLPPNKLLEAI

SEQ ID NO: 73175 - DNA, 1170 bp, Zygosaccharomyces rouxii
  CDS (1)..(1170)
atggccgccactgacagattaaaccaaacctccgatatcctatctcattctatgaagaagactgatacctcaatgtcaattgttaccgctgagaatccttacaaggtcgctgttgtcggttctggtaactggggtaccactatcgctaaggttgttgccgaaaacaccaaagaaaagccagagttgttccaaggacgtgtggacatgtgggttttcgaagaacaaatcgatggtactccattgactcaaatcatcaacaccaaacaccaaaacgtcaaataccttccaaacatcgatcttccggggaatttggtcgctaacccagatttgatctctactaccaaggacgctgatgtcatcgttttcaacgttcctcaccaatttttgggccgtatcgtttctcaaatgaagggtcaaatcaaaccagatgctcgtgccatctcctgtctaaagggtttcgaagttggtccaaagggtgtccaactactttctgactacgtcactcaagaattaggtatccaatgtggtgccctatctggtgctaacttggctccagaagtcgccaaggaacactggtccgaaactaccgtcgcttaccaagtcccagatgacttcaagggtgaaggtaaagatatcgaccaccgtgtcttgaaacaattgttccacagaccatacttccacgtcaatgtgatcgacgatgttgctggtatttctatcgcaggtgcattgaagaacgtggttgccttgggttgcggtttcgtcaccggtctaggctggggtaacaacgctgccgccgccatccaacgtgttggtttgggtgaaatcatcaagttcggtagaatgttcttcccagaatccaaggtggaaacttactaccaagaatctgcaggtgttgctgatttgatcactacctgttccggtggtagaaacgttcgtgtcgccactgaaatggccaagactggtaagagcggtgaacaagtcgaaaaggacatcttgaacggtcaatccgctcaaggtttgattactgctaaggaagtccaccaatggttggaatccagcggtcacaccgaagaatacccattgtttgaagccgtctaccaaatcacttacgaaaacgtgcccatgaaggagttgccatccatgatcgaagaattggatatcgtagaataa

SEQ ID NO: 73176 - protein, 389 aa, Zygosaccharomyces rouxii
MAATDRLNQTSDILSHSMKKTDTSMSIVTAENPYKVAVVGSGNWGTTIAKVVAENTKEKPELFQGRVDMWVFEEQIDGTPLTQIINTKHQNVKYLPNIDLPGNLVANPDLISTTKDADVIVFNVPHQFLGRIVSQMKGQIKPDARAISCLKGFEVGPKGVQLLSDYVTQELGIQCGALSGANLAPEVAKEHWSETTVAYQVPDDFKGEGKDIDHRVLKQLFHRPYFHVNVIDDVAGISIAGALKNVVALGCGFVTGLGWGNNAAAAIQRVGLGEIIKFGRMFFPESKVETYYQESAGVADLITTCSGGRNVRVATEMAKTGKSGEQVEKDILNGQSAQGLITAKEVHQWLESSGHTEEYPLFEAVYQITYENVPMKELPSMIEELDIVE

SEQ ID NO: 73177 - DNA, 1119 bp, Cuphea lanceolata
  CDS (1)..(1119)
atggctccctctgagctcaactgcacccaccagaaccagcattcaagcggttacgacggacccagatcgagggtcaccgttgtcggtagtggaaactggggtagtgttgctgccaagctcattgctaccaataccctcaagcttccatcttttcatgatgaagtgagaatgtgggtatttgaggagacgctaccgagcggcgagaagcttactgatgtcatcaaccagaccaatgaaaatgttaagtatctccccggaattaagctcggtaggaatgttgttgcagatccagacctcgaaaacgcagttaaggatgcaaatatgctcgtgtttgtgacaccgcatcagttcatggagggcatctgcaaaagactcgaagggaaaatacaagaaggagcacaggctctctcccttataaagggcatggaggtcaaaatggaggggccttgcatgatctcgagcttaatctctgatcttctcgggattaactgctgtgtcctaatgggggcaaacatcgctaatgagattgctgttgagaaattcagtgaagcgacagtcgggttcagagaaaatagagatattgcagagaaatgggttcagctctttagcactccgtacttcatggtctcagctgttgaagatgttgaaggagtagaactttgtggaacactgaagaatatcgtggccatagcagccggttttgtggatggattggagatgggaaacaacacaaaagcagcaattatgaggatcgggttacgggagatgaaggcattctccaagcttttgtttccatctgttaaggacactactttcttcgagagctgtggagtcgctgacctcatcacaacttgtttgggcgggagaaacagaaaagttgctgaggcttttgcaaagaatggcgggaaaaggtcattcgatgatctcgaagcagagatgctccgggggcaaaaattacagggtgtctcaacagcaaaggaggtctatgaagtcttggggcaccgaggctggctcgagctgttcccgctcttctcaaccgtgcacgagatatccactggccgtctgcctccttcagccatcgtcgaatacagcgaacaaaaaaccatcttctcttggtag

SEQ ID NO: 73178 - protein, 372 aa, Cuphea lanceolata
MAPSELNCTHQNQHSSGYDGPRSRVTVVGSGNWGSVAAKLIATNTLKLPSFHDEVRMWVFEETLPSGEKLTDVINQTNENVKYLPGIKLGRNVVADPDLENAVKDANMLVFVTPHQFMEGICKRLEGKIQEGAQALSLIKGMEVKMEGPCMISSLISDLLGINCCVLMGANIANEIAVEKFSEATVGFRENRDIAEKWVQLFSTPYFMVSAVEDVEGVELCGTLKNIVAIAAGFVDGLEMGNNTKAAIMRIGLREMKAFSKLLFPSVKDTTFFESCGVADLITTCLGGRNRKVAEAFAKNGGKRSFDDLEAEMLRGQKLQGVSTAKEVYEVLGHRGWLELFPLFSTVHEISTGRLPPSAIVEYSEQKTIFSW

SEQ ID NO: 73179 - DNA, 1275 bp, Ashbya gossypii
  CDS (1)..(1275)
atggtaaacacaacggctcttatacgctcacctacttttgtggcgcaatttagagtactgaagcaagtaaacagagggctattctcacagactagttacgctagaacgcacgcaaggacgagttatacacacacgatggcgggcacagatagactacagcaaacgtcgcagattctttcgcggtcgacgtcgtcggagatccggttggagcgccccttcaaagtgacagttatcgggtcgggtaactgggggaccaccatcgccaaggtggtggcggagaacacgcaggagtacccgcagctgtttgagcggcgcgtggacatgtgggtgttcgaggagcagattgagggccgcaagctgacggagatcatcaacgagcaacacgagaacgtgaagtatctgccgggaatcacgctgccggaaaacctggttgcgaacccgtcggtggcggctgccgccgcggacgcggatgtgctagtgtttaacataccacaccagtttctggggcggattgtggagcagctcaaggggcacgtgaagccgggcgcgcgggcgatctcgtgcctgaagggcttcagcgtgggcaaggacggcgtgcagctgctgtcgacctacatcgaggagcacctgcacatcccttgcggcgcgctatccggtgcgaacctggcgccggaggtggcgaagggcaactggtcggagacgacagtggcgtacacgctgccccaggacttccgtggcacgggcaaggacgtggaccacgcggtattgaagaagctgttccaccgcccctacttccacgtgaacgttgtggacgacgtcgcggggatttccgttgcgggcgcgctgaagaacgtggttgcgctggcttgcggtttcgtgctgggcctcgggtggggcaacaacgcagccgcagccgtgcagcgcgtaggcttgagcgagatgatcaagtttgcgcgcatgttcttcccggaatcgaaggtggagaccttctaccaggagtctgccggtgtcgcagacctgatcactacctgtgcgggtggcaggaatgtccgcattggtcgtgccatggcagagaccggcaaatccgcacaagagcttgagaaggagctcttgaacggccagtcatcccagggcatttacacgacgcaggaggtgcacgagtggttgcagcagtgcggcaagaaggacgagttcccactgtttgaggctgtgtacaagattgtctacgagggcgttccaatgtccaagttacctgacatgcttgaggatgcctaa

SEQ ID NO: 73180 - protein, 424 aa, Ashbya gossypii
MVNTTALIRSPTFVAQFRVLKQVNRGLFSQTSYARTHARTSYTHTMAGTDRLQQTSQILSRSTSSEIRLERPFKVTVIGSGNWGTTIAKVVAENTQEYPQLFERRVDMWVFEEQIEGRKLTEIINEQHENVKYLPGITLPENLVANPSVAAAAADADVLVFNIPHQFLGRIVEQLKGHVKPGARAISCLKGFSVGKDGVQLLSTYIEEHLHIPCGALSGANLAPEVAKGNWSETTVAYTLPQDFRGTGKDVDHAVLKKLFHRPYFHVNVVDDVAGISVAGALKNVVALACGFVLGLGWGNNAAAAVQRVGLSEMIKFARMFFPESKVETFYQESAGVADLITTCAGGRNVRIGRAMAETGKSAQELEKELLNGQSSQGIYTTQEVHEWLQQCGKKDEFPLFEAVYKIVYEGVPMSKLPDMLEDA

SEQ ID NO: 73181 - DNA, 1176 bp, Candida tropicalis
  CDS (1)..(1176): transl_table=12
atgtgcacatctgcaaacaacagattggaccaattaacccagatcttacaccccgagaacctcttgaacccaaccaatgcttcgcacccagaatcttccttaagaccggaccaccctttcaagattgccgttgttggttccggtaactggggtaccaccatcgccaagattgtctccgagaacgccgtcgccagaccacacttgttctcccatttcgtcaacatgtgggtctttgaagagaaaatcgacggcaccaacttgaccgaaatcatcaacaccagacacgaaaacatcaagtacttgcccggtgtcaaattacccaaaaacttgatcgcggtgccggacatcgtcaaggccgtcaaaggcgccgatttgattgtgttcaacttgccacaccagttcttgcctaggatcttgaagcagttgaagggccatgttccaaagacgacgagagccatctcgtgccttaaaggtttggaagtcaacgctaacggatgtaagttgttgtccaccgtcattgaagaagaattgggcattgcctgtggtgctttgtccggtgccaacttggcccctgagattgccagaggaaactggtccgagactactgtcgcctacagagtgcctgctgattacaggggtccaggaaaagatatcgacaagttggtcttgaaagctttgttccacagaccttacttccacgttaacgtcattgacgacgttgctggtgtttccatagccggtgccttgaagaacgttgttgcattggctgttggtttcgttgaaggtttgggctggggtgacaatgccaaggctgctgttatgagagtcggattgttggagaccatcaagtttgctaagctcttctttaatgatgctgagattgacacctttactggtgaatctgctggtgttgctgatttgatcactacttgttccggtggtagaaacgtcaaggttggtagatacatggctgagactggatgtgctgctgaagaagccgagaagaagttgttgaacggccagagttctcaaggtattgttaccaccaaggaagtccacgagttcttgactaacgttaacaagttggaagagttcccattgtttgaagctacctaccaaatcacctttggttctgaatccatcgaaaacttgccaaacttgttgaacaattattag

SEQ ID NO: 73182 - protein, 391 aa, Candida tropicalis
MCTSANNRLDQLTQILHPENLLNPTNASHPESSLRPDHPFKIAVVGSGNWGTTIAKIVSENAVARPHLFSHFVNMWVFEEKIDGTNLTEIINTRHENIKYLPGVKLPKNLIAVPDIVKAVKGADLIVFNLPHQFLPRILKQLKGHVPKTTRAISCLKGLEVNANGCKLLSTVIEEELGIACGALSGANLAPEIARGNWSETTVAYRVPADYRGPGKDIDKLVLKALFHRPYFHVNVIDDVAGVSIAGALKNVVALAVGFVEGLGWGDNAKAAVMRVGLLETIKFAKLFFNDAEIDTFTGESAGVADLITTCSGGRNVKVGRYMAETGCAAEEAEKKLLNGQSSQGIVTTKEVHEFLTNVNKLEEFPLFEATYQITFGSESIENLPNLLNNY

SEQ ID NO: 73183 - DNA, 1263 bp, Colletotrichum gloeosporioides
  CDS (1)..(1263)
atggcttctctcggcgccgacaagaaacacaaggtcacagtggtgggctccggtaactggggctcgaccatctgcaagatcgttgccgaaaacacaaaagcgaaccccgacctgttcgaagaagccgtccacatgtgggtgttcgaggaagatgttgttatcgacaagtcctcaccctactacgaccctgccgtcggcgacgctccccagaagctcaccggcgttatcaacaagtaccacgagaacacaaagtacctgccgggtatcaagctcccagacaacatcattgcgaacccctcgctccaggatgctgtcaaggactccaccatcctcgtcttcaacctcccccatcagtttattggcaacgtctgcaagcagctgcgtggtcatattatgccctttgcccgcggtatctcctgcatcaagggcgtcaacgtctcggacgacggcatttctctcttcagcgagtggattggcgacggtctgggcatctactgcggcgccctctccggcgccaacattgcctctgagattgcggccgagaaatggtcagagacgaccatcgcttacgaccctcctcccatggacaactcccgtgccccgacaccgcgctccaactcgcctgcaaacggaaacggcatcgcccctctgactcccgtcgagatgcagcacaaggacgcccgcggccgcacctccaagacgaagctcacccccgttcccgccgagtacccgcccctggaccaccagatcttcaagcagctcttccacagaccctatttccacgtccgcatggtctccgacgttgccggcgtgtcgcttggcggtgccctgaagaacatcgtcgcgctggcggccggtttcgtggacggccgcggctggggtgacaacgccaaggctgccattatgcgggtcggattgttggagatggtcaactttggaaaggagttctttggccagacggtgcacacgggcaccttcaccgaggagtcggctggtgtggcggatctgattacgtcctgtagcggtggtcgcaacttcaggtgcgccaagatggccgtcgcggagggattgagcgttgaggagattgagaaacgcgagctgaacggccagctgttgcagggtaccagcaccgccaaggaggtgaacagtttcctcaaggcgcgggggctggagaaggactacccgctctttacggcggtacacgggattctggagggacgacacagcgtcgacgacattccgagcctcgtctcggacagctag

SEQ ID NO: 73184 - protein, 420 aa, Colletotrichum gloeosporioides
MASLGADKKHKVTVVGSGNWGSTICKIVAENTKANPDLFEEAVHMWVFEEDVVIDKSSPYYDPAVGDAPQKLTGVINKYHENTKYLPGIKLPDNIIANPSLQDAVKDSTILVFNLPHQFIGNVCKQLRGHIMPFARGISCIKGVNVSDDGISLFSEWIGDGLGIYCGALSGANIASEIAAEKWSETTIAYDPPPMDNSRAPTPRSNSPANGNGIAPLTPVEMQHKDARGRTSKTKLTPVPAEYPPLDHQIFKQLFHRPYFHVRMVSDVAGVSLGGALKNIVALAAGFVDGRGWGDNAKAAIMRVGLLEMVNFGKEFFGQTVHTGTFTEESAGVADLITSCSGGRNFRCAKMAVAEGLSVEEIEKRELNGQLLQGTSTAKEVNSFLKARGLEKDYPLFTAVHGILEGRHSVDDIPSLVSDS

SEQ ID NO: 73185 - DNA, 1236 bp, Kluyveromyces thermotolerans
  CDS (1)..(1236)
atgttttcaatctccagaatcactagaacttctagtttcactacacagtttagagcgctataccgttttaaacactcagcaaggaaactccagagcatccctttcagcatatacaagaaaatgtccgctgccgacagactgaatcagacccacgacatcctatccgaatccgtgcaagccgtggaaaaccctttcaaagtcaccgtgattgggtccggtaactggggtaccaccatctccaaggttgtggccgagaacgctgcgctaagaccacacttgttcgtcaagcgtgtcgacatgtgggtgtttgaggagaccgtcgacggccagaagttgaccgagatcatcaacaccaagcaccagaacgtcaagtacctgcctaacatcgacctgccagagaacctggtcgccaacccagacttggtctctgccgtcaaggacgccgacatcctggtcttcaacatccctcaccagttcttgccacgcattgtctcccagttgcagggcaacatcaagaaggacgcccgtgccatctcctgtttgaagggtttcgacgtgtccaaggacggtgtcaagctgctatccacctacgtcaccgagaagctcggaatcacctgtggtgccctttccggtgctaacttggccccagaggttgccaaggagaactggtccgagaccactgttgcctacgagttgccaaaggacttcaagggcgagggcaaggacgtcgaccacgccgtcttgaaggctttgttccacagaccatacttccacgtcaacgtcattgacgatgtcgctggtatctctgttgccggtgccttgaagaacgttgtcgctctaggttgcggtttcgtcgagggtctaggctggggtaacaacgcctccgctgccatccagagagttggtttgggtgagatcatcaagttcggtcagatgttcttcccagactcccgtgtcgagacctactaccaggagtccgccggtgttgctgacttgatcaccacctgctctggtggtagaaacgtcagagtcgccacccacatggccaagactggtaagtctgccgaggagtgcgagaaggagctgttgaacggccagtccgcccaggtattcacacatgtaaggaggtccacgagtggttggccgagtgcggtaagaccgatgaattcgttctgttcgaggccgtttaccagattgtctacgagaacgctcctatggacactttgccagacatga

SEQ ID NO: 73186 - protein, 411 aa, Kluyveromyces thermotolerans
MFSISRITRTSSFTTQFRALYRFKHSARKLQSIPFSIYKKMSAADRLNQTHDILSESVQAVENPFKVTVIGSGNWGTTISKVVAENAALRPHLFVKRVDMWVFEETVDGQKLTEIINTKHQNVKYLPNIDLPENLVANPDLVSAVKDADILVFNIPHQFLPRIVSQLQGNIKKDARAISCLKGFDVSKDGVKLLSTYVTEKLGITCGALSGANLAPEVAKENWSETTVAYELPKDFKGEGKDVDHAVLKALFHRPYFHVNVIDDVAGISVAGALKNVVALGCGFVEGLGWGNNASAAIQRVGLGEIIKFGQMFFPDSRVETYYQESAGVADLITTCSGGRNVRVATHMAKTGKSAEECEKELLNGQSAQVFTHVRRSTSGWPSAVRPMNSFCSRPFTRLSTRTLLWTLCQT

SEQ ID NO: 73187 - DNA, 1302 bp, Magnaporthe grisea
  CDS (1)..(1302)
atggcttcacttgggagctacgcgaagaaacacaaggtcacgatcattggatcggggaactggggctctaccattgccaagattgtggccgagagcacaagagaacacaaggatgttttcgaagaagatgtgcagatgtgggtgtttgaggagaaggttacaatcccaaaggattcgccatactacgagagcgaagagccacaaaagctcacagaggtaatcaacaaacaccacgaaaacgtcaagtacctccctggtatcaaactgccatccaacatcattgccaacccctcgctcaccgacgctgtccgcgactcatccgtcctcgtcttcaacttgccccatgagttcctcggcaaggtttgccagcagctcaatggtcacattgtaccatttgcccgaggaatatcttgcatcaagggcgtggacgtgtcgggctccggcatcaacctgttttgcgaggtcatcggcgagaaattgggcatttactgtggtgcactctccggagccaacgtggcatctcagattgctgcagaggaaggcgtcagcgagaccactatcgcctacgacccgccgcccattgacagcagccgcgcggctactccccgcgaccgctcgcctaactacgattccaccagcgcaaacaagcttcctgacttgaccgtgacgtcggccgactccaacgggaaagatgacaggggccgcaggaccaaggcgaaactgactcctgtacctgagtcgtatccaccactcgaccacgagacattgcaaattctcttcgaccgtccttacttttccgtttccatggtgtctgacgtggctggcgtgtcgctcagcggtgccttgaagaacatcgtcgccctcgctgctggatttgtcgacggcaagggctggggttccaacgtgcagtcggcagtgattcgagttggcctggcagaaatgctcaaattcgcccgcgagttctttggggagtcggtcgatccgttcacgattctgctcgaaagtgccggcgtggctgatgtcatcacatcatgcatcagtggaagaaatttccgttgcgcgagcatggcagtcaagcgaggtgtatccgttgctgaaatcgaggaaaaggaactcaatggacagaagctgcagggaacctctaccgctaaggaagtaaacagtctattgaaggcacgtggcagggagggcgattatcccctgttcaccactgttaatgaaattcttgaaggcaaggcgagagtggacgaccttcccaagctcgtcatccgacaaaagcacaccatcgagaaatcaggctag

SEQ ID NO: 73188 - protein, 433 aa, Magnaporthe grisea
MASLGSYAKKHKVTIIGSGNWGSTIAKIVAESTREHKDVFEEDVQMWVFEEKVTIPKDSPYYESEEPQKLTEVINKHHENVKYLPGIKLPSNIIANPSLTDAVRDSSVLVFNLPHEFLGKVCQQLNGHIVPFARGISCIKGVDVSGSGINLFCEVIGEKLGIYCGALSGANVASQIAAEEGVSETTIAYDPPPIDSSRAATPRDRSPNYDSTSANKLPDLTVTSADSNGKDDRGRRTKAKLTPVPESYPPLDHETLQILFDRPYFSVSMVSDVAGVSLSGALKNIVALAAGFVDGKGWGSNVQSAVIRVGLAEMLKFAREFFGESVDPFTILLESAGVADVITSCISGRNFRCASMAVKRGVSVAEIEEKELNGQKLQGTSTAKEVNSLLKARGREGDYPLFTTVNEILEGKARVDDLPKLVIRQKHTIEKSG

SEQ ID NO: 73189 - DNA, 1146 bp, Pichia angusta
  CDS (1)..(1146)
atgactgctatggatagactggatcacgttagtaaccaattggccgcaaagcgccagaagaaaaacccggaaggcaagcctttccgcatcaccgtggtgggctccggcaattgggggtcaacgatcgcaaaagtggtcgccgagaacgctaaggagcttccggaggagttccatcagattgtgaaaatgtgggttttcgaggaggaagtggacggacgtaagctgaccgaaattatcaatacggaccacgagaacgtcaaatacctcccggacgtcaagttgcctgataacattgttgccattccggacattgttgacgcttgtgcggacgccgacattatcattttcaatatccctcaccagtttctgccaaagatccttgcccaattgaagggcaaggtcaacccaaaagcacgcgcaatctcctgtctgaagggtcttgaggtcaccaaggacggctgcaagttgctctcgaactatatcacggaggagctgggaatttactgtggtgccctttcaggagccaaccttgctccggaggttgccagacaaaagtggtcagagaccactgtggcttacagaattcctcaggacttccgtggcgaaggcaaggatgtcgaccagagcgtgatcagaaaccttttccaccgcccatacttccacgtccgagtcatcgacgacgttgctggtgtgtccttgagtggggctctgaagaacgtcattgccatggccgccggcttcgtcgagggacttggctggggagacaatgcgaagtcagctgtgatgcggattggattggtcgagatgatcaaatttgcccacatgttctttgaagactgccagtccaccactttcactcacgagagtgctggtgttgcggacatcatcacgacgtgcgccggaggcagaaacgtgcgtgttggaagatacatggcagagcacaaggtgagcggttttgaggcggagaaggtcttgttgaacggccagtcctgccagggtctgcacaccaccagagaggtgtatgagctgctggctgccaagaacgtgatcgacgagttcccgctcttcaaggccacgtaccaaatcatttacgaggggcttcctatggagaagttgccagagttgcttgaggcatctgaggactaa

SEQ ID NO: 73190 - protein, 381 aa, Pichia angusta
MTAMDRLDHVSNQLAAKRQKKNPEGKPFRITVVGSGNWGSTIAKVVAENAKELPEEFHQIVKMWVFEEEVDGRKLTEIINTDHENVKYLPDVKLPDNIVAIPDIVDACADADIIIFNIPHQFLPKILAQLKGKVNPKARAISCLKGLEVTKDGCKLLSNYITEELGIYCGALSGANLAPEVARQKWSETTVAYRIPQDFRGEGKDVDQSVIRNLFHRPYFHVRVIDDVAGVSLSGALKNVIAMAAGFVEGLGWGDNAKSAVMRIGLVEMIKFAHMFFEDCQSTTFTHESAGVADIITTCAGGRNVRVGRYMAEHKVSGFEAEKVLLNGQSCQGLHTTREVYELLAAKNVIDEFPLFKATYQIIYEGLPMEKLPELLEASED

SEQ ID NO: 73191 - DNA, 1284 bp, Trichoderma atroviride
  CDS (1)..(1284)
atggcgttcctcggcggctacgagaagaagcacaaggtcaccattgtgggatctggtaactgggggtctaccattgcaaaaatcgttgccgaaaacacgcgagcgaacaaggatgtctttgaggaggacgtccagatgtgggtgtttgaggaggacgtcaccatcgccaaggactccaagcactacgacgaatccatcggcgacgctccccagaagctgacccacgtcatcaacaagtaccacgaaaacgtcaagtacctgcccggcatcaccctccccagcaacatcatcgccaacccctccctcgtggacgccgtccaagactcgtcgatcctcatcttcaacctcccccaccagttcatccgcaacgtctgcaaccagatccgcggcaagatcctgccctttgcgcgcggcatcagctgcatcaagggcgtcaacgtgtccgacgacggcgtcagcctgttcagcgaatggattggcgacggcctcagcatctacgtcggcgcgctgagcggggccaacatcgccagcgagattgccgcggagaagtggtccgagacaaccattgcctacgacccgccgccaatggacaacagcagggcgcccacgccgcggtcccagagccccggcctgaccatgaccgtcacggagccgcctgccgacatgcagcaccgcgatgccaggggccgcaagtccaagaccaagctgacgcccgtgcccgcagagtatcccccgctcgaccacgcctgcttccattcgctcttccaccgcccttacttccacgtcgagatggtctctgacgttgctggcgtgtcccttggcggtgcgctgaagaacattgttgccctcgctgcgggcttcgttgacggccgcggctggggtgataatgccaaggccgctgtgatgcgaattggcttgatggaaatggtcaagtttggcaaggagttctttggggagactgtgcacactgcgactttcaccgagtcatctgccggtgttgccgacttgatcacctcttgctctggaggtcgaaacttccgatgcgcaagaaaggcggttgaaaagggcatcaccgtcgacgaggtggagaagcaggatctaaacggccagaagctccagggcaccagcacggcgtttgaggtcaacagcttcctcacggcccgtgggctggagaaggactacccgctgctgacggccgtcaatgctattctgctgggcaaggcgagcgttgacgacattcccagcctggtttccgacactgagcgaaaacaaccccttccatga

SEQ ID NO: 73192 - protein, 427 aa, Trichoderma atroviride
MAFLGGYEKKHKVTIVGSGNWGSTIAKIVAENTRANKDVFEEDVQMWVFEEDVTIAKDSKHYDESIGDAPQKLTHVINKYHENVKYLPGITLPSNIIANPSLVDAVQDSSILIFNLPHQFIRNVCNQIRGKILPFARGISCIKGVNVSDDGVSLFSEWIGDGLSIYVGALSGANIASEIAAEKWSETTIAYDPPPMDNSRAPTPRSQSPGLTMTVTEPPADMQHRDARGRKSKTKLTPVPAEYPPLDHACFHSLFHRPYFHVEMVSDVAGVSLGGALKNIVALAAGFVDGRGWGDNAKAAVMRIGLMEMVKFGKEFFGETVHTATFTESSAGVADLITSCSGGRNFRCARKAVEKGITVDEVEKQDLNGQKLQGTSTAFEVNSFLTARGLEKDYPLLTAVNAILLGKASVDDIPSLVSDTERKQPLP

SEQ ID NO: 73193 - DNA, 25 bp, Artificial sequence
  primer
atgcttgctgtcagaagattaacaa

SEQ ID NO: 73194 - DNA, 24 bp, Artificial sequence
  primer
ctattcgtcatcgatgtctagctc

SEQ ID NO: 73195 - protein, 419 aa, Artificial sequence
  consensus sequence
  Variant (2)..(4): Xaa in position 2 to 4 is any amino acid
  Variant (11)..(13): Xaa in position 11 to 13 is any amino acid
  Variant (16)..(17): Xaa in position 16 to 17 is any amino acid
  Variant (21)..(26): Xaa in position 21 to 26 is any amino acid
  Variant (27)..(31): Xaa in position 27 to 31 is any or no amino acid
  Variant (33)..(35): Xaa in position 33 to 35 is any amino acid
  Variant (37)..(37): Xaa in position 37 is any amino acid
  Variant (44)..(49): Xaa in position 44 to 49 is any amino acid
  Variant (50)..(66): Xaa in position 50 to 66 is any or no amino acid
  Variant (69)..(70): Xaa in position 69 to 70 is any amino acid
  Variant (73)..(74): Xaa in position 73 to 74 is any amino acid
  Variant (76)..(76): Xaa in position 76 is any amino acid
  Variant (78)..(78): Xaa in position 78 is any amino acid
  Variant (83)..(85): Xaa in position 83 to 85 is any amino acid
  Variant (88)..(88): Xaa in position 88 is any amino acid
  Variant (90)..(91): Xaa in position 90 to 91 is any amino acid
  Variant (93)..(93): Xaa in position 93 is any amino acid
  Variant (95)..(106): Xaa in position 95 to 106 is any amino acid
  Variant (109)..(110): Xaa in position 109 to 110 is any amino acid
  Variant (115)..(120): Xaa in position 115 to 120 is any amino acid
  Variant (122)..(123): Xaa in position 122 to 123 is any amino acid
  Variant (124)..(125): Xaa in position 124 to 125 is any or no amino acid
  Variant (127)..(133): Xaa in position 127 to 133 is any amino acid
  Variant (134)..(134): Xaa in position 134 is any or no amino acid
  Variant (138)..(138): Xaa in position 138 is any amino acid
  Variant (141)..(142): Xaa in position 141 to 142 is any amino acid
  Variant (144)..(146): Xaa in position 144 to 146 is any amino acid
  Variant (148)..(149): Xaa in position 148 to 149 is any amino acid
  Variant (151)..(151): Xaa in position 151 is any amino acid
  Variant (153)..(158): Xaa in position 153 to 158 is any amino acid
  Variant (162)..(162): Xaa in position 162 is any amino acid
  Variant (165)..(165): Xaa in position 165 is any amino acid
  Variant (171)..(171): Xaa in position 171 is any amino acid
  Variant (173)..(173): Xaa in position 173 is any amino acid
  Variant (175)..(175): Xaa in position 175 is any amino acid
  Variant (177)..(180): Xaa in position 177 to 180 is any amino acid
  Variant (181)..(181): Xaa in position 181 is any or no amino acid
  Variant (186)..(187): Xaa in position 186 to 187 is any amino acid
  Variant (189)..(189): Xaa in position 189 is any amino acid
  Variant (190)..(190): Xaa in position 190 is any or no amino acid
  Variant (192)..(200): Xaa in position 192 to 200 is any amino acid
  Variant (201)..(257): Xaa in position 201 to 257 is any or no amino acid
  Variant (260)..(260): Xaa in position 260 is any amino acid
  Variant (265)..(265): Xaa in position 265 is any amino acid
  Variant (267)..(270): Xaa in position 267 to 270 is any amino acid
  Variant (273)..(273): Xaa in position 273 is any amino acid
  Variant (275)..(278): Xaa in position 275 to 278 is any amino acid
  Variant (284)..(284): Xaa in position 284 is any amino acid
  Variant (287)..(289): Xaa in position 287 to 289 is any amino acid
  Variant (293)..(293): Xaa in position 293 is any amino acid
  Variant (295)..(296): Xaa in position 295 to 296 is any amino acid
  Variant (299)..(299): Xaa in position 299 is any amino acid
  Variant (301)..(302): Xaa in position 301 to 302 is any amino acid
  Variant (305)..(306): Xaa in position 305 to 306 is any amino acid
  Variant (308)..(308): Xaa in position 308 is any amino acid
  Variant (311)..(311): Xaa in position 311 is any amino acid
  Variant (313)..(315): Xaa in position 313 to 315 is any amino acid
  Variant (317)..(320): Xaa in position 317 to 320 is any amino acid
  Variant (322)..(326): Xaa in position 322 to 326 is any amino acid
  Variant (327)..(334): Xaa in position 327 to 334 is any or no amino acid
  Variant (336)..(337): Xaa in position 336 to 337 is any amino acid
  Variant (338)..(338): Xaa in position 338 is any or no amino acid
  Variant (349)..(349): Xaa in position 349 is any amino acid
  Variant (351)..(351): Xaa in position 351 is any amino acid
  Variant (356)..(358): Xaa in position 356 to 358 is any amino acid
  Variant (360)..(372): Xaa in position 360 to 372 is any amino acid
  Variant (373)..(378): Xaa in position 373 to 378 is any or no amino acid
  Variant (380)..(382): Xaa in position 380 to 382 is any amino acid
  Variant (384)..(384): Xaa in position 384 is any amino acid
  Variant (387)..(388): Xaa in position 387 to 388 is any amino acid
  Variant (391)..(392): Xaa in position 391 to 392 is any amino acid
  Variant (394)..(395): Xaa in position 394 to 395 is any amino acid
  Variant (398)..(400): Xaa in position 398 to 400 is any amino acid
  Variant (402)..(410): Xaa in position 402 to 410 is any amino acid
  Variant (413)..(418): Xaa in position 413 to 418 is any amino acid
VXXXGSGNWGXXXAKXXAENXXXXXXXXXXXFXXXVXMWVFEEXXXXXXXXXXXXXXXXXXXXXXXLTXXINXXHXNXKYLPXXXLPXNXXAXPXXXXXXXXXXXXVFXXPHQFXXXXXXQXXXXGXXXXXXXXISCXKGXXVXXXGXXLXSXXXXXXLGIXCGXLSGANXAXEXAXXXXXSETTXXYXXPXXXXXXXXXXXXXXXXXXXXXXXXXXXXXXXXXXXXXXXXXXXXXXXXXXXXXXXXXXXXXXXXXXLFXRPYFXVXXXXDVXGXXXXGALKNXVAXXXGFVXGXXWGXNXXAAXXRXGLXEXXXFXXXXFXXXXXXXXXXXXXTXXXESAGVADLITXCXGGRNXXXAXXXXXXXXXXXXXXXXXXXEXXXLXGQXXQGXXTXXEVXXXLXXXXXXXXXPLXXXXXXI

SEQ ID NO: 73196 - protein, 59 aa, Artificial sequence
  protein pattern
  Variant (2)..(2): Xaa in position 2 is any amino acid
  Variant (7)..(7): Xaa in position 7 is any amino acid
  Variant (8)..(8): Xaa in position 8 is Ile or Val
  Variant (9)..(10): Xaa in position 9 to 10 is any amino acid
  Variant (11)..(11): Xaa in position 11 is Ile, Leu or Val
  Variant (12)..(12): Xaa in position 12 is any amino acid
  Variant (15)..(15): Xaa in position 15 is Ala, Pro or Val
  Variant (17)..(17): Xaa in position 17 is Ala, Ile or Val
  Variant (18)..(18): Xaa in position 18 is Ala, Glu or Ser
  Variant (19)..(19): Xaa in position 19 is Ile, Leu, Met or Val
  Variant (20)..(20): Xaa in position 20 is Ala, Cys, Gly or Ser
  Variant (22)..(22): Xaa in position 22 is Ala or Thr
  Variant (26)..(27): Xaa in position 26 to 27 is Ile or Val
  Variant (29)..(29): Xaa in position 29 is any amino acid
  Variant (30)..(30): Xaa in position 30 is Ala, Cys, Gly or Ser
  Variant (31)..(31): Xaa in position 31 is Ala, Cys or Val
  Variant (33)..(33): Xaa in position 33 is any amino acid
  Variant (34)..(34): Xaa in position 34 is Ala, Gly, Ile or Val
  Variant (35)..(35): Xaa in position 35 is any amino acid
  Variant (37)..(37): Xaa in position 37 is any amino acid
  Variant (38)..(38): Xaa in position 38 is Glu, Gly, Asn or Gln
  Variant (39)..(39): Xaa in position 39 is any amino acid
  Variant (41)..(41): Xaa in position 41 is any amino acid
  Variant (43)..(43): Xaa in position 43 is Ala, Gly, Ser, Thr or Val
  Variant (44)..(44): Xaa in position 44 is any amino acid
  Variant (45)..(46): Xaa in position 45 to 46 is Ala or Ser
  Variant (47)..(47): Xaa in position 47 is Ile or Val
  Variant (48)..(48): Xaa in position 48 is any amino acid
  Variant (50)..(50): Xaa in position 50 is any amino acid
  Variant (52)..(52): Xaa in position 52 is Ile, Leu, Met or Val
  Variant (53)..(53): Xaa in position 53 is any amino acid
  Variant (55)..(57): Xaa in position 55 to 57 is any amino acid
  Variant (59)..(59): Xaa in position 59 is Ala, Cys, Gly or Ser
FXRPYFXXXXXXDVXGXXXXGXLKNXXAXXXGXXXGXXXGXNXXXXXXRXGXXEXXXFX

SEQ ID NO: 73197 - protein, 57 aa, Artificial sequence
  protein pattern
  Variant (2)..(3): Xaa in position 2 to 3 is any amino acid
  Variant (4)..(4): Xaa in position 4 is any or no amino acid
  Variant (6)..(6): Xaa in position 6 is any or no amino acid
  Variant (8)..(9): Xaa in position 8 to 9 is any amino acid
  Variant (11)..(11): Xaa in position 11 is any amino acid
  Variant (13)..(13): Xaa in position 13 is any amino acid
  Variant (14)..(14): Xaa in position 14 is Glu, Lys or Arg
  Variant (18)..(20): Xaa in position 18 to 20 is any amino acid
  Variant (23)..(23): Xaa in position 23 is any amino acid
  Variant (25)..(25): Xaa in position 25 is Ile, Leu or Val
  Variant (26)..(26): Xaa in position 26 is any amino acid
  Variant (28)..(28): Xaa in position 28 is any amino acid
  Variant (30)..(30): Xaa in position 30 is any amino acid
  Variant (31)..(31): Xaa in position 31 is Ile, Leu, Pro or Val
  Variant (32)..(33): Xaa in position 32 to 33 is any amino acid
  Variant (34)..(34): Xaa in position 34 is Ala, Ser, Thr or Val
  Variant (35)..(36): Xaa in position 35 to 36 is any amino acid
  Variant (37)..(37): Xaa in position 37 is Asp, Gly or Asn
  Variant (38)..(38): Xaa in position 38 is Ala, Ser or Val
  Variant (39)..(39): Xaa in position 39 is Asp, Asn, Ser or Thr
  Variant (40)..(40): Xaa in position 40 is Ile, Leu or Val
  Variant (41)..(41): Xaa in position 41 is Ile or Leu
  Variant (42)..(42): Xaa in position 42 is Ile or Val
  Variant (44)..(44): Xaa in position 44 is Asn or Val
  Variant (45)..(45): Xaa in position 45 is Ile, Leu or Val
  Variant (48)..(48): Xaa in position 48 is Glu or Gln
  Variant (50)..(50): Xaa in position 50 is Ile or Leu
  Variant (51)..(55): Xaa in position 51 to 55 is any amino acid
  Variant (56)..(56): Xaa in position 56 is Glu, Asn or Gln
  Variant (57)..(57): Xaa in position 57 is Ile, Leu or Met
LXXXIXNXXHXNXXYLPXXXLPXNXXAXPXXXXXXXXXXXXXFXXPHXFXXXXXXXX

SEQ ID NO: 73198 - protein, 20 aa, Artificial sequence
  protein pattern
  Variant (2)..(2): Xaa in position 2 is Ala or Cys
  Variant (4)..(4): Xaa in position 4 is Ile or Val
  Variant (9)..(9): Xaa in position 9 is Ala or Thr
  Variant (10)..(10): Xaa in position 10 is Ser or Thr
  Variant (11)..(11): Xaa in position 11 is Cys or Ser
  Variant (12)..(12): Xaa in position 12 is any amino acid
  Variant (17)..(17): Xaa in position 17 is any amino acid
  Variant (18)..(18): Xaa in position 18 is Lys or Arg
  Variant (19)..(19): Xaa in position 19 is any amino acid
  Variant (20)..(20): Xaa in position 20 is Ala or Gly
SXGXADLIXXXXGGRNXXXX

SEQ ID NO: 73199 - protein, 22 aa, Artificial sequence
  protein pattern
  Variant (2)..(3): Xaa in position 2 to 3 is any or no amino acid
  Variant (5)..(5): Xaa in position 5 is any or no amino acid
  Variant (12)..(12): Xaa in position 12 is Ser or Thr
  Variant (13)..(13): Xaa in position 13 is Ala, Thr or Val
  Variant (14)..(14): Xaa in position 14 is Ala, Ile or Val
  Variant (15)..(15): Xaa in position 15 is Ala, Cys, Gly or Ser
  Variant (16)..(16): Xaa in position 16 is Lys or Arg
  Variant (17)..(17): Xaa in position 17 is Ile, Leu or Val
  Variant (18)..(18): Xaa in position 18 is any amino acid
  Variant (19)..(19): Xaa in position 19 is Ala, Gly or Ser
  Variant (20)..(20): Xaa in position 20 is Glu, Gln, Ser or Thr
  Variant (22)..(22): Xaa in position 22 is Ala, Cys or Thr
VXXVXGSGNWGXXXXXXXXXNX

SEQ ID NO: 73200 - protein, 21 aa, Artificial sequence
  protein pattern
  Variant (2)..(2): Xaa in position 2 is Cys or Gly
  Variant (3)..(3): Xaa in position 3 is Ala or Val
  Variant (5)..(5): Xaa in position 5 is any amino acid
  Variant (9)..(9): Xaa in position 9 is Ile, Leu or Val
  Variant (11)..(11): Xaa in position 11 is any amino acid
  Variant (13)..(13): Xaa in position 13 is Ile or Val
  Variant (15)..(15): Xaa in position 15 is any amino acid
  Variant (16)..(19): Xaa in position 16 to 19 is any or no amino acid
  Variant (21)..(21): Xaa in position 21 is Ala, Asn, Ser or Thr
CXXLXGANXAXEXAXXXXXEX

SEQ ID NO: 73201 - protein, 23 aa, Artificial sequence
  protein pattern
  Variant (2)..(4): Xaa in position 2 to 4 is any amino acid
  Variant (6)..(6): Xaa in position 6 is any amino acid
  Variant (9)..(10): Xaa in position 9 to 10 is any amino acid
  Variant (13)..(14): Xaa in position 13 to 14 is any amino acid
  Variant (16)..(16): Xaa in position 16 is Ala, Cys or Thr
  Variant (17)..(17): Xaa in position 17 is any amino acid
  Variant (20)..(22): Xaa in position 20 to 22 is any amino acid
EXXXLXGQXXQGXXTXXEVXXXL

SEQ ID NO: 73202 - protein, 14 aa, Artificial sequence
  protein pattern
  Variant (2)..(4): Xaa in position 2 to 4 is any amino acid
  Variant (6)..(6): Xaa in position 6 is any amino acid
  Variant (11)..(11): Xaa in position 11 is Asp, Glu or Gln
  Variant (13)..(13): Xaa in position 13 is any amino acid
  Variant (14)..(14): Xaa in position 14 is Ile, Leu or Val
FXXXVXMWVFXEXX

SEQ ID NO: 73203 - protein, 12 aa, Artificial sequence
  protein pattern
  Variant (2)..(2): Xaa in position 2 is any amino acid
  Variant (3)..(4): Xaa in position 3 to 4 is any or no amino acid
  Variant (7)..(7): Xaa in position 7 is Ile or Leu
  Variant (10)..(10): Xaa in position 10 is Phe, Leu or Val
  Variant (11)..(11): Xaa in position 11 is any amino acid
  Variant (12)..(12): Xaa in position 12 is Leu or Val
AXXXSCXKGXXX

SEQ ID NO: 73204 - DNA, 1083 bp, Saccharomyces cerevisiae
  CDS (1)..(1083)
atgaagctactaaccttcccaggtcaagggacctccatctccatttcgatattaaaagcgataataagaaacaaatcaagagaattccaaacaatactgagtcagaacggcaaggaatcaaatgatctattgcagtacatcttccagaacccttccagccccggaagcattgcagtctgctccaaccttttctatcaattgtaccagatactctcgaatccttctgatcctcaagatcaagcaccaaaaaatatgactaagatcgattcccccgacaagaaagacaatgaacaatgttaccttttgggtcactcgctaggcgagttaacatgtctgagtgttaattcactgttttcgttaaaggatctttttgatattgctaattttagaaataagttaatggtaacatctactgaaaagtacttagtagcccacaatatcaacagatccaacaaatttgaaatgtgggcactctcttctccgagggccacagatttaccgcaagaagtgcaaaaactactaaattcccctaatttattatcatcttcacaaaataccatttctgtagcaaatgcaaattcagtaaagcaatgtgtagtcaccggtctggttgatgatttagagtccttaagaacagaattgaacttaaggttcccgcgtttaagaattacagaattaactaacccatacaacatccccttccataatagcactgtgttgaggcccgttcaggaaccactctatgactacatttgggatatattaaagaaaaacggaactcacacgttgatggagttgaaccatccaataatagctaacttagatggtaatatatcttactatattcatcatgccctagatagattcgttaagtgttcaagcaggactgtgcaattcaccatgtgttatgataccataaactctggaaccccagtggaaattgataagagtatttgctttggcccgggcaatgtgatttataaccttattcggagaaattgtccccaagtggacactatagaatacacctctttagcaactatagacgcttatcacaaggcggcagaggagaacaaagattga

SEQ ID NO: 73205 - protein, 360 aa, Saccharomyces cerevisiae
MKLLTFPGQGTSISISILKAIIRNKSREFQTILSQNGKESNDLLQYIFQNPSSPGSIAVCSNLFYQLYQILSNPSDPQDQAPKNMTKIDSPDKKDNEQCYLLGHSLGELTCLSVNSLFSLKDLFDIANFRNKLMVTSTEKYLVAHNINRSNKFEMWALSSPRATDLPQEVQKLLNSPNLLSSSQNTISVANANSVKQCVVTGLVDDLESLRTELNLRFPRLRITELTNPYNIPFHNSTVLRPVQEPLYDYIWDILKKNGTHTLMELNHPIIANLDGNISYYIHHALDRFVKCSSRTVQFTMCYDTINSGTPVEIDKSICFGPGNVIYNLIRRNCPQVDTIEYTSLATIDAYHKAAEENKD

SEQ ID NO: 73206 - DNA, 891 bp, Eremothecium gossypii
  CDS (1)..(891)
atgcgattagtcacgtttcctgggcagggtagcgccgtgttggcgagctcgctggcccgctggtgtgagtcgcgggcgggcttccagcacagctcggtggcggacgtggtggcatacgtggagcggcagcccgcagcgccgggggcgattgccgcgtgctcgacgctgctgtaccagtgctggctggagcgcgggccggagcagggcgaggcgatgatgctggggcactcgctgggggagctgagcgcgctgaacgcgagcggcagcaacgcgctgctgggggtgcatgacgtgctggaggtggcgcagcgtcggcacgcgctgatgcgcgaggcggcggcggcgcatgcgcgggcgcacggcgtgcgcgggttcgtggcgcgggtggtgacgctgcggcgcgcgggcgatctgcgggcgcagctggagctgcgcgggacgctgcgcctagcgaaccacaactcgctgcggcagtgcatcgtgacgggggcggcggacgacccggcgtgggcggcgctgccggcgggcgcgcgcgtggacgcgctgctgaacccggacggcatccctttccacaacgacgcggtgctgcggccgatccagggcccgctgtacgacctgctgtgggagcggttggcgcgcaacggcgtgagccgcgcgcgcagcctggaccgcccgctgctgagctgcctggacggcgcggcgaccgaccgtcttgacgtggccgtggagaagttcgtgcgctcgagcacgaacgtggtcgagttcgtcgcagcctgccgcacggcggtgcaggcgggcgcgacggccgcgctgcacgtcgggcccgggcgcgcggtcggcgcgctggtggaccgcaacacggggctcaccgcgagcgagacgctagactga

SEQ ID NO: 73207 - protein, 296 aa, Eremothecium gossypii
MRLVTFPGQGSAVLASSLARWCESRAGFQHSSVADVVAYVERQPAAPGAIAACSTLLYQCWLERGPEQGEAMMLGHSLGELSALNASGSNALLGVHDVLEVAQRRHALMREAAAAHARAHGVRGFVARVVTLRRAGDLRAQLELRGTLRLANHNSLRQCIVTGAADDPAWAALPAGARVDALLNPDGIPFHNDAVLRPIQGPLYDLLWERLARNGVSRARSLDRPLLSCLDGAATDRLDVAVEKFVRSSTNVVEFVAACRTAVQAGATAALHVGPGRAVGALVDRNTGLTASETLD

SEQ ID NO: 73208 - DNA, 1035 bp, Candida glabrata CBS 138
  CDS (1)..(1035)
atgaagttggttacattccctggacaaggcactccgatccctgttgctgtactgaaggccttgattcggaacaaagatgcgcagttcaacactatcttgaatcgtggactgcacagacgggacttactagagtacatattcagaaacccatctagccccggtagcatcgcagtgtgttccaatttcctatatgaaatgtatggtctgatctccgaggacttgcggccccaccatcgggactcgcttatactgcttgggcactcgctaggtgagctgacctgcttgaaggtgaatgagctgttcactacaaaggagctgtttgagattgccaactacagaaatgacctaatggtcaagtacacggaacagtacctgagggcttacaacagaagaggatcgaagtttgagatgtgggcgctgtcgtctccaaaggctactgacttaccatatgagatacataaattgctcacggagtcacctacgttcccgggatcccacacaatatcggtcgccaatgcaaattcagttaagcagtgcgtggtaacgggtctagtcgaggacttagaagcattgagaacagaattacacttgaatataccaagactaagaatttcagaactaaccaatccacataacttgccattccacaacaacacagtactaagaccaattcaggaaccactatacgatttcatatggaagataatgaagaataacggcacacatacatggactacgctaaaccacccaatagtttccaacctcgacggtaaagaaaccaaatttatacaccacgcactggataagtttgtaaagtgtagctcaaccactgtacagttcacaaaatgctacgataccattaacagaatagcggaagccacaaaagatcaagaggaccccttggatgcagctatctgtatcgggccgggaaatgtcatctacaacttaatcagaaggaatgtccctagcctgaaatgcgtggaatactcttcaatggccaccatagactcctaccatggtacacacgacttataa

SEQ ID NO: 73209 - protein, 344 aa, Candida glabrata CBS 138
MKLVTFPGQGTPIPVAVLKALIRNKDAQFNTILNRGLHRRDLLEYIFRNPSSPGSIAVCSNFLYEMYGLISEDLRPHHRDSLILLGHSLGELTCLKVNELFTTKELFEIANYRNDLMVKYTEQYLRAYNRRGSKFEMWALSSPKATDLPYEIHKLLTESPTFPGSHTISVANANSVKQCVVTGLVEDLEALRTELHLNIPRLRISELTNPHNLPFHNNTVLRPIQEPLYDFIWKIMKNNGTHTWTTLNHPIVSNLDGKETKFIHHALDKFVKCSSTTVQFTKCYDTINRIAEATKDQEDPLDAAICIGPGNVIYNLIRRNVPSLKCVEYSSMATIDSYHGTHDL

SEQ ID NO: 73210 - DNA, 972 bp, Kluyveromyces lactis NRRL Y-1140
  CDS (1)..(972)
atgtccggacggttattaagttttccgggtcagggcagcaaagtacttctagacaggttacagcgttgggctgctaatgtctcgggatttaaagacgtaagcttgatcgacagattcactggtacattggaacaaccggaaactatcgctgcatgttcgaaccttttatatagcaattggttaacggataatgcgaatcagaattcaaacggtaaaacttatgttattggacattcgcttggagaattgaatgctctgaatgcaagtgtcaatggattggccttcggatgtaaagatatcatagaaattgcatcgtttcggaaccaactaatggtagaagccacccaacgctatttagaaaagtgtagaataaccgatgattcctttgagttgtgggccgttacaaatgtccgaagtaaaaatttaaggaaggacctatcggctgttttagattccaatataacaaactcttcggttgacaaaccgtgtagcatcaaactggctaatgacaatgcagtcaaccaatgcgttattacagggttatccaatgatatccagaaacttgtggaaacatgcaagatggaaaatctaagacacaaatttactaaattggatagtccgttttccattcctttccacaatataaatgttctacgatccattcaggaaccattatacgatttcatttgggatacactaaaggaaaatgggaaacaccattttatcaatgagaaggtggaaaatggcattttttctaatatagacggtaagttgacgtaccaattcgatactgcgttagaaaattttgtcgcaggtagttgcaacattgtcaacttcgtcgattcctgtaaaaacatatcttcactatcaagcgtagaaaaggcataccattttggtcctggtacatctattgggaaacttattgaacgcaacctcaagacatgcgatatctctcataattttatcgattga

SEQ ID NO: 73211 - protein, 323 aa, Kluyveromyces lactis NRRL Y-1140
MSGRLLSFPGQGSKVLLDRLQRWAANVSGFKDVSLIDRFTGTLEQPETIAACSNLLYSNWLTDNANQNSNGKTYVIGHSLGELNALNASVNGLAFGCKDIIEIASFRNQLMVEATQRYLEKCRITDDSFELWAVTNVRSKNLRKDLSAVLDSNITNSSVDKPCSIKLANDNAVNQCVITGLSNDIQKLVETCKMENLRHKFTKLDSPFSIPFHNINVLRSIQEPLYDFIWDTLKENGKHHFINEKVENGIFSNIDGKLTYQFDTALENFVAGSCNIVNFVDSCKNISSLSSVEKAYHFGPGTSIGKLIERNLKTCDISHNFID

SEQ ID NO: 73212 - DNA, 25 bp, Artificial sequence
  primer
atgcttgtcttgagaaagttggaag

SEQ ID NO: 73213 - DNA, 23 bp, Artificial sequence
  primer
tcaatctttgttctcctctgccg

SEQ ID NO: 73214 - protein, 360 aa, Artificial sequence
  consensus sequence
  Variant (2)..(3): Xaa in position 2 to 3 is any amino acid
  Variant (9)..(15): Xaa in position 9 to 15 is any amino acid
  Variant (17)..(32): Xaa in position 17 to 32 is any amino acid
  Variant (33)..(39): Xaa in position 33 to 39 is any or no amino acid
  Variant (41)..(48): Xaa in position 41 to 48 is any amino acid
  Variant (49)..(51): Xaa in position 49 to 51 is any or no amino acid
  Variant (53)..(54): Xaa in position 53 to 54 is any amino acid
  Variant (57)..(57): Xaa in position 57 is any amino acid
  Variant (60)..(62): Xaa in position 60 to 62 is any amino acid
  Variant (64)..(79): Xaa in position 64 to 79 is any amino acid
  Variant (80)..(100): Xaa in position 80 to 100 is any or no amino acid
  Variant (108)..(109): Xaa in position 108 to 109 is any amino acid
  Variant (111)..(124): Xaa in position 111 to 124 is any amino acid
  Variant (125)..(127): Xaa in position 125 to 127 is any or no amino acid
  Variant (129)..(130): Xaa in position 129 to 130 is any amino acid
  Variant (132)..(133): Xaa in position 132 to 133 is any amino acid
  Variant (136)..(150): Xaa in position 136 to 150 is any amino acid
  Variant (151)..(153): Xaa in position 151 to 153 is any or no amino acid
  Variant (155)..(166): Xaa in position 155 to 166 is any amino acid
  Variant (168)..(179): Xaa in position 168 to 179 is any amino acid
  Variant (180)..(192): Xaa in position 180 to 192 is any or no amino acid
  Variant (195)..(195): Xaa in position 195 is any amino acid
  Variant (197)..(199): Xaa in position 197 to 199 is any amino acid
  Variant (202)..(203): Xaa in position 202 to 203 is any amino acid
  Variant (206)..(208): Xaa in position 206 to 208 is any amino acid
  Variant (210)..(223): Xaa in position 210 to 223 is any amino acid
  Variant (224)..(228): Xaa in position 224 to 228 is any or no amino acid
  Variant (230)..(231): Xaa in position 230 to 231 is any amino acid
  Variant (233)..(235): Xaa in position 233 to 235 is any amino acid
  Variant (240)..(241): Xaa in position 240 to 241 is any amino acid
  Variant (245)..(246): Xaa in position 245 to 246 is any amino acid
  Variant (248)..(248): Xaa in position 248 is any amino acid
  Variant (253)..(254): Xaa in position 253 to 254 is any amino acid
  Variant (256)..(260): Xaa in position 256 to 260 is any amino acid
  Variant (263)..(277): Xaa in position 263 to 277 is any amino acid
  Variant (278)..(279): Xaa in position 278 to 279 is any or no amino acid
  Variant (282)..(289): Xaa in position 282 to 289 is any amino acid
  Variant (291)..(293): Xaa in position 291 to 293 is any amino acid
  Variant (296)..(297): Xaa in position 296 to 297 is any amino acid
  Variant (299)..(301): Xaa in position 299 to 301 is any amino acid
  Variant (303)..(303): Xaa in position 303 is any amino acid
  Variant (305)..(322): Xaa in position 305 to 322 is any amino acid
  Variant (323)..(331): Xaa in position 323 to 331 is any or no amino acid
  Variant (335)..(339): Xaa in position 335 to 339 is any amino acid
  Variant (341)..(342): Xaa in position 341 to 342 is any amino acid
  Variant (345)..(353): Xaa in position 345 to 353 is any amino acid
  Variant (354)..(359): Xaa in position 354 to 359 is any or no amino acid
LXXFPGQGXXXXXXXLXXXXXXXXXXXXXXXXXXXXXXXDXXXXXXXXXXXPXXIAXCSXXXYXXXXXXXXXXXXXXXXXXXXXXXXXXXXXXXXXXXXXGHSLGELXXLXXXXXXXXXXXXXXXXXAXXRXXLMXXXXXXXXXXXXXXXXXXFXXXXXXXXXXXXLXXXXXXXXXXXXXXXXXXXXXXXXXANXNXXXQCXXTGXXXDXXXXXXXXXXXXXXXXXXXLXXPXXXPFHNXXVLRXXQXPLYDXXWXXXXXNGXXXXXXXXXXXXXXXXXDGXXXXXXXXAXXXFVXXSXXXVXFXXXXXXXXXXXXXXXXXXXXXXXXXXXGPGXXXXXLXXRNXXXXXXXXXXXXXXXD

SEQ ID NO: 73215 - protein, 40 aa, Artificial sequence
  protein pattern
  Variant (2)..(4): Xaa in position 2 to 4 is any amino acid
  Variant (5)..(6): Xaa in position 5 to 6 is any or no amino acid
  Variant (8)..(8): Xaa in position 8 is any amino acid
  Variant (9)..(9): Xaa in position 9 is Asn or Ser
  Variant (11)..(11): Xaa in position 11 is any amino acid
  Variant (12)..(12): Xaa in position 12 is Gly, Asn or Ser
  Variant (13)..(13): Xaa in position 13 is Ile or Leu
  Variant (18)..(18): Xaa in position 18 is any amino acid
  Variant (19)..(19): Xaa in position 19 is Ala, Asn or Thr
  Variant (23)..(23): Xaa in position 23 is Pro or Ser
  Variant (24)..(24): Xaa in position 24 is Ile or Val
  Variant (26)..(26): Xaa in position 26 is Glu or Gly
  Variant (31)..(31): Xaa in position 31 is any amino acid
  Variant (32)..(32): Xaa in position 32 is Ile or Leu
  Variant (34)..(34): Xaa in position 34 is Asp, Glu or Lys
  Variant (35)..(35): Xaa in position 35 is any amino acid
  Variant (36)..(36): Xaa in position 36 is Leu or Met
  Variant (37)..(38): Xaa in position 37 to 38 is any amino acid
RXXXXXLXXPXXXPFHNXXVLRXXQXPLYDXXWXXXXXNG

SEQ ID NO: 73216 - protein, 31 aa, Artificial sequence
  protein pattern
  Variant (3)..(4): Xaa in position 3 to 4 is any amino acid
  Variant (5)..(5): Xaa in position 5 is Ser or Thr
  Variant (6)..(7): Xaa in position 6 to 7 is any amino acid
  Variant (8)..(8): Xaa in position 8 is Phe, Ile or Leu
  Variant (9)..(9): Xaa in position 9 is Asp or His
  Variant (10)..(10): Xaa in position 10 is any amino acid
  Variant (12)..(12): Xaa in position 12 is Leu or Val
  Variant (13)..(13): Xaa in position 13 is Asp or Glu
  Variant (14)..(14): Xaa in position 14 is any amino acid
  Variant (17)..(17): Xaa in position 17 is any amino acid
  Variant (18)..(18): Xaa in position 18 is Cys, Gly or Ser
  Variant (20)..(20): Xaa in position 20 is Cys, Ser or Thr
  Variant (21)..(22): Xaa in position 21 to 22 is any amino acid
  Variant (24)..(24): Xaa in position 24 is Glu, Asn or Gln
  Variant (26)..(27): Xaa in position 26 to 27 is any amino acid
  Variant (28)..(28): Xaa in position 28 is any or no amino acid
  Variant (30)..(30): Xaa in position 30 is any amino acid
  Variant (31)..(31): Xaa in position 31 is Asp, Asn or Thr
DGXXXXXXXXAXXXFVXXSXXXVXFXXXCXX

SEQ ID NO: 73217 - protein, 16 aa, Artificial sequence
  protein pattern
  Variant (2)..(2): Xaa in position 2 is Glu or Gly
  Variant (3)..(3): Xaa in position 3 is Ala, Ser or Thr
  Variant (6)..(6): Xaa in position 6 is Ala or Val
  Variant (9)..(9): Xaa in position 9 is any amino acid
  Variant (10)..(10): Xaa in position 10 is any or no amino acid
  Variant (12)..(12): Xaa in position 12 is any or no amino acid
  Variant (14)..(14): Xaa in position 14 is Glu, Gln or Ser
  Variant (15)..(15): Xaa in position 15 is any amino acid
  Variant (16)..(16): Xaa in position 16 is Trp or Tyr
PXXIAXCSXXLXYXXX

SEQ ID NO: 73218 - protein, 18 aa, Artificial sequence
  protein pattern
  Variant (3)..(3): Xaa in position 3 is any amino acid
  Variant (5)..(5): Xaa in position 5 is Ala or Ser
  Variant (6)..(6): Xaa in position 6 is Leu or Val
  Variant (7)..(7): Xaa in position 7 is any amino acid
  Variant (10)..(10): Xaa in position 10 is any or no amino acid
  Variant (12)..(12): Xaa in position 12 is any or no amino acid
  Variant (15)..(16): Xaa in position 15 to 16 is any amino acid
  Variant (17)..(17): Xaa in position 17 is any or no amino acid
ANXNXXXQCXVXTGXXXD

SEQ ID NO: 73219 - protein, 9 aa, Artificial sequence
  protein pattern
  Variant (2)..(2): Xaa in position 2 is Leu or Val
  Variant (3)..(3): Xaa in position 3 is Ser or Thr
  Variant (9)..(9): Xaa in position 9 is Ser or Thr
LXXFPGQGX

SEQ ID NO: 73220 - protein, 14 aa, Artificial sequence
  protein pattern
  Variant (4)..(4): Xaa in position 4 is any amino acid
  Variant (5)..(5): Xaa in position 5 is Ala, Ser or Val
  Variant (6)..(6): Xaa in position 6 is Ile or Val
  Variant (7)..(8): Xaa in position 7 to 8 is any amino acid
  Variant (10)..(10): Xaa in position 10 is any amino acid
  Variant (11)..(11): Xaa in position 11 is any or no amino acid
  Variant (13)..(13): Xaa in position 13 is any or no amino acid
GPGXXXXXLXXRXN

SEQ ID NO: 73221 - protein, 10 aa, Artificial sequence
  protein pattern
  Variant (8)..(8): Xaa in position 8 is Asn, Ser or Thr
  Variant (9)..(9): Xaa in position 9 is Ala or Cys
GHSLGELXXL

SEQ ID NO: 73222 - DNA, 981 bp, Saccharomyces cerevisiae
  CDS (1)..(981)
atggcagaagtactgaccgtcctcgagcagccgaactcaattaaagattttctcaagcaggattcaaatattgcgtttctagctggtggagtagctggcgcggtttcccgaaccgttgtttcaccttttgagagagttaaaatactgctgcaagttcaaagttcaaccacttcttataaccgaggtatctttagctctatacggcaggtttaccatgaggagggaaccaaaggtttattcagaggaaatggtttgaactgcataagaatttttccctatagtgcagtccagtttgtagtatacgaagcttgtaagaaaaagttattccatgtaaatggcaataatggacaagaacaactaacgaacacccaaagactattcagtggtgcattgtgtggtggttgtagtgtggtggctacttacccgttggacttgatcaaaacaagactatcgattcagacagcaaatttgagcagtttaaaccgctcaaaggcaaaaagtatatcaaagcctccggggatctggcaattactaagcgaaacttacagactcgaaggcggtctcaggggattatataggggtgtatggccaacgagtcttggtgttgttccatatgtagcactaaactttgcagtttacgaacaattgagagaattcggtgtcaattcctccgatgctcagccttcctggaaaagtaacctctataaattaacaattggcgccataagtggaggggttgcgcaaacaatcacttatccctttgatctgctaagaagaagatttcaagttctcgcaatgggcggaaatgaactgggatttagatacacgagtgtctgggatgcgctcgtgacaatcggcagagcagaaggcgttagcggttactacaaaggcttagctgcaaacctttttaaagttgttccttcaactgcagtgagttggctagtttacgaagttgtatgtgattctgtaagaaattggtga

SEQ ID NO: 73223 - protein, 326 aa, Saccharomyces cerevisiae
MAEVLTVLEQPNSIKDFLKQDSNIAFLAGGVAGAVSRTVVSPFERVKILLQVQSSTTSYNRGIFSSIRQVYHEEGTKGLFRGNGLNCIRIFPYSAVQFVVYEACKKKLFHVNGNNGQEQLTNTQRLFSGALCGGCSVVATYPLDLIKTRLSIQTANLSSLNRSKAKSISKPPGIWQLLSETYRLEGGLRGLYRGVWPTSLGVVPYVALNFAVYEQLREFGVNSSDAQPSWKSNLYKLTIGAISGGVAQTITYPFDLLRRRFQVLAMGGNELGFRYTSVWDALVTIGRAEGVSGYYKGLAANLFKVVPSTAVSWLVYEVVCDSVRNW

SEQ ID NO: 73224 - DNA, 954 bp, Schizosaccharomyces pombe 972h-
  CDS (1)..(954)
atgcaaaaggacaaatttggcccttgtgcaccttctaggatacctctgttgagcaatgatttgatttctatgttatccggaggagttgctgctaccgttagtcggacagcggtaagcccactggaacgaatgaagatcatttttcaggttcaaaacaacaaagaatatacttctctcacttcgacacttgtcaaaatatggaaccgtgaaggcctcataggtttttttcggggcaatggtacgaactgcttgagagcgtttccttacggggccgtacaattcgcgactttcaatatgctcaaacaaagagccttaaaaaatagatcacatcagaatttggaaaatcatgaaaggcttctttttggcgcaattgctggtgctgccagttgcgctacgacatatcctttggacattgcacgaacgcgtttgtccattgagacagctggactaacatcacgaagcttagcaatcaataatgtcgctaataattctttgaaagtaaaacctcttactttgtggtctactctattatacatagttcagcatgagggtggatatcctgccctttataatggtctccctgccactttattgaacgtcgttccgtatgtctcaatatgtttttttacatttgaattttgcaaacaaaaatttttctcaaatgctgacttgactgcttttcaaaagctctttttgggtgggtttaccgggattattggccaaacactaacatttcctgctgatgtacttcgacggcgatttcaagtgaatagaattcctggtattggacacaattataaaaatataaaaagcgcaatatttcatatatataaaaccgaaggaatcaatggattttttcgtggctattcgagcaatatgttgaaaattatccctgttatgagtattacatggtatacatatgaaactgttagtaaaatgcttcacgatctttaa

SEQ ID NO: 73225 - protein, 317 aa, Schizosaccharomyces pombe 972h-
MQKDKFGPCAPSRIPLLSNDLISMLSGGVAATVSRTAVSPLERMKIIFQVQNNKEYTSLTSTLVKIWNREGLIGFFRGNGTNCLRAFPYGAVQFATFNMLKQRALKNRSHQNLENHERLLFGAIAGAASCATTYPLDIARTRLSIETAGLTSRSLAINNVANNSLKVKPLTLWSTLLYIVQHEGGYPALYNGLPATLLNVVPYVSICFFTFEFCKQKFFSNADLTAFQKLFLGGFTGIIGQTLTFPADVLRRRFQVNRIPGIGHNYKNIKSAIFHIYKTEGINGFFRGYSSNMLKIIPVMSITWYTYETVSKMLHDL

SEQ ID NO: 73226 - DNA, 1008 bp, Arabidopsis thaliana
  CDS (1)..(1008)
atggagcatgttgataaggacaacaacggaattataacttttgaggagtggagggattttcttttgctaaaccctcatgaagctacaattgagaacatttatcatcactgggaaagagtatgcttaatagacattggagagcaagctgttataccagatggtataagtgcacacgctcaaagaagcaaattacttctcgcgggaggaatagcaggggctgtttctagaaccgcaactgcgcctctggaccgtctgaaagttgctctgcaagttcaacggacaaatttgggtgttgtcccgaccattaagaaaatatggagagaagataagttgttgggtttcttcagaggtaatgggttaaatgtagcgaaagtcgctcctgaaagcgctataaagtttgctgcttatgaaatgctgaaaccaataattgggggagcggatggtgacattggtacaagcgggaggcttttggctggtggattggctggtgcagtggctcaaacagctatttatcctatggatctcgtgaagactcggttacagacttttgtgagtgaagttgggacaccaaagctgtggaaactcacaaaggatatttggattcaagaaggaccccgagctttttacaggggtctttgtccttctctaattgggattatcccttacgcaggaattgaccttgctgcttacgaaactcttaaagacttatcaagggcacattttcttcatgacactgcggagccaggtcctttgatacaactgggatgtggaatgacttctggagctcttggagcatcgtgtgtttacccattacaggtcataagaacaagaatgcaagctgatagctcaaaaacaagcatgggccaagagtttctgaaaacgctaagaggcgaaggtctaaaaggtttttacagaggaatcttccccaacttcttcaaagtcattccttccgcaagcatttcgtaccttgtctacgaagctatgaagaaaaatcttgcccttgattaa

SEQ ID NO: 73227 - protein, 335 aa, Arabidopsis thaliana
MEHVDKDNNGIITFEEWRDFLLLNPHEATIENIYHHWERVCLIDIGEQAVIPDGISAHAQRSKLLLAGGIAGAVSRTATAPLDRLKVALQVQRTNLGVVPTIKKIWREDKLLGFFRGNGLNVAKVAPESAIKFAAYEMLKPIIGGADGDIGTSGRLLAGGLAGAVAQTAIYPMDLVKTRLQTFVSEVGTPKLWKLTKDIWIQEGPRAFYRGLCPSLIGIIPYAGIDLAAYETLKDLSRAHFLHDTAEPGPLIQLGCGMTSGALGASCVYPLQVIRTRMQADSSKTSMGQEFLKTLRGEGLKGFYRGIFPNFFKVIPSASISYLVYEAMKKNLALD

SEQ ID NO: 73228 - DNA, 996 bp, Arabidopsis thaliana
  CDS (1)..(996)
atgggttcgtcacaaggctccacactctcggctgatgtgatgagccttgtggatacattgcctgtgcttgcaaaaacccttatcgctggaggagctgctggggcaattgctaagactgctgttgcacctttggaaaggatcaaaattctattgcagactagaacaaacgactttaagacccttggtgtgtcccagtcattaaagaaggtgttacaatttgatggtcctctcggattctataaaggaaatggggcgagtgttattcggattattccatatgccgcccttcattacatgacgtatgaagtttatcgtgactggattttggaaaaaaatcttcccttaggttctggtccaattgttgatcttgtggctggttcagctgcaggtggaacagcagttttgtgcacatatccccttgatttagctcgtactaagctagcttaccaggtttctgacacaagacagagtctccgaggtggtgcgaatggattttaccgtcaacctacttattcaggcataaaagaggtgcttgcaatggcttataaagaagggggaccacgcgggctatatcgtggcatagggccaacgctgatcgggatccttccttacgcggggcttaagttctacatatatgaggaattgaaaaggcatgttcctgaagagcatcaaaactctgttcgaatgcatctaccatgtggagctttagctggtttatttggccagaccatcacttacccattggacgttgttaggagacaaatgcaggtagagaatctgcaacctatgacgagtgaaggcaacaacaagcgttacaagaacacatttgatgggcttaacacgattgttcgaactcagggttggaaacagttgtttgctggtttaagcatcaactacattaagattgttccatcggttgcgattggattcacagtctatgagtcgatgaagtcatggatgcgaattccaccgcgcgagagatcaaagccagcatga

SEQ ID NO: 73229 - protein, 331 aa, Arabidopsis thaliana
MGSSQGSTLSADVMSLVDTLPVLAKTLIAGGAAGAIAKTAVAPLERIKILLQTRTNDFKTLGVSQSLKKVLQFDGPLGFYKGNGASVIRIIPYAALHYMTYEVYRDWILEKNLPLGSGPIVDLVAGSAAGGTAVLCTYPLDLARTKLAYQVSDTRQSLRGGANGFYRQPTYSGIKEVLAMAYKEGGPRGLYRGIGPTLIGILPYAGLKFYIYEELKRHVPEEHQNSVRMHLPCGALAGLFGQTITYPLDVVRRQMQVENLQPMTSEGNNKRYKNTFDGLNTIVRTQGWKQLFAGLSINYIKIVPSVAIGFTVYESMKSWMRIPPRERSKPA

SEQ ID NO: 73230 - DNA, 1014 bp, Arabidopsis thaliana
  CDS (1)..(1014)
atgaatgttgacgctagagtcggtgttgcggtcgatggagctcagagtgctcttaacactgcaaccactgttcatagtagcgtcgtcatgacgcagattaagccgcaggcaaagctaggaaccttccagaatctcctcgctggtggtattgccggcgccattagcaagacatgtaccgctcctcttgctcgcctcaccatcttgtttcagttgcaagggatgcaatcagaaggtgcagtgttaagccgtccaaacttacggcgtgaagcttcccgtattatcaacgaggaaggatatagagccttttggaaaggaaatttggttactgtagtacacaggattccttatactgcagtaaacttctatgcatatgagaagtacaatctatttttcaattcaaatccagtcgtacagagttttataggaaatacgagtggcaatccgatagtgcattttgttagtggtggcttggctggaattacagctgctacagctacatatcccctcgatcttgtcaggactcgtcttgctgcacagaggaatgcaatttactaccagggtattgagcatactttccgtaccatatgcagagaagagggaattttgggtctatataaaggacttggtgctacattattgggtgttggaccaagtcttgctatcaatttcgccgcgtacgagtctatgaaattgttttggcattctcataggccaaatgattcggatttggttgtttctcttgtttctggaggtctagctggagctgtttcttcaacagctacatacccattggatcttgtgagaagaagaatgcaagtggaaggagctggtggaagagcaagagtatacaacactggactctttggaacattcaaacacatattcaagtcagaaggcttcaaagggatatacagaggaatattgcctgaatattacaaagtagttcctggcgttggcatcgtcttcatgacatacgatgctttgcggagactcttaacttctctccccgattga

SEQ ID NO: 73231 - protein, 337 aa, Arabidopsis thaliana
MNVDARVGVAVDGAQSALNTATTVHSSVVMTQIKPQAKLGTFQNLLAGGIAGAISKTCTAPLARLTILFQLQGMQSEGAVLSRPNLRREASRIINEEGYRAFWKGNLVTVVHRIPYTAVNFYAYEKYNLFFNSNPVVQSFIGNTSGNPIVHFVSGGLAGITAATATYPLDLVRTRLAAQRNAIYYQGIEHTFRTICREEGILGLYKGLGATLLGVGPSLAINFAAYESMKLFWHSHRPNDSDLVVSLVSGGLAGAVSSTATYPLDLVRRRMQVEGAGGRARVYNTGLFGTFKHIFKSEGFKGIYRGILPEYYKVVPGVGIVFMTYDALRRLLTSLPD

SEQ ID NO: 73232 - DNA, 999 bp, Arabidopsis thaliana
  CDS (1)..(999)
atggtgatgcagacggaagctagggttggtgtgagctcaggacatggcgtagcttcgtcttctcatcgtttaacgcaggaccagagatcacatatcgaatcggcgtcgcagctcttagccggaggactcgctggtgcttttagcaagacttgtactgctcctctatctcgtctcaccattctcttccaggtgcaaggtatgcacacaaatgctgcagctttaagaaagccaagcatattacacgaggcttcacggatattgaatgaagaaggattgaaagctttttggaaagggaatctagttactattgctcaccggcttccatattcttctgttaatttctacgcatatgaacactacaagaagttcatgtatatggttactgggatggaaaatcacaaggagggtataagttcaaacctttttgtacattttgtagccggtggtttggctggaatcacagctgcttctgccacttatccacttgatcttgttagaactcgtcttgctgctcagacaaaagtaatctactactcgggtatctggcatactctgcgctctattacaaccgatgaaggtatcttgggcctctacaagggactaggaacaacgcttgtgggtgttgggcctagtattgccattagcttttctgtgtatgaatcattgagatcttattggaggtcaactaggccccatgattcccctatcatggtcagtctagcttgtggaagtctttcaggaatagcatcttcaacagctacgtttccattggatctggtgagaagaaggaagcagctggaaggaataggcgggcgagcggtagtgtacaagacaggtttgttaggcacattaaagcgtattgttcaaacggaaggagcgagaggcctgtacagaggaattcttccagagtactacaaagtggtacctggtgtagggatttgcttcatgacctacgagacactcaagctttacttcaaggatctttcttcgaatctataa

SEQ ID NO: 73233 - protein, 332 aa, Arabidopsis thaliana
MVMQTEARVGVSSGHGVASSSHRLTQDQRSHIESASQLLAGGLAGAFSKTCTAPLSRLTILFQVQGMHTNAAALRKPSILHEASRILNEEGLKAFWKGNLVTIAHRLPYSSVNFYAYEHYKKFMYMVTGMENHKEGISSNLFVHFVAGGLAGITAASATYPLDLVRTRLAAQTKVIYYSGIWHTLRSITTDEGILGLYKGLGTTLVGVGPSIAISFSVYESLRSYWRSTRPHDSPIMVSLACGSLSGIASSTATFPLDLVRRRKQLEGIGGRAVVYKTGLLGTLKRIVQTEGARGLYRGILPEYYKVVPGVGICFMTYETLKLYFKDLSSNL

SEQ ID NO: 73234 - DNA, 1059 bp, Arabidopsis thaliana
  CDS (1)..(1059)
atggcatcagaggatgtgaaaagaacagaatcagcagctgtgtcaacgatcgtaaatctggcggaggaagcgagggaaggagtcaaagctccgagttatgcttttaaaagcatctgcaagtctctttttgccggtggtgtcgctggtggagtgtcacgaactgctgttgcacctctggaaaggatgaagatattacttcaggtccaaaatccgcataatataaagtacagtgggacagtccaaggattgaagcatatttggagaaccgagggacttcgtggactgttcaaaggaaatggcaccaactgtgctcgtattgttcctaattcggctgttaaatttttcagctatgagcaagcttcaaatggcatactgtacatgtatcgtcagcggaccggaaatgaaaatgcccaacttactcctcttttacggcttggagctggtgcaaccgctgggataatagccatgtctgcaacgtacccgatggatatggttcgtggaaggctaactgtccagaccgcaaattctccttatcaatatagaggaattgcccatgctttggcaactgtcctgcgagaggaaggtccacgggccttgtaccgtggttggcttccatcagtgattggagttgttccatatgtgggcttgaacttttcggtgtatgagtctctaaaggactggctagttaaagagaacccatacggtctagtagaaaacaatgagctgacggttgtaacgaggctcacttgtggtgcaatagctggaacagttggtcaaacaattgcttatccactggatgtgattcgtaggagaatgcaaatggtcgggtggaaagatgcttccgctattgtaacaggcgaagggagaagcacagcttcacttgaatacactggtatggtcgatgcatttagaaaaacagttcgtcatgaaggctttggagcattgtacaagggtttggtccccaattcagtgaaggttgtaccatcgattgcgattgcatttgtgacatatgagatggtgaaagacgttttaggagtggagtttaggatatcagactga

SEQ ID NO: 73235 - protein, 352 aa, Arabidopsis thaliana
MASEDVKRTESAAVSTIVNLAEEAREGVKAPSYAFKSICKSLFAGGVAGGVSRTAVAPLERMKILLQVQNPHNIKYSGTVQGLKHIWRTEGLRGLFKGNGTNCARIVPNSAVKFFSYEQASNGILYMYRQRTGNENAQLTPLLRLGAGATAGIIAMSATYPMDMVRGRLTVQTANSPYQYRGIAHALATVLREEGPRALYRGWLPSVIGVVPYVGLNFSVYESLKDWLVKENPYGLVENNELTVVTRLTCGAIAGTVGQTIAYPLDVIRRRMQMVGWKDASAIVTGEGRSTASLEYTGMVDAFRKTVRHEGFGALYKGLVPNSVKVVPSIAIAFVTYEMVKDVLGVEFRISD

SEQ ID NO: 73236 - DNA, 978 bp, Arabidopsis thaliana
  CDS (1)..(978)
atggcggagggtgaagagaagaacggaattattgattcgattcctttattcgctaaggagcttattgccggcggcgtcacgggtggtatagctaaaaccgccgttgctccactcgagcgaattaagattcttttccagaccagaagggatgagtttaaaaggataggacttgttggatcaatcaacaagattggcaaaactgaaggtttgatgggtttctacagagggaatggtgcaagtgttgctcggatagttccctatgcagctcttcattacatggcttatgaggaatacaggagatggattatctttggtttcccagacactactcgaggcccattgcttgatctcgtagctggatcatttgctggtggtactgcggttctcttcacctatcctcttgacctggtccggactaagctcgcttatcagacgcaagtaaaagctattcccgtggaacaaatcatatacagaggaattgtagattgtttctcgaggacatacagagaatctggagcccgaggcctatatcgtggtgtagctccttctctctatgggatcttcccttatgctggtttgaagttctacttctacgaggagatgaaacgtcatgtccctccggaacataagcaagacatttccctgaaactcgtttgtgggtcagtcgctggattgcttggtcagactttaacataccctctcgatgttgtccggagacaaatgcaggttgagagactatattcagccgttaaggaagaaacaagaagaggaacaatgcaaacccttttcaagattgcaagagaagaaggttggaagcaactcttctcagggcttagcatcaattaccttaaggttgtaccgtctgtggcaatcggattcacagtgtatgatattatgaagctgcacttaagagtcccgcctcgagaggaacctgaggcagaagctgtgacgacacgaaaaaggaaagttttcacctaa

SEQ ID NO: 73237 - protein, 325 aa, Arabidopsis thaliana
MAEGEEKNGIIDSIPLFAKELIAGGVTGGIAKTAVAPLERIKILFQTRRDEFKRIGLVGSINKIGKTEGLMGFYRGNGASVARIVPYAALHYMAYEEYRRWIIFGFPDTTRGPLLDLVAGSFAGGTAVLFTYPLDLVRTKLAYQTQVKAIPVEQIIYRGIVDCFSRTYRESGARGLYRGVAPSLYGIFPYAGLKFYFYEEMKRHVPPEHKQDISLKLVCGSVAGLLGQTLTYPLDVVRRQMQVERLYSAVKEETRRGTMQTLFKIAREEGWKQLFSGLSINYLKVVPSVAIGFTVYDIMKLHLRVPPREEPEAEAVTTRKRKVFT

SEQ ID NO: 73238 - DNA, 1179 bp, Arabidopsis thaliana
  CDS (1)..(1179)
atggggaaaaccggaatccaattgttcgacgattcgaggaatgggtttttctccgtttccgatttaggattcgattcgagcctaaacagctctaattaccacccaattggtgggttattcgccagcgttaatcagactaatccattcgcatccctctcgtcctcggatctttccaacagaggcaacaacagcttctctacccagctcaatgatctctacaccaagtatatgccgggaaaagaggaggaggaagaagtagttaatggcgagaagaggaagaggaagaagaaaggtgggctcacactgaagattaagatcgctaatccttcgttgcggcggctattaagcggagcagtagctggagcggtgtcgagaacggtggttgcgccgttggagacaatcaggacgcatctaatggtgggaagtggaggaaactccagcactgaagtgttcagtgatatcatgaagcatgaaggttggactggtctcttcaggggcaatttggtcaatgtcattcgtgttgcacctgctcgagccgtcgagctttttgtattcgagaccgtaaacaagaaattgtcgccgccacatggacaagaatcgaaaatcccaattccagcttctttactggctggtgcctgtgctggagttagccagacactcttgacataccctcttgaactagtcaagactcgccttacaattcagagaggtgtttacaaagggatttttgatgcgtttctcaaaatcatacgcgaggaaggacccacagaactctacaggggtcttgctcctagccttattggagttgttccatacgcagctacaaattactttgcatatgattctttgagaaaagcataccggagtttttcaaagcaggagaagattggaaacattgagactcttttgataggttctttagcaggtgcactatcgagcactgcaactttccctcttgaagtggcccggaagcatatgcaggtgggagctgttagcgggagggttgtgtacaagaacatgttgcacgctctggtgaccatacttgagcatgaaggtattctcggttggtacaaagggcttggaccgagttgcttgaagttggttcctgctgctggaatctccttcatgtgttatgaagcttgcaagaagatactcatcgagaacaaccaagaagcttga

SEQ ID NO: 73239 - protein, 392 aa, Arabidopsis thaliana
MGKTGIQLFDDSRNGFFSVSDLGFDSSLNSSNYHPIGGLFASVNQTNPFASLSSSDLSNRGNNSFSTQLNDLYTKYMPGKEEEEEVVNGEKRKRKKKGGLTLKIKIANPSLRRLLSGAVAGAVSRTVVAPLETIRTHLMVGSGGNSSTEVFSDIMKHEGWTGLFRGNLVNVIRVAPARAVELFVFETVNKKLSPPHGQESKIPIPASLLAGACAGVSQTLLTYPLELVKTRLTIQRGVYKGIFDAFLKIIREEGPTELYRGLAPSLIGVVPYAATNYFAYDSLRKAYRSFSKQEKIGNIETLLIGSLAGALSSTATFPLEVARKHMQVGAVSGRVVYKNMLHALVTILEHEGILGWYKGLGPSCLKLVPAAGISFMCYEACKKILIENNQEA

SEQ ID NO: 73240 - DNA, 1440 bp, Arabidopsis thaliana
  CDS (1)..(1440)
atggagtcatcgaagcccaaaaaccgtaacccgatgaagaaacctgtatccatcacgatggagcatgttctattggcgttacgtgagacaatggatgagagagagatcaggattcgtagtttgtttgatttctttgataattcgaatttagggttcttagattatgcccagatcgaaaagggtcttgcttcgcttcagattcctcctgagtacaagtacgctagagatttgtttagagtctgcgacgctaatcgagatgggcgtgttgattaccaggagtttcgtcgatacattgatgctaaggagcttgagctatacaggattttccaagccattgatgttgagcataatggctgcattttgcctgaggagctttgggaggctcttgttaaggccggcattgagatcgatgatgaggaactcgctcgttttgtggagcatgttgataaggacaacaatggaactataacgtttgaagagtggagagattttcttttgttatatcctcatgaagccacccttgaaaacatatatcatcattgggaaagggtgtgcttgatagatattggggagcaagctgttataccggatggtataagtaaacatgtgaaaagaagcagattacttctcgctggaggactagccggagctgtttctagaactgcaactgcgcctcttgatcgtctgaaggttgttttgcaagttcaaagggcacatgcaggggtcctcccgacaattaagaagatatggagagaagataagttgatgggtttctttagaggtaatgggttaaatgtcatgaaggttgctcctgaaagtgccattaagttttgtgcttacgaaatgctaaaacccatgattggaggggaggatggtgatattggtacaagtgggagacttatggcaggtggaatggctggtgcattggctcaaaccgctatttaccctatggatctcgtgaagactcggttacagacttgtgtcagtgaaggtggaaaggcacctaagttgtggaagcttacaaaagatatatgggttcgggagggacctcgggctttctacaagggtctgtttccttctcttcttgggattgttccttatgcaggaattgacctcgctgcatatgaaacgctaaaagacttgtccagaacatatattcttcaggacactgagccgggtcctctgatacagctgagctgtggaatgacatcaggagcccttggagcatcatgtgtttacccgttacaggtagtaagaacaagaatgcaagcggatagttcgaagacgacaatgaagcaagagtttatgaatacgatgaaaggagaaggtcttagaggtttctacagaggactattacccaatcttctcaaagtagttccagcggcaagcatcacgtacattgtttatgaagctatgaagaaaaatatggctcttgattag

SEQ ID NO: 73241 - protein, 479 aa, Arabidopsis thaliana
MESSKPKNRNPMKKPVSITMEHVLLALRETMDEREIRIRSLFDFFDNSNLGFLDYAQIEKGLASLQIPPEYKYARDLFRVCDANRDGRVDYQEFRRYIDAKELELYRIFQAIDVEHNGCILPEELWEALVKAGIEIDDEELARFVEHVDKDNNGTITFEEWRDFLLLYPHEATLENIYHHWERVCLIDIGEQAVIPDGISKHVKRSRLLLAGGLAGAVSRTATAPLDRLKVVLQVQRAHAGVLPTIKKIWREDKLMGFFRGNGLNVMKVAPESAIKFCAYEMLKPMIGGEDGDIGTSGRLMAGGMAGALAQTAIYPMDLVKTRLQTCVSEGGKAPKLWKLTKDIWVREGPRAFYKGLFPSLLGIVPYAGIDLAAYETLKDLSRTYILQDTEPGPLIQLSCGMTSGALGASCVYPLQVVRTRMQADSSKTTMKQEFMNTMKGEGLRGFYRGLLPNLLKVVPAASITYIVYEAMKKNMALD

SEQ ID NO: 73242 - DNA, 1020 bp, Arabidopsis thaliana
  CDS (1)..(1020)
atgattcctacgacggcgacggttgatgatgagccgggacagattaaacgtgctctgattgatgcttctgccggagctatctctggtggtgtttctcgttctgtaacttctcctcttgatgtcattaagattagatttcaggttcagctagaaccgacgacttcatggggtttggttcggggaaacttgtcaggagcttctaagtatactggaatggtacaggcgactaaagatatatttagagaagaaggttttcgggggttttggcggggtaatgtgccagctttgctcatggtcatgccgtatacttcaattcagtttacagtactacataagctgaaatcttttgcatctggttctactaaaacagaggatcatatacatttgagcccttatctatccttcgtcagtggagcgttagcaggatgtgctgctactctaggatcttatccttttgatcttttaaggacaatattggcctcacaaggggagcctaaggtgtatccaacaatgaggtctgcttttgtcgatattattcagtctcgaggtataagaggattgtataatggattaacaccaactcttgttgagattgtgccttacgctggcctgcaatttggcacatatgatatgtttaagcgttggatgatggactggaatcgatacaaattatcctccaaaatcccgatcaatgtggacaccaacctttctagcttccagcttttcatttgtgggcttggggcgggcactagcgccaagctcgtctgccatccccttgatgtggtcaaaaaacgattccagattgaaggtttacagagacatccaagatatggagcccgagtggagcgacgtgcatacagaaacatgttagacggtcttagacagattatgatatcagaagggtggcatggtctgtacaaaggcattgtgccatcgactgtgaaagctgctcctgctggtgctgtaacctttgtggcctatgagtttacctccgattggttggagtcaatttcttggtag

SEQ ID NO: 73243 - protein, 339 aa, Arabidopsis thaliana
MIPTTATVDDEPGQIKRALIDASAGAISGGVSRSVTSPLDVIKIRFQVQLEPTTSWGLVRGNLSGASKYTGMVQATKDIFREEGFRGFWRGNVPALLMVMPYTSIQFTVLHKLKSFASGSTKTEDHIHLSPYLSFVSGALAGCAATLGSYPFDLLRTILASQGEPKVYPTMRSAFVDIIQSRGIRGLYNGLTPTLVEIVPYAGLQFGTYDMFKRWMMDWNRYKLSSKIPINVDTNLSSFQLFICGLGAGTSAKLVCHPLDVVKKRFQIEGLQRHPRYGARVERRAYRNMLDGLRQIMISEGWHGLYKGIVPSTVKAAPAGAVTFVAYEFTSDWLESISW

SEQ ID NO: 73244 - DNA, 1464 bp, Arabidopsis thaliana
  CDS (1)..(1464)
atggaagctacgaagtcgtcgaaacaaaattgttgcaacccggttaagaaacccggacccgtttcaattgatcatgttctcttagctctccgtgagacaagagaagagcgagatttacgaatcaggagcttattcagtttctttgattctgagaatgttggttacttagattgtgctcaaattgagaaggggttatgtgcgcttcaaatcccaagtgggtataaatacgctaaggagttgtttagggtttgtgatgcgaatagagatgggcgtgtggattatcatgagtttcgtagatatatggatgataaggagcttgagctgtatagaatctttcaagctattgatgttgagcataatggttgtatttctcctgagggactttgggattcactcgttaaagctgggattgagataaaagatgaggagcttgctcgttttgtggaacatgttgacaaggacaatgatggaatcattatgtttgaagaatggagagattttcttttgctgtaccctcacgaagctaccattgaaaatatataccatcactgggaaagagtatgtcttgtagatattggagaacaagctgtaattccagaaggcatcagcaaacatataaagaggagtaactatttcatcgcaggtggcatagctggtgcagcttctaggactgctactgcacctctagatcgcttaaaagttcttttgcaaattcagaaaaccgatgctagaatccgagaagccataaagttgatatggaagcagggtggagttagaggtttttttcgaggtaacgggttgaatattgtgaaggtagcaccagagagtgccatcaagttctatgcatatgagcttttcaaaaacgctatcggtgaaaacatgggtgaagacaaagcggatataggcacaacagttagactttttgctggaggaatggctggtgcagtagctcaagcctctatataccctttagatcttgtgaaaactcggttgcagacttacacgagccaagcaggtgttgctgttcccaggcttggaacgctcaccaaagatatattggttcatgagggtccacgtgccttctacaaaggtcttttcccttctcttcttgggattattccttacgcgggtattgaccttgctgcatatgagacattaaaggacttgtccaggacatatattcttcaagacgctgaaccaggtccgctcgtgcaactaggatgtggaacaatctcaggagctcttggagcaacctgtgtctatcctttgcaggttgtgagaacaagaatgcaagcggaacgagcaagaacctcgatgtcaggagtattcaggagaacaataagtgaagaaggttacagagcactctacaaagggctactaccgaaccttctaaaggtagttcctgctgcaagcattacatatatggtttacgaagcaatgaaaaagagtctagaacttgattga

SEQ ID NO: 73245 - protein, 487 aa, Arabidopsis thaliana
MEATKSSKQNCCNPVKKPGPVSIDHVLLALRETREERDLRIRSLFSFFDSENVGYLDCAQIEKGLCALQIPSGYKYAKELFRVCDANRDGRVDYHEFRRYMDDKELELYRIFQAIDVEHNGCISPEGLWDSLVKAGIEIKDEELARFVEHVDKDNDGIIMFEEWRDFLLLYPHEATIENIYHHWERVCLVDIGEQAVIPEGISKHIKRSNYFIAGGIAGAASRTATAPLDRLKVLLQIQKTDARIREAIKLIWKQGGVRGFFRGNGLNIVKVAPESAIKFYAYELFKNAIGENMGEDKADIGTTVRLFAGGMAGAVAQASIYPLDLVKTRLQTYTSQAGVAVPRLGTLTKDILVHEGPRAFYKGLFPSLLGIIPYAGIDLAAYETLKDLSRTYILQDAEPGPLVQLGCGTISGALGATCVYPLQVVRTRMQAERARTSMSGVFRRTISEEGYRALYKGLLPNLLKVVPAASITYMVYEAMKKSLELD

SEQ ID NO: 73246 - DNA, 993 bp, Arabidopsis thaliana
  CDS (1)..(993)
atgtgtatttcaaaagaagacgaagaagatccatcaagaaatcgaaggaatcaatcaccattatcgcttcctcaaactctgaaacatttccaaaaagatttgcttgctggtgctgtaatgggaggtgttgttcacacgatcgtggcaccaatcgaaagagccaagcttttattgcagacacaagagagcaatatcgcaatcgttggagacgaaggtcacgcagggaagagaaggtttaaaggaatgtttgattttatcttccgtactgttagagaagaaggtgttttatctttatggagaggcaatggaagcagtgtgctccgttattatccttctgttgctcttaatttctctcttaaggatctatatagaagcattcttagaaacagtagctctcaagagaatcatatcttctctggtgcattagctaatttcatggctggttctgctgctggttgtactgctttgattgttgtttatccgcttgatatcgcgcatactcgtttagctgctgacattgggaagcctgaagctcgtcagttcagaggaatccatcatttcttgtcaacgattcataagaaagatggggttagaggaatctatagaggcttacctgcgtctctacatggtgtgattattcaccgtggcttatactttggagggtttgatacagttaaggagattttctcagaggatactaaacctgagttggcattgtggaagagatggggtttggctcaagctgtgactacatctgctggtttggcttcttacccgttggatacagttcgtagacggataatgatgcaatccgggatggagcatccgatgtaccgtagcacattggattgttggaagaagatatataggagtgaagggttggcttcgttttaccgtggagcactctctaatatgtttaggagcaccggttcggctgctatcttggttttttatgatgaagtgaagaggttcttgaattggggagggatctaa

SEQ ID NO: 73247 - protein, 330 aa, Arabidopsis thaliana
MCISKEDEEDPSRNRRNQSPLSLPQTLKHFQKDLLAGAVMGGVVHTIVAPIERAKLLLQTQESNIAIVGDEGHAGKRRFKGMFDFIFRTVREEGVLSLWRGNGSSVLRYYPSVALNFSLKDLYRSILRNSSSQENHIFSGALANFMAGSAAGCTALIVVYPLDIAHTRLAADIGKPEARQFRGIHHFLSTIHKKDGVRGIYRGLPASLHGVIIHRGLYFGGFDTVKEIFSEDTKPELALWKRWGLAQAVTTSAGLASYPLDTVRRRIMMQSGMEHPMYRSTLDCWKKIYRSEGLASFYRGALSNMFRSTGSAAILVFYDEVKRFLNWGGI

SEQ ID NO: 73248 - DNA, 1008 bp, Arabidopsis thaliana
  CDS (1)..(1008)
atgagtggtacagagttagatgagcctggaaagttaaaacgtgctgtcattgatgcttctgctggtggtgttgctggtgcgatttcacgtatggttacctctccccttgatgttatcaagattagatttcaggttcagttggagcctacagctacatgggctctgaaagattctcagctgaaaccgaagtacaatggtttgtttcgaacaacgaaggatatctttagagaggaaggtttatcgggtttctggcgtggaaatgttccagctttacttatggttgtgccttatacatccatacaatttgcagtcttacataaggtgaagtcttttgccgctggttcatcaaaggccgaaaatcatgctcaactgagcccttatctttcttacatcagtggggcactagcagggtgtgcagcaacagttggatcgtatccgtttgacctattgcggactgtattggcgtcccagggtgagccaaaggtgtatccaaatatgaggtcagcatttctgagtatagtgcaaactcgtggaatcaaagggttgtatgcaggattgtcccctactctgatcgagatcattccttatgctggtctgcagtttggcacctatgacacatttaaacgctggagtatggtatataataagcgataccgatcttcttcatcaagctcaacgaatccaagtgatagtctttctagctttcagcttttcctttgcggtttagcttcgggcactgtttctaaactagtctgtcatccgcttgatgttgtcaagaaaagattccaggtcgaaggtctgcaacgtcacccaaaatatggagcccgagtagagctgaatgcttacaagaacatgtttgacggtttagggcagatattaagatctgaaggttggcacgggctttataaaggcattgttccatcaaccattaaagctgcacctgctggtgctgtaacatttgtggcctatgaacttgcatccgattggtttgaggcaaatttgacctga

SEQ ID NO: 73249 - protein, 335 aa, Arabidopsis thaliana
MSGTELDEPGKLKRAVIDASAGGVAGAISRMVTSPLDVIKIRFQVQLEPTATWALKDSQLKPKYNGLFRTTKDIFREEGLSGFWRGNVPALLMVVPYTSIQFAVLHKVKSFAAGSSKAENHAQLSPYLSYISGALAGCAATVGSYPFDLLRTVLASQGEPKVYPNMRSAFLSIVQTRGIKGLYAGLSPTLIEIIPYAGLQFGTYDTFKRWSMVYNKRYRSSSSSSTNPSDSLSSFQLFLCGLASGTVSKLVCHPLDVVKKRFQVEGLQRHPKYGARVELNAYKNMFDGLGQILRSEGWHGLYKGIVPSTIKAAPAGAVTFVAYELASDWFEANLT

SEQ ID NO: 73250 - DNA, 1116 bp, Schizosaccharomyces pombe 972h-
  CDS (1)..(1116)
atggttgatgattctctaaaggatgctatagcaggaggagctgctggattggcctcttctcttgtagtggcacctttagatgtagtaaaaacaagaaagcaggcacaaaaggctttttattcaactggtggtggaaaaaatacaatggttttgggtgggaccctcagttcgatgcgaacaatttttcacaatgaaggcatcgccggtctttatagaggtgttggacccatgatgttaggttatcttcctagttggtccatttattttgtagtctatgaaaaatgcaaagtgctatttggggtaaataaaaaatacacttctctccacgaaattgattcgtccaaggttggcatcaaggcttccttagatagttctgacaaacaattttatcgttactggggtggtcaaatcttttctgcggttatcgccggtgctgcaagtgtcactcttactaaccccatttgggttgtaaaaacaaggttagtcactcaatcacatcctagggcttcttcttttgtagataaaattgctgcggctacaaccgtccagtttcgtaatcttcaaacggacgcaccatccgtcaaatggagaatgcctcgcttttggctcaagcgtaggacgaatgtcaaatcttctccatcacagcatccagtgaatcctcccacaggccctgcatgttcacctgcatacaacaacacatttgacgcatttcgaaaaatttataaatacgaaggccttgcagcattttaccgaggtcttttcccctctttatttggtacattgcatgttggcatccaatttccactgtacgaatattttaaatcatttttggatgatttttttggtaaaaaaagcaactttcatatagtgttagcagctactttgtctaaaatcgcagcttctaccgtcacttatcctcatgaagttttgagaactcggttgcagagtttggatgcacctacacacaactcggctaccttacttattcgagacatatggcgttcagagggttggagaaaatattactctggcatggcaacaaattttatacgcaccatacctgccagttcggttaccttcctcagtttcgaaattgttcgcaaatggctgaactaa

SEQ ID NO: 73251 - protein, 371 aa, Schizosaccharomyces pombe 972h-
MVDDSLKDAIAGGAAGLASSLVVAPLDVVKTRKQAQKAFYSTGGGKNTMVLGGTLSSMRTIFHNEGIAGLYRGVGPMMLGYLPSWSIYFVVYEKCKVLFGVNKKYTSLHEIDSSKVGIKASLDSSDKQFYRYWGGQIFSAVIAGAASVTLTNPIWVVKTRLVTQSHPRASSFVDKIAAATTVQFRNLQTDAPSVKWRMPRFWLKRRTNVKSSPSQHPVNPPTGPACSPAYNNTFDAFRKIYKYEGLAAFYRGLFPSLFGTLHVGIQFPLYEYFKSFLDDFFGKKSNFHIVLAATLSKIAASTVTYPHEVLRTRLQSLDAPTHNSATLLIRDIWRSEGWRKYYSGMATNFIRTIPASSVTFLSFEIVRKWLN

SEQ ID NO: 73252 - DNA, 1086 bp, Schizosaccharomyces pombe 972h-
  CDS (1)..(1086)
atgacattacattgccaagagccaaaaattaggagtttggacatgctgtcaaattcagagattaaaccctctgaaaactcacaaaaaacaaaagttttattaacaaaagcaaataatgccagtaacgaacgtgctccaccgcctttgtcgcattttatagcgggtggagttgcaggaatgttaggagcgattgcaacagcacctttggacgtagtgaagacgaggttgcagtctgacttttacaaagacagatttttgaagcaaacggcgaaatcgaaaagtccattgacggctgcatataggcattttatggatacatgtataatattaaaaaatgtaaaagttcatgaaggaacaagagcactatttcgtggcttaggtcctaatttaataggaacaattcctgcacggtcaattaactttttttcatatggcaatggcaagcgtatattggctgatctctttaataatggtcaagagaactctcaaatacatctaatggctgctgcaattgcaggtgtaattacttctgctgcgactaatccaatatggttagtaaaaacacgattacaattagataaaaaaagtggacaagctgctcagtatcgttcttcgattgattgcatcataaaaacaataaggcttgaaggattccgaggattatataaaggtttatctgccagtttactaggagtcggtgaaagtactctccagtgggttctatacgaaaaattcaagcacgctgtcgctattcgacaacttcgtcgaaaagaacttggtattcaagaaactatttatgacaaagttttagattggggtgggaagcttggaggagctggaattgctaaatttatggcagccggcattgcatatccacatgaagttgttcgaacacgtttacgacaaagtccatctataaatggtactcctaaatacactggactcatacaatgctttaaattagtttggatggaacaagggattgttggactgtacggaggtttgactgcacatttactacgagtagttcctaatgcttgcattctttttggaagttacgaagtaataatgcacttcattggctag

SEQ ID NO: 73253 - protein, 361 aa, Schizosaccharomyces pombe 972h-
MTLHCQEPKIRSLDMLSNSEIKPSENSQKTKVLLTKANNASNERAPPPLSHFIAGGVAGMLGAIATAPLDVVKTRLQSDFYKDRFLKQTAKSKSPLTAAYRHFMDTCIILKNVKVHEGTRALFRGLGPNLIGTIPARSINFFSYGNGKRILADLFNNGQENSQIHLMAAAIAGVITSAATNPIWLVKTRLQLDKKSGQAAQYRSSIDCIIKTIRLEGFRGLYKGLSASLLGVGESTLQWVLYEKFKHAVAIRQLRRKELGIQETIYDKVLDWGGKLGGAGIAKFMAAGIAYPHEVVRTRLRQSPSINGTPKYTGLIQCFKLVWMEQGIVGLYGGLTAHLLRVVPNACILFGSYEVIMHFIG

SEQ ID NO: 73254 - DNA, 1002 bp, Oryza sativa (japonica cultivar-group)
  CDS (1)..(1002)
atggacagcggcgccgccgccgcggccgctcggaggtactcgacgcagcagcagcagcagcagccgccgccgccgcagctgcaccaccaccagccgcagctcgggacggtgccccacctccttgccggcggcgtcgcgggcgccgtcagcaagacttgtaccgcgcctctcgcccgcctcactattctattccaggtgcaaggaatgcattcagatgtggctaccatgcggaagactagcatatggcgtgaggcatcccgcattgtctacgaagaaggcttccgagcattctggaaaggaaatcttgtaactattgcacaccggttaccttactcctcaattagcttttacacatatgagaggtacaagaacctgctacaaatgatacctggtcttgacaggaatggtggatttggtgcagatgttggtgttagattgataggtggtggtttgtctggaataacagcagcttcgatgacatatcccttggacttagtacggactcgtcttgctgctcagacgaacactgcttactacaggggcatatctcatgctctttacgccatctgcagagacgagggtgtcaaggggctctacaagggccttggtgccactttgctgggagtaggtcccagcatagcaataagcttctgtgtctatgagacattgcgatctcattggcaaatagagaggccatatgattcccctgttctgatcagtttggcttgtggaagtctttcaggaattgcatcctcaactattacatttccgttggatctagtaagacgccgcatgcagttggaaggcgcagctggaagggcccgtgtctaccaaactggactttttggaacatttgggcatatcgttcgcacagaaagtttaagaggattgtatagaggaattttgcccgagtactgcaaagtggtcccaagtgttggcattgtttttatgacgtatgagacgctgaagtccatcctcacggaactggcatcagatgattag

SEQ ID NO: 73255 - protein, 333 aa, Oryza sativa (japonica cultivar-group)
MDSGAAAAAARRYSTQQQQQQPPPPQLHHHQPQLGTVPHLLAGGVAGAVSKTCTAPLARLTILFQVQGMHSDVATMRKTSIWREASRIVYEEGFRAFWKGNLVTIAHRLPYSSISFYTYERYKNLLQMIPGLDRNGGFGADVGVRLIGGGLSGITAASMTYPLDLVRTRLAAQTNTAYYRGISHALYAICRDEGVKGLYKGLGATLLGVGPSIAISFCVYETLRSHWQIERPYDSPVLISLACGSLSGIASSTITFPLDLVRRRMQLEGAAGRARVYQTGLFGTFGHIVRTESLRGLYRGILPEYCKVVPSVGIVFMTYETLKSILTELASDD

SEQ ID NO: 73256 - DNA, 1005 bp, Oryza sativa (japonica cultivar-group)
  CDS (1)..(1005)
atgggctccgaggaggagccgtcgcagatgcggagggcgctggtggacgcgctcgcgggggccatctccggcggcatctcccgcaccgtcacctcccccctcgacgtcatcaaaatccgcttccaggttcaattggagcccacaacctcgtggggtgtacttcgaagggatgtctatggaccttccaagtacactgggcttttgcaagcaagtaaagatattctccgagaggaaggtttgccgggattttggagaggaaatgttccagccctattaatgtatatgccatatacagctatacaattcactgttctacacaagctgaaaacatttgcttctggttcatccaaaacagaggatcatttgcacttgagtccttacctatcgtatgtaagtggggctatagcaggatgtgcagcaacagtaggatcatatccatttgaccttctcagaacaattcttgcatcacagggtgaaccgaaggtttaccctgacatgaggtctgcatttcttgatataatgaaaacccgcggtttccgaggactttacgccggtctaactccaactcttgttgaaatcataccatatgctggcttacagtttggttcatatgatactttcaaacggtcgatgatgacatggaataggtaccgatattcacatcttaactcaggaagtgaggatgattcagtatcaagcttccagttatttctttgtggatttgcagccggaacattttcaaaagctgcttgtcacccacttgatgttgtaaagaaaagatttcagattgaaggattaaaacgacatccaagatatggcgcccgaattgagagcagcacatacaagggcatgtaccatgccctaaaagagattgttgcgaaggaggggtttggaggcctttataaaggacttttcccatctttggtgaaatcggctcctgctggtgccgtgacatttgtggcatatgaatacatctcagactggttagagtcaatactgatgtga

SEQ ID NO: 73257 - protein, 334 aa, Oryza sativa (japonica cultivar-group)
MGSEEEPSQMRRALVDALAGAISGGISRTVTSPLDVIKIRFQVQLEPTTSWGVLRRDVYGPSKYTGLLQASKDILREEGLPGFWRGNVPALLMYMPYTAIQFTVLHKLKTFASGSSKTEDHLHLSPYLSYVSGAIAGCAATVGSYPFDLLRTILASQGEPKVYPDMRSAFLDIMKTRGFRGLYAGLTPTLVEIIPYAGLQFGSYDTFKRSMMTWNRYRYSHLNSGSEDDSVSSFQLFLCGFAAGTFSKAACHPLDVVKKRFQIEGLKRHPRYGARIESSTYKGMYHALKEIVAKEGFGGLYKGLFPSLVKSAPAGAVTFVAYEYISDWLESILM

SEQ ID NO: 73258 - DNA, 1005 bp, Oryza sativa (japonica cultivar-group); identical to SEQ ID NO: 73256
  CDS (1)..(1005)

SEQ ID NO: 73259 - protein, 334 aa, Oryza sativa (japonica cultivar-group); identical to SEQ ID NO: 73257

SEQ ID NO: 73260 - DNA, 1482 bp, Eremothecium gossypii
  CDS (1)..(1482)
atgagcgcgggacaggaaagcgaggagcagcaaaggcggcggcacgagcagctgttccggcgactggacctcgacgggacggggcgcgtggacctggcgacgctgcagcgagcgttcgagcgggagggacaccctctgcgggacagcgcggaggcggtggcggcggtgtttgcggcgctggacgcggaccgggacgcggtggtggactttgcggacttccaacggtacctgggggaggcggagcggcagatccggcgggggtgggagcagctggacgcggatgcggacgggcgggtcggcgcggcggagctgcagggctacgtgggcggcgagggcgggcggtttctggagtgggcgtttccgcgggcgcggggcgggtacgtgacgtacgagcagttccgggacctgctgttgctgacgccgcggcaggcggggtcgcggctgcggacggcgtactcgtactacgcgagcgaggacctgtcgtcggagggggacatgacgctgacgaacgactttgtgcggggcttcgggttcttcctggcgggggggtttgcaggcgtggtgtcgcggacgtgcacggcgccgttcgaccgcatcaaggtgtttttgattgcgcggacggacctgtcgtcaccgttgctgcacacgccggagcagctgctgcaccacaacccccgcgcggacccggcgaagatccggtcgccgctggtgaaggcagcgacgtcgttgtaccggcaaggcggcctgcgcgcgttctacctgggcaacgggctcaacgtcatcaaggtgttcccggagtcggcgatgaagttcggctcgttcgagctggcgaagcgcgtgctggcgggcttggagggctgcggcgagacgggcgagctctcgcgcctgtcgacgtacgttgcgggggggcttggcggcatcatggcgcagttctcggtctacccaatcgacaccttgaagtttcgcatacagtgtgcgcccctggatacgcgctgccggggtctgccgctgctaatcaagacggcgaaggacatgtaccgcgaggggggtctgcgactcttctaccgcggccttggcgttggcattttgggcgtgttcccgtacgcggcgctcgacctcggcaccttctcggccctcaaacgctggtacattacccgtcgcgcaaatgcgctgggcatctccgagaacgaagtggtcatgagcaatctcgtggtgctgccgatgggcgccttcagcggtacggtcggcgccacggtggtctaccctatcaaccttctacggacgcggctccaggcccagggcacgtatgcgcacccgcatcgctacgacggctttcaagacgtgttccggaagaccgtccagcgcgagggcctccccggcttatacaaagggttggttcctacattggccaaggtctgcccggcagtcgccatcagctacttgtgctacgaaaacttgaagcgcgcgatgcgcctcgaatga

SEQ ID NO: 73261 - protein, 493 aa, Eremothecium gossypii
MSAGQESEEQQRRRHEQLFRRLDLDGTGRVDLATLQRAFEREGHPLRDSAEAVAAVFAALDADRDAVVDFADFQRYLGEAERQIRRGWEQLDADADGRVGAAELQGYVGGEGGRFLEWAFPRARGGYVTYEQFRDLLLLTPRQAGSRLRTAYSYYASEDLSSEGDMTLTNDFVRGFGFFLAGGFAGVVSRTCTAPFDRIKVFLIARTDLSSPLLHTPEQLLHHNPRADPAKIRSPLVKAATSLYRQGGLRAFYLGNGLNVIKVFPESAMKFGSFELAKRVLAGLEGCGETGELSRLSTYVAGGLGGIMAQFSVYPIDTLKFRIQCAPLDTRCRGLPLLIKTAKDMYREGGLRLFYRGLGVGILGVFPYAALDLGTFSALKRWYITRRANALGISENEVVMSNLVVLPMGAFSGTVGATVVYPINLLRTRLQAQGTYAHPHRYDGFQDVFRKTVQREGLPGLYKGLVPTLAKVCPAVAISYLCYENLKRAMRLE

SEQ ID NO: 73262 - DNA, 951 bp, Eremothecium gossypii
  CDS (1)..(951)
atggggcaacccgaaaactacattcaaacggtctacaagaatgatggtttcattgcctttgttgcggggggcgttggtggcgcggtgtctcgcacagtggtgtcaccggtggagcgagtgaagattctgctgcaggttcagagctcgaccaccgcgtataatggcgggcttgtacatgctgtgaagcaagtgtacaaggaggagggcgtcaagggccttttccgcggcaatggcatcaactgcctgcgcatcttcccgtacagtgcggtgcagtacgccgtgtacgagttttgcaagaccagggtgttccacgtcgggcagagcggccacgagcagctgagaagctgggagcgactggtaggcggggcgctgggaggcggggcaagcgttctcgtgacctacccgctcgacctggtgcgaacgcgcctgtcgatccagacggccaacctggccaagctgcaccgctccaaggcgcacgacatccgcaggccgcccggcatcgtagagctgctcaggcgcatcttccgcgaggagggcggccttcgaggctggtaccgcggcgtgtacccgaccagcctgggcgtcgtgccgttcgtggcgctcaacttcgcactctacgagcgcctcaaggccctgatcccgcacgactacgacgccggctcggtcgccgccgccaagctcgcgatcggcgcggtcagcggcggcatagcccagaccgtcgtgtaccccttcgacctgctccgaaggcgtttccaggttctgaccatgggacagagcgagcttggcttccgctacgccagtgtggcggacgcgctctggaccatcggccgccaggagggcctccgtggctactacaagggcctcacggccaacctggtgaaggtggtgccggccatggccgtccaatggtttgtctacgagctcatctccgaaaatatgcatggcctgtga

SEQ ID NO: 73263 - protein, 316 aa, Eremothecium gossypii
MGQPENYIQTVYKNDGFIAFVAGGVGGAVSRTVVSPVERVKILLQVQSSTTAYNGGLVHAVKQVYKEEGVKGLFRGNGINCLRIFPYSAVQYAVYEFCKTRVFHVGQSGHEQLRSWERLVGGALGGGASVLVTYPLDLVRTRLSIQTANLAKLHRSKAHDIRRPPGIVELLRRIFREEGGLRGWYRGVYPTSLGVVPFVALNFALYERLKALIPHDYDAGSVAAAKLAIGAVSGGIAQTVVYPFDLLRRRFQVLTMGQSELGFRYASVADALWTIGRQEGLRGYYKGLTANLVKVVPAMAVQWFVYELISENMHGL

SEQ ID NO: 73264 - DNA, 1086 bp, Magnaporthe grisea 70-15
  CDS (1)..(1086)
atgtcgagtacaagcgccgccacatcatccctcccgtctccgccgccacagtcctccaacagcacaatgacgtcgcatcctcctcctccgacatcgcctggcccggtggccgcggcaccagtagtcgcctcgatacccaatgataccctgacgcagtttcgcggcttcatatcacagccggtaacagcagccttctgcgccggcggcatcgcaggcgccgtgtcacggacggtggtgtcgcccctggagcgtctcaagattctcttccagatccagagcgccgggcgcgaggagtacaagctgtcggtcggcaaggcgctaaagaagatgtggcaagaggaagggtggcggggcttcatgcgcggcaacggcaccaactgcatacggatcgtgccgtactcggccgtgcagtttggctcgtacggcttctacaaacggacgctgttcgagtcgagccccggggcggacctgacgccgctcgagcgcctcatttgtggcggcatcgcgggtatcacgtcggtgacgtttacctacccgctcgacattgtgcggacgcgcctctcgatccagtcggcgtcgtttgccgacctcggcgacaagcccaaggagctcccgggcatgatggccaccatggtgcgcatgtaccgcgacgagggaggtatgatggcgctgtatcgcggcatcgtgcccaccgtcacgggcgtggcgccgtacgtcggtctcaactttatgacgtacgagtttgtgcgcacgcacctgaccccagagggtgagaagaaccccagcgcggccaggaagctgcttgcaggtgccatctcgggtgctgtcgcgcagacctgcacatatccatttgatgttctgaggagacggttccaaatcaacaccatgtctggtatgggataccagtacaagtcgatcccggatgccgtcaaagtgattgtgatgcaagagggcatcaaggggctgtacaaaggcatcgtaccgaacctgctcaaggtggcgccgagtatggcgtcaagttggttgagttttgaggtcttcagggatttcttcgtctccctggaccccaaggagacggcgatgtga

SEQ ID NO: 73265 - protein, 361 aa, Magnaporthe grisea 70-15
MSSTSAATSSLPSPPPQSSNSTMTSHPPPPTSPGPVAAAPVVASIPNDTLTQFRGFISQPVTAAFCAGGIAGAVSRTVVSPLERLKILFQIQSAGREEYKLSVGKALKKMWQEEGWRGFMRGNGTNCIRIVPYSAVQFGSYGFYKRTLFESSPGADLTPLERLICGGIAGITSVTFTYPLDIVRTRLSIQSASFADLGDKPKELPGMMATMVRMYRDEGGMMALYRGIVPTVTGVAPYVGLNFMTYEFVRTHLTPEGEKNPSAARKLLAGAISGAVAQTCTYPFDVLRRRFQINTMSGMGYQYKSIPDAVKVIVMQEGIKGLYKGIVPNLLKVAPSMASSWLSFEVFRDFFVSLDPKETAM

SEQ ID NO: 73266 - DNA, 1122 bp, Magnaporthe grisea 70-15
  CDS (1)..(1122)
atgccaggtattacacagcaacaccaaccaccaaaggatatcgattatgcagaggtgatcgcgcaaccgcttgcgcccaagaagcgcgtcgtcgataagcagagctttgaatatgcgtggcgatctggtgtcgccggtgggcttgccggctgtgcggcgaaaacagtcgttgcccccctcgatcgcgtcaagatcctctttcagtcgagcaacccccagttcgcaaaatattcgggttcatgggcaggagtcgccgagtcgttgagggtcatacatgaccaggaaggcgcggctggcctcttccgcggccactctgcaacgcttatgcgagtgtttccgtatgccgccatcaagttcctcgcctacgagcagatccgatcggtaataatcccggaccataaccacgagaccccgctccgccgactggtcagcggatcactggccggcattacatcagtgtttttcacgtaccctcttgaggtcgtgcgggtgcgcttggcgtttgagacaaagcgcgagggccgctcatcactcctcgagatatgcaaaaagatttaccacgaacaaccagtcgcaccaaagccactggcctccaacctggctgcatctacaggtgttcaagcggctgcagcgactcagtcagtactggaagcggcggtgccgaggtctggactggccaacttttatagggggttctccccgaccatgctgggcatgcttccgtacgccggcatgtcgttcctgacacacgacacgtgcggcgacattttgaggcggccattcctagccaagtggactactttaccacaaccggacaacgccacgccgggcaagccggcgccgctcaggtactgggcagagcttctgtcgggcggaattgcaggtctcgtgtcgcagtcggtctcgtacccgttggaagtcatacgacggcgcatgcaggttggcggtgccgtaggagacgggcgcaggctgcgcatcgccgagacggcgggcttgatcatgaaggaaaaaggtatacgtgggttctttgtcggtttgacgattggctacgtcaaggtggtgcccatggctgcagtggctttctacacatatgagcgtttcaagctttggtttgggatctga

SEQ ID NO: 73267 - protein, 373 aa, Magnaporthe grisea 70-15
MPGITQQHQPPKDIDYAEVIAQPLAPKKRVVDKQSFEYAWRSGVAGGLAGCAAKTVVAPLDRVKILFQSSNPQFAKYSGSWAGVAESLRVIHDQEGAAGLFRGHSATLMRVFPYAAIKFLAYEQIRSVIIPDHNHETPLRRLVSGSLAGITSVFFTYPLEVVRVRLAFETKREGRSSLLEICKKIYHEQPVAPKPLASNLAASTGVQAAAATQSVLEAAVPRSGLANFYRGFSPTMLGMLPYAGMSFLTHDTCGDILRRPFLAKWTTLPQPDNATPGKPAPLRYWAELLSGGIAGLVSQSVSYPLEVIRRRMQVGGAVGDGRRLRIAETAGLIMKEKGIRGFFVGLTIGYVKVVPMAAVAFYTYERFKLWFGI

SEQ ID NO: 73268 - DNA, 1194 bp, Gibberella zeae PH-1
  CDS (1)..(1194)
atgtcctccgccgacgctgctcacatggagcaggcctcatccatgaccgaggttgcgctggaaagcaacatacagacccatggttctgcgcatgcccttaccaagtcgaaaagggagccttctgtttctcccacagatcaggaagcagcaacaacgaaaccgcacatgaaaagtctcgaatacatatggaagtccggcgtcgcgggtggtttagccggttgcgctggtaaaaccgttgtcgcgcctttagatcgagtaaagattctttttcaagccagcaatcctcggttcgcaaaatatacaggatcatgggttggtgttgccagcgccatgaaggatatccatcaatatgaaggccttcggggactctaccgtggacactctgcgacactattacgaatatttccttacgccggtatcaaattcctcgcatacgaacaaatccgagccattgttatccccgatagatcgtacgagacgccgatgaggagactactcagtggaagtttggcaggtgtcacatccgtcttctttacataccctctagaggtcatccgagtacgactggctttcgagactaagcgcgacggccattcttctctgtcatcgatatgccgccagatatataacgagcaacccatggagaaagcgccggcacctcggttaccgaatgctcctgcgcctttatcagcgactgcagaggcaaccgcagcgacagttgaagccatcgctccccgaacaggactgatcaacttctatcgaggttttgctccaactgtcatgggaatgctcccgtacgcgggcatgtcattcttgactcacgatactgttggtgatattctgcggttaccacgcttcgcgaagcacacgacactaccaaagaaggagaaccatcctgaaggaaagccagcacctttacggtcatgggcagagcttactgctggtggtattgccggtctgatttctcaaaccgcatcatatcctctcgaggtaatccgccggcgaatgcaagttggcggagccgtcggtgacggccgtcgactacgcataggcgagactgcgggtatgatcttacgagaaaagggtctgcctggtttctttgttggcctgactattggatacgtcaaggtgtttcccatggctgcggtcgccttcttcacatatgagcgcatgaagctcgcctttggcatatag

SEQ ID NO: 73269 - protein, 397 aa, Gibberella zeae PH-1
MSSADAAHMEQASSMTEVALESNIQTHGSAHALTKSKREPSVSPTDQEAATTKPHMKSLEYIWKSGVAGGLAGCAGKTVVAPLDRVKILFQASNPRFAKYTGSWVGVASAMKDIHQYEGLRGLYRGHSATLLRIFPYAGIKFLAYEQIRAIVIPDRSYETPMRRLLSGSLAGVTSVFFTYPLEVIRVRLAFETKRDGHSSLSSICRQIYNEQPMEKAPAPRLPNAPAPLSATAEATAATVEAIAPRTGLINFYRGFAPTVMGMLPYAGMSFLTHDTVGDILRLPRFAKHTTLPKKENHPEGKPAPLRSWAELTAGGIAGLISQTASYPLEVIRRRMQVGGAVGDGRRLRIGETAGMILREKGLPGFFVGLTIGYVKVFPMAAVAFFTYERMKLAFGI

SEQ ID NO: 73270 - DNA, 945 bp, Gibberella zeae PH-1
  CDS (1)..(945)
atgtctacttttcgagagtccatttcccagccagtcgtcgccgcgttttgcgctggaggcgttgctggtgctgtgtcccgaacggttgtatcccctttagaacgactcaagattcttatgcaggtgcaaagcgttgggcgagatgcgtacaagctgtcggttggaaaagccttagtcaagatgtggaaagaagaaggctggagaggtttcatgcgaggtaatggcaccaattgcattcgcattgttccttactctgctgttcaattcagcagctacaacttttacaagcggagtatatttgaaagtcatccaggagctgatctgtcaccactcactcgccttgtctgcggtggcctagcgggtataacgtccgtgtttcttacgtaccccctcgatattgtccgaacacgactatctatccagtctgcgagtttcgccgagctgggcgccaaaccaaaaaagttgcctggcatgtggactactttgatgcagatgtacaaaaccgagggtggtatgtccgcgttgtatcgaggcatcgtccctactgttgctggtgtagcaccatatgttggcctcaacttcatggtttacgaatctgtccgtaaatatctcacaccagagggagagcaaaaccccagcgccacgcggaagctgcttgctggtgccatctctggtgccgtagcacaaacttgcacataccccttcgatgttctacggcggcgattccagatcaacacaatgtcaggcatgggctaccgatacaagggcatcacagacgcggttcgggtcatcgtgatgcaagagggaatcaagggtctttacaagggcatcgtgcctaatctcttgaaggtggcccccagtatggcatcgagttggttaagtttcgagatgacgcgtgatttcctggttgatctcaggcctgaccctgagccccaaccattatga

SEQ ID NO: 73271 - protein, 314 aa, Gibberella zeae PH-1
MSTFRESISQPVVAAFCAGGVAGAVSRTVVSPLERLKILMQVQSVGRDAYKLSVGKALVKMWKEEGWRGFMRGNGTNCIRIVPYSAVQFSSYNFYKRSIFESHPGADLSPLTRLVCGGLAGITSVFLTYPLDIVRTRLSIQSASFAELGAKPKKLPGMWTTLMQMYKTEGGMSALYRGIVPTVAGVAPYVGLNFMVYESVRKYLTPEGEQNPSATRKLLAGAISGAVAQTCTYPFDVLRRRFQINTMSGMGYRYKGITDAVRVIVMQEGIKGLYKGIVPNLLKVAPSMASSWLSFEMTRDFLVDLRPDPEPQPL

SEQ ID NO: 73272 - DNA, 1242 bp, Gibberella zeae PH-1
  CDS (1)..(1242)
atgtcgtcaactgaccaggttcctcccgaagctgcccagtcgccgtcttcagactatgctgcatcttcttacggttacgcatcctccgacgccctaatgtactccacgacggtaacgccaatgcaccgttgggcgctaaacgcctccgactcgcagttcaacgctatcgccggcgcagtgggtggtttcacctcaggtgttgtgacatgcccactcgacgtcatcaagaccaagctccaggcgcagggtggctacgctgctctcaacaagggacgacatgttggccatccaaagttatacaacggccttcttggctcaggaaaggtcatctggagagaggaaggaattcgaggtctttatcgtgggctagggcctatcgtgatggggtacttaccaacctgggctgtgtggtttacagtttacaataagagcaaggggtacatatcgcaacattatgacaacagtcacatagtcaacttttggtcatcaatcatagcaggcgccagcagtacaatagtcaccaacccaatctgggttatcaagacacggctcatgtcacagagcaacattcgacacaacacacaggatcatcatgccgcatactacccgaaagcgactagcacgccaacaacacgaccaacactacacgactggcactacaaatccacactagacgcggctcgcaagatgtacacctcggaaggtctcatttctttctattccgggctaacacctgctcttctcggcttgacgcacgttgctgtacaatttccgacatacgaatacctcaaaactaggtttaccggccaaggaatgggcgaatccagcgagcaagatagcaaaaaccacgttttcgggatcctaggggcttcgatcctatccaagatcctcgccagtaccgcgacgtaccctcatgaagttatccgcacccgtttacagacccaacggcgtccgcttgccggcgaggagttcgctcagggtatgggagtgacgggtacaggcccccgtggcgctcgagcccctgctgagaagccgaggtaccaaggcgtcgtccatactttccgtgtcatactggccgaagaagggtggcgagcgttttatgctggtctgggtactaacatgatgcgagctgttccagcagcaacagtcaccatgttgacttacgaatatgttatgaagcaactgtaccacaccagggctgaagcacgacatcttttactagatccgacagcagaatcataa

SEQ ID NO: 73273 - protein, 413 aa, Gibberella zeae PH-1
MSSTDQVPPEAAQSPSSDYAASSYGYASSDALMYSTTVTPMHRWALNASDSQFNAIAGAVGGFTSGVVTCPLDVIKTKLQAQGGYAALNKGRHVGHPKLYNGLLGSGKVIWREEGIRGLYRGLGPIVMGYLPTWAVWFTVYNKSKGYISQHYDNSHIVNFWSSIIAGASSTIVTNPIWVIKTRLMSQSNIRHNTQDHHAAYYPKATSTPTTRPTLHDWHYKSTLDAARKMYTSEGLISFYSGLTPALLGLTHVAVQFPTYEYLKTRFTGQGMGESSEQDSKNHVFGILGASILSKILASTATYPHEVIRTRLQTQRRPLAGEEFAQGMGVTGTGPRGARAPAEKPRYQGVVHTFRVILAEEGWRAFYAGLGTNMMRAVPAATVTMLTYEYVMKQLYHTRAEARHLLLDPTAES

SEQ ID NO: 73274 - DNA, 921 bp, Candida glabrata CBS 138
  CDS (1)..(921)
atgtctgaaactaagaagcctcaatccaacttcgccatcgatttcttgatgggtggtgtttccgctgccgttgctaagacagctgcttctcctatcgagagagtcaagttgttgatccaaaaccaagatgaaatgatcaagcaaggttctctagaccaccgttacaagggtattgtcgactgtttccaaagaactgccagacaagaaggtatcatctctttctggagaggtaacaccgctaacgttatccgttacttcccaacccaagctttgaacttcgccttcaaggatcaaatcaaggccatgttcggtttcaagaaggaagaaggttacgccaagtggttcgctggtaacttggcctccggtggtattgctggtggtttgtccctaatgttcgtctactccttggattacgccagaaccagattggctgccgatgccaagtcctctaagaagggtggtgaaagacaattcaacggtttggtcgatgtctacaagaagactatcgcttctgatggtgtcgccggtttgtacagaggtttcttgccatccgtcatcggtatcgttgtctacagaggtttgtacttcggtctatacgactcctgtaagccattgctattgactggttctctagaaggttctttcatcgcctctttcttgttgggttgggttgttaccactggtgcttccaccgcttcttacccattggataccgttagaagaagaatgatgatgacctccggtcaagccgttaagtacaagggtgccatggactgtctacaaaagattgttgctgccgaaggtgtctcctccttgttcaagggttgtggtgctaacatcttgagaggtgtcgccggtgccggtgtcatctccttgtatgaccaattgcaaatgatcctattcggtaagaagttcaaataa

SEQ ID NO: 73275 - protein, 306 aa, Candida glabrata CBS 138
MSETKKPQSNFAIDFLMGGVSAAVAKTAASPIERVKLLIQNQDEMIKQGSLDHRYKGIVDCFQRTARQEGIISFWRGNTANVIRYFPTQALNFAFKDQIKAMFGFKKEEGYAKWFAGNLASGGIAGGLSLMFVYSLDYARTRLAADAKSSKKGGERQFNGLVDVYKKTIASDGVAGLYRGFLPSVIGIVVYRGLYFGLYDSCKPLLLTGSLEGSFIASFLLGWVVTTGASTASYPLDTVRRRMMMTSGQAVKYKGAMDCLQKIVAAEGVSSLFKGCGANILRGVAGAGVISLYDQLQMILFGKKFK

SEQ ID NO: 73276 - DNA, 984 bp, Candida glabrata CBS 138
  CDS (1)..(984)
atgtccgaggttatacttcctgcaattgaagaagagaatcaattgaagaacttcctcaagcaagacactaatgttgcattcttagcaggtggtattgcgggtgctatctctaggacagtagtgtcaccgtttgaaagggttaagatcctcttgcaagtccagagctcgacaacagcatacaataaagggttgttcgatgccatcgggcaagtgtacaaagaagagaatataaaaggtttgttccgtggtaatgggcttaactgcatcagagtattcccgtatagtgctgtacagttcgtggtcttcgaaggctgtaagaaacacatatttcatgtcgatacgaagggtaaaggtgaacaactcaacaattggcaaagactgtttagtggcgctttatgtggtggttgtagtgtagttgccacatacccgctggatcttgtgagaacaagactatctgtgcagacggcaaacctatcgaaactttccaagtctagggcctctgatattgccaagccaccgggtgtttggaagttgctatctaaggcttacgctgaagaaggtggcataatggggctatacagaggtgtatggccaactagtctgggaatcgtgccatatgtggcattaaactttgctgtatatgaacaattgaaagagttcatgcccagtgatgaaaacgggaacagtagcatgcgtgacagcttatataagctgagcatgggagctattagtggtggtgttgcccagacaataacatacccatttgatcttctaagaaggagattccaagtgctggccatgggtggtaacgagttgggattccattataatagtgtctgggacgcacttgtgaccatcggcaaaactgaaggtttcaaaggttactacaagggcctcacagccaacctgtttaaagtggtaccatctactgcagtgagctggttggtttacgaactgacgtgggattacatgaaacgctggtaa

SEQ ID NO: 73277 - protein, 327 aa, Candida glabrata CBS 138
MSEVILPAIEEENQLKNFLKQDTNVAFLAGGIAGAISRTVVSPFERVKILLQVQSSTTAYNKGLFDAIGQVYKEENIKGLFRGNGLNCIRVFPYSAVQFVVFEGCKKHIFHVDTKGKGEQLNNWQRLFSGALCGGCSVVATYPLDLVRTRLSVQTANLSKLSKSRASDIAKPPGVWKLLSKAYAEEGGIMGLYRGVWPTSLGIVPYVALNFAVYEQLKEFMPSDENGNSSMRDSLYKLSMGAISGGVAQTITYPFDLLRRRFQVLAMGGNELGFHYNSVWDALVTIGKTEGFKGYYKGLTANLFKVVPSTAVSWLVYELTWDYMKRW

SEQ ID NO: 73278 - DNA, 1029 bp, Candida glabrata CBS 138
  CDS (1)..(1029)
atgactaaaactaacaatcgtcaggcggtcgacaagaactcattagattacgttgtgcggtccggccttgctggaggtgtatctggttcttgtgcaaaaacactcatagcccctctggatcgaataaaaattttatttcaaacgtcgaatccccattatagtaaatatgcgggatccctggttggactttatgaggcagcaaagcatatttggataaatgatggtattcgtgggttctttcaaggccactcggtaactttattgagaatattcccatatgctgctgtcaaatttgtggcatatgaacaaattaggagtatactaataccatcgagagaatatgaatctcattggagaagacttgccagcggttcattagcaggattatgcagtgtgttcataacttatcctttggatttgactagagtacgacttgcttatgtaacggaacacaaaagggtaaaactaagagacatagtgaagacaatataccatgaaccagcatcggaagggctaacttcgcatttgcttgtgccaaaatggtttgcccattggtgtaatttctacagaggctatgtaccaaccgttcttggcatgattccttatgctggtgtttctttttttgctcacgatttaattcacgatatcatgaaatcttcattaatggcgccatacgctgtcaaacaattatctagtcaagaagagttagaaagaaaaaaattgaggcagaaaactccgttaagaacttgggcagaattagttgccggaggtctgtctggtattttatctcagacagctgcctatcccttagagattataagaagaagattacaagtcagcactttgagtccgaggaagatgtacgaccacaaatttcagtcaatctccagtattgcgagaataatctaccaagaaaaaggctggagaggattttttgtaggtttaagcattggctacatcaaagttacgccaatggtggcatgcagcttttttgtttatgaaagaatgaaatggcatttgggtatttag

SEQ ID NO: 73279 - protein, 342 aa, Candida glabrata CBS 138
MTKTNNRQAVDKNSLDYVVRSGLAGGVSGSCAKTLIAPLDRIKILFQTSNPHYSKYAGSLVGLYEAAKHIWINDGIRGFFQGHSVTLLRIFPYAAVKFVAYEQIRSILIPSREYESHWRRLASGSLAGLCSVFITYPLDLTRVRLAYVTEHKRVKLRDIVKTIYHEPASEGLTSHLLVPKWFAHWCNFYRGYVPTVLGMIPYAGVSFFAHDLIHDIMKSSLMAPYAVKQLSSQEELERKKLRQKTPLRTWAELVAGGLSGILSQTAAYPLEIIRRRLQVSTLSPRKMYDHKFQSISSIARIIYQEKGWRGFFVGLSIGYIKVTPMVACSFFVYERMKWHLGI

SEQ ID NO: 73280 - DNA, 954 bp, Kluyveromyces lactis NRRL Y-1140
  CDS (1)..(954)
atgaacactggcataaggaaagaccatctcaggaaaggtgaaacggtatcatggtacaattcagtgattgctggttctgtttctggggtatttgctaggatggcaactgcaccaatggatactgtaaaaatacgatatcagttacaaccggtacaagaggacaaatataagggaattgcatctactgtgagaactataatgaaagaagaaggacttcgagcgttatggaaaggaaacatcccggcgacggcgatgtacgttgtttacggtgcagtacaattcggatcttactcgtggttcaacaacgtttggtctgcgaagttccctcggttttcacagcagggacaaacgctaacggtcggagcgttggcaggaatgactagttcagtggtatcttacccgctagatttgcttcggacaagacttatagcaaacagaacgagccatcggaccagtgtcgcagaggagtgccgacaaatgtggctcaatgaaggtgtacgaggttttttcactggaatatccactgcgatgacaacggttactttatccacggctatcatgtttctcacatatgagaccgtgaatatagtctgtgaaaaccacgagaaagaattctggtcgcgacctgtaagtgctagttcagggatcatcgcagggtttgtatccaagacgatggtgttccccattgacactttacgtcgcagaatgcaagtgatgaactctaagagaacagttcatttcaccaaattccctgctgtttaccacgagtacaggtataaatcatccactgcaattatttacaagatactaagacaggagggtgtatcagcgttgtaccgaggacttacaatgggactatgtaaatctgttccaacgacagcaatcagtcttttcgtgtatgaacgcacaatggatctctttgatcacggacagcgctgggggagatctccatag

SEQ ID NO: 73281 - protein, 317 aa, Kluyveromyces lactis NRRL Y-1140
MNTGIRKDHLRKGETVSWYNSVIAGSVSGVFARMATAPMDTVKIRYQLQPVQEDKYKGIASTVRTIMKEEGLRALWKGNIPATAMYVVYGAVQFGSYSWFNNVWSAKFPRFSQQGQTLTVGALAGMTSSVVSYPLDLLRTRLIANRTSHRTSVAEECRQMWLNEGVRGFFTGISTAMTTVTLSTAIMFLTYETVNIVCENHEKEFWSRPVSASSGIIAGFVSKTMVFPIDTLRRRMQVMNSKRTVHFTKFPAVYHEYRYKSSTAIIYKILRQEGVSALYRGLTMGLCKSVPTTAISLFVYERTMDLFDHGQRWGRSP

SEQ ID NO: 73282 - DNA, 1146 bp, Kluyveromyces lactis NRRL Y-1140
  CDS (1)..(1146)
atgtcgacaaatgtcgctgcaaagaaggcgacaaatgatggtaccggcggtactgttacagcttgcagtatgaatagtaacacgaagaattcaggtctgcttccgcgaaaatctggtgatgcagcagcatacaccagcaaacagaattttgattatatattaaaatcgggccttgccggaggggtagcaggttcgtgtgcaaaaaccttgatagcccctttagatcgtatcaagatccttttccagacttctaatccgcattatgtgaaatacgcaggttcgttccaggggttactgaacgctggtgtgcatatttggtcaagagatagattgagaggggttttccagggacattcggctactttgctgaggattttcccctatgctgcagtgaaatttatagcatatgaacagatcagaaacgtgattataccgagcaaagagtatgagactcatttcagaaggctttgttccggttcgttggccggtttatgttctgtgttttgtacttatccgttggacttgataagagttagattggcatatgtgacagaacatcataaggtaagggtatggccgttggtaaagcagatttactcggaaccagcttctgaagccttgtcttcgaaagcttacgttccaaagtggttcgctcaatggtgtaacttctaccgtggttatatccctaccgttattgggatgatcccttacgcaggtgtgtcattcttcgcacatgacttgttccatgacatacttagacatccagtcattgccccatactcggtacttcgtgtcgatgacttggatgcagatgatttgaaagtggatgtacagactactcgaacggggaaaagaattccattgaatacttgggcagaactattagctggtggattggccggtatggcttcccaaacagcggcatacccatttgaaattattaggagacgtctacaagtcggtgctgtgaccaatccgcttgagcataaatttacatccatgtctgagatggcgaaaattatcttccacgaacgtggatggagaggttttttcgttggtttgagtatcggttacatcaaggtcacaccaatggtcgcatgttcgttcttcgtatatgaaagaatgaagtggtatatgggaatttaa

SEQ ID NO: 73283 - protein, 381 aa, Kluyveromyces lactis NRRL Y-1140
MSTNVAAKKATNDGTGGTVTACSMNSNTKNSGLLPRKSGDAAAYTSKQNFDYILKSGLAGGVAGSCAKTLIAPLDRIKILFQTSNPHYVKYAGSFQGLLNAGVHIWSRDRLRGVFQGHSATLLRIFPYAAVKFIAYEQIRNVIIPSKEYETHFRRLCSGSLAGLCSVFCTYPLDLIRVRLAYVTEHHKVRVWPLVKQIYSEPASEALSSKAYVPKWFAQWCNFYRGYIPTVIGMIPYAGVSFFAHDLFHDILRHPVIAPYSVLRVDDLDADDLKVDVQTTRTGKRIPLNTWAELLAGGLAGMASQTAAYPFEIIRRRLQVGAVTNPLEHKFTSMSEMAKIIFHERGWRGFFVGLSIGYIKVTPMVACSFFVYERMKWYMGI

SEQ ID NO: 73284 - DNA, 1197 bp, Debaryomyces hansenii CBS767
  CDS (1)..(1197)
atgataccgacaactaatagaaataaactaaatatgaattgcaacgaggagtcgacgccatttgaacctgttcgagtgattgataagcaatcgttggattatgtattaaggtctggggtctcgggtggtttagctggaagtgcagctaaaactctaattgccccattggatagagtaaagattctctttcaaacgtcaaacccagaatttttaaagtatagaggcaagttttcaggactctttcgtgcaagtaagcgaatctggtccaacgatgggttttatgggttatttcaaggtcattcggttactttgttaagaatcttcccctatgcagctattaagtttgttgcttatgagcaaatcagaactattttgatcccaacggatttacacgaaactgcaattagaagatttatggctggttcattatctggtttagcaagcgttttctttacatatccattggatttacttagagttagaatggcatttgaaactaagcatttacacaacgatgacataagggctaatagtcgtcaacacatcatagcgcagcatcgaggacgattaagtacaaccgttcgagaaatattaaatgaacgcccaccccataaagtaaatgaccctacctggttcaaactcatgagacagaatttgcctccgtcagtaatgtcattatcaaacttttacagagggtttgctccaactattttgggaatgattccctacgcgggggtatcattctatacgcacgatttgatccatgatatcttgagatccaaatatttatcgaagtacactgttcagtcagcaggtgctctttcccactcgatttccacttcatcttcaagcaatagagttattagaaaatcttcgagcaataaagaccaaataaattcaagagattccaggttgcctttgaaagcatatgcgcaattactagcaggtggactcgccggtatgtgttcacaaactgctgcatatccatttgaagttataagaagaagaatgcaagtgggtggtgcggtaaatcaagggcaacatttatcattcaaatccacggcaaaaatagtttatagagaaagcggatttagaggcttttttgttggtttaagtattggctacataaaagtcatcccgatggttgcatgttcattttacgtttacgaaagatgtaaaatgtttttcggaatatga

SEQ ID NO: 73285 - protein, 398 aa, Debaryomyces hansenii CBS767
MIPTTNRNKLNMNCNEESTPFEPVRVIDKQSLDYVLRSGVSGGLAGSAAKTLIAPLDRVKILFQTSNPEFLKYRGKFSGLFRASKRIWSNDGFYGLFQGHSVTLLRIFPYAAIKFVAYEQIRTILIPTDLHETAIRRFMAGSLSGLASVFFTYPLDLLRVRMAFETKHLHNDDIRANSRQHIIAQHRGRLSTTVREILNERPPHKVNDPTWFKLMRQNLPPSVMSLSNFYRGFAPTILGMIPYAGVSFYTHDLIHDILRSKYLSKYTVQSAGALSHSISTSSSSNRVIRKSSSNKDQINSRDSRLPLKAYAQLLAGGLAGMCSQTAAYPFEVIRRRMQVGGAVNQGQHLSFKSTAKIVYRESGFRGFFVGLSIGYIKVIPMVACSFYVYERCKMFFGI

SEQ ID NO: 73286 - DNA, 1173 bp, Debaryomyces hansenii CBS767
  CDS (1)..(1173)
atggttaacaggaatcctcgagatttggaggagttgtcgctcactccaatagagagggacttctcagatcgagtgcagggcgaagacttagagttttgggcatcggatgaaggcaaatatcaaataatacataaggaaaaccagcgtaatgcatttctgccatccaagatattatctaagttcacggcaacccagttggtgacaatgtcgggggcagcgtcgggatttttagcgggtgtggtggtttgtccgttggatgttgttaaaacgcggtttcaggcccatggggcgttagctcaaagcacaggtagtttggcaagcaagaaatatagaggctttctaggcgccttcaagacgatattgcgagaagaaggtctacgaggattatacagagggttagttcctataacgattgggtatttacctacctggactatatactttactgtgtacgagcgggctaagttgttctatccggaatttttgaagtctcatttcaacttagaaactcatgcattaaaccatttctgttcagctttgacggcgggaatgacatcttcaatagcggttaatccaatttgggttgtgaaaactagattgatgatccagacaggctccggtagtacaatttataacaataacgctgaaaacaaatctgctgcacaaccaaaggttgaaagaacctactacaaaggcacattagatgcaattagaaccatgtataaagaagaagggatcagagtcttctatagtgggcttattccatctttgtttggcttgttacatgttggtattcattttccagtgtatgaaaagctaaaattgtggctcgagtgtgatttgaaatccgcttcagctgatgaacaaaaaagtaccttgggaagattgatagccgcatcgtcagtttccaaaatgatagcaagtactatcacctaccctcatgagatcctcagaacaagaatgcagatacagtcttctaacaggaataaatcggataagcaaaaaggaaagttaattaattcaataataaaaatataccagaaagagggtcttaaaggcttttacgcgggctatggtgtaaatttaattagaacggtacctgcgagtgcagtcacattggttagtttcgaatactttaaaacttatttattagagattagtgggaaactatag

SEQ ID NO: 73287 - protein, 390 aa, Debaryomyces hansenii CBS767
MVNRNPRDLEELSLTPIERDFSDRVQGEDLEFWASDEGKYQIIHKENQRNAFLPSKILSKFTATQLVTMSGAASGFLAGVVVCPLDVVKTRFQAHGALAQSTGSLASKKYRGFLGAFKTILREEGLRGLYRGLVPITIGYLPTWTIYFTVYERAKLFYPEFLKSHFNLETHALNHFCSALTAGMTSSIAVNPIWVVKTRLMIQTGSGSTIYNNNAENKSAAQPKVERTYYKGTLDAIRTMYKEEGIRVFYSGLIPSLFGLLHVGIHFPVYEKLKLWLECDLKSASADEQKSTLGRLIAASSVSKMIASTITYPHEILRTRMQIQSSNRNKSDKQKGKLINSIIKIYQKEGLKGFYAGYGVNLIRTVPASAVTLVSFEYFKTYLLEISGKL

SEQ ID NO: 73288 - DNA, 957 bp, Debaryomyces hansenii CBS767
  CDS (1)..(957)
atgtcagaattcgatatacgaagagacatgccatatgacatcaaacagtttttaaagcaagaatctaacgcgtctttgatggctggaggaattgctggtgcagtttcacggactgtggtgtcaccattcgaaagagctaagatcctattgcaactccaaggccccggatttaagtcatacaacggcatgttccccacgatcttcaaaatgtacgccgaagaaggctggagaggacttttcagaggtaacctcttgaactgcattcgtatcgtcccttacagtgctgtccagtacgccgtgtttgaaaaatgcaaggccatcatgatggccaacaaggacggttcgtctgagctccaggtgcacgaacgattgattgccgggtcgattggtggtattgcatcggtggctgctacgtaccctctagacctcgtgcgggccagaataaccgtgcagacggcatcgttggccaaactagcgaagggacgcttggtgaagcccccatcggtggtagaaacgttggtcgaagtctacaagcacgagggtggcctccgcgccctctacaagggcatagtacccaccaccatgggagtagccccctacgtggccatcaacttcaccctatacgaaaaaatgagggactacatggacaactcgcccgcagactattcaaatcccctctggaagctctcggccggggcattctccagtttcgtgggtggtgtcctcatctaccccttggatttgctccgtaagcgctaccaagtcgccagcatggccggtggtgaattgggcttccaatattcctccgtcgcccgtgcattgatctccattttcaccactgaaggcttctttggggcctacaaaggtctcactgcaaatctctacaaaatcgtgccttctatggctgtgagctggctctgctacgataatatcaaggaagaaattgctaaatggtag

SEQ ID NO: 73289 - protein, 318 aa, Debaryomyces hansenii CBS767
MSEFDIRRDMPYDIKQFLKQESNASLMAGGIAGAVSRTVVSPFERAKILLQLQGPGFKSYNGMFPTIFKMYAEEGWRGLFRGNLLNCIRIVPYSAVQYAVFEKCKAIMMANKDGSSELQVHERLIAGSIGGIASVAATYPLDLVRARITVQTASLAKLAKGRLVKPPSVVETLVEVYKHEGGLRALYKGIVPTTMGVAPYVAINFTLYEKMRDYMDNSPADYSNPLWKLSAGAFSSFVGGVLIYPLDLLRKRYQVASMAGGELGFQYSSVARALISIFTTEGFFGAYKGLTANLYKIVPSMAVSWLCYDNIKEEIAKW

SEQ ID NO: 73290 - DNA, 1023 bp, Oryza sativa (japonica cultivar-group)
  CDS (1)..(1023)
atgggttcctcacaggaatccactttttcctccgcctcaacggccgcgcaggtgaatgcctgcgcgctggacttgctcccggtatacgccaaggagcttatcgccgggggtgcagccggtgcattcgcaaagactgcggtagcgccgctggagagggtcaagatcttactgcagaccagaactcatgggtttcaatcccttggtatcctccaatcattgaggaagctgtggcagtatgagggaattcgaggcttctacaaggggaatggcgccagtgtgcttcggattgttccatatgcggcattgcattacatgacttatgagcagtatcggtgctggatattgaataattttgctccatcagtgggtacagggcctgtggttgatctattggctggctcagccgcaggtgggactgcagttctatgtacctacccattagaccttgctaggacaaagctggcatatcaggtttcaaatgtgggccaacctggcaatgctttgggaaatgctggtagacagccagcatatggtggtatcaaggacgttttcaaaactgtttacaaggaaggaggcgcacgagctttataccgtggagtaggcccaactctgatcggtatcctaccatatgctggactaaaattctatatatatgaagacctgaaatcgcgagttccagaggattacaagagatctgttgtattgaaactctcttgtggtgctttagctggtctttttgggcaaaccctcacttatccactggatgttgtccgaagacagatgcaggttcagaataagcagccccataatgcgaacgatgccttccgtataagagggacatttcagggtctagcactcattattaggtgccaggggtggaggcaactcttcgctggcctaagccttaactatgtgaaggtcgtcccttcggttgctattggtttcacaacatatgacatgatgaagaatttgctgagagtgccaccccgagagagactttatcaatcgtctggtaacgcatga

SEQ ID NO: 73291 - protein, 340 aa, Oryza sativa (japonica cultivar-group)
MGSSQESTFSSASTAAQVNACALDLLPVYAKELIAGGAAGAFAKTAVAPLERVKILLQTRTHGFQSLGILQSLRKLWQYEGIRGFYKGNGASVLRIVPYAALHYMTYEQYRCWILNNFAPSVGTGPVVDLLAGSAAGGTAVLCTYPLDLARTKLAYQVSNVGQPGNALGNAGRQPAYGGIKDVFKTVYKEGGARALYRGVGPTLIGILPYAGLKFYIYEDLKSRVPEDYKRSVVLKLSCGALAGLFGQTLTYPLDVVRRQMQVQNKQPHNANDAFRIRGTFQGLALIIRCQGWRQLFAGLSLNYVKVVPSVAIGFTTYDMMKNLLRVPPRERLYQSSGNA

SEQ ID NO: 73292 - DNA, 1431 bp, Oryza sativa (japonica cultivar-group)
  CDS (1)..(1431)
atggagcacgtgctgctggcgctgcacgagacggaggcggagagggaggcgcggatccgcgccatgttcggcttcttcgacgccgcggggcggggccacctcgaccacgcgcagatcgaggccggcctcgccgcgctccacctcccgccgccgccgccgcccgaggagggcggcggcggctacgcccgcgagctgctccgcgcgtgcgaccgcgaccgcgacggccgcgtcggctacgacgacttccgcaggtacatggacgacaaggagctggagctctaccgcatcttccaggccatcgacgtcgagcacaacggctgcatcctccccgaggagctctggcacgccctcgtcaaggctggcatagaaattgatgacgaggagcttgcaagatttgttgagcatgtggataaggataataatggaattattacttttgaagaatggagggactttcttttgctttaccctcatgaggcaaccattgagaacatctaccatcattgggaaagagtctgccttgtagatataggcgagcaggctgctataccagaacgaataagtaaacatgcaagcgcaagcaaatatctaattgcaggaggtgtttctggtgcaacatcccgtactgctactgcacctcttgaccgtctcaaagtcatcatgcaagtacaaacaaaccgtattacagtattacaagcagtgaaggatatatggagagagggcagtctgcgtggtttcttcagaggaaatggattaaatgtggtaaaggttgctccagaaagtgcaataagattttatgcctacgaaatgctaaaagaatacataatgaaaagtaaaggagaaaataagagcgacattggtacttctggacgtctgatggctggtggtttggctggagcagtggcacagacagcaatttatcccatagatttagtaaagactcgactgcagacttttgcatgtggtagtggtaaaattcctagccttggtgcactatcaagagacatttggatgcaggaaggtcctcgagcattttacagaggcctcgttccatcattgcttggtatggttccgtatgctggaattgatcttactgtttatgaaacactgaaagaaatgtccaagacatatgtcctcaaggatagcgatcctggtcctttagtccaactaggttgtgggacagtctcaggagctctaggagcaacatgtgtttaccctttgcaagtcatcagaacaagactgcaagctcaacgagccaattcagaggctgcatatagagggatgtctgatgttttctggaaaacactgcagcatgagggaatttccggattctacaaagggcttgtaccaaatcttctcaaagtggttccagctgcaagtataacatatcttgtttatgagacaatgaagaaaagtctatcactcgattaa

SEQ ID NO: 73293 - protein, 476 aa, Oryza sativa (japonica cultivar-group)
MEHVLLALHETEAEREARIRAMFGFFDAAGRGHLDHAQIEAGLAALHLPPPPPPEEGGGGYARELLRACDRDRDGRVGYDDFRRYMDDKELELYRIFQAIDVEHNGCILPEELWHALVKAGIEIDDEELARFVEHVDKDNNGIITFEEWRDFLLLYPHEATIENIYHHWERVCLVDIGEQAAIPERISKHASASKYLIAGGVSGATSRTATAPLDRLKVIMQVQTNRITVLQAVKDIWREGSLRGFFRGNGLNVVKVAPESAIRFYAYEMLKEYIMKSKGENKSDIGTSGRLMAGGLAGAVAQTAIYPIDLVKTRLQTFACGSGKIPSLGALSRDIWMQEGPRAFYRGLVPSLLGMVPYAGIDLTVYETLKEMSKTYVLKDSDPGPLVQLGCGTVSGALGATCVYPLQVIRTRLQAQRANSEAAYRGMSDVFWKTLQHEGISGFYKGLVPNLLKVVPAASITYLVYETMKKSLSLD

SEQ ID NO: 73294 - DNA, 1278 bp, Oryza sativa (japonica cultivar-group)
  CDS (1)..(1278)
atggcggcgatgatggcggtgacgacgatggtgacgaggaacaacgccgtcggcggcggcgcggtggcggtggtggacaggaaggggtggttcgtcccggaggtgtcgttcccgtggagctcggtggaaggggagtgcatcaacagcagcagcaagaggttggagttccctcgccggacggctgcgccgccgctgttcgccagcgtcgggctcagcttgccgtctgcggcgaagggccgggacaactgcgacgtcgcgcggcagctcgccgccgcggaggccgaggaggcggcggggaagaagaggcagggcaggaagatgaagggcggcggcgggctgctgtcgctgaggaaggtgagggtgaagatcgggaacccgcaccttcgccggctggtgagcggcgccatcgccggcgccgtgtcgcgcaccttcgtggcgccgctggagaccatccgcacccacctcatggtcggcagctgcggcgccggctccatggccgaggtcttccgctggatcatgcgcaccgagggctggaccggcctcttccgcggcaacgccgtcaacgtcctccgcgtcgcccccagcaaggccatcgagcatttcacctacgacacggccaagaagtacctcaccccggaggacggcgagcctgccaagatccccatccccgtccccctcgtcgccggcgccctcgccggtgtcgcctccaccctctgcacctaccccatggagctcgtcaagacccgcctcaccatcgagaaggacgtgtacgacaacgtgctgcacgcgttcgtgaagatcgtgcgggagggcgggccgggggagctgtaccgcggcctggcgccgagcctgatcggcgtggtgccctacgcggccaccaacttctacgcctacgagacgctgcgccgcctgtaccgccgcgccacggggcgcgccgacgtcggcccggccgcgacgctgctcatcgggtcggcggcgggcgccatcgccagcacggccaccttcccgctcgaggtcgcccgcaagcagatgcaggtcggcgccgtcggcggccggcaggtgtaccgccacgtgctccacgccatgtactgcatcctccgcggcgagggcgccgcgggcctctaccgcggcctcggccccagctgcatcaagctcatgcccgccgccggcatctccttcatgtgctacgaggcgctcaagaaggtactcgtcgaggaggaggcggcgccggagctggaggcggagtgcgcggaggagatcaaggagaaggttgcgtga

SEQ ID NO: 73295 - protein, 425 aa, Oryza sativa (japonica cultivar-group)
MAAMMAVTTMVTRNNAVGGGAVAVVDRKGWFVPEVSFPWSSVEGECINSSSKRLEFPRRTAAPPLFASVGLSLPSAAKGRDNCDVARQLAAAEAEEAAGKKRQGRKMKGGGGLLSLRKVRVKIGNPHLRRLVSGAIAGAVSRTFVAPLETIRTHLMVGSCGAGSMAEVFRWIMRTEGWTGLFRGNAVNVLRVAPSKAIEHFTYDTAKKYLTPEDGEPAKIPIPVPLVAGALAGVASTLCTYPMELVKTRLTIEKDVYDNVLHAFVKIVREGGPGELYRGLAPSLIGVVPYAATNFYAYETLRRLYRRATGRADVGPAATLLIGSAAGAIASTATFPLEVARKQMQVGAVGGRQVYRHVLHAMYCILRGEGAAGLYRGLGPSCIKLMPAAGISFMCYEALKKVLVEEEAAPELEAECAEEIKEKVA

SEQ ID NO: 73296 - DNA, 1281 bp, Oryza sativa (japonica cultivar-group)
  CDS (1)..(1281)
atgtgggccccacctgcccccccctcccccccccccccgggggcacgcacgaaactcctcgtcttcttccgctattactattctccctcctctttgcgtctctccgcctccgcctccgcttcgacctacctctcctcctcgcgttcgcttctccccccctctccccctccctctcccgcgacgaggcgggaggcatggaggcgcgcgcgcgggggcgggaggcgggggagggaggttggggcggaggcggaggtggcctgccgctcgccgtgcgggagctcgtcgccggcggggtggcggggggagtcgccaagacggccgtcgcgccgctcgagcgcgtcaagatcctcttccaggcacactagaagagcagaattccatggttctggattaattggatcatttcgaacaatctctcgaacagaagggcttttagggttttacaggggaaatggagccagtgttgctcggattgttccttatgcagctttgcattatatggcctatgaagaatacagacgatggatcattcttggttttcctaatgttgagcaaggccctattcttgatctagtggctggatcaatagctggtggaacagctgtcatatgcacataccctcttgatctagttcgcacaaagttggcttatcaggttaaaggtgcagtgaaacttagtttaagagaatataagccctctgaacaggtttataaagggatccttgattgtgtcaaaacaatatacagacaaaatgggttaagaggcctatatcgtggcatggctccatcgttgtatggaatcttcccttactctggtcttaaattctacttttacgagactatgaagacttatgtacctgaagagcacagaaaagatatcattgcaaaacttgcctgtggatctgtggctggtttgttagggcagacaataacatatccccttgatgttgttaggcggcaaatgcaggccttttcatcatccaacctagaaaagggaaaaggaacatttggaagcattgctatgatagcaaaacatcaaggttggcggcaactgttctcaggattatctatcaactatttgaaggaactatatcaattagacacttcagtatgtgcttttatttatgtgcaatgtggggaaaaggtggtcccatcagtagccatagggtttacagtttatgactcaatgaaggtttggcttaaagttccatcgagagaggacacggctattgctgcgctgacagaagaaagaagtaatgcagcccctgctcactccagttag

SEQ ID NO: 73297 - protein, 426 aa, Oryza sativa (japonica cultivar-group)
MWAPPAPPSPPPPGARTKLLVFFRYYYSPSSLRLSASASASTYLSSSRSLLPPSPPPSPATRREAWRRARGGGRRGREVGAEAEVACRSPCGSSSPAGWRGESPRRPSRRSSASRSSSRHTRRAEFHGSGLIGSFRTISRTEGLLGFYRGNGASVARIVPYAALHYMAYEEYRRWIILGFPNVEQGPILDLVAGSIAGGTAVICTYPLDLVRTKLAYQVKGAVKLSLREYKPSEQVYKGILDCVKTIYRQNGLRGLYRGMAPSLYGIFPYSGLKFYFYETMKTYVPEEHRKDIIAKLACGSVAGLLGQTITYPLDVVRRQMQAFSSSNLEKGKGTFGSIAMIAKHQGWRQLFSGLSINYLKELYQLDTSVCAFIYVQCGEKVVPSVAIGFTVYDSMKVWLKVPSREDTAIAALTEERSNAAPAHSS

SEQ ID NO: 73298 - DNA, 1281 bp, Oryza sativa (japonica cultivar-group); identical to SEQ ID NO: 73296
  CDS (1)..(1281)

SEQ ID NO: 73299 - protein, 426 aa, Oryza sativa (japonica cultivar-group); identical to SEQ ID NO: 73297

SEQ ID NO: 73300 - DNA, 1068 bp, Oryza sativa (japonica cultivar-group)
  CDS (1)..(1068)
atggcatcggaggacgtggtggggaagagcaggggggacaccgcggtcaccaccatcgtcaacctggcggaggaggccaagctcgcgcgggagggggtcaaggggcctggttaccaggtgctctccatctgcaagtctctcttcgccggtggcgtcgccggtggagtatcacgtactgctgttgctccgctcgaacgaatgaagattctgcttcaggtccaaaaccctcacagtatcaagtacaacggtacaattcaaggtcttaagtacatatggagaacagagggtctccgtggactttttaagggcaatggtaccaattgtgccagaattgttccaaattctgccgtgaagttttttagctatgagcaagcatcaagtggaattttatggctttatcggcaacaaacagggaatgaggatgctcagcttagtccactattgcgccttggagctggtgcttgtgctggtatcatagccatgtctgctacttacccgatggatatggttaggggtaggattaccgtgcagacggaaaagtctccttatcagtaccgtggtatgtttcatgcattgggttcagtataccgtgaagaaggcttccgtgctctatacagagggtggcttccatctgttatcggagtggttccgtatgttggcctcaactttgctgtgtacgagtctctgaaggactggctgcttcagacaaatccatatgatcttggcaaggacaatgagttgcatgtagttacaaggcttggatgtggagctgtggctggaaccataggccagactgttgcttaccctcttgatgtcatcaggaggagaatgcagatggttggttggaataatgcagcatctattgttactggagaaggcaaagaggcgctccagtacaatggtatgatcgatgcattcaggaaaactgttcgctatgaaggtgttggtgctttgtacaagggtcttgtgcccaattcagtgaaggtggtgccttctatcgctattgcattcgtgacatacgagtttgtgcaaaaagttctaggagtagagatgaggatatcagactga

SEQ ID NO: 73301 - protein, 355 aa, Oryza sativa (japonica cultivar-group)
MASEDVVGKSRGDTAVTTIVNLAEEAKLAREGVKGPGYQVLSICKSLFAGGVAGGVSRTAVAPLERMKILLQVQNPHSIKYNGTIQGLKYIWRTEGLRGLFKGNGTNCARIVPNSAVKFFSYEQASSGILWLYRQQTGNEDAQLSPLLRLGAGACAGIIAMSATYPMDMVRGRITVQTEKSPYQYRGMFHALGSVYREEGFRALYRGWLPSVIGVVPYVGLNFAVYESLKDWLLQTNPYDLGKDNELHVVTRLGCGAVAGTIGQTVAYPLDVIRRRMQMVGWNNAASIVTGEGKEALQYNGMIDAFRKTVRYEGVGALYKGLVPNSVKVVPSIAIAFVTYEFVQKVLGVEMRISD

SEQ ID NO: 73302 - DNA, 1002 bp, Oryza sativa (japonica cultivar-group)
  CDS (1)..(1002)
atggcggcgcgcgagcccgtgttcgcgggcaccaacgacaccatggagctgtccagcgacgccgccccgtccccggccaatctctcgaggacggccacggcgatctgctcgacgccggcgttcgccagggagatggtcgccggtggcgtcgcgggcgtggtggcgaagacggccgtggcaccgctcgaacgggtgaacctcatgaggcaggtcggcgcggcgccgcggggcgccggcgccgtgcagatgctgcgcgagatcggccgcggcgagggcgtcgcggggctcttccgcggcaacggcgccaacgcgctccgcgtgttccacaccaaggcgctccacttcatggcgtacgagcggtacaagcggttcctcctcggcgccgccccctcgctcggcgacggaccggtggtggacctcctcgccgggtcggcggcgggcggcaccgcggtgctcgccacctacccgctcgacctcgcgcgcaccaggctcgcctgcgccgccgcgccgcccggcgccgcggcggcgggcatgtccggcgtgctccggagcgcgtacagggagggcggcggcgtgcgcggggtgtaccgcggcctgtgcccgtcgctggcgcgcgtgctcccgatgtcgggcctcaacttctgcgtgtacgaggcgctcaaggcgcagatcccccgcgaggaggaggagcacggggcgcgcggctggcgccgggcggcgaaggtggcgtgcggcgtggcggcggggttggtggcgagcacggcgacgtacccgctcgacgtggtgcggcggcagatacagctgggcggcggcggcggcggcacgctgcaggcattccgcgccatcgtgcgggcgcagggcgcgcggcagctgtacgccggcctcgggatcacgtacgtcaagaaggtgccgtcgacggccgtcgggctggtggcctacgactacatgaagtcgctgctcatgttgccggcgagtggtcccaaggccaatggtagtaagtag

SEQ ID NO: 73303 - protein, 333 aa, Oryza sativa (japonica cultivar-group)
MAAREPVFAGTNDTMELSSDAAPSPANLSRTATAICSTPAFAREMVAGGVAGVVAKTAVAPLERVNLMRQVGAAPRGAGAVQMLREIGRGEGVAGLFRGNGANALRVFHTKALHFMAYERYKRFLLGAAPSLGDGPVVDLLAGSAAGGTAVLATYPLDLARTRLACAAAPPGAAAAGMSGVLRSAYREGGGVRGVYRGLCPSLARVLPMSGLNFCVYEALKAQIPREEEEHGARGWRRAAKVACGVAAGLVASTATYPLDVVRRQIQLGGGGGGTLQAFRAIVRAQGARQLYAGLGITYVKKVPSTAVGLVAYDYMKSLLMLPASGPKANGSK

SEQ ID NO: 73304 - DNA, 1017 bp, Yarrowia lipolytica CLIB122
  CDS (1)..(1017)
atgtcgctcaaggaacaagtgcccatgttgcactcggtccgtgagtttttcggccagcccaccgtggcctccttttgcgctggaggagtcgctggagccgtctcccgaaccgtcgtgtcccccctggagcggatgaaaatcatctttcaggtccagagcgccggtcctggaggcgcaccgtaccagggcgtcatccccacgctgtccaaaatgtggcgcgaggagggctggcgcggcttcatgcgaggaaacggaacaaactgcatccggatcgtgccctactcggccgtccagttctcctcctacaccatctacaaaaagctgctgttccccgaccaggatggaacgaccctgggagcaacaacggccgagggcgtgcagtcgtccttcagctccaaattcaacatggacgctctgcgacgtctgacggcaggaggtttggcgggtatcacttctgtgtttgcaacctaccccctggacattgtgcgaacgcgtctgtcgatccagaccgctgatatcggcaccttcgccaaccgaaacgtcaagccccccggaatgtggcaggtcatgtgcgaaatctaccgaaacgaaggtggtttccgagctctgtatcgaggtatcatccccaccaccatgggagtggctccttatgtcggtctcaactttgccgtgtacgaactcttcagagacgtggtgacgcccgtgggacagaaggacccctcagctggaggaaagctgctggcaggagccatctctggagccgtggcccagaccgtcacatatccgttcgacgtgctgcgaagacggttccaggtggtagccatgccggaccccaagctcaaggagatgcagggcaactacaccagtgtttggagcgccattaagtccatcattcgagcagagggaatcaagggaatgtataagggtctgtcggccaacctgctgaaggtggcgccctccatggcctcgtcgtggctgtcctacgagctcgtcaaggacgccctgctcatcaaatag

SEQ ID NO: 73305 - protein, 338 aa, Yarrowia lipolytica CLIB122
MSLKEQVPMLHSVREFFGQPTVASFCAGGVAGAVSRTVVSPLERMKIIFQVQSAGPGGAPYQGVIPTLSKMWREEGWRGFMRGNGTNCIRIVPYSAVQFSSYTIYKKLLFPDQDGTTLGATTAEGVQSSFSSKFNMDALRRLTAGGLAGITSVFATYPLDIVRTRLSIQTADIGTFANRNVKPPGMWQVMCEIYRNEGGFRALYRGIIPTTMGVAPYVGLNFAVYELFRDVVTPVGQKDPSAGGKLLAGAISGAVAQTVTYPFDVLRRRFQVVAMPDPKLKEMQGNYTSVWSAIKSIIRAEGIKGMYKGLSANLLKVAPSMASSWLSYELVKDALLIK

SEQ ID NO: 73306 - DNA, 1089 bp, Yarrowia lipolytica CLIB122
  CDS (1)..(1089)
atgtcggctcacgggacgtacgaaaataaacgcactttggcgtacgtgtgcaaaagcggtttggcaggaggcatggctggatgtgttgctaagactgtgatcgctccgctggatcgagtcaagattctgttccagacgtcgaatcccgagttccgcaagtatcgtggctcgtttctgggcttctggcgcgcaggaaagttcatttacagccaacagggcgtgtggggtttgttccagggccactcggcgacgctgctgcgaatctttccctatgctgcagtcaagtttgtggcctatgagcagtttcgggcgcttttgatttccggtcccgaccaggaggtggctctgcgacgaatggcagccggctctctgtccggaatcgtgtctgtctactgcacttatcctctcgagttgattcgagttcgcatggcgtatgccactaacgaggttggaaagccccacggaggccggctactggcagcggctcggtccatctacgccgagactccgtcggcaaaggccacccaattcttctcgcccagaatagctgcctggaccaacttttaccgaggcttcacccccacgattatgggtatgatcccatacgcaggcgtctcgtttctgacccacgactacatccacgacctgttccacacacggtacttccgatcatggaccgtcaagggcgagattgcgccgaaaaagacttatccgcatctactggaaaccaacaatgacgatgtcatgctggagggccatcaccatgaggacgaagacaagaaggtgtcatacaaaagagagcccctcaaggcgtgggcacaactcattgccggaggagtggccggaatggtgtcgcaaactgcatcgtatccgttcgaggtgattcgacgacgtatgcaggtcgcaggcgcacaggcgggctcatcaggagtgcatcccagcatagtggcgaccgcactgacaatttacaaggaaagcggcttcaagggtttttttgtgggactcactattggatatataaaggtgactccaatggtcgcatgttcgttctttgtctacgagagaatgaagcattggttgggcatttaa

SEQ ID NO: 73307 - protein, 362 aa, Yarrowia lipolytica CLIB122
MSAHGTYENKRTLAYVCKSGLAGGMAGCVAKTVIAPLDRVKILFQTSNPEFRKYRGSFLGFWRAGKFIYSQQGVWGLFQGHSATLLRIFPYAAVKFVAYEQFRALLISGPDQEVALRRMAAGSLSGIVSVYCTYPLELIRVRMAYATNEVGKPHGGRLLAAARSIYAETPSAKATQFFSPRIAAWTNFYRGFTPTIMGMIPYAGVSFLTHDYIHDLFHTRYFRSWTVKGEIAPKKTYPHLLETNNDDVMLEGHHHEDEDKKVSYKREPLKAWAQLIAGGVAGMVSQTASYPFEVIRRRMQVAGAQAGSSGVHPSIVATALTIYKESGFKGFFVGLTIGYIKVTPMVACSFFVYERMKHWLGI

SEQ ID NO: 73308 - DNA, 939 bp, Yarrowia lipolytica CLIB122
  CDS (1)..(939)
atgggtggaagttccgatactcaacatttctggattgatttcctcatgggaggtgtgtctgccgccgtgtctaagaccgccgccgctcccatcgagcgagtcaagctgctgctccaaaaccaggaggagatgatcaagcagggtcgtctgtctcgaccttacaagggtatcattgactgtttccgacgaacttggggagaggagggtctggcttctttctggcgaggtaacaccgccaacgttatccgatacttccccactcaggctcttaacttcgccttccgagacaagttcaaggctatgtttggctacaacagaaagaaggatggcttctggcttactctgtacggtaacatcgcctctggtggtatggctggtgccacatctctgttctttgtctactctctcgatttcgcccgaactcgacttgccaacgacgccaagtctgtcaccaagggccccgatggtaagcccgttgagggccagcggcagttcaagggtctgattgacgtgtatgtccagaccatcaagtctgacggtgtccagggtctgtaccgaggttttgtcccctctgttatcggtattgttgtttatcgaggtctgtactttggtctttacgatacccttaagcccattgttcttgtcggacctctcgagggtaacttcctggcctccttccttcttggttgggttgtcaccaccggtgcctctaccgcctcctaccctctggatactgtgcgacgacgaatgatgatgacttctggacagaaggtcaagtacaagtcttccattgatgccttctccaagattgtggctgctgagggtgtcggagctctgttcaagggatgtggagccaacattctgcgaggtgttgctggtgccggtgtgctgtccatctacgaccagctccagatgatcatgtggggtaagaagttttaa

SEQ ID NO: 73309 - protein, 312 aa, Yarrowia lipolytica CLIB122
MGGSSDTQHFWIDFLMGGVSAAVSKTAAAPIERVKLLLQNQEEMIKQGRLSRPYKGIIDCFRRTWGEEGLASFWRGNTANVIRYFPTQALNFAFRDKFKAMFGYNRKKDGFWLTLYGNIASGGMAGATSLFFVYSLDFARTRLANDAKSVTKGPDGKPVEGQRQFKGLIDVYVQTIKSDGVQGLYRGFVPSVIGIVVYRGLYFGLYDTLKPIVLVGPLEGNFLASFLLGWVVTTGASTASYPLDTVRRRMMMTSGQKVKYKSSIDAFSKIVAAEGVGALFKGCGANILRGVAGAGVLSIYDQLQMIMWGKKF

SEQ ID NO: 73310 - DNA, 918 bp, Oryza sativa (japonica cultivar-group)
  CDS (1)..(918)
atgggccgccgccacatcggcaccgtcgcccacctcgccgccgggggcttcgccggcgccgtcagcaagacctgcaccgccccactcgcccgcctcaccatcctcttccaggtggcaggtatgcattcagatgtggcagctctaaagaagtacagcatatggcatgaagcttcacgaatagttcgagaagaaggatttggagcattttggaaaggcaatctggtgacaattgtgcatcgtttaccttattctgccatcagcttttattcatatgagcgctacaaaaaatttctccaaagggttcctggccttgatgaagactcaaattatgttggtgttgctcgtttacttagtggcggtttggcaggaattactgctgcatctgtaacttatcccttggatgttgtccgtactcgtttggcaacacagaaaacaaccaggtattacaaaggcatctttcatgcagtgtctaccatttgtagagatgagggtgtcaaaggattgtacaagggccttggggccacattattgggagtcggacctagcatagcaatcagctttactgtatatgaatcattgaggtctcattggcaaatggaaaggccccaagattcccctgcagttgttagtttgttttctgggagtctatctggtattgcatcatctactgccacatttccccttgatcttgtaaagagacgaatgcaactgcaaggggcagctgggacatcgtcagtctgtaaatcaagcataactggaaccatccgccaaatctttcagaaggaaggccttcgtggcttctacagagggatagtccctgagtacctgaaggttgttcctagtgtagggattgccttcatgacctatgagaccctgaagagcttgctctccagcatagacgaagacgacgagagctga

SEQ ID NO: 73311 - protein, 305 aa, Oryza sativa (japonica cultivar-group)
MGRRHIGTVAHLAAGGFAGAVSKTCTAPLARLTILFQVAGMHSDVAALKKYSIWHEASRIVREEGFGAFWKGNLVTIVHRLPYSAISFYSYERYKKFLQRVPGLDEDSNYVGVARLLSGGLAGITAASVTYPLDVVRTRLATQKTTRYYKGIFHAVSTICRDEGVKGLYKGLGATLLGVGPSIAISFTVYESLRSHWQMERPQDSPAVVSLFSGSLSGIASSTATFPLDLVKRRMQLQGAAGTSSVCKSSITGTIRQIFQKEGLRGFYRGIVPEYLKVVPSVGIAFMTYETLKSLLSSIDEDDES

SEQ ID NO: 73312 - DNA, 1104 bp, Aspergillus nidulans FGSC A4
  CDS (1)..(1104)
atgagtctgaatcgccaggaagcaacccgtcatgacgggtcagatggcgttgacaaaagtgctttgtcgaaaatctcgcaattagaggcacccacttcgactcaggaaacatatccgagaagctccctcctgcacggagctagagttgcagtcgccgagcccgttacggcagctttcctagctgggggagtagctggcgctgtatcgagaaccatcgtatcgccgctcgaacgtttgaaaattcttcttcagatccaaagtgtcgggagggaggaatacaaactatcaatctggcaggccctaaaaaagattggacgggaggaaggctggcgaggctttttgcggggaaatggcacgaactgtatacggattatcccgtactcagcggtgcagttcggcagttataatttctataaaaggttcgctgagccttcgcctgatgcggatttgacgccaatacgccgactcatttgtggaggggcggctgggataacctcagtcattgtaacctatccccttgatttggtccgtacaaggctgtccatacaatctgcctcttttgcggctctcaagcgtgatagcgccggcgagaagttgccgggaatgtttacgaccatggttttagtctataagaatgagggcggctttttagcgctttaccgtggtatcattccaaccgtagccggtgttgccccttatgttggcttgaactttatgacatacgaatcagttcgtaaatatttgactcctgaaggggactccacacccagtgctcttcgcaaattgctggccggtgccatctcaggggctgtggcacaaacatgcacctatcccttcgatgtcctccgaaggcgtttccagatcaacacgatgtccaatatgggctaccaatatgcttcaatcttcgacgccgtaaaagtgattgtggccgaagagggtgtccgcggtctcttcaagggaatcgcgccgaacctccttaaagttgctcccagcatggcgagcagttggctcagctttgagctcacccgggattttttattgagctttgacgaaagaacggaggtaaaggagcaataccaatgcgactacgggcatctaagatag

SEQ ID NO: 73313 - protein, 367 aa, Aspergillus nidulans FGSC A4
MSLNRQEATRHDGSDGVDKSALSKISQLEAPTSTQETYPRSSLLHGARVAVAEPVTAAFLAGGVAGAVSRTIVSPLERLKILLQIQSVGREEYKLSIWQALKKIGREEGWRGFLRGNGTNCIRIIPYSAVQFGSYNFYKRFAEPSPDADLTPIRRLICGGAAGITSVIVTYPLDLVRTRLSIQSASFAALKRDSAGEKLPGMFTTMVLVYKNEGGFLALYRGIIPTVAGVAPYVGLNFMTYESVRKYLTPEGDSTPSALRKLLAGAISGAVAQTCTYPFDVLRRRFQINTMSNMGYQYASIFDAVKVIVAEEGVRGLFKGIAPNLLKVAPSMASSWLSFELTRDFLLSFDERTEVKEQYQCDYGHLR

SEQ ID NO: 73314 - DNA, 1302 bp, Aspergillus nidulans FGSC A4
  CDS (1)..(1302)
atgtctgcagcagctaccggccatgcgcaagacgactctacctcattaatcccgaatcctacttcccccaatatcataggcgactctcagtctcgaaatcagtccgcttcgcagcagatggaatcagcgtcacacgcacaacggccgacatcacataacatcagcagcggggcagtggtggccgggcctcacgcgaccacggctgatgacccatcacatcgtccgggtcagagcagtcgaaatggtggccaggagaagaacaagaggagcctcgattatgtcttaaggagtggactcgctggagggctggctggttgtgcgacagtggttgcgcctcttgatcgagtgaagatccttttccaagcgtcgaatcctcagttcgccaaatatacaggaagttggactggacttgtcttcgctattcgggatatcaagcggcacgaaggtgcccgaggcctgtaccgaggccactcagcaacattacttaggatttttccttacgcatccatcaagttcctcgcttatgagcagtttcgagcaatagttataccgtcacgggacaaagagactccatttcgtcgccttgtctcagggagcttggcaggcattacctccgttttcttcacgtacccgttagagttgataagggtgcggctagcgttcgagaccaagaagtcttcgcgttcatcccttgtggataccatccgacaaatctatggagagcaagttaaacctcctaaagagctctcgaccggcaaaggaacctcctccgttaccgggaccgctgccgctgccgcgaataccgtttcttcgactacgaggaatattgttcctagctcagggctggccaacttctaccggggatttacacctacgcttcttggaatgattccgtatgcgggcgtgtccttcctcactcatgacacagttggcgactggctccgtttaccgttactagccccttacaccaccatccctcgatcttcgtcctcgggccataagaaggatcggcaaaaactgcaactgacggccgccgcagaattattgtcaggagcaatcgccggccttgtttcccaaacatcttcatatcctttggaagtggtgcgccggcgaatgcaagtcggcggagtcgttggtgatggccgccgtttgggcatggcggaaacagcgcgaataataatgatggaaagaggatttcgcgggttctttataggcttgacgattggttatcttaagatgatacccatgacggctactggtttttttgtttatgaacggctcaaatggtcactagggatttag

SEQ ID NO: 73315 - protein, 433 aa, Aspergillus nidulans FGSC A4
MSAAATGHAQDDSTSLIPNPTSPNIIGDSQSRNQSASQQMESASHAQRPTSHNISSGAVVAGPHATTADDPSHRPGQSSRNGGQEKNKRSLDYVLRSGLAGGLAGCATVVAPLDRVKILFQASNPQFAKYTGSWTGLVFAIRDIKRHEGARGLYRGHSATLLRIFPYASIKFLAYEQFRAIVIPSRDKETPFRRLVSGSLAGITSVFFTYPLELIRVRLAFETKKSSRSSLVDTIRQIYGEQVKPPKELSTGKGTSSVTGTAAAAANTVSSTTRNIVPSSGLANFYRGFTPTLLGMIPYAGVSFLTHDTVGDWLRLPLLAPYTTIPRSSSSGHKKDRQKLQLTAAAELLSGAIAGLVSQTSSYPLEVVRRRMQVGGVVGDGRRLGMAETARIIMMERGFRGFFIGLTIGYLKMIPMTATGFFVYERLKWSLGI

SEQ ID NO: 73316 - DNA, 1227 bp, Candida albicans SC5314
  CDS (1)..(1227): transl_table=12
atgacccaatctaatagtgactcgtcaagtactggcgacgtacccaatatcaacactttgctaataccgtcgatctcaaaaccagtatactcacgtatccctatcccgggccatttaagcaatgatcaatccacccccattgaggatattaagattatcgataaacagagcatagactatataataaggtcaggtctagctggtggcttagctggatcttgtgccaagaccttagtggcacctttggacagaatcaagatcttgttccaaacatcaaacccagaattcataaagtatagaggaacatttggcgggttcattgatgctggaaaacgtatatggaaagccgacggggtaatggggttgtaccaaggtaactcagtgactttgttacgtatcttcccctatgcagcaatcaaatttgttgcctatgaacaaattcgtacttttttgatcccaaacgacagttacgaaaccgccgctagaagatttatggctgggtcgttatcaggactagcatcggtgtttttcacgtatccactagacttagttagagtgagattagcatttgaaactagaaacttgtctcattcacaaatccatcaccaccacaaagagtttatggcccatcgtcgaggaagaatattttctaccgtcagcctaatttataacgaaaacccaccaatcaaaaccactgacccgtcgtggttgaaattaatgcgaaaatcgttcccgtcacccataaaccatttagccaatttctaccgtgggtttgccccgacaatattaggtatgatcccttacgctggtgtctcattctacactcatgatttgttgcacgatattttgcgctccaaatggctcgcaaaatatactgtccaatcaaccaaccaccaaaacgtcgtggtaaagaaaaaggggaaatcgtccagagaatcacgtgcgcccctaaaagcatatgcacaattatttgctggtgggttggctgggttatgttcccagaccgccgcctacccgtttgaagttatccgaagaagaatgcaagtgggaggcgccataaaccagggtcagtttttgtcattcaaaaacacagcaaaactaatctatcgagagaacggacttcaagggtttttcgttgggttgagtattggttatatgaaagtagtgcccatggttgcatgctcgttctttgtctacgaaagaatgaaaaagttcttaggtatatag

SEQ ID NO: 73317 - protein, 408 aa, Candida albicans SC5314
MTQSNSDSSSTGDVPNINTLLIPSISKPVYSRIPIPGHLSNDQSTPIEDIKIIDKQSIDYIIRSGLAGGLAGSCAKTLVAPLDRIKILFQTSNPEFIKYRGTFGGFIDAGKRIWKADGVMGLYQGNSVTLLRIFPYAAIKFVAYEQIRTFLIPNDSYETAARRFMAGSLSGLASVFFTYPLDLVRVRLAFETRNLSHSQIHHHHKEFMAHRRGRIFSTVSLIYNENPPIKTTDPSWLKLMRKSFPSPINHLANFYRGFAPTILGMIPYAGVSFYTHDLLHDILRSKWLAKYTVQSTNHQNVVVKKKGKSSRESRAPLKAYAQLFAGGLAGLCSQTAAYPFEVIRRRMQVGGAINQGQFLSFKNTAKLIYRENGLQGFFVGLSIGYMKVVPMVACSFFVYERMKKFLGI

SEQ ID NO: 73318 - DNA, 981 bp, Candida albicans SC5314
  CDS (1)..(981): transl_table=12
atggaagaatataagctacagccaatggccaaggaatcaaatcaccttctatctgatatcaaaaacttcataaagatagactctaatgcttcgtttattgcagggggtattgccggtgccgtttccaggacggttgtatcaccgtttgaaagagctaaaatattgttacaacttcaaggacctggatcgcaacaagcataccaaggaatgttccccacaatactaaagatgtaccgggaagaaggctggaaaggtttattccgagggaacttattaaactgtattagaatatttccttatagtgctgtccaatttgcaacttttgagaaatgtaaagacatcatgttgcattacaacccacgtgacacacaacaactaaatggatatgaaagattaatagctggttctgttggtggtatagtgtctgttgccgttacatacccattggatttagtcagagctcgtatcactgtccaaaccgcgtcactaagcaaattaaacaaaggtaaaatggtccgggcaccgaaagtaatggaaactttaaaggacgtttacaaaaacgaagggggaattttaggattatatcgtggaataataccaacgactttgggtgtggctccttatgtagctatcaattttgcactttatgagaaattgagggagatgatggatagttcaccacgtgacttttccaatcctgtatggaagttatcagcaggtgcagttagtagctttattggaggagtattgatctatcccttagatttgttaagaaaaagataccaagtagcaagtatggcaggcggggaactcgggtttcagtatagatcagttgcgcacgctttgcattcaattttcaccaccgagggtttctttggtgcttataagggattaacagcaaatttatacaagattgtaccttcaatggcagtcagttggctatgctatgatacattaaaagactggataaatagatggtaa

SEQ ID NO: 73319 - protein, 326 aa, Candida albicans SC5314
MEEYKLQPMAKESNHLLSDIKNFIKIDSNASFIAGGIAGAVSRTVVSPFERAKILLQLQGPGSQQAYQGMFPTILKMYREEGWKGLFRGNLLNCIRIFPYSAVQFATFEKCKDIMLHYNPRDTQQLNGYERLIAGSVGGIVSVAVTYPLDLVRARITVQTASLSKLNKGKMVRAPKVMETLKDVYKNEGGILGLYRGIIPTTLGVAPYVAINFALYEKLREMMDSSPRDFSNPVWKLSAGAVSSFIGGVLIYPLDLLRKRYQVASMAGGELGFQYRSVAHALHSIFTTEGFFGAYKGLTANLYKIVPSMAVSWLCYDTLKDWINRW

SEQ ID NO: 73320 - DNA, 954 bp, Ustilago maydis 521
  CDS (1)..(954)
atgggtaccgttgccgaccccgctaagactaagaagaccgtcagtggcttcgccactgatttcctcatgggtggtgtttccgccgccgtctccaagacggctgccgcccccatcgagcgtgtcaagcttctcatccagaaccaggacgagatgatcaagcagggccgtctcgccgccccctacaagggcattggcgactgcttcgtccgcacctaccagcaggagggtctcgtctcgctctggcgtggtaacaccgctaacgtcattcgttacttccccactcaggctcttaacttcgccttcaaggacttcttcaagtccctcttcgccgtccccaagactgctccttactggaagtcgctctcggccaaccttgcctccggtggtgctgccggtgcctcgtcgctcctctttgtttactcgcttgactacgcccgtacccgtcttgccaacgatgccaagtcggctgctaagggtggaggagaccgtcagttcaacggtctcgtcgacgtttaccgcaagaccattgcctcggacggtatcgctggtctctaccgtggtttcgttccctcggttgtcggtatcgttgtctaccgtggtctctacttcggcatgtacgactcgcttaagcccgttctgcttactggtaacctctcgaacaacttccttgcctcgttcttgctcggctggggtgttaccactggtgctggtcttgcttcttaccctctcgacaccatccgacgacgaatgatgatgacctcgggtggcaaggtccactacaagaacatgttcgatgccggtcgctccatcattgccgccgagggtgtctcgtcgctcttcaagggtgccggtgccaacattctccgtggtatcgccggtgccggtgtgctctctggttacgacaagctccaggagctcatgttcggcaaggtctacaagggtggttccggttaa

SEQ ID NO: 73321 - protein, 317 aa, Ustilago maydis 521
MGTVADPAKTKKTVSGFATDFLMGGVSAAVSKTAAAPIERVKLLIQNQDEMIKQGRLAAPYKGIGDCFVRTYQQEGLVSLWRGNTANVIRYFPTQALNFAFKDFFKSLFAVPKTAPYWKSLSANLASGGAAGASSLLFVYSLDYARTRLANDAKSAAKGGGDRQFNGLVDVYRKTIASDGIAGLYRGFVPSVVGIVVYRGLYFGMYDSLKPVLLTGNLSNNFLASFLLGWGVTTGAGLASYPLDTIRRRMMMTSGGKVHYKNMFDAGRSIIAAEGVSSLFKGAGANILRGIAGAGVLSGYDKLQELMFGKVYKGGSG

SEQ ID NO: 73322 - DNA, 1059 bp, Ustilago maydis 521
  CDS (1)..(1059)
atgctgcatgcgtcagcgatagcgggcgcatgtgcgggcctggtgtcgtcggtggtcacttgtccgctggatgttgtcaagacgcggctgcaggcgcaagagggtcgacgacaacccatcgccgatgcacagtcggtatgcacaacaacacatcgaatacatagcgctgatccaccacggtatctgggactgcgtggcacactgcgcaagatctggcgcgacgacggagttcgtggcttctatcgcggactgggcccgaccatcttcggatacttgcccacctgggcgatctactttagcgtgtacgacaagtgcaagtcgtcgctggcgcagaacgagctgacggcgtccaaggatttcctgaaccacatcctgtcggccatgacggccggtgcagcatcgacggtgtgcacgtctccgttgtgggtggtcaagacacgcttcatgcttcagtcggccaaggacacgggcgtcaagccgtaccgacacacgggggatgcatttgtgcagatctacaagagcgaaggattgcgcggcttctacaaggggttgctgccgagtctgttcggtgtgagtcacgttgcggttcagttcccgttgtacgagagcttcaaggcgattgctaggggcagtaagcgtgatgcggatgacgcagagttggaggcgagtacgatcctgttgtgcagtagcacagctaagatgatagcgagtgtgactacctatccgcacgaagtgttgcggacgagattgcagatgcagccgcgcatcaagtcggtgggtagcgcgatggccgagaccaagcacgtgcggatggcggcgtcggttccgacgagatcgcaggcggtagcggatgatacagcgttggcacgtgcagggtcgaggtatacaggtgtcttgcaggcttgtcgcaccatcgcgcaccaagaggggcttcgcggcttttacaaaggcatggctgtcaacctggtcagaacggtccccagctcggcactcaccatcttgacgtacgaagtgatcatgcagcatcttacgcatccccccccctccgaacacgtgtaa

SEQ ID NO: 73323 - protein, 352 aa, Ustilago maydis 521
MLHASAIAGACAGLVSSVVTCPLDVVKTRLQAQEGRRQPIADAQSVCTTTHRIHSADPPRYLGLRGTLRKIWRDDGVRGFYRGLGPTIFGYLPTWAIYFSVYDKCKSSLAQNELTASKDFLNHILSAMTAGAASTVCTSPLWVVKTRFMLQSAKDTGVKPYRHTGDAFVQIYKSEGLRGFYKGLLPSLFGVSHVAVQFPLYESFKAIARGSKRDADDAELEASTILLCSSTAKMIASVTTYPHEVLRTRLQMQPRIKSVGSAMAETKHVRMAASVPTRSQAVADDTALARAGSRYTGVLQACRTIAHQEGLRGFYKGMAVNLVRTVPSSALTILTYEVIMQHLTHPPPSEHV

SEQ ID NO: 73324 - DNA, 1488 bp, Ustilago maydis 521
  CDS (1)..(1488)
atgacgacagcagcagactctacgagccccatggcagggctcacgcgctcgagtcaagcttcgacttcggcatcgacgctcgagagtttcctcgaatctgccactgctcttgtctcgcctgcgagtgaaacgacgtttccatcaacgcctgcctctgatcggctgccaatatcgcgcacacgtccagcggccactttgcgagctggaaaagcagcggcaacagcagcagagacgccgcttacacctaccgaaattgcccgagtcagagcatatcaacagcttcatcgtacagaatctgcgctcaacgcatcgccagctggcaatgtcgtggaagtcgagagctcgtcgtcatcacagagagatgcaaatcaacatgtgcggtcgcacgcgcatccggcgacgaaccacgcatttctgatcacttattttgtcgctggtggtgcagcaggtgctacatctcgaaccgttgtttcgcctttggaaaggctcaagatcatcatgcaggttcaaccccaatcttcccaatcgtcttcttccggcgccgcttcgaccacggcgaaaagtcgatctgccgtgaaaaatcgagcgtacaacggcgtctggactggccttgtcaagatgtggcaggaagaaggatttgcaggttttatgcgcggcaacggtatcaactgtttgcgcattgcgccttactctgctgtgcagtttacgacgtacgaaatgtgcaagacgtatttgcgacaagagggcagcgacgaattggatgtcatgcgaaaactcaccgcgggagcaatcgccggaattgcgagtgtcgtcagcacctacccgttagatctcgttcgatcgaggatcagcattgcaagtgccaacatgtacaacgaggccaagagcgaggctatctcggcgtctaccaagatggctgtagccgaaagagtgccggagcaggtcttgcgtacgcagatcgcagcgaggcagaaggctgttccagggatttgggccatgacgaccaaggtgtatcgcgaagaaggtggtcttcgcgggctgtaccgtggttgcgttcccacttcggtcggtgtggcgccgtacgtggcgctgaacttctacttttacgaagcagcgcgaaaacgtatctcgccagcggacggaagcgatccttcggcactcctcaagctcgcctgcggtgccctggccggaagcatctcccagaccctgacatatcccctcgacgtcctcagacgcagaatgcaggtggccggaatgaaggacagccaggagaaactgggatacaaagataaaaatgccatcaatgctatccagaatatcatcaaggccgaaggcgtcactggattgtacagaggcttactgcccaatttgttgaaggtcgcaccgagcatcggtacgagcttcctcacctacgaggcggtcaaggggttcttggaggtccatctcgacgatctgcacaagcccgaagacacgtctaaggcggcttga

SEQ ID NO: 73325 - protein, 495 aa, Ustilago maydis 521
MTTAADSTSPMAGLTRSSQASTSASTLESFLESATALVSPASETTFPSTPASDRLPISRTRPAATLRAGKAAATAAETPLTPTEIARVRAYQQLHRTESALNASPAGNVVEVESSSSSQRDANQHVRSHAHPATNHAFLITYFVAGGAAGATSRTVVSPLERLKIIMQVQPQSSQSSSSGAASTTAKSRSAVKNRAYNGVWTGLVKMWQEEGFAGFMRGNGINCLRIAPYSAVQFTTYEMCKTYLRQEGSDELDVMRKLTAGAIAGIASVVSTYPLDLVRSRISIASANMYNEAKSEAISASTKMAVAERVPEQVLRTQIAARQKAVPGIWAMTTKVYREEGGLRGLYRGCVPTSVGVAPYVALNFYFYEAARKRISPADGSDPSALLKLACGALAGSISQTLTYPLDVLRRRMQVAGMKDSQEKLGYKDKNAINAIQNIIKAEGVTGLYRGLLPNLLKVAPSIGTSFLTYEAVKGFLEVHLDDLHKPEDTSKAA

SEQ ID NO: 73326 - DNA, 1203 bp, Medicago truncatula
  CDS (1)..(1203)
atgggtaggaacaaaatccaactttttgatgacaaaagagatgtgtttttctctgtttctaatttattttctcaatctcatgagtattactattatccttgtggtttgtttgctagtgttggtcaagtcggaataggttttggtgttccacaaccaaacccttctgattctaattcccctgaaaatgttgatgaccctaaatttcctttcagtgaattatacgttaagtatattcaatcactgttgaaattcgagcctaatggtgttacagggaagggggaaggtgaagaagttgttaaggtgaagaataaaaatggtgggtttaagctcaagattaagataaggaatccttctattaggaggttgtgtagtggagcaatagctggtgcaatttctagaaccactgtggcacctttggagactattaggactcatttgatggtgggaagtagtggtcattctactgctgaggttttccaggatattatgaaaactgatggatggaagggtttgtttaggggaaatcttgttaatgtcattcgggttgctcctagcaaggccattgagctatttgcttatgatacggtaaacaagaacctatccgcaaagcctggagagcagtccaaactctcagttcctgcatcgttgattgcaggtgcctgtgctggagtcagttcaactatatgcacgtatccgcttgaactactcaagactagactaactatccagagaggtgtttacaatggtctccttgacgctttcgtgaaaataattaaagaagagggccctgcagaactttacagaggcctgacacctagtcttattggagttattccatattcggctaccaattactttgcctacgacactctgcggaaagcataccggaaaattttcaaacaagagaagatcggcaactttgaaacccttttgattggttcagcggctggtgctatttcaagtactgcaacttttccacttgaggtggctcgcaagcatatgcaagttggagctctcagtggaagacaggtctacaaaaatgtggttcatgcccttgttagcatactagaacaagaagggatccagggtctatatagagggcttggacctagttgcatgaagttagtgccagccgctggaatctctttcatgtgttacgaagcatgcaagaagatattgatagataatgacgaggaggaatag

SEQ ID NO: 73327 - protein, 400 aa, Medicago truncatula
MGRNKIQLFDDKRDVFFSVSNLFSQSHEYYYYPCGLFASVGQVGIGFGVPQPNPSDSNSPENVDDPKFPFSELYVKYIQSLLKFEPNGVTGKGEGEEVVKVKNKNGGFKLKIKIRNPSIRRLCSGAIAGAISRTTVAPLETIRTHLMVGSSGHSTAEVFQDIMKTDGWKGLFRGNLVNVIRVAPSKAIELFAYDTVNKNLSAKPGEQSKLSVPASLIAGACAGVSSTICTYPLELLKTRLTIQRGVYNGLLDAFVKIIKEEGPAELYRGLTPSLIGVIPYSATNYFAYDTLRKAYRKIFKQEKIGNFETLLIGSAAGAISSTATFPLEVARKHMQVGALSGRQVYKNVVHALVSILEQEGIQGLYRGLGPSCMKLVPAAGISFMCYEACKKILIDNDEEE

SEQ ID NO: 73328 - DNA, 1452 bp, Medicago truncatula
  CDS (1)..(1452)
atgggtggtggcagtatcaaaaagaagatctcaaaaaacatttcactagatcacgtgcttgaggcattaggtgaaacaaaagaagaaagggaaattcgcattcgaagccttttcaatttctttgatggagggaataatgggtacatagattatattcagatagagaaagggttatctgcattgcaaattccagcggagtataaatatgcaagagagcttttcatggtttgtgatgctaatagtgatggtagggttgattacaatgagtttaggagatatatggatgataaggaattggaactttattgtatttttcaagctattgatgttgaacatagtggtagtattcttcctgaagagctttgggatgctcttgatagggctggaattgaaatggatgaagaggagcttgctcgctttgtggagcacgttgacaaggacaataatggaactatcacttttgaagaatggagagattttcttctactttaccctcatgaagcaactattgaaaatatatatcaccattgggagagagtctaccatgtagacattggagaccaagctgtcattcctgaagacattagcaagcacgctaaccggagcaaatattttattgctggaggaatagcaggtgctacttcacgtactgctaccgcacctctcgatcgtctgaaggtgatgttgcaagttcagactacacgttcttctgttgtttccgcagttacgacaatatggaagcaagataatataaggggatttttccgaggtaatggattgaatgttgtgaaggtatcaccagaaagtgcaatcaaattctatgcttttgaaatgttgaaaaaagtaattggagaggctcaagggaacaattcggatattggtgctgctgggaggcttttagcaggtggcgtggctggtggaattgcgcagaccgcaatttatcctatggaccttatcaaaactaggctacaaacttgtgcttctgaaggtggaagggctcctaaacttggaaccctcacaaagaatatatgggttcaagaaggacctcgagctttctaccgaggacttcttccgtctgtgattggcatgattccttatgctggcattgatcttgctttttatgataccttgaaagatatgtccaagaaatatattattcatgatagtgatcctggtcctctagtacaactaggatgtgggacaatttctggaactcttggagctacatgtgtctatccactgcaggttattcgtactaggcttcaggcacaacctttgaacagttccgatgcttataagggaatgtttgatgcattttgtagaacttttcagcatgaaggctttagaggtttctacaagggactccttccaaatctactcaaagttgtgccagctgcgagcattacttatatggtctatgaaagtatgaagaaaaatctcgatttagagtag

SEQ ID NO: 73329 - protein, 483 aa, Medicago truncatula
MGGGSIKKKISKNISLDHVLEALGETKEEREIRIRSLFNFFDGGNNGYIDYIQIEKGLSALQIPAEYKYARELFMVCDANSDGRVDYNEFRRYMDDKELELYCIFQAIDVEHSGSILPEELWDALDRAGIEMDEEELARFVEHVDKDNNGTITFEEWRDFLLLYPHEATIENIYHHWERVYHVDIGDQAVIPEDISKHANRSKYFIAGGIAGATSRTATAPLDRLKVMLQVQTTRSSVVSAVTTIWKQDNIRGFFRGNGLNVVKVSPESAIKFYAFEMLKKVIGEAQGNNSDIGAAGRLLAGGVAGGIAQTAIYPMDLIKTRLQTCASEGGRAPKLGTLTKNIWVQEGPRAFYRGLLPSVIGMIPYAGIDLAFYDTLKDMSKKYIIHDSDPGPLVQLGCGTISGTLGATCVYPLQVIRTRLQAQPLNSSDAYKGMFDAFCRTFQHEGFRGFYKGLLPNLLKVVPAASITYMVYESMKKNLDLE

SEQ ID NO: 73330 - DNA, 1068 bp, Solanum tuberosum
  CDS (1)..(1068)
atggcttctgaggatgtgaaggcgagcgaatcagcggtggagaaaattgtgagtctcgcggaagaggcgaatttagctagacaagaaatcaggcctacaagccatgctgttatcagtatctgcaagtcactcgtagctggaggtgtcgccggaggcgtgtcacgaactgctgtggccccactggaacggctaaagatattgctccaggttcaaaattcacatagcataaaatacaatgggaccatttcaggcttaaaatatatctggagaactgaggggttcaaaggactgttcaagggcaatggcaccaattgtgcacgtatcgtcccaaactcagcagtcaagttcttcagctatgagcaagcttccaagggtatactatatctttaccagcaacaaactggcaatgaggatgctcagctcactcccttactacgtcttggagctggagcttgtgctggcataattgccatgtctgcaacttacccaatggacatggtgcggggaagaattactgtgcagacagagaagtctccttatcaatacagaggaatggtccatgccctatccaccatactccgtgaggaaggtccacgtgctttgtataaaggatggcttccttctgtcataggagttattccatatgtgggacttaactttgcagtttacgaatctctaaaagaatggttggtcaaaacaaaaccacttggtctagttgatgattctactgaacctggtgttgttacaaggctggcatgtggggctgtggcagggactttggggcaaactgttgcttaccctcttgacgttgtacgcagaaggatgcagatggtgggttggaaagatgctgcatccatcgttactggtgatgggaggagcaaggcctcccttgaatattctggtatgattgatactttcaggaaaactgtgaggtatgagggcttcagcgccttgtacaaaggtttggtgcctaattcagtgaaggtcgtcccttcaatagctattgcttttgtgacatatgagcaagtgaaggacctattgggagttgagatcaggatatctgactga

SEQ ID NO: 73331 - protein, 355 aa, Solanum tuberosum
MASEDVKASESAVEKIVSLAEEANLARQEIRPTSHAVISICKSLVAGGVAGGVSRTAVAPLERLKILLQVQNSHSIKYNGTISGLKYIWRTEGFKGLFKGNGTNCARIVPNSAVKFFSYEQASKGILYLYQQQTGNEDAQLTPLLRLGAGACAGIIAMSATYPMDMVRGRITVQTEKSPYQYRGMVHALSTILREEGPRALYKGWLPSVIGVIPYVGLNFAVYESLKEWLVKTKPLGLVDDSTEPGVVTRLACGAVAGTLGQTVAYPLDVVRRRMQMVGWKDAASIVTGDGRSKASLEYSGMIDTFRKTVRYEGFSALYKGLVPNSVKVVPSIAIAFVTYEQVKDLLGVEIRISD

SEQ ID NO: 73332 - DNA, 1014 bp, Aspergillus oryzae
  CDS (1)..(1014)
atgggtggcactagtccttctggttcgctcgtagaagattcatctaatgtgacaagaaacagtcaccgtgataatcatggcttagaatcggacaatgccagccgaaaccagggttttgattggagaaatggagtagcgggaggtgttgcaggctgcgcagcaaagacgattgttgctccgatggagagaatcaagattctctttcaaacgtcgaatccgcatttcctgccgtattcaacccggtggaatggtttcatcgaggctatcagtcatattcggacgagccatggggtgcctgcacttttcaaaggccacgcggcgagtctgatccgcgtttttccatatgctggtattaactttttggcatacgaacaactccaacgtgtaatcatcatatcacccaagagagacacaccgtttcatcgattcttctgcgggagtacggcgggtgccatctccaccgcctttacatatcctcttgagttgatccgtatccgtcttgcctttgaagcagaacagcacagacattcctcttggttcgggattagtcgaagaatttactttgaaagcggcggtaaaggtagtttattaaatctttatcaaggaattggcccgactatgctaggcatacttccctatgccggcacctcattcgtaacccacgatttaatgagagaacagctgcgctcacctttgtttgcgccttatgctcttgaaaagggatcatcaactcgactgacggcagttgcgcagctttgttgcggagcaatcgctggcattgttgctcaaacagttgcttaccccattgatatccttcggcgacgaatgcaagtcggaagtgtggttggcagtagatcaggaatcttagagacagctcgtcgcgtatttatggagagaggagttaagggcttctatgttggcctgacaattggttacatgaaaatggctcccatggtggcgacgagtttctacgtctatgatcgaatgaaacgactattgggccttatcgagtaa

SEQ ID NO: 73333 - protein, 337 aa, Aspergillus oryzae
MGGTSPSGSLVEDSSNVTRNSHRDNHGLESDNASRNQGFDWRNGVAGGVAGCAAKTIVAPMERIKILFQTSNPHFLPYSTRWNGFIEAISHIRTSHGVPALFKGHAASLIRVFPYAGINFLAYEQLQRVIIISPKRDTPFHRFFCGSTAGAISTAFTYPLELIRIRLAFEAEQHRHSSWFGISRRIYFESGGKGSLLNLYQGIGPTMLGILPYAGTSFVTHDLMREQLRSPLFAPYALEKGSSTRLTAVAQLCCGAIAGIVAQTVAYPIDILRRRMQVGSVVGSRSGILETARRVFMERGVKGFYVGLTIGYMKMAPMVATSFYVYDRMKRLLGLIE

SEQ ID NO: 73334 - DNA, 1068 bp, Aspergillus oryzae
  CDS (1)..(1068)
atgagtctggatcgtcaggaatcggttcgtcacgatgaatcgaagacttcaagggacaataccttggccaagttaacccagttgccaccgagttcggcttcgatcaaggaagcgtcttcgggaaatagcagcaaatttgttggtaaactcaagggcagaatcgcggaacctgtcgtggcagctttcgttgctgggggcgtagcaggtgcggtatccagaaccatcgtgtcgccacttgaacgtctaaaaatcctgcttcaaatacaaagtgttggcagggaagagtataggctatctatatggaaggctcttgtaaagatcggcaaagaggagggatggagagggtttatgcggggcaatggtaccaattgcattcgaataatcccttattctgcggttcaatttggaagttacaatttttacaaaaggtttgcagaaccaactccagatgctgagttgtcaccagtacgccggctcatttgcggaggcgctgctggaattacctcagtcactataacttatcctcttgacattgttcggacacgtctttctattcaatcagcgtcgttcgcagccctcggtcagcgcgatggcagcgggaagctaccgggcatgttcggcaccatggtcttaatgtacaagaccgagggtggtatcttagcgctctatcgcggaatcatccctaccgtggctggtgtcgccccatatgttggtttgaatttcatgacatacgaatcggttcgaaagtatttgactcccgacggtgacaagactcctagttcgctgcgtaaattgctagcgggcgctatttcaggagcagtggctcaaacatgtacttatccatttgatgttctacggcggcgtttccaaattaatacaatgtctggaatgggctatcagtatgcatccgtctgggacgccgtgaaagtcattgttgcagaagagggaacgcgtggtcttttcaaaggaattgtccccaatcttctgaaagtggcaccgagcatggcgagtagttggctcagctttgagctaacgagggactttcttgtccagctgaatgacaaatga

SEQ ID NO: 73335 - protein, 355 aa, Aspergillus oryzae
MSLDRQESVRHDESKTSRDNTLAKLTQLPPSSASIKEASSGNSSKFVGKLKGRIAEPVVAAFVAGGVAGAVSRTIVSPLERLKILLQIQSVGREEYRLSIWKALVKIGKEEGWRGFMRGNGTNCIRIIPYSAVQFGSYNFYKRFAEPTPDAELSPVRRLICGGAAGITSVTITYPLDIVRTRLSIQSASFAALGQRDGSGKLPGMFGTMVLMYKTEGGILALYRGIIPTVAGVAPYVGLNFMTYESVRKYLTPDGDKTPSSLRKLLAGAISGAVAQTCTYPFDVLRRRFQINTMSGMGYQYASVWDAVKVIVAEEGTRGLFKGIVPNLLKVAPSMASSWLSFELTRDFLVQLNDK

SEQ ID NO: 73336 - DNA, 1185 bp, Aspergillus oryzae
  CDS (1)..(1185)
atggaacaggtcgcagattcaagaccagcgcggggtgatgtaagtaggaacgcagcggtagccacgacacaaacgaccgctgtcgatgatgcttcgtcaccgggttataaaaagaatgatcatggaggcccacaacagatgaacaagcggagtttggattatgtattaaggagtggacttgcggggggtgtggcggggtgtgcggcgaaaacgatggttgcgccgcttgaccgcgtcaaaatcctttttcaggcatcgaacccgcagttcgctaagtatacaggcagctggtctggcctgttatacgcagttcgggacattaatcgtcacgaagggaggagaggcttgtttaaaggtcattctgcgacacttctccgcattttcccttatgccgccatcaagtttctcgcatatgaacagatccgagcggtgataatcccgtcgcgagataaggaaacaccgttccgccgcttgatttccgggagtttggcggggatgacatcggttttctttacgtatccgttggagttgattcgagtacgattggctttcgagactaagcgatcttctcgctcttccttcacggacattttccgacagatctaccgcgagcgggtttcgccgccttccgtaccaagcggactgtcgtccagctcctcagcctcagctgcagccactgccacggccgaagtctcttctgctgtgaataaagtcgttcctagctctggactggcgaatttctatcgtggattcacgcctaccctcatgggaatgcttccatatgcgggagtgtctttccttacgcatgacaccgttggtgattggcttcggtcaccggcactctctcaatatacaactattccgggatctgaatctcagtccaagaaaggttcacatcgcactcaactgaccgccgcggcggaacttttctctggggccgttgccggccttgtctctcagacgtcatcatacccgctggaggtcattcggaggcgaatgcaagtaggaggagtagtgggcgatggtcatcgactaggaatagccgagaccgcccggacgatctggctcgagcgaggcttccgggggttctggattggtctgagcattggatacctcaagatcattcccatgacagccacgagctttttcgtgtacgagcggatgaagtggtccttgggaatctga

SEQ ID NO: 73337 - protein, 394 aa, Aspergillus oryzae
MEQVADSRPARGDVSRNAAVATTQTTAVDDASSPGYKKNDHGGPQQMNKRSLDYVLRSGLAGGVAGCAAKTMVAPLDRVKILFQASNPQFAKYTGSWSGLLYAVRDINRHEGRRGLFKGHSATLLRIFPYAAIKFLAYEQIRAVIIPSRDKETPFRRLISGSLAGMTSVFFTYPLELIRVRLAFETKRSSRSSFTDIFRQIYRERVSPPSVPSGLSSSSSASAAATATAEVSSAVNKVVPSSGLANFYRGFTPTLMGMLPYAGVSFLTHDTVGDWLRSPALSQYTTIPGSESQSKKGSHRTQLTAAAELFSGAVAGLVSQTSSYPLEVIRRRMQVGGVVGDGHRLGIAETARTIWLERGFRGFWIGLSIGYLKIIPMTATSFFVYERMKWSLGI

SEQ ID NO: 73338 - DNA, 1197 bp, Solanum tuberosum
  CDS (1)..(1197)
atggctagaagggatatacaagcgttggagtgtaaaaaggatgggagtatgtctatttctcatttggggctccaatggagtctccaagattcaaacttctgtcctggtggattgtttgcatcagttggtcagatgggaagtatgggttttggtgtttcatcacctaatccatctgattcccgggatgaaaatggtggattcaagctaccttattccgatttgtgtatgaaatatttatcattctctgaggggtttaagattgtagggaatggggaggaagaaggggttgtgaaggagaagaagaagaaaggtgggctaaagattaagcttaaggtttcaaatccttcattaaggaggttaataagtggtgcaatcgcaggggcgatatctagaactgctgtagctccattggagacaataaggacacatttgatggtgggaagtagtggacattctagtactgaggtgttcaatagtatcatgaagactgaaggttggactggattgtttaggggcaactttgttaatgtgattcgagttgcccctagcaaagctgtagagctttttgtgtatgatacagttaataagaacttgtcatctaaacccggtgagcaatccaaaattccaattcctgcctcattagttgcaggagcgtgtgccggagtcagctctaccttactgacatatccacttgagctagtgaagactcggttgacaattcagagaggagtttacaatggtttacttgatgcatttgtaaaaatattgaaagagggtgggcctgctgagctctatagaggtctcactccaagtgttataggagtcattccctatgccgccacaaactactttgcttatgattcattgcggaaagcctacagaaagattttcaaggaagagaagattggaaacatagagactcttctgattggatcagcagctggtgctatatctagcactgcaacctttcctctggaggtggctcgtaagcacatgcaggtgggtgctgttagtggaagagcagtttacaagaatgtaattcatgctcttgtgagtatacttgaacaggatgggattcatggtctgtataaagggcttggtcccagctgcatgaagttagttcctgccgcgggaatatctttcatgtgttatgaagcatgcaagaggatattgatagaggcagaaaatgaagagtaa

SEQ ID NO: 73339 - protein, 398 aa, Solanum tuberosum
MARRDIQALECKKDGSMSISHLGLQWSLQDSNFCPGGLFASVGQMGSMGFGVSSPNPSDSRDENGGFKLPYSDLCMKYLSFSEGFKIVGNGEEEGVVKEKKKKGGLKIKLKVSNPSLRRLISGAIAGAISRTAVAPLETIRTHLMVGSSGHSSTEVFNSIMKTEGWTGLFRGNFVNVIRVAPSKAVELFVYDTVNKNLSSKPGEQSKIPIPASLVAGACAGVSSTLLTYPLELVKTRLTIQRGVYNGLLDAFVKILKEGGPAELYRGLTPSVIGVIPYAATNYFAYDSLRKAYRKIFKEEKIGNIETLLIGSAAGAISSTATFPLEVARKHMQVGAVSGRAVYKNVIHALVSILEQDGIHGLYKGLGPSCMKLVPAAGISFMCYEACKRILIEAENEE

SEQ ID NO: 73340 - DNA, 1011 bp, Oryza sativa
  CDS (1)..(1011)
atgggctccgaggaggagccgtcgcagatgcggagggcgctggtggacgcgctcgcgggggccatctccggcggcatctcccgcaccgtcacctcccccctcgacgtcatcaaaatccgcttccaggttcaattggagcccacaacctcgtggggtgtacttcgaagggatgtctatggaccttccaagtacactgggcttttgcaagcaagtaaagatattctccgagaggaaggtttgccgggattttggagaggaaatgttccagccctattaatgtatatgccatatacagctatacaattcactgttctacacaagctgaaaacatttgcttctggttcatccaaaacagaggatcatttgcacttgagtccttacctatcgtatgtaagtggggctatagcaggatgtgcagcaacagtaggatcatatccatttgaccttctcagaacaattcttgcatcacagggtgaaccgaaggtttaccctgacatgaggtctgcatttcttgatataatgaaaacccgcggtttccgaggactttacgccggtctaactccaactcttgttgaaatcataccatatgctggcttacagtttggttcatatgatactttcaaacggtcgatgatgacatggaataggtaccgatattcacatcttaactcaggaagtgaggatgattcagtatcaagcttccagttatttctttgtggatttgcagccggaacattttcaaaagctgcttgtcacccacttgatgttgtaaagaaaagatttcagattgaaggattaaaacgacatccaagatatggcgcccgaattgagagcagcacatacaagggcatgtaccatgccctaaaagagattgttgcgaaggaggggtttggaggcctttataaaggacttttcccatctttggtgaaatcggctcctgctggtgccgtgacatttgtggcatatgaatacatctcagactggatagggagcaaagctggagtcgagtga

SEQ ID NO: 73341 - protein, 336 aa, Oryza sativa
MGSEEEPSQMRRALVDALAGAISGGISRTVTSPLDVIKIRFQVQLEPTTSWGVLRRDVYGPSKYTGLLQASKDILREEGLPGFWRGNVPALLMYMPYTAIQFTVLHKLKTFASGSSKTEDHLHLSPYLSYVSGAIAGCAATVGSYPFDLLRTILASQGEPKVYPDMRSAFLDIMKTRGFRGLYAGLTPTLVEIIPYAGLQFGSYDTFKRSMMTWNRYRYSHLNSGSEDDSVSSFQLFLCGFAAGTFSKAACHPLDVVKKRFQIEGLKRHPRYGARIESSTYKGMYHALKEIVAKEGFGGLYKGLFPSLVKSAPAGAVTFVAYEYISDWIGSKAGVE

SEQ ID NO: 73342 - DNA, 1014 bp, Oryza sativa
  CDS (1)..(1014)
atgggcaccccctcgcagggctcggcggccgtggcagcggctggggtcgacctctgcgtgctcgacctggtgcccgtcttcgccaaggagatgatcgccgggggcgtcgccggcgccttctccaagaccgccatcgcgccgctcgagcgcctcaagatattgctacagactaggacaaatgaattcagttctcttggcgtcctcaaatcattgaagaaattaaaacaacatgatggaattttgggcttttacaagggaaatggtgctagtgtattaagaattgttccttatgctgcattacattatatggcgtatgaacgatacaggtgttggatcttgaataactgcccctcacttgggacaggacccttagtagaccttttagctggttcagcatctggaggaaccgcagtgttgtgtacttatcccttggatctggctaggactaaacttgccttccaggtcaatagttcagaccaaatcagtagtggtttgaagaggacaaactttcaaccaaaatatggaggaataaaggatgtttttcgaggtgtttattcagaaggtggagtgcgagctctctatcgtggagtaggtccaacgctcatgggaatacttccttatgctggtcttaaattctacatatacgaaggactgaaggcacatgtacctgaagattacaaaaattctgtcacattgaagttgtcctgtggtgctgctgctggattatttgggcagactctaacttacccactagatgttgtaagaaggcagatgcaggttcagagtcaacaatatcacgataaatttggtgggccacagataaggggaacattccaaggtcttatgatcatcaaacaaacgcagggatggaggcaattgtttgctggcttgagcctcaattacatcaaggtggtaccctctgtggctattggttttaccgcatatgacacgatgaagagtttactgaagatacctcccagagagaagaaaatgtcaggtcatggttctaattga

SEQ ID NO: 73343 - protein, 337 aa, Oryza sativa
MGTPSQGSAAVAAAGVDLCVLDLVPVFAKEMIAGGVAGAFSKTAIAPLERLKILLQTRTNEFSSLGVLKSLKKLKQHDGILGFYKGNGASVLRIVPYAALHYMAYERYRCWILNNCPSLGTGPLVDLLAGSASGGTAVLCTYPLDLARTKLAFQVNSSDQISSGLKRTNFQPKYGGIKDVFRGVYSEGGVRALYRGVGPTLMGILPYAGLKFYIYEGLKAHVPEDYKNSVTLKLSCGAAAGLFGQTLTYPLDVVRRQMQVQSQQYHDKFGGPQIRGTFQGLMIIKQTQGWRQLFAGLSLNYIKVVPSVAIGFTAYDTMKSLLKIPPREKKMSGHGSN

SEQ ID NO: 73344 - DNA, 993 bp, Oryza sativa
  CDS (1)..(993)
atgagtagtcctatcactcttcttcctccccgcgcaaatcctcgccgccacttggatgccagggagctccacctcgccgccgaccaccaccaccacccttctctcctccgctccccgctggagagggtcaagatcttactgcagaccagaactcatgggtttcaatcccttggtatcctccaatcattgaggaagctgtggcagtatgagggaattcgaggcttctacaaggggaatggcgccagtgtgcttcggattgttccatatgcggcattgcattacatgacttatgagcagtatcggtgctggatattgaataattttgctccatcagtgggtacagggcctgtggttgatctattggctggctcagccgcaggtgggactgcagttctatgtacctacccattagaccttgctaggacaaagctggcatatcaggtttcaaatgtgggccaacctggcaatgctttgggaaatgctggtagacagccagcatatggtggtatcaaggacgttttcaaaactgtttacaaggaaggaggcgcacgagctttataccgtggagtaggcccaactctgatcggtatcctaccatatgctggactaaaattctatatatatgaagacctgaaatcgcgagttccagaggattacaagagatctgttgtattgaaactctcttgtggtgctttagctggtctttttgggcaaaccctcacttatccactggatgttgtccgaagacagatgcaggttcagaataagcagccccataatgcgaacgatgccttccgtataagagggacatttcagggtctagcactcattattaggtgccaggggtggaggcaactcttcgctggcctaagccttaactatgtgaaggtcgtcccttcggttgctattggtttcacaacatatgacatgatgaagaatttgctgagagtgccaccccgagagagactttatcaatcgtctggtaacgcatga

SEQ ID NO: 73345 - protein, 330 aa, Oryza sativa
MSSPITLLPPRANPRRHLDARELHLAADHHHHPSLLRSPLERVKILLQTRTHGFQSLGILQSLRKLWQYEGIRGFYKGNGASVLRIVPYAALHYMTYEQYRCWILNNFAPSVGTGPVVDLLAGSAAGGTAVLCTYPLDLARTKLAYQVSNVGQPGNALGNAGRQPAYGGIKDVFKTVYKEGGARALYRGVGPTLIGILPYAGLKFYIYEDLKSRVPEDYKRSVVLKLSCGALAGLFGQTLTYPLDVVRRQMQVQNKQPHNANDAFRIRGTFQGLALIIRCQGWRQLFAGLSLNYVKVVPSVAIGFTTYDMMKNLLRVPPRERLYQSSGNA

SEQ ID NO: 73346 - DNA, 1248 bp, Oryza sativa
  CDS (1)..(1248)
atgagcaagaggagttgcggcggcggcggcgcgcggttgcaatgcgcggcggcggattggggcggctgcttcctcgcgctgccaccggcggcggcggcggcggtgccctcaggcggtgacaccgatggcggattcaacctggcgtggactctccaccagtcgttccaccctgcctccggcctcttcgccagcgtcggcgtcggcttcccggcgacctcctcgagctcgccgtcgccgccggacgctcccggagacccgtatgccaagtatgtctcgccggagatcgagcaccatgctctgcccggtcaaagtgtggaggtggagctaatggagaaggggaagaagaacaagaagaagacgaataaagcattcaagctcaagatcaaggtgggcaatccccacctgaagaggctgatcagcggggggatcgccggcgcggtgtcgaggacggccgtcgcgccattggagacgatcaggacgcatttgatggtggggagtaatgggaattcgaccgcggaggtgttccagtccatcatgaagcatgaagggtggactgggttgttccgcggtaactttgttaatgtcattcgagtcgccccgagcaaagcaattgagctcttcgcttttgatacagctaacaagttcttgacccccaaatctggggaacaaaagaaggtcccactccctccttcactagtggctggggcatttgctggtgtcagttcaaccctctgtacttaccctctggaattaattaagacacgattaaccatacagagaggtgtatatgataactttctccacgctcttgtcaaaattgtccgtgaagaaggccctactgagctgtaccgaggtttaacgccaagtttaattggagttgtgccatatgcggcgaccaactactttgcttacgacacccttaagaaggcctacaagaagatgttcaagacgaatgaaatcggcaacgttcctaccctgctcattgggtcggccgcaggagctatctcaagcacagctactttccccctcgaggttgcacgcaagcacatgcaagttggcgcagtcggtggcaggaaggtctacaagaacatgcttcatgctctcctgagcattctggaggatgaaggggttggagggctttacaggggtctggggccaagttgcatgaagttggtgccagccgccggtatttcgtttatgtgctatgaggcttgcaagaaggtattgacagaggaagaggatgactga

SEQ ID NO: 73347 - protein, 415 aa, Oryza sativa
MSKRSCGGGGARLQCAAADWGGCFLALPPAAAAAVPSGGDTDGGFNLAWTLHQSFHPASGLFASVGVGFPATSSSSPSPPDAPGDPYAKYVSPEIEHHALPGQSVEVELMEKGKKNKKKTNKAFKLKIKVGNPHLKRLISGGIAGAVSRTAVAPLETIRTHLMVGSNGNSTAEVFQSIMKHEGWTGLFRGNFVNVIRVAPSKAIELFAFDTANKFLTPKSGEQKKVPLPPSLVAGAFAGVSSTLCTYPLELIKTRLTIQRGVYDNFLHALVKIVREEGPTELYRGLTPSLIGVVPYAATNYFAYDTLKKAYKKMFKTNEIGNVPTLLIGSAAGAISSTATFPLEVARKHMQVGAVGGRKVYKNMLHALLSILEDEGVGGLYRGLGPSCMKLVPAAGISFMCYEACKKVLTEEEDD

SEQ ID NO: 73348 - DNA, 1014 bp, Arabidopsis thaliana
  CDS (1)..(1014)
atgaatgttgacgctagagtcggtgttgcggtcgatggagctcagagtgctcttaacactgcaaccactgttcatagtagcgtcgtcatgacgcagattaagccgcaggcaaagctaggaaccttccagaatctcctcgctggtggtattgccggcgccattagcaagacatgtaccgctcctcttgctcgcctcaccatcttgtttcagttgcaagggatgcaatcagaaggtgcagtgttaagccgtccaaacttacggcgtgaagcttcccgtattatcaacgaggaaggatatagagccttttggaaaggaaatttggttactgtagtacacaggattccttatactgcagtaaacttctatgcatatgagaagtacaatctatttttcaattcaaatccagtcgtacagagttttataggaaatacgagtggcaatccgatggtgcattttgttagtggtggcttggctggaattacagctgctacagctacatatcccctcgatcttgtcaggactcgtcttgctgcacagaggaatgcaatttactaccagggtattgagcatactttccgtaccatatgcagagaagagggaattttgggtctatataaaggacttggtgctacattattgggtgttggaccaagtcttgctatcaatttcgccgcgtacgagtctatgaaattgttttggcattctcataggccaaatgattcggatttggttgtttctcttgtttctggaggtctagctggagctgtttcttcaacagctacatacccattggatcttgtgagaagaagaatgcaagtggaaggagctggtggaagagcaagagtatacaacactggactctttggaacattcaaacacatattcaagtcagaaggcttcaaagggatatacagaggaatattgcctgaatattacaaagtagttcctggcgttggcatcgtcttcatgacatacgatgctttgcggagactcttaacttctctccccgattga

SEQ ID NO: 73349 - protein, 337 aa, Arabidopsis thaliana
MNVDARVGVAVDGAQSALNTATTVHSSVVMTQIKPQAKLGTFQNLLAGGIAGAISKTCTAPLARLTILFQLQGMQSEGAVLSRPNLRREASRIINEEGYRAFWKGNLVTVVHRIPYTAVNFYAYEKYNLFFNSNPVVQSFIGNTSGNPMVHFVSGGLAGITAATATYPLDLVRTRLAAQRNAIYYQGIEHTFRTICREEGILGLYKGLGATLLGVGPSLAINFAAYESMKLFWHSHRPNDSDLVVSLVSGGLAGAVSSTATYPLDLVRRRMQVEGAGGRARVYNTGLFGTFKHIFKSEGFKGIYRGILPEYYKVVPGVGIVFMTYDALRRLLTSLPD

SEQ ID NO: 73350 - DNA, 1548 bp, Oryza sativa
  CDS (1)..(1548)
atgcccggcgcggcggtccacgcggtggacccacggggcggcgcctccccgccccccgtcgccaaggcggaggcggcgacggctgcagcggcggcggcgggagggtgcgagccggcgcggaaggcgggggcggtgaccatggagcacgtgctgctggcgctgcacgagacggaggcggagagggaggcgcggatccgggagatgttcgccttcttcgacgtggacgggcgcgggcagctggactacgcgcagatcgaggccgggctcgccgcgctgcagatccccgccgagtgcaagtacgcgcgggagctgctccgcgcctgcgaccgcgaccgcgacggccgcgtcgggtacgacgacttcaggcggtacatggacgacaaggagctcgagctctaccgcatcttccaggccatcgacgtcgagcacaacggctgcatcctccccgaggagctctgggacgcgctcgtcaaggctggtatagagattgatgatgaggagcttgcacggtttgtcgagcatgtggacaaggacaacaatggaattattacttttgaagagtggagggactttcttttgctatatcctaatgaagtaaccattgagaatatttatcatcactgggaaagagtatgtcttgtagatataggtgaacaggctgttataccagaaggcataagtaagtcggtcaatgcaagtaaatatctgattgcaggagggattgcaggtgctgcatctcgtactgcaactgcacctcttgaccgccttaaagtgatcatgcaagtacagactacacgaactacagtcatgcattcaattaaggatatatggagccagggtggcatgttagcattttttagagggaatggattgaatgttgtgaaagttgctccagaaagcgcaataagattttatgcctatgaaatgctgaaagaatatattatgaagagcaaaggagaaaataagagcgaagttggtccttctgaacgtcttgtagctggtggtttggctggtgcagtagcacaaacagcaatttatcccgtagatttagtgaaaacacgactgcagacttattcatgtgtggatggtaaagtacctagtcttggtgcattgtcaagggatatattgatgcacgagggtcctcgagcattctatagaggtctggttccatctttgcttggtattgtcccttatgccggaattgatcttgctgtatatgagacattgaaagacgtatccaagacatatatcctgaaggatagtgatcctggtcctctagtacaactgggctgtgggactgtatcaggagccttgggggcaacatgtgtttaccctttacaggttatcaggacaagactgcaagctcaacgagccaattcagaatctgcatatagaggtatgtctgatgtattctggagaacgctacagcatgagggtgtttctggattctacaaaggaatcctaccaaatcttcttaaagtggtgcctgcagcaagtattacctacctagtgtatgaagcaatgaagaaaaatctctcccttgattga

SEQ ID NO: 73351 - protein, 515 aa, Oryza sativa
MPGAAVHAVDPRGGASPPPVAKAEAATAAAAAAGGCEPARKAGAVTMEHVLLALHETEAEREARIREMFAFFDVDGRGQLDYAQIEAGLAALQIPAECKYARELLRACDRDRDGRVGYDDFRRYMDDKELELYRIFQAIDVEHNGCILPEELWDALVKAGIEIDDEELARFVEHVDKDNNGIITFEEWRDFLLLYPNEVTIENIYHHWERVCLVDIGEQAVIPEGISKSVNASKYLIAGGIAGAASRTATAPLDRLKVIMQVQTTRTTVMHSIKDIWSQGGMLAFFRGNGLNVVKVAPESAIRFYAYEMLKEYIMKSKGENKSEVGPSERLVAGGLAGAVAQTAIYPVDLVKTRLQTYSCVDGKVPSLGALSRDILMHEGPRAFYRGLVPSLLGIVPYAGIDLAVYETLKDVSKTYILKDSDPGPLVQLGCGTVSGALGATCVYPLQVIRTRLQAQRANSESAYRGMSDVFWRTLQHEGVSGFYKGILPNLLKVVPAASITYLVYEAMKKNLSLD

SEQ ID NO: 73352 - DNA, 1260 bp, Oryza sativa
  CDS (1)..(1260)
atggtggcgatgtcggccaagagcaagaacagcgtgctgacattggagaagaagcagggctggtctgtcccacaacttccggagctccggttcccttgggatttgcatgaagacaagggcttctctttgagcttacatggctctgcctcccctcatggtgggctgtttgctagcgtcggtctcaaagtgtccacagctgcaccagcagtggcacccagtcctgccgagcatgacttcaagattccgttcgctgatcattgcataaagtatgtctcctcagcagtggggtaccaagttcctgggactgaggctgaatctgtcaatgaggaagaggtggtggatggcaaggctgtgaagaaagccaagaaacgtgggctgaagctgaaaattaagattgggaacccacatttgaggcggctggttagcggagccgttgcgggagctgtctcgaggacttgtgtggcacctctggagacgattaggacccatttgatggttgggagcaatggggactctatgacagaggtattccagtcaatcatgaagaccgaggggtggacagggctgttccgtgggaactttgtcaatgtcatccgagttgcaccaagcaaggctattgagctatttgctttcgatacagccaagaaattcttaactccaaaggctgatgagtcccctaagacacccttccctccatcgcttattgctggagcacttgctggggttagctcaacattgtgcacataccccttggaattgatcaagacccgattgactattgagaaagatgtctataacaacttcctccatgctttcgtcaagatactacgagaggaaggcccctcagagctctaccgcgggctgacaccgagtctgatcggcgtggtgccatacgctgcaaccaattactatgcctacgacaccctgaagaagctctacaggaagacattcaagcaggaggagatcagcaacatcgcgactcttctcatcggttcagccgcgggtgccatctcgagcaccgccaccttccctctcgaggtagctcgcaagcaaatgcaggtcggagcggtaggcggcaggcaggtctacaagaatgtcttccatgctctgtattgcataatggagaatgaagggattggcggcctttacaaggggcttgggccgagctgcatcaagctgatgcctgcggctggaatctcattcatgtgctatgaagcttgcaagaagatactggttgaagatgatcaggatagtgagtga

SEQ ID NO: 73353 - protein, 419 aa, Oryza sativa
MVAMSAKSKNSVLTLEKKQGWSVPQLPELRFPWDLHEDKGFSLSLHGSASPHGGLFASVGLKVSTAAPAVAPSPAEHDFKIPFADHCIKYVSSAVGYQVPGTEAESVNEEEVVDGKAVKKAKKRGLKLKIKIGNPHLRRLVSGAVAGAVSRTCVAPLETIRTHLMVGSNGDSMTEVFQSIMKTEGWTGLFRGNFVNVIRVAPSKAIELFAFDTAKKFLTPKADESPKTPFPPSLIAGALAGVSSTLCTYPLELIKTRLTIEKDVYNNFLHAFVKILREEGPSELYRGLTPSLIGVVPYAATNYYAYDTLKKLYRKTFKQEEISNIATLLIGSAAGAISSTATFPLEVARKQMQVGAVGGRQVYKNVFHALYCIMENEGIGGLYKGLGPSCIKLMPAAGISFMCYEACKKILVEDDQDSE

SEQ ID NO: 73354 - DNA, 1278 bp, Hordeum vulgare var
  CDS (1)..(1278)
atggcggcggcaatggctgcaacgacaatggtgaccaagaacaacggcggctcgctcgccatggacaagaagaactggttctttcggccggcccctgaggtcgccttctcttggagctcgcagcccgagtccaggagcttggagttcccacgcagggctctgttcgccagcgtcggactcagcctgtcccacgacgggaaggctcggcccgccgacgacgtcgcacaccaactcgcagccgcgggcgatgcgggcgtccagcaggcccagaaggcgaaaaaggccaagaagcagcagctgggtctgaggaaggtgagggtcaagatcggcaacccgcacctgcgtcggctggtcagcggcgccatcgccggcgccgtttcgaggactttcgtggcgccgctggagacgatcaggacgcacctgatggtgggaagctccggcgccgactccatgggcggggttttccggtggatcatgaggacggaggggtggcccggcctcttccgcggcaacgccgtcaacgtcctccgcgtcgcgccgagcaaggccatcgagcacttcacttacgacacggccaagaagtacctgaccccggaggccggcgagccagccaaggtccccatccccacgccgcttgtcgccggagcgctcgccggagtggcctcaaccctgtgcacctatcccatggagctcgtcaagacccgtctcaccatcgagaaggatgtgtacgacaacctcctccacgcgttcgtcaagatcgtgcgcgacgaggggcccggagagctgtaccgcgggctggcgccgagcctgatcggcgtggtgccgtacgcggcggccaacttctacgcctacgagacactgcggggcgcgtaccgccgcgcgtcggggaaggaggaggtgggcaacgtgccgacgctgctgatcgggtccgcggcgggcgccatcgccagcacggccaccttcccgctggaggtggcgcggaagcagatgcaggtgggcgccgtgggcgggaggcaggtgtacaagaacgtcctgcacgccatgtactgcatcctcaacaaggagggcgccgccgggctctaccgcgggctcggccccagctgcatcaagctcatgcccgccgccggcatctccttcatgtgctacgaggcctgcaagaagatactcgtcgacgacaaacaagacggcgagccccaggaccaggaggagacggagaccggacacacacaaggacaggcggcgcccaagagccccaacgccaacggtgatcgaccatga

SEQ ID NO: 73355 - protein, 425 aa, Hordeum vulgare var
MAAAMAATTMVTKNNGGSLAMDKKNWFFRPAPEVAFSWSSQPESRSLEFPRRALFASVGLSLSHDGKARPADDVAHQLAAAGDAGVQQAQKAKKAKKQQLGLRKVRVKIGNPHLRRLVSGAIAGAVSRTFVAPLETIRTHLMVGSSGADSMGGVFRWIMRTEGWPGLFRGNAVNVLRVAPSKAIEHFTYDTAKKYLTPEAGEPAKVPIPTPLVAGALAGVASTLCTYPMELVKTRLTIEKDVYDNLLHAFVKIVRDEGPGELYRGLAPSLIGVVPYAAANFYAYETLRGAYRRASGKEEVGNVPTLLIGSAAGAIASTATFPLEVARKQMQVGAVGGRQVYKNVLHAMYCILNKEGAAGLYRGLGPSCIKLMPAAGISFMCYEACKKILVDDKQDGEPQDQEETETGHTQGQAAPKSPNANGDRP

SEQ ID NO: 73356 - DNA, 1047 bp, Arabidopsis thaliana
  CDS (1)..(1047)
atgaatgttgacgctagagtcggtgttgcggtcgatggagctcagagtgctcttaacactgcaaccactgttcatagtagcgtcgtcatgacgcagattaagccgcaggcaaagctaggaaccttccagaatctcctcgctggtggtattgccggcgccattagcaagacatgtaccgctcctcttgctcgcctcaccatcttgtttcagttgcaagggatgcaatcagaaggtgcagtgttaagccgtccaaacttacggcgtgaagcttcccgtattatcaacgaggaaggatatagagccttttggaaaggaaatttggttactgtagtacacaggattccttatactgcagtaaacttctatgcatatgagaagtacaatctatttttcaattcaaatccagtcgtacagagttttataggaaatacgagtggcaatccgatagtgcattttgttagtggtggcttggctggaattacagctgctacagctacatatcccctcgatcttgtcaggactcgtcttgctgcacagaggaatgcaatttactaccagggtattgagcatactttccgtaccatatgcagagaagagggaattttgggtctatataaaggacttggtgctacattattgggtgttggaccaagtcttgctatcaatttcgccgcgtacgagtctatgaaattgttttggcattctcataggccaaatgattcggatttggttgtttctcttgtttctggaggtctagctggagctgtttcttcaacagatgataaactttttgatgcccataactatgtagctacatacccattggatcttgtgagaagaagaatgcaagtggaaggagctggtggaagagcaagagtatacaacactggactctttggaacattcaaacacatattcaagtcagaaggcttcaaagggatatacagaggaatattgcctgaatattacaaagtagttcctggcgttggcatcgtcttcatgacatacgatgctttgcggagactcttaacttctctccccgattga

SEQ ID NO: 73357 - protein, 348 aa, Arabidopsis thaliana
MNVDARVGVAVDGAQSALNTATTVHSSVVMTQIKPQAKLGTFQNLLAGGIAGAISKTCTAPLARLTILFQLQGMQSEGAVLSRPNLRREASRIINEEGYRAFWKGNLVTVVHRIPYTAVNFYAYEKYNLFFNSNPVVQSFIGNTSGNPIVHFVSGGLAGITAATATYPLDLVRTRLAAQRNAIYYQGIEHTFRTICREEGILGLYKGLGATLLGVGPSLAINFAAYESMKLFWHSHRPNDSDLVVSLVSGGLAGAVSSTDDKLFDAHNYVATYPLDLVRRRMQVEGAGGRARVYNTGLFGTFKHIFKSEGFKGIYRGILPEYYKVVPGVGIVFMTYDALRRLLTSLPD

SEQ ID NO: 73358 - DNA, 915 bp, Saccharomyces kluyveri
  CDS (1)..(915)
atggccgaaaagaagcaatccaacttcgctatcgactttttgatgggtggtgtctctgccgccgtctccaagactgctgctgctccaattgaaagagtcaagttgttgattcaaaaccaagatgaaatgatcaagcaaggttctttggacagacgttacaacggtattgttgactgtttcaagagaacttctgaagctgaaggtgttgtttctttctggagaggtaacactgctaacgttatccgttacttcccaacccaagctttgaactttgccttcaaggacaagatcaaggctatgtttggtttcaagaaggaagaaggttacgctaagtggtttgctggtaacttggcttccggtggtctagctggtggtttgtctttgatgtttgtctactctttggattacgccagaaccagattggctgctgactccaagtccgccaagaagggtggtgaacgtcaattcaacggtttagttgatgtctacaagaagaccttggcttccgatggtgttgctggtttgtacagaggtttcttgccatctgtcgttggtatcgttgtctacagaggtttgtacttcggtttgtatgactctttgaagccattgttgttgactggtactttggaaggttctttctttgcctctttcttgttgggttgggccgtcaccactggtgcttccaccgcttcctacccattggacaccgttagaagaagaatgatgatgacttccggtcaagccgtcaagtacgacggtgcctttgacgctttcagaaagattgttgctgctgaaggtatcaagtccttgttcaagggttgtggtgctaacatcttgagaggtgtggccggtgccggtgtcatttccatgtatgaccaattgcaaatgatcttgttcggtaagaagttcaaataa

SEQ ID NO: 73359 - protein, 304 aa, Saccharomyces kluyveri
MAEKKQSNFAIDFLMGGVSAAVSKTAAAPIERVKLLIQNQDEMIKQGSLDRRYNGIVDCFKRTSEAEGVVSFWRGNTANVIRYFPTQALNFAFKDKIKAMFGFKKEEGYAKWFAGNLASGGLAGGLSLMFVYSLDYARTRLAADSKSAKKGGERQFNGLVDVYKKTLASDGVAGLYRGFLPSVVGIVVYRGLYFGLYDSLKPLLLTGTLEGSFFASFLLGWAVTTGASTASYPLDTVRRRMMMTSGQAVKYDGAFDAFRKIVAAEGIKSLFKGCGANILRGVAGAGVISMYDQLQMILFGKKFK
